United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 95

SEQ ID NO: 3380208 - RNA, 16 nt, Pseudomonas aeruginosa PA01
cccaccgaccaccauc

SEQ ID NO: 3380209 - RNA, 14 nt, Pseudomonas aeruginosa PA01
cccaccgcgcggca

SEQ ID NO: 3380210 - RNA, 15 nt, Pseudomonas aeruginosa PA01
cccaccgcgcggcac

SEQ ID NO: 3380211 - RNA, 18 nt, Pseudomonas aeruginosa PA01
cccaccgcgcggcacagg

SEQ ID NO: 3380212 - RNA, 22 nt, Pseudomonas aeruginosa PA01
cccaccgcgcggcacaggcggc

SEQ ID NO: 3380213 - RNA, 21 nt, Pseudomonas aeruginosa PA01
cccaccggucuuggcgcgcga

SEQ ID NO: 3380214 - RNA, 14 nt, Pseudomonas aeruginosa PA01
cccaccugaacgcg

SEQ ID NO: 3380215 - RNA, 16 nt, Pseudomonas aeruginosa PA01
cccacgacgcacucau

SEQ ID NO: 3380216 - RNA, 16 nt, Pseudomonas aeruginosa PA01
cccacgcauuggcuuc

SEQ ID NO: 3380217 - RNA, 14 nt, Pseudomonas aeruginosa PA01
cccacgcccaucgg

SEQ ID NO: 3380218 - RNA, 19 nt, Pseudomonas aeruginosa PA01
cccacgccuugcagcaccg

SEQ ID NO: 3380219 - RNA, 17 nt, Pseudomonas aeruginosa PA01
cccacggcgccuuccca

SEQ ID NO: 3380220 - RNA, 18 nt, Pseudomonas aeruginosa PA01
cccacggcgcggccgugc

SEQ ID NO: 3380221 - RNA, 15 nt, Pseudomonas aeruginosa PA01
cccacgggcgaccca

SEQ ID NO: 3380222 - RNA, 15 nt, Pseudomonas aeruginosa PA01
cccacgggcggccga

SEQ ID NO: 3380223 - RNA, 20 nt, Pseudomonas aeruginosa PA01
cccacgggcggccgacgugc

SEQ ID NO: 3380224 - RNA, 22 nt, Pseudomonas aeruginosa PA01
cccacgguagagacggcggcga

SEQ ID NO: 3380225 - RNA, 18 nt, Pseudomonas aeruginosa PA01
cccacguacuccagcaac

SEQ ID NO: 3380226 - RNA, 20 nt, Pseudomonas aeruginosa PA01
cccacguacuccagcaacgg

SEQ ID NO: 3380227 - RNA, 20 nt, Pseudomonas aeruginosa PA01
cccacucaucucagcaaccc

SEQ ID NO: 3380228 - RNA, 14 nt, Pseudomonas aeruginosa PA01
cccacuccagcgcg

SEQ ID NO: 3380229 - RNA, 21 nt, Pseudomonas aeruginosa PA01
cccacuccccagcaggcaggc

SEQ ID NO: 3380230 - RNA, 12 nt, Pseudomonas aeruginosa PA01
cccacuccgucc

SEQ ID NO: 3380231 - RNA, 12 nt, Pseudomonas aeruginosa PA01
cccacugaagac

SEQ ID NO: 3380232 - RNA, 15 nt, Pseudomonas aeruginosa PA01
cccacuuccggcccg

SEQ ID NO: 3380233 - RNA, 17 nt, Pseudomonas aeruginosa PA01
cccacuuccggcccggc

SEQ ID NO: 3380234 - RNA, 22 nt, Pseudomonas aeruginosa PA01
cccagaaaaaagccccgcaucg

SEQ ID NO: 3380235 - RNA, 16 nt, Pseudomonas aeruginosa PA01
cccagaaaccgaucag

SEQ ID NO: 3380236 - RNA, 21 nt, Pseudomonas aeruginosa PA01
cccagaaaccgaucagcaccg

SEQ ID NO: 3380237 - RNA, 22 nt, Pseudomonas aeruginosa PA01
cccagaaaccgaucagcaccgc

SEQ ID NO: 3380238 - RNA, 15 nt, Pseudomonas aeruginosa PA01
cccagaagccccaga

SEQ ID NO: 3380239 - RNA, 19 nt, Pseudomonas aeruginosa PA01
cccagaagccgaccuugcg

SEQ ID NO: 3380240 - RNA, 21 nt, Pseudomonas aeruginosa PA01
cccagaaguaguacugguccg

SEQ ID NO: 3380241 - RNA, 12 nt, Pseudomonas aeruginosa PA01
cccagacacgcc

SEQ ID NO: 3380242 - RNA, 18 nt, Pseudomonas aeruginosa PA01
cccagacaggccugugga

SEQ ID NO: 3380243 - RNA, 17 nt, Pseudomonas aeruginosa PA01
cccagaccacccggcug

SEQ ID NO: 3380244 - RNA, 14 nt, Pseudomonas aeruginosa PA01
cccagaccagcagc

SEQ ID NO: 3380245 - RNA, 17 nt, Pseudomonas aeruginosa PA01
cccagaccagcagcggc

SEQ ID NO: 3380246 - RNA, 20 nt, Pseudomonas aeruginosa PA01
cccagaccagcagcggcagc

SEQ ID NO: 3380247 - RNA, 13 nt, Pseudomonas aeruginosa PA01
cccagaccccauc

SEQ ID NO: 3380248 - RNA, 15 nt, Pseudomonas aeruginosa PA01
cccagacccucuccc

SEQ ID NO: 3380249 - RNA, 23 nt, Pseudomonas aeruginosa PA01
cccagacccucucccugaaggga

SEQ ID NO: 3380250 - RNA, 20 nt, Pseudomonas aeruginosa PA01
cccagaccucgaaguccugc

SEQ ID NO: 3380251 - RNA, 12 nt, Pseudomonas aeruginosa PA01
cccagaccugcc

SEQ ID NO: 3380252 - RNA, 13 nt, Pseudomonas aeruginosa PA01
cccagaccuggcc

SEQ ID NO: 3380253 - RNA, 19 nt, Pseudomonas aeruginosa PA01
cccagaccuggccgcugug

SEQ ID NO: 3380254 - RNA, 18 nt, Pseudomonas aeruginosa PA01
cccagaccuuccagccgc

SEQ ID NO: 3380255 - RNA, 22 nt, Pseudomonas aeruginosa PA01
cccagaccuuccagccgcgcgc

SEQ ID NO: 3380256 - RNA, 15 nt, Pseudomonas aeruginosa PA01
cccagacguccagcg

SEQ ID NO: 3380257 - RNA, 16 nt, Pseudomonas aeruginosa PA01
cccagacguccagcgc

SEQ ID NO: 3380258 - RNA, 18 nt, Pseudomonas aeruginosa PA01
cccagacguccagcgcca

SEQ ID NO: 3380259 - RNA, 13 nt, Pseudomonas aeruginosa PA01
cccagagcaccag

SEQ ID NO: 3380260 - RNA, 15 nt, Pseudomonas aeruginosa PA01
cccagagcagcacca

SEQ ID NO: 3380261 - RNA, 13 nt, Pseudomonas aeruginosa PA01
cccagagcccgcc

SEQ ID NO: 3380262 - RNA, 15 nt, Pseudomonas aeruginosa PA01
cccagagcccgccga

SEQ ID NO: 3380263 - RNA, 14 nt, Pseudomonas aeruginosa PA01
cccagagcgcgccc

SEQ ID NO: 3380264 - RNA, 19 nt, Pseudomonas aeruginosa PA01
cccagaguucgcccagcuc

SEQ ID NO: 3380265 - RNA, 21 nt, Pseudomonas aeruginosa PA01
cccagauauccagggccagga

SEQ ID NO: 3380266 - RNA, 19 nt, Pseudomonas aeruginosa PA01
cccagauccccugcaggac

SEQ ID NO: 3380267 - RNA, 21 nt, Pseudomonas aeruginosa PA01
cccagaugaucaggccgagca

SEQ ID NO: 3380268 - RNA, 19 nt, Pseudomonas aeruginosa PA01
cccagaugaucuucauccc

SEQ ID NO: 3380269 - RNA, 20 nt, Pseudomonas aeruginosa PA01
cccagauggguaagguugcc

SEQ ID NO: 3380270 - RNA, 18 nt, Pseudomonas aeruginosa PA01
cccagcaccacagcacca

SEQ ID NO: 3380271 - RNA, 16 nt, Pseudomonas aeruginosa PA01
cccagcaccgagcuga

SEQ ID NO: 3380272 - RNA, 15 nt, Pseudomonas aeruginosa PA01
cccagcaccuggacg

SEQ ID NO: 3380273 - RNA, 18 nt, Pseudomonas aeruginosa PA01
cccagcagcaacagcgcc

SEQ ID NO: 3380274 - RNA, 15 nt, Pseudomonas aeruginosa PA01
cccagcagcaccauc

SEQ ID NO: 3380275 - RNA, 13 nt, Pseudomonas aeruginosa PA01
cccagcagcaggc

SEQ ID NO: 3380276 - RNA, 19 nt, Pseudomonas aeruginosa PA01
cccagcagcaggccggcga

SEQ ID NO: 3380277 - RNA, 14 nt, Pseudomonas aeruginosa PA01
cccagcagcgccuc

SEQ ID NO: 3380278 - RNA, 21 nt, Pseudomonas aeruginosa PA01
cccagcagcgccucggcaucg

SEQ ID NO: 3380279 - RNA, 23 nt, Pseudomonas aeruginosa PA01
cccagcagcgccucggcaucgac

SEQ ID NO: 3380280 - RNA, 18 nt, Pseudomonas aeruginosa PA01
cccagcaggccagccaac

SEQ ID NO: 3380281 - RNA, 17 nt, Pseudomonas aeruginosa PA01
cccagcaggccggccag

SEQ ID NO: 3380282 - RNA, 12 nt, Pseudomonas aeruginosa PA01
cccagcaggcgc

SEQ ID NO: 3380283 - RNA, 14 nt, Pseudomonas aeruginosa PA01
cccagcaggcgcgc

SEQ ID NO: 3380284 - RNA, 13 nt, Pseudomonas aeruginosa PA01
cccagcaggcugc

SEQ ID NO: 3380285 - RNA, 22 nt, Pseudomonas aeruginosa PA01
cccagcaggcugcugcugcggc

SEQ ID NO: 3380286 - RNA, 15 nt, Pseudomonas aeruginosa PA01
cccaggcgcccaggc

SEQ ID NO: 3380287 - RNA, 17 nt, Pseudomonas aeruginosa PA01
cccaggcgcccaggcag

SEQ ID NO: 3380288 - RNA, 13 nt, Pseudomonas aeruginosa PA01
cccaggcgcggcg

SEQ ID NO: 3380289 - RNA, 16 nt, Pseudomonas aeruginosa PA01
cccaggcgcucggcga

SEQ ID NO: 3380290 - RNA, 23 nt, Pseudomonas aeruginosa PA01
cccaggcgcucggcgaccuugcg

SEQ ID NO: 3380291 - RNA, 21 nt, Pseudomonas aeruginosa PA01
cccaggcgcucggcggcgcgc

SEQ ID NO: 3380292 - RNA, 20 nt, Pseudomonas aeruginosa PA01
cccaggcgggcacgucgcgg

SEQ ID NO: 3380293 - RNA, 18 nt, Pseudomonas aeruginosa PA01
cccaggcgucgccgacuu

SEQ ID NO: 3380294 - RNA, 14 nt, Pseudomonas aeruginosa PA01
cccaggcgucgcgc

SEQ ID NO: 3380295 - RNA, 22 nt, Pseudomonas aeruginosa PA01
cccaggcgucgcgccagcaccg

SEQ ID NO: 3380296 - RNA, 23 nt, Pseudomonas aeruginosa PA01
cccaggcgucgcgccagcaccgu

SEQ ID NO: 3380297 - RNA, 15 nt, Pseudomonas aeruginosa PA01
cccaggcugacccgg

SEQ ID NO: 3380298 - RNA, 15 nt, Pseudomonas aeruginosa PA01
cccaggcugccgccg

SEQ ID NO: 3380299 - RNA, 15 nt, Pseudomonas aeruginosa PA01
cccaggcuucggcgc

SEQ ID NO: 3380300 - RNA, 16 nt, Pseudomonas aeruginosa PA01
cccaggcuucggcgcg

SEQ ID NO: 3380301 - RNA, 17 nt, Pseudomonas aeruginosa PA01
cccaggcuucggcgcgc

SEQ ID NO: 3380302 - RNA, 18 nt, Pseudomonas aeruginosa PA01
cccaggcuucggcgcgcu

SEQ ID NO: 3380303 - RNA, 15 nt, Pseudomonas aeruginosa PA01
cccagggacgcgccg

SEQ ID NO: 3380304 - RNA, 17 nt, Pseudomonas aeruginosa PA01
cccagggccagcagcgg

SEQ ID NO: 3380305 - RNA, 18 nt, Pseudomonas aeruginosa PA01
cccagggccagcagcggc

SEQ ID NO: 3380306 - RNA, 18 nt, Pseudomonas aeruginosa PA01
cccagggcccagagcagc

SEQ ID NO: 3380307 - RNA, 13 nt, Pseudomonas aeruginosa PA01
cccagggcgcugc

SEQ ID NO: 3380308 - RNA, 21 nt, Pseudomonas aeruginosa PA01
cccagggcgcugccgaucagc

SEQ ID NO: 3380309 - RNA, 19 nt, Pseudomonas aeruginosa PA01
cccagggcguggucggcgg

SEQ ID NO: 3380310 - RNA, 18 nt, Pseudomonas aeruginosa PA01
cccagggggccgggccga

SEQ ID NO: 3380311 - RNA, 17 nt, Pseudomonas aeruginosa PA01
cccaggggucggcaucg

SEQ ID NO: 3380312 - RNA, 16 nt, Pseudomonas aeruginosa PA01
cccagguaagcggcgu

SEQ ID NO: 3380313 - RNA, 19 nt, Pseudomonas aeruginosa PA01
cccagguaagcggcguuuc

SEQ ID NO: 3380314 - RNA, 19 nt, Pseudomonas aeruginosa PA01
cccagguagccggcgagcg

SEQ ID NO: 3380315 - RNA, 14 nt, Pseudomonas aeruginosa PA01
cccagguagcgcug

SEQ ID NO: 3380316 - RNA, 19 nt, Pseudomonas aeruginosa PA01
cccagguagcgcugcgcca

SEQ ID NO: 3380317 - RNA, 18 nt, Pseudomonas aeruginosa PA01
cccagguagucgcccagc

SEQ ID NO: 3380318 - RNA, 14 nt, Pseudomonas aeruginosa PA01
cccaggucggcggg

SEQ ID NO: 3380319 - RNA, 16 nt, Pseudomonas aeruginosa PA01
cccaggucggcgggca

SEQ ID NO: 3380320 - RNA, 22 nt, Pseudomonas aeruginosa PA01
cccaggucggcgggcaccgcca

SEQ ID NO: 3380321 - RNA, 14 nt, Pseudomonas aeruginosa PA01
cccaggugcagcga

SEQ ID NO: 3380322 - RNA, 14 nt, Pseudomonas aeruginosa PA01
cccaggugcccugg

SEQ ID NO: 3380323 - RNA, 15 nt, Pseudomonas aeruginosa PA01
cccaggugcccugga

SEQ ID NO: 3380324 - RNA, 21 nt, Pseudomonas aeruginosa PA01
cccaggugcgagucaccccga

SEQ ID NO: 3380325 - RNA, 16 nt, Pseudomonas aeruginosa PA01
cccaggugcgcaggcg

SEQ ID NO: 3380326 - RNA, 15 nt, Pseudomonas aeruginosa PA01
cccagguggcaggcc

SEQ ID NO: 3380327 - RNA, 16 nt, Pseudomonas aeruginosa PA01
cccagguggcaggccu

SEQ ID NO: 3380328 - RNA, 17 nt, Pseudomonas aeruginosa PA01
cccagguggucgaccag

SEQ ID NO: 3380329 - RNA, 21 nt, Pseudomonas aeruginosa PA01
cccagguggucgaccaggcgu

SEQ ID NO: 3380330 - RNA, 19 nt, Pseudomonas aeruginosa PA01
cccagguucuggucgccga

SEQ ID NO: 3380331 - RNA, 21 nt, Pseudomonas aeruginosa PA01
cccaguagcgcuucgcgcagc

SEQ ID NO: 3380332 - RNA, 24 nt, Pseudomonas aeruginosa PA01
cccaguagcgcuucgcgcagcucg

SEQ ID NO: 3380333 - RNA, 23 nt, Pseudomonas aeruginosa PA01
cccaguagggcccgugguagucg

SEQ ID NO: 3380334 - RNA, 14 nt, Pseudomonas aeruginosa PA01
cccagugcucccgc

SEQ ID NO: 3380335 - RNA, 17 nt, Pseudomonas aeruginosa PA01
cccagugggccaccggc

SEQ ID NO: 3380336 - RNA, 15 nt, Pseudomonas aeruginosa PA01
cccagugguuccagg

SEQ ID NO: 3380337 - RNA, 19 nt, Pseudomonas aeruginosa PA01
cccagugguuccaggaggg

SEQ ID NO: 3380338 - RNA, 23 nt, Pseudomonas aeruginosa PA01
cccagugguuccaggagggcugc

SEQ ID NO: 3380339 - RNA, 21 nt, Pseudomonas aeruginosa PA01
cccagugguuuuccugcaucu

SEQ ID NO: 3380340 - RNA, 15 nt, Pseudomonas aeruginosa PA01
cccaguucaacugga

SEQ ID NO: 3380341 - RNA, 14 nt, Pseudomonas aeruginosa PA01
cccaguucgccggc

SEQ ID NO: 3380342 - RNA, 16 nt, Pseudomonas aeruginosa PA01
cccaguucgccggcca

SEQ ID NO: 3380343 - RNA, 14 nt, Pseudomonas aeruginosa PA01
cccaguucgcguag

SEQ ID NO: 3380344 - RNA, 15 nt, Pseudomonas aeruginosa PA01
cccaguucgcguagc

SEQ ID NO: 3380345 - RNA, 15 nt, Pseudomonas aeruginosa PA01
cccaguucgcugccg

SEQ ID NO: 3380346 - RNA, 19 nt, Pseudomonas aeruginosa PA01
cccaguucgcugccgccgc

SEQ ID NO: 3380347 - RNA, 21 nt, Pseudomonas aeruginosa PA01
cccaguucgcugccgccgcgc

SEQ ID NO: 3380348 - RNA, 22 nt, Pseudomonas aeruginosa PA01
cccaguucuucgccgcccgcgc

SEQ ID NO: 3380349 - RNA, 17 nt, Pseudomonas aeruginosa PA01
cccaucacggccccgag

SEQ ID NO: 3380350 - RNA, 12 nt, Pseudomonas aeruginosa PA01
cccaucagcagu

SEQ ID NO: 3380351 - RNA, 15 nt, Pseudomonas aeruginosa PA01
cccaucagcaguccg

SEQ ID NO: 3380352 - RNA, 13 nt, Pseudomonas aeruginosa PA01
cccaucaggaugc

SEQ ID NO: 3380353 - RNA, 12 nt, Pseudomonas aeruginosa PA01
cccaucaggcuc

SEQ ID NO: 3380354 - RNA, 14 nt, Pseudomonas aeruginosa PA01
cccauccgccgcag

SEQ ID NO: 3380355 - RNA, 24 nt, Pseudomonas aeruginosa PA01
cccauccgggcggcgggcgcaagc

SEQ ID NO: 3380356 - RNA, 22 nt, Pseudomonas aeruginosa PA01
cccaucgaugcucauccugccc

SEQ ID NO: 3380357 - RNA, 18 nt, Pseudomonas aeruginosa PA01
cccaucgccaccagcagg

SEQ ID NO: 3380358 - RNA, 18 nt, Pseudomonas aeruginosa PA01
cccaucgccuccacggcg

SEQ ID NO: 3380359 - RNA, 14 nt, Pseudomonas aeruginosa PA01
cccaucugccggcc

SEQ ID NO: 3380360 - RNA, 16 nt, Pseudomonas aeruginosa PA01
cccaucuucaggccgu

SEQ ID NO: 3380361 - RNA, 20 nt, Pseudomonas aeruginosa PA01
cccaugaaaaagccccgccg

SEQ ID NO: 3380362 - RNA, 22 nt, Pseudomonas aeruginosa PA01
cccaugaaaaagcccggccugg

SEQ ID NO: 3380363 - RNA, 21 nt, Pseudomonas aeruginosa PA01
cccaugaaaaaggcgcccgcg

SEQ ID NO: 3380364 - RNA, 19 nt, Pseudomonas aeruginosa PA01
cccaugaaaaauggccgcu

SEQ ID NO: 3380365 - RNA, 20 nt, Pseudomonas aeruginosa PA01
cccaugaccgucagccaggc

SEQ ID NO: 3380366 - RNA, 16 nt, Pseudomonas aeruginosa PA01
cccaugaucgccaccg

SEQ ID NO: 3380367 - RNA, 17 nt, Pseudomonas aeruginosa PA01
cccaugauggucggcac

SEQ ID NO: 3380368 - RNA, 19 nt, Pseudomonas aeruginosa PA01
cccaugauggucggcacga

SEQ ID NO: 3380369 - RNA, 16 nt, Pseudomonas aeruginosa PA01
cccaugcccgccccgc

SEQ ID NO: 3380370 - RNA, 20 nt, Pseudomonas aeruginosa PA01
cccaugcccgccccgcacca

SEQ ID NO: 3380371 - RNA, 15 nt, Pseudomonas aeruginosa PA01
cccaugccgcccggc

SEQ ID NO: 3380372 - RNA, 23 nt, Pseudomonas aeruginosa PA01
cccaugccgcuagcccugcugcu

SEQ ID NO: 3380373 - RNA, 15 nt, Pseudomonas aeruginosa PA01
cccaugccguucagc

SEQ ID NO: 3380374 - RNA, 16 nt, Pseudomonas aeruginosa PA01
cccaugcgcggcgaga

SEQ ID NO: 3380375 - RNA, 22 nt, Pseudomonas aeruginosa PA01
cccauggagaauaccgugucga

SEQ ID NO: 3380376 - RNA, 22 nt, Pseudomonas aeruginosa PA01
cccauggcgguaguguugaagc

SEQ ID NO: 3380377 - RNA, 22 nt, Pseudomonas aeruginosa PA01
cccaugugcuugaccgccgccu

SEQ ID NO: 3380378 - RNA, 16 nt, Pseudomonas aeruginosa PA01
cccauuacguuguagu

SEQ ID NO: 3380379 - RNA, 20 nt, Pseudomonas aeruginosa PA01
cccauucgaugccgcgcgcc

SEQ ID NO: 3380380 - RNA, 18 nt, Pseudomonas aeruginosa PA01
cccauucgcugucgucgg

SEQ ID NO: 3380381 - RNA, 21 nt, Pseudomonas aeruginosa PA01
cccauuucguagcccaggcgg

SEQ ID NO: 3380382 - RNA, 22 nt, Pseudomonas aeruginosa PA01
ccccaacaucaacccaccgacc

SEQ ID NO: 3380383 - RNA, 18 nt, Pseudomonas aeruginosa PA01
ccccaacccggccagccc

SEQ ID NO: 3380384 - RNA, 15 nt, Pseudomonas aeruginosa PA01
ccccaaggcacgccc

SEQ ID NO: 3380385 - RNA, 21 nt, Pseudomonas aeruginosa PA01
ccccaauugcccguagggcga

SEQ ID NO: 3380386 - RNA, 22 nt, Pseudomonas aeruginosa PA01
ccccaauugcccguagggcgaa

SEQ ID NO: 3380387 - RNA, 16 nt, Pseudomonas aeruginosa PA01
ccccaauugccguagg

SEQ ID NO: 3380388 - RNA, 18 nt, Pseudomonas aeruginosa PA01
ccccggcagccaccaggu

SEQ ID NO: 3380389 - RNA, 20 nt, Pseudomonas aeruginosa PA01
ccccggcaggcaggccuggg

SEQ ID NO: 3380390 - RNA, 18 nt, Pseudomonas aeruginosa PA01
ccccggcaucgccggggc

SEQ ID NO: 3380391 - RNA, 16 nt, Pseudomonas aeruginosa PA01
ccccggccagguaccg

SEQ ID NO: 3380392 - RNA, 20 nt, Pseudomonas aeruginosa PA01
ccccggccagguaccggcca

SEQ ID NO: 3380393 - RNA, 13 nt, Pseudomonas aeruginosa PA01
ccccggcccagcc

SEQ ID NO: 3380394 - RNA, 15 nt, Pseudomonas aeruginosa PA01
ccccggcccagccgc

SEQ ID NO: 3380395 - RNA, 11 nt, Pseudomonas aeruginosa PA01
ccccggcccgg

SEQ ID NO: 3380396 - RNA, 20 nt, Pseudomonas aeruginosa PA01
ccccggcccggcgugagcag

SEQ ID NO: 3380397 - RNA, 13 nt, Pseudomonas aeruginosa PA01
ccccggccgcgcc

SEQ ID NO: 3380398 - RNA, 15 nt, Pseudomonas aeruginosa PA01
ccccggccgcgccag

SEQ ID NO: 3380399 - RNA, 22 nt, Pseudomonas aeruginosa PA01
ccccggccucaacgaccgccca

SEQ ID NO: 3380400 - RNA, 15 nt, Pseudomonas aeruginosa PA01
ccccggccuccaggc

SEQ ID NO: 3380401 - RNA, 12 nt, Pseudomonas aeruginosa PA01
ccccggccuggc

SEQ ID NO: 3380402 - RNA, 14 nt, Pseudomonas aeruginosa PA01
ccccggccuggcgc

SEQ ID NO: 3380403 - RNA, 17 nt, Pseudomonas aeruginosa PA01
ccccggcgaugcugcug

SEQ ID NO: 3380404 - RNA, 12 nt, Pseudomonas aeruginosa PA01
ccccggcgccca

SEQ ID NO: 3380405 - RNA, 15 nt, Pseudomonas aeruginosa PA01
ccccggcgccgaccg

SEQ ID NO: 3380406 - RNA, 13 nt, Pseudomonas aeruginosa PA01
ccccggcgcucgc

SEQ ID NO: 3380407 - RNA, 21 nt, Pseudomonas aeruginosa PA01
ccccggcggguucagcccgcc

SEQ ID NO: 3380408 - RNA, 16 nt, Pseudomonas aeruginosa PA01
ccccggcuuggcgggc

SEQ ID NO: 3380409 - RNA, 20 nt, Pseudomonas aeruginosa PA01
ccccgggaugcccggccgca

SEQ ID NO: 3380410 - RNA, 14 nt, Pseudomonas aeruginosa PA01
ccccgggucgcugc

SEQ ID NO: 3380411 - RNA, 12 nt, Pseudomonas aeruginosa PA01
ccccggucaggc

SEQ ID NO: 3380412 - RNA, 16 nt, Pseudomonas aeruginosa PA01
ccccggucaggccgau

SEQ ID NO: 3380413 - RNA, 24 nt, Pseudomonas aeruginosa PA01
ccccgguccggugaaccugaccau

SEQ ID NO: 3380414 - RNA, 14 nt, Pseudomonas aeruginosa PA01
ccccggucucgcgc

SEQ ID NO: 3380415 - RNA, 18 nt, Pseudomonas aeruginosa PA01
ccccgguuacucgccggc

SEQ ID NO: 3380416 - RNA, 20 nt, Pseudomonas aeruginosa PA01
ccccguagccaugcccggcu

SEQ ID NO: 3380417 - RNA, 13 nt, Pseudomonas aeruginosa PA01
ccccguagcgcuc

SEQ ID NO: 3380418 - RNA, 14 nt, Pseudomonas aeruginosa PA01
ccccguagcgcucg

SEQ ID NO: 3380419 - RNA, 16 nt, Pseudomonas aeruginosa PA01
ccccguauccuccgcg

SEQ ID NO: 3380420 - RNA, 17 nt, Pseudomonas aeruginosa PA01
ccccguauccuccgcga

SEQ ID NO: 3380421 - RNA, 18 nt, Pseudomonas aeruginosa PA01
ccccguauccuccgcgac

SEQ ID NO: 3380422 - RNA, 15 nt, Pseudomonas aeruginosa PA01
ccccgucgacgcauc

SEQ ID NO: 3380423 - RNA, 22 nt, Pseudomonas aeruginosa PA01
ccccgucgacgcccugggcgac

SEQ ID NO: 3380424 - RNA, 14 nt, Pseudomonas aeruginosa PA01
ccccgucucgcugc

SEQ ID NO: 3380425 - RNA, 13 nt, Pseudomonas aeruginosa PA01
ccccguggcgacg

SEQ ID NO: 3380426 - RNA, 15 nt, Pseudomonas aeruginosa PA01
ccccguggcgccgca

SEQ ID NO: 3380427 - RNA, 13 nt, Pseudomonas aeruginosa PA01
ccccguggcgggc

SEQ ID NO: 3380428 - RNA, 14 nt, Pseudomonas aeruginosa PA01
ccccguguugcgga

SEQ ID NO: 3380429 - RNA, 19 nt, Pseudomonas aeruginosa PA01
ccccguuguacccggcgga

SEQ ID NO: 3380430 - RNA, 15 nt, Pseudomonas aeruginosa PA01
ccccuagaccaacug

SEQ ID NO: 3380431 - RNA, 12 nt, Pseudomonas aeruginosa PA01
ccccucacacca

SEQ ID NO: 3380432 - RNA, 15 nt, Pseudomonas aeruginosa PA01
ccccucacggcgcga

SEQ ID NO: 3380433 - RNA, 20 nt, Pseudomonas aeruginosa PA01
ccccucacuccgucuccagc

SEQ ID NO: 3380434 - RNA, 22 nt, Pseudomonas aeruginosa PA01
ccccucagaaguaguaggggaa

SEQ ID NO: 3380435 - RNA, 16 nt, Pseudomonas aeruginosa PA01
ccccucaggcgccgcu

SEQ ID NO: 3380436 - RNA, 19 nt, Pseudomonas aeruginosa PA01
ccccuccaguuccugcucc

SEQ ID NO: 3380437 - RNA, 23 nt, Pseudomonas aeruginosa PA01
ccccucggcuaaccgccuucgcg

SEQ ID NO: 3380438 - RNA, 13 nt, Pseudomonas aeruginosa PA01
ccccucguggcgc

SEQ ID NO: 3380439 - RNA, 17 nt, Pseudomonas aeruginosa PA01
ccccucucaacaccccg

SEQ ID NO: 3380440 - RNA, 16 nt, Pseudomonas aeruginosa PA01
ccccugcaugccggcc

SEQ ID NO: 3380441 - RNA, 17 nt, Pseudomonas aeruginosa PA01
ccccugcaugccggccg

SEQ ID NO: 3380442 - RNA, 21 nt, Pseudomonas aeruginosa PA01
ccccugcaugccggccgucgc

SEQ ID NO: 3380443 - RNA, 13 nt, Pseudomonas aeruginosa PA01
ccccugccgcccu

SEQ ID NO: 3380444 - RNA, 14 nt, Pseudomonas aeruginosa PA01
ccccugccgcccuc

SEQ ID NO: 3380445 - RNA, 22 nt, Pseudomonas aeruginosa PA01
ccccugccgcggauacggcagg

SEQ ID NO: 3380446 - RNA, 20 nt, Pseudomonas aeruginosa PA01
ccccugccguauccgcggca

SEQ ID NO: 3380447 - RNA, 13 nt, Pseudomonas aeruginosa PA01
ccccugcgcggac

SEQ ID NO: 3380448 - RNA, 21 nt, Pseudomonas aeruginosa PA01
ccccugcggaccgcagaacca

SEQ ID NO: 3380449 - RNA, 13 nt, Pseudomonas aeruginosa PA01
ccccugcggcgcc

SEQ ID NO: 3380450 - RNA, 14 nt, Pseudomonas aeruginosa PA01
ccccugcggcgccg

SEQ ID NO: 3380451 - RNA, 16 nt, Pseudomonas aeruginosa PA01
ccccugcuccucgccg

SEQ ID NO: 3380452 - RNA, 17 nt, Pseudomonas aeruginosa PA01
ccccugcuccucgccgu

SEQ ID NO: 3380453 - RNA, 16 nt, Pseudomonas aeruginosa PA01
ccccuggagcccccgu

SEQ ID NO: 3380454 - RNA, 20 nt, Pseudomonas aeruginosa PA01
ccccuggccguugaccagcg

SEQ ID NO: 3380455 - RNA, 13 nt, Pseudomonas aeruginosa PA01
ccccuggcgcugg

SEQ ID NO: 3380456 - RNA, 14 nt, Pseudomonas aeruginosa PA01
ccccuggcgcuggg

SEQ ID NO: 3380457 - RNA, 17 nt, Pseudomonas aeruginosa PA01
ccccuggcgcugggccu

SEQ ID NO: 3380458 - RNA, 22 nt, Pseudomonas aeruginosa PA01
ccccuggcgcugggccuugagc

SEQ ID NO: 3380459 - RNA, 13 nt, Pseudomonas aeruginosa PA01
ccccugggccggc

SEQ ID NO: 3380460 - RNA, 14 nt, Pseudomonas aeruginosa PA01
ccccugguccucaa

SEQ ID NO: 3380461 - RNA, 14 nt, Pseudomonas aeruginosa PA01
ccccuguggucagg

SEQ ID NO: 3380462 - RNA, 23 nt, Pseudomonas aeruginosa PA01
ccccuguuucgaugagcuucgcc

SEQ ID NO: 3380463 - RNA, 14 nt, Pseudomonas aeruginosa PA01
ccccuucagcucca

SEQ ID NO: 3380464 - RNA, 17 nt, Pseudomonas aeruginosa PA01
ccccuucagcuccagca

SEQ ID NO: 3380465 - RNA, 21 nt, Pseudomonas aeruginosa PA01
ccccuucggcugcaacuucca

SEQ ID NO: 3380466 - RNA, 18 nt, Pseudomonas aeruginosa PA01
ccccuugauauguucgaa

SEQ ID NO: 3380467 - RNA, 13 nt, Pseudomonas aeruginosa PA01
ccccuuggccagc

SEQ ID NO: 3380468 - RNA, 14 nt, Pseudomonas aeruginosa PA01
ccccuuugccgagc

SEQ ID NO: 3380469 - RNA, 21 nt, Pseudomonas aeruginosa PA01
ccccuuuuucaugcgcgggcc

SEQ ID NO: 3380470 - RNA, 19 nt, Pseudomonas aeruginosa PA01
ccccuuuuucggcgcggac

SEQ ID NO: 3380471 - RNA, 19 nt, Pseudomonas aeruginosa PA01
ccccuuuuuuugcgcgcca

SEQ ID NO: 3380472 - RNA, 22 nt, Pseudomonas aeruginosa PA01
cccgaaaccggcgaugcucagc

SEQ ID NO: 3380473 - RNA, 11 nt, Pseudomonas aeruginosa PA01
cccgaacgccg

SEQ ID NO: 3380474 - RNA, 12 nt, Pseudomonas aeruginosa PA01
cccgaacgccga

SEQ ID NO: 3380475 - RNA, 13 nt, Pseudomonas aeruginosa PA01
cccgaacgccgac

SEQ ID NO: 3380476 - RNA, 14 nt, Pseudomonas aeruginosa PA01
cccgaacucgccgu

SEQ ID NO: 3380477 - RNA, 19 nt, Pseudomonas aeruginosa PA01
cccgaaguagcgacggaag

SEQ ID NO: 3380478 - RNA, 22 nt, Pseudomonas aeruginosa PA01
cccgaauagaucugcaccaggc

SEQ ID NO: 3380479 - RNA, 20 nt, Pseudomonas aeruginosa PA01
cccgaaucccuuggcugcuc

SEQ ID NO: 3380480 - RNA, 15 nt, Pseudomonas aeruginosa PA01
cccgacaggcagcgc

SEQ ID NO: 3380481 - RNA, 18 nt, Pseudomonas aeruginosa PA01
cccgacaggcagcgccgc

SEQ ID NO: 3380482 - RNA, 22 nt, Pseudomonas aeruginosa PA01
cccgacaggcagcgccgcccac

SEQ ID NO: 3380483 - RNA, 12 nt, Pseudomonas aeruginosa PA01
cccgaccagcgc

SEQ ID NO: 3380484 - RNA, 13 nt, Pseudomonas aeruginosa PA01
cccgaccagcgcg

SEQ ID NO: 3380485 - RNA, 19 nt, Pseudomonas aeruginosa PA01
cccgaccagcgcgcucuuc

SEQ ID NO: 3380486 - RNA, 22 nt, Pseudomonas aeruginosa PA01
cccgaccagcgcgcucuucgcc

SEQ ID NO: 3380487 - RNA, 21 nt, Pseudomonas aeruginosa PA01
cccgaccaggucgcuggcacc

SEQ ID NO: 3380488 - RNA, 18 nt, Pseudomonas aeruginosa PA01
cccgaccgguuccagcgg

SEQ ID NO: 3380489 - RNA, 24 nt, Pseudomonas aeruginosa PA01
cccgaccgguuccagcggccgcga

SEQ ID NO: 3380490 - RNA, 16 nt, Pseudomonas aeruginosa PA01
cccgacgcccuccagc

SEQ ID NO: 3380491 - RNA, 13 nt, Pseudomonas aeruginosa PA01
cccgccgcgcauc

SEQ ID NO: 3380492 - RNA, 14 nt, Pseudomonas aeruginosa PA01
cccgccgcgcauca

SEQ ID NO: 3380493 - RNA, 11 nt, Pseudomonas aeruginosa PA01
cccgccgcgcc

SEQ ID NO: 3380494 - RNA, 13 nt, Pseudomonas aeruginosa PA01
cccgccgcgccgc

SEQ ID NO: 3380495 - RNA, 14 nt, Pseudomonas aeruginosa PA01
cccgccgcggcgag

SEQ ID NO: 3380496 - RNA, 15 nt, Pseudomonas aeruginosa PA01
cccgccgcggcgagc

SEQ ID NO: 3380497 - RNA, 22 nt, Pseudomonas aeruginosa PA01
cccgccgcggcguuagccgccu

SEQ ID NO: 3380498 - RNA, 13 nt, Pseudomonas aeruginosa PA01
cccgccggccaug

SEQ ID NO: 3380499 - RNA, 15 nt, Pseudomonas aeruginosa PA01
cccgccggccaugcc

SEQ ID NO: 3380500 - RNA, 21 nt, Pseudomonas aeruginosa PA01
cccgccggccgggagcuacag

SEQ ID NO: 3380501 - RNA, 13 nt, Pseudomonas aeruginosa PA01
cccgccggcgcgc

SEQ ID NO: 3380502 - RNA, 18 nt, Pseudomonas aeruginosa PA01
cccgccggcgcgcccagg

SEQ ID NO: 3380503 - RNA, 13 nt, Pseudomonas aeruginosa PA01
cccgccggggcgu

SEQ ID NO: 3380504 - RNA, 22 nt, Pseudomonas aeruginosa PA01
cccgccggggcgugcaggccgc

SEQ ID NO: 3380505 - RNA, 16 nt, Pseudomonas aeruginosa PA01
cccgccggucaaccgc

SEQ ID NO: 3380506 - RNA, 18 nt, Pseudomonas aeruginosa PA01
cccgccguccuccagcaa

SEQ ID NO: 3380507 - RNA, 13 nt, Pseudomonas aeruginosa PA01
cccgccgucgccc

SEQ ID NO: 3380508 - RNA, 12 nt, Pseudomonas aeruginosa PA01
cccgccgugcgc

SEQ ID NO: 3380509 - RNA, 13 nt, Pseudomonas aeruginosa PA01
cccgccgugcgcu

SEQ ID NO: 3380510 - RNA, 17 nt, Pseudomonas aeruginosa PA01
cccgccgugcgcuccgc

SEQ ID NO: 3380511 - RNA, 12 nt, Pseudomonas aeruginosa PA01
cccgccucgcgc

SEQ ID NO: 3380512 - RNA, 15 nt, Pseudomonas aeruginosa PA01
cccgccucgcgcaac

SEQ ID NO: 3380513 - RNA, 20 nt, Pseudomonas aeruginosa PA01
cccgccucgucgccaugcgg

SEQ ID NO: 3380514 - RNA, 21 nt, Pseudomonas aeruginosa PA01
cccgccuggaaggcgcugggc

SEQ ID NO: 3380515 - RNA, 23 nt, Pseudomonas aeruginosa PA01
cccgccuggaaggcgcugggcgg

SEQ ID NO: 3380516 - RNA, 15 nt, Pseudomonas aeruginosa PA01
cccgccuucaggcgg

SEQ ID NO: 3380517 - RNA, 18 nt, Pseudomonas aeruginosa PA01
cccgccuuguucgccagc

SEQ ID NO: 3380518 - RNA, 24 nt, Pseudomonas aeruginosa PA01
cccgccuuguucgccagcaccucg

SEQ ID NO: 3380519 - RNA, 22 nt, Pseudomonas aeruginosa PA01
cccgcgaaccucgguagccggc

SEQ ID NO: 3380520 - RNA, 14 nt, Pseudomonas aeruginosa PA01
cccgcgacaacggc

SEQ ID NO: 3380521 - RNA, 20 nt, Pseudomonas aeruginosa PA01
cccgcgacaacggccguccc

SEQ ID NO: 3380522 - RNA, 20 nt, Pseudomonas aeruginosa PA01
cccgcgacucgagcaccacc

SEQ ID NO: 3380523 - RNA, 16 nt, Pseudomonas aeruginosa PA01
cccgcgacucguaggg

SEQ ID NO: 3380524 - RNA, 14 nt, Pseudomonas aeruginosa PA01
cccgcgagcagccg

SEQ ID NO: 3380525 - RNA, 13 nt, Pseudomonas aeruginosa PA01
cccgcgagccgcg

SEQ ID NO: 3380526 - RNA, 17 nt, Pseudomonas aeruginosa PA01
cccgcgagccgcgcagc

SEQ ID NO: 3380527 - RNA, 13 nt, Pseudomonas aeruginosa PA01
cccgcgaggccgg

SEQ ID NO: 3380528 - RNA, 16 nt, Pseudomonas aeruginosa PA01
cccgcgaggccggccc

SEQ ID NO: 3380529 - RNA, 18 nt, Pseudomonas aeruginosa PA01
cccgcgaggccggcccca

SEQ ID NO: 3380530 - RNA, 18 nt, Pseudomonas aeruginosa PA01
cccgcgauugcagcuccu

SEQ ID NO: 3380531 - RNA, 23 nt, Pseudomonas aeruginosa PA01
cccgcgcauggagacggcccgcc

SEQ ID NO: 3380532 - RNA, 14 nt, Pseudomonas aeruginosa PA01
cccgcgccagcgcc

SEQ ID NO: 3380533 - RNA, 15 nt, Pseudomonas aeruginosa PA01
cccgcgccagcgccg

SEQ ID NO: 3380534 - RNA, 16 nt, Pseudomonas aeruginosa PA01
cccgcgccagcgccgc

SEQ ID NO: 3380535 - RNA, 14 nt, Pseudomonas aeruginosa PA01
cccgcgccagcucg

SEQ ID NO: 3380536 - RNA, 13 nt, Pseudomonas aeruginosa PA01
cccgcgccgccgc

SEQ ID NO: 3380537 - RNA, 16 nt, Pseudomonas aeruginosa PA01
cccgcgccgccgcggc

SEQ ID NO: 3380538 - RNA, 14 nt, Pseudomonas aeruginosa PA01
cccgcgccgccgga

SEQ ID NO: 3380539 - RNA, 12 nt, Pseudomonas aeruginosa PA01
cccgcgccgccu

SEQ ID NO: 3380540 - RNA, 15 nt, Pseudomonas aeruginosa PA01
cccgcgccgccucga

SEQ ID NO: 3380541 - RNA, 16 nt, Pseudomonas aeruginosa PA01
cccgcgccgccucgau

SEQ ID NO: 3380542 - RNA, 11 nt, Pseudomonas aeruginosa PA01
cccgcgccgcg

SEQ ID NO: 3380543 - RNA, 12 nt, Pseudomonas aeruginosa PA01
cccgcgccggca

SEQ ID NO: 3380544 - RNA, 14 nt, Pseudomonas aeruginosa PA01
cccgcgccggcagc

SEQ ID NO: 3380545 - RNA, 18 nt, Pseudomonas aeruginosa PA01
cccgcgccggcagcucgg

SEQ ID NO: 3380546 - RNA, 13 nt, Pseudomonas aeruginosa PA01
cccgcgccuccag

SEQ ID NO: 3380547 - RNA, 20 nt, Pseudomonas aeruginosa PA01
cccgcgccuccaggcgcgcc

SEQ ID NO: 3380548 - RNA, 21 nt, Pseudomonas aeruginosa PA01
cccgcgccugcaggucgaggc

SEQ ID NO: 3380549 - RNA, 19 nt, Pseudomonas aeruginosa PA01
cccgcgccuucaguucguu

SEQ ID NO: 3380550 - RNA, 14 nt, Pseudomonas aeruginosa PA01
cccgcgcgcugugc

SEQ ID NO: 3380551 - RNA, 20 nt, Pseudomonas aeruginosa PA01
cccgcgcggcaacgucaggc

SEQ ID NO: 3380552 - RNA, 13 nt, Pseudomonas aeruginosa PA01
cccgcgcggcccu

SEQ ID NO: 3380553 - RNA, 14 nt, Pseudomonas aeruginosa PA01
cccgcgcgggccga

SEQ ID NO: 3380554 - RNA, 13 nt, Pseudomonas aeruginosa PA01
cccgcgcuucuuc

SEQ ID NO: 3380555 - RNA, 16 nt, Pseudomonas aeruginosa PA01
cccgcggaccgggcgg

SEQ ID NO: 3380556 - RNA, 19 nt, Pseudomonas aeruginosa PA01
cccgcggaccgggcggcgc

SEQ ID NO: 3380557 - RNA, 16 nt, Pseudomonas aeruginosa PA01
cccgcggcagcagcca

SEQ ID NO: 3380558 - RNA, 16 nt, Pseudomonas aeruginosa PA01
cccgcggcccaagggc

SEQ ID NO: 3380559 - RNA, 19 nt, Pseudomonas aeruginosa PA01
cccgcggcccgccgccggg

SEQ ID NO: 3380560 - RNA, 12 nt, Pseudomonas aeruginosa PA01
cccgcggccgag

SEQ ID NO: 3380561 - RNA, 14 nt, Pseudomonas aeruginosa PA01
cccgcggcgcgccu

SEQ ID NO: 3380562 - RNA, 14 nt, Pseudomonas aeruginosa PA01
cccgcggcggcgac

SEQ ID NO: 3380563 - RNA, 20 nt, Pseudomonas aeruginosa PA01
cccgcggcggcgacgcuggc

SEQ ID NO: 3380564 - RNA, 22 nt, Pseudomonas aeruginosa PA01
cccgcgggcagcagucgcagcu

SEQ ID NO: 3380565 - RNA, 14 nt, Pseudomonas aeruginosa PA01
cccgcgggcagcuc

SEQ ID NO: 3380566 - RNA, 17 nt, Pseudomonas aeruginosa PA01
cccgcgguacccggcag

SEQ ID NO: 3380567 - RNA, 19 nt, Pseudomonas aeruginosa PA01
cccgcggucacucggccuc

SEQ ID NO: 3380568 - RNA, 22 nt, Pseudomonas aeruginosa PA01
cccgcggucacucggccucggc

SEQ ID NO: 3380569 - RNA, 19 nt, Pseudomonas aeruginosa PA01
cccgcguccuccuggagga

SEQ ID NO: 3380570 - RNA, 24 nt, Pseudomonas aeruginosa PA01
cccgcguccuccuggaggacgcgg

SEQ ID NO: 3380571 - RNA, 13 nt, Pseudomonas aeruginosa PA01
cccgcgucgcgcg

SEQ ID NO: 3380572 - RNA, 16 nt, Pseudomonas aeruginosa PA01
cccgcguucgcggggc

SEQ ID NO: 3380573 - RNA, 15 nt, Pseudomonas aeruginosa PA01
cccgcuacccugccc

SEQ ID NO: 3380574 - RNA, 16 nt, Pseudomonas aeruginosa PA01
cccgcucaagggcugg

SEQ ID NO: 3380575 - RNA, 22 nt, Pseudomonas aeruginosa PA01
cccgcucaugagauccgccagc

SEQ ID NO: 3380576 - RNA, 23 nt, Pseudomonas aeruginosa PA01
cccgcucaugagauccgccagca

SEQ ID NO: 3380577 - RNA, 14 nt, Pseudomonas aeruginosa PA01
cccgcuccagccgg

SEQ ID NO: 3380578 - RNA, 18 nt, Pseudomonas aeruginosa PA01
cccgcuccagccggcaag

SEQ ID NO: 3380579 - RNA, 15 nt, Pseudomonas aeruginosa PA01
cccgcuccgcggccg

SEQ ID NO: 3380580 - RNA, 14 nt, Pseudomonas aeruginosa PA01
cccgcuccggcucu

SEQ ID NO: 3380581 - RNA, 22 nt, Pseudomonas aeruginosa PA01
cccgcucgagggugucguagag

SEQ ID NO: 3380582 - RNA, 11 nt, Pseudomonas aeruginosa PA01
cccgcucgccg

SEQ ID NO: 3380583 - RNA, 12 nt, Pseudomonas aeruginosa PA01
cccgcucgccgg

SEQ ID NO: 3380584 - RNA, 23 nt, Pseudomonas aeruginosa PA01
cccgcucgccgggaaucgccagc

SEQ ID NO: 3380585 - RNA, 13 nt, Pseudomonas aeruginosa PA01
cccgcucggccuu

SEQ ID NO: 3380586 - RNA, 22 nt, Pseudomonas aeruginosa PA01
cccgcucggccuuagcgguugc

SEQ ID NO: 3380587 - RNA, 22 nt, Pseudomonas aeruginosa PA01
cccgcucggccuuguccggcac

SEQ ID NO: 3380588 - RNA, 22 nt, Pseudomonas aeruginosa PA01
cccgcucgucauggcgcacgcc

SEQ ID NO: 3380589 - RNA, 23 nt, Pseudomonas aeruginosa PA01
cccgcucgucauggcgcacgccg

SEQ ID NO: 3380590 - RNA, 21 nt, Pseudomonas aeruginosa PA01
cccgcugaaggacugugccug

SEQ ID NO: 3380591 - RNA, 13 nt, Pseudomonas aeruginosa PA01
cccgcugcaacuc

SEQ ID NO: 3380592 - RNA, 18 nt, Pseudomonas aeruginosa PA01
cccgcugcaugugccagg

SEQ ID NO: 3380593 - RNA, 22 nt, Pseudomonas aeruginosa PA01
cccgcugcaugugccaggccug

SEQ ID NO: 3380594 - RNA, 23 nt, Pseudomonas aeruginosa PA01
cccgcugcaugugccaggccugg

SEQ ID NO: 3380595 - RNA, 13 nt, Pseudomonas aeruginosa PA01
cccggccggcagg

SEQ ID NO: 3380596 - RNA, 16 nt, Pseudomonas aeruginosa PA01
cccggccuccaggcug

SEQ ID NO: 3380597 - RNA, 17 nt, Pseudomonas aeruginosa PA01
cccggccuccaggcugg

SEQ ID NO: 3380598 - RNA, 17 nt, Pseudomonas aeruginosa PA01
cccggccuccccggccc

SEQ ID NO: 3380599 - RNA, 20 nt, Pseudomonas aeruginosa PA01
cccggccucgccggucgcgc

SEQ ID NO: 3380600 - RNA, 22 nt, Pseudomonas aeruginosa PA01
cccggccucgccugcggcgccu

SEQ ID NO: 3380601 - RNA, 12 nt, Pseudomonas aeruginosa PA01
cccggccuggau

SEQ ID NO: 3380602 - RNA, 17 nt, Pseudomonas aeruginosa PA01
cccggccuggcgcgcgc

SEQ ID NO: 3380603 - RNA, 13 nt, Pseudomonas aeruginosa PA01
cccggccuggcug

SEQ ID NO: 3380604 - RNA, 16 nt, Pseudomonas aeruginosa PA01
cccggccuucaccgcg

SEQ ID NO: 3380605 - RNA, 19 nt, Pseudomonas aeruginosa PA01
cccggcgaagcuccucgau

SEQ ID NO: 3380606 - RNA, 15 nt, Pseudomonas aeruginosa PA01
cccggcgagagcguc

SEQ ID NO: 3380607 - RNA, 22 nt, Pseudomonas aeruginosa PA01
cccggcgagagcguccggcagg

SEQ ID NO: 3380608 - RNA, 11 nt, Pseudomonas aeruginosa PA01
cccggcgagcg

SEQ ID NO: 3380609 - RNA, 20 nt, Pseudomonas aeruginosa PA01
cccggcgaugcugcugauca

SEQ ID NO: 3380610 - RNA, 13 nt, Pseudomonas aeruginosa PA01
cccggcgcacgcc

SEQ ID NO: 3380611 - RNA, 14 nt, Pseudomonas aeruginosa PA01
cccggcgcacgccg

SEQ ID NO: 3380612 - RNA, 15 nt, Pseudomonas aeruginosa PA01
cccggcgcacgccgg

SEQ ID NO: 3380613 - RNA, 16 nt, Pseudomonas aeruginosa PA01
cccggcgcacgccggc

SEQ ID NO: 3380614 - RNA, 17 nt, Pseudomonas aeruginosa PA01
cccggcgcacgccggcc

SEQ ID NO: 3380615 - RNA, 14 nt, Pseudomonas aeruginosa PA01
cccggcgcacugcg

SEQ ID NO: 3380616 - RNA, 19 nt, Pseudomonas aeruginosa PA01
cccggcgcacugcgugggu

SEQ ID NO: 3380617 - RNA, 20 nt, Pseudomonas aeruginosa PA01
cccggcgcagaacugccggg

SEQ ID NO: 3380618 - RNA, 12 nt, Pseudomonas aeruginosa PA01
cccggcgcagag

SEQ ID NO: 3380619 - RNA, 18 nt, Pseudomonas aeruginosa PA01
cccggcgcaugccgcagg

SEQ ID NO: 3380620 - RNA, 18 nt, Pseudomonas aeruginosa PA01
cccggcgccaccccgccg

SEQ ID NO: 3380621 - RNA, 19 nt, Pseudomonas aeruginosa PA01
cccggcgccaccccgccgc

SEQ ID NO: 3380622 - RNA, 22 nt, Pseudomonas aeruginosa PA01
cccggcgccaccgauucgccgg

SEQ ID NO: 3380623 - RNA, 15 nt, Pseudomonas aeruginosa PA01
cccggcgccaccgcg

SEQ ID NO: 3380624 - RNA, 17 nt, Pseudomonas aeruginosa PA01
cccggcgccaccgcguu

SEQ ID NO: 3380625 - RNA, 15 nt, Pseudomonas aeruginosa PA01
cccggcgccaggcug

SEQ ID NO: 3380626 - RNA, 12 nt, Pseudomonas aeruginosa PA01
cccggcgccagu

SEQ ID NO: 3380627 - RNA, 12 nt, Pseudomonas aeruginosa PA01
cccggcgccccg

SEQ ID NO: 3380628 - RNA, 13 nt, Pseudomonas aeruginosa PA01
cccggcgcccggc

SEQ ID NO: 3380629 - RNA, 19 nt, Pseudomonas aeruginosa PA01
cccggcgcccggcgcaugc

SEQ ID NO: 3380630 - RNA, 20 nt, Pseudomonas aeruginosa PA01
cccggcgccgaccguggcga

SEQ ID NO: 3380631 - RNA, 14 nt, Pseudomonas aeruginosa PA01
cccggcgccgcccu

SEQ ID NO: 3380632 - RNA, 21 nt, Pseudomonas aeruginosa PA01
cccggcgcgaccgucggccgg

SEQ ID NO: 3380633 - RNA, 22 nt, Pseudomonas aeruginosa PA01
cccggcgcgaccgucggccggg

SEQ ID NO: 3380634 - RNA, 12 nt, Pseudomonas aeruginosa PA01
cccggcgcgacg

SEQ ID NO: 3380635 - RNA, 19 nt, Pseudomonas aeruginosa PA01
cccggcgcgacgcuccagg

SEQ ID NO: 3380636 - RNA, 21 nt, Pseudomonas aeruginosa PA01
cccggcgcgacgcuccaggug

SEQ ID NO: 3380637 - RNA, 13 nt, Pseudomonas aeruginosa PA01
cccggcgcggaac

SEQ ID NO: 3380638 - RNA, 14 nt, Pseudomonas aeruginosa PA01
cccggcgcggccga

SEQ ID NO: 3380639 - RNA, 12 nt, Pseudomonas aeruginosa PA01
cccggcgcggcg

SEQ ID NO: 3380640 - RNA, 13 nt, Pseudomonas aeruginosa PA01
cccggcgcggcgg

SEQ ID NO: 3380641 - RNA, 22 nt, Pseudomonas aeruginosa PA01
cccggcgcggcuacccucuccc

SEQ ID NO: 3380642 - RNA, 15 nt, Pseudomonas aeruginosa PA01
cccggcgcugcuucu

SEQ ID NO: 3380643 - RNA, 19 nt, Pseudomonas aeruginosa PA01
cccggcgcuggccgcgcga

SEQ ID NO: 3380644 - RNA, 13 nt, Pseudomonas aeruginosa PA01
cccggcgcuucgc

SEQ ID NO: 3380645 - RNA, 15 nt, Pseudomonas aeruginosa PA01
cccggcgcuucgcgc

SEQ ID NO: 3380646 - RNA, 17 nt, Pseudomonas aeruginosa PA01
cccggcgcuucgcgcag

SEQ ID NO: 3380647 - RNA, 18 nt, Pseudomonas aeruginosa PA01
cccggcgcuucgcgcagg

SEQ ID NO: 3380648 - RNA, 21 nt, Pseudomonas aeruginosa PA01
cccggcgcuucgcgcaggacg

SEQ ID NO: 3380649 - RNA, 23 nt, Pseudomonas aeruginosa PA01
cccggcggacaaccaccaugcgg

SEQ ID NO: 3380650 - RNA, 22 nt, Pseudomonas aeruginosa PA01
cccggcggcgacccagaccugc

SEQ ID NO: 3380651 - RNA, 13 nt, Pseudomonas aeruginosa PA01
cccggcggcggca

SEQ ID NO: 3380652 - RNA, 15 nt, Pseudomonas aeruginosa PA01
cccggcggcggcacc

SEQ ID NO: 3380653 - RNA, 22 nt, Pseudomonas aeruginosa PA01
cccggcggcggcaccgacgccg

SEQ ID NO: 3380654 - RNA, 23 nt, Pseudomonas aeruginosa PA01
cccggcggcggcaccgacgccga

SEQ ID NO: 3380655 - RNA, 20 nt, Pseudomonas aeruginosa PA01
cccggcggguucagcccgcc

SEQ ID NO: 3380656 - RNA, 21 nt, Pseudomonas aeruginosa PA01
cccggcggguucagcccgccg

SEQ ID NO: 3380657 - RNA, 16 nt, Pseudomonas aeruginosa PA01
cccggcgguccgccgc

SEQ ID NO: 3380658 - RNA, 17 nt, Pseudomonas aeruginosa PA01
cccggcgguccgccgcg

SEQ ID NO: 3380659 - RNA, 23 nt, Pseudomonas aeruginosa PA01
cccggcgguccgccgcgggacgc

SEQ ID NO: 3380660 - RNA, 17 nt, Pseudomonas aeruginosa PA01
cccggcgguuucgccga

SEQ ID NO: 3380661 - RNA, 14 nt, Pseudomonas aeruginosa PA01
cccggcgucggcgc

SEQ ID NO: 3380662 - RNA, 20 nt, Pseudomonas aeruginosa PA01
cccggcgucggcgcgggcgc

SEQ ID NO: 3380663 - RNA, 23 nt, Pseudomonas aeruginosa PA01
cccggcgucggcgcgggcgccga

SEQ ID NO: 3380664 - RNA, 16 nt, Pseudomonas aeruginosa PA01
cccggcgugagcaggg

SEQ ID NO: 3380665 - RNA, 20 nt, Pseudomonas aeruginosa PA01
cccggcgugagcagggccga

SEQ ID NO: 3380666 - RNA, 19 nt, Pseudomonas aeruginosa PA01
cccggcgugggcggucggc

SEQ ID NO: 3380667 - RNA, 21 nt, Pseudomonas aeruginosa PA01
cccggcgugggcggucggcga

SEQ ID NO: 3380668 - RNA, 23 nt, Pseudomonas aeruginosa PA01
cccggcgugggcggucggcgagg

SEQ ID NO: 3380669 - RNA, 19 nt, Pseudomonas aeruginosa PA01
cccggcuaucgcuuucagc

SEQ ID NO: 3380670 - RNA, 20 nt, Pseudomonas aeruginosa PA01
cccggcuaucgcuuucagca

SEQ ID NO: 3380671 - RNA, 24 nt, Pseudomonas aeruginosa PA01
cccggcuaucgcuuucagcaauca

SEQ ID NO: 3380672 - RNA, 22 nt, Pseudomonas aeruginosa PA01
cccggcucaacugguuggccgc

SEQ ID NO: 3380673 - RNA, 16 nt, Pseudomonas aeruginosa PA01
cccggcuccagccggg

SEQ ID NO: 3380674 - RNA, 13 nt, Pseudomonas aeruginosa PA01
cccggcucgccga

SEQ ID NO: 3380675 - RNA, 14 nt, Pseudomonas aeruginosa PA01
cccggcucgccgcc

SEQ ID NO: 3380676 - RNA, 15 nt, Pseudomonas aeruginosa PA01
cccggcucgccgccg

SEQ ID NO: 3380677 - RNA, 17 nt, Pseudomonas aeruginosa PA01
cccggcucgccgccggg

SEQ ID NO: 3380678 - RNA, 12 nt, Pseudomonas aeruginosa PA01
cccggcucggca

SEQ ID NO: 3380679 - RNA, 22 nt, Pseudomonas aeruginosa PA01
cccggcucggcacgcguggcga

SEQ ID NO: 3380680 - RNA, 12 nt, Pseudomonas aeruginosa PA01
cccggcucggcg

SEQ ID NO: 3380681 - RNA, 16 nt, Pseudomonas aeruginosa PA01
cccggcugagcgccag

SEQ ID NO: 3380682 - RNA, 20 nt, Pseudomonas aeruginosa PA01
cccggcugagcgccaggcgc

SEQ ID NO: 3380683 - RNA, 21 nt, Pseudomonas aeruginosa PA01
cccggcugguugccagcagcg

SEQ ID NO: 3380684 - RNA, 22 nt, Pseudomonas aeruginosa PA01
cccggcugguugccagcagcgc

SEQ ID NO: 3380685 - RNA, 22 nt, Pseudomonas aeruginosa PA01
cccggcuucggcggcgcgcugc

SEQ ID NO: 3380686 - RNA, 16 nt, Pseudomonas aeruginosa PA01
cccggcuugccggcag

SEQ ID NO: 3380687 - RNA, 13 nt, Pseudomonas aeruginosa PA01
cccggcuugccgu

SEQ ID NO: 3380688 - RNA, 14 nt, Pseudomonas aeruginosa PA01
cccggcuugccguc

SEQ ID NO: 3380689 - RNA, 22 nt, Pseudomonas aeruginosa PA01
cccggcuugccgucgguguccg

SEQ ID NO: 3380690 - RNA, 21 nt, Pseudomonas aeruginosa PA01
cccggcuuggcgggcucgccc

SEQ ID NO: 3380691 - RNA, 21 nt, Pseudomonas aeruginosa PA01
cccggcuuuuuucgcccgugc

SEQ ID NO: 3380692 - RNA, 19 nt, Pseudomonas aeruginosa PA01
cccgggaaaccaccaggaa

SEQ ID NO: 3380693 - RNA, 12 nt, Pseudomonas aeruginosa PA01
cccgggaucgau

SEQ ID NO: 3380694 - RNA, 13 nt, Pseudomonas aeruginosa PA01
cccgggcccaagc

SEQ ID NO: 3380695 - RNA, 22 nt, Pseudomonas aeruginosa PA01
cccgggcccaagccgagcggca

SEQ ID NO: 3380696 - RNA, 16 nt, Pseudomonas aeruginosa PA01
cccgggccuccuggcg

SEQ ID NO: 3380697 - RNA, 18 nt, Pseudomonas aeruginosa PA01
cccgggccuccuggcggc

SEQ ID NO: 3380698 - RNA, 16 nt, Pseudomonas aeruginosa PA01
cccguuccggcgcagc

SEQ ID NO: 3380699 - RNA, 13 nt, Pseudomonas aeruginosa PA01
cccguuccuugcg

SEQ ID NO: 3380700 - RNA, 18 nt, Pseudomonas aeruginosa PA01
cccguuccuugcgcggca

SEQ ID NO: 3380701 - RNA, 23 nt, Pseudomonas aeruginosa PA01
cccguucgaucaauugccgguag

SEQ ID NO: 3380702 - RNA, 13 nt, Pseudomonas aeruginosa PA01
cccguucgccggc

SEQ ID NO: 3380703 - RNA, 22 nt, Pseudomonas aeruginosa PA01
cccguugccgagguguugugug

SEQ ID NO: 3380704 - RNA, 19 nt, Pseudomonas aeruginosa PA01
cccguugcgccucgccgcc

SEQ ID NO: 3380705 - RNA, 18 nt, Pseudomonas aeruginosa PA01
cccguuguacccggcgga

SEQ ID NO: 3380706 - RNA, 14 nt, Pseudomonas aeruginosa PA01
cccguuuugccgac

SEQ ID NO: 3380707 - RNA, 22 nt, Pseudomonas aeruginosa PA01
cccguuuuuccucuaugggacg

SEQ ID NO: 3380708 - RNA, 18 nt, Pseudomonas aeruginosa PA01
cccuacagcccccccagc

SEQ ID NO: 3380709 - RNA, 17 nt, Pseudomonas aeruginosa PA01
cccuaccagcgcaaccg

SEQ ID NO: 3380710 - RNA, 19 nt, Pseudomonas aeruginosa PA01
cccuaccagcgcaaccggu

SEQ ID NO: 3380711 - RNA, 14 nt, Pseudomonas aeruginosa PA01
cccuaccccagggg

SEQ ID NO: 3380712 - RNA, 20 nt, Pseudomonas aeruginosa PA01
cccuaccccaggggucggca

SEQ ID NO: 3380713 - RNA, 14 nt, Pseudomonas aeruginosa PA01
cccuaccgcccacc

SEQ ID NO: 3380714 - RNA, 17 nt, Pseudomonas aeruginosa PA01
cccuaccguccgcagca

SEQ ID NO: 3380715 - RNA, 16 nt, Pseudomonas aeruginosa PA01
cccuaccugucccgga

SEQ ID NO: 3380716 - RNA, 11 nt, Pseudomonas aeruginosa PA01
cccuacgaaag

SEQ ID NO: 3380717 - RNA, 12 nt, Pseudomonas aeruginosa PA01
cccuacgccagu

SEQ ID NO: 3380718 - RNA, 22 nt, Pseudomonas aeruginosa PA01
cccuacggggacaugucgaggg

SEQ ID NO: 3380719 - RNA, 21 nt, Pseudomonas aeruginosa PA01
cccuacggggcgugucgaggg

SEQ ID NO: 3380720 - RNA, 14 nt, Pseudomonas aeruginosa PA01
cccuacuccagggg

SEQ ID NO: 3380721 - RNA, 17 nt, Pseudomonas aeruginosa PA01
cccuaggcgacccggca

SEQ ID NO: 3380722 - RNA, 19 nt, Pseudomonas aeruginosa PA01
cccuagggguucuccgggu

SEQ ID NO: 3380723 - RNA, 14 nt, Pseudomonas aeruginosa PA01
cccuagggucggcg

SEQ ID NO: 3380724 - RNA, 15 nt, Pseudomonas aeruginosa PA01
cccuagucgagggga

SEQ ID NO: 3380725 - RNA, 14 nt, Pseudomonas aeruginosa PA01
cccucacaccacca

SEQ ID NO: 3380726 - RNA, 17 nt, Pseudomonas aeruginosa PA01
cccucacaccaccagca

SEQ ID NO: 3380727 - RNA, 15 nt, Pseudomonas aeruginosa PA01
cccucagcagcgccg

SEQ ID NO: 3380728 - RNA, 13 nt, Pseudomonas aeruginosa PA01
cccucagcggcgg

SEQ ID NO: 3380729 - RNA, 19 nt, Pseudomonas aeruginosa PA01
cccucaggauagccggcgc

SEQ ID NO: 3380730 - RNA, 15 nt, Pseudomonas aeruginosa PA01
cccucaggcgccgcu

SEQ ID NO: 3380731 - RNA, 20 nt, Pseudomonas aeruginosa PA01
cccucaggggugcagcccug

SEQ ID NO: 3380732 - RNA, 21 nt, Pseudomonas aeruginosa PA01
cccucaggggugcagcccugg

SEQ ID NO: 3380733 - RNA, 15 nt, Pseudomonas aeruginosa PA01
cccucaggucggcgc

SEQ ID NO: 3380734 - RNA, 17 nt, Pseudomonas aeruginosa PA01
cccucagucgcccccac

SEQ ID NO: 3380735 - RNA, 20 nt, Pseudomonas aeruginosa PA01
cccucagucgcccccaccgc

SEQ ID NO: 3380736 - RNA, 20 nt, Pseudomonas aeruginosa PA01
cccucauggaaaccccggcc

SEQ ID NO: 3380737 - RNA, 18 nt, Pseudomonas aeruginosa PA01
cccucauggcuguagcuc

SEQ ID NO: 3380738 - RNA, 15 nt, Pseudomonas aeruginosa PA01
cccuccagcaccgcc

SEQ ID NO: 3380739 - RNA, 12 nt, Pseudomonas aeruginosa PA01
cccuccaggcga

SEQ ID NO: 3380740 - RNA, 14 nt, Pseudomonas aeruginosa PA01
cccuccaguuccug

SEQ ID NO: 3380741 - RNA, 22 nt, Pseudomonas aeruginosa PA01
cccuccaguuccugcuccuccg

SEQ ID NO: 3380742 - RNA, 21 nt, Pseudomonas aeruginosa PA01
cccuccaucagcgccuccauc

SEQ ID NO: 3380743 - RNA, 13 nt, Pseudomonas aeruginosa PA01
cccucccgcgcca

SEQ ID NO: 3380744 - RNA, 15 nt, Pseudomonas aeruginosa PA01
cccucccgcgccagc

SEQ ID NO: 3380745 - RNA, 16 nt, Pseudomonas aeruginosa PA01
cccucccgcgccagcg

SEQ ID NO: 3380746 - RNA, 18 nt, Pseudomonas aeruginosa PA01
cccucccuaucuccgccg

SEQ ID NO: 3380747 - RNA, 21 nt, Pseudomonas aeruginosa PA01
cccuccggcgcguuggcuggc

SEQ ID NO: 3380748 - RNA, 13 nt, Pseudomonas aeruginosa PA01
cccuccuccagca

SEQ ID NO: 3380749 - RNA, 23 nt, Pseudomonas aeruginosa PA01
cccuccugcucgauccagccggc

SEQ ID NO: 3380750 - RNA, 19 nt, Pseudomonas aeruginosa PA01
cccuccuggaaagaccggc

SEQ ID NO: 3380751 - RNA, 20 nt, Pseudomonas aeruginosa PA01
cccuccuggaaagaccggcg

SEQ ID NO: 3380752 - RNA, 13 nt, Pseudomonas aeruginosa PA01
cccuccugggccu

SEQ ID NO: 3380753 - RNA, 22 nt, Pseudomonas aeruginosa PA01
cccuccuucgagccuggccagg

SEQ ID NO: 3380754 - RNA, 14 nt, Pseudomonas aeruginosa PA01
cccucgaagcccug

SEQ ID NO: 3380755 - RNA, 15 nt, Pseudomonas aeruginosa PA01
cccucgaagcccugc

SEQ ID NO: 3380756 - RNA, 13 nt, Pseudomonas aeruginosa PA01
cccucgaccuggc

SEQ ID NO: 3380757 - RNA, 21 nt, Pseudomonas aeruginosa PA01
cccucgacgauauccacgccg

SEQ ID NO: 3380758 - RNA, 16 nt, Pseudomonas aeruginosa PA01
cccucgagcaccgcgg

SEQ ID NO: 3380759 - RNA, 19 nt, Pseudomonas aeruginosa PA01
cccucgagcaccgcggucu

SEQ ID NO: 3380760 - RNA, 22 nt, Pseudomonas aeruginosa PA01
cccucgauguaggccucggccu

SEQ ID NO: 3380761 - RNA, 14 nt, Pseudomonas aeruginosa PA01
cccucgcagccggc

SEQ ID NO: 3380762 - RNA, 15 nt, Pseudomonas aeruginosa PA01
cccucgcaguacagc

SEQ ID NO: 3380763 - RNA, 20 nt, Pseudomonas aeruginosa PA01
cccucgcaguacagcucggc

SEQ ID NO: 3380764 - RNA, 13 nt, Pseudomonas aeruginosa PA01
cccucgccauucu

SEQ ID NO: 3380765 - RNA, 17 nt, Pseudomonas aeruginosa PA01
cccucgcccaggugcgc

SEQ ID NO: 3380766 - RNA, 14 nt, Pseudomonas aeruginosa PA01
cccucgccgaccgc

SEQ ID NO: 3380767 - RNA, 18 nt, Pseudomonas aeruginosa PA01
cccucgccgaccgccaag

SEQ ID NO: 3380768 - RNA, 12 nt, Pseudomonas aeruginosa PA01
cccucgccguga

SEQ ID NO: 3380769 - RNA, 19 nt, Pseudomonas aeruginosa PA01
cccucgcgcuggacccgca

SEQ ID NO: 3380770 - RNA, 18 nt, Pseudomonas aeruginosa PA01
cccucgcggacgcuggcg

SEQ ID NO: 3380771 - RNA, 22 nt, Pseudomonas aeruginosa PA01
cccucgcggacgcuggcgauca

SEQ ID NO: 3380772 - RNA, 22 nt, Pseudomonas aeruginosa PA01
cccucgcggaucugcuccugca

SEQ ID NO: 3380773 - RNA, 13 nt, Pseudomonas aeruginosa PA01
cccucgcggcggc

SEQ ID NO: 3380774 - RNA, 20 nt, Pseudomonas aeruginosa PA01
cccucgcuccaacgcaggcg

SEQ ID NO: 3380775 - RNA, 13 nt, Pseudomonas aeruginosa PA01
cccucgcugagca

SEQ ID NO: 3380776 - RNA, 16 nt, Pseudomonas aeruginosa PA01
cccucggaugccgcac

SEQ ID NO: 3380777 - RNA, 14 nt, Pseudomonas aeruginosa PA01
cccucggccaggac

SEQ ID NO: 3380778 - RNA, 21 nt, Pseudomonas aeruginosa PA01
cccucggccaggaccagggcg

SEQ ID NO: 3380779 - RNA, 22 nt, Pseudomonas aeruginosa PA01
cccucggccaggaccagggcgg

SEQ ID NO: 3380780 - RNA, 23 nt, Pseudomonas aeruginosa PA01
cccucggccaggcauuccuccag

SEQ ID NO: 3380781 - RNA, 22 nt, Pseudomonas aeruginosa PA01
cccucggcgaccaacagggcgu

SEQ ID NO: 3380782 - RNA, 14 nt, Pseudomonas aeruginosa PA01
cccucggcgagggu

SEQ ID NO: 3380783 - RNA, 12 nt, Pseudomonas aeruginosa PA01
cccucggcgccc

SEQ ID NO: 3380784 - RNA, 14 nt, Pseudomonas aeruginosa PA01
cccucggcgcccgc

SEQ ID NO: 3380785 - RNA, 15 nt, Pseudomonas aeruginosa PA01
cccucggcgcccgcc

SEQ ID NO: 3380786 - RNA, 15 nt, Pseudomonas aeruginosa PA01
cccucggcgcuggcc

SEQ ID NO: 3380787 - RNA, 16 nt, Pseudomonas aeruginosa PA01
cccucggcgcuggcca

SEQ ID NO: 3380788 - RNA, 18 nt, Pseudomonas aeruginosa PA01
cccucggcgcuggccagg

SEQ ID NO: 3380789 - RNA, 15 nt, Pseudomonas aeruginosa PA01
cccucggcuucgucc

SEQ ID NO: 3380790 - RNA, 19 nt, Pseudomonas aeruginosa PA01
cccucggcuucguccugcu

SEQ ID NO: 3380791 - RNA, 15 nt, Pseudomonas aeruginosa PA01
cccucggggccgagg

SEQ ID NO: 3380792 - RNA, 19 nt, Pseudomonas aeruginosa PA01
cccucggggccgaggucga

SEQ ID NO: 3380793 - RNA, 22 nt, Pseudomonas aeruginosa PA01
cccucggugauaccgccggcgg

SEQ ID NO: 3380794 - RNA, 14 nt, Pseudomonas aeruginosa PA01
cccucggugcggcc

SEQ ID NO: 3380795 - RNA, 16 nt, Pseudomonas aeruginosa PA01
cccucggugcggccga

SEQ ID NO: 3380796 - RNA, 19 nt, Pseudomonas aeruginosa PA01
cccucggugcgguuggagc

SEQ ID NO: 3380797 - RNA, 14 nt, Pseudomonas aeruginosa PA01
cccucguggcgcga

SEQ ID NO: 3380798 - RNA, 14 nt, Pseudomonas aeruginosa PA01
cccucguggcgggu

SEQ ID NO: 3380799 - RNA, 20 nt, Pseudomonas aeruginosa PA01
cccucucaggagcgccgcgc

SEQ ID NO: 3380800 - RNA, 16 nt, Pseudomonas aeruginosa PA01
cccucucccugaaggg

SEQ ID NO: 3380801 - RNA, 20 nt, Pseudomonas aeruginosa PA01
cccuggcggauaucgcgccg

SEQ ID NO: 3380802 - RNA, 13 nt, Pseudomonas aeruginosa PA01
cccuggcggcgaa

SEQ ID NO: 3380803 - RNA, 17 nt, Pseudomonas aeruginosa PA01
cccuggcguggccggcg

SEQ ID NO: 3380804 - RNA, 18 nt, Pseudomonas aeruginosa PA01
cccuggcuuuccagggcc

SEQ ID NO: 3380805 - RNA, 20 nt, Pseudomonas aeruginosa PA01
cccuggcuuuccagggccug

SEQ ID NO: 3380806 - RNA, 19 nt, Pseudomonas aeruginosa PA01
cccugggaauggcggauag

SEQ ID NO: 3380807 - RNA, 15 nt, Pseudomonas aeruginosa PA01
cccugggagccgccg

SEQ ID NO: 3380808 - RNA, 16 nt, Pseudomonas aeruginosa PA01
cccugggagccgccgg

SEQ ID NO: 3380809 - RNA, 18 nt, Pseudomonas aeruginosa PA01
cccugggagccgccggac

SEQ ID NO: 3380810 - RNA, 17 nt, Pseudomonas aeruginosa PA01
cccugggaugccgccaa

SEQ ID NO: 3380811 - RNA, 19 nt, Pseudomonas aeruginosa PA01
cccugggaugccgccaagc

SEQ ID NO: 3380812 - RNA, 18 nt, Pseudomonas aeruginosa PA01
cccugggccccggccggc

SEQ ID NO: 3380813 - RNA, 13 nt, Pseudomonas aeruginosa PA01
cccugggcggcga

SEQ ID NO: 3380814 - RNA, 14 nt, Pseudomonas aeruginosa PA01
cccugggcguggca

SEQ ID NO: 3380815 - RNA, 14 nt, Pseudomonas aeruginosa PA01
cccugguacagcgc

SEQ ID NO: 3380816 - RNA, 23 nt, Pseudomonas aeruginosa PA01
cccugguaguccagcagguggcg

SEQ ID NO: 3380817 - RNA, 22 nt, Pseudomonas aeruginosa PA01
cccuggucgacauagcgcagca

SEQ ID NO: 3380818 - RNA, 17 nt, Pseudomonas aeruginosa PA01
cccugguugcggaacgg

SEQ ID NO: 3380819 - RNA, 22 nt, Pseudomonas aeruginosa PA01
cccugguugcggaacggcucgc

SEQ ID NO: 3380820 - RNA, 18 nt, Pseudomonas aeruginosa PA01
cccuguccccucacggcg

SEQ ID NO: 3380821 - RNA, 20 nt, Pseudomonas aeruginosa PA01
cccuguccccucacggcgcg

SEQ ID NO: 3380822 - RNA, 12 nt, Pseudomonas aeruginosa PA01
cccugucccgcc

SEQ ID NO: 3380823 - RNA, 18 nt, Pseudomonas aeruginosa PA01
cccugucccgccgcgccg

SEQ ID NO: 3380824 - RNA, 20 nt, Pseudomonas aeruginosa PA01
cccugucuaucugcguaacg

SEQ ID NO: 3380825 - RNA, 22 nt, Pseudomonas aeruginosa PA01
cccuguggucaggcgccaggac

SEQ ID NO: 3380826 - RNA, 21 nt, Pseudomonas aeruginosa PA01
cccugugguuggaaaagcccc

SEQ ID NO: 3380827 - RNA, 16 nt, Pseudomonas aeruginosa PA01
cccuguuccgggccca

SEQ ID NO: 3380828 - RNA, 20 nt, Pseudomonas aeruginosa PA01
cccuguucggcgggaucgac

SEQ ID NO: 3380829 - RNA, 18 nt, Pseudomonas aeruginosa PA01
cccuucaaaaaccaugcg

SEQ ID NO: 3380830 - RNA, 19 nt, Pseudomonas aeruginosa PA01
cccuucaaaaaccaugcgg

SEQ ID NO: 3380831 - RNA, 22 nt, Pseudomonas aeruginosa PA01
cccuucacguaguugacccgcc

SEQ ID NO: 3380832 - RNA, 17 nt, Pseudomonas aeruginosa PA01
cccuucagcgcaccgcc

SEQ ID NO: 3380833 - RNA, 14 nt, Pseudomonas aeruginosa PA01
cccuucagcgccuc

SEQ ID NO: 3380834 - RNA, 15 nt, Pseudomonas aeruginosa PA01
cccuucaucccuucu

SEQ ID NO: 3380835 - RNA, 15 nt, Pseudomonas aeruginosa PA01
cccuuccagccgccc

SEQ ID NO: 3380836 - RNA, 15 nt, Pseudomonas aeruginosa PA01
cccuuccagcgugug

SEQ ID NO: 3380837 - RNA, 18 nt, Pseudomonas aeruginosa PA01
cccuuccuccucgccgcu

SEQ ID NO: 3380838 - RNA, 15 nt, Pseudomonas aeruginosa PA01
cccuucgaacccgcc

SEQ ID NO: 3380839 - RNA, 21 nt, Pseudomonas aeruginosa PA01
cccuucgacaugggccgcgca

SEQ ID NO: 3380840 - RNA, 23 nt, Pseudomonas aeruginosa PA01
cccuucgacaugggccgcgcaga

SEQ ID NO: 3380841 - RNA, 11 nt, Pseudomonas aeruginosa PA01
cccuucgcccu

SEQ ID NO: 3380842 - RNA, 20 nt, Pseudomonas aeruginosa PA01
cccuucggucgcgccccgcc

SEQ ID NO: 3380843 - RNA, 23 nt, Pseudomonas aeruginosa PA01
cccuucguccucguggcgcgccg

SEQ ID NO: 3380844 - RNA, 15 nt, Pseudomonas aeruginosa PA01
cccuucgugcuggcg

SEQ ID NO: 3380845 - RNA, 14 nt, Pseudomonas aeruginosa PA01
cccuucuccgccag

SEQ ID NO: 3380846 - RNA, 15 nt, Pseudomonas aeruginosa PA01
cccuucuccgccagc

SEQ ID NO: 3380847 - RNA, 20 nt, Pseudomonas aeruginosa PA01
cccuucuuuuauacccggcg

SEQ ID NO: 3380848 - RNA, 21 nt, Pseudomonas aeruginosa PA01
cccuucuuuuuuucaccgcuc

SEQ ID NO: 3380849 - RNA, 16 nt, Pseudomonas aeruginosa PA01
cccuugaagcgcuucu

SEQ ID NO: 3380850 - RNA, 21 nt, Pseudomonas aeruginosa PA01
cccuugaagcgcuucugcagg

SEQ ID NO: 3380851 - RNA, 14 nt, Pseudomonas aeruginosa PA01
cccuugagcgcguu

SEQ ID NO: 3380852 - RNA, 17 nt, Pseudomonas aeruginosa PA01
cccuugaugaucagguc

SEQ ID NO: 3380853 - RNA, 23 nt, Pseudomonas aeruginosa PA01
cccuugaugaucaggucggccgc

SEQ ID NO: 3380854 - RNA, 17 nt, Pseudomonas aeruginosa PA01
cccuugcaaccgccgcc

SEQ ID NO: 3380855 - RNA, 14 nt, Pseudomonas aeruginosa PA01
cccuugcagccagc

SEQ ID NO: 3380856 - RNA, 20 nt, Pseudomonas aeruginosa PA01
cccuugccauccuccagcac

SEQ ID NO: 3380857 - RNA, 12 nt, Pseudomonas aeruginosa PA01
cccuugccgguc

SEQ ID NO: 3380858 - RNA, 12 nt, Pseudomonas aeruginosa PA01
cccuugcgccgc

SEQ ID NO: 3380859 - RNA, 15 nt, Pseudomonas aeruginosa PA01
cccuugcgcggcgca

SEQ ID NO: 3380860 - RNA, 16 nt, Pseudomonas aeruginosa PA01
cccuugcggcccgccu

SEQ ID NO: 3380861 - RNA, 19 nt, Pseudomonas aeruginosa PA01
cccuugcguccugccucgg

SEQ ID NO: 3380862 - RNA, 14 nt, Pseudomonas aeruginosa PA01
cccuugcucccgcc

SEQ ID NO: 3380863 - RNA, 15 nt, Pseudomonas aeruginosa PA01
cccuugcucgcggcg

SEQ ID NO: 3380864 - RNA, 13 nt, Pseudomonas aeruginosa PA01
cccuuggccagcg

SEQ ID NO: 3380865 - RNA, 15 nt, Pseudomonas aeruginosa PA01
cccuuggccagcgcg

SEQ ID NO: 3380866 - RNA, 18 nt, Pseudomonas aeruginosa PA01
cccuuggcgucgcggcuu

SEQ ID NO: 3380867 - RNA, 20 nt, Pseudomonas aeruginosa PA01
cccuuggcugcucgccucgg

SEQ ID NO: 3380868 - RNA, 21 nt, Pseudomonas aeruginosa PA01
cccuuguacagcuucaggcgc

SEQ ID NO: 3380869 - RNA, 22 nt, Pseudomonas aeruginosa PA01
cccuuguagaucgacagccacu

SEQ ID NO: 3380870 - RNA, 14 nt, Pseudomonas aeruginosa PA01
cccuuguccggccc

SEQ ID NO: 3380871 - RNA, 20 nt, Pseudomonas aeruginosa PA01
cccuugucgcccuucuucca

SEQ ID NO: 3380872 - RNA, 17 nt, Pseudomonas aeruginosa PA01
cccuuguuuuccuggcc

SEQ ID NO: 3380873 - RNA, 20 nt, Pseudomonas aeruginosa PA01
cccuuguuuuccuggcccug

SEQ ID NO: 3380874 - RNA, 13 nt, Pseudomonas aeruginosa PA01
cccuuuuccucca

SEQ ID NO: 3380875 - RNA, 14 nt, Pseudomonas aeruginosa PA01
cccuuuuucggcgc

SEQ ID NO: 3380876 - RNA, 15 nt, Pseudomonas aeruginosa PA01
cccuuuuucggcgcg

SEQ ID NO: 3380877 - RNA, 19 nt, Pseudomonas aeruginosa PA01
cccuuuuucggcgcggacc

SEQ ID NO: 3380878 - RNA, 22 nt, Pseudomonas aeruginosa PA01
cccuuuuucgucgccagcccgg

SEQ ID NO: 3380879 - RNA, 16 nt, Pseudomonas aeruginosa PA01
cccuuuuuucagccug

SEQ ID NO: 3380880 - RNA, 20 nt, Pseudomonas aeruginosa PA01
cccuuuuuucaugggcaucu

SEQ ID NO: 3380881 - RNA, 15 nt, Pseudomonas aeruginosa PA01
ccgaaaagaaaaggc

SEQ ID NO: 3380882 - RNA, 15 nt, Pseudomonas aeruginosa PA01
ccgaaacgccgacgg

SEQ ID NO: 3380883 - RNA, 22 nt, Pseudomonas aeruginosa PA01
ccgaaaucgaugucgcggcgcu

SEQ ID NO: 3380884 - RNA, 22 nt, Pseudomonas aeruginosa PA01
ccgaaauggcgguggccguggg

SEQ ID NO: 3380885 - RNA, 12 nt, Pseudomonas aeruginosa PA01
ccgaacaccagc

SEQ ID NO: 3380886 - RNA, 14 nt, Pseudomonas aeruginosa PA01
ccgaacagaggaag

SEQ ID NO: 3380887 - RNA, 21 nt, Pseudomonas aeruginosa PA01
ccgaacagaggaaggcgccgg

SEQ ID NO: 3380888 - RNA, 22 nt, Pseudomonas aeruginosa PA01
ccgaacagaggaaggcgccggc

SEQ ID NO: 3380889 - RNA, 23 nt, Pseudomonas aeruginosa PA01
ccgaacagaggaaggcgccggca

SEQ ID NO: 3380890 - RNA, 17 nt, Pseudomonas aeruginosa PA01
ccgaacagcaacaccgc

SEQ ID NO: 3380891 - RNA, 19 nt, Pseudomonas aeruginosa PA01
ccgaacagcaacaccgcgc

SEQ ID NO: 3380892 - RNA, 14 nt, Pseudomonas aeruginosa PA01
ccgaacagccgccc

SEQ ID NO: 3380893 - RNA, 21 nt, Pseudomonas aeruginosa PA01
ccgaacagccgccccaccacc

SEQ ID NO: 3380894 - RNA, 17 nt, Pseudomonas aeruginosa PA01
ccgaacaggcgacggua

SEQ ID NO: 3380895 - RNA, 17 nt, Pseudomonas aeruginosa PA01
ccgaacaggcgucccau

SEQ ID NO: 3380896 - RNA, 23 nt, Pseudomonas aeruginosa PA01
ccgaacaggcgucccauggcgcc

SEQ ID NO: 3380897 - RNA, 13 nt, Pseudomonas aeruginosa PA01
ccgaacagggcga

SEQ ID NO: 3380898 - RNA, 20 nt, Pseudomonas aeruginosa PA01
ccgaacagggcgaaggccac

SEQ ID NO: 3380899 - RNA, 14 nt, Pseudomonas aeruginosa PA01
ccgaacagggcgag

SEQ ID NO: 3380900 - RNA, 22 nt, Pseudomonas aeruginosa PA01
ccgaacagggcgagcagggcgc

SEQ ID NO: 3380901 - RNA, 16 nt, Pseudomonas aeruginosa PA01
ccgaacaguucggcgg

SEQ ID NO: 3380902 - RNA, 16 nt, Pseudomonas aeruginosa PA01
ccgaacaucagcagca

SEQ ID NO: 3380903 - RNA, 22 nt, Pseudomonas aeruginosa PA01
ccgacauccugucgaggccucg

SEQ ID NO: 3380904 - RNA, 21 nt, Pseudomonas aeruginosa PA01
ccgacaucggagugcaugccg

SEQ ID NO: 3380905 - RNA, 19 nt, Pseudomonas aeruginosa PA01
ccgacaugccccgccgacu

SEQ ID NO: 3380906 - RNA, 20 nt, Pseudomonas aeruginosa PA01
ccgaccacaugggcgaccgg

SEQ ID NO: 3380907 - RNA, 18 nt, Pseudomonas aeruginosa PA01
ccgaccaccaucaccgcc

SEQ ID NO: 3380908 - RNA, 19 nt, Pseudomonas aeruginosa PA01
ccgaccaccuucaggcugc

SEQ ID NO: 3380909 - RNA, 21 nt, Pseudomonas aeruginosa PA01
ccgaccacgaccgcguccaug

SEQ ID NO: 3380910 - RNA, 22 nt, Pseudomonas aeruginosa PA01
ccgaccacguaguaggcgcggg

SEQ ID NO: 3380911 - RNA, 16 nt, Pseudomonas aeruginosa PA01
ccgaccacuuccaggu

SEQ ID NO: 3380912 - RNA, 22 nt, Pseudomonas aeruginosa PA01
ccgaccacuuccagguagccca

SEQ ID NO: 3380913 - RNA, 17 nt, Pseudomonas aeruginosa PA01
ccgaccacuucggcggu

SEQ ID NO: 3380914 - RNA, 20 nt, Pseudomonas aeruginosa PA01
ccgaccacuucggcgguggg

SEQ ID NO: 3380915 - RNA, 13 nt, Pseudomonas aeruginosa PA01
ccgaccagcaaca

SEQ ID NO: 3380916 - RNA, 21 nt, Pseudomonas aeruginosa PA01
ccgaccagcagggccagcagc

SEQ ID NO: 3380917 - RNA, 13 nt, Pseudomonas aeruginosa PA01
ccgaccagccgca

SEQ ID NO: 3380918 - RNA, 13 nt, Pseudomonas aeruginosa PA01
ccgaccagcgccg

SEQ ID NO: 3380919 - RNA, 19 nt, Pseudomonas aeruginosa PA01
ccgaccagcgccgacuugc

SEQ ID NO: 3380920 - RNA, 12 nt, Pseudomonas aeruginosa PA01
ccgaccagcgcg

SEQ ID NO: 3380921 - RNA, 13 nt, Pseudomonas aeruginosa PA01
ccgaccagcgcgc

SEQ ID NO: 3380922 - RNA, 13 nt, Pseudomonas aeruginosa PA01
ccgaccaggccga

SEQ ID NO: 3380923 - RNA, 14 nt, Pseudomonas aeruginosa PA01
ccgaccaggccgau

SEQ ID NO: 3380924 - RNA, 20 nt, Pseudomonas aeruginosa PA01
ccgaccaggccguaggcgau

SEQ ID NO: 3380925 - RNA, 15 nt, Pseudomonas aeruginosa PA01
ccgaccaggcggccg

SEQ ID NO: 3380926 - RNA, 21 nt, Pseudomonas aeruginosa PA01
ccgaccaggcggccgucggcc

SEQ ID NO: 3380927 - RNA, 18 nt, Pseudomonas aeruginosa PA01
ccgaccagguccgccacu

SEQ ID NO: 3380928 - RNA, 20 nt, Pseudomonas aeruginosa PA01
ccgaccaggucgcuggcacc

SEQ ID NO: 3380929 - RNA, 22 nt, Pseudomonas aeruginosa PA01
ccgaccaggucgcuggcaccgg

SEQ ID NO: 3380930 - RNA, 16 nt, Pseudomonas aeruginosa PA01
ccgaccaguaccagca

SEQ ID NO: 3380931 - RNA, 18 nt, Pseudomonas aeruginosa PA01
ccgaccaguaccagcaau

SEQ ID NO: 3380932 - RNA, 17 nt, Pseudomonas aeruginosa PA01
ccgacccacuugaacac

SEQ ID NO: 3380933 - RNA, 16 nt, Pseudomonas aeruginosa PA01
ccgaccccacgccggc

SEQ ID NO: 3380934 - RNA, 17 nt, Pseudomonas aeruginosa PA01
ccgaccccacgccggcc

SEQ ID NO: 3380935 - RNA, 19 nt, Pseudomonas aeruginosa PA01
ccgaccccacgccggccgg

SEQ ID NO: 3380936 - RNA, 20 nt, Pseudomonas aeruginosa PA01
ccgaccccacgccggccggc

SEQ ID NO: 3380937 - RNA, 21 nt, Pseudomonas aeruginosa PA01
ccgaccccacgccggccggcu

SEQ ID NO: 3380938 - RNA, 15 nt, Pseudomonas aeruginosa PA01
ccgacccgcagcggc

SEQ ID NO: 3380939 - RNA, 17 nt, Pseudomonas aeruginosa PA01
ccgacccgcagcggcgc

SEQ ID NO: 3380940 - RNA, 17 nt, Pseudomonas aeruginosa PA01
ccgacccgcaggccggc

SEQ ID NO: 3380941 - RNA, 21 nt, Pseudomonas aeruginosa PA01
ccgacccgcaggccggccagg

SEQ ID NO: 3380942 - RNA, 17 nt, Pseudomonas aeruginosa PA01
ccgacccgcuccggacu

SEQ ID NO: 3380943 - RNA, 13 nt, Pseudomonas aeruginosa PA01
ccgacccggccga

SEQ ID NO: 3380944 - RNA, 15 nt, Pseudomonas aeruginosa PA01
ccgacccggccgacc

SEQ ID NO: 3380945 - RNA, 16 nt, Pseudomonas aeruginosa PA01
ccgacccuagggucgg

SEQ ID NO: 3380946 - RNA, 16 nt, Pseudomonas aeruginosa PA01
ccgacccucggcgagg

SEQ ID NO: 3380947 - RNA, 23 nt, Pseudomonas aeruginosa PA01
ccgaccgacuuggcagucgccgc

SEQ ID NO: 3380948 - RNA, 20 nt, Pseudomonas aeruginosa PA01
ccgaccgagcagcggacgca

SEQ ID NO: 3380949 - RNA, 16 nt, Pseudomonas aeruginosa PA01
ccgaccgcaccgccag

SEQ ID NO: 3380950 - RNA, 14 nt, Pseudomonas aeruginosa PA01
ccgaccgccaaggu

SEQ ID NO: 3380951 - RNA, 22 nt, Pseudomonas aeruginosa PA01
ccgaccgccaggccgacccgca

SEQ ID NO: 3380952 - RNA, 21 nt, Pseudomonas aeruginosa PA01
ccgaccgcgaguucgccggcc

SEQ ID NO: 3380953 - RNA, 14 nt, Pseudomonas aeruginosa PA01
ccgaccggacuccg

SEQ ID NO: 3380954 - RNA, 16 nt, Pseudomonas aeruginosa PA01
ccgaccggacuccgcg

SEQ ID NO: 3380955 - RNA, 20 nt, Pseudomonas aeruginosa PA01
ccgaccggggaguucgaccc

SEQ ID NO: 3380956 - RNA, 17 nt, Pseudomonas aeruginosa PA01
ccgaccgguuccagcgg

SEQ ID NO: 3380957 - RNA, 18 nt, Pseudomonas aeruginosa PA01
ccgaccgguuccagcggc

SEQ ID NO: 3380958 - RNA, 13 nt, Pseudomonas aeruginosa PA01
ccgaccucggccg

SEQ ID NO: 3380959 - RNA, 16 nt, Pseudomonas aeruginosa PA01
ccgaccucggccgcca

SEQ ID NO: 3380960 - RNA, 22 nt, Pseudomonas aeruginosa PA01
ccgaccucggccgccagggcgu

SEQ ID NO: 3380961 - RNA, 22 nt, Pseudomonas aeruginosa PA01
ccgaccuggggcggccucaggc

SEQ ID NO: 3380962 - RNA, 17 nt, Pseudomonas aeruginosa PA01
ccgaccuguaccgcucc

SEQ ID NO: 3380963 - RNA, 17 nt, Pseudomonas aeruginosa PA01
ccgaccuucaccaccag

SEQ ID NO: 3380964 - RNA, 19 nt, Pseudomonas aeruginosa PA01
ccgaccuucaccaccagcg

SEQ ID NO: 3380965 - RNA, 17 nt, Pseudomonas aeruginosa PA01
ccgaccuucaucaggcg

SEQ ID NO: 3380966 - RNA, 20 nt, Pseudomonas aeruginosa PA01
ccgaccuucaucaggcggca

SEQ ID NO: 3380967 - RNA, 14 nt, Pseudomonas aeruginosa PA01
ccgaccuugccggu

SEQ ID NO: 3380968 - RNA, 16 nt, Pseudomonas aeruginosa PA01
ccgaccuugcgucuuc

SEQ ID NO: 3380969 - RNA, 24 nt, Pseudomonas aeruginosa PA01
ccgaccuuugagggucagaccagc

SEQ ID NO: 3380970 - RNA, 21 nt, Pseudomonas aeruginosa PA01
ccgacgaaguugcaggccagc

SEQ ID NO: 3380971 - RNA, 19 nt, Pseudomonas aeruginosa PA01
ccgacgacccggauacccc

SEQ ID NO: 3380972 - RNA, 19 nt, Pseudomonas aeruginosa PA01
ccgacgagcagcucgccgg

SEQ ID NO: 3380973 - RNA, 22 nt, Pseudomonas aeruginosa PA01
ccgacgagcagcucgccggcgu

SEQ ID NO: 3380974 - RNA, 16 nt, Pseudomonas aeruginosa PA01
ccgacgaugggcacga

SEQ ID NO: 3380975 - RNA, 23 nt, Pseudomonas aeruginosa PA01
ccgacgauguucgaggcgccgac

SEQ ID NO: 3380976 - RNA, 23 nt, Pseudomonas aeruginosa PA01
ccgacgauguuguugcccaccag

SEQ ID NO: 3380977 - RNA, 14 nt, Pseudomonas aeruginosa PA01
ccgacgccaccagc

SEQ ID NO: 3380978 - RNA, 18 nt, Pseudomonas aeruginosa PA01
ccgacgccaccagccagg

SEQ ID NO: 3380979 - RNA, 19 nt, Pseudomonas aeruginosa PA01
ccgacgccaccagccaggc

SEQ ID NO: 3380980 - RNA, 13 nt, Pseudomonas aeruginosa PA01
ccgacgcccccca

SEQ ID NO: 3380981 - RNA, 18 nt, Pseudomonas aeruginosa PA01
ccgacgcccuccagcacc

SEQ ID NO: 3380982 - RNA, 20 nt, Pseudomonas aeruginosa PA01
ccgacgcccuccagcaccgc

SEQ ID NO: 3380983 - RNA, 22 nt, Pseudomonas aeruginosa PA01
ccgacgccgaaggacaggccgu

SEQ ID NO: 3380984 - RNA, 15 nt, Pseudomonas aeruginosa PA01
ccgacgccgcccggc

SEQ ID NO: 3380985 - RNA, 16 nt, Pseudomonas aeruginosa PA01
ccgacgccgcccggca

SEQ ID NO: 3380986 - RNA, 12 nt, Pseudomonas aeruginosa PA01
ccgacgccgccu

SEQ ID NO: 3380987 - RNA, 13 nt, Pseudomonas aeruginosa PA01
ccgacgccgccug

SEQ ID NO: 3380988 - RNA, 17 nt, Pseudomonas aeruginosa PA01
ccgacgccgccugcgcc

SEQ ID NO: 3380989 - RNA, 19 nt, Pseudomonas aeruginosa PA01
ccgacgccgccugcgccuc

SEQ ID NO: 3380990 - RNA, 14 nt, Pseudomonas aeruginosa PA01
ccgacgccgcggcc

SEQ ID NO: 3380991 - RNA, 15 nt, Pseudomonas aeruginosa PA01
ccgacgccgcggccg

SEQ ID NO: 3380992 - RNA, 16 nt, Pseudomonas aeruginosa PA01
ccgacgccgcggccgg

SEQ ID NO: 3380993 - RNA, 18 nt, Pseudomonas aeruginosa PA01
ccgacgccgcggccggcg

SEQ ID NO: 3380994 - RNA, 14 nt, Pseudomonas aeruginosa PA01
ccgacgccgcgucc

SEQ ID NO: 3380995 - RNA, 23 nt, Pseudomonas aeruginosa PA01
ccgacgccggacgcaccagcagg

SEQ ID NO: 3380996 - RNA, 15 nt, Pseudomonas aeruginosa PA01
ccgacgcgucguccg

SEQ ID NO: 3380997 - RNA, 16 nt, Pseudomonas aeruginosa PA01
ccgacgcgucguccga

SEQ ID NO: 3380998 - RNA, 14 nt, Pseudomonas aeruginosa PA01
ccgacgcucgcggc

SEQ ID NO: 3380999 - RNA, 17 nt, Pseudomonas aeruginosa PA01
ccgacgcucgcggcauc

SEQ ID NO: 3381000 - RNA, 23 nt, Pseudomonas aeruginosa PA01
ccgacgcugaggaucacgauggc

SEQ ID NO: 3381001 - RNA, 18 nt, Pseudomonas aeruginosa PA01
ccgacgcuguugccggca

SEQ ID NO: 3381002 - RNA, 19 nt, Pseudomonas aeruginosa PA01
ccgacgcuuccucgcucgc

SEQ ID NO: 3381003 - RNA, 18 nt, Pseudomonas aeruginosa PA01
ccgacggacguccuccug

SEQ ID NO: 3381004 - RNA, 23 nt, Pseudomonas aeruginosa PA01
ccgacggagucggugugaccuuc

SEQ ID NO: 3381005 - RNA, 23 nt, Pseudomonas aeruginosa PA01
ccgagcgccgccaggcaggccgg

SEQ ID NO: 3381006 - RNA, 13 nt, Pseudomonas aeruginosa PA01
ccgagcgccgccu

SEQ ID NO: 3381007 - RNA, 15 nt, Pseudomonas aeruginosa PA01
ccgagcgccgccugg

SEQ ID NO: 3381008 - RNA, 16 nt, Pseudomonas aeruginosa PA01
ccgagcgccgccuggg

SEQ ID NO: 3381009 - RNA, 12 nt, Pseudomonas aeruginosa PA01
ccgagcgccugg

SEQ ID NO: 3381010 - RNA, 17 nt, Pseudomonas aeruginosa PA01
ccgagcgccuggcaacc

SEQ ID NO: 3381011 - RNA, 12 nt, Pseudomonas aeruginosa PA01
ccgagcgcgagu

SEQ ID NO: 3381012 - RNA, 19 nt, Pseudomonas aeruginosa PA01
ccgagcgcgagugcagcga

SEQ ID NO: 3381013 - RNA, 21 nt, Pseudomonas aeruginosa PA01
ccgagcgcgagugcagcgagu

SEQ ID NO: 3381014 - RNA, 18 nt, Pseudomonas aeruginosa PA01
ccgagcgcgaucagccgc

SEQ ID NO: 3381015 - RNA, 12 nt, Pseudomonas aeruginosa PA01
ccgagcgcgccg

SEQ ID NO: 3381016 - RNA, 14 nt, Pseudomonas aeruginosa PA01
ccgagcgcgccgcc

SEQ ID NO: 3381017 - RNA, 16 nt, Pseudomonas aeruginosa PA01
ccgagcgcgccgccga

SEQ ID NO: 3381018 - RNA, 16 nt, Pseudomonas aeruginosa PA01
ccgagcggcaaggcca

SEQ ID NO: 3381019 - RNA, 13 nt, Pseudomonas aeruginosa PA01
ccgagcggcgcga

SEQ ID NO: 3381020 - RNA, 21 nt, Pseudomonas aeruginosa PA01
ccgagcgugcgcaugcccgcg

SEQ ID NO: 3381021 - RNA, 21 nt, Pseudomonas aeruginosa PA01
ccgagcguggugcuaucgaug

SEQ ID NO: 3381022 - RNA, 23 nt, Pseudomonas aeruginosa PA01
ccgagcguugggccucgcugcgc

SEQ ID NO: 3381023 - RNA, 15 nt, Pseudomonas aeruginosa PA01
ccgagcugaccacca

SEQ ID NO: 3381024 - RNA, 18 nt, Pseudomonas aeruginosa PA01
ccgagcugaucgcgcaga

SEQ ID NO: 3381025 - RNA, 15 nt, Pseudomonas aeruginosa PA01
ccgagcugccgcacc

SEQ ID NO: 3381026 - RNA, 17 nt, Pseudomonas aeruginosa PA01
ccgagcugccgcaccgc

SEQ ID NO: 3381027 - RNA, 15 nt, Pseudomonas aeruginosa PA01
ccgagcugccgggcg

SEQ ID NO: 3381028 - RNA, 15 nt, Pseudomonas aeruginosa PA01
ccgagcuggcgcgcg

SEQ ID NO: 3381029 - RNA, 22 nt, Pseudomonas aeruginosa PA01
ccgagcuggcgcgcgucgaugc

SEQ ID NO: 3381030 - RNA, 15 nt, Pseudomonas aeruginosa PA01
ccgagcuugaccuug

SEQ ID NO: 3381031 - RNA, 20 nt, Pseudomonas aeruginosa PA01
ccgagcuugaccuugccgcc

SEQ ID NO: 3381032 - RNA, 22 nt, Pseudomonas aeruginosa PA01
ccgagcuugaccuugccgccgg

SEQ ID NO: 3381033 - RNA, 17 nt, Pseudomonas aeruginosa PA01
ccgagcuuugcgcagcc

SEQ ID NO: 3381034 - RNA, 19 nt, Pseudomonas aeruginosa PA01
ccgaggaacauccgcggcc

SEQ ID NO: 3381035 - RNA, 15 nt, Pseudomonas aeruginosa PA01
ccgaggaacgccgac

SEQ ID NO: 3381036 - RNA, 16 nt, Pseudomonas aeruginosa PA01
ccgaggaacgccgaca

SEQ ID NO: 3381037 - RNA, 20 nt, Pseudomonas aeruginosa PA01
ccgaggaacgccgacaggcc

SEQ ID NO: 3381038 - RNA, 20 nt, Pseudomonas aeruginosa PA01
ccgaggaacuccuccucgcu

SEQ ID NO: 3381039 - RNA, 20 nt, Pseudomonas aeruginosa PA01
ccgaggaacucgcggucccg

SEQ ID NO: 3381040 - RNA, 20 nt, Pseudomonas aeruginosa PA01
ccgaggaacuucaugaugcg

SEQ ID NO: 3381041 - RNA, 22 nt, Pseudomonas aeruginosa PA01
ccgaggaacuucaugaugcgcc

SEQ ID NO: 3381042 - RNA, 16 nt, Pseudomonas aeruginosa PA01
ccgaggaagccgaccg

SEQ ID NO: 3381043 - RNA, 22 nt, Pseudomonas aeruginosa PA01
ccgaggaagccgaccggcgccg

SEQ ID NO: 3381044 - RNA, 23 nt, Pseudomonas aeruginosa PA01
ccgaggaagccgaccggcgccgg

SEQ ID NO: 3381045 - RNA, 21 nt, Pseudomonas aeruginosa PA01
ccgaggaaggcgcuggcgcug

SEQ ID NO: 3381046 - RNA, 23 nt, Pseudomonas aeruginosa PA01
ccgaggaaggcgcuggcgcugua

SEQ ID NO: 3381047 - RNA, 14 nt, Pseudomonas aeruginosa PA01
ccgaggagaaaccg

SEQ ID NO: 3381048 - RNA, 23 nt, Pseudomonas aeruginosa PA01
ccgaggagacgcggcaugaagcu

SEQ ID NO: 3381049 - RNA, 18 nt, Pseudomonas aeruginosa PA01
ccgaggaggaucucgcgc

SEQ ID NO: 3381050 - RNA, 22 nt, Pseudomonas aeruginosa PA01
ccgaggaggaucucgcgccccg

SEQ ID NO: 3381051 - RNA, 20 nt, Pseudomonas aeruginosa PA01
ccgaggauagcguccagcuc

SEQ ID NO: 3381052 - RNA, 17 nt, Pseudomonas aeruginosa PA01
ccgaggaucggcacgaa

SEQ ID NO: 3381053 - RNA, 15 nt, Pseudomonas aeruginosa PA01
ccgaggccaccacuu

SEQ ID NO: 3381054 - RNA, 18 nt, Pseudomonas aeruginosa PA01
ccgaggccagcaggccgu

SEQ ID NO: 3381055 - RNA, 16 nt, Pseudomonas aeruginosa PA01
ccgaggcccagcgacu

SEQ ID NO: 3381056 - RNA, 12 nt, Pseudomonas aeruginosa PA01
ccgaggccggcg

SEQ ID NO: 3381057 - RNA, 12 nt, Pseudomonas aeruginosa PA01
ccgaggcgaacg

SEQ ID NO: 3381058 - RNA, 14 nt, Pseudomonas aeruginosa PA01
ccgaggcgaacggc

SEQ ID NO: 3381059 - RNA, 13 nt, Pseudomonas aeruginosa PA01
ccgaggcgacgcc

SEQ ID NO: 3381060 - RNA, 16 nt, Pseudomonas aeruginosa PA01
ccgaggcgaucgccgc

SEQ ID NO: 3381061 - RNA, 21 nt, Pseudomonas aeruginosa PA01
ccgaggcgaucgccgcggcga

SEQ ID NO: 3381062 - RNA, 13 nt, Pseudomonas aeruginosa PA01
ccgaggcgcgcca

SEQ ID NO: 3381063 - RNA, 21 nt, Pseudomonas aeruginosa PA01
ccgaggcgcgccacgcaaucc

SEQ ID NO: 3381064 - RNA, 13 nt, Pseudomonas aeruginosa PA01
ccgaggcgcgccg

SEQ ID NO: 3381065 - RNA, 14 nt, Pseudomonas aeruginosa PA01
ccgaggcgcgccga

SEQ ID NO: 3381066 - RNA, 19 nt, Pseudomonas aeruginosa PA01
ccgaggcgcgccgacagca

SEQ ID NO: 3381067 - RNA, 21 nt, Pseudomonas aeruginosa PA01
ccgaggcgcgccgacagcacg

SEQ ID NO: 3381068 - RNA, 21 nt, Pseudomonas aeruginosa PA01
ccgaggcgcuucugcucggcc

SEQ ID NO: 3381069 - RNA, 23 nt, Pseudomonas aeruginosa PA01
ccgaggcgcuucugcucggccug

SEQ ID NO: 3381070 - RNA, 15 nt, Pseudomonas aeruginosa PA01
ccgaggcggaagacg

SEQ ID NO: 3381071 - RNA, 21 nt, Pseudomonas aeruginosa PA01
ccgaggcggauuugccgccga

SEQ ID NO: 3381072 - RNA, 13 nt, Pseudomonas aeruginosa PA01
ccgaggcggccga

SEQ ID NO: 3381073 - RNA, 18 nt, Pseudomonas aeruginosa PA01
ccgaggcggccguagccg

SEQ ID NO: 3381074 - RNA, 23 nt, Pseudomonas aeruginosa PA01
ccgaggcggccguagccgucgaa

SEQ ID NO: 3381075 - RNA, 21 nt, Pseudomonas aeruginosa PA01
ccgaggcguuauccgccgaua

SEQ ID NO: 3381076 - RNA, 14 nt, Pseudomonas aeruginosa PA01
ccgaggcugcgggc

SEQ ID NO: 3381077 - RNA, 19 nt, Pseudomonas aeruginosa PA01
ccgaggcuuccucgaagaa

SEQ ID NO: 3381078 - RNA, 14 nt, Pseudomonas aeruginosa PA01
ccgaggcuuuccag

SEQ ID NO: 3381079 - RNA, 21 nt, Pseudomonas aeruginosa PA01
ccgaggcuuuccagcaggcgc

SEQ ID NO: 3381080 - RNA, 19 nt, Pseudomonas aeruginosa PA01
ccgagggaggaggcgccgg

SEQ ID NO: 3381081 - RNA, 16 nt, Pseudomonas aeruginosa PA01
ccgagggcaccgacga

SEQ ID NO: 3381082 - RNA, 17 nt, Pseudomonas aeruginosa PA01
ccgagggccgcgccgac

SEQ ID NO: 3381083 - RNA, 18 nt, Pseudomonas aeruginosa PA01
ccgagggccgcgccgacc

SEQ ID NO: 3381084 - RNA, 20 nt, Pseudomonas aeruginosa PA01
ccgagggccgcgccgaccca

SEQ ID NO: 3381085 - RNA, 12 nt, Pseudomonas aeruginosa PA01
ccgagggcgaag

SEQ ID NO: 3381086 - RNA, 13 nt, Pseudomonas aeruginosa PA01
ccgagggcgaaga

SEQ ID NO: 3381087 - RNA, 19 nt, Pseudomonas aeruginosa PA01
ccgagggcgaguucggcga

SEQ ID NO: 3381088 - RNA, 16 nt, Pseudomonas aeruginosa PA01
ccgagggcgccaggug

SEQ ID NO: 3381089 - RNA, 16 nt, Pseudomonas aeruginosa PA01
ccgagggcgcgcagua

SEQ ID NO: 3381090 - RNA, 15 nt, Pseudomonas aeruginosa PA01
ccgagggcgcggcgc

SEQ ID NO: 3381091 - RNA, 21 nt, Pseudomonas aeruginosa PA01
ccgagggcgcggcgccagcgc

SEQ ID NO: 3381092 - RNA, 12 nt, Pseudomonas aeruginosa PA01
ccgagggcggca

SEQ ID NO: 3381093 - RNA, 18 nt, Pseudomonas aeruginosa PA01
ccgagggcugagacgcug

SEQ ID NO: 3381094 - RNA, 16 nt, Pseudomonas aeruginosa PA01
ccgagggcugccgccc

SEQ ID NO: 3381095 - RNA, 17 nt, Pseudomonas aeruginosa PA01
ccgagggcugccgcccg

SEQ ID NO: 3381096 - RNA, 20 nt, Pseudomonas aeruginosa PA01
ccgagggcuguaaucgccgc

SEQ ID NO: 3381097 - RNA, 20 nt, Pseudomonas aeruginosa PA01
ccgagggucgccuugaccag

SEQ ID NO: 3381098 - RNA, 16 nt, Pseudomonas aeruginosa PA01
ccgagggugcagagca

SEQ ID NO: 3381099 - RNA, 14 nt, Pseudomonas aeruginosa PA01
ccgaggguggcgcu

SEQ ID NO: 3381100 - RNA, 16 nt, Pseudomonas aeruginosa PA01
ccgaggguggcgcugg

SEQ ID NO: 3381101 - RNA, 19 nt, Pseudomonas aeruginosa PA01
ccgaggguggcgcuggcca

SEQ ID NO: 3381102 - RNA, 15 nt, Pseudomonas aeruginosa PA01
ccgaggguguagagg

SEQ ID NO: 3381103 - RNA, 22 nt, Pseudomonas aeruginosa PA01
ccgagguaguaggucugguagu

SEQ ID NO: 3381104 - RNA, 23 nt, Pseudomonas aeruginosa PA01
ccgaggucaguucggugccgccg

SEQ ID NO: 3381105 - RNA, 15 nt, Pseudomonas aeruginosa PA01
ccgaggucgccgcca

SEQ ID NO: 3381106 - RNA, 16 nt, Pseudomonas aeruginosa PA01
ccgaggucgccgccag

SEQ ID NO: 3381107 - RNA, 20 nt, Pseudomonas aeruginosa PA01
ccgaucuucagcagcaggcg

SEQ ID NO: 3381108 - RNA, 15 nt, Pseudomonas aeruginosa PA01
ccgaucuucgccgac

SEQ ID NO: 3381109 - RNA, 16 nt, Pseudomonas aeruginosa PA01
ccgaugaaagagcccg

SEQ ID NO: 3381110 - RNA, 18 nt, Pseudomonas aeruginosa PA01
ccgaugaaauagccggcg

SEQ ID NO: 3381111 - RNA, 22 nt, Pseudomonas aeruginosa PA01
ccgaugaaauagccggcgaugc

SEQ ID NO: 3381112 - RNA, 15 nt, Pseudomonas aeruginosa PA01
ccgaugaagcaggcg

SEQ ID NO: 3381113 - RNA, 16 nt, Pseudomonas aeruginosa PA01
ccgaugaagcaggcgg

SEQ ID NO: 3381114 - RNA, 23 nt, Pseudomonas aeruginosa PA01
ccgaugaucuccgcgccgggcug

SEQ ID NO: 3381115 - RNA, 14 nt, Pseudomonas aeruginosa PA01
ccgaugcccaggcc

SEQ ID NO: 3381116 - RNA, 17 nt, Pseudomonas aeruginosa PA01
ccgaugccgacgucgac

SEQ ID NO: 3381117 - RNA, 21 nt, Pseudomonas aeruginosa PA01
ccgaugccgccgaccucggcc

SEQ ID NO: 3381118 - RNA, 19 nt, Pseudomonas aeruginosa PA01
ccgaugccggaaagccugg

SEQ ID NO: 3381119 - RNA, 21 nt, Pseudomonas aeruginosa PA01
ccgaugccggaaagccuggcc

SEQ ID NO: 3381120 - RNA, 15 nt, Pseudomonas aeruginosa PA01
ccgaugccggccggc

SEQ ID NO: 3381121 - RNA, 22 nt, Pseudomonas aeruginosa PA01
ccgaugccgggcaacgcgcaga

SEQ ID NO: 3381122 - RNA, 14 nt, Pseudomonas aeruginosa PA01
ccgaugcgccgacg

SEQ ID NO: 3381123 - RNA, 19 nt, Pseudomonas aeruginosa PA01
ccgaugcgcgacucgaagc

SEQ ID NO: 3381124 - RNA, 20 nt, Pseudomonas aeruginosa PA01
ccgaugcgcgacucgaagcu

SEQ ID NO: 3381125 - RNA, 21 nt, Pseudomonas aeruginosa PA01
ccgaugcgcgacucgaagcuc

SEQ ID NO: 3381126 - RNA, 18 nt, Pseudomonas aeruginosa PA01
ccgaugcgcuacggcauc

SEQ ID NO: 3381127 - RNA, 22 nt, Pseudomonas aeruginosa PA01
ccgaugcgguagucgcugcugg

SEQ ID NO: 3381128 - RNA, 17 nt, Pseudomonas aeruginosa PA01
ccgaugcuaucgcgugg

SEQ ID NO: 3381129 - RNA, 19 nt, Pseudomonas aeruginosa PA01
ccgaugcucgcgccagccc

SEQ ID NO: 3381130 - RNA, 18 nt, Pseudomonas aeruginosa PA01
ccgaugcugaucacccgc

SEQ ID NO: 3381131 - RNA, 19 nt, Pseudomonas aeruginosa PA01
ccgaugcugaucacccgcc

SEQ ID NO: 3381132 - RNA, 18 nt, Pseudomonas aeruginosa PA01
ccgaugcuguucagcagg

SEQ ID NO: 3381133 - RNA, 19 nt, Pseudomonas aeruginosa PA01
ccgaugcuguucagcagga

SEQ ID NO: 3381134 - RNA, 22 nt, Pseudomonas aeruginosa PA01
ccgauggagauguagucgacgc

SEQ ID NO: 3381135 - RNA, 23 nt, Pseudomonas aeruginosa PA01
ccgauggagauguagucgacgcc

SEQ ID NO: 3381136 - RNA, 20 nt, Pseudomonas aeruginosa PA01
ccgauggccagggggccugg

SEQ ID NO: 3381137 - RNA, 11 nt, Pseudomonas aeruginosa PA01
ccgauggcccc

SEQ ID NO: 3381138 - RNA, 12 nt, Pseudomonas aeruginosa PA01
ccgauggccccg

SEQ ID NO: 3381139 - RNA, 14 nt, Pseudomonas aeruginosa PA01
ccgauggccccggc

SEQ ID NO: 3381140 - RNA, 13 nt, Pseudomonas aeruginosa PA01
ccgauggcgccgc

SEQ ID NO: 3381141 - RNA, 15 nt, Pseudomonas aeruginosa PA01
ccgauggcgccgccg

SEQ ID NO: 3381142 - RNA, 16 nt, Pseudomonas aeruginosa PA01
ccgauggcgccgccga

SEQ ID NO: 3381143 - RNA, 14 nt, Pseudomonas aeruginosa PA01
ccgauggcgccgcg

SEQ ID NO: 3381144 - RNA, 15 nt, Pseudomonas aeruginosa PA01
ccgauggcgccgcga

SEQ ID NO: 3381145 - RNA, 18 nt, Pseudomonas aeruginosa PA01
ccgauggcugucggcgcc

SEQ ID NO: 3381146 - RNA, 15 nt, Pseudomonas aeruginosa PA01
ccgaugggccuucag

SEQ ID NO: 3381147 - RNA, 22 nt, Pseudomonas aeruginosa PA01
ccgaugucguagccgcgcgcca

SEQ ID NO: 3381148 - RNA, 14 nt, Pseudomonas aeruginosa PA01
ccgaugugcacgcu

SEQ ID NO: 3381149 - RNA, 16 nt, Pseudomonas aeruginosa PA01
ccgauuccgcgcagga

SEQ ID NO: 3381150 - RNA, 12 nt, Pseudomonas aeruginosa PA01
ccgauucgccgg

SEQ ID NO: 3381151 - RNA, 18 nt, Pseudomonas aeruginosa PA01
ccgauucgccggccacca

SEQ ID NO: 3381152 - RNA, 20 nt, Pseudomonas aeruginosa PA01
ccgauucuuggcucggcagc

SEQ ID NO: 3381153 - RNA, 19 nt, Pseudomonas aeruginosa PA01
ccgauugugcagggccgcg

SEQ ID NO: 3381154 - RNA, 17 nt, Pseudomonas aeruginosa PA01
ccgauuucgaugacgcc

SEQ ID NO: 3381155 - RNA, 14 nt, Pseudomonas aeruginosa PA01
ccgcaaccgcagac

SEQ ID NO: 3381156 - RNA, 12 nt, Pseudomonas aeruginosa PA01
ccgcaaccgcug

SEQ ID NO: 3381157 - RNA, 17 nt, Pseudomonas aeruginosa PA01
ccgcaaccgcugccgcc

SEQ ID NO: 3381158 - RNA, 15 nt, Pseudomonas aeruginosa PA01
ccgcaaccugccaga

SEQ ID NO: 3381159 - RNA, 19 nt, Pseudomonas aeruginosa PA01
ccgcaagcggauauccccc

SEQ ID NO: 3381160 - RNA, 19 nt, Pseudomonas aeruginosa PA01
ccgcaagcgguuauucgcc

SEQ ID NO: 3381161 - RNA, 20 nt, Pseudomonas aeruginosa PA01
ccgcaagcgguuauucgccc

SEQ ID NO: 3381162 - RNA, 13 nt, Pseudomonas aeruginosa PA01
ccgcaaggagccc

SEQ ID NO: 3381163 - RNA, 17 nt, Pseudomonas aeruginosa PA01
ccgcaaggccagggcgg

SEQ ID NO: 3381164 - RNA, 16 nt, Pseudomonas aeruginosa PA01
ccgcaagggcgucgcu

SEQ ID NO: 3381165 - RNA, 21 nt, Pseudomonas aeruginosa PA01
ccgcaaggugcgggccgucgu

SEQ ID NO: 3381166 - RNA, 14 nt, Pseudomonas aeruginosa PA01
ccgcaaguaccgcc

SEQ ID NO: 3381167 - RNA, 14 nt, Pseudomonas aeruginosa PA01
ccgcaaguggcggc

SEQ ID NO: 3381168 - RNA, 15 nt, Pseudomonas aeruginosa PA01
ccgcaaguggcggcu

SEQ ID NO: 3381169 - RNA, 15 nt, Pseudomonas aeruginosa PA01
ccgcaauccgaccgg

SEQ ID NO: 3381170 - RNA, 16 nt, Pseudomonas aeruginosa PA01
ccgcaauccgaccggg

SEQ ID NO: 3381171 - RNA, 13 nt, Pseudomonas aeruginosa PA01
ccgcacaccgcgc

SEQ ID NO: 3381172 - RNA, 13 nt, Pseudomonas aeruginosa PA01
ccgcacaggcugg

SEQ ID NO: 3381173 - RNA, 19 nt, Pseudomonas aeruginosa PA01
ccgcacaggcuggccagaa

SEQ ID NO: 3381174 - RNA, 14 nt, Pseudomonas aeruginosa PA01
ccgcacagguagag

SEQ ID NO: 3381175 - RNA, 18 nt, Pseudomonas aeruginosa PA01
ccgcacaguugcgcgccg

SEQ ID NO: 3381176 - RNA, 19 nt, Pseudomonas aeruginosa PA01
ccgcacaguugcgcgccgg

SEQ ID NO: 3381177 - RNA, 21 nt, Pseudomonas aeruginosa PA01
ccgcacaguugcgcgccggcg

SEQ ID NO: 3381178 - RNA, 22 nt, Pseudomonas aeruginosa PA01
ccgcacaguugcgcgccggcgg

SEQ ID NO: 3381179 - RNA, 15 nt, Pseudomonas aeruginosa PA01
ccgcaccacccgcug

SEQ ID NO: 3381180 - RNA, 18 nt, Pseudomonas aeruginosa PA01
ccgcaccacguagccggc

SEQ ID NO: 3381181 - RNA, 19 nt, Pseudomonas aeruginosa PA01
ccgcaccacguagccggcg

SEQ ID NO: 3381182 - RNA, 20 nt, Pseudomonas aeruginosa PA01
ccgcaccacguagccggcgu

SEQ ID NO: 3381183 - RNA, 12 nt, Pseudomonas aeruginosa PA01
ccgcaccagcca

SEQ ID NO: 3381184 - RNA, 13 nt, Pseudomonas aeruginosa PA01
ccgcaccagccgg

SEQ ID NO: 3381185 - RNA, 13 nt, Pseudomonas aeruginosa PA01
ccgcacccgggca

SEQ ID NO: 3381186 - RNA, 14 nt, Pseudomonas aeruginosa PA01
ccgcacccgggcaa

SEQ ID NO: 3381187 - RNA, 15 nt, Pseudomonas aeruginosa PA01
ccgcaccgccagcgu

SEQ ID NO: 3381188 - RNA, 21 nt, Pseudomonas aeruginosa PA01
ccgcaccggcauguagcgcgc

SEQ ID NO: 3381189 - RNA, 23 nt, Pseudomonas aeruginosa PA01
ccgcaccggcauguagcgcgccg

SEQ ID NO: 3381190 - RNA, 15 nt, Pseudomonas aeruginosa PA01
ccgcaccggcgcgcc

SEQ ID NO: 3381191 - RNA, 16 nt, Pseudomonas aeruginosa PA01
ccgcaccggcgcgccg

SEQ ID NO: 3381192 - RNA, 19 nt, Pseudomonas aeruginosa PA01
ccgcaccggcgcgccggac

SEQ ID NO: 3381193 - RNA, 22 nt, Pseudomonas aeruginosa PA01
ccgcaccggcgcgccggacagg

SEQ ID NO: 3381194 - RNA, 17 nt, Pseudomonas aeruginosa PA01
ccgcaccgguucgacac

SEQ ID NO: 3381195 - RNA, 14 nt, Pseudomonas aeruginosa PA01
ccgcaccguagcgg

SEQ ID NO: 3381196 - RNA, 12 nt, Pseudomonas aeruginosa PA01
ccgcaccugccg

SEQ ID NO: 3381197 - RNA, 19 nt, Pseudomonas aeruginosa PA01
ccgcaccuggaccgggauc

SEQ ID NO: 3381198 - RNA, 13 nt, Pseudomonas aeruginosa PA01
ccgcaccuggugg

SEQ ID NO: 3381199 - RNA, 22 nt, Pseudomonas aeruginosa PA01
ccgcaccugguggacacccugc

SEQ ID NO: 3381200 - RNA, 23 nt, Pseudomonas aeruginosa PA01
ccgcaccugguggacacccugcu

SEQ ID NO: 3381201 - RNA, 16 nt, Pseudomonas aeruginosa PA01
ccgcaccuugcccugc

SEQ ID NO: 3381202 - RNA, 17 nt, Pseudomonas aeruginosa PA01
ccgcaccuugcccugca

SEQ ID NO: 3381203 - RNA, 13 nt, Pseudomonas aeruginosa PA01
ccgcacggccguc

SEQ ID NO: 3381204 - RNA, 22 nt, Pseudomonas aeruginosa PA01
ccgcacguugaggucgaagacc

SEQ ID NO: 3381205 - RNA, 18 nt, Pseudomonas aeruginosa PA01
ccgcacugguggcgaaca

SEQ ID NO: 3381206 - RNA, 20 nt, Pseudomonas aeruginosa PA01
ccgcacugguggcgaacagc

SEQ ID NO: 3381207 - RNA, 16 nt, Pseudomonas aeruginosa PA01
ccgcacuuccaggcgc

SEQ ID NO: 3381208 - RNA, 21 nt, Pseudomonas aeruginosa PA01
ccgcagaaccagacgcucggc

SEQ ID NO: 3381209 - RNA, 22 nt, Pseudomonas aeruginosa PA01
ccgcagaaccagacgcucggcc

SEQ ID NO: 3381210 - RNA, 23 nt, Pseudomonas aeruginosa PA01
ccgcaucgcugaccucgagcugg

SEQ ID NO: 3381211 - RNA, 12 nt, Pseudomonas aeruginosa PA01
ccgcaucggcca

SEQ ID NO: 3381212 - RNA, 22 nt, Pseudomonas aeruginosa PA01
ccgcaucggccaccuucgcccg

SEQ ID NO: 3381213 - RNA, 23 nt, Pseudomonas aeruginosa PA01
ccgcaucggccaccuucgcccgc

SEQ ID NO: 3381214 - RNA, 19 nt, Pseudomonas aeruginosa PA01
ccgcaucguuggcgccguc

SEQ ID NO: 3381215 - RNA, 22 nt, Pseudomonas aeruginosa PA01
ccgcaugaacgccucgccaacc

SEQ ID NO: 3381216 - RNA, 15 nt, Pseudomonas aeruginosa PA01
ccgcaugccagggcc

SEQ ID NO: 3381217 - RNA, 16 nt, Pseudomonas aeruginosa PA01
ccgcaugccagggccu

SEQ ID NO: 3381218 - RNA, 16 nt, Pseudomonas aeruginosa PA01
ccgcauugacccgggu

SEQ ID NO: 3381219 - RNA, 22 nt, Pseudomonas aeruginosa PA01
ccgcauugcggggcguucuuuu

SEQ ID NO: 3381220 - RNA, 16 nt, Pseudomonas aeruginosa PA01
ccgcauuggccaggcc

SEQ ID NO: 3381221 - RNA, 16 nt, Pseudomonas aeruginosa PA01
ccgccaaggaugggaa

SEQ ID NO: 3381222 - RNA, 14 nt, Pseudomonas aeruginosa PA01
ccgccaaggcccug

SEQ ID NO: 3381223 - RNA, 20 nt, Pseudomonas aeruginosa PA01
ccgccaaggcccugcugcag

SEQ ID NO: 3381224 - RNA, 20 nt, Pseudomonas aeruginosa PA01
ccgccaaggccucggcaucc

SEQ ID NO: 3381225 - RNA, 13 nt, Pseudomonas aeruginosa PA01
ccgccaaggcggg

SEQ ID NO: 3381226 - RNA, 14 nt, Pseudomonas aeruginosa PA01
ccgccaagggcgcc

SEQ ID NO: 3381227 - RNA, 17 nt, Pseudomonas aeruginosa PA01
ccgccaagggcgccgcc

SEQ ID NO: 3381228 - RNA, 18 nt, Pseudomonas aeruginosa PA01
ccgccaagggcgccgccg

SEQ ID NO: 3381229 - RNA, 21 nt, Pseudomonas aeruginosa PA01
ccgccaagggcgccgccgagg

SEQ ID NO: 3381230 - RNA, 15 nt, Pseudomonas aeruginosa PA01
ccgccacagaucgcc

SEQ ID NO: 3381231 - RNA, 23 nt, Pseudomonas aeruginosa PA01
ccgccacagaucgccagcucgcc

SEQ ID NO: 3381232 - RNA, 21 nt, Pseudomonas aeruginosa PA01
ccgccaccaaccacaaccagc

SEQ ID NO: 3381233 - RNA, 12 nt, Pseudomonas aeruginosa PA01
ccgccaccacgg

SEQ ID NO: 3381234 - RNA, 17 nt, Pseudomonas aeruginosa PA01
ccgccaccacggcgaag

SEQ ID NO: 3381235 - RNA, 11 nt, Pseudomonas aeruginosa PA01
ccgccaccagc

SEQ ID NO: 3381236 - RNA, 15 nt, Pseudomonas aeruginosa PA01
ccgccaccagccagu

SEQ ID NO: 3381237 - RNA, 15 nt, Pseudomonas aeruginosa PA01
ccgccaccagcgagu

SEQ ID NO: 3381238 - RNA, 17 nt, Pseudomonas aeruginosa PA01
ccgccaccccgccggcg

SEQ ID NO: 3381239 - RNA, 18 nt, Pseudomonas aeruginosa PA01
ccgccaccccgccggcgu

SEQ ID NO: 3381240 - RNA, 16 nt, Pseudomonas aeruginosa PA01
ccgccaccgccaccgc

SEQ ID NO: 3381241 - RNA, 19 nt, Pseudomonas aeruginosa PA01
ccgccaccgccaccgccgg

SEQ ID NO: 3381242 - RNA, 13 nt, Pseudomonas aeruginosa PA01
ccgccaccgccgg

SEQ ID NO: 3381243 - RNA, 20 nt, Pseudomonas aeruginosa PA01
ccgccaccgccggaaccugu

SEQ ID NO: 3381244 - RNA, 13 nt, Pseudomonas aeruginosa PA01
ccgccaccugccc

SEQ ID NO: 3381245 - RNA, 14 nt, Pseudomonas aeruginosa PA01
ccgccaccugcccc

SEQ ID NO: 3381246 - RNA, 13 nt, Pseudomonas aeruginosa PA01
ccgccaccuggcg

SEQ ID NO: 3381247 - RNA, 14 nt, Pseudomonas aeruginosa PA01
ccgccaccuggcgg

SEQ ID NO: 3381248 - RNA, 16 nt, Pseudomonas aeruginosa PA01
ccgccaccuggcgggc

SEQ ID NO: 3381249 - RNA, 13 nt, Pseudomonas aeruginosa PA01
ccgccacgccgau

SEQ ID NO: 3381250 - RNA, 18 nt, Pseudomonas aeruginosa PA01
ccgccacgccgauaccgg

SEQ ID NO: 3381251 - RNA, 23 nt, Pseudomonas aeruginosa PA01
ccgccacggcgcgcuccggcgcg

SEQ ID NO: 3381252 - RNA, 23 nt, Pseudomonas aeruginosa PA01
ccgccacggcgguuucgucgaag

SEQ ID NO: 3381253 - RNA, 17 nt, Pseudomonas aeruginosa PA01
ccgccacguacagcgcg

SEQ ID NO: 3381254 - RNA, 18 nt, Pseudomonas aeruginosa PA01
ccgccacguacagcgcga

SEQ ID NO: 3381255 - RNA, 21 nt, Pseudomonas aeruginosa PA01
ccgccacuucaagcuggcgca

SEQ ID NO: 3381256 - RNA, 15 nt, Pseudomonas aeruginosa PA01
ccgccacuuccagca

SEQ ID NO: 3381257 - RNA, 16 nt, Pseudomonas aeruginosa PA01
ccgccacuuccagcac

SEQ ID NO: 3381258 - RNA, 21 nt, Pseudomonas aeruginosa PA01
ccgccacuuccagcacgccga

SEQ ID NO: 3381259 - RNA, 17 nt, Pseudomonas aeruginosa PA01
ccgccagacaggccagc

SEQ ID NO: 3381260 - RNA, 23 nt, Pseudomonas aeruginosa PA01
ccgccagcaacaguugccgcagc

SEQ ID NO: 3381261 - RNA, 14 nt, Pseudomonas aeruginosa PA01
ccgccagcaccacc

SEQ ID NO: 3381262 - RNA, 18 nt, Pseudomonas aeruginosa PA01
ccgccagcaccacccggc

SEQ ID NO: 3381263 - RNA, 19 nt, Pseudomonas aeruginosa PA01
ccgccagcaccacccggcc

SEQ ID NO: 3381264 - RNA, 20 nt, Pseudomonas aeruginosa PA01
ccgccagcaccacccggccg

SEQ ID NO: 3381265 - RNA, 22 nt, Pseudomonas aeruginosa PA01
ccgccagcaccacccggccgcg

SEQ ID NO: 3381266 - RNA, 12 nt, Pseudomonas aeruginosa PA01
ccgccagcaggc

SEQ ID NO: 3381267 - RNA, 17 nt, Pseudomonas aeruginosa PA01
ccgccagcaggccgaag

SEQ ID NO: 3381268 - RNA, 20 nt, Pseudomonas aeruginosa PA01
ccgccagcaggccgaaggcc

SEQ ID NO: 3381269 - RNA, 21 nt, Pseudomonas aeruginosa PA01
ccgccagcaggccgaaggcca

SEQ ID NO: 3381270 - RNA, 14 nt, Pseudomonas aeruginosa PA01
ccgccagcaggcgc

SEQ ID NO: 3381271 - RNA, 16 nt, Pseudomonas aeruginosa PA01
ccgccagcaggcgccg

SEQ ID NO: 3381272 - RNA, 15 nt, Pseudomonas aeruginosa PA01
ccgccagcaggcgcg

SEQ ID NO: 3381273 - RNA, 16 nt, Pseudomonas aeruginosa PA01
ccgccagcaggcgcgg

SEQ ID NO: 3381274 - RNA, 17 nt, Pseudomonas aeruginosa PA01
ccgccagcaggcgcggg

SEQ ID NO: 3381275 - RNA, 17 nt, Pseudomonas aeruginosa PA01
ccgccagcaggucggcc

SEQ ID NO: 3381276 - RNA, 22 nt, Pseudomonas aeruginosa PA01
ccgccagcaggucggccugcug

SEQ ID NO: 3381277 - RNA, 23 nt, Pseudomonas aeruginosa PA01
ccgccagcauggcgaagcucggc

SEQ ID NO: 3381278 - RNA, 21 nt, Pseudomonas aeruginosa PA01
ccgccagccagagcagcgucg

SEQ ID NO: 3381279 - RNA, 15 nt, Pseudomonas aeruginosa PA01
ccgccagccagccgc

SEQ ID NO: 3381280 - RNA, 18 nt, Pseudomonas aeruginosa PA01
ccgccagccgccaggacg

SEQ ID NO: 3381281 - RNA, 12 nt, Pseudomonas aeruginosa PA01
ccgccagccggc

SEQ ID NO: 3381282 - RNA, 13 nt, Pseudomonas aeruginosa PA01
ccgccagccggcu

SEQ ID NO: 3381283 - RNA, 14 nt, Pseudomonas aeruginosa PA01
ccgccagccggcug

SEQ ID NO: 3381284 - RNA, 16 nt, Pseudomonas aeruginosa PA01
ccgccagcgccggcca

SEQ ID NO: 3381285 - RNA, 15 nt, Pseudomonas aeruginosa PA01
ccgccagcgcggcgc

SEQ ID NO: 3381286 - RNA, 16 nt, Pseudomonas aeruginosa PA01
ccgccagcgcggcgcu

SEQ ID NO: 3381287 - RNA, 12 nt, Pseudomonas aeruginosa PA01
ccgccagcgucg

SEQ ID NO: 3381288 - RNA, 16 nt, Pseudomonas aeruginosa PA01
ccgccagcgucgccgc

SEQ ID NO: 3381289 - RNA, 18 nt, Pseudomonas aeruginosa PA01
ccgccagcgucgccgccg

SEQ ID NO: 3381290 - RNA, 20 nt, Pseudomonas aeruginosa PA01
ccgccagcgucgccgccgcg

SEQ ID NO: 3381291 - RNA, 15 nt, Pseudomonas aeruginosa PA01
ccgccagcuaccggc

SEQ ID NO: 3381292 - RNA, 18 nt, Pseudomonas aeruginosa PA01
ccgccagcuaccggcagg

SEQ ID NO: 3381293 - RNA, 16 nt, Pseudomonas aeruginosa PA01
ccgccagcucauggag

SEQ ID NO: 3381294 - RNA, 23 nt, Pseudomonas aeruginosa PA01
ccgccagcucauggagcaacagc

SEQ ID NO: 3381295 - RNA, 13 nt, Pseudomonas aeruginosa PA01
ccgccagcucgcu

SEQ ID NO: 3381296 - RNA, 19 nt, Pseudomonas aeruginosa PA01
ccgccagcucgcuguccag

SEQ ID NO: 3381297 - RNA, 21 nt, Pseudomonas aeruginosa PA01
ccgccagcucgcuguccagca

SEQ ID NO: 3381298 - RNA, 16 nt, Pseudomonas aeruginosa PA01
ccgccaggaccuccug

SEQ ID NO: 3381299 - RNA, 22 nt, Pseudomonas aeruginosa PA01
ccgccaggaccucgaagcuggc

SEQ ID NO: 3381300 - RNA, 12 nt, Pseudomonas aeruginosa PA01
ccgccaggacgg

SEQ ID NO: 3381301 - RNA, 14 nt, Pseudomonas aeruginosa PA01
ccgccaggcagacc

SEQ ID NO: 3381302 - RNA, 18 nt, Pseudomonas aeruginosa PA01
ccgccaggcagaccaggc

SEQ ID NO: 3381303 - RNA, 23 nt, Pseudomonas aeruginosa PA01
ccgccaggcagaccaggccgagc

SEQ ID NO: 3381304 - RNA, 22 nt, Pseudomonas aeruginosa PA01
ccgccaggcagaccugcagcag

SEQ ID NO: 3381305 - RNA, 20 nt, Pseudomonas aeruginosa PA01
ccgccaggcaggccgggcug

SEQ ID NO: 3381306 - RNA, 17 nt, Pseudomonas aeruginosa PA01
ccgccaggcccugggcg

SEQ ID NO: 3381307 - RNA, 19 nt, Pseudomonas aeruginosa PA01
ccgccaggcccugggcggc

SEQ ID NO: 3381308 - RNA, 15 nt, Pseudomonas aeruginosa PA01
ccgccaggccucggc

SEQ ID NO: 3381309 - RNA, 17 nt, Pseudomonas aeruginosa PA01
ccgccaggccucggcgc

SEQ ID NO: 3381310 - RNA, 17 nt, Pseudomonas aeruginosa PA01
ccgccaggccuuccaga

SEQ ID NO: 3381311 - RNA, 20 nt, Pseudomonas aeruginosa PA01
ccgccaggcgcagccagcac

SEQ ID NO: 3381312 - RNA, 13 nt, Pseudomonas aeruginosa PA01
ccgccaggcgcgu

SEQ ID NO: 3381313 - RNA, 14 nt, Pseudomonas aeruginosa PA01
ccgcccgucgcgcc

SEQ ID NO: 3381314 - RNA, 18 nt, Pseudomonas aeruginosa PA01
ccgcccgucgcgccggcc

SEQ ID NO: 3381315 - RNA, 19 nt, Pseudomonas aeruginosa PA01
ccgcccgucgcgccggcca

SEQ ID NO: 3381316 - RNA, 21 nt, Pseudomonas aeruginosa PA01
ccgcccuacgcaacccgcccg

SEQ ID NO: 3381317 - RNA, 19 nt, Pseudomonas aeruginosa PA01
ccgcccuagcgguccggac

SEQ ID NO: 3381318 - RNA, 14 nt, Pseudomonas aeruginosa PA01
ccgcccucgggccg

SEQ ID NO: 3381319 - RNA, 18 nt, Pseudomonas aeruginosa PA01
ccgcccucgucgcaccug

SEQ ID NO: 3381320 - RNA, 17 nt, Pseudomonas aeruginosa PA01
ccgcccugcgcgauccc

SEQ ID NO: 3381321 - RNA, 21 nt, Pseudomonas aeruginosa PA01
ccgcccugcgcgaucccccgc

SEQ ID NO: 3381322 - RNA, 22 nt, Pseudomonas aeruginosa PA01
ccgcccugcgcgaucccccgcc

SEQ ID NO: 3381323 - RNA, 13 nt, Pseudomonas aeruginosa PA01
ccgcccuggccgc

SEQ ID NO: 3381324 - RNA, 14 nt, Pseudomonas aeruginosa PA01
ccgcccuggccgcc

SEQ ID NO: 3381325 - RNA, 21 nt, Pseudomonas aeruginosa PA01
ccgcccuggcucugggccaug

SEQ ID NO: 3381326 - RNA, 22 nt, Pseudomonas aeruginosa PA01
ccgcccuggcucugggccauga

SEQ ID NO: 3381327 - RNA, 21 nt, Pseudomonas aeruginosa PA01
ccgcccuguucgucuggcgcc

SEQ ID NO: 3381328 - RNA, 22 nt, Pseudomonas aeruginosa PA01
ccgcccuguucgucuggcgccu

SEQ ID NO: 3381329 - RNA, 23 nt, Pseudomonas aeruginosa PA01
ccgcccuguucgucuggcgccug

SEQ ID NO: 3381330 - RNA, 21 nt, Pseudomonas aeruginosa PA01
ccgcccuucgaacccgcccuc

SEQ ID NO: 3381331 - RNA, 22 nt, Pseudomonas aeruginosa PA01
ccgcccuucgaacccgcccucg

SEQ ID NO: 3381332 - RNA, 21 nt, Pseudomonas aeruginosa PA01
ccgcccuugccauccuccagc

SEQ ID NO: 3381333 - RNA, 22 nt, Pseudomonas aeruginosa PA01
ccgcccuugccauccuccagca

SEQ ID NO: 3381334 - RNA, 14 nt, Pseudomonas aeruginosa PA01
ccgcccuuggcggc

SEQ ID NO: 3381335 - RNA, 18 nt, Pseudomonas aeruginosa PA01
ccgcccuuggcggcgcca

SEQ ID NO: 3381336 - RNA, 15 nt, Pseudomonas aeruginosa PA01
ccgcccuugucgaug

SEQ ID NO: 3381337 - RNA, 19 nt, Pseudomonas aeruginosa PA01
ccgcccuuuuucgucgcca

SEQ ID NO: 3381338 - RNA, 22 nt, Pseudomonas aeruginosa PA01
ccgcccuuuuucgucgccagcc

SEQ ID NO: 3381339 - RNA, 15 nt, Pseudomonas aeruginosa PA01
ccgccgaaaugcugc

SEQ ID NO: 3381340 - RNA, 19 nt, Pseudomonas aeruginosa PA01
ccgccgaaaugcugcaggc

SEQ ID NO: 3381341 - RNA, 21 nt, Pseudomonas aeruginosa PA01
ccgccgaaaugcugcaggccg

SEQ ID NO: 3381342 - RNA, 22 nt, Pseudomonas aeruginosa PA01
ccgccgaaaugcugcaggccga

SEQ ID NO: 3381343 - RNA, 20 nt, Pseudomonas aeruginosa PA01
ccgccgaacagcaacaccgc

SEQ ID NO: 3381344 - RNA, 24 nt, Pseudomonas aeruginosa PA01
ccgccgaacagcaacaccgcgcag

SEQ ID NO: 3381345 - RNA, 21 nt, Pseudomonas aeruginosa PA01
ccgccgaacaugccgaagagc

SEQ ID NO: 3381346 - RNA, 14 nt, Pseudomonas aeruginosa PA01
ccgccgaacgccac

SEQ ID NO: 3381347 - RNA, 17 nt, Pseudomonas aeruginosa PA01
ccgccgaacgccaccag

SEQ ID NO: 3381348 - RNA, 22 nt, Pseudomonas aeruginosa PA01
ccgccgaacgccaccagggccu

SEQ ID NO: 3381349 - RNA, 17 nt, Pseudomonas aeruginosa PA01
ccgccgaacggaucgcg

SEQ ID NO: 3381350 - RNA, 20 nt, Pseudomonas aeruginosa PA01
ccgccgaacggaucgcgucg

SEQ ID NO: 3381351 - RNA, 20 nt, Pseudomonas aeruginosa PA01
ccgccgaagccgacgccgag

SEQ ID NO: 3381352 - RNA, 21 nt, Pseudomonas aeruginosa PA01
ccgccgaagccgacgccgagc

SEQ ID NO: 3381353 - RNA, 15 nt, Pseudomonas aeruginosa PA01
ccgccgaagcggggc

SEQ ID NO: 3381354 - RNA, 15 nt, Pseudomonas aeruginosa PA01
ccgccgaagggccgc

SEQ ID NO: 3381355 - RNA, 17 nt, Pseudomonas aeruginosa PA01
ccgccgacacccgcgcc

SEQ ID NO: 3381356 - RNA, 19 nt, Pseudomonas aeruginosa PA01
ccgccgacacccgcgccgc

SEQ ID NO: 3381357 - RNA, 13 nt, Pseudomonas aeruginosa PA01
ccgccgaccagca

SEQ ID NO: 3381358 - RNA, 15 nt, Pseudomonas aeruginosa PA01
ccgccgaccagcacg

SEQ ID NO: 3381359 - RNA, 16 nt, Pseudomonas aeruginosa PA01
ccgccgaccagcacgg

SEQ ID NO: 3381360 - RNA, 20 nt, Pseudomonas aeruginosa PA01
ccgccgaccagcacggcgaa

SEQ ID NO: 3381361 - RNA, 15 nt, Pseudomonas aeruginosa PA01
ccgccgaccgggcgg

SEQ ID NO: 3381362 - RNA, 21 nt, Pseudomonas aeruginosa PA01
ccgccgaccucggccgccagg

SEQ ID NO: 3381363 - RNA, 19 nt, Pseudomonas aeruginosa PA01
ccgccgacgccggacgagc

SEQ ID NO: 3381364 - RNA, 16 nt, Pseudomonas aeruginosa PA01
ccgccgacgucgugga

SEQ ID NO: 3381365 - RNA, 15 nt, Pseudomonas aeruginosa PA01
ccgccgacugcaacu

SEQ ID NO: 3381366 - RNA, 21 nt, Pseudomonas aeruginosa PA01
ccgccgacugcaacuggccga

SEQ ID NO: 3381367 - RNA, 23 nt, Pseudomonas aeruginosa PA01
ccgccgacuggcagcgauaaccg

SEQ ID NO: 3381368 - RNA, 17 nt, Pseudomonas aeruginosa PA01
ccgccgagaacccggcc

SEQ ID NO: 3381369 - RNA, 20 nt, Pseudomonas aeruginosa PA01
ccgccgagaacccggccagg

SEQ ID NO: 3381370 - RNA, 16 nt, Pseudomonas aeruginosa PA01
ccgccgagcaggccca

SEQ ID NO: 3381371 - RNA, 17 nt, Pseudomonas aeruginosa PA01
ccgccgagcgccuggca

SEQ ID NO: 3381372 - RNA, 20 nt, Pseudomonas aeruginosa PA01
ccgccgagcguugggccucg

SEQ ID NO: 3381373 - RNA, 22 nt, Pseudomonas aeruginosa PA01
ccgccgaggaacauccgcggcc

SEQ ID NO: 3381374 - RNA, 18 nt, Pseudomonas aeruginosa PA01
ccgccgaggaagccgacc

SEQ ID NO: 3381375 - RNA, 22 nt, Pseudomonas aeruginosa PA01
ccgccgaggaagccgaccggcg

SEQ ID NO: 3381376 - RNA, 21 nt, Pseudomonas aeruginosa PA01
ccgccgaggaggaucucgcgc

SEQ ID NO: 3381377 - RNA, 22 nt, Pseudomonas aeruginosa PA01
ccgccgaggaggaucucgcgcc

SEQ ID NO: 3381378 - RNA, 15 nt, Pseudomonas aeruginosa PA01
ccgccgaggauagcg

SEQ ID NO: 3381379 - RNA, 23 nt, Pseudomonas aeruginosa PA01
ccgccgaggauagcguccagcuc

SEQ ID NO: 3381380 - RNA, 14 nt, Pseudomonas aeruginosa PA01
ccgccgaggcgcgc

SEQ ID NO: 3381381 - RNA, 15 nt, Pseudomonas aeruginosa PA01
ccgccgaggcgcgcc

SEQ ID NO: 3381382 - RNA, 17 nt, Pseudomonas aeruginosa PA01
ccgccgaggcgcgccac

SEQ ID NO: 3381383 - RNA, 20 nt, Pseudomonas aeruginosa PA01
ccgccgaggcgcgccacgca

SEQ ID NO: 3381384 - RNA, 15 nt, Pseudomonas aeruginosa PA01
ccgccgagggcaccg

SEQ ID NO: 3381385 - RNA, 16 nt, Pseudomonas aeruginosa PA01
ccgccgagggcaccga

SEQ ID NO: 3381386 - RNA, 18 nt, Pseudomonas aeruginosa PA01
ccgccgagggcaccgacg

SEQ ID NO: 3381387 - RNA, 21 nt, Pseudomonas aeruginosa PA01
ccgccgagggcaccgacgaug

SEQ ID NO: 3381388 - RNA, 14 nt, Pseudomonas aeruginosa PA01
ccgccgagggcgaa

SEQ ID NO: 3381389 - RNA, 16 nt, Pseudomonas aeruginosa PA01
ccgccgagggcgaaga

SEQ ID NO: 3381390 - RNA, 14 nt, Pseudomonas aeruginosa PA01
ccgccgagggcgcc

SEQ ID NO: 3381391 - RNA, 17 nt, Pseudomonas aeruginosa PA01
ccgccgagggcgccagg

SEQ ID NO: 3381392 - RNA, 21 nt, Pseudomonas aeruginosa PA01
ccgccgagggcgccaggugca

SEQ ID NO: 3381393 - RNA, 20 nt, Pseudomonas aeruginosa PA01
ccgccgaggucaguucggug

SEQ ID NO: 3381394 - RNA, 18 nt, Pseudomonas aeruginosa PA01
ccgccgaggugcugcacc

SEQ ID NO: 3381395 - RNA, 20 nt, Pseudomonas aeruginosa PA01
ccgccgaggugcugcaccgg

SEQ ID NO: 3381396 - RNA, 19 nt, Pseudomonas aeruginosa PA01
ccgccgagugugccggcca

SEQ ID NO: 3381397 - RNA, 16 nt, Pseudomonas aeruginosa PA01
ccgccgauacaccacc

SEQ ID NO: 3381398 - RNA, 21 nt, Pseudomonas aeruginosa PA01
ccgccgauagggaaacacguc

SEQ ID NO: 3381399 - RNA, 16 nt, Pseudomonas aeruginosa PA01
ccgccgaucagcgcgc

SEQ ID NO: 3381400 - RNA, 23 nt, Pseudomonas aeruginosa PA01
ccgccgaucagcgcgccuucgac

SEQ ID NO: 3381401 - RNA, 12 nt, Pseudomonas aeruginosa PA01
ccgccgauccag

SEQ ID NO: 3381402 - RNA, 16 nt, Pseudomonas aeruginosa PA01
ccgccgauccaggaac

SEQ ID NO: 3381403 - RNA, 19 nt, Pseudomonas aeruginosa PA01
ccgccgaucugcuggguca

SEQ ID NO: 3381404 - RNA, 22 nt, Pseudomonas aeruginosa PA01
ccgccgaucugcugggucaucg

SEQ ID NO: 3381405 - RNA, 15 nt, Pseudomonas aeruginosa PA01
ccgccgcagaccagc

SEQ ID NO: 3381406 - RNA, 16 nt, Pseudomonas aeruginosa PA01
ccgccgcagaccagcg

SEQ ID NO: 3381407 - RNA, 14 nt, Pseudomonas aeruginosa PA01
ccgccgcagagcca

SEQ ID NO: 3381408 - RNA, 20 nt, Pseudomonas aeruginosa PA01
ccgccgcagagccagccgca

SEQ ID NO: 3381409 - RNA, 23 nt, Pseudomonas aeruginosa PA01
ccgccgcagagccagccgcagcc

SEQ ID NO: 3381410 - RNA, 18 nt, Pseudomonas aeruginosa PA01
ccgccgcagccguggcgc

SEQ ID NO: 3381411 - RNA, 20 nt, Pseudomonas aeruginosa PA01
ccgccgcagccguggcgcga

SEQ ID NO: 3381412 - RNA, 17 nt, Pseudomonas aeruginosa PA01
ccgccgcaggucggcgu

SEQ ID NO: 3381413 - RNA, 15 nt, Pseudomonas aeruginosa PA01
ccgccgccagcaacg

SEQ ID NO: 3381414 - RNA, 23 nt, Pseudomonas aeruginosa PA01
ccgccggccgggagcuacagcga

SEQ ID NO: 3381415 - RNA, 17 nt, Pseudomonas aeruginosa PA01
ccgccggccggggcgcg

SEQ ID NO: 3381416 - RNA, 12 nt, Pseudomonas aeruginosa PA01
ccgccggccucg

SEQ ID NO: 3381417 - RNA, 13 nt, Pseudomonas aeruginosa PA01
ccgccggcgaacg

SEQ ID NO: 3381418 - RNA, 21 nt, Pseudomonas aeruginosa PA01
ccgccggcgaacggcaugcgu

SEQ ID NO: 3381419 - RNA, 16 nt, Pseudomonas aeruginosa PA01
ccgccggcgaccgcgc

SEQ ID NO: 3381420 - RNA, 15 nt, Pseudomonas aeruginosa PA01
ccgccggcgacgagg

SEQ ID NO: 3381421 - RNA, 19 nt, Pseudomonas aeruginosa PA01
ccgccggcgaggaucgcgc

SEQ ID NO: 3381422 - RNA, 24 nt, Pseudomonas aeruginosa PA01
ccgccggcgaggaucgcgcuggcc

SEQ ID NO: 3381423 - RNA, 12 nt, Pseudomonas aeruginosa PA01
ccgccggcgaug

SEQ ID NO: 3381424 - RNA, 18 nt, Pseudomonas aeruginosa PA01
ccgccggcgaugcccagg

SEQ ID NO: 3381425 - RNA, 20 nt, Pseudomonas aeruginosa PA01
ccgccggcgaugcccaggcc

SEQ ID NO: 3381426 - RNA, 12 nt, Pseudomonas aeruginosa PA01
ccgccggcgccc

SEQ ID NO: 3381427 - RNA, 14 nt, Pseudomonas aeruginosa PA01
ccgccggcgcccug

SEQ ID NO: 3381428 - RNA, 19 nt, Pseudomonas aeruginosa PA01
ccgccggcgcccugcucug

SEQ ID NO: 3381429 - RNA, 15 nt, Pseudomonas aeruginosa PA01
ccgccggcgcccugg

SEQ ID NO: 3381430 - RNA, 16 nt, Pseudomonas aeruginosa PA01
ccgccggcgccgccgg

SEQ ID NO: 3381431 - RNA, 16 nt, Pseudomonas aeruginosa PA01
ccgccggcgccgccuc

SEQ ID NO: 3381432 - RNA, 16 nt, Pseudomonas aeruginosa PA01
ccgccggcgcgcccag

SEQ ID NO: 3381433 - RNA, 19 nt, Pseudomonas aeruginosa PA01
ccgccggcgcgcccaggcc

SEQ ID NO: 3381434 - RNA, 23 nt, Pseudomonas aeruginosa PA01
ccgccggcgcgcccaggcccagc

SEQ ID NO: 3381435 - RNA, 22 nt, Pseudomonas aeruginosa PA01
ccgccggcgcgucccugggcgc

SEQ ID NO: 3381436 - RNA, 15 nt, Pseudomonas aeruginosa PA01
ccgccggcggccagg

SEQ ID NO: 3381437 - RNA, 19 nt, Pseudomonas aeruginosa PA01
ccgccggcggccagggcgu

SEQ ID NO: 3381438 - RNA, 14 nt, Pseudomonas aeruginosa PA01
ccgccggcgugccg

SEQ ID NO: 3381439 - RNA, 16 nt, Pseudomonas aeruginosa PA01
ccgccggcgugccgac

SEQ ID NO: 3381440 - RNA, 20 nt, Pseudomonas aeruginosa PA01
ccgccggcguuauccgccga

SEQ ID NO: 3381441 - RNA, 21 nt, Pseudomonas aeruginosa PA01
ccgccggcguuauccgccgau

SEQ ID NO: 3381442 - RNA, 15 nt, Pseudomonas aeruginosa PA01
ccgccggcguucgac

SEQ ID NO: 3381443 - RNA, 15 nt, Pseudomonas aeruginosa PA01
ccgccgggaccacgc

SEQ ID NO: 3381444 - RNA, 16 nt, Pseudomonas aeruginosa PA01
ccgccgggagcggccg

SEQ ID NO: 3381445 - RNA, 18 nt, Pseudomonas aeruginosa PA01
ccgccgggagcggccgug

SEQ ID NO: 3381446 - RNA, 21 nt, Pseudomonas aeruginosa PA01
ccgccgggagcggccgugcau

SEQ ID NO: 3381447 - RNA, 12 nt, Pseudomonas aeruginosa PA01
ccgccgggccgc

SEQ ID NO: 3381448 - RNA, 13 nt, Pseudomonas aeruginosa PA01
ccgccgggccgcc

SEQ ID NO: 3381449 - RNA, 14 nt, Pseudomonas aeruginosa PA01
ccgccgggcgcccg

SEQ ID NO: 3381450 - RNA, 15 nt, Pseudomonas aeruginosa PA01
ccgccgggcgcgcgc

SEQ ID NO: 3381451 - RNA, 17 nt, Pseudomonas aeruginosa PA01
ccgccgggcgcgcgccu

SEQ ID NO: 3381452 - RNA, 19 nt, Pseudomonas aeruginosa PA01
ccgccgggcgcgcgccuca

SEQ ID NO: 3381453 - RNA, 15 nt, Pseudomonas aeruginosa PA01
ccgccgggcguaacg

SEQ ID NO: 3381454 - RNA, 16 nt, Pseudomonas aeruginosa PA01
ccgccgggcuucggug

SEQ ID NO: 3381455 - RNA, 23 nt, Pseudomonas aeruginosa PA01
ccgccgggcuucgguguaucggc

SEQ ID NO: 3381456 - RNA, 17 nt, Pseudomonas aeruginosa PA01
ccgccggggaagcugcc

SEQ ID NO: 3381457 - RNA, 17 nt, Pseudomonas aeruginosa PA01
ccgccggggaucagcga

SEQ ID NO: 3381458 - RNA, 19 nt, Pseudomonas aeruginosa PA01
ccgccggggaucagcgaga

SEQ ID NO: 3381459 - RNA, 14 nt, Pseudomonas aeruginosa PA01
ccgccggggcgggc

SEQ ID NO: 3381460 - RNA, 20 nt, Pseudomonas aeruginosa PA01
ccgccggggcgugcaggccg

SEQ ID NO: 3381461 - RNA, 22 nt, Pseudomonas aeruginosa PA01
ccgccggggcgugcaggccgcc

SEQ ID NO: 3381462 - RNA, 18 nt, Pseudomonas aeruginosa PA01
ccgccggguccaccgcgg

SEQ ID NO: 3381463 - RNA, 16 nt, Pseudomonas aeruginosa PA01
ccgccgguagccguuc

SEQ ID NO: 3381464 - RNA, 19 nt, Pseudomonas aeruginosa PA01
ccgccgguagccguucgac

SEQ ID NO: 3381465 - RNA, 18 nt, Pseudomonas aeruginosa PA01
ccgccgguaucccggcug

SEQ ID NO: 3381466 - RNA, 20 nt, Pseudomonas aeruginosa PA01
ccgccggucaccacuggaaa

SEQ ID NO: 3381467 - RNA, 21 nt, Pseudomonas aeruginosa PA01
ccgccggucaccacuggaaac

SEQ ID NO: 3381468 - RNA, 20 nt, Pseudomonas aeruginosa PA01
ccgccggugaacagguagcu

SEQ ID NO: 3381469 - RNA, 17 nt, Pseudomonas aeruginosa PA01
ccgccggugcaccaggc

SEQ ID NO: 3381470 - RNA, 18 nt, Pseudomonas aeruginosa PA01
ccgccgguucgcaggcca

SEQ ID NO: 3381471 - RNA, 19 nt, Pseudomonas aeruginosa PA01
ccgccguagaguucggcug

SEQ ID NO: 3381472 - RNA, 15 nt, Pseudomonas aeruginosa PA01
ccgccguagccgucg

SEQ ID NO: 3381473 - RNA, 14 nt, Pseudomonas aeruginosa PA01
ccgccgucauggcg

SEQ ID NO: 3381474 - RNA, 15 nt, Pseudomonas aeruginosa PA01
ccgccgucauggcgg

SEQ ID NO: 3381475 - RNA, 17 nt, Pseudomonas aeruginosa PA01
ccgccgucauggcgggc

SEQ ID NO: 3381476 - RNA, 21 nt, Pseudomonas aeruginosa PA01
ccgccguccuguuucugcugu

SEQ ID NO: 3381477 - RNA, 15 nt, Pseudomonas aeruginosa PA01
ccgccgucgcggcca

SEQ ID NO: 3381478 - RNA, 21 nt, Pseudomonas aeruginosa PA01
ccgccgucgcggccaucggcg

SEQ ID NO: 3381479 - RNA, 22 nt, Pseudomonas aeruginosa PA01
ccgccgucgcggccaucggcga

SEQ ID NO: 3381480 - RNA, 22 nt, Pseudomonas aeruginosa PA01
ccgccgucuugccgcugcgcgc

SEQ ID NO: 3381481 - RNA, 18 nt, Pseudomonas aeruginosa PA01
ccgccgugaggcgcgcgc

SEQ ID NO: 3381482 - RNA, 23 nt, Pseudomonas aeruginosa PA01
ccgccgugaggcgcgcgccgaac

SEQ ID NO: 3381483 - RNA, 19 nt, Pseudomonas aeruginosa PA01
ccgccgugaucucgaacuc

SEQ ID NO: 3381484 - RNA, 12 nt, Pseudomonas aeruginosa PA01
ccgccgugcgcu

SEQ ID NO: 3381485 - RNA, 15 nt, Pseudomonas aeruginosa PA01
ccgccgugcgcuccg

SEQ ID NO: 3381486 - RNA, 18 nt, Pseudomonas aeruginosa PA01
ccgccgugcgcuccgcca

SEQ ID NO: 3381487 - RNA, 19 nt, Pseudomonas aeruginosa PA01
ccgccgugcgcuccgccag

SEQ ID NO: 3381488 - RNA, 20 nt, Pseudomonas aeruginosa PA01
ccgccgugcgcuccgccagg

SEQ ID NO: 3381489 - RNA, 15 nt, Pseudomonas aeruginosa PA01
ccgccguggaacgca

SEQ ID NO: 3381490 - RNA, 17 nt, Pseudomonas aeruginosa PA01
ccgccguggaacgcagg

SEQ ID NO: 3381491 - RNA, 16 nt, Pseudomonas aeruginosa PA01
ccgccguggcugugcu

SEQ ID NO: 3381492 - RNA, 21 nt, Pseudomonas aeruginosa PA01
ccgccguggcugugcuggcca

SEQ ID NO: 3381493 - RNA, 22 nt, Pseudomonas aeruginosa PA01
ccgccguggcugugcuggccac

SEQ ID NO: 3381494 - RNA, 15 nt, Pseudomonas aeruginosa PA01
ccgccguuacgccgg

SEQ ID NO: 3381495 - RNA, 21 nt, Pseudomonas aeruginosa PA01
ccgccguuccuccucgccgcc

SEQ ID NO: 3381496 - RNA, 23 nt, Pseudomonas aeruginosa PA01
ccgccguuccuccucgccgccga

SEQ ID NO: 3381497 - RNA, 14 nt, Pseudomonas aeruginosa PA01
ccgccguucgcccg

SEQ ID NO: 3381498 - RNA, 15 nt, Pseudomonas aeruginosa PA01
ccgccguucgcccgc

SEQ ID NO: 3381499 - RNA, 16 nt, Pseudomonas aeruginosa PA01
ccgccguucgcccgcc

SEQ ID NO: 3381500 - RNA, 20 nt, Pseudomonas aeruginosa PA01
ccgccguucucauugcgccg

SEQ ID NO: 3381501 - RNA, 21 nt, Pseudomonas aeruginosa PA01
ccgccguucucauugcgccgc

SEQ ID NO: 3381502 - RNA, 13 nt, Pseudomonas aeruginosa PA01
ccgccguugagga

SEQ ID NO: 3381503 - RNA, 19 nt, Pseudomonas aeruginosa PA01
ccgccguugaugacgaacu

SEQ ID NO: 3381504 - RNA, 15 nt, Pseudomonas aeruginosa PA01
ccgccuaccggggcg

SEQ ID NO: 3381505 - RNA, 22 nt, Pseudomonas aeruginosa PA01
ccgccuaccggggcgcgggcga

SEQ ID NO: 3381506 - RNA, 21 nt, Pseudomonas aeruginosa PA01
ccgccuauccgugacgucggc

SEQ ID NO: 3381507 - RNA, 19 nt, Pseudomonas aeruginosa PA01
ccgccucaccccacgggcg

SEQ ID NO: 3381508 - RNA, 23 nt, Pseudomonas aeruginosa PA01
ccgccucgaagaaaaggcccggc

SEQ ID NO: 3381509 - RNA, 16 nt, Pseudomonas aeruginosa PA01
ccgccucgaccagcgc

SEQ ID NO: 3381510 - RNA, 19 nt, Pseudomonas aeruginosa PA01
ccgccucgaccagcgccgc

SEQ ID NO: 3381511 - RNA, 21 nt, Pseudomonas aeruginosa PA01
ccgccucgaccagcgccgcgg

SEQ ID NO: 3381512 - RNA, 23 nt, Pseudomonas aeruginosa PA01
ccgccucgaccagcgccgcggcg

SEQ ID NO: 3381513 - RNA, 20 nt, Pseudomonas aeruginosa PA01
ccgccucgaccaucggcggc

SEQ ID NO: 3381514 - RNA, 24 nt, Pseudomonas aeruginosa PA01
ccgccucgaccaucggcggcggcc

SEQ ID NO: 3381515 - RNA, 19 nt, Pseudomonas aeruginosa PA01
ccgccucgaccccggaaag

SEQ ID NO: 3381516 - RNA, 17 nt, Pseudomonas aeruginosa PA01
ccgcgaccgaagccgcg

SEQ ID NO: 3381517 - RNA, 19 nt, Pseudomonas aeruginosa PA01
ccgcgaccgaagccgcgca

SEQ ID NO: 3381518 - RNA, 21 nt, Pseudomonas aeruginosa PA01
ccgcgaccgaagccgcgcagc

SEQ ID NO: 3381519 - RNA, 12 nt, Pseudomonas aeruginosa PA01
ccgcgaccucgu

SEQ ID NO: 3381520 - RNA, 14 nt, Pseudomonas aeruginosa PA01
ccgcgaccugcucg

SEQ ID NO: 3381521 - RNA, 20 nt, Pseudomonas aeruginosa PA01
ccgcgacgacugcggcagcu

SEQ ID NO: 3381522 - RNA, 21 nt, Pseudomonas aeruginosa PA01
ccgcgacgcgaccuccggcgc

SEQ ID NO: 3381523 - RNA, 14 nt, Pseudomonas aeruginosa PA01
ccgcgacgcgcugg

SEQ ID NO: 3381524 - RNA, 19 nt, Pseudomonas aeruginosa PA01
ccgcgacgcgcuggaccau

SEQ ID NO: 3381525 - RNA, 18 nt, Pseudomonas aeruginosa PA01
ccgcgacgcuccagcggc

SEQ ID NO: 3381526 - RNA, 19 nt, Pseudomonas aeruginosa PA01
ccgcgacgcuccagcggca

SEQ ID NO: 3381527 - RNA, 21 nt, Pseudomonas aeruginosa PA01
ccgcgacgcuccagcggcagc

SEQ ID NO: 3381528 - RNA, 19 nt, Pseudomonas aeruginosa PA01
ccgcgacggaccgcgacaa

SEQ ID NO: 3381529 - RNA, 13 nt, Pseudomonas aeruginosa PA01
ccgcgacucgagc

SEQ ID NO: 3381530 - RNA, 18 nt, Pseudomonas aeruginosa PA01
ccgcgacucgagcaccac

SEQ ID NO: 3381531 - RNA, 14 nt, Pseudomonas aeruginosa PA01
ccgcgacucggcug

SEQ ID NO: 3381532 - RNA, 14 nt, Pseudomonas aeruginosa PA01
ccgcgagcagccga

SEQ ID NO: 3381533 - RNA, 24 nt, Pseudomonas aeruginosa PA01
ccgcgagcagccgacgauccggcc

SEQ ID NO: 3381534 - RNA, 14 nt, Pseudomonas aeruginosa PA01
ccgcgagccagccg

SEQ ID NO: 3381535 - RNA, 19 nt, Pseudomonas aeruginosa PA01
ccgcgagccagccguggca

SEQ ID NO: 3381536 - RNA, 22 nt, Pseudomonas aeruginosa PA01
ccgcgagccagccguggcaggc

SEQ ID NO: 3381537 - RNA, 17 nt, Pseudomonas aeruginosa PA01
ccgcgagccgcgcagca

SEQ ID NO: 3381538 - RNA, 21 nt, Pseudomonas aeruginosa PA01
ccgcgagccguccugcggccg

SEQ ID NO: 3381539 - RNA, 21 nt, Pseudomonas aeruginosa PA01
ccgcgagcgaaacggcgcuga

SEQ ID NO: 3381540 - RNA, 15 nt, Pseudomonas aeruginosa PA01
ccgcgagcgccgccu

SEQ ID NO: 3381541 - RNA, 13 nt, Pseudomonas aeruginosa PA01
ccgcgagcgcggc

SEQ ID NO: 3381542 - RNA, 18 nt, Pseudomonas aeruginosa PA01
ccgcgagcgcggccggcc

SEQ ID NO: 3381543 - RNA, 19 nt, Pseudomonas aeruginosa PA01
ccgcgagcgcggccggcca

SEQ ID NO: 3381544 - RNA, 14 nt, Pseudomonas aeruginosa PA01
ccgcgagcuuggcc

SEQ ID NO: 3381545 - RNA, 17 nt, Pseudomonas aeruginosa PA01
ccgcgagcuuggcccug

SEQ ID NO: 3381546 - RNA, 22 nt, Pseudomonas aeruginosa PA01
ccgcgaggaaaagacgcuguuc

SEQ ID NO: 3381547 - RNA, 23 nt, Pseudomonas aeruginosa PA01
ccgcgaggcauucucgcgacccu

SEQ ID NO: 3381548 - RNA, 15 nt, Pseudomonas aeruginosa PA01
ccgcgaggccggccc

SEQ ID NO: 3381549 - RNA, 20 nt, Pseudomonas aeruginosa PA01
ccgcgaggcggucaugcgcc

SEQ ID NO: 3381550 - RNA, 22 nt, Pseudomonas aeruginosa PA01
ccgcgagguccggcuccggcug

SEQ ID NO: 3381551 - RNA, 20 nt, Pseudomonas aeruginosa PA01
ccgcgagguggaugaacagc

SEQ ID NO: 3381552 - RNA, 18 nt, Pseudomonas aeruginosa PA01
ccgcgaguccuucggcgc

SEQ ID NO: 3381553 - RNA, 19 nt, Pseudomonas aeruginosa PA01
ccgcgaguccuucggcgca

SEQ ID NO: 3381554 - RNA, 12 nt, Pseudomonas aeruginosa PA01
ccgcgaguucgc

SEQ ID NO: 3381555 - RNA, 15 nt, Pseudomonas aeruginosa PA01
ccgcgaguucgccgg

SEQ ID NO: 3381556 - RNA, 18 nt, Pseudomonas aeruginosa PA01
ccgcgaguucgccggcca

SEQ ID NO: 3381557 - RNA, 19 nt, Pseudomonas aeruginosa PA01
ccgcgaguucgccggccag

SEQ ID NO: 3381558 - RNA, 17 nt, Pseudomonas aeruginosa PA01
ccgcgauaucacgcccc

SEQ ID NO: 3381559 - RNA, 21 nt, Pseudomonas aeruginosa PA01
ccgcgauauucgcccuacgaa

SEQ ID NO: 3381560 - RNA, 22 nt, Pseudomonas aeruginosa PA01
ccgcgauauucgcccuacgaaa

SEQ ID NO: 3381561 - RNA, 16 nt, Pseudomonas aeruginosa PA01
ccgcgaugcguuccag

SEQ ID NO: 3381562 - RNA, 15 nt, Pseudomonas aeruginosa PA01
ccgcgauggcucgcg

SEQ ID NO: 3381563 - RNA, 22 nt, Pseudomonas aeruginosa PA01
ccgcgauggcucgcggcgcucg

SEQ ID NO: 3381564 - RNA, 14 nt, Pseudomonas aeruginosa PA01
ccgcgauguccccg

SEQ ID NO: 3381565 - RNA, 16 nt, Pseudomonas aeruginosa PA01
ccgcgauguccccggc

SEQ ID NO: 3381566 - RNA, 16 nt, Pseudomonas aeruginosa PA01
ccgcgauucgccgggc

SEQ ID NO: 3381567 - RNA, 18 nt, Pseudomonas aeruginosa PA01
ccgcgauucgccgggcuc

SEQ ID NO: 3381568 - RNA, 17 nt, Pseudomonas aeruginosa PA01
ccgcgauugcagcuccu

SEQ ID NO: 3381569 - RNA, 16 nt, Pseudomonas aeruginosa PA01
ccgcgcaaccguucca

SEQ ID NO: 3381570 - RNA, 23 nt, Pseudomonas aeruginosa PA01
ccgcgcaaggcagcguccgaacg

SEQ ID NO: 3381571 - RNA, 18 nt, Pseudomonas aeruginosa PA01
ccgcgcacaaaaaagccc

SEQ ID NO: 3381572 - RNA, 10 nt, Pseudomonas aeruginosa PA01
ccgcgcacca

SEQ ID NO: 3381573 - RNA, 17 nt, Pseudomonas aeruginosa PA01
ccgcgcacggaucgcgc

SEQ ID NO: 3381574 - RNA, 17 nt, Pseudomonas aeruginosa PA01
ccgcgcacuuguagagg

SEQ ID NO: 3381575 - RNA, 20 nt, Pseudomonas aeruginosa PA01
ccgcgcagaucgcguccagg

SEQ ID NO: 3381576 - RNA, 22 nt, Pseudomonas aeruginosa PA01
ccgcgcagaucgcguccagggu

SEQ ID NO: 3381577 - RNA, 18 nt, Pseudomonas aeruginosa PA01
ccgcgcagcaacggcgca

SEQ ID NO: 3381578 - RNA, 16 nt, Pseudomonas aeruginosa PA01
ccgcgcagcacuuccu

SEQ ID NO: 3381579 - RNA, 12 nt, Pseudomonas aeruginosa PA01
ccgcgcagcgcg

SEQ ID NO: 3381580 - RNA, 14 nt, Pseudomonas aeruginosa PA01
ccgcgcagcuugcc

SEQ ID NO: 3381581 - RNA, 21 nt, Pseudomonas aeruginosa PA01
ccgcgcagcuugccuuccagg

SEQ ID NO: 3381582 - RNA, 22 nt, Pseudomonas aeruginosa PA01
ccgcgcagcuugccuuccaggc

SEQ ID NO: 3381583 - RNA, 12 nt, Pseudomonas aeruginosa PA01
ccgcgcaggaag

SEQ ID NO: 3381584 - RNA, 22 nt, Pseudomonas aeruginosa PA01
ccgcgcaggaccacgcugguca

SEQ ID NO: 3381585 - RNA, 18 nt, Pseudomonas aeruginosa PA01
ccgcgcaggcggucgccg

SEQ ID NO: 3381586 - RNA, 19 nt, Pseudomonas aeruginosa PA01
ccgcgcaggcggucgccga

SEQ ID NO: 3381587 - RNA, 16 nt, Pseudomonas aeruginosa PA01
ccgcgcauaggaggcg

SEQ ID NO: 3381588 - RNA, 22 nt, Pseudomonas aeruginosa PA01
ccgcgcauggagacggcccgcc

SEQ ID NO: 3381589 - RNA, 12 nt, Pseudomonas aeruginosa PA01
ccgcgcauggcg

SEQ ID NO: 3381590 - RNA, 15 nt, Pseudomonas aeruginosa PA01
ccgcgcauggcggcg

SEQ ID NO: 3381591 - RNA, 19 nt, Pseudomonas aeruginosa PA01
ccgcgcauggcggcgaccg

SEQ ID NO: 3381592 - RNA, 17 nt, Pseudomonas aeruginosa PA01
ccgcgccaaaaagcagg

SEQ ID NO: 3381593 - RNA, 17 nt, Pseudomonas aeruginosa PA01
ccgcgccaacuggcgca

SEQ ID NO: 3381594 - RNA, 17 nt, Pseudomonas aeruginosa PA01
ccgcgccacgcgcaucg

SEQ ID NO: 3381595 - RNA, 17 nt, Pseudomonas aeruginosa PA01
ccgcgccacgcucuccg

SEQ ID NO: 3381596 - RNA, 23 nt, Pseudomonas aeruginosa PA01
ccgcgccacgcucuccgucaaug

SEQ ID NO: 3381597 - RNA, 16 nt, Pseudomonas aeruginosa PA01
ccgcgccacgggcaga

SEQ ID NO: 3381598 - RNA, 17 nt, Pseudomonas aeruginosa PA01
ccgcgccacgggcagac

SEQ ID NO: 3381599 - RNA, 13 nt, Pseudomonas aeruginosa PA01
ccgcgccagcagg

SEQ ID NO: 3381600 - RNA, 14 nt, Pseudomonas aeruginosa PA01
ccgcgccagcaggc

SEQ ID NO: 3381601 - RNA, 19 nt, Pseudomonas aeruginosa PA01
ccgcgccagcaggcgcagc

SEQ ID NO: 3381602 - RNA, 21 nt, Pseudomonas aeruginosa PA01
ccgcgccagccacucccggcc

SEQ ID NO: 3381603 - RNA, 22 nt, Pseudomonas aeruginosa PA01
ccgcgccagccacucccggccc

SEQ ID NO: 3381604 - RNA, 14 nt, Pseudomonas aeruginosa PA01
ccgcgccagcgccg

SEQ ID NO: 3381605 - RNA, 19 nt, Pseudomonas aeruginosa PA01
ccgcgccagcgccgccagu

SEQ ID NO: 3381606 - RNA, 13 nt, Pseudomonas aeruginosa PA01
ccgcgccaggcgc

SEQ ID NO: 3381607 - RNA, 23 nt, Pseudomonas aeruginosa PA01
ccgcgccaggcgcaguaggccug

SEQ ID NO: 3381608 - RNA, 14 nt, Pseudomonas aeruginosa PA01
ccgcgccagugccu

SEQ ID NO: 3381609 - RNA, 22 nt, Pseudomonas aeruginosa PA01
ccgcgccaucggucgcgccccc

SEQ ID NO: 3381610 - RNA, 13 nt, Pseudomonas aeruginosa PA01
ccgcgccaugccg

SEQ ID NO: 3381611 - RNA, 14 nt, Pseudomonas aeruginosa PA01
ccgcgccaugccgg

SEQ ID NO: 3381612 - RNA, 15 nt, Pseudomonas aeruginosa PA01
ccgcgccaugccggc

SEQ ID NO: 3381613 - RNA, 12 nt, Pseudomonas aeruginosa PA01
ccgcgcccaggc

SEQ ID NO: 3381614 - RNA, 16 nt, Pseudomonas aeruginosa PA01
ccgcgcccaggcgcac

SEQ ID NO: 3381615 - RNA, 15 nt, Pseudomonas aeruginosa PA01
ccgcgcccaggcugc

SEQ ID NO: 3381616 - RNA, 18 nt, Pseudomonas aeruginosa PA01
ccgcgcccaggcugccgg

SEQ ID NO: 3381617 - RNA, 19 nt, Pseudomonas aeruginosa PA01
ccgcgcccaggcugccggc

SEQ ID NO: 3381618 - RNA, 14 nt, Pseudomonas aeruginosa PA01
ccgcgcugcgccag

SEQ ID NO: 3381619 - RNA, 15 nt, Pseudomonas aeruginosa PA01
ccgcgcugcgccagg

SEQ ID NO: 3381620 - RNA, 18 nt, Pseudomonas aeruginosa PA01
ccgcgcugcgccaggccg

SEQ ID NO: 3381621 - RNA, 12 nt, Pseudomonas aeruginosa PA01
ccgcgcugcugc

SEQ ID NO: 3381622 - RNA, 14 nt, Pseudomonas aeruginosa PA01
ccgcgcugucggcc

SEQ ID NO: 3381623 - RNA, 15 nt, Pseudomonas aeruginosa PA01
ccgcgcugucggccu

SEQ ID NO: 3381624 - RNA, 16 nt, Pseudomonas aeruginosa PA01
ccgcgcugucggccuc

SEQ ID NO: 3381625 - RNA, 17 nt, Pseudomonas aeruginosa PA01
ccgcgcugucggccucg

SEQ ID NO: 3381626 - RNA, 18 nt, Pseudomonas aeruginosa PA01
ccgcgcugucggccucga

SEQ ID NO: 3381627 - RNA, 19 nt, Pseudomonas aeruginosa PA01
ccgcgcuuccgcaucggcc

SEQ ID NO: 3381628 - RNA, 20 nt, Pseudomonas aeruginosa PA01
ccgcgcuuccgcaucggccg

SEQ ID NO: 3381629 - RNA, 15 nt, Pseudomonas aeruginosa PA01
ccgcgcuucuucgac

SEQ ID NO: 3381630 - RNA, 23 nt, Pseudomonas aeruginosa PA01
ccgcgcuuggccuugccguccag

SEQ ID NO: 3381631 - RNA, 22 nt, Pseudomonas aeruginosa PA01
ccgcggaaaacgccgcgaagcc

SEQ ID NO: 3381632 - RNA, 22 nt, Pseudomonas aeruginosa PA01
ccgcggaaggcccgcgagccgc

SEQ ID NO: 3381633 - RNA, 17 nt, Pseudomonas aeruginosa PA01
ccgcggaagugcgccgg

SEQ ID NO: 3381634 - RNA, 19 nt, Pseudomonas aeruginosa PA01
ccgcggaaucgcguagcgc

SEQ ID NO: 3381635 - RNA, 17 nt, Pseudomonas aeruginosa PA01
ccgcggaccgggcggcg

SEQ ID NO: 3381636 - RNA, 18 nt, Pseudomonas aeruginosa PA01
ccgcggaccgggcggcgc

SEQ ID NO: 3381637 - RNA, 22 nt, Pseudomonas aeruginosa PA01
ccgcggaccgggcggcgcggcg

SEQ ID NO: 3381638 - RNA, 21 nt, Pseudomonas aeruginosa PA01
ccgcggacgauauugguguag

SEQ ID NO: 3381639 - RNA, 21 nt, Pseudomonas aeruginosa PA01
ccgcggacggccggcucggug

SEQ ID NO: 3381640 - RNA, 21 nt, Pseudomonas aeruginosa PA01
ccgcggagaaacgcuuggcga

SEQ ID NO: 3381641 - RNA, 13 nt, Pseudomonas aeruginosa PA01
ccgcggagcaccg

SEQ ID NO: 3381642 - RNA, 12 nt, Pseudomonas aeruginosa PA01
ccgcggagucgc

SEQ ID NO: 3381643 - RNA, 16 nt, Pseudomonas aeruginosa PA01
ccgcggagucgccggu

SEQ ID NO: 3381644 - RNA, 21 nt, Pseudomonas aeruginosa PA01
ccgcggaucaccuggccgugc

SEQ ID NO: 3381645 - RNA, 23 nt, Pseudomonas aeruginosa PA01
ccgcggauccacgccuggcccug

SEQ ID NO: 3381646 - RNA, 15 nt, Pseudomonas aeruginosa PA01
ccgcggaucgcgccg

SEQ ID NO: 3381647 - RNA, 21 nt, Pseudomonas aeruginosa PA01
ccgcggaucgcgccgucgcug

SEQ ID NO: 3381648 - RNA, 15 nt, Pseudomonas aeruginosa PA01
ccgcggaucguccgg

SEQ ID NO: 3381649 - RNA, 18 nt, Pseudomonas aeruginosa PA01
ccgcggaugacgggcgaa

SEQ ID NO: 3381650 - RNA, 19 nt, Pseudomonas aeruginosa PA01
ccgcggaugacgggcgaag

SEQ ID NO: 3381651 - RNA, 18 nt, Pseudomonas aeruginosa PA01
ccgcggcaaugcggcgau

SEQ ID NO: 3381652 - RNA, 17 nt, Pseudomonas aeruginosa PA01
ccgcggcaccggcgacg

SEQ ID NO: 3381653 - RNA, 23 nt, Pseudomonas aeruginosa PA01
ccgcggcagaucccaucgcccug

SEQ ID NO: 3381654 - RNA, 11 nt, Pseudomonas aeruginosa PA01
ccgcggcagca

SEQ ID NO: 3381655 - RNA, 14 nt, Pseudomonas aeruginosa PA01
ccgcggcagcagcc

SEQ ID NO: 3381656 - RNA, 15 nt, Pseudomonas aeruginosa PA01
ccgcggcagcagcca

SEQ ID NO: 3381657 - RNA, 16 nt, Pseudomonas aeruginosa PA01
ccgcggcaucggccug

SEQ ID NO: 3381658 - RNA, 14 nt, Pseudomonas aeruginosa PA01
ccgcggccagcccc

SEQ ID NO: 3381659 - RNA, 15 nt, Pseudomonas aeruginosa PA01
ccgcggcccaagggc

SEQ ID NO: 3381660 - RNA, 12 nt, Pseudomonas aeruginosa PA01
ccgcggccccgg

SEQ ID NO: 3381661 - RNA, 13 nt, Pseudomonas aeruginosa PA01
ccgcggccccggc

SEQ ID NO: 3381662 - RNA, 14 nt, Pseudomonas aeruginosa PA01
ccgcggccccggcg

SEQ ID NO: 3381663 - RNA, 20 nt, Pseudomonas aeruginosa PA01
ccgcggcccugcgccgcagc

SEQ ID NO: 3381664 - RNA, 15 nt, Pseudomonas aeruginosa PA01
ccgcggcccugcucg

SEQ ID NO: 3381665 - RNA, 23 nt, Pseudomonas aeruginosa PA01
ccgcggccgaaaucgaugucgcg

SEQ ID NO: 3381666 - RNA, 13 nt, Pseudomonas aeruginosa PA01
ccgcggccggcag

SEQ ID NO: 3381667 - RNA, 16 nt, Pseudomonas aeruginosa PA01
ccgcggccggcaggcc

SEQ ID NO: 3381668 - RNA, 22 nt, Pseudomonas aeruginosa PA01
ccgcggccggcaggccgauggc

SEQ ID NO: 3381669 - RNA, 13 nt, Pseudomonas aeruginosa PA01
ccgcggccggcuu

SEQ ID NO: 3381670 - RNA, 19 nt, Pseudomonas aeruginosa PA01
ccgcggccggcuucagcaa

SEQ ID NO: 3381671 - RNA, 13 nt, Pseudomonas aeruginosa PA01
ccgcggccgggga

SEQ ID NO: 3381672 - RNA, 19 nt, Pseudomonas aeruginosa PA01
ccgcggccggggaacaggu

SEQ ID NO: 3381673 - RNA, 13 nt, Pseudomonas aeruginosa PA01
ccgcggccucgcu

SEQ ID NO: 3381674 - RNA, 18 nt, Pseudomonas aeruginosa PA01
ccgcggccucgcuggcga

SEQ ID NO: 3381675 - RNA, 14 nt, Pseudomonas aeruginosa PA01
ccgcggccugcucg

SEQ ID NO: 3381676 - RNA, 15 nt, Pseudomonas aeruginosa PA01
ccgcggccugcucgg

SEQ ID NO: 3381677 - RNA, 19 nt, Pseudomonas aeruginosa PA01
ccgcggcgaagcgcucgac

SEQ ID NO: 3381678 - RNA, 18 nt, Pseudomonas aeruginosa PA01
ccgcggcgaccagcgcgg

SEQ ID NO: 3381679 - RNA, 12 nt, Pseudomonas aeruginosa PA01
ccgcggcgacgg

SEQ ID NO: 3381680 - RNA, 20 nt, Pseudomonas aeruginosa PA01
ccgcggcgacggcucuuccc

SEQ ID NO: 3381681 - RNA, 21 nt, Pseudomonas aeruginosa PA01
ccgcggcgacggcucuucccc

SEQ ID NO: 3381682 - RNA, 16 nt, Pseudomonas aeruginosa PA01
ccgcggcgagcagcgg

SEQ ID NO: 3381683 - RNA, 22 nt, Pseudomonas aeruginosa PA01
ccgcggcgagcaucucggccag

SEQ ID NO: 3381684 - RNA, 23 nt, Pseudomonas aeruginosa PA01
ccgcggcgagcaucucggccagg

SEQ ID NO: 3381685 - RNA, 18 nt, Pseudomonas aeruginosa PA01
ccgcggcgauaggcgcgc

SEQ ID NO: 3381686 - RNA, 21 nt, Pseudomonas aeruginosa PA01
ccgcggcgccacgcucaccgg

SEQ ID NO: 3381687 - RNA, 22 nt, Pseudomonas aeruginosa PA01
ccgcggcgcccucugccggucg

SEQ ID NO: 3381688 - RNA, 13 nt, Pseudomonas aeruginosa PA01
ccgcggcgcgccu

SEQ ID NO: 3381689 - RNA, 15 nt, Pseudomonas aeruginosa PA01
ccgcggcgcucggca

SEQ ID NO: 3381690 - RNA, 15 nt, Pseudomonas aeruginosa PA01
ccgcggcggcgacgc

SEQ ID NO: 3381691 - RNA, 14 nt, Pseudomonas aeruginosa PA01
ccgcggcggcgugc

SEQ ID NO: 3381692 - RNA, 15 nt, Pseudomonas aeruginosa PA01
ccgcggcggcgugca

SEQ ID NO: 3381693 - RNA, 19 nt, Pseudomonas aeruginosa PA01
ccgcggcggcgugcaggcc

SEQ ID NO: 3381694 - RNA, 21 nt, Pseudomonas aeruginosa PA01
ccgcggcggcgugcaggccga

SEQ ID NO: 3381695 - RNA, 20 nt, Pseudomonas aeruginosa PA01
ccgcggcguaaucgcgccag

SEQ ID NO: 3381696 - RNA, 22 nt, Pseudomonas aeruginosa PA01
ccgcggcguuagccgccugcgg

SEQ ID NO: 3381697 - RNA, 24 nt, Pseudomonas aeruginosa PA01
ccgcggcguugucggccagcagca

SEQ ID NO: 3381698 - RNA, 14 nt, Pseudomonas aeruginosa PA01
ccgcggcuccagcc

SEQ ID NO: 3381699 - RNA, 17 nt, Pseudomonas aeruginosa PA01
ccgcggcugaugccgcg

SEQ ID NO: 3381700 - RNA, 22 nt, Pseudomonas aeruginosa PA01
ccgcggcuggcaggugccgcuc

SEQ ID NO: 3381701 - RNA, 14 nt, Pseudomonas aeruginosa PA01
ccgcggcuggccau

SEQ ID NO: 3381702 - RNA, 19 nt, Pseudomonas aeruginosa PA01
ccgcggcuggccauccgcc

SEQ ID NO: 3381703 - RNA, 14 nt, Pseudomonas aeruginosa PA01
ccgcgggacgccgc

SEQ ID NO: 3381704 - RNA, 12 nt, Pseudomonas aeruginosa PA01
ccgcgggacgcg

SEQ ID NO: 3381705 - RNA, 15 nt, Pseudomonas aeruginosa PA01
ccgcgggacgcggcg

SEQ ID NO: 3381706 - RNA, 14 nt, Pseudomonas aeruginosa PA01
ccgcgggaggccgc

SEQ ID NO: 3381707 - RNA, 21 nt, Pseudomonas aeruginosa PA01
ccgcgggaggccgccucgacc

SEQ ID NO: 3381708 - RNA, 13 nt, Pseudomonas aeruginosa PA01
ccgcgggcagcuc

SEQ ID NO: 3381709 - RNA, 14 nt, Pseudomonas aeruginosa PA01
ccgcgggccagccg

SEQ ID NO: 3381710 - RNA, 15 nt, Pseudomonas aeruginosa PA01
ccgcgggcgaacggc

SEQ ID NO: 3381711 - RNA, 18 nt, Pseudomonas aeruginosa PA01
ccgcgggcgaacggcagc

SEQ ID NO: 3381712 - RNA, 22 nt, Pseudomonas aeruginosa PA01
ccgcgggcgaacggcagcgucu

SEQ ID NO: 3381713 - RNA, 23 nt, Pseudomonas aeruginosa PA01
ccgcgggcgccuuuuucauggcc

SEQ ID NO: 3381714 - RNA, 21 nt, Pseudomonas aeruginosa PA01
ccgcggggaggaagcuccccg

SEQ ID NO: 3381715 - RNA, 22 nt, Pseudomonas aeruginosa PA01
ccgcggggaggaagcuccccgc

SEQ ID NO: 3381716 - RNA, 13 nt, Pseudomonas aeruginosa PA01
ccgcgggucacca

SEQ ID NO: 3381717 - RNA, 16 nt, Pseudomonas aeruginosa PA01
ccgcgggucaccagcg

SEQ ID NO: 3381718 - RNA, 20 nt, Pseudomonas aeruginosa PA01
ccgcgggucaccagcgccgg

SEQ ID NO: 3381719 - RNA, 17 nt, Pseudomonas aeruginosa PA01
ccgcgggucucgaucag

SEQ ID NO: 3381720 - RNA, 18 nt, Pseudomonas aeruginosa PA01
ccgcgggucucgaucagc

SEQ ID NO: 3381721 - RNA, 14 nt, Pseudomonas aeruginosa PA01
ccgcucccaggcaa

SEQ ID NO: 3381722 - RNA, 17 nt, Pseudomonas aeruginosa PA01
ccgcuccccacucggcc

SEQ ID NO: 3381723 - RNA, 18 nt, Pseudomonas aeruginosa PA01
ccgcuccccacucggcca

SEQ ID NO: 3381724 - RNA, 15 nt, Pseudomonas aeruginosa PA01
ccgcuccgcggccgg

SEQ ID NO: 3381725 - RNA, 16 nt, Pseudomonas aeruginosa PA01
ccgcuccgcggccggc

SEQ ID NO: 3381726 - RNA, 17 nt, Pseudomonas aeruginosa PA01
ccgcuccgcggccggcu

SEQ ID NO: 3381727 - RNA, 16 nt, Pseudomonas aeruginosa PA01
ccgcuccggcgccgag

SEQ ID NO: 3381728 - RNA, 19 nt, Pseudomonas aeruginosa PA01
ccgcuccggcucuccccgc

SEQ ID NO: 3381729 - RNA, 18 nt, Pseudomonas aeruginosa PA01
ccgcuccuggcaggcuca

SEQ ID NO: 3381730 - RNA, 13 nt, Pseudomonas aeruginosa PA01
ccgcucgacccgg

SEQ ID NO: 3381731 - RNA, 19 nt, Pseudomonas aeruginosa PA01
ccgcucgagggcgaccgcc

SEQ ID NO: 3381732 - RNA, 21 nt, Pseudomonas aeruginosa PA01
ccgcucgaguucgcgcggguc

SEQ ID NO: 3381733 - RNA, 16 nt, Pseudomonas aeruginosa PA01
ccgcucgaucccggcg

SEQ ID NO: 3381734 - RNA, 17 nt, Pseudomonas aeruginosa PA01
ccgcucgaucccggcgc

SEQ ID NO: 3381735 - RNA, 19 nt, Pseudomonas aeruginosa PA01
ccgcucgaucccggcgcgg

SEQ ID NO: 3381736 - RNA, 20 nt, Pseudomonas aeruginosa PA01
ccgcucgaugcccgccagca

SEQ ID NO: 3381737 - RNA, 23 nt, Pseudomonas aeruginosa PA01
ccgcucgaugcccgccagcaggc

SEQ ID NO: 3381738 - RNA, 13 nt, Pseudomonas aeruginosa PA01
ccgcucgccggga

SEQ ID NO: 3381739 - RNA, 14 nt, Pseudomonas aeruginosa PA01
ccgcucgcgcacgg

SEQ ID NO: 3381740 - RNA, 21 nt, Pseudomonas aeruginosa PA01
ccgcucgcgguuauccgccgc

SEQ ID NO: 3381741 - RNA, 22 nt, Pseudomonas aeruginosa PA01
ccgcucgcgguuauccgccgcc

SEQ ID NO: 3381742 - RNA, 23 nt, Pseudomonas aeruginosa PA01
ccgcucgcgguuauccgccgccg

SEQ ID NO: 3381743 - RNA, 23 nt, Pseudomonas aeruginosa PA01
ccgcucgcguccgcaguucgccc

SEQ ID NO: 3381744 - RNA, 15 nt, Pseudomonas aeruginosa PA01
ccgcucggccgccag

SEQ ID NO: 3381745 - RNA, 20 nt, Pseudomonas aeruginosa PA01
ccgcucggccuugagcgccg

SEQ ID NO: 3381746 - RNA, 14 nt, Pseudomonas aeruginosa PA01
ccgcucggcgagcc

SEQ ID NO: 3381747 - RNA, 19 nt, Pseudomonas aeruginosa PA01
ccgcucggcgagccgccgg

SEQ ID NO: 3381748 - RNA, 12 nt, Pseudomonas aeruginosa PA01
ccgcucggcggg

SEQ ID NO: 3381749 - RNA, 22 nt, Pseudomonas aeruginosa PA01
ccgcucggcggguauccgccgg

SEQ ID NO: 3381750 - RNA, 18 nt, Pseudomonas aeruginosa PA01
ccgcucggggcaucggcc

SEQ ID NO: 3381751 - RNA, 20 nt, Pseudomonas aeruginosa PA01
ccgcucggugccuucccagc

SEQ ID NO: 3381752 - RNA, 23 nt, Pseudomonas aeruginosa PA01
ccgcucggugccuucccagccga

SEQ ID NO: 3381753 - RNA, 15 nt, Pseudomonas aeruginosa PA01
ccgcucgucaggcgc

SEQ ID NO: 3381754 - RNA, 19 nt, Pseudomonas aeruginosa PA01
ccgcucgucauggcgcacg

SEQ ID NO: 3381755 - RNA, 13 nt, Pseudomonas aeruginosa PA01
ccgcucguccagu

SEQ ID NO: 3381756 - RNA, 19 nt, Pseudomonas aeruginosa PA01
ccgcucguccaguuccagg

SEQ ID NO: 3381757 - RNA, 16 nt, Pseudomonas aeruginosa PA01
ccgcucguuggcggcc

SEQ ID NO: 3381758 - RNA, 20 nt, Pseudomonas aeruginosa PA01
ccgcucguuggcggccagca

SEQ ID NO: 3381759 - RNA, 21 nt, Pseudomonas aeruginosa PA01
ccgcucguuggcggccagcau

SEQ ID NO: 3381760 - RNA, 15 nt, Pseudomonas aeruginosa PA01
ccgcucugcagugcg

SEQ ID NO: 3381761 - RNA, 13 nt, Pseudomonas aeruginosa PA01
ccgcucugccaga

SEQ ID NO: 3381762 - RNA, 20 nt, Pseudomonas aeruginosa PA01
ccgcucugccagaaggccug

SEQ ID NO: 3381763 - RNA, 17 nt, Pseudomonas aeruginosa PA01
ccgcucugcccgaccgg

SEQ ID NO: 3381764 - RNA, 12 nt, Pseudomonas aeruginosa PA01
ccgcucugcugg

SEQ ID NO: 3381765 - RNA, 15 nt, Pseudomonas aeruginosa PA01
ccgcucugcuggcca

SEQ ID NO: 3381766 - RNA, 17 nt, Pseudomonas aeruginosa PA01
ccgcucugcuggccacc

SEQ ID NO: 3381767 - RNA, 15 nt, Pseudomonas aeruginosa PA01
ccgcucugcuggccg

SEQ ID NO: 3381768 - RNA, 16 nt, Pseudomonas aeruginosa PA01
ccgcucuggcugcugg

SEQ ID NO: 3381769 - RNA, 22 nt, Pseudomonas aeruginosa PA01
ccgcucuucugguaggccagca

SEQ ID NO: 3381770 - RNA, 14 nt, Pseudomonas aeruginosa PA01
ccgcucuugauacc

SEQ ID NO: 3381771 - RNA, 17 nt, Pseudomonas aeruginosa PA01
ccgcugaaauagcgcgu

SEQ ID NO: 3381772 - RNA, 22 nt, Pseudomonas aeruginosa PA01
ccgcugaaguccuggccgagca

SEQ ID NO: 3381773 - RNA, 20 nt, Pseudomonas aeruginosa PA01
ccgcugaauaccaccgggcc

SEQ ID NO: 3381774 - RNA, 22 nt, Pseudomonas aeruginosa PA01
ccgcugaccgggcggaucgcca

SEQ ID NO: 3381775 - RNA, 19 nt, Pseudomonas aeruginosa PA01
ccgcugaggauguagccgg

SEQ ID NO: 3381776 - RNA, 21 nt, Pseudomonas aeruginosa PA01
ccgcugaggauguagccggcu

SEQ ID NO: 3381777 - RNA, 22 nt, Pseudomonas aeruginosa PA01
ccgcugaggauguagccggcuu

SEQ ID NO: 3381778 - RNA, 16 nt, Pseudomonas aeruginosa PA01
ccgcugaggcucgccg

SEQ ID NO: 3381779 - RNA, 20 nt, Pseudomonas aeruginosa PA01
ccgcugaucaguaccggcag

SEQ ID NO: 3381780 - RNA, 21 nt, Pseudomonas aeruginosa PA01
ccgcugaucaguaccggcagc

SEQ ID NO: 3381781 - RNA, 15 nt, Pseudomonas aeruginosa PA01
ccgcugaugcgcugg

SEQ ID NO: 3381782 - RNA, 16 nt, Pseudomonas aeruginosa PA01
ccgcugaugcgcuggu

SEQ ID NO: 3381783 - RNA, 15 nt, Pseudomonas aeruginosa PA01
ccgcugcaaaaaagc

SEQ ID NO: 3381784 - RNA, 20 nt, Pseudomonas aeruginosa PA01
ccgcugcaaaaaagcgcgcc

SEQ ID NO: 3381785 - RNA, 21 nt, Pseudomonas aeruginosa PA01
ccgcugcaaaaaagcgcgccc

SEQ ID NO: 3381786 - RNA, 16 nt, Pseudomonas aeruginosa PA01
ccgcugcaacuccgcc

SEQ ID NO: 3381787 - RNA, 18 nt, Pseudomonas aeruginosa PA01
ccgcugcaacuccgccug

SEQ ID NO: 3381788 - RNA, 13 nt, Pseudomonas aeruginosa PA01
ccgcugcaccagc

SEQ ID NO: 3381789 - RNA, 14 nt, Pseudomonas aeruginosa PA01
ccgcugcaccagcu

SEQ ID NO: 3381790 - RNA, 13 nt, Pseudomonas aeruginosa PA01
ccgcugcacgccu

SEQ ID NO: 3381791 - RNA, 19 nt, Pseudomonas aeruginosa PA01
ccgcugcacgccuuccggg

SEQ ID NO: 3381792 - RNA, 15 nt, Pseudomonas aeruginosa PA01
ccgcugcaggccacc

SEQ ID NO: 3381793 - RNA, 16 nt, Pseudomonas aeruginosa PA01
ccgcugcagggcggcg

SEQ ID NO: 3381794 - RNA, 20 nt, Pseudomonas aeruginosa PA01
ccgcugcagggcggcgcugu

SEQ ID NO: 3381795 - RNA, 23 nt, Pseudomonas aeruginosa PA01
ccgcugcaugaaaaagcccggcc

SEQ ID NO: 3381796 - RNA, 15 nt, Pseudomonas aeruginosa PA01
ccgcugcauggggau

SEQ ID NO: 3381797 - RNA, 19 nt, Pseudomonas aeruginosa PA01
ccgcugcaugugccaggcc

SEQ ID NO: 3381798 - RNA, 20 nt, Pseudomonas aeruginosa PA01
ccgcugcaugugccaggccu

SEQ ID NO: 3381799 - RNA, 13 nt, Pseudomonas aeruginosa PA01
ccgcugccgccgc

SEQ ID NO: 3381800 - RNA, 18 nt, Pseudomonas aeruginosa PA01
ccgcugccgccgcgcagg

SEQ ID NO: 3381801 - RNA, 13 nt, Pseudomonas aeruginosa PA01
ccgcugccgccgu

SEQ ID NO: 3381802 - RNA, 14 nt, Pseudomonas aeruginosa PA01
ccgcugccgccguc

SEQ ID NO: 3381803 - RNA, 15 nt, Pseudomonas aeruginosa PA01
ccgcugccgccgucu

SEQ ID NO: 3381804 - RNA, 21 nt, Pseudomonas aeruginosa PA01
ccgcugccgccgucuccgccg

SEQ ID NO: 3381805 - RNA, 15 nt, Pseudomonas aeruginosa PA01
ccgcugccgcucugg

SEQ ID NO: 3381806 - RNA, 19 nt, Pseudomonas aeruginosa PA01
ccgcugccgcucuggcugc

SEQ ID NO: 3381807 - RNA, 20 nt, Pseudomonas aeruginosa PA01
ccgcugccgcucuggcugcu

SEQ ID NO: 3381808 - RNA, 19 nt, Pseudomonas aeruginosa PA01
ccgcugccggcgggacgcg

SEQ ID NO: 3381809 - RNA, 20 nt, Pseudomonas aeruginosa PA01
ccgcugccugucgcagcggg

SEQ ID NO: 3381810 - RNA, 21 nt, Pseudomonas aeruginosa PA01
ccgcugccugucgcagcgggc

SEQ ID NO: 3381811 - RNA, 22 nt, Pseudomonas aeruginosa PA01
ccgcugccugucgcagcgggca

SEQ ID NO: 3381812 - RNA, 15 nt, Pseudomonas aeruginosa PA01
ccgcugcgcaggccg

SEQ ID NO: 3381813 - RNA, 17 nt, Pseudomonas aeruginosa PA01
ccgcugcgcaggccgag

SEQ ID NO: 3381814 - RNA, 22 nt, Pseudomonas aeruginosa PA01
ccgcugcgcaggccgagaaggu

SEQ ID NO: 3381815 - RNA, 14 nt, Pseudomonas aeruginosa PA01
ccgcugcgccgccg

SEQ ID NO: 3381816 - RNA, 15 nt, Pseudomonas aeruginosa PA01
ccgcugcgccgccgu

SEQ ID NO: 3381817 - RNA, 22 nt, Pseudomonas aeruginosa PA01
ccgcugcgccgccgucuugccg

SEQ ID NO: 3381818 - RNA, 11 nt, Pseudomonas aeruginosa PA01
ccgcugcgcga

SEQ ID NO: 3381819 - RNA, 14 nt, Pseudomonas aeruginosa PA01
ccgcugcgcgaagc

SEQ ID NO: 3381820 - RNA, 18 nt, Pseudomonas aeruginosa PA01
ccgcugcgcgcaguucag

SEQ ID NO: 3381821 - RNA, 14 nt, Pseudomonas aeruginosa PA01
ccgcugcgcggguc

SEQ ID NO: 3381822 - RNA, 20 nt, Pseudomonas aeruginosa PA01
ccgcugcgcgggucuugccg

SEQ ID NO: 3381823 - RNA, 22 nt, Pseudomonas aeruginosa PA01
ccggaagcgcucgcgcuuccgg

SEQ ID NO: 3381824 - RNA, 17 nt, Pseudomonas aeruginosa PA01
ccggaagcuucaggcuc

SEQ ID NO: 3381825 - RNA, 21 nt, Pseudomonas aeruginosa PA01
ccggaagcuucaggcucggcc

SEQ ID NO: 3381826 - RNA, 23 nt, Pseudomonas aeruginosa PA01
ccggaagcuucaggcucggccug

SEQ ID NO: 3381827 - RNA, 17 nt, Pseudomonas aeruginosa PA01
ccggaaucacgcugcuc

SEQ ID NO: 3381828 - RNA, 17 nt, Pseudomonas aeruginosa PA01
ccggaaucacgucgauc

SEQ ID NO: 3381829 - RNA, 20 nt, Pseudomonas aeruginosa PA01
ccggaaucacgucgaucugc

SEQ ID NO: 3381830 - RNA, 19 nt, Pseudomonas aeruginosa PA01
ccggacaacaggccgggcg

SEQ ID NO: 3381831 - RNA, 23 nt, Pseudomonas aeruginosa PA01
ccggacacaaaaaaaccgccccg

SEQ ID NO: 3381832 - RNA, 17 nt, Pseudomonas aeruginosa PA01
ccggacaggccacccgc

SEQ ID NO: 3381833 - RNA, 19 nt, Pseudomonas aeruginosa PA01
ccggacaggccacccgccu

SEQ ID NO: 3381834 - RNA, 17 nt, Pseudomonas aeruginosa PA01
ccggacauaucgaucac

SEQ ID NO: 3381835 - RNA, 13 nt, Pseudomonas aeruginosa PA01
ccggaccagggcg

SEQ ID NO: 3381836 - RNA, 15 nt, Pseudomonas aeruginosa PA01
ccggaccagggcgcc

SEQ ID NO: 3381837 - RNA, 16 nt, Pseudomonas aeruginosa PA01
ccggaccagggcgccg

SEQ ID NO: 3381838 - RNA, 17 nt, Pseudomonas aeruginosa PA01
ccggaccagggcgccgg

SEQ ID NO: 3381839 - RNA, 19 nt, Pseudomonas aeruginosa PA01
ccggaccagggcgccgggc

SEQ ID NO: 3381840 - RNA, 14 nt, Pseudomonas aeruginosa PA01
ccggacccggcugc

SEQ ID NO: 3381841 - RNA, 17 nt, Pseudomonas aeruginosa PA01
ccggacccggcugcacg

SEQ ID NO: 3381842 - RNA, 17 nt, Pseudomonas aeruginosa PA01
ccggaccggcucucuuc

SEQ ID NO: 3381843 - RNA, 15 nt, Pseudomonas aeruginosa PA01
ccggaccgggcggca

SEQ ID NO: 3381844 - RNA, 17 nt, Pseudomonas aeruginosa PA01
ccggaccgggcggcagg

SEQ ID NO: 3381845 - RNA, 17 nt, Pseudomonas aeruginosa PA01
ccggaccucucucgcug

SEQ ID NO: 3381846 - RNA, 22 nt, Pseudomonas aeruginosa PA01
ccggacgacgaaagaagccgca

SEQ ID NO: 3381847 - RNA, 23 nt, Pseudomonas aeruginosa PA01
ccggacgacgaaagaagccgcac

SEQ ID NO: 3381848 - RNA, 14 nt, Pseudomonas aeruginosa PA01
ccggacgcaccagc

SEQ ID NO: 3381849 - RNA, 15 nt, Pseudomonas aeruginosa PA01
ccggacgcaccagca

SEQ ID NO: 3381850 - RNA, 22 nt, Pseudomonas aeruginosa PA01
ccggacgcaccagcaggccgau

SEQ ID NO: 3381851 - RNA, 20 nt, Pseudomonas aeruginosa PA01
ccggacggcugaggcuggcg

SEQ ID NO: 3381852 - RNA, 17 nt, Pseudomonas aeruginosa PA01
ccggacugcccagcgcc

SEQ ID NO: 3381853 - RNA, 19 nt, Pseudomonas aeruginosa PA01
ccggacugcccagcgccgc

SEQ ID NO: 3381854 - RNA, 23 nt, Pseudomonas aeruginosa PA01
ccggacugcccagcgccgccagc

SEQ ID NO: 3381855 - RNA, 21 nt, Pseudomonas aeruginosa PA01
ccggacugcccgacgaagacg

SEQ ID NO: 3381856 - RNA, 20 nt, Pseudomonas aeruginosa PA01
ccggacuggauucggccugc

SEQ ID NO: 3381857 - RNA, 22 nt, Pseudomonas aeruginosa PA01
ccggacuggauucggccugccg

SEQ ID NO: 3381858 - RNA, 21 nt, Pseudomonas aeruginosa PA01
ccggacuuggagaagaucgcc

SEQ ID NO: 3381859 - RNA, 14 nt, Pseudomonas aeruginosa PA01
ccggagaacgccgc

SEQ ID NO: 3381860 - RNA, 16 nt, Pseudomonas aeruginosa PA01
ccggagaacgccgcca

SEQ ID NO: 3381861 - RNA, 23 nt, Pseudomonas aeruginosa PA01
ccggagaacgccgccacgccgau

SEQ ID NO: 3381862 - RNA, 14 nt, Pseudomonas aeruginosa PA01
ccggagaccgugcc

SEQ ID NO: 3381863 - RNA, 15 nt, Pseudomonas aeruginosa PA01
ccggagaccgugccg

SEQ ID NO: 3381864 - RNA, 17 nt, Pseudomonas aeruginosa PA01
ccggagaccgugccgcc

SEQ ID NO: 3381865 - RNA, 18 nt, Pseudomonas aeruginosa PA01
ccggagaccgugccgccg

SEQ ID NO: 3381866 - RNA, 19 nt, Pseudomonas aeruginosa PA01
ccggagaccgugccgccgg

SEQ ID NO: 3381867 - RNA, 20 nt, Pseudomonas aeruginosa PA01
ccggagaccgugccgccggg

SEQ ID NO: 3381868 - RNA, 21 nt, Pseudomonas aeruginosa PA01
ccggagagcgaauacaccgag

SEQ ID NO: 3381869 - RNA, 14 nt, Pseudomonas aeruginosa PA01
ccggagaucgccgc

SEQ ID NO: 3381870 - RNA, 17 nt, Pseudomonas aeruginosa PA01
ccggagaucgccgcgcc

SEQ ID NO: 3381871 - RNA, 18 nt, Pseudomonas aeruginosa PA01
ccggagaucgccgcgccg

SEQ ID NO: 3381872 - RNA, 16 nt, Pseudomonas aeruginosa PA01
ccggagaucggcugca

SEQ ID NO: 3381873 - RNA, 12 nt, Pseudomonas aeruginosa PA01
ccggagcaggcc

SEQ ID NO: 3381874 - RNA, 21 nt, Pseudomonas aeruginosa PA01
ccggagcaggccauggguguc

SEQ ID NO: 3381875 - RNA, 14 nt, Pseudomonas aeruginosa PA01
ccggagccaacgcc

SEQ ID NO: 3381876 - RNA, 22 nt, Pseudomonas aeruginosa PA01
ccggagccaccgggaucuggcc

SEQ ID NO: 3381877 - RNA, 13 nt, Pseudomonas aeruginosa PA01
ccggagccgggca

SEQ ID NO: 3381878 - RNA, 15 nt, Pseudomonas aeruginosa PA01
ccggagccgggcaac

SEQ ID NO: 3381879 - RNA, 12 nt, Pseudomonas aeruginosa PA01
ccggagcggcug

SEQ ID NO: 3381880 - RNA, 22 nt, Pseudomonas aeruginosa PA01
ccggagcggcugccgaggcuga

SEQ ID NO: 3381881 - RNA, 18 nt, Pseudomonas aeruginosa PA01
ccggagcuuugcagggcg

SEQ ID NO: 3381882 - RNA, 19 nt, Pseudomonas aeruginosa PA01
ccggagcuuugcagggcga

SEQ ID NO: 3381883 - RNA, 16 nt, Pseudomonas aeruginosa PA01
ccggaggcagcgaugc

SEQ ID NO: 3381884 - RNA, 13 nt, Pseudomonas aeruginosa PA01
ccggaggcgcaca

SEQ ID NO: 3381885 - RNA, 16 nt, Pseudomonas aeruginosa PA01
ccggaggcgcacaggc

SEQ ID NO: 3381886 - RNA, 19 nt, Pseudomonas aeruginosa PA01
ccggaggcgcacaggcgga

SEQ ID NO: 3381887 - RNA, 13 nt, Pseudomonas aeruginosa PA01
ccggaggcggcga

SEQ ID NO: 3381888 - RNA, 14 nt, Pseudomonas aeruginosa PA01
ccggaggggcggcc

SEQ ID NO: 3381889 - RNA, 15 nt, Pseudomonas aeruginosa PA01
ccggaggggcggccg

SEQ ID NO: 3381890 - RNA, 18 nt, Pseudomonas aeruginosa PA01
ccggagucguagcgcgcg

SEQ ID NO: 3381891 - RNA, 19 nt, Pseudomonas aeruginosa PA01
ccggagucguagcgcgcgg

SEQ ID NO: 3381892 - RNA, 20 nt, Pseudomonas aeruginosa PA01
ccggagucguagcgcgcggc

SEQ ID NO: 3381893 - RNA, 21 nt, Pseudomonas aeruginosa PA01
ccggagucguagcgcgcggcg

SEQ ID NO: 3381894 - RNA, 22 nt, Pseudomonas aeruginosa PA01
ccggauacaccagguuggccag

SEQ ID NO: 3381895 - RNA, 23 nt, Pseudomonas aeruginosa PA01
ccggauacaccagguuggccagu

SEQ ID NO: 3381896 - RNA, 23 nt, Pseudomonas aeruginosa PA01
ccggauaccccgguugugcgccc

SEQ ID NO: 3381897 - RNA, 16 nt, Pseudomonas aeruginosa PA01
ccggauagaucaggcc

SEQ ID NO: 3381898 - RNA, 12 nt, Pseudomonas aeruginosa PA01
ccggaucagcuc

SEQ ID NO: 3381899 - RNA, 21 nt, Pseudomonas aeruginosa PA01
ccggaucgaaguagucggcgu

SEQ ID NO: 3381900 - RNA, 22 nt, Pseudomonas aeruginosa PA01
ccggaucgaaguagucggcgua

SEQ ID NO: 3381901 - RNA, 19 nt, Pseudomonas aeruginosa PA01
ccggaucgcccuggcgcca

SEQ ID NO: 3381902 - RNA, 20 nt, Pseudomonas aeruginosa PA01
ccggaucggccuuggcgaug

SEQ ID NO: 3381903 - RNA, 13 nt, Pseudomonas aeruginosa PA01
ccggaucggcuga

SEQ ID NO: 3381904 - RNA, 19 nt, Pseudomonas aeruginosa PA01
ccggaugcagauccagcgg

SEQ ID NO: 3381905 - RNA, 20 nt, Pseudomonas aeruginosa PA01
ccggaugcagauccagcggc

SEQ ID NO: 3381906 - RNA, 21 nt, Pseudomonas aeruginosa PA01
ccggaugcagauccagcggca

SEQ ID NO: 3381907 - RNA, 14 nt, Pseudomonas aeruginosa PA01
ccggauggccgccg

SEQ ID NO: 3381908 - RNA, 23 nt, Pseudomonas aeruginosa PA01
ccggauggcugacccgcugcugg

SEQ ID NO: 3381909 - RNA, 15 nt, Pseudomonas aeruginosa PA01
ccggaugggcgagcu

SEQ ID NO: 3381910 - RNA, 15 nt, Pseudomonas aeruginosa PA01
ccggauucgccgagg

SEQ ID NO: 3381911 - RNA, 15 nt, Pseudomonas aeruginosa PA01
ccggauucgcgcagc

SEQ ID NO: 3381912 - RNA, 17 nt, Pseudomonas aeruginosa PA01
ccggauucgcgcagcag

SEQ ID NO: 3381913 - RNA, 16 nt, Pseudomonas aeruginosa PA01
ccggauuggccgaggu

SEQ ID NO: 3381914 - RNA, 19 nt, Pseudomonas aeruginosa PA01
ccggauugguggucaccag

SEQ ID NO: 3381915 - RNA, 15 nt, Pseudomonas aeruginosa PA01
ccggcaaaugccggg

SEQ ID NO: 3381916 - RNA, 14 nt, Pseudomonas aeruginosa PA01
ccggcaacagcagc

SEQ ID NO: 3381917 - RNA, 18 nt, Pseudomonas aeruginosa PA01
ccggcaacaggucgaggg

SEQ ID NO: 3381918 - RNA, 15 nt, Pseudomonas aeruginosa PA01
ccggcaacaguucug

SEQ ID NO: 3381919 - RNA, 22 nt, Pseudomonas aeruginosa PA01
ccggcaacaguucugccgcaga

SEQ ID NO: 3381920 - RNA, 20 nt, Pseudomonas aeruginosa PA01
ccggcaacgaacuucagggc

SEQ ID NO: 3381921 - RNA, 13 nt, Pseudomonas aeruginosa PA01
ccggcaagcgccg

SEQ ID NO: 3381922 - RNA, 23 nt, Pseudomonas aeruginosa PA01
ccggcaagcgccggcaacagcag

SEQ ID NO: 3381923 - RNA, 16 nt, Pseudomonas aeruginosa PA01
ccggcaagcgugcccc

SEQ ID NO: 3381924 - RNA, 19 nt, Pseudomonas aeruginosa PA01
ccggcaagcgugccccgac

SEQ ID NO: 3381925 - RNA, 21 nt, Pseudomonas aeruginosa PA01
ccggcauuagucuuuggucua

SEQ ID NO: 3381926 - RNA, 12 nt, Pseudomonas aeruginosa PA01
ccggcauucgcc

SEQ ID NO: 3381927 - RNA, 17 nt, Pseudomonas aeruginosa PA01
ccggcauucgccgggcu

SEQ ID NO: 3381928 - RNA, 13 nt, Pseudomonas aeruginosa PA01
ccggcauugccga

SEQ ID NO: 3381929 - RNA, 18 nt, Pseudomonas aeruginosa PA01
ccggcauuggcacccugg

SEQ ID NO: 3381930 - RNA, 14 nt, Pseudomonas aeruginosa PA01
ccggccaauggccg

SEQ ID NO: 3381931 - RNA, 15 nt, Pseudomonas aeruginosa PA01
ccggccaauggccgg

SEQ ID NO: 3381932 - RNA, 21 nt, Pseudomonas aeruginosa PA01
ccggccaccaucacgucgcgc

SEQ ID NO: 3381933 - RNA, 20 nt, Pseudomonas aeruginosa PA01
ccggccacgcgaccagcgcc

SEQ ID NO: 3381934 - RNA, 22 nt, Pseudomonas aeruginosa PA01
ccggccacgcgaccagcgccag

SEQ ID NO: 3381935 - RNA, 23 nt, Pseudomonas aeruginosa PA01
ccggccacgcgaccagcgccagg

SEQ ID NO: 3381936 - RNA, 15 nt, Pseudomonas aeruginosa PA01
ccggccacucgcagc

SEQ ID NO: 3381937 - RNA, 17 nt, Pseudomonas aeruginosa PA01
ccggccacucgcagccg

SEQ ID NO: 3381938 - RNA, 21 nt, Pseudomonas aeruginosa PA01
ccggccacucgcagccgcgcu

SEQ ID NO: 3381939 - RNA, 15 nt, Pseudomonas aeruginosa PA01
ccggccagcagcgcc

SEQ ID NO: 3381940 - RNA, 19 nt, Pseudomonas aeruginosa PA01
ccggccagcagcgccuccu

SEQ ID NO: 3381941 - RNA, 11 nt, Pseudomonas aeruginosa PA01
ccggccagcca

SEQ ID NO: 3381942 - RNA, 13 nt, Pseudomonas aeruginosa PA01
ccggccagcccgg

SEQ ID NO: 3381943 - RNA, 15 nt, Pseudomonas aeruginosa PA01
ccggccagcccggcc

SEQ ID NO: 3381944 - RNA, 16 nt, Pseudomonas aeruginosa PA01
ccggccagcccggccu

SEQ ID NO: 3381945 - RNA, 21 nt, Pseudomonas aeruginosa PA01
ccggccagccgcgccagugcc

SEQ ID NO: 3381946 - RNA, 14 nt, Pseudomonas aeruginosa PA01
ccggccagccuggc

SEQ ID NO: 3381947 - RNA, 19 nt, Pseudomonas aeruginosa PA01
ccggccagccuucccggcg

SEQ ID NO: 3381948 - RNA, 12 nt, Pseudomonas aeruginosa PA01
ccggccagcgca

SEQ ID NO: 3381949 - RNA, 19 nt, Pseudomonas aeruginosa PA01
ccggccagcgcaucgaggc

SEQ ID NO: 3381950 - RNA, 18 nt, Pseudomonas aeruginosa PA01
ccggccagcgcggcggac

SEQ ID NO: 3381951 - RNA, 13 nt, Pseudomonas aeruginosa PA01
ccggccaggaagg

SEQ ID NO: 3381952 - RNA, 12 nt, Pseudomonas aeruginosa PA01
ccggccaggcca

SEQ ID NO: 3381953 - RNA, 13 nt, Pseudomonas aeruginosa PA01
ccggccaggcccu

SEQ ID NO: 3381954 - RNA, 20 nt, Pseudomonas aeruginosa PA01
ccggccaggcccucagcggc

SEQ ID NO: 3381955 - RNA, 21 nt, Pseudomonas aeruginosa PA01
ccggccaggcccucagcggcg

SEQ ID NO: 3381956 - RNA, 12 nt, Pseudomonas aeruginosa PA01
ccggccaggccg

SEQ ID NO: 3381957 - RNA, 14 nt, Pseudomonas aeruginosa PA01
ccggccaggccgcc

SEQ ID NO: 3381958 - RNA, 15 nt, Pseudomonas aeruginosa PA01
ccggccaggccgccc

SEQ ID NO: 3381959 - RNA, 16 nt, Pseudomonas aeruginosa PA01
ccggccaggccgccca

SEQ ID NO: 3381960 - RNA, 18 nt, Pseudomonas aeruginosa PA01
ccggccaggccgcccagg

SEQ ID NO: 3381961 - RNA, 13 nt, Pseudomonas aeruginosa PA01
ccggccaggcgau

SEQ ID NO: 3381962 - RNA, 15 nt, Pseudomonas aeruginosa PA01
ccggccaggcggucc

SEQ ID NO: 3381963 - RNA, 17 nt, Pseudomonas aeruginosa PA01
ccggccaggcgguccag

SEQ ID NO: 3381964 - RNA, 15 nt, Pseudomonas aeruginosa PA01
ccggccagggcgcgg

SEQ ID NO: 3381965 - RNA, 17 nt, Pseudomonas aeruginosa PA01
ccggccagggcgcggua

SEQ ID NO: 3381966 - RNA, 17 nt, Pseudomonas aeruginosa PA01
ccggccagguaccggcc

SEQ ID NO: 3381967 - RNA, 20 nt, Pseudomonas aeruginosa PA01
ccggccagguaccggccagg

SEQ ID NO: 3381968 - RNA, 19 nt, Pseudomonas aeruginosa PA01
ccggccagguaggcgacga

SEQ ID NO: 3381969 - RNA, 20 nt, Pseudomonas aeruginosa PA01
ccggccagguaggcgacgaa

SEQ ID NO: 3381970 - RNA, 22 nt, Pseudomonas aeruginosa PA01
ccggccaggucguugcgccggc

SEQ ID NO: 3381971 - RNA, 23 nt, Pseudomonas aeruginosa PA01
ccggccaggucguugcgccggcc

SEQ ID NO: 3381972 - RNA, 12 nt, Pseudomonas aeruginosa PA01
ccggccaggugg

SEQ ID NO: 3381973 - RNA, 16 nt, Pseudomonas aeruginosa PA01
ccggccaucagcacca

SEQ ID NO: 3381974 - RNA, 17 nt, Pseudomonas aeruginosa PA01
ccggccaucagcaccag

SEQ ID NO: 3381975 - RNA, 17 nt, Pseudomonas aeruginosa PA01
ccggccauccagccagg

SEQ ID NO: 3381976 - RNA, 18 nt, Pseudomonas aeruginosa PA01
ccggccauccagccaggc

SEQ ID NO: 3381977 - RNA, 14 nt, Pseudomonas aeruginosa PA01
ccggccauccuggc

SEQ ID NO: 3381978 - RNA, 17 nt, Pseudomonas aeruginosa PA01
ccggccauccuggccgg

SEQ ID NO: 3381979 - RNA, 14 nt, Pseudomonas aeruginosa PA01
ccggccaugcaggc

SEQ ID NO: 3381980 - RNA, 15 nt, Pseudomonas aeruginosa PA01
ccggccaugcaggcc

SEQ ID NO: 3381981 - RNA, 16 nt, Pseudomonas aeruginosa PA01
ccggccaugcaggcca

SEQ ID NO: 3381982 - RNA, 17 nt, Pseudomonas aeruginosa PA01
ccggccaugcaggccag

SEQ ID NO: 3381983 - RNA, 18 nt, Pseudomonas aeruginosa PA01
ccggccaugcaggccagg

SEQ ID NO: 3381984 - RNA, 14 nt, Pseudomonas aeruginosa PA01
ccggccaugccgcc

SEQ ID NO: 3381985 - RNA, 15 nt, Pseudomonas aeruginosa PA01
ccggccaugccgccg

SEQ ID NO: 3381986 - RNA, 18 nt, Pseudomonas aeruginosa PA01
ccggccaugccgccgacg

SEQ ID NO: 3381987 - RNA, 21 nt, Pseudomonas aeruginosa PA01
ccggccaugccgccgacgccg

SEQ ID NO: 3381988 - RNA, 22 nt, Pseudomonas aeruginosa PA01
ccggccaugccgccgacgccgg

SEQ ID NO: 3381989 - RNA, 18 nt, Pseudomonas aeruginosa PA01
ccggccauuacgccgagc

SEQ ID NO: 3381990 - RNA, 19 nt, Pseudomonas aeruginosa PA01
ccggccauuacgccgagca

SEQ ID NO: 3381991 - RNA, 16 nt, Pseudomonas aeruginosa PA01
ccggccauuccuucca

SEQ ID NO: 3381992 - RNA, 17 nt, Pseudomonas aeruginosa PA01
ccggccauuccuuccag

SEQ ID NO: 3381993 - RNA, 18 nt, Pseudomonas aeruginosa PA01
ccggccauuccuuccagg

SEQ ID NO: 3381994 - RNA, 19 nt, Pseudomonas aeruginosa PA01
ccggccauuccuuccaggg

SEQ ID NO: 3381995 - RNA, 23 nt, Pseudomonas aeruginosa PA01
ccggccauucgcugucgagcagg

SEQ ID NO: 3381996 - RNA, 17 nt, Pseudomonas aeruginosa PA01
ccggccauugccgccag

SEQ ID NO: 3381997 - RNA, 18 nt, Pseudomonas aeruginosa PA01
ccggccauugccgccaga

SEQ ID NO: 3381998 - RNA, 14 nt, Pseudomonas aeruginosa PA01
ccggcccagcaggc

SEQ ID NO: 3381999 - RNA, 16 nt, Pseudomonas aeruginosa PA01
ccggcccagcaggccg

SEQ ID NO: 3382000 - RNA, 19 nt, Pseudomonas aeruginosa PA01
ccggcccagcaggccggcc

SEQ ID NO: 3382001 - RNA, 18 nt, Pseudomonas aeruginosa PA01
ccggcccagccgcggcgc

SEQ ID NO: 3382002 - RNA, 19 nt, Pseudomonas aeruginosa PA01
ccggcccagcguucggcgc

SEQ ID NO: 3382003 - RNA, 23 nt, Pseudomonas aeruginosa PA01
ccggcccagcguucggcgcuggc

SEQ ID NO: 3382004 - RNA, 12 nt, Pseudomonas aeruginosa PA01
ccggcccaggcc

SEQ ID NO: 3382005 - RNA, 13 nt, Pseudomonas aeruginosa PA01
ccggcccaggccg

SEQ ID NO: 3382006 - RNA, 14 nt, Pseudomonas aeruginosa PA01
ccggcccaggccgg

SEQ ID NO: 3382007 - RNA, 15 nt, Pseudomonas aeruginosa PA01
ccggcccauccgccg

SEQ ID NO: 3382008 - RNA, 13 nt, Pseudomonas aeruginosa PA01
ccggccccugggc

SEQ ID NO: 3382009 - RNA, 14 nt, Pseudomonas aeruginosa PA01
ccggccccugggcc

SEQ ID NO: 3382010 - RNA, 15 nt, Pseudomonas aeruginosa PA01
ccggccccugggccg

SEQ ID NO: 3382011 - RNA, 16 nt, Pseudomonas aeruginosa PA01
ccggccccugggccgg

SEQ ID NO: 3382012 - RNA, 15 nt, Pseudomonas aeruginosa PA01
ccggcccgcgccgcc

SEQ ID NO: 3382013 - RNA, 16 nt, Pseudomonas aeruginosa PA01
ccggcccgcgccgccu

SEQ ID NO: 3382014 - RNA, 14 nt, Pseudomonas aeruginosa PA01
ccggcccgcgcggc

SEQ ID NO: 3382015 - RNA, 23 nt, Pseudomonas aeruginosa PA01
ccggcccggagaucgccgcgccg

SEQ ID NO: 3382016 - RNA, 21 nt, Pseudomonas aeruginosa PA01
ccggcccggagcgcgaggcga

SEQ ID NO: 3382017 - RNA, 12 nt, Pseudomonas aeruginosa PA01
ccggcccggcca

SEQ ID NO: 3382018 - RNA, 13 nt, Pseudomonas aeruginosa PA01
ccggcccggccag

SEQ ID NO: 3382019 - RNA, 18 nt, Pseudomonas aeruginosa PA01
ccggcccggccagguagg

SEQ ID NO: 3382020 - RNA, 19 nt, Pseudomonas aeruginosa PA01
ccggcccgggcguuggcuc

SEQ ID NO: 3382021 - RNA, 13 nt, Pseudomonas aeruginosa PA01
ccggcccuugagc

SEQ ID NO: 3382022 - RNA, 20 nt, Pseudomonas aeruginosa PA01
ccggcccuugagcauggcgu

SEQ ID NO: 3382023 - RNA, 13 nt, Pseudomonas aeruginosa PA01
ccggccgaccagg

SEQ ID NO: 3382024 - RNA, 15 nt, Pseudomonas aeruginosa PA01
ccggccgaccaggug

SEQ ID NO: 3382025 - RNA, 18 nt, Pseudomonas aeruginosa PA01
ccggccgaccaggugcug

SEQ ID NO: 3382026 - RNA, 19 nt, Pseudomonas aeruginosa PA01
ccggccgacgauguucgag

SEQ ID NO: 3382027 - RNA, 15 nt, Pseudomonas aeruginosa PA01
ccggccgaucuccug

SEQ ID NO: 3382028 - RNA, 22 nt, Pseudomonas aeruginosa PA01
ccggcgaccuuguccaggcgcu

SEQ ID NO: 3382029 - RNA, 15 nt, Pseudomonas aeruginosa PA01
ccggcgacgacgauc

SEQ ID NO: 3382030 - RNA, 21 nt, Pseudomonas aeruginosa PA01
ccggcgacgacgaucccggcg

SEQ ID NO: 3382031 - RNA, 19 nt, Pseudomonas aeruginosa PA01
ccggcgacgcaggacgucg

SEQ ID NO: 3382032 - RNA, 21 nt, Pseudomonas aeruginosa PA01
ccggcgagaaaggcugcuucg

SEQ ID NO: 3382033 - RNA, 21 nt, Pseudomonas aeruginosa PA01
ccggcgagagcguccggcagg

SEQ ID NO: 3382034 - RNA, 15 nt, Pseudomonas aeruginosa PA01
ccggcgagccagguu

SEQ ID NO: 3382035 - RNA, 21 nt, Pseudomonas aeruginosa PA01
ccggcgagccagguuuccggc

SEQ ID NO: 3382036 - RNA, 15 nt, Pseudomonas aeruginosa PA01
ccggcgagccgcugg

SEQ ID NO: 3382037 - RNA, 13 nt, Pseudomonas aeruginosa PA01
ccggcgagcgagc

SEQ ID NO: 3382038 - RNA, 18 nt, Pseudomonas aeruginosa PA01
ccggcgagcgagcggcag

SEQ ID NO: 3382039 - RNA, 14 nt, Pseudomonas aeruginosa PA01
ccggcgagcgccug

SEQ ID NO: 3382040 - RNA, 15 nt, Pseudomonas aeruginosa PA01
ccggcgagcgccugg

SEQ ID NO: 3382041 - RNA, 16 nt, Pseudomonas aeruginosa PA01
ccggcgagcgccugga

SEQ ID NO: 3382042 - RNA, 20 nt, Pseudomonas aeruginosa PA01
ccggcgaggcguuccaggug

SEQ ID NO: 3382043 - RNA, 17 nt, Pseudomonas aeruginosa PA01
ccggcgagggcggcgac

SEQ ID NO: 3382044 - RNA, 21 nt, Pseudomonas aeruginosa PA01
ccggcgagggcggcgaccugg

SEQ ID NO: 3382045 - RNA, 20 nt, Pseudomonas aeruginosa PA01
ccggcgaggucgggguucuu

SEQ ID NO: 3382046 - RNA, 21 nt, Pseudomonas aeruginosa PA01
ccggcgagucguuacgaaacg

SEQ ID NO: 3382047 - RNA, 22 nt, Pseudomonas aeruginosa PA01
ccggcgagucguuacgaaacgg

SEQ ID NO: 3382048 - RNA, 16 nt, Pseudomonas aeruginosa PA01
ccggcgaucagcucgc

SEQ ID NO: 3382049 - RNA, 15 nt, Pseudomonas aeruginosa PA01
ccggcgaucauccag

SEQ ID NO: 3382050 - RNA, 14 nt, Pseudomonas aeruginosa PA01
ccggcgaucgccag

SEQ ID NO: 3382051 - RNA, 19 nt, Pseudomonas aeruginosa PA01
ccggcgaucgccaggcgau

SEQ ID NO: 3382052 - RNA, 16 nt, Pseudomonas aeruginosa PA01
ccggcgaugcccaggc

SEQ ID NO: 3382053 - RNA, 17 nt, Pseudomonas aeruginosa PA01
ccggcgaugcccaggcc

SEQ ID NO: 3382054 - RNA, 18 nt, Pseudomonas aeruginosa PA01
ccggcgaugcccaggccg

SEQ ID NO: 3382055 - RNA, 20 nt, Pseudomonas aeruginosa PA01
ccggcgaugcccaggccgcc

SEQ ID NO: 3382056 - RNA, 15 nt, Pseudomonas aeruginosa PA01
ccggcgaugccgccc

SEQ ID NO: 3382057 - RNA, 19 nt, Pseudomonas aeruginosa PA01
ccggcgaugccgcccagca

SEQ ID NO: 3382058 - RNA, 22 nt, Pseudomonas aeruginosa PA01
ccggcgaugccgcccagcaccg

SEQ ID NO: 3382059 - RNA, 22 nt, Pseudomonas aeruginosa PA01
ccggcgaugcguuugucgaccu

SEQ ID NO: 3382060 - RNA, 23 nt, Pseudomonas aeruginosa PA01
ccggcgaugcguuugucgaccug

SEQ ID NO: 3382061 - RNA, 16 nt, Pseudomonas aeruginosa PA01
ccggcgaugcucagcg

SEQ ID NO: 3382062 - RNA, 18 nt, Pseudomonas aeruginosa PA01
ccggcgaugcucagcgcc

SEQ ID NO: 3382063 - RNA, 20 nt, Pseudomonas aeruginosa PA01
ccggcgaugcucagcgccgg

SEQ ID NO: 3382064 - RNA, 22 nt, Pseudomonas aeruginosa PA01
ccggcgaugcucagcgccggcc

SEQ ID NO: 3382065 - RNA, 12 nt, Pseudomonas aeruginosa PA01
ccggcgauggcc

SEQ ID NO: 3382066 - RNA, 15 nt, Pseudomonas aeruginosa PA01
ccggcgauggcccag

SEQ ID NO: 3382067 - RNA, 16 nt, Pseudomonas aeruginosa PA01
ccggcgauggcccaga

SEQ ID NO: 3382068 - RNA, 17 nt, Pseudomonas aeruginosa PA01
ccggcgauggccgccug

SEQ ID NO: 3382069 - RNA, 21 nt, Pseudomonas aeruginosa PA01
ccggcgauggccgccugcagg

SEQ ID NO: 3382070 - RNA, 15 nt, Pseudomonas aeruginosa PA01
ccggcgauggccggc

SEQ ID NO: 3382071 - RNA, 17 nt, Pseudomonas aeruginosa PA01
ccggcgauggccggcac

SEQ ID NO: 3382072 - RNA, 14 nt, Pseudomonas aeruginosa PA01
ccggcgauguucgc

SEQ ID NO: 3382073 - RNA, 15 nt, Pseudomonas aeruginosa PA01
ccggcgcacgccggc

SEQ ID NO: 3382074 - RNA, 17 nt, Pseudomonas aeruginosa PA01
ccggcgcacgccggccu

SEQ ID NO: 3382075 - RNA, 21 nt, Pseudomonas aeruginosa PA01
ccggcgcacgccggccucgcg

SEQ ID NO: 3382076 - RNA, 15 nt, Pseudomonas aeruginosa PA01
ccggcgcagaacugc

SEQ ID NO: 3382077 - RNA, 17 nt, Pseudomonas aeruginosa PA01
ccggcgcagaucgcggc

SEQ ID NO: 3382078 - RNA, 18 nt, Pseudomonas aeruginosa PA01
ccggcgcagaucgcggcg

SEQ ID NO: 3382079 - RNA, 12 nt, Pseudomonas aeruginosa PA01
ccggcgcagccc

SEQ ID NO: 3382080 - RNA, 14 nt, Pseudomonas aeruginosa PA01
ccggcgcagcccag

SEQ ID NO: 3382081 - RNA, 18 nt, Pseudomonas aeruginosa PA01
ccggcgcagcccagccgc

SEQ ID NO: 3382082 - RNA, 17 nt, Pseudomonas aeruginosa PA01
ccggcgcagucgucaag

SEQ ID NO: 3382083 - RNA, 16 nt, Pseudomonas aeruginosa PA01
ccggcgcaucagcgcc

SEQ ID NO: 3382084 - RNA, 18 nt, Pseudomonas aeruginosa PA01
ccggcgcaucagcgccgg

SEQ ID NO: 3382085 - RNA, 16 nt, Pseudomonas aeruginosa PA01
ccggcgcaucgucgaa

SEQ ID NO: 3382086 - RNA, 17 nt, Pseudomonas aeruginosa PA01
ccggcgcaugcgccggc

SEQ ID NO: 3382087 - RNA, 19 nt, Pseudomonas aeruginosa PA01
ccggcgcaugcgccggcuu

SEQ ID NO: 3382088 - RNA, 21 nt, Pseudomonas aeruginosa PA01
ccggcgccaacugcuugccga

SEQ ID NO: 3382089 - RNA, 16 nt, Pseudomonas aeruginosa PA01
ccggcgccaccccgcc

SEQ ID NO: 3382090 - RNA, 21 nt, Pseudomonas aeruginosa PA01
ccggcgccaccccgccgcgca

SEQ ID NO: 3382091 - RNA, 22 nt, Pseudomonas aeruginosa PA01
ccggcgccaccccgccgcgcau

SEQ ID NO: 3382092 - RNA, 12 nt, Pseudomonas aeruginosa PA01
ccggcgccaccg

SEQ ID NO: 3382093 - RNA, 23 nt, Pseudomonas aeruginosa PA01
ccggcgccaccgauucgccggcc

SEQ ID NO: 3382094 - RNA, 13 nt, Pseudomonas aeruginosa PA01
ccggcgccaccgc

SEQ ID NO: 3382095 - RNA, 22 nt, Pseudomonas aeruginosa PA01
ccggcgccaggcccucggcgac

SEQ ID NO: 3382096 - RNA, 15 nt, Pseudomonas aeruginosa PA01
ccggcgccaggccgg

SEQ ID NO: 3382097 - RNA, 14 nt, Pseudomonas aeruginosa PA01
ccggcgccaggcug

SEQ ID NO: 3382098 - RNA, 16 nt, Pseudomonas aeruginosa PA01
ccggcgccaguucgcc

SEQ ID NO: 3382099 - RNA, 13 nt, Pseudomonas aeruginosa PA01
ccggcgcccagaa

SEQ ID NO: 3382100 - RNA, 21 nt, Pseudomonas aeruginosa PA01
ccggcgcccagaaaaaagccc

SEQ ID NO: 3382101 - RNA, 14 nt, Pseudomonas aeruginosa PA01
ccggcgccccggcc

SEQ ID NO: 3382102 - RNA, 12 nt, Pseudomonas aeruginosa PA01
ccggcgccccug

SEQ ID NO: 3382103 - RNA, 14 nt, Pseudomonas aeruginosa PA01
ccggcgccccugcg

SEQ ID NO: 3382104 - RNA, 20 nt, Pseudomonas aeruginosa PA01
ccggcgccccugcggcgccg

SEQ ID NO: 3382105 - RNA, 18 nt, Pseudomonas aeruginosa PA01
ccggcgcccggcgcaugc

SEQ ID NO: 3382106 - RNA, 19 nt, Pseudomonas aeruginosa PA01
ccggcgcccggcgcaugcc

SEQ ID NO: 3382107 - RNA, 18 nt, Pseudomonas aeruginosa PA01
ccggcgcccugggcgcga

SEQ ID NO: 3382108 - RNA, 19 nt, Pseudomonas aeruginosa PA01
ccggcgcccugggcgcgaa

SEQ ID NO: 3382109 - RNA, 20 nt, Pseudomonas aeruginosa PA01
ccggcgcccuucgagaaacu

SEQ ID NO: 3382110 - RNA, 22 nt, Pseudomonas aeruginosa PA01
ccggcgccgcagggugcggcug

SEQ ID NO: 3382111 - RNA, 12 nt, Pseudomonas aeruginosa PA01
ccggcgccgccg

SEQ ID NO: 3382112 - RNA, 13 nt, Pseudomonas aeruginosa PA01
ccggcgccgccga

SEQ ID NO: 3382113 - RNA, 13 nt, Pseudomonas aeruginosa PA01
ccggcgccgccgg

SEQ ID NO: 3382114 - RNA, 21 nt, Pseudomonas aeruginosa PA01
ccggcgccgccggggaucagc

SEQ ID NO: 3382115 - RNA, 14 nt, Pseudomonas aeruginosa PA01
ccggcgccgccucg

SEQ ID NO: 3382116 - RNA, 15 nt, Pseudomonas aeruginosa PA01
ccggcgccgccucgg

SEQ ID NO: 3382117 - RNA, 14 nt, Pseudomonas aeruginosa PA01
ccggcgccgccugg

SEQ ID NO: 3382118 - RNA, 17 nt, Pseudomonas aeruginosa PA01
ccggcgccgccuggccg

SEQ ID NO: 3382119 - RNA, 18 nt, Pseudomonas aeruginosa PA01
ccggcgccgccuggccgg

SEQ ID NO: 3382120 - RNA, 15 nt, Pseudomonas aeruginosa PA01
ccggcgccggcagga

SEQ ID NO: 3382121 - RNA, 23 nt, Pseudomonas aeruginosa PA01
ccggcgccggcaggaacgcccgc

SEQ ID NO: 3382122 - RNA, 13 nt, Pseudomonas aeruginosa PA01
ccggcgccgggau

SEQ ID NO: 3382123 - RNA, 12 nt, Pseudomonas aeruginosa PA01
ccggcgccgucg

SEQ ID NO: 3382124 - RNA, 14 nt, Pseudomonas aeruginosa PA01
ccggcgccgucgac

SEQ ID NO: 3382125 - RNA, 17 nt, Pseudomonas aeruginosa PA01
ccggcgccuugcgccag

SEQ ID NO: 3382126 - RNA, 18 nt, Pseudomonas aeruginosa PA01
ccggcgccuugcgccagg

SEQ ID NO: 3382127 - RNA, 20 nt, Pseudomonas aeruginosa PA01
ccggcgccuugcgccaggcc

SEQ ID NO: 3382128 - RNA, 19 nt, Pseudomonas aeruginosa PA01
ccggcgcgaccgucggccg

SEQ ID NO: 3382129 - RNA, 17 nt, Pseudomonas aeruginosa PA01
ccggcgcgacgcuccag

SEQ ID NO: 3382130 - RNA, 21 nt, Pseudomonas aeruginosa PA01
ccggcgcgacgcuccaggugc

SEQ ID NO: 3382131 - RNA, 22 nt, Pseudomonas aeruginosa PA01
ccggcggggaagccuucgcccg

SEQ ID NO: 3382132 - RNA, 23 nt, Pseudomonas aeruginosa PA01
ccggcggggaagccuucgcccgg

SEQ ID NO: 3382133 - RNA, 19 nt, Pseudomonas aeruginosa PA01
ccggcggguucagcccgcc

SEQ ID NO: 3382134 - RNA, 16 nt, Pseudomonas aeruginosa PA01
ccggcgguccgccgcg

SEQ ID NO: 3382135 - RNA, 21 nt, Pseudomonas aeruginosa PA01
ccggcggugagggcgacggcg

SEQ ID NO: 3382136 - RNA, 17 nt, Pseudomonas aeruginosa PA01
ccggcgguggacgucgg

SEQ ID NO: 3382137 - RNA, 20 nt, Pseudomonas aeruginosa PA01
ccggcgguggacgucggcgu

SEQ ID NO: 3382138 - RNA, 22 nt, Pseudomonas aeruginosa PA01
ccggcgguggacgucggcgugg

SEQ ID NO: 3382139 - RNA, 21 nt, Pseudomonas aeruginosa PA01
ccggcgguuucgccgaggccc

SEQ ID NO: 3382140 - RNA, 22 nt, Pseudomonas aeruginosa PA01
ccggcguaccuugagcagggcg

SEQ ID NO: 3382141 - RNA, 22 nt, Pseudomonas aeruginosa PA01
ccggcguacgaaccccgggccg

SEQ ID NO: 3382142 - RNA, 23 nt, Pseudomonas aeruginosa PA01
ccggcguacgaaccccgggccgc

SEQ ID NO: 3382143 - RNA, 17 nt, Pseudomonas aeruginosa PA01
ccggcguccacuccggc

SEQ ID NO: 3382144 - RNA, 13 nt, Pseudomonas aeruginosa PA01
ccggcguccagga

SEQ ID NO: 3382145 - RNA, 20 nt, Pseudomonas aeruginosa PA01
ccggcguccccuuccuccuc

SEQ ID NO: 3382146 - RNA, 23 nt, Pseudomonas aeruginosa PA01
ccggcguccccuuccuccucgcc

SEQ ID NO: 3382147 - RNA, 14 nt, Pseudomonas aeruginosa PA01
ccggcguccgggug

SEQ ID NO: 3382148 - RNA, 21 nt, Pseudomonas aeruginosa PA01
ccggcguccgggugccccagg

SEQ ID NO: 3382149 - RNA, 22 nt, Pseudomonas aeruginosa PA01
ccggcguccgggugccccaggc

SEQ ID NO: 3382150 - RNA, 15 nt, Pseudomonas aeruginosa PA01
ccggcguccuccucc

SEQ ID NO: 3382151 - RNA, 17 nt, Pseudomonas aeruginosa PA01
ccggcguccuccuccag

SEQ ID NO: 3382152 - RNA, 14 nt, Pseudomonas aeruginosa PA01
ccggcguccucgcg

SEQ ID NO: 3382153 - RNA, 16 nt, Pseudomonas aeruginosa PA01
ccggcguccucgcgac

SEQ ID NO: 3382154 - RNA, 21 nt, Pseudomonas aeruginosa PA01
ccggcguccucgcgacaccgg

SEQ ID NO: 3382155 - RNA, 14 nt, Pseudomonas aeruginosa PA01
ccggcguccuugcc

SEQ ID NO: 3382156 - RNA, 16 nt, Pseudomonas aeruginosa PA01
ccggcguccuugccga

SEQ ID NO: 3382157 - RNA, 20 nt, Pseudomonas aeruginosa PA01
ccggcgucggcgagcaggcg

SEQ ID NO: 3382158 - RNA, 14 nt, Pseudomonas aeruginosa PA01
ccggcgucggcgcg

SEQ ID NO: 3382159 - RNA, 21 nt, Pseudomonas aeruginosa PA01
ccggcgucggcgcgggcgccg

SEQ ID NO: 3382160 - RNA, 22 nt, Pseudomonas aeruginosa PA01
ccggcgucggcgcgggcgccga

SEQ ID NO: 3382161 - RNA, 21 nt, Pseudomonas aeruginosa PA01
ccggcgucguccugcgcggcg

SEQ ID NO: 3382162 - RNA, 22 nt, Pseudomonas aeruginosa PA01
ccggcgucguccugcgcggcga

SEQ ID NO: 3382163 - RNA, 20 nt, Pseudomonas aeruginosa PA01
ccggcgucucauggaacagc

SEQ ID NO: 3382164 - RNA, 21 nt, Pseudomonas aeruginosa PA01
ccggcgucucauggaacagca

SEQ ID NO: 3382165 - RNA, 17 nt, Pseudomonas aeruginosa PA01
ccggcgugagcagggcc

SEQ ID NO: 3382166 - RNA, 22 nt, Pseudomonas aeruginosa PA01
ccggcgugagcagggccgagcg

SEQ ID NO: 3382167 - RNA, 23 nt, Pseudomonas aeruginosa PA01
ccggcgugagcagggccgagcgc

SEQ ID NO: 3382168 - RNA, 18 nt, Pseudomonas aeruginosa PA01
ccggcguggacccacgca

SEQ ID NO: 3382169 - RNA, 24 nt, Pseudomonas aeruginosa PA01
ccggcguggacccacgcauuggcu

SEQ ID NO: 3382170 - RNA, 20 nt, Pseudomonas aeruginosa PA01
ccggcgugggcggucggcga

SEQ ID NO: 3382171 - RNA, 15 nt, Pseudomonas aeruginosa PA01
ccggcguuauccgcc

SEQ ID NO: 3382172 - RNA, 18 nt, Pseudomonas aeruginosa PA01
ccggcguuauccgccgau

SEQ ID NO: 3382173 - RNA, 19 nt, Pseudomonas aeruginosa PA01
ccggcguuauccgccgaua

SEQ ID NO: 3382174 - RNA, 20 nt, Pseudomonas aeruginosa PA01
ccggcguucgccggguuuuu

SEQ ID NO: 3382175 - RNA, 20 nt, Pseudomonas aeruginosa PA01
ccggcguugaacugcccgca

SEQ ID NO: 3382176 - RNA, 13 nt, Pseudomonas aeruginosa PA01
ccggcguugccga

SEQ ID NO: 3382177 - RNA, 17 nt, Pseudomonas aeruginosa PA01
ccggcguugccgauggu

SEQ ID NO: 3382178 - RNA, 16 nt, Pseudomonas aeruginosa PA01
ccggcguuucgccggg

SEQ ID NO: 3382179 - RNA, 18 nt, Pseudomonas aeruginosa PA01
ccggcguuucgccgggcc

SEQ ID NO: 3382180 - RNA, 14 nt, Pseudomonas aeruginosa PA01
ccggcuaaccgcga

SEQ ID NO: 3382181 - RNA, 17 nt, Pseudomonas aeruginosa PA01
ccggcuaaccgcgaagc

SEQ ID NO: 3382182 - RNA, 15 nt, Pseudomonas aeruginosa PA01
ccggcuacaggccgu

SEQ ID NO: 3382183 - RNA, 19 nt, Pseudomonas aeruginosa PA01
ccggcuacaggccguagcg

SEQ ID NO: 3382184 - RNA, 20 nt, Pseudomonas aeruginosa PA01
ccggcuaucccccggccgau

SEQ ID NO: 3382185 - RNA, 13 nt, Pseudomonas aeruginosa PA01
ccggcucaacugc

SEQ ID NO: 3382186 - RNA, 21 nt, Pseudomonas aeruginosa PA01
ccggcucaacugguuggccgc

SEQ ID NO: 3382187 - RNA, 22 nt, Pseudomonas aeruginosa PA01
ccggcucaacugguuggccgcc

SEQ ID NO: 3382188 - RNA, 19 nt, Pseudomonas aeruginosa PA01
ccggcucagcgcuucggcu

SEQ ID NO: 3382189 - RNA, 15 nt, Pseudomonas aeruginosa PA01
ccggcucauggccgg

SEQ ID NO: 3382190 - RNA, 17 nt, Pseudomonas aeruginosa PA01
ccggcuccaacggcccu

SEQ ID NO: 3382191 - RNA, 13 nt, Pseudomonas aeruginosa PA01
ccggcuccagccg

SEQ ID NO: 3382192 - RNA, 16 nt, Pseudomonas aeruginosa PA01
ccggcuccagccgggc

SEQ ID NO: 3382193 - RNA, 17 nt, Pseudomonas aeruginosa PA01
ccggcuccagccgggcu

SEQ ID NO: 3382194 - RNA, 17 nt, Pseudomonas aeruginosa PA01
ccggcuccaguugcagc

SEQ ID NO: 3382195 - RNA, 11 nt, Pseudomonas aeruginosa PA01
ccggcucgccc

SEQ ID NO: 3382196 - RNA, 17 nt, Pseudomonas aeruginosa PA01
ccggcucgcccagcagg

SEQ ID NO: 3382197 - RNA, 21 nt, Pseudomonas aeruginosa PA01
ccggcucgcccaugcgcggcg

SEQ ID NO: 3382198 - RNA, 22 nt, Pseudomonas aeruginosa PA01
ccggcucgcccaugcgcggcga

SEQ ID NO: 3382199 - RNA, 19 nt, Pseudomonas aeruginosa PA01
ccggcucgccgacuuccag

SEQ ID NO: 3382200 - RNA, 21 nt, Pseudomonas aeruginosa PA01
ccggcucgccgacuuccaggc

SEQ ID NO: 3382201 - RNA, 13 nt, Pseudomonas aeruginosa PA01
ccggcucgccgcc

SEQ ID NO: 3382202 - RNA, 14 nt, Pseudomonas aeruginosa PA01
ccggcucgccgcgc

SEQ ID NO: 3382203 - RNA, 18 nt, Pseudomonas aeruginosa PA01
ccggcucgccgcgcugca

SEQ ID NO: 3382204 - RNA, 15 nt, Pseudomonas aeruginosa PA01
ccggcucgcugacgc

SEQ ID NO: 3382205 - RNA, 21 nt, Pseudomonas aeruginosa PA01
ccggcucggcacgcguggcga

SEQ ID NO: 3382206 - RNA, 18 nt, Pseudomonas aeruginosa PA01
ccggcucgguguaggcga

SEQ ID NO: 3382207 - RNA, 19 nt, Pseudomonas aeruginosa PA01
ccggcucgguuuccaccug

SEQ ID NO: 3382208 - RNA, 16 nt, Pseudomonas aeruginosa PA01
ccggcucgugcgacuc

SEQ ID NO: 3382209 - RNA, 16 nt, Pseudomonas aeruginosa PA01
ccggcucguucauguc

SEQ ID NO: 3382210 - RNA, 19 nt, Pseudomonas aeruginosa PA01
ccggcucuccccgcucccg

SEQ ID NO: 3382211 - RNA, 15 nt, Pseudomonas aeruginosa PA01
ccggcucucuucggc

SEQ ID NO: 3382212 - RNA, 16 nt, Pseudomonas aeruginosa PA01
ccggcugacgcuggcg

SEQ ID NO: 3382213 - RNA, 21 nt, Pseudomonas aeruginosa PA01
ccggcugacgcuggcgaaggc

SEQ ID NO: 3382214 - RNA, 13 nt, Pseudomonas aeruginosa PA01
ccggcugagcgcc

SEQ ID NO: 3382215 - RNA, 15 nt, Pseudomonas aeruginosa PA01
ccggcugagcgccag

SEQ ID NO: 3382216 - RNA, 16 nt, Pseudomonas aeruginosa PA01
ccggcugagcgccagg

SEQ ID NO: 3382217 - RNA, 20 nt, Pseudomonas aeruginosa PA01
ccggcugagcgccaggcgca

SEQ ID NO: 3382218 - RNA, 23 nt, Pseudomonas aeruginosa PA01
ccggcugaugcccgggucgucgg

SEQ ID NO: 3382219 - RNA, 13 nt, Pseudomonas aeruginosa PA01
ccggcugcacagg

SEQ ID NO: 3382220 - RNA, 17 nt, Pseudomonas aeruginosa PA01
ccggcugccgcgcgugg

SEQ ID NO: 3382221 - RNA, 20 nt, Pseudomonas aeruginosa PA01
ccggcugcuccgggcggcug

SEQ ID NO: 3382222 - RNA, 14 nt, Pseudomonas aeruginosa PA01
ccggcugcuuggcc

SEQ ID NO: 3382223 - RNA, 17 nt, Pseudomonas aeruginosa PA01
ccggcugcuuggccagg

SEQ ID NO: 3382224 - RNA, 20 nt, Pseudomonas aeruginosa PA01
ccggcuggacacgguccagg

SEQ ID NO: 3382225 - RNA, 23 nt, Pseudomonas aeruginosa PA01
ccggcuggccauccauaucggcc

SEQ ID NO: 3382226 - RNA, 13 nt, Pseudomonas aeruginosa PA01
ccggcuggcccuc

SEQ ID NO: 3382227 - RNA, 14 nt, Pseudomonas aeruginosa PA01
ccggcuggcccucc

SEQ ID NO: 3382228 - RNA, 12 nt, Pseudomonas aeruginosa PA01
ccggcuggccgc

SEQ ID NO: 3382229 - RNA, 12 nt, Pseudomonas aeruginosa PA01
ccggcuggcgcc

SEQ ID NO: 3382230 - RNA, 16 nt, Pseudomonas aeruginosa PA01
ccggcuggcgccggug

SEQ ID NO: 3382231 - RNA, 17 nt, Pseudomonas aeruginosa PA01
ccggcuggcgccggugc

SEQ ID NO: 3382232 - RNA, 20 nt, Pseudomonas aeruginosa PA01
ccggcuggcgccggugcaug

SEQ ID NO: 3382233 - RNA, 22 nt, Pseudomonas aeruginosa PA01
ccgggcaggccgaggccggcga

SEQ ID NO: 3382234 - RNA, 15 nt, Pseudomonas aeruginosa PA01
ccgggcagugcgccc

SEQ ID NO: 3382235 - RNA, 14 nt, Pseudomonas aeruginosa PA01
ccgggcaucgccga

SEQ ID NO: 3382236 - RNA, 16 nt, Pseudomonas aeruginosa PA01
ccgggcaucuugccca

SEQ ID NO: 3382237 - RNA, 22 nt, Pseudomonas aeruginosa PA01
ccgggcauucgcagcggccccg

SEQ ID NO: 3382238 - RNA, 18 nt, Pseudomonas aeruginosa PA01
ccgggcauuuccucgaug

SEQ ID NO: 3382239 - RNA, 21 nt, Pseudomonas aeruginosa PA01
ccgggcccaagccgagcggca

SEQ ID NO: 3382240 - RNA, 14 nt, Pseudomonas aeruginosa PA01
ccgggcccaggcug

SEQ ID NO: 3382241 - RNA, 15 nt, Pseudomonas aeruginosa PA01
ccgggcccaggcugg

SEQ ID NO: 3382242 - RNA, 17 nt, Pseudomonas aeruginosa PA01
ccgggcccaggcuggcg

SEQ ID NO: 3382243 - RNA, 16 nt, Pseudomonas aeruginosa PA01
ccgggcccaguucgcg

SEQ ID NO: 3382244 - RNA, 22 nt, Pseudomonas aeruginosa PA01
ccgggcccaguucgcguagccc

SEQ ID NO: 3382245 - RNA, 12 nt, Pseudomonas aeruginosa PA01
ccgggcccugcu

SEQ ID NO: 3382246 - RNA, 15 nt, Pseudomonas aeruginosa PA01
ccgggcccugggccc

SEQ ID NO: 3382247 - RNA, 18 nt, Pseudomonas aeruginosa PA01
ccgggcccugggccccgg

SEQ ID NO: 3382248 - RNA, 21 nt, Pseudomonas aeruginosa PA01
ccgggcccugggccccggccg

SEQ ID NO: 3382249 - RNA, 16 nt, Pseudomonas aeruginosa PA01
ccgggccgaccugccc

SEQ ID NO: 3382250 - RNA, 19 nt, Pseudomonas aeruginosa PA01
ccgggccgaccugcccgcu

SEQ ID NO: 3382251 - RNA, 19 nt, Pseudomonas aeruginosa PA01
ccgggccgagggcugagac

SEQ ID NO: 3382252 - RNA, 18 nt, Pseudomonas aeruginosa PA01
ccgggccgaucaccaccu

SEQ ID NO: 3382253 - RNA, 21 nt, Pseudomonas aeruginosa PA01
ccgggccgaucaccaccugga

SEQ ID NO: 3382254 - RNA, 22 nt, Pseudomonas aeruginosa PA01
ccgggccgaugcgcgacucgaa

SEQ ID NO: 3382255 - RNA, 13 nt, Pseudomonas aeruginosa PA01
ccgggccgcagcg

SEQ ID NO: 3382256 - RNA, 19 nt, Pseudomonas aeruginosa PA01
ccgggccgcagcgcagccg

SEQ ID NO: 3382257 - RNA, 20 nt, Pseudomonas aeruginosa PA01
ccgggccgcaucgcgggcgu

SEQ ID NO: 3382258 - RNA, 13 nt, Pseudomonas aeruginosa PA01
ccgggccgccggc

SEQ ID NO: 3382259 - RNA, 14 nt, Pseudomonas aeruginosa PA01
ccgggccgccggcg

SEQ ID NO: 3382260 - RNA, 15 nt, Pseudomonas aeruginosa PA01
ccgggccgccggcga

SEQ ID NO: 3382261 - RNA, 15 nt, Pseudomonas aeruginosa PA01
ccgggccgcgcacaa

SEQ ID NO: 3382262 - RNA, 23 nt, Pseudomonas aeruginosa PA01
ccgggccgcgcacaaaaaagccc

SEQ ID NO: 3382263 - RNA, 17 nt, Pseudomonas aeruginosa PA01
ccgggccggccagggcg

SEQ ID NO: 3382264 - RNA, 14 nt, Pseudomonas aeruginosa PA01
ccgggccgggggcg

SEQ ID NO: 3382265 - RNA, 18 nt, Pseudomonas aeruginosa PA01
ccgggccgggggcggcgc

SEQ ID NO: 3382266 - RNA, 23 nt, Pseudomonas aeruginosa PA01
ccgggccgggggcggcgccuggu

SEQ ID NO: 3382267 - RNA, 20 nt, Pseudomonas aeruginosa PA01
ccgggccgucgggcauggcg

SEQ ID NO: 3382268 - RNA, 14 nt, Pseudomonas aeruginosa PA01
ccgggccuccuggc

SEQ ID NO: 3382269 - RNA, 13 nt, Pseudomonas aeruginosa PA01
ccgggccuggugc

SEQ ID NO: 3382270 - RNA, 13 nt, Pseudomonas aeruginosa PA01
ccgggcgaccugc

SEQ ID NO: 3382271 - RNA, 14 nt, Pseudomonas aeruginosa PA01
ccgggcgaccugcu

SEQ ID NO: 3382272 - RNA, 23 nt, Pseudomonas aeruginosa PA01
ccgggcgaccugcucgcgcaccg

SEQ ID NO: 3382273 - RNA, 19 nt, Pseudomonas aeruginosa PA01
ccgggcgagucgaucaggu

SEQ ID NO: 3382274 - RNA, 23 nt, Pseudomonas aeruginosa PA01
ccgggcgagucgaucaggucgcc

SEQ ID NO: 3382275 - RNA, 22 nt, Pseudomonas aeruginosa PA01
ccgggcgccaccgauagcggcg

SEQ ID NO: 3382276 - RNA, 23 nt, Pseudomonas aeruginosa PA01
ccgggcgccaccgauagcggcgc

SEQ ID NO: 3382277 - RNA, 17 nt, Pseudomonas aeruginosa PA01
ccgggcgcccggccgga

SEQ ID NO: 3382278 - RNA, 15 nt, Pseudomonas aeruginosa PA01
ccgggcgccggguca

SEQ ID NO: 3382279 - RNA, 13 nt, Pseudomonas aeruginosa PA01
ccgggcgccucgu

SEQ ID NO: 3382280 - RNA, 21 nt, Pseudomonas aeruginosa PA01
ccgggcgcgcgccucagcggc

SEQ ID NO: 3382281 - RNA, 22 nt, Pseudomonas aeruginosa PA01
ccgggcgcgcgccucagcggcu

SEQ ID NO: 3382282 - RNA, 23 nt, Pseudomonas aeruginosa PA01
ccgggcgcgcgccucagcggcug

SEQ ID NO: 3382283 - RNA, 12 nt, Pseudomonas aeruginosa PA01
ccgggcgcgcug

SEQ ID NO: 3382284 - RNA, 14 nt, Pseudomonas aeruginosa PA01
ccgggcgcgcuggu

SEQ ID NO: 3382285 - RNA, 14 nt, Pseudomonas aeruginosa PA01
ccgggcgcggcugg

SEQ ID NO: 3382286 - RNA, 13 nt, Pseudomonas aeruginosa PA01
ccgggcggaggcg

SEQ ID NO: 3382287 - RNA, 22 nt, Pseudomonas aeruginosa PA01
ccgggcggaggcgaggucgccg

SEQ ID NO: 3382288 - RNA, 14 nt, Pseudomonas aeruginosa PA01
ccgggcggcaggcg

SEQ ID NO: 3382289 - RNA, 16 nt, Pseudomonas aeruginosa PA01
ccgggcggcaggcgcc

SEQ ID NO: 3382290 - RNA, 17 nt, Pseudomonas aeruginosa PA01
ccgggcggcaggcgccg

SEQ ID NO: 3382291 - RNA, 15 nt, Pseudomonas aeruginosa PA01
ccgggcggcgcggcg

SEQ ID NO: 3382292 - RNA, 18 nt, Pseudomonas aeruginosa PA01
ccgggcggcgcggcgcaa

SEQ ID NO: 3382293 - RNA, 14 nt, Pseudomonas aeruginosa PA01
ccgggcggcggcgc

SEQ ID NO: 3382294 - RNA, 20 nt, Pseudomonas aeruginosa PA01
ccgggcggcgggcgcaagcc

SEQ ID NO: 3382295 - RNA, 20 nt, Pseudomonas aeruginosa PA01
ccgggcggcgucgcggagaa

SEQ ID NO: 3382296 - RNA, 21 nt, Pseudomonas aeruginosa PA01
ccgggcggcuguagcggauca

SEQ ID NO: 3382297 - RNA, 18 nt, Pseudomonas aeruginosa PA01
ccgggcgguacaggcgca

SEQ ID NO: 3382298 - RNA, 13 nt, Pseudomonas aeruginosa PA01
ccgggcguaacgg

SEQ ID NO: 3382299 - RNA, 22 nt, Pseudomonas aeruginosa PA01
ccgggcguaacggcucgccggg

SEQ ID NO: 3382300 - RNA, 18 nt, Pseudomonas aeruginosa PA01
ccgggcguagggcgaaua

SEQ ID NO: 3382301 - RNA, 18 nt, Pseudomonas aeruginosa PA01
ccgggcguggggcgaaua

SEQ ID NO: 3382302 - RNA, 13 nt, Pseudomonas aeruginosa PA01
ccgggcgugucga

SEQ ID NO: 3382303 - RNA, 23 nt, Pseudomonas aeruginosa PA01
ccgggcgugucgaggaaggccag

SEQ ID NO: 3382304 - RNA, 20 nt, Pseudomonas aeruginosa PA01
ccgggcguugguacagcucg

SEQ ID NO: 3382305 - RNA, 21 nt, Pseudomonas aeruginosa PA01
ccgggcguugguacagcucgc

SEQ ID NO: 3382306 - RNA, 23 nt, Pseudomonas aeruginosa PA01
ccgggcguuuucguugccgcgcu

SEQ ID NO: 3382307 - RNA, 22 nt, Pseudomonas aeruginosa PA01
ccgggcguuuucguuggcgcga

SEQ ID NO: 3382308 - RNA, 23 nt, Pseudomonas aeruginosa PA01
ccgggcucacucccguccagcgc

SEQ ID NO: 3382309 - RNA, 14 nt, Pseudomonas aeruginosa PA01
ccgggcucagcgcg

SEQ ID NO: 3382310 - RNA, 15 nt, Pseudomonas aeruginosa PA01
ccgggcucagcgcgc

SEQ ID NO: 3382311 - RNA, 17 nt, Pseudomonas aeruginosa PA01
ccgggcucagcgcgcgu

SEQ ID NO: 3382312 - RNA, 15 nt, Pseudomonas aeruginosa PA01
ccgggcuccaccagu

SEQ ID NO: 3382313 - RNA, 15 nt, Pseudomonas aeruginosa PA01
ccgggcucugguagc

SEQ ID NO: 3382314 - RNA, 21 nt, Pseudomonas aeruginosa PA01
ccgggcucugguagccgcagu

SEQ ID NO: 3382315 - RNA, 12 nt, Pseudomonas aeruginosa PA01
ccgggcugccga

SEQ ID NO: 3382316 - RNA, 17 nt, Pseudomonas aeruginosa PA01
ccgggcugccgaacagg

SEQ ID NO: 3382317 - RNA, 13 nt, Pseudomonas aeruginosa PA01
ccgggcugcgcuc

SEQ ID NO: 3382318 - RNA, 15 nt, Pseudomonas aeruginosa PA01
ccgggcugcgcucgg

SEQ ID NO: 3382319 - RNA, 19 nt, Pseudomonas aeruginosa PA01
ccgggcugcgcucggcgcu

SEQ ID NO: 3382320 - RNA, 12 nt, Pseudomonas aeruginosa PA01
ccgggcuggcca

SEQ ID NO: 3382321 - RNA, 13 nt, Pseudomonas aeruginosa PA01
ccgggcuggccac

SEQ ID NO: 3382322 - RNA, 14 nt, Pseudomonas aeruginosa PA01
ccgggcuggccacc

SEQ ID NO: 3382323 - RNA, 17 nt, Pseudomonas aeruginosa PA01
ccgggcuggccaccagc

SEQ ID NO: 3382324 - RNA, 20 nt, Pseudomonas aeruginosa PA01
ccgggcuggccaccagcacc

SEQ ID NO: 3382325 - RNA, 16 nt, Pseudomonas aeruginosa PA01
ccgggcuggccaccgc

SEQ ID NO: 3382326 - RNA, 17 nt, Pseudomonas aeruginosa PA01
ccgggcuggccaccgcc

SEQ ID NO: 3382327 - RNA, 13 nt, Pseudomonas aeruginosa PA01
ccgggcuggccgu

SEQ ID NO: 3382328 - RNA, 14 nt, Pseudomonas aeruginosa PA01
ccgggcuggccguc

SEQ ID NO: 3382329 - RNA, 18 nt, Pseudomonas aeruginosa PA01
ccgggcuggccgucgagg

SEQ ID NO: 3382330 - RNA, 20 nt, Pseudomonas aeruginosa PA01
ccgggcuggucguagcagcg

SEQ ID NO: 3382331 - RNA, 14 nt, Pseudomonas aeruginosa PA01
ccgggcuuccuggc

SEQ ID NO: 3382332 - RNA, 20 nt, Pseudomonas aeruginosa PA01
ccgggcuucuucaggcaagg

SEQ ID NO: 3382333 - RNA, 17 nt, Pseudomonas aeruginosa PA01
ccgggcuuuuucauggc

SEQ ID NO: 3382334 - RNA, 19 nt, Pseudomonas aeruginosa PA01
ccgggcuuuuucauggcug

SEQ ID NO: 3382335 - RNA, 22 nt, Pseudomonas aeruginosa PA01
ccgggcuuuuucauggcuggcc

SEQ ID NO: 3382336 - RNA, 23 nt, Pseudomonas aeruginosa PA01
ccgguacagcgccuggucggcgg

SEQ ID NO: 3382337 - RNA, 19 nt, Pseudomonas aeruginosa PA01
ccgguacagcuguccgcgc

SEQ ID NO: 3382338 - RNA, 21 nt, Pseudomonas aeruginosa PA01
ccgguacagcuguccgcgccg

SEQ ID NO: 3382339 - RNA, 22 nt, Pseudomonas aeruginosa PA01
ccgguacagcuguccgcgccgc

SEQ ID NO: 3382340 - RNA, 15 nt, Pseudomonas aeruginosa PA01
ccgguaccacgggca

SEQ ID NO: 3382341 - RNA, 13 nt, Pseudomonas aeruginosa PA01
ccgguacccguac

SEQ ID NO: 3382342 - RNA, 15 nt, Pseudomonas aeruginosa PA01
ccgguacgcucacca

SEQ ID NO: 3382343 - RNA, 16 nt, Pseudomonas aeruginosa PA01
ccgguacgcucaccac

SEQ ID NO: 3382344 - RNA, 18 nt, Pseudomonas aeruginosa PA01
ccgguacgcucaccacca

SEQ ID NO: 3382345 - RNA, 20 nt, Pseudomonas aeruginosa PA01
ccgguacgcucaccaccacc

SEQ ID NO: 3382346 - RNA, 17 nt, Pseudomonas aeruginosa PA01
ccgguacucgccgggcg

SEQ ID NO: 3382347 - RNA, 18 nt, Pseudomonas aeruginosa PA01
ccgguacucgccgggcgu

SEQ ID NO: 3382348 - RNA, 17 nt, Pseudomonas aeruginosa PA01
ccgguacugcugggccu

SEQ ID NO: 3382349 - RNA, 18 nt, Pseudomonas aeruginosa PA01
ccgguagacgccucccac

SEQ ID NO: 3382350 - RNA, 13 nt, Pseudomonas aeruginosa PA01
ccgguagccggcg

SEQ ID NO: 3382351 - RNA, 21 nt, Pseudomonas aeruginosa PA01
ccgguagccguucgacgcugc

SEQ ID NO: 3382352 - RNA, 17 nt, Pseudomonas aeruginosa PA01
ccgguagcgcgccugcu

SEQ ID NO: 3382353 - RNA, 23 nt, Pseudomonas aeruginosa PA01
ccgguagcggcgcaccgacgccg

SEQ ID NO: 3382354 - RNA, 15 nt, Pseudomonas aeruginosa PA01
ccgguaggagcgaga

SEQ ID NO: 3382355 - RNA, 19 nt, Pseudomonas aeruginosa PA01
ccgguaggagcgagagcgc

SEQ ID NO: 3382356 - RNA, 21 nt, Pseudomonas aeruginosa PA01
ccgguaggagcgagagcgcug

SEQ ID NO: 3382357 - RNA, 24 nt, Pseudomonas aeruginosa PA01
ccgguaggagcgagagcgcugccg

SEQ ID NO: 3382358 - RNA, 13 nt, Pseudomonas aeruginosa PA01
ccgguagggcgaa

SEQ ID NO: 3382359 - RNA, 23 nt, Pseudomonas aeruginosa PA01
ccgguagggcgaauagcgccgca

SEQ ID NO: 3382360 - RNA, 15 nt, Pseudomonas aeruginosa PA01
ccgguagucggggca

SEQ ID NO: 3382361 - RNA, 15 nt, Pseudomonas aeruginosa PA01
ccgguaucgcgcuug

SEQ ID NO: 3382362 - RNA, 17 nt, Pseudomonas aeruginosa PA01
ccgguaucgcgcuugga

SEQ ID NO: 3382363 - RNA, 13 nt, Pseudomonas aeruginosa PA01
ccgguaugccgau

SEQ ID NO: 3382364 - RNA, 23 nt, Pseudomonas aeruginosa PA01
ccggucaaaccauggcguagggc

SEQ ID NO: 3382365 - RNA, 23 nt, Pseudomonas aeruginosa PA01
ccggucaaaucguagcguagggc

SEQ ID NO: 3382366 - RNA, 12 nt, Pseudomonas aeruginosa PA01
ccggucaccacc

SEQ ID NO: 3382367 - RNA, 15 nt, Pseudomonas aeruginosa PA01
ccggucaccacccag

SEQ ID NO: 3382368 - RNA, 19 nt, Pseudomonas aeruginosa PA01
ccggucaccacccagccgc

SEQ ID NO: 3382369 - RNA, 21 nt, Pseudomonas aeruginosa PA01
ccggucaccacccagccgcgg

SEQ ID NO: 3382370 - RNA, 22 nt, Pseudomonas aeruginosa PA01
ccggucaccacccagccgcggc

SEQ ID NO: 3382371 - RNA, 13 nt, Pseudomonas aeruginosa PA01
ccggucaccgugg

SEQ ID NO: 3382372 - RNA, 23 nt, Pseudomonas aeruginosa PA01
ccggucaccguggagaggucgcc

SEQ ID NO: 3382373 - RNA, 18 nt, Pseudomonas aeruginosa PA01
ccggucacgccgggaauc

SEQ ID NO: 3382374 - RNA, 19 nt, Pseudomonas aeruginosa PA01
ccggucagagacagguacu

SEQ ID NO: 3382375 - RNA, 18 nt, Pseudomonas aeruginosa PA01
ccggucagcuucgccgcc

SEQ ID NO: 3382376 - RNA, 23 nt, Pseudomonas aeruginosa PA01
ccggucaggcaaucucccccucu

SEQ ID NO: 3382377 - RNA, 12 nt, Pseudomonas aeruginosa PA01
ccggucaggcug

SEQ ID NO: 3382378 - RNA, 17 nt, Pseudomonas aeruginosa PA01
ccggucaggcugcggcg

SEQ ID NO: 3382379 - RNA, 16 nt, Pseudomonas aeruginosa PA01
ccggucaggcuggugc

SEQ ID NO: 3382380 - RNA, 19 nt, Pseudomonas aeruginosa PA01
ccggucaggcuggugccgc

SEQ ID NO: 3382381 - RNA, 23 nt, Pseudomonas aeruginosa PA01
ccggucagguaggcaucgacgcc

SEQ ID NO: 3382382 - RNA, 22 nt, Pseudomonas aeruginosa PA01
ccggucagguuggacagguccu

SEQ ID NO: 3382383 - RNA, 22 nt, Pseudomonas aeruginosa PA01
ccggucauggugccgagcagga

SEQ ID NO: 3382384 - RNA, 21 nt, Pseudomonas aeruginosa PA01
ccggucccagguagcgcugcg

SEQ ID NO: 3382385 - RNA, 20 nt, Pseudomonas aeruginosa PA01
ccgguccgacaaucagcggc

SEQ ID NO: 3382386 - RNA, 22 nt, Pseudomonas aeruginosa PA01
ccgguccgacaaucagcggcgg

SEQ ID NO: 3382387 - RNA, 16 nt, Pseudomonas aeruginosa PA01
ccgguccguccagcgc

SEQ ID NO: 3382388 - RNA, 17 nt, Pseudomonas aeruginosa PA01
ccgguccguccagcgcg

SEQ ID NO: 3382389 - RNA, 20 nt, Pseudomonas aeruginosa PA01
ccgguccguccagcgcgccc

SEQ ID NO: 3382390 - RNA, 23 nt, Pseudomonas aeruginosa PA01
ccgguccguccagcgcgcccggc

SEQ ID NO: 3382391 - RNA, 13 nt, Pseudomonas aeruginosa PA01
ccgguccucgaca

SEQ ID NO: 3382392 - RNA, 14 nt, Pseudomonas aeruginosa PA01
ccgguccucgcccg

SEQ ID NO: 3382393 - RNA, 15 nt, Pseudomonas aeruginosa PA01
ccgguccucgcccgu

SEQ ID NO: 3382394 - RNA, 15 nt, Pseudomonas aeruginosa PA01
ccgguccugcaacug

SEQ ID NO: 3382395 - RNA, 13 nt, Pseudomonas aeruginosa PA01
ccggucgcgcagc

SEQ ID NO: 3382396 - RNA, 14 nt, Pseudomonas aeruginosa PA01
ccggucgcgcagca

SEQ ID NO: 3382397 - RNA, 18 nt, Pseudomonas aeruginosa PA01
ccggucgcgcucaggcgc

SEQ ID NO: 3382398 - RNA, 21 nt, Pseudomonas aeruginosa PA01
ccggucgcgcucaggcgcagc

SEQ ID NO: 3382399 - RNA, 21 nt, Pseudomonas aeruginosa PA01
ccggucgcgcuggaccuggcc

SEQ ID NO: 3382400 - RNA, 14 nt, Pseudomonas aeruginosa PA01
ccggucgcugacca

SEQ ID NO: 3382401 - RNA, 18 nt, Pseudomonas aeruginosa PA01
ccggucgcugaccagccc

SEQ ID NO: 3382402 - RNA, 20 nt, Pseudomonas aeruginosa PA01
ccggucgcugaccagcccgg

SEQ ID NO: 3382403 - RNA, 21 nt, Pseudomonas aeruginosa PA01
ccggucgcugaccagcccggc

SEQ ID NO: 3382404 - RNA, 21 nt, Pseudomonas aeruginosa PA01
ccggucggaacgaccacgccu

SEQ ID NO: 3382405 - RNA, 11 nt, Pseudomonas aeruginosa PA01
ccggucggacu

SEQ ID NO: 3382406 - RNA, 13 nt, Pseudomonas aeruginosa PA01
ccggucggccugu

SEQ ID NO: 3382407 - RNA, 12 nt, Pseudomonas aeruginosa PA01
ccggucggccuu

SEQ ID NO: 3382408 - RNA, 14 nt, Pseudomonas aeruginosa PA01
ccggucggccuuga

SEQ ID NO: 3382409 - RNA, 16 nt, Pseudomonas aeruginosa PA01
ccggucuagccgggcc

SEQ ID NO: 3382410 - RNA, 16 nt, Pseudomonas aeruginosa PA01
ccggucuagcgccccg

SEQ ID NO: 3382411 - RNA, 20 nt, Pseudomonas aeruginosa PA01
ccggucuagcgccccggccg

SEQ ID NO: 3382412 - RNA, 21 nt, Pseudomonas aeruginosa PA01
ccggucuagcgccccggccgc

SEQ ID NO: 3382413 - RNA, 16 nt, Pseudomonas aeruginosa PA01
ccggucucagccggcg

SEQ ID NO: 3382414 - RNA, 18 nt, Pseudomonas aeruginosa PA01
ccggucucagccggcgcu

SEQ ID NO: 3382415 - RNA, 15 nt, Pseudomonas aeruginosa PA01
ccggucucgcgcagc

SEQ ID NO: 3382416 - RNA, 13 nt, Pseudomonas aeruginosa PA01
ccggucugcugcg

SEQ ID NO: 3382417 - RNA, 20 nt, Pseudomonas aeruginosa PA01
ccggucugcugcgcgcacca

SEQ ID NO: 3382418 - RNA, 19 nt, Pseudomonas aeruginosa PA01
ccggucuucacgccuugcu

SEQ ID NO: 3382419 - RNA, 22 nt, Pseudomonas aeruginosa PA01
ccggucuucacgccuugcugcg

SEQ ID NO: 3382420 - RNA, 15 nt, Pseudomonas aeruginosa PA01
ccggucuugccggcu

SEQ ID NO: 3382421 - RNA, 18 nt, Pseudomonas aeruginosa PA01
ccggucuugccggcugcg

SEQ ID NO: 3382422 - RNA, 13 nt, Pseudomonas aeruginosa PA01
ccggugaacaggu

SEQ ID NO: 3382423 - RNA, 19 nt, Pseudomonas aeruginosa PA01
ccggugacauucgacagca

SEQ ID NO: 3382424 - RNA, 23 nt, Pseudomonas aeruginosa PA01
ccggugacccacuccggcaggcg

SEQ ID NO: 3382425 - RNA, 19 nt, Pseudomonas aeruginosa PA01
ccggugacgaacgaagcgc

SEQ ID NO: 3382426 - RNA, 23 nt, Pseudomonas aeruginosa PA01
ccggugacgcugcucaccaggug

SEQ ID NO: 3382427 - RNA, 13 nt, Pseudomonas aeruginosa PA01
ccggugaggcgca

SEQ ID NO: 3382428 - RNA, 15 nt, Pseudomonas aeruginosa PA01
ccggugaggcgcagc

SEQ ID NO: 3382429 - RNA, 16 nt, Pseudomonas aeruginosa PA01
ccggugaggcgcagca

SEQ ID NO: 3382430 - RNA, 21 nt, Pseudomonas aeruginosa PA01
ccggugaggcgcagcagcgcc

SEQ ID NO: 3382431 - RNA, 22 nt, Pseudomonas aeruginosa PA01
ccggugaggcgcagcagcgcca

SEQ ID NO: 3382432 - RNA, 23 nt, Pseudomonas aeruginosa PA01
ccggugaggcgcagcagcgccag

SEQ ID NO: 3382433 - RNA, 13 nt, Pseudomonas aeruginosa PA01
ccggugaucgagc

SEQ ID NO: 3382434 - RNA, 18 nt, Pseudomonas aeruginosa PA01
ccggugaucgagccgccg

SEQ ID NO: 3382435 - RNA, 19 nt, Pseudomonas aeruginosa PA01
ccggugaucgagccgccgg

SEQ ID NO: 3382436 - RNA, 17 nt, Pseudomonas aeruginosa PA01
ccggugaucucgcggcg

SEQ ID NO: 3382437 - RNA, 18 nt, Pseudomonas aeruginosa PA01
ccggugaucucgcggcgc

SEQ ID NO: 3382438 - RNA, 21 nt, Pseudomonas aeruginosa PA01
ccguagcgcaguucgccgccg

SEQ ID NO: 3382439 - RNA, 18 nt, Pseudomonas aeruginosa PA01
ccguagcugcgcgccucu

SEQ ID NO: 3382440 - RNA, 16 nt, Pseudomonas aeruginosa PA01
ccguaggccacuuccc

SEQ ID NO: 3382441 - RNA, 19 nt, Pseudomonas aeruginosa PA01
ccguagggcgaacaacgcc

SEQ ID NO: 3382442 - RNA, 21 nt, Pseudomonas aeruginosa PA01
ccguagggcgaacaacgccgc

SEQ ID NO: 3382443 - RNA, 23 nt, Pseudomonas aeruginosa PA01
ccguagggcgaauaacgccaccg

SEQ ID NO: 3382444 - RNA, 13 nt, Pseudomonas aeruginosa PA01
ccguagggcgacg

SEQ ID NO: 3382445 - RNA, 19 nt, Pseudomonas aeruginosa PA01
ccguaggugaccgcccagg

SEQ ID NO: 3382446 - RNA, 21 nt, Pseudomonas aeruginosa PA01
ccguaguggcguuccaggcgg

SEQ ID NO: 3382447 - RNA, 22 nt, Pseudomonas aeruginosa PA01
ccguaguggcguuccaggcggc

SEQ ID NO: 3382448 - RNA, 19 nt, Pseudomonas aeruginosa PA01
ccgucaacccuugcucccg

SEQ ID NO: 3382449 - RNA, 21 nt, Pseudomonas aeruginosa PA01
ccgucaacccuugcucccgcc

SEQ ID NO: 3382450 - RNA, 23 nt, Pseudomonas aeruginosa PA01
ccgucaaugcggccugcaacgcc

SEQ ID NO: 3382451 - RNA, 18 nt, Pseudomonas aeruginosa PA01
ccgucaccuguucggcgc

SEQ ID NO: 3382452 - RNA, 16 nt, Pseudomonas aeruginosa PA01
ccgucacgcggaccca

SEQ ID NO: 3382453 - RNA, 17 nt, Pseudomonas aeruginosa PA01
ccgucacgcggacccag

SEQ ID NO: 3382454 - RNA, 18 nt, Pseudomonas aeruginosa PA01
ccgucacuucacgacagg

SEQ ID NO: 3382455 - RNA, 14 nt, Pseudomonas aeruginosa PA01
ccgucagccaggcu

SEQ ID NO: 3382456 - RNA, 15 nt, Pseudomonas aeruginosa PA01
ccgucagccaggcug

SEQ ID NO: 3382457 - RNA, 16 nt, Pseudomonas aeruginosa PA01
ccgucaggcaccucgu

SEQ ID NO: 3382458 - RNA, 17 nt, Pseudomonas aeruginosa PA01
ccgucaggccuugcgcg

SEQ ID NO: 3382459 - RNA, 20 nt, Pseudomonas aeruginosa PA01
ccgucagggcguaagcuggg

SEQ ID NO: 3382460 - RNA, 16 nt, Pseudomonas aeruginosa PA01
ccgucaucacccacca

SEQ ID NO: 3382461 - RNA, 17 nt, Pseudomonas aeruginosa PA01
ccgucaugaccagagcc

SEQ ID NO: 3382462 - RNA, 21 nt, Pseudomonas aeruginosa PA01
ccgucaugaccagagccgccg

SEQ ID NO: 3382463 - RNA, 19 nt, Pseudomonas aeruginosa PA01
ccgucaugcacuucgacca

SEQ ID NO: 3382464 - RNA, 20 nt, Pseudomonas aeruginosa PA01
ccgucaugcacuucgaccag

SEQ ID NO: 3382465 - RNA, 12 nt, Pseudomonas aeruginosa PA01
ccgucauggugc

SEQ ID NO: 3382466 - RNA, 17 nt, Pseudomonas aeruginosa PA01
ccguccacaccgagacg

SEQ ID NO: 3382467 - RNA, 14 nt, Pseudomonas aeruginosa PA01
ccguccaccagcca

SEQ ID NO: 3382468 - RNA, 15 nt, Pseudomonas aeruginosa PA01
ccguccacuggccca

SEQ ID NO: 3382469 - RNA, 13 nt, Pseudomonas aeruginosa PA01
ccguccagccggc

SEQ ID NO: 3382470 - RNA, 13 nt, Pseudomonas aeruginosa PA01
ccguccagcgaga

SEQ ID NO: 3382471 - RNA, 20 nt, Pseudomonas aeruginosa PA01
ccguccagcgagaacuugcc

SEQ ID NO: 3382472 - RNA, 22 nt, Pseudomonas aeruginosa PA01
ccguccagcgagaacuugccgg

SEQ ID NO: 3382473 - RNA, 19 nt, Pseudomonas aeruginosa PA01
ccguccagcgcgcccggcg

SEQ ID NO: 3382474 - RNA, 13 nt, Pseudomonas aeruginosa PA01
ccguccaggcugc

SEQ ID NO: 3382475 - RNA, 17 nt, Pseudomonas aeruginosa PA01
ccguccaggcugccgcc

SEQ ID NO: 3382476 - RNA, 15 nt, Pseudomonas aeruginosa PA01
ccguccagugcggca

SEQ ID NO: 3382477 - RNA, 14 nt, Pseudomonas aeruginosa PA01
ccguccaucaggcg

SEQ ID NO: 3382478 - RNA, 20 nt, Pseudomonas aeruginosa PA01
ccguccaucuguaccaccgc

SEQ ID NO: 3382479 - RNA, 17 nt, Pseudomonas aeruginosa PA01
ccgucccacaggccggc

SEQ ID NO: 3382480 - RNA, 19 nt, Pseudomonas aeruginosa PA01
ccgucccacaggccggcua

SEQ ID NO: 3382481 - RNA, 12 nt, Pseudomonas aeruginosa PA01
ccgucccagucg

SEQ ID NO: 3382482 - RNA, 14 nt, Pseudomonas aeruginosa PA01
ccgucccagucggc

SEQ ID NO: 3382483 - RNA, 16 nt, Pseudomonas aeruginosa PA01
ccgucccagucggcgu

SEQ ID NO: 3382484 - RNA, 15 nt, Pseudomonas aeruginosa PA01
ccgucccgcgcgccg

SEQ ID NO: 3382485 - RNA, 17 nt, Pseudomonas aeruginosa PA01
ccgucccggaguuccag

SEQ ID NO: 3382486 - RNA, 21 nt, Pseudomonas aeruginosa PA01
ccgucccggaguuccagcggg

SEQ ID NO: 3382487 - RNA, 17 nt, Pseudomonas aeruginosa PA01
ccgucccuaccagcgca

SEQ ID NO: 3382488 - RNA, 21 nt, Pseudomonas aeruginosa PA01
ccguccgaggauaccgcacgg

SEQ ID NO: 3382489 - RNA, 19 nt, Pseudomonas aeruginosa PA01
ccguccgcagcacagcccc

SEQ ID NO: 3382490 - RNA, 12 nt, Pseudomonas aeruginosa PA01
ccguccgcagcg

SEQ ID NO: 3382491 - RNA, 14 nt, Pseudomonas aeruginosa PA01
ccguccgccugcgg

SEQ ID NO: 3382492 - RNA, 13 nt, Pseudomonas aeruginosa PA01
ccguccgcgccgc

SEQ ID NO: 3382493 - RNA, 14 nt, Pseudomonas aeruginosa PA01
ccguccgcgccgcg

SEQ ID NO: 3382494 - RNA, 16 nt, Pseudomonas aeruginosa PA01
ccguccgcgccgcgcg

SEQ ID NO: 3382495 - RNA, 17 nt, Pseudomonas aeruginosa PA01
ccguccgcgccgcgcgu

SEQ ID NO: 3382496 - RNA, 15 nt, Pseudomonas aeruginosa PA01
ccguccgcgggcgau

SEQ ID NO: 3382497 - RNA, 15 nt, Pseudomonas aeruginosa PA01
ccguccgcugcgcca

SEQ ID NO: 3382498 - RNA, 13 nt, Pseudomonas aeruginosa PA01
ccguccgggcacg

SEQ ID NO: 3382499 - RNA, 18 nt, Pseudomonas aeruginosa PA01
ccguccgggucggucacg

SEQ ID NO: 3382500 - RNA, 22 nt, Pseudomonas aeruginosa PA01
ccguccgggugggucauggcgu

SEQ ID NO: 3382501 - RNA, 22 nt, Pseudomonas aeruginosa PA01
ccguccuacgcgaccggucagg

SEQ ID NO: 3382502 - RNA, 15 nt, Pseudomonas aeruginosa PA01
ccguccuccagcaag

SEQ ID NO: 3382503 - RNA, 23 nt, Pseudomonas aeruginosa PA01
ccguccucgggaugcaguucguu

SEQ ID NO: 3382504 - RNA, 15 nt, Pseudomonas aeruginosa PA01
ccguccucgucgagg

SEQ ID NO: 3382505 - RNA, 19 nt, Pseudomonas aeruginosa PA01
ccguccugcaacugcucga

SEQ ID NO: 3382506 - RNA, 15 nt, Pseudomonas aeruginosa PA01
ccguccugcuugacc

SEQ ID NO: 3382507 - RNA, 13 nt, Pseudomonas aeruginosa PA01
ccguccuggcccu

SEQ ID NO: 3382508 - RNA, 15 nt, Pseudomonas aeruginosa PA01
ccguccuucaggacg

SEQ ID NO: 3382509 - RNA, 14 nt, Pseudomonas aeruginosa PA01
ccguccuucggccg

SEQ ID NO: 3382510 - RNA, 22 nt, Pseudomonas aeruginosa PA01
ccguccuugaguagcuggcgca

SEQ ID NO: 3382511 - RNA, 14 nt, Pseudomonas aeruginosa PA01
ccgucgaacagcag

SEQ ID NO: 3382512 - RNA, 19 nt, Pseudomonas aeruginosa PA01
ccgucgaacagcagcucgc

SEQ ID NO: 3382513 - RNA, 21 nt, Pseudomonas aeruginosa PA01
ccgucgaacagcagcucgccg

SEQ ID NO: 3382514 - RNA, 16 nt, Pseudomonas aeruginosa PA01
ccgucgaaccagccgc

SEQ ID NO: 3382515 - RNA, 14 nt, Pseudomonas aeruginosa PA01
ccgucgaagaucac

SEQ ID NO: 3382516 - RNA, 15 nt, Pseudomonas aeruginosa PA01
ccgucgaagaucacc

SEQ ID NO: 3382517 - RNA, 17 nt, Pseudomonas aeruginosa PA01
ccgucgaagaucaccgg

SEQ ID NO: 3382518 - RNA, 18 nt, Pseudomonas aeruginosa PA01
ccgucgaagccaggcacc

SEQ ID NO: 3382519 - RNA, 12 nt, Pseudomonas aeruginosa PA01
ccgucgaagggc

SEQ ID NO: 3382520 - RNA, 18 nt, Pseudomonas aeruginosa PA01
ccgucgaauuggacagca

SEQ ID NO: 3382521 - RNA, 23 nt, Pseudomonas aeruginosa PA01
ccgucgaauuggacagcaggcug

SEQ ID NO: 3382522 - RNA, 22 nt, Pseudomonas aeruginosa PA01
ccgucgacacugauauccgcuc

SEQ ID NO: 3382523 - RNA, 17 nt, Pseudomonas aeruginosa PA01
ccgucgaccaucaccag

SEQ ID NO: 3382524 - RNA, 18 nt, Pseudomonas aeruginosa PA01
ccgucgaccaucaccagc

SEQ ID NO: 3382525 - RNA, 22 nt, Pseudomonas aeruginosa PA01
ccgucgaccaucaccagcgccg

SEQ ID NO: 3382526 - RNA, 14 nt, Pseudomonas aeruginosa PA01
ccgucgacccgccu

SEQ ID NO: 3382527 - RNA, 20 nt, Pseudomonas aeruginosa PA01
ccgucgacccgccucacccc

SEQ ID NO: 3382528 - RNA, 13 nt, Pseudomonas aeruginosa PA01
ccgucgaccugcg

SEQ ID NO: 3382529 - RNA, 22 nt, Pseudomonas aeruginosa PA01
ccgucgacgcaucgacggggcg

SEQ ID NO: 3382530 - RNA, 18 nt, Pseudomonas aeruginosa PA01
ccgucgacgcccugggcg

SEQ ID NO: 3382531 - RNA, 16 nt, Pseudomonas aeruginosa PA01
ccgucgagcaccagca

SEQ ID NO: 3382532 - RNA, 18 nt, Pseudomonas aeruginosa PA01
ccgucgagcaccagcagg

SEQ ID NO: 3382533 - RNA, 19 nt, Pseudomonas aeruginosa PA01
ccgucgagcaccagcaggu

SEQ ID NO: 3382534 - RNA, 17 nt, Pseudomonas aeruginosa PA01
ccgucgagcaccaggcg

SEQ ID NO: 3382535 - RNA, 15 nt, Pseudomonas aeruginosa PA01
ccgucgagccagccc

SEQ ID NO: 3382536 - RNA, 17 nt, Pseudomonas aeruginosa PA01
ccgucgagccagcccag

SEQ ID NO: 3382537 - RNA, 21 nt, Pseudomonas aeruginosa PA01
ccgucgagccagcccagcggc

SEQ ID NO: 3382538 - RNA, 22 nt, Pseudomonas aeruginosa PA01
ccgucgagccagcccagcggcg

SEQ ID NO: 3382539 - RNA, 14 nt, Pseudomonas aeruginosa PA01
ccgucgagggcaaa

SEQ ID NO: 3382540 - RNA, 24 nt, Pseudomonas aeruginosa PA01
ccgucgagggcaaaggcgcgcagg

SEQ ID NO: 3382541 - RNA, 18 nt, Pseudomonas aeruginosa PA01
ccguucugccgcagcgcc

SEQ ID NO: 3382542 - RNA, 21 nt, Pseudomonas aeruginosa PA01
ccguucugccgcagcgccucc

SEQ ID NO: 3382543 - RNA, 22 nt, Pseudomonas aeruginosa PA01
ccguucugccgcagcgccuccc

SEQ ID NO: 3382544 - RNA, 18 nt, Pseudomonas aeruginosa PA01
ccguucuugaucaccgcg

SEQ ID NO: 3382545 - RNA, 20 nt, Pseudomonas aeruginosa PA01
ccguugaaacgcucggcguc

SEQ ID NO: 3382546 - RNA, 16 nt, Pseudomonas aeruginosa PA01
ccguugaacucggcgc

SEQ ID NO: 3382547 - RNA, 15 nt, Pseudomonas aeruginosa PA01
ccguugaccagcgcg

SEQ ID NO: 3382548 - RNA, 16 nt, Pseudomonas aeruginosa PA01
ccguugaccagcgcgu

SEQ ID NO: 3382549 - RNA, 14 nt, Pseudomonas aeruginosa PA01
ccguugagcaccuc

SEQ ID NO: 3382550 - RNA, 16 nt, Pseudomonas aeruginosa PA01
ccguugaggccgucga

SEQ ID NO: 3382551 - RNA, 13 nt, Pseudomonas aeruginosa PA01
ccguugaugacga

SEQ ID NO: 3382552 - RNA, 14 nt, Pseudomonas aeruginosa PA01
ccguugaugucgac

SEQ ID NO: 3382553 - RNA, 13 nt, Pseudomonas aeruginosa PA01
ccguugcccucgc

SEQ ID NO: 3382554 - RNA, 15 nt, Pseudomonas aeruginosa PA01
ccguugcccucgcgc

SEQ ID NO: 3382555 - RNA, 18 nt, Pseudomonas aeruginosa PA01
ccguugccgaccgagcag

SEQ ID NO: 3382556 - RNA, 22 nt, Pseudomonas aeruginosa PA01
ccguugccgaccgagcagcgga

SEQ ID NO: 3382557 - RNA, 14 nt, Pseudomonas aeruginosa PA01
ccguugccgaugcc

SEQ ID NO: 3382558 - RNA, 18 nt, Pseudomonas aeruginosa PA01
ccguugccgguacucgcc

SEQ ID NO: 3382559 - RNA, 18 nt, Pseudomonas aeruginosa PA01
ccguugccuucgccgucg

SEQ ID NO: 3382560 - RNA, 22 nt, Pseudomonas aeruginosa PA01
ccguugcgcauuugcacgucgg

SEQ ID NO: 3382561 - RNA, 19 nt, Pseudomonas aeruginosa PA01
ccguugcgccucgccgccc

SEQ ID NO: 3382562 - RNA, 20 nt, Pseudomonas aeruginosa PA01
ccguugcgccucgccgcccg

SEQ ID NO: 3382563 - RNA, 23 nt, Pseudomonas aeruginosa PA01
ccguugcggcagcauccguacca

SEQ ID NO: 3382564 - RNA, 16 nt, Pseudomonas aeruginosa PA01
ccguuggccagcaggc

SEQ ID NO: 3382565 - RNA, 17 nt, Pseudomonas aeruginosa PA01
ccguuggccagcaggcg

SEQ ID NO: 3382566 - RNA, 19 nt, Pseudomonas aeruginosa PA01
ccguuggccagcaggcgcc

SEQ ID NO: 3382567 - RNA, 11 nt, Pseudomonas aeruginosa PA01
ccguuggccuu

SEQ ID NO: 3382568 - RNA, 19 nt, Pseudomonas aeruginosa PA01
ccguuggccuucacuucgg

SEQ ID NO: 3382569 - RNA, 20 nt, Pseudomonas aeruginosa PA01
ccguuggcgaacuucaggcc

SEQ ID NO: 3382570 - RNA, 22 nt, Pseudomonas aeruginosa PA01
ccguuggcgaacuucaggccgg

SEQ ID NO: 3382571 - RNA, 19 nt, Pseudomonas aeruginosa PA01
ccguuggcgaggacuuucu

SEQ ID NO: 3382572 - RNA, 13 nt, Pseudomonas aeruginosa PA01
ccguuggcgcggg

SEQ ID NO: 3382573 - RNA, 20 nt, Pseudomonas aeruginosa PA01
ccguuggcgcgggcgaaggc

SEQ ID NO: 3382574 - RNA, 19 nt, Pseudomonas aeruginosa PA01
ccguuggcgucaacgguga

SEQ ID NO: 3382575 - RNA, 15 nt, Pseudomonas aeruginosa PA01
ccguuggcgucgcgc

SEQ ID NO: 3382576 - RNA, 18 nt, Pseudomonas aeruginosa PA01
ccguuggcguuaugcgcc

SEQ ID NO: 3382577 - RNA, 21 nt, Pseudomonas aeruginosa PA01
ccguuggcguuaugcgcccua

SEQ ID NO: 3382578 - RNA, 17 nt, Pseudomonas aeruginosa PA01
ccguugggccagggccu

SEQ ID NO: 3382579 - RNA, 16 nt, Pseudomonas aeruginosa PA01
ccguuggucaacggcg

SEQ ID NO: 3382580 - RNA, 19 nt, Pseudomonas aeruginosa PA01
ccguuguagaucggcagca

SEQ ID NO: 3382581 - RNA, 23 nt, Pseudomonas aeruginosa PA01
ccguugucugggaguuccgcgca

SEQ ID NO: 3382582 - RNA, 22 nt, Pseudomonas aeruginosa PA01
ccguugugcagguacggcgccg

SEQ ID NO: 3382583 - RNA, 14 nt, Pseudomonas aeruginosa PA01
ccguuguggcaggc

SEQ ID NO: 3382584 - RNA, 14 nt, Pseudomonas aeruginosa PA01
ccguuguggcggcg

SEQ ID NO: 3382585 - RNA, 16 nt, Pseudomonas aeruginosa PA01
ccguuguggcggcgcu

SEQ ID NO: 3382586 - RNA, 16 nt, Pseudomonas aeruginosa PA01
ccguuguucaggcgcg

SEQ ID NO: 3382587 - RNA, 16 nt, Pseudomonas aeruginosa PA01
ccguuucgccgccggc

SEQ ID NO: 3382588 - RNA, 12 nt, Pseudomonas aeruginosa PA01
ccguuucggcga

SEQ ID NO: 3382589 - RNA, 16 nt, Pseudomonas aeruginosa PA01
ccguuugccgucggcg

SEQ ID NO: 3382590 - RNA, 17 nt, Pseudomonas aeruginosa PA01
ccguuugccgucggcgc

SEQ ID NO: 3382591 - RNA, 19 nt, Pseudomonas aeruginosa PA01
ccuacaaugauggcccuuc

SEQ ID NO: 3382592 - RNA, 23 nt, Pseudomonas aeruginosa PA01
ccuacaucuuggcaaucaucgcg

SEQ ID NO: 3382593 - RNA, 16 nt, Pseudomonas aeruginosa PA01
ccuaccagaccgcagc

SEQ ID NO: 3382594 - RNA, 21 nt, Pseudomonas aeruginosa PA01
ccuaccagaccgcagccggcg

SEQ ID NO: 3382595 - RNA, 22 nt, Pseudomonas aeruginosa PA01
ccuaccagaccgcagccggcga

SEQ ID NO: 3382596 - RNA, 17 nt, Pseudomonas aeruginosa PA01
ccuaccaguaguucucc

SEQ ID NO: 3382597 - RNA, 14 nt, Pseudomonas aeruginosa PA01
ccuaccccaggggu

SEQ ID NO: 3382598 - RNA, 16 nt, Pseudomonas aeruginosa PA01
ccuacccgacaggcag

SEQ ID NO: 3382599 - RNA, 17 nt, Pseudomonas aeruginosa PA01
ccuacccgacaggcagc

SEQ ID NO: 3382600 - RNA, 16 nt, Pseudomonas aeruginosa PA01
ccuaccgcccacccug

SEQ ID NO: 3382601 - RNA, 16 nt, Pseudomonas aeruginosa PA01
ccuaccggcgccgccc

SEQ ID NO: 3382602 - RNA, 21 nt, Pseudomonas aeruginosa PA01
ccuacgcaacccgcccggcuc

SEQ ID NO: 3382603 - RNA, 12 nt, Pseudomonas aeruginosa PA01
ccuacgcggcac

SEQ ID NO: 3382604 - RNA, 15 nt, Pseudomonas aeruginosa PA01
ccuacggaccggugc

SEQ ID NO: 3382605 - RNA, 16 nt, Pseudomonas aeruginosa PA01
ccuacggaccggugcc

SEQ ID NO: 3382606 - RNA, 22 nt, Pseudomonas aeruginosa PA01
ccuacggaccggugccccgcug

SEQ ID NO: 3382607 - RNA, 15 nt, Pseudomonas aeruginosa PA01
ccuacggccccaggc

SEQ ID NO: 3382608 - RNA, 22 nt, Pseudomonas aeruginosa PA01
ccuacgguacaguucaggcugg

SEQ ID NO: 3382609 - RNA, 22 nt, Pseudomonas aeruginosa PA01
ccuacuccaggggucggcaucg

SEQ ID NO: 3382610 - RNA, 13 nt, Pseudomonas aeruginosa PA01
ccuacugggcgug

SEQ ID NO: 3382611 - RNA, 18 nt, Pseudomonas aeruginosa PA01
ccuacuugaucagccgca

SEQ ID NO: 3382612 - RNA, 15 nt, Pseudomonas aeruginosa PA01
ccuagcacccgggua

SEQ ID NO: 3382613 - RNA, 21 nt, Pseudomonas aeruginosa PA01
ccuagcacccggguauagaaa

SEQ ID NO: 3382614 - RNA, 15 nt, Pseudomonas aeruginosa PA01
ccuaggcgacccggc

SEQ ID NO: 3382615 - RNA, 14 nt, Pseudomonas aeruginosa PA01
ccuaggggacgcca

SEQ ID NO: 3382616 - RNA, 18 nt, Pseudomonas aeruginosa PA01
ccuauccgugacgucggc

SEQ ID NO: 3382617 - RNA, 15 nt, Pseudomonas aeruginosa PA01
ccucaacgaccgccc

SEQ ID NO: 3382618 - RNA, 19 nt, Pseudomonas aeruginosa PA01
ccucaacgaccgcccaggc

SEQ ID NO: 3382619 - RNA, 21 nt, Pseudomonas aeruginosa PA01
ccucaacgaccgcccaggcug

SEQ ID NO: 3382620 - RNA, 17 nt, Pseudomonas aeruginosa PA01
ccucaagucuccagcga

SEQ ID NO: 3382621 - RNA, 23 nt, Pseudomonas aeruginosa PA01
ccucaccccacgggcgacccagg

SEQ ID NO: 3382622 - RNA, 15 nt, Pseudomonas aeruginosa PA01
ccucacccugcuggg

SEQ ID NO: 3382623 - RNA, 17 nt, Pseudomonas aeruginosa PA01
ccucacccugcugggcg

SEQ ID NO: 3382624 - RNA, 17 nt, Pseudomonas aeruginosa PA01
ccucacggcgcagccgc

SEQ ID NO: 3382625 - RNA, 18 nt, Pseudomonas aeruginosa PA01
ccucacggcgcagccgca

SEQ ID NO: 3382626 - RNA, 20 nt, Pseudomonas aeruginosa PA01
ccucacggcgcagccgcaag

SEQ ID NO: 3382627 - RNA, 22 nt, Pseudomonas aeruginosa PA01
ccucacggguguuucggccgcu

SEQ ID NO: 3382628 - RNA, 23 nt, Pseudomonas aeruginosa PA01
ccucacggguguuucggccgcug

SEQ ID NO: 3382629 - RNA, 16 nt, Pseudomonas aeruginosa PA01
ccucacggucgcaggg

SEQ ID NO: 3382630 - RNA, 22 nt, Pseudomonas aeruginosa PA01
ccucagaaguauuucaaccagg

SEQ ID NO: 3382631 - RNA, 17 nt, Pseudomonas aeruginosa PA01
ccucagaccacgcccug

SEQ ID NO: 3382632 - RNA, 10 nt, Pseudomonas aeruginosa PA01
ccucagaggc

SEQ ID NO: 3382633 - RNA, 20 nt, Pseudomonas aeruginosa PA01
ccucagaggcgaccagccgg

SEQ ID NO: 3382634 - RNA, 16 nt, Pseudomonas aeruginosa PA01
ccucagcagcgccgcc

SEQ ID NO: 3382635 - RNA, 23 nt, Pseudomonas aeruginosa PA01
ccucagccucacccugcugggcg

SEQ ID NO: 3382636 - RNA, 15 nt, Pseudomonas aeruginosa PA01
ccucagcgacauccc

SEQ ID NO: 3382637 - RNA, 21 nt, Pseudomonas aeruginosa PA01
ccucagcgccgguagcggcgc

SEQ ID NO: 3382638 - RNA, 17 nt, Pseudomonas aeruginosa PA01
ccucagcggccuucgac

SEQ ID NO: 3382639 - RNA, 15 nt, Pseudomonas aeruginosa PA01
ccucagcggcuggcg

SEQ ID NO: 3382640 - RNA, 13 nt, Pseudomonas aeruginosa PA01
ccucagcucuguc

SEQ ID NO: 3382641 - RNA, 17 nt, Pseudomonas aeruginosa PA01
ccucaggauagccggcg

SEQ ID NO: 3382642 - RNA, 16 nt, Pseudomonas aeruginosa PA01
ccucaggccuggcgca

SEQ ID NO: 3382643 - RNA, 18 nt, Pseudomonas aeruginosa PA01
ccuccggacgccgaacgc

SEQ ID NO: 3382644 - RNA, 20 nt, Pseudomonas aeruginosa PA01
ccuccggaugcagauccagc

SEQ ID NO: 3382645 - RNA, 20 nt, Pseudomonas aeruginosa PA01
ccuccggcacgcugccgccg

SEQ ID NO: 3382646 - RNA, 21 nt, Pseudomonas aeruginosa PA01
ccuccggcacgcugccgccga

SEQ ID NO: 3382647 - RNA, 12 nt, Pseudomonas aeruginosa PA01
ccuccggcagcg

SEQ ID NO: 3382648 - RNA, 14 nt, Pseudomonas aeruginosa PA01
ccuccggcagcguc

SEQ ID NO: 3382649 - RNA, 13 nt, Pseudomonas aeruginosa PA01
ccuccggcgccag

SEQ ID NO: 3382650 - RNA, 14 nt, Pseudomonas aeruginosa PA01
ccuccggcgccagg

SEQ ID NO: 3382651 - RNA, 19 nt, Pseudomonas aeruginosa PA01
ccuccggcgccaggcccuc

SEQ ID NO: 3382652 - RNA, 12 nt, Pseudomonas aeruginosa PA01
ccuccucgccgc

SEQ ID NO: 3382653 - RNA, 14 nt, Pseudomonas aeruginosa PA01
ccuccucgccgccg

SEQ ID NO: 3382654 - RNA, 15 nt, Pseudomonas aeruginosa PA01
ccuccucgccgccga

SEQ ID NO: 3382655 - RNA, 17 nt, Pseudomonas aeruginosa PA01
ccuccucgccgcuccgc

SEQ ID NO: 3382656 - RNA, 14 nt, Pseudomonas aeruginosa PA01
ccuccucgcuccag

SEQ ID NO: 3382657 - RNA, 17 nt, Pseudomonas aeruginosa PA01
ccuccucgcuccagagg

SEQ ID NO: 3382658 - RNA, 15 nt, Pseudomonas aeruginosa PA01
ccuccucgcucugcg

SEQ ID NO: 3382659 - RNA, 18 nt, Pseudomonas aeruginosa PA01
ccuccucgcucugcgccg

SEQ ID NO: 3382660 - RNA, 14 nt, Pseudomonas aeruginosa PA01
ccuccucggcggcu

SEQ ID NO: 3382661 - RNA, 15 nt, Pseudomonas aeruginosa PA01
ccuccucggcggcuu

SEQ ID NO: 3382662 - RNA, 16 nt, Pseudomonas aeruginosa PA01
ccuccucggcggcuuc

SEQ ID NO: 3382663 - RNA, 20 nt, Pseudomonas aeruginosa PA01
ccuccucggcggcuuccucc

SEQ ID NO: 3382664 - RNA, 23 nt, Pseudomonas aeruginosa PA01
ccuccucggcggcuuccuccauc

SEQ ID NO: 3382665 - RNA, 21 nt, Pseudomonas aeruginosa PA01
ccuccucguaggcguccuggc

SEQ ID NO: 3382666 - RNA, 16 nt, Pseudomonas aeruginosa PA01
ccuccucuaccaggcg

SEQ ID NO: 3382667 - RNA, 18 nt, Pseudomonas aeruginosa PA01
ccuccugcaacgccuggu

SEQ ID NO: 3382668 - RNA, 17 nt, Pseudomonas aeruginosa PA01
ccuccuggaaagaccgg

SEQ ID NO: 3382669 - RNA, 21 nt, Pseudomonas aeruginosa PA01
ccuccuggaaagaccggcgcc

SEQ ID NO: 3382670 - RNA, 20 nt, Pseudomonas aeruginosa PA01
ccuccuggaggacgcgggcu

SEQ ID NO: 3382671 - RNA, 20 nt, Pseudomonas aeruginosa PA01
ccuccuggauacgcucggcc

SEQ ID NO: 3382672 - RNA, 15 nt, Pseudomonas aeruginosa PA01
ccuccuggcgcgucg

SEQ ID NO: 3382673 - RNA, 16 nt, Pseudomonas aeruginosa PA01
ccuccuggcggcgugg

SEQ ID NO: 3382674 - RNA, 19 nt, Pseudomonas aeruginosa PA01
ccuccugggccgacgcuuc

SEQ ID NO: 3382675 - RNA, 21 nt, Pseudomonas aeruginosa PA01
ccuccugggccgacgcuuccu

SEQ ID NO: 3382676 - RNA, 22 nt, Pseudomonas aeruginosa PA01
ccuccugggccgacgcuuccuc

SEQ ID NO: 3382677 - RNA, 13 nt, Pseudomonas aeruginosa PA01
ccuccugggccug

SEQ ID NO: 3382678 - RNA, 17 nt, Pseudomonas aeruginosa PA01
ccuccugggccugucgg

SEQ ID NO: 3382679 - RNA, 17 nt, Pseudomonas aeruginosa PA01
ccuccuucgagccuggc

SEQ ID NO: 3382680 - RNA, 15 nt, Pseudomonas aeruginosa PA01
ccucgaaagccgccg

SEQ ID NO: 3382681 - RNA, 16 nt, Pseudomonas aeruginosa PA01
ccucgaaagccgccgc

SEQ ID NO: 3382682 - RNA, 20 nt, Pseudomonas aeruginosa PA01
ccucgaacagcuugccgcug

SEQ ID NO: 3382683 - RNA, 19 nt, Pseudomonas aeruginosa PA01
ccucgaacauggccaccga

SEQ ID NO: 3382684 - RNA, 18 nt, Pseudomonas aeruginosa PA01
ccucgaaccccuggcgcu

SEQ ID NO: 3382685 - RNA, 20 nt, Pseudomonas aeruginosa PA01
ccucgaaccccuggcgcucg

SEQ ID NO: 3382686 - RNA, 19 nt, Pseudomonas aeruginosa PA01
ccucgaagaaaaggcccgg

SEQ ID NO: 3382687 - RNA, 20 nt, Pseudomonas aeruginosa PA01
ccucgaagaaaaggcccggc

SEQ ID NO: 3382688 - RNA, 23 nt, Pseudomonas aeruginosa PA01
ccucgaagaaaaggcccggcguc

SEQ ID NO: 3382689 - RNA, 19 nt, Pseudomonas aeruginosa PA01
ccucgaagaacuccaucuc

SEQ ID NO: 3382690 - RNA, 18 nt, Pseudomonas aeruginosa PA01
ccucgaagcccagcgccu

SEQ ID NO: 3382691 - RNA, 19 nt, Pseudomonas aeruginosa PA01
ccucgaagcccagcgccug

SEQ ID NO: 3382692 - RNA, 22 nt, Pseudomonas aeruginosa PA01
ccucgaagcggaucucgucgcc

SEQ ID NO: 3382693 - RNA, 13 nt, Pseudomonas aeruginosa PA01
ccucgaagcuggc

SEQ ID NO: 3382694 - RNA, 16 nt, Pseudomonas aeruginosa PA01
ccucgaaggccggcaa

SEQ ID NO: 3382695 - RNA, 20 nt, Pseudomonas aeruginosa PA01
ccucgaaggucagcccgugu

SEQ ID NO: 3382696 - RNA, 12 nt, Pseudomonas aeruginosa PA01
ccucgaccagcg

SEQ ID NO: 3382697 - RNA, 18 nt, Pseudomonas aeruginosa PA01
ccucgaccagcgccgcgg

SEQ ID NO: 3382698 - RNA, 19 nt, Pseudomonas aeruginosa PA01
ccucgaccagcgccgcggc

SEQ ID NO: 3382699 - RNA, 23 nt, Pseudomonas aeruginosa PA01
ccucgaccagcgccgcggcgacc

SEQ ID NO: 3382700 - RNA, 19 nt, Pseudomonas aeruginosa PA01
ccucgaccagguccggcag

SEQ ID NO: 3382701 - RNA, 23 nt, Pseudomonas aeruginosa PA01
ccucgaccagguccggcagcgcc

SEQ ID NO: 3382702 - RNA, 15 nt, Pseudomonas aeruginosa PA01
ccucgaccaucggcg

SEQ ID NO: 3382703 - RNA, 21 nt, Pseudomonas aeruginosa PA01
ccucgacccuggcgccgaccu

SEQ ID NO: 3382704 - RNA, 15 nt, Pseudomonas aeruginosa PA01
ccucgaccgcgccgg

SEQ ID NO: 3382705 - RNA, 17 nt, Pseudomonas aeruginosa PA01
ccucgaccgcgccggcg

SEQ ID NO: 3382706 - RNA, 18 nt, Pseudomonas aeruginosa PA01
ccucgaccuggccacgcc

SEQ ID NO: 3382707 - RNA, 20 nt, Pseudomonas aeruginosa PA01
ccucgaccuggccacgcccg

SEQ ID NO: 3382708 - RNA, 21 nt, Pseudomonas aeruginosa PA01
ccucgaccuggccacgcccgg

SEQ ID NO: 3382709 - RNA, 12 nt, Pseudomonas aeruginosa PA01
ccucgaccuggu

SEQ ID NO: 3382710 - RNA, 22 nt, Pseudomonas aeruginosa PA01
ccucgacgagguugcucugggc

SEQ ID NO: 3382711 - RNA, 13 nt, Pseudomonas aeruginosa PA01
ccucgacgcccgc

SEQ ID NO: 3382712 - RNA, 22 nt, Pseudomonas aeruginosa PA01
ccucgacgcccgcuugcgccgc

SEQ ID NO: 3382713 - RNA, 14 nt, Pseudomonas aeruginosa PA01
ccucgacgccgagc

SEQ ID NO: 3382714 - RNA, 18 nt, Pseudomonas aeruginosa PA01
ccucgacggcgaucucag

SEQ ID NO: 3382715 - RNA, 13 nt, Pseudomonas aeruginosa PA01
ccucgacggcggg

SEQ ID NO: 3382716 - RNA, 21 nt, Pseudomonas aeruginosa PA01
ccucgacggcgggagcggccu

SEQ ID NO: 3382717 - RNA, 13 nt, Pseudomonas aeruginosa PA01
ccucgagcaccgc

SEQ ID NO: 3382718 - RNA, 15 nt, Pseudomonas aeruginosa PA01
ccucgagcaccgcgg

SEQ ID NO: 3382719 - RNA, 16 nt, Pseudomonas aeruginosa PA01
ccucgagcaggccgag

SEQ ID NO: 3382720 - RNA, 17 nt, Pseudomonas aeruginosa PA01
ccucgagcaggccgagg

SEQ ID NO: 3382721 - RNA, 22 nt, Pseudomonas aeruginosa PA01
ccucgaggaucuugcgcccggc

SEQ ID NO: 3382722 - RNA, 16 nt, Pseudomonas aeruginosa PA01
ccucgaggucggccug

SEQ ID NO: 3382723 - RNA, 20 nt, Pseudomonas aeruginosa PA01
ccucgaggucggccuggcug

SEQ ID NO: 3382724 - RNA, 16 nt, Pseudomonas aeruginosa PA01
ccucgaucacccgcga

SEQ ID NO: 3382725 - RNA, 16 nt, Pseudomonas aeruginosa PA01
ccucgaucaucugcgg

SEQ ID NO: 3382726 - RNA, 17 nt, Pseudomonas aeruginosa PA01
ccucgauccgcuccagc

SEQ ID NO: 3382727 - RNA, 13 nt, Pseudomonas aeruginosa PA01
ccucgauccgcug

SEQ ID NO: 3382728 - RNA, 18 nt, Pseudomonas aeruginosa PA01
ccucgauccgcugggccu

SEQ ID NO: 3382729 - RNA, 17 nt, Pseudomonas aeruginosa PA01
ccucgaugaaacgcagg

SEQ ID NO: 3382730 - RNA, 23 nt, Pseudomonas aeruginosa PA01
ccucgaugaacagugcgcccgug

SEQ ID NO: 3382731 - RNA, 20 nt, Pseudomonas aeruginosa PA01
ccucgaugaaugcgcagguc

SEQ ID NO: 3382732 - RNA, 15 nt, Pseudomonas aeruginosa PA01
ccucgaugaauggcu

SEQ ID NO: 3382733 - RNA, 20 nt, Pseudomonas aeruginosa PA01
ccucgaugagcaugccgcag

SEQ ID NO: 3382734 - RNA, 17 nt, Pseudomonas aeruginosa PA01
ccucgaugauccgcucg

SEQ ID NO: 3382735 - RNA, 23 nt, Pseudomonas aeruginosa PA01
ccucgaugauccgcucgaucccg

SEQ ID NO: 3382736 - RNA, 13 nt, Pseudomonas aeruginosa PA01
ccucgaugaucgc

SEQ ID NO: 3382737 - RNA, 16 nt, Pseudomonas aeruginosa PA01
ccucgaugaucgccgg

SEQ ID NO: 3382738 - RNA, 13 nt, Pseudomonas aeruginosa PA01
ccucgaugcccgc

SEQ ID NO: 3382739 - RNA, 16 nt, Pseudomonas aeruginosa PA01
ccucgaugcccgccuc

SEQ ID NO: 3382740 - RNA, 23 nt, Pseudomonas aeruginosa PA01
ccucgaugcccgccucgcgcaac

SEQ ID NO: 3382741 - RNA, 17 nt, Pseudomonas aeruginosa PA01
ccucgcaaaggucggcg

SEQ ID NO: 3382742 - RNA, 22 nt, Pseudomonas aeruginosa PA01
ccucgcaaaggucggcgaaggc

SEQ ID NO: 3382743 - RNA, 22 nt, Pseudomonas aeruginosa PA01
ccucgcaauugaucauccagga

SEQ ID NO: 3382744 - RNA, 20 nt, Pseudomonas aeruginosa PA01
ccucgcagagcgccagccag

SEQ ID NO: 3382745 - RNA, 12 nt, Pseudomonas aeruginosa PA01
ccucggcgacca

SEQ ID NO: 3382746 - RNA, 16 nt, Pseudomonas aeruginosa PA01
ccucggcgaccaccgc

SEQ ID NO: 3382747 - RNA, 18 nt, Pseudomonas aeruginosa PA01
ccucggcgaccaccgcga

SEQ ID NO: 3382748 - RNA, 19 nt, Pseudomonas aeruginosa PA01
ccucggcgaucacccggcg

SEQ ID NO: 3382749 - RNA, 23 nt, Pseudomonas aeruginosa PA01
ccucggcgaucacccggcgaagc

SEQ ID NO: 3382750 - RNA, 19 nt, Pseudomonas aeruginosa PA01
ccucggcgaucgccaggug

SEQ ID NO: 3382751 - RNA, 12 nt, Pseudomonas aeruginosa PA01
ccucggcgcagu

SEQ ID NO: 3382752 - RNA, 21 nt, Pseudomonas aeruginosa PA01
ccucggcgccauaggccagca

SEQ ID NO: 3382753 - RNA, 19 nt, Pseudomonas aeruginosa PA01
ccucggcgcccgccugcag

SEQ ID NO: 3382754 - RNA, 14 nt, Pseudomonas aeruginosa PA01
ccucggcgccgagc

SEQ ID NO: 3382755 - RNA, 19 nt, Pseudomonas aeruginosa PA01
ccucggcgccgucgaucag

SEQ ID NO: 3382756 - RNA, 16 nt, Pseudomonas aeruginosa PA01
ccucggcgcgauccuc

SEQ ID NO: 3382757 - RNA, 19 nt, Pseudomonas aeruginosa PA01
ccucggcgcgauccuccgc

SEQ ID NO: 3382758 - RNA, 22 nt, Pseudomonas aeruginosa PA01
ccucggcgcgcgcccccuggcc

SEQ ID NO: 3382759 - RNA, 18 nt, Pseudomonas aeruginosa PA01
ccucggcggacagcccgc

SEQ ID NO: 3382760 - RNA, 21 nt, Pseudomonas aeruginosa PA01
ccucggcggacagcccgcgcu

SEQ ID NO: 3382761 - RNA, 23 nt, Pseudomonas aeruginosa PA01
ccucggcggacagcccgcgcucg

SEQ ID NO: 3382762 - RNA, 20 nt, Pseudomonas aeruginosa PA01
ccucggcggccuuuucggcg

SEQ ID NO: 3382763 - RNA, 11 nt, Pseudomonas aeruginosa PA01
ccucggcggcg

SEQ ID NO: 3382764 - RNA, 23 nt, Pseudomonas aeruginosa PA01
ccucggcggcgagcgggucgaug

SEQ ID NO: 3382765 - RNA, 12 nt, Pseudomonas aeruginosa PA01
ccucggcggcgg

SEQ ID NO: 3382766 - RNA, 15 nt, Pseudomonas aeruginosa PA01
ccucggcggcggccu

SEQ ID NO: 3382767 - RNA, 16 nt, Pseudomonas aeruginosa PA01
ccucggcguagccggc

SEQ ID NO: 3382768 - RNA, 18 nt, Pseudomonas aeruginosa PA01
ccucggcguagccggcca

SEQ ID NO: 3382769 - RNA, 19 nt, Pseudomonas aeruginosa PA01
ccucggcguagccggccag

SEQ ID NO: 3382770 - RNA, 17 nt, Pseudomonas aeruginosa PA01
ccucggcgucgcgcagg

SEQ ID NO: 3382771 - RNA, 18 nt, Pseudomonas aeruginosa PA01
ccucggcgucgcgcaggc

SEQ ID NO: 3382772 - RNA, 14 nt, Pseudomonas aeruginosa PA01
ccucggcgucggca

SEQ ID NO: 3382773 - RNA, 15 nt, Pseudomonas aeruginosa PA01
ccucggcuucguccu

SEQ ID NO: 3382774 - RNA, 17 nt, Pseudomonas aeruginosa PA01
ccucgggcaccagcacg

SEQ ID NO: 3382775 - RNA, 21 nt, Pseudomonas aeruginosa PA01
ccucgggcaccagcacggugc

SEQ ID NO: 3382776 - RNA, 12 nt, Pseudomonas aeruginosa PA01
ccucgggcagcc

SEQ ID NO: 3382777 - RNA, 14 nt, Pseudomonas aeruginosa PA01
ccucgggcagcccc

SEQ ID NO: 3382778 - RNA, 13 nt, Pseudomonas aeruginosa PA01
ccucgggcagcuc

SEQ ID NO: 3382779 - RNA, 13 nt, Pseudomonas aeruginosa PA01
ccucgggccggag

SEQ ID NO: 3382780 - RNA, 19 nt, Pseudomonas aeruginosa PA01
ccucgggcgagcgcagacg

SEQ ID NO: 3382781 - RNA, 24 nt, Pseudomonas aeruginosa PA01
ccucgggcgagcgcagacgggugc

SEQ ID NO: 3382782 - RNA, 13 nt, Pseudomonas aeruginosa PA01
ccucgggcgccgu

SEQ ID NO: 3382783 - RNA, 21 nt, Pseudomonas aeruginosa PA01
ccucggggaagcgcggcucgg

SEQ ID NO: 3382784 - RNA, 14 nt, Pseudomonas aeruginosa PA01
ccucggggccgagg

SEQ ID NO: 3382785 - RNA, 22 nt, Pseudomonas aeruginosa PA01
ccucggggccgaggucgaccag

SEQ ID NO: 3382786 - RNA, 19 nt, Pseudomonas aeruginosa PA01
ccucggggccguccgccag

SEQ ID NO: 3382787 - RNA, 16 nt, Pseudomonas aeruginosa PA01
ccucgggggugcccau

SEQ ID NO: 3382788 - RNA, 18 nt, Pseudomonas aeruginosa PA01
ccucggguuuggcgcccg

SEQ ID NO: 3382789 - RNA, 19 nt, Pseudomonas aeruginosa PA01
ccucggguuuggcgcccgc

SEQ ID NO: 3382790 - RNA, 18 nt, Pseudomonas aeruginosa PA01
ccucgguagaccccggug

SEQ ID NO: 3382791 - RNA, 16 nt, Pseudomonas aeruginosa PA01
ccucgguagccggcca

SEQ ID NO: 3382792 - RNA, 13 nt, Pseudomonas aeruginosa PA01
ccucggucaggua

SEQ ID NO: 3382793 - RNA, 21 nt, Pseudomonas aeruginosa PA01
ccucggucagguauucgccgg

SEQ ID NO: 3382794 - RNA, 21 nt, Pseudomonas aeruginosa PA01
ccucggucuuuuucgcgugcu

SEQ ID NO: 3382795 - RNA, 13 nt, Pseudomonas aeruginosa PA01
ccucggugaggua

SEQ ID NO: 3382796 - RNA, 19 nt, Pseudomonas aeruginosa PA01
ccucggugauaccgccggc

SEQ ID NO: 3382797 - RNA, 18 nt, Pseudomonas aeruginosa PA01
ccucggugcggccgagga

SEQ ID NO: 3382798 - RNA, 19 nt, Pseudomonas aeruginosa PA01
ccucgguggcccacuccag

SEQ ID NO: 3382799 - RNA, 18 nt, Pseudomonas aeruginosa PA01
ccucgguuuccggccagg

SEQ ID NO: 3382800 - RNA, 21 nt, Pseudomonas aeruginosa PA01
ccucgguuuccggccaggcgc

SEQ ID NO: 3382801 - RNA, 20 nt, Pseudomonas aeruginosa PA01
ccucguaggccgacucgcga

SEQ ID NO: 3382802 - RNA, 20 nt, Pseudomonas aeruginosa PA01
ccucguauuccacgucgccg

SEQ ID NO: 3382803 - RNA, 23 nt, Pseudomonas aeruginosa PA01
ccucguauuccacgucgccgacc

SEQ ID NO: 3382804 - RNA, 19 nt, Pseudomonas aeruginosa PA01
ccucguccagcaggacguc

SEQ ID NO: 3382805 - RNA, 16 nt, Pseudomonas aeruginosa PA01
ccucguccgacagcag

SEQ ID NO: 3382806 - RNA, 19 nt, Pseudomonas aeruginosa PA01
ccucguccgacagcagguc

SEQ ID NO: 3382807 - RNA, 19 nt, Pseudomonas aeruginosa PA01
ccucgucgacgcucagcac

SEQ ID NO: 3382808 - RNA, 16 nt, Pseudomonas aeruginosa PA01
ccucgucgagcagcgc

SEQ ID NO: 3382809 - RNA, 17 nt, Pseudomonas aeruginosa PA01
ccucgucgagcagcgcg

SEQ ID NO: 3382810 - RNA, 21 nt, Pseudomonas aeruginosa PA01
ccucgucgagcagcgcgcggc

SEQ ID NO: 3382811 - RNA, 22 nt, Pseudomonas aeruginosa PA01
ccucgucgagcagcgcgcggcu

SEQ ID NO: 3382812 - RNA, 13 nt, Pseudomonas aeruginosa PA01
ccucgucgagcau

SEQ ID NO: 3382813 - RNA, 19 nt, Pseudomonas aeruginosa PA01
ccucgucgagcgcagcgac

SEQ ID NO: 3382814 - RNA, 19 nt, Pseudomonas aeruginosa PA01
ccucgucgauacgcaucug

SEQ ID NO: 3382815 - RNA, 13 nt, Pseudomonas aeruginosa PA01
ccucgucgauccg

SEQ ID NO: 3382816 - RNA, 14 nt, Pseudomonas aeruginosa PA01
ccucgucgauccgc

SEQ ID NO: 3382817 - RNA, 16 nt, Pseudomonas aeruginosa PA01
ccucgucgaucucgcc

SEQ ID NO: 3382818 - RNA, 15 nt, Pseudomonas aeruginosa PA01
ccucgucgcaccugu

SEQ ID NO: 3382819 - RNA, 19 nt, Pseudomonas aeruginosa PA01
ccucgucgcaccuguucca

SEQ ID NO: 3382820 - RNA, 20 nt, Pseudomonas aeruginosa PA01
ccucgucgcaccuguuccag

SEQ ID NO: 3382821 - RNA, 18 nt, Pseudomonas aeruginosa PA01
ccucgucgccaugcggca

SEQ ID NO: 3382822 - RNA, 22 nt, Pseudomonas aeruginosa PA01
ccucgucgccaugcggcaggcc

SEQ ID NO: 3382823 - RNA, 16 nt, Pseudomonas aeruginosa PA01
ccucgucgcgccaggc

SEQ ID NO: 3382824 - RNA, 18 nt, Pseudomonas aeruginosa PA01
ccucgucgcgccaggcga

SEQ ID NO: 3382825 - RNA, 19 nt, Pseudomonas aeruginosa PA01
ccucgucguucagcccacc

SEQ ID NO: 3382826 - RNA, 21 nt, Pseudomonas aeruginosa PA01
ccucgucguucagcccacccc

SEQ ID NO: 3382827 - RNA, 13 nt, Pseudomonas aeruginosa PA01
ccucgugcucggg

SEQ ID NO: 3382828 - RNA, 17 nt, Pseudomonas aeruginosa PA01
ccucguggaacagcgcg

SEQ ID NO: 3382829 - RNA, 18 nt, Pseudomonas aeruginosa PA01
ccucguggaacagcgcgu

SEQ ID NO: 3382830 - RNA, 19 nt, Pseudomonas aeruginosa PA01
ccucguggaacagcgcguc

SEQ ID NO: 3382831 - RNA, 13 nt, Pseudomonas aeruginosa PA01
ccucguggcgcga

SEQ ID NO: 3382832 - RNA, 15 nt, Pseudomonas aeruginosa PA01
ccucguggcgcgccg

SEQ ID NO: 3382833 - RNA, 18 nt, Pseudomonas aeruginosa PA01
ccucguggcgcgccgcua

SEQ ID NO: 3382834 - RNA, 23 nt, Pseudomonas aeruginosa PA01
ccucguggggccagaagcgcucg

SEQ ID NO: 3382835 - RNA, 15 nt, Pseudomonas aeruginosa PA01
ccucgugggugccgg

SEQ ID NO: 3382836 - RNA, 19 nt, Pseudomonas aeruginosa PA01
ccucgugggugccgggggc

SEQ ID NO: 3382837 - RNA, 23 nt, Pseudomonas aeruginosa PA01
ccucguucagcagcaugccgcuc

SEQ ID NO: 3382838 - RNA, 18 nt, Pseudomonas aeruginosa PA01
ccucguuccacgggucgc

SEQ ID NO: 3382839 - RNA, 18 nt, Pseudomonas aeruginosa PA01
ccucguucgucgccgacu

SEQ ID NO: 3382840 - RNA, 22 nt, Pseudomonas aeruginosa PA01
ccucuaccaggcgguuggcccg

SEQ ID NO: 3382841 - RNA, 21 nt, Pseudomonas aeruginosa PA01
ccucuaugaaccggggcggcc

SEQ ID NO: 3382842 - RNA, 14 nt, Pseudomonas aeruginosa PA01
ccucucaacacccc

SEQ ID NO: 3382843 - RNA, 18 nt, Pseudomonas aeruginosa PA01
ccucucaggagcgccgcg

SEQ ID NO: 3382844 - RNA, 20 nt, Pseudomonas aeruginosa PA01
ccucucaggagcgccgcgca

SEQ ID NO: 3382845 - RNA, 15 nt, Pseudomonas aeruginosa PA01
ccucuccccagaccc

SEQ ID NO: 3382846 - RNA, 22 nt, Pseudomonas aeruginosa PA01
ccucuccccagacccucucccu

SEQ ID NO: 3382847 - RNA, 15 nt, Pseudomonas aeruginosa PA01
ccucuccccucgccc

SEQ ID NO: 3382848 - RNA, 17 nt, Pseudomonas aeruginosa PA01
ccucuccgagacgcugc

SEQ ID NO: 3382849 - RNA, 17 nt, Pseudomonas aeruginosa PA01
ccucucucgccucggcg

SEQ ID NO: 3382850 - RNA, 23 nt, Pseudomonas aeruginosa PA01
ccucugaccgcgcccggaaaaaa

SEQ ID NO: 3382851 - RNA, 17 nt, Pseudomonas aeruginosa PA01
ccucugcgcugagcagg

SEQ ID NO: 3382852 - RNA, 22 nt, Pseudomonas aeruginosa PA01
ccucuggcugaagacccugcac

SEQ ID NO: 3382853 - RNA, 15 nt, Pseudomonas aeruginosa PA01
ccucuuccgcgcuga

SEQ ID NO: 3382854 - RNA, 22 nt, Pseudomonas aeruginosa PA01
ccucuuccuggaccuccgccag

SEQ ID NO: 3382855 - RNA, 18 nt, Pseudomonas aeruginosa PA01
ccucuucgccauccuuga

SEQ ID NO: 3382856 - RNA, 20 nt, Pseudomonas aeruginosa PA01
ccucuucguggacggacagg

SEQ ID NO: 3382857 - RNA, 23 nt, Pseudomonas aeruginosa PA01
ccucuucguggacggacagggaa

SEQ ID NO: 3382858 - RNA, 20 nt, Pseudomonas aeruginosa PA01
ccucuugaaaacugucggcg

SEQ ID NO: 3382859 - RNA, 22 nt, Pseudomonas aeruginosa PA01
ccucuugaaaacugucggcgga

SEQ ID NO: 3382860 - RNA, 18 nt, Pseudomonas aeruginosa PA01
ccugaacgcgcccggcca

SEQ ID NO: 3382861 - RNA, 22 nt, Pseudomonas aeruginosa PA01
ccugaacgcgcccggccaggcc

SEQ ID NO: 3382862 - RNA, 17 nt, Pseudomonas aeruginosa PA01
ccugaaggaccagcuug

SEQ ID NO: 3382863 - RNA, 16 nt, Pseudomonas aeruginosa PA01
ccugaaggcgcggggc

SEQ ID NO: 3382864 - RNA, 16 nt, Pseudomonas aeruginosa PA01
ccugaccccggccugg

SEQ ID NO: 3382865 - RNA, 19 nt, Pseudomonas aeruginosa PA01
ccugaccccggccuggcug

SEQ ID NO: 3382866 - RNA, 13 nt, Pseudomonas aeruginosa PA01
ccugaccgcgagc

SEQ ID NO: 3382867 - RNA, 18 nt, Pseudomonas aeruginosa PA01
ccugaccgcgagcgccgc

SEQ ID NO: 3382868 - RNA, 19 nt, Pseudomonas aeruginosa PA01
ccugaccgcgagcgccgcc

SEQ ID NO: 3382869 - RNA, 19 nt, Pseudomonas aeruginosa PA01
ccugaccguccuggcccug

SEQ ID NO: 3382870 - RNA, 20 nt, Pseudomonas aeruginosa PA01
ccugaccguccuggcccugc

SEQ ID NO: 3382871 - RNA, 16 nt, Pseudomonas aeruginosa PA01
ccugacgaugcagggc

SEQ ID NO: 3382872 - RNA, 20 nt, Pseudomonas aeruginosa PA01
ccugacgcaagcgcucggcc

SEQ ID NO: 3382873 - RNA, 23 nt, Pseudomonas aeruginosa PA01
ccugacgcaagcgcucggccugc

SEQ ID NO: 3382874 - RNA, 17 nt, Pseudomonas aeruginosa PA01
ccugacguugccgcgcg

SEQ ID NO: 3382875 - RNA, 20 nt, Pseudomonas aeruginosa PA01
ccugagaucagcgcccggca

SEQ ID NO: 3382876 - RNA, 12 nt, Pseudomonas aeruginosa PA01
ccugagcagggu

SEQ ID NO: 3382877 - RNA, 19 nt, Pseudomonas aeruginosa PA01
ccugagcgacguggcaggg

SEQ ID NO: 3382878 - RNA, 14 nt, Pseudomonas aeruginosa PA01
ccugaggcucccag

SEQ ID NO: 3382879 - RNA, 15 nt, Pseudomonas aeruginosa PA01
ccugaggcucccagg

SEQ ID NO: 3382880 - RNA, 18 nt, Pseudomonas aeruginosa PA01
ccugaggcucccaggugg

SEQ ID NO: 3382881 - RNA, 15 nt, Pseudomonas aeruginosa PA01
ccugaucaucugggc

SEQ ID NO: 3382882 - RNA, 17 nt, Pseudomonas aeruginosa PA01
ccugaucaucugggcca

SEQ ID NO: 3382883 - RNA, 23 nt, Pseudomonas aeruginosa PA01
ccugcaaagaggcgcucaacgcc

SEQ ID NO: 3382884 - RNA, 16 nt, Pseudomonas aeruginosa PA01
ccugcaaagcggcgac

SEQ ID NO: 3382885 - RNA, 18 nt, Pseudomonas aeruginosa PA01
ccugcaacacccaggccu

SEQ ID NO: 3382886 - RNA, 21 nt, Pseudomonas aeruginosa PA01
ccugcaacacccaggccuggg

SEQ ID NO: 3382887 - RNA, 22 nt, Pseudomonas aeruginosa PA01
ccugcaacacccaggccugggu

SEQ ID NO: 3382888 - RNA, 17 nt, Pseudomonas aeruginosa PA01
ccugcaacacguagcgc

SEQ ID NO: 3382889 - RNA, 18 nt, Pseudomonas aeruginosa PA01
ccugcaacacgucggacu

SEQ ID NO: 3382890 - RNA, 15 nt, Pseudomonas aeruginosa PA01
ccugcaacaggaccc

SEQ ID NO: 3382891 - RNA, 15 nt, Pseudomonas aeruginosa PA01
ccugcaacagggcau

SEQ ID NO: 3382892 - RNA, 21 nt, Pseudomonas aeruginosa PA01
ccugcaacaguggguaggcca

SEQ ID NO: 3382893 - RNA, 22 nt, Pseudomonas aeruginosa PA01
ccugcaacaguggguaggccag

SEQ ID NO: 3382894 - RNA, 13 nt, Pseudomonas aeruginosa PA01
ccugcaacgccag

SEQ ID NO: 3382895 - RNA, 14 nt, Pseudomonas aeruginosa PA01
ccugcaacgccagc

SEQ ID NO: 3382896 - RNA, 16 nt, Pseudomonas aeruginosa PA01
ccugcaacgccagcag

SEQ ID NO: 3382897 - RNA, 23 nt, Pseudomonas aeruginosa PA01
ccugcaacgccagcaggcgcagg

SEQ ID NO: 3382898 - RNA, 14 nt, Pseudomonas aeruginosa PA01
ccugcaacgcccgc

SEQ ID NO: 3382899 - RNA, 16 nt, Pseudomonas aeruginosa PA01
ccugcaacgcccgcga

SEQ ID NO: 3382900 - RNA, 13 nt, Pseudomonas aeruginosa PA01
ccugcaacgccgc

SEQ ID NO: 3382901 - RNA, 20 nt, Pseudomonas aeruginosa PA01
ccugcaacgccgccaacugg

SEQ ID NO: 3382902 - RNA, 15 nt, Pseudomonas aeruginosa PA01
ccugcaacucgaaaa

SEQ ID NO: 3382903 - RNA, 15 nt, Pseudomonas aeruginosa PA01
ccugcaacucggcgc

SEQ ID NO: 3382904 - RNA, 16 nt, Pseudomonas aeruginosa PA01
ccugcaacucggcgcc

SEQ ID NO: 3382905 - RNA, 18 nt, Pseudomonas aeruginosa PA01
ccugcaacucgucgucca

SEQ ID NO: 3382906 - RNA, 22 nt, Pseudomonas aeruginosa PA01
ccugcaaggcggugaccagcgg

SEQ ID NO: 3382907 - RNA, 22 nt, Pseudomonas aeruginosa PA01
ccugcaauggggcggccggcgc

SEQ ID NO: 3382908 - RNA, 19 nt, Pseudomonas aeruginosa PA01
ccugcaauuccaccggcug

SEQ ID NO: 3382909 - RNA, 20 nt, Pseudomonas aeruginosa PA01
ccugcacaucaccuucgccc

SEQ ID NO: 3382910 - RNA, 17 nt, Pseudomonas aeruginosa PA01
ccugcaccacgucggaa

SEQ ID NO: 3382911 - RNA, 19 nt, Pseudomonas aeruginosa PA01
ccugcaccagccaguccgg

SEQ ID NO: 3382912 - RNA, 15 nt, Pseudomonas aeruginosa PA01
ccugcacccuuggcg

SEQ ID NO: 3382913 - RNA, 23 nt, Pseudomonas aeruginosa PA01
ccugcaccgggccgaccugcccg

SEQ ID NO: 3382914 - RNA, 16 nt, Pseudomonas aeruginosa PA01
ccugcaccugcucggg

SEQ ID NO: 3382915 - RNA, 23 nt, Pseudomonas aeruginosa PA01
ccugcacgcugcgccggcgcugc

SEQ ID NO: 3382916 - RNA, 22 nt, Pseudomonas aeruginosa PA01
ccugcagacgguucagcagcgg

SEQ ID NO: 3382917 - RNA, 18 nt, Pseudomonas aeruginosa PA01
ccugcagauaaagcugga

SEQ ID NO: 3382918 - RNA, 19 nt, Pseudomonas aeruginosa PA01
ccugcagauaaagcuggac

SEQ ID NO: 3382919 - RNA, 19 nt, Pseudomonas aeruginosa PA01
ccugcagcaccaccucgcc

SEQ ID NO: 3382920 - RNA, 24 nt, Pseudomonas aeruginosa PA01
ccugcagcaccaccucgccaagcu

SEQ ID NO: 3382921 - RNA, 17 nt, Pseudomonas aeruginosa PA01
ccugcagcaggucgagc

SEQ ID NO: 3382922 - RNA, 21 nt, Pseudomonas aeruginosa PA01
ccugcagcaggucgagcaguu

SEQ ID NO: 3382923 - RNA, 16 nt, Pseudomonas aeruginosa PA01
ccugcagccagcuuca

SEQ ID NO: 3382924 - RNA, 12 nt, Pseudomonas aeruginosa PA01
ccugcagcgccu

SEQ ID NO: 3382925 - RNA, 17 nt, Pseudomonas aeruginosa PA01
ccugcagcgcgcgcugg

SEQ ID NO: 3382926 - RNA, 20 nt, Pseudomonas aeruginosa PA01
ccugcaggaaggcuuccggc

SEQ ID NO: 3382927 - RNA, 22 nt, Pseudomonas aeruginosa PA01
ccugcaggccgaauccgccggc

SEQ ID NO: 3382928 - RNA, 23 nt, Pseudomonas aeruginosa PA01
ccugcaggccgaauccgccggcg

SEQ ID NO: 3382929 - RNA, 20 nt, Pseudomonas aeruginosa PA01
ccugcaggcucagcaccuug

SEQ ID NO: 3382930 - RNA, 22 nt, Pseudomonas aeruginosa PA01
ccugcagguagcgcugcgcccg

SEQ ID NO: 3382931 - RNA, 15 nt, Pseudomonas aeruginosa PA01
ccugcaucaccaggc

SEQ ID NO: 3382932 - RNA, 17 nt, Pseudomonas aeruginosa PA01
ccugcaucaccaggcug

SEQ ID NO: 3382933 - RNA, 19 nt, Pseudomonas aeruginosa PA01
ccugcaucacguacggcgc

SEQ ID NO: 3382934 - RNA, 13 nt, Pseudomonas aeruginosa PA01
ccugcaucgcgac

SEQ ID NO: 3382935 - RNA, 16 nt, Pseudomonas aeruginosa PA01
ccugcaucucuuccuc

SEQ ID NO: 3382936 - RNA, 11 nt, Pseudomonas aeruginosa PA01
ccugcaugccg

SEQ ID NO: 3382937 - RNA, 15 nt, Pseudomonas aeruginosa PA01
ccugccagaccgaga

SEQ ID NO: 3382938 - RNA, 18 nt, Pseudomonas aeruginosa PA01
ccugccagaccguggcgc

SEQ ID NO: 3382939 - RNA, 13 nt, Pseudomonas aeruginosa PA01
ccugccagaggau

SEQ ID NO: 3382940 - RNA, 24 nt, Pseudomonas aeruginosa PA01
ccugccagcgcgucggcacgccga

SEQ ID NO: 3382941 - RNA, 13 nt, Pseudomonas aeruginosa PA01
ccugccagcgggc

SEQ ID NO: 3382942 - RNA, 14 nt, Pseudomonas aeruginosa PA01
ccugccagcgggcg

SEQ ID NO: 3382943 - RNA, 16 nt, Pseudomonas aeruginosa PA01
ccugccagcgggcgcc

SEQ ID NO: 3382944 - RNA, 12 nt, Pseudomonas aeruginosa PA01
ccugccaggcgg

SEQ ID NO: 3382945 - RNA, 23 nt, Pseudomonas aeruginosa PA01
ccugccaggggcuagucgcgcag

SEQ ID NO: 3382946 - RNA, 12 nt, Pseudomonas aeruginosa PA01
ccugccauccgg

SEQ ID NO: 3382947 - RNA, 22 nt, Pseudomonas aeruginosa PA01
ccugccaucgaugugagcccca

SEQ ID NO: 3382948 - RNA, 19 nt, Pseudomonas aeruginosa PA01
ccugcccagugggccaccg

SEQ ID NO: 3382949 - RNA, 14 nt, Pseudomonas aeruginosa PA01
ccugcucgauccag

SEQ ID NO: 3382950 - RNA, 17 nt, Pseudomonas aeruginosa PA01
ccugcucgauccagccg

SEQ ID NO: 3382951 - RNA, 20 nt, Pseudomonas aeruginosa PA01
ccugcucgauccagccggca

SEQ ID NO: 3382952 - RNA, 15 nt, Pseudomonas aeruginosa PA01
ccugcucgccgcuga

SEQ ID NO: 3382953 - RNA, 14 nt, Pseudomonas aeruginosa PA01
ccugcucgccggcg

SEQ ID NO: 3382954 - RNA, 15 nt, Pseudomonas aeruginosa PA01
ccugcucgccggcgc

SEQ ID NO: 3382955 - RNA, 17 nt, Pseudomonas aeruginosa PA01
ccugcucgcgcaccgcg

SEQ ID NO: 3382956 - RNA, 20 nt, Pseudomonas aeruginosa PA01
ccugcucgcgcaccgcggcc

SEQ ID NO: 3382957 - RNA, 21 nt, Pseudomonas aeruginosa PA01
ccugcucgcgcaccgcggcca

SEQ ID NO: 3382958 - RNA, 15 nt, Pseudomonas aeruginosa PA01
ccugcucgcgcagcc

SEQ ID NO: 3382959 - RNA, 14 nt, Pseudomonas aeruginosa PA01
ccugcucgcggcug

SEQ ID NO: 3382960 - RNA, 17 nt, Pseudomonas aeruginosa PA01
ccugcucgcggcuggcc

SEQ ID NO: 3382961 - RNA, 18 nt, Pseudomonas aeruginosa PA01
ccugcucgcggcuggccg

SEQ ID NO: 3382962 - RNA, 12 nt, Pseudomonas aeruginosa PA01
ccugcucgcggg

SEQ ID NO: 3382963 - RNA, 13 nt, Pseudomonas aeruginosa PA01
ccugcucgcgggu

SEQ ID NO: 3382964 - RNA, 15 nt, Pseudomonas aeruginosa PA01
ccugcucgcggguca

SEQ ID NO: 3382965 - RNA, 14 nt, Pseudomonas aeruginosa PA01
ccugcucggccugc

SEQ ID NO: 3382966 - RNA, 20 nt, Pseudomonas aeruginosa PA01
ccugcucggccugcugcgcc

SEQ ID NO: 3382967 - RNA, 19 nt, Pseudomonas aeruginosa PA01
ccugcucggcucgcgguuc

SEQ ID NO: 3382968 - RNA, 18 nt, Pseudomonas aeruginosa PA01
ccugcucuuccagcgggc

SEQ ID NO: 3382969 - RNA, 15 nt, Pseudomonas aeruginosa PA01
ccugcucuucggcgg

SEQ ID NO: 3382970 - RNA, 20 nt, Pseudomonas aeruginosa PA01
ccugcucuucggcggccagc

SEQ ID NO: 3382971 - RNA, 18 nt, Pseudomonas aeruginosa PA01
ccugcucuugccgacaag

SEQ ID NO: 3382972 - RNA, 19 nt, Pseudomonas aeruginosa PA01
ccugcugagcagucgccug

SEQ ID NO: 3382973 - RNA, 20 nt, Pseudomonas aeruginosa PA01
ccugcugagcagucgccugg

SEQ ID NO: 3382974 - RNA, 22 nt, Pseudomonas aeruginosa PA01
ccugcugagcagucgccuggcc

SEQ ID NO: 3382975 - RNA, 19 nt, Pseudomonas aeruginosa PA01
ccugcugcagggccucgcu

SEQ ID NO: 3382976 - RNA, 22 nt, Pseudomonas aeruginosa PA01
ccugcugcgacaguucgcggaa

SEQ ID NO: 3382977 - RNA, 17 nt, Pseudomonas aeruginosa PA01
ccugcugcgccggcacg

SEQ ID NO: 3382978 - RNA, 23 nt, Pseudomonas aeruginosa PA01
ccugcugcgccggcacggcaucg

SEQ ID NO: 3382979 - RNA, 22 nt, Pseudomonas aeruginosa PA01
ccugcugcgcgggugucgcgac

SEQ ID NO: 3382980 - RNA, 17 nt, Pseudomonas aeruginosa PA01
ccugcugcgggcgcugc

SEQ ID NO: 3382981 - RNA, 18 nt, Pseudomonas aeruginosa PA01
ccugcugcgggcgcugca

SEQ ID NO: 3382982 - RNA, 21 nt, Pseudomonas aeruginosa PA01
ccugcugcgggcgcugcaugg

SEQ ID NO: 3382983 - RNA, 17 nt, Pseudomonas aeruginosa PA01
ccugcugcucgaccgcc

SEQ ID NO: 3382984 - RNA, 15 nt, Pseudomonas aeruginosa PA01
ccugcugcugcucag

SEQ ID NO: 3382985 - RNA, 20 nt, Pseudomonas aeruginosa PA01
ccugcugcugcucagcgcgc

SEQ ID NO: 3382986 - RNA, 21 nt, Pseudomonas aeruginosa PA01
ccugcugcugcucagcgcgcu

SEQ ID NO: 3382987 - RNA, 13 nt, Pseudomonas aeruginosa PA01
ccugcuggccggu

SEQ ID NO: 3382988 - RNA, 22 nt, Pseudomonas aeruginosa PA01
ccugcuggccggugccgcccug

SEQ ID NO: 3382989 - RNA, 20 nt, Pseudomonas aeruginosa PA01
ccugcuggccugggacggcg

SEQ ID NO: 3382990 - RNA, 19 nt, Pseudomonas aeruginosa PA01
ccugcuggcgaauuuccug

SEQ ID NO: 3382991 - RNA, 13 nt, Pseudomonas aeruginosa PA01
ccugcuggcgagc

SEQ ID NO: 3382992 - RNA, 17 nt, Pseudomonas aeruginosa PA01
ccugcuggcgagcgucg

SEQ ID NO: 3382993 - RNA, 13 nt, Pseudomonas aeruginosa PA01
ccugcuggcgcag

SEQ ID NO: 3382994 - RNA, 18 nt, Pseudomonas aeruginosa PA01
ccugcuggcgcagccagg

SEQ ID NO: 3382995 - RNA, 19 nt, Pseudomonas aeruginosa PA01
ccugcuggcgcagccaggc

SEQ ID NO: 3382996 - RNA, 17 nt, Pseudomonas aeruginosa PA01
ccugcuggcugcccagu

SEQ ID NO: 3382997 - RNA, 17 nt, Pseudomonas aeruginosa PA01
ccugcugggccagcgcc

SEQ ID NO: 3382998 - RNA, 20 nt, Pseudomonas aeruginosa PA01
ccugcugggcgucgaacacc

SEQ ID NO: 3382999 - RNA, 12 nt, Pseudomonas aeruginosa PA01
ccugcugguuga

SEQ ID NO: 3383000 - RNA, 17 nt, Pseudomonas aeruginosa PA01
ccugcuguguccggcgg

SEQ ID NO: 3383001 - RNA, 16 nt, Pseudomonas aeruginosa PA01
ccugcuucagcccggc

SEQ ID NO: 3383002 - RNA, 20 nt, Pseudomonas aeruginosa PA01
ccugcuucagguagugcaac

SEQ ID NO: 3383003 - RNA, 21 nt, Pseudomonas aeruginosa PA01
ccugcuucagguagugcaaca

SEQ ID NO: 3383004 - RNA, 18 nt, Pseudomonas aeruginosa PA01
ccugcuucaggucgucgg

SEQ ID NO: 3383005 - RNA, 17 nt, Pseudomonas aeruginosa PA01
ccugcuuccagaccucg

SEQ ID NO: 3383006 - RNA, 21 nt, Pseudomonas aeruginosa PA01
ccugcuuccagaccucgagca

SEQ ID NO: 3383007 - RNA, 21 nt, Pseudomonas aeruginosa PA01
ccugcuucgaccagggcaucc

SEQ ID NO: 3383008 - RNA, 21 nt, Pseudomonas aeruginosa PA01
ccugcuucugguugcucacca

SEQ ID NO: 3383009 - RNA, 18 nt, Pseudomonas aeruginosa PA01
ccugcuuggccagcgcgg

SEQ ID NO: 3383010 - RNA, 14 nt, Pseudomonas aeruginosa PA01
ccugcuuggcggcg

SEQ ID NO: 3383011 - RNA, 21 nt, Pseudomonas aeruginosa PA01
ccugcuugggcgccucgccgc

SEQ ID NO: 3383012 - RNA, 17 nt, Pseudomonas aeruginosa PA01
ccugcuugucgaugguc

SEQ ID NO: 3383013 - RNA, 20 nt, Pseudomonas aeruginosa PA01
ccugcuugucgauggucagg

SEQ ID NO: 3383014 - RNA, 16 nt, Pseudomonas aeruginosa PA01
ccuggaaagaccggcg

SEQ ID NO: 3383015 - RNA, 17 nt, Pseudomonas aeruginosa PA01
ccuggaaagaccggcgc

SEQ ID NO: 3383016 - RNA, 19 nt, Pseudomonas aeruginosa PA01
ccuggaaagaccggcgccc

SEQ ID NO: 3383017 - RNA, 19 nt, Pseudomonas aeruginosa PA01
ccuggaaaggccucggcga

SEQ ID NO: 3383018 - RNA, 14 nt, Pseudomonas aeruginosa PA01
ccuggaacaccagg

SEQ ID NO: 3383019 - RNA, 12 nt, Pseudomonas aeruginosa PA01
ccuggaacagga

SEQ ID NO: 3383020 - RNA, 13 nt, Pseudomonas aeruginosa PA01
ccuggaaccgcuc

SEQ ID NO: 3383021 - RNA, 18 nt, Pseudomonas aeruginosa PA01
ccuggaacuagcccucga

SEQ ID NO: 3383022 - RNA, 21 nt, Pseudomonas aeruginosa PA01
ccuggaacuagcccucgaccu

SEQ ID NO: 3383023 - RNA, 19 nt, Pseudomonas aeruginosa PA01
ccuggaagaauggcguggc

SEQ ID NO: 3383024 - RNA, 21 nt, Pseudomonas aeruginosa PA01
ccuggaagaauggcguggcuu

SEQ ID NO: 3383025 - RNA, 13 nt, Pseudomonas aeruginosa PA01
ccuggaagccggc

SEQ ID NO: 3383026 - RNA, 20 nt, Pseudomonas aeruginosa PA01
ccuggaagcgaugggcgaga

SEQ ID NO: 3383027 - RNA, 13 nt, Pseudomonas aeruginosa PA01
ccuggaagcgggu

SEQ ID NO: 3383028 - RNA, 14 nt, Pseudomonas aeruginosa PA01
ccuggaaggcgcug

SEQ ID NO: 3383029 - RNA, 22 nt, Pseudomonas aeruginosa PA01
ccuggaaggcgcugggcggcug

SEQ ID NO: 3383030 - RNA, 17 nt, Pseudomonas aeruginosa PA01
ccuggaaguauucggcg

SEQ ID NO: 3383031 - RNA, 19 nt, Pseudomonas aeruginosa PA01
ccuggaaguauucggcggg

SEQ ID NO: 3383032 - RNA, 19 nt, Pseudomonas aeruginosa PA01
ccuggaauucaggcuuccu

SEQ ID NO: 3383033 - RNA, 18 nt, Pseudomonas aeruginosa PA01
ccuggaccccgcccuagc

SEQ ID NO: 3383034 - RNA, 15 nt, Pseudomonas aeruginosa PA01
ccuggacccgggccu

SEQ ID NO: 3383035 - RNA, 16 nt, Pseudomonas aeruginosa PA01
ccuggacccgggccuc

SEQ ID NO: 3383036 - RNA, 17 nt, Pseudomonas aeruginosa PA01
ccuggacccgggccucc

SEQ ID NO: 3383037 - RNA, 20 nt, Pseudomonas aeruginosa PA01
ccuggacccgggccuccugg

SEQ ID NO: 3383038 - RNA, 23 nt, Pseudomonas aeruginosa PA01
ccuggacccgggccuccuggcgg

SEQ ID NO: 3383039 - RNA, 21 nt, Pseudomonas aeruginosa PA01
ccuggacccguugccgaccga

SEQ ID NO: 3383040 - RNA, 12 nt, Pseudomonas aeruginosa PA01
ccuggaccuccg

SEQ ID NO: 3383041 - RNA, 19 nt, Pseudomonas aeruginosa PA01
ccuggacgugggaaaucac

SEQ ID NO: 3383042 - RNA, 19 nt, Pseudomonas aeruginosa PA01
ccuggagaaacucgcgggc

SEQ ID NO: 3383043 - RNA, 21 nt, Pseudomonas aeruginosa PA01
ccuggagaaacucgcgggcgc

SEQ ID NO: 3383044 - RNA, 19 nt, Pseudomonas aeruginosa PA01
ccuggagaaauccggcugg

SEQ ID NO: 3383045 - RNA, 14 nt, Pseudomonas aeruginosa PA01
ccuggagcagggcg

SEQ ID NO: 3383046 - RNA, 13 nt, Pseudomonas aeruginosa PA01
ccuggaggacgcg

SEQ ID NO: 3383047 - RNA, 17 nt, Pseudomonas aeruginosa PA01
ccuggaggcacgaaccg

SEQ ID NO: 3383048 - RNA, 17 nt, Pseudomonas aeruginosa PA01
ccuggagguagcugcgc

SEQ ID NO: 3383049 - RNA, 18 nt, Pseudomonas aeruginosa PA01
ccuggagguagcugcgcc

SEQ ID NO: 3383050 - RNA, 21 nt, Pseudomonas aeruginosa PA01
ccuggagguagcugcgccgcc

SEQ ID NO: 3383051 - RNA, 18 nt, Pseudomonas aeruginosa PA01
ccuggcgcgucaugccgc

SEQ ID NO: 3383052 - RNA, 20 nt, Pseudomonas aeruginosa PA01
ccuggcgcgucaugccgccg

SEQ ID NO: 3383053 - RNA, 17 nt, Pseudomonas aeruginosa PA01
ccuggcgcgucggccgc

SEQ ID NO: 3383054 - RNA, 19 nt, Pseudomonas aeruginosa PA01
ccuggcgcucagcgccgcu

SEQ ID NO: 3383055 - RNA, 24 nt, Pseudomonas aeruginosa PA01
ccuggcgcucagcgccgcuucuuc

SEQ ID NO: 3383056 - RNA, 21 nt, Pseudomonas aeruginosa PA01
ccuggcgcugaacaagcccug

SEQ ID NO: 3383057 - RNA, 22 nt, Pseudomonas aeruginosa PA01
ccuggcgcugggccuugagcag

SEQ ID NO: 3383058 - RNA, 18 nt, Pseudomonas aeruginosa PA01
ccuggcgcugucgcccgg

SEQ ID NO: 3383059 - RNA, 19 nt, Pseudomonas aeruginosa PA01
ccuggcgcuugggcgcgga

SEQ ID NO: 3383060 - RNA, 18 nt, Pseudomonas aeruginosa PA01
ccuggcggauaucgcgcc

SEQ ID NO: 3383061 - RNA, 21 nt, Pseudomonas aeruginosa PA01
ccuggcggauaucgcgccgcg

SEQ ID NO: 3383062 - RNA, 13 nt, Pseudomonas aeruginosa PA01
ccuggcggcgugg

SEQ ID NO: 3383063 - RNA, 15 nt, Pseudomonas aeruginosa PA01
ccuggcggcguggca

SEQ ID NO: 3383064 - RNA, 20 nt, Pseudomonas aeruginosa PA01
ccuggcggcguggcaccgcu

SEQ ID NO: 3383065 - RNA, 15 nt, Pseudomonas aeruginosa PA01
ccuggcggcugagcu

SEQ ID NO: 3383066 - RNA, 13 nt, Pseudomonas aeruginosa PA01
ccuggcggcuggc

SEQ ID NO: 3383067 - RNA, 17 nt, Pseudomonas aeruginosa PA01
ccuggcggcuggcgugg

SEQ ID NO: 3383068 - RNA, 17 nt, Pseudomonas aeruginosa PA01
ccuggcgguagcccggc

SEQ ID NO: 3383069 - RNA, 19 nt, Pseudomonas aeruginosa PA01
ccuggcgguagcccggcag

SEQ ID NO: 3383070 - RNA, 22 nt, Pseudomonas aeruginosa PA01
ccuggcgguagcccggcagcuc

SEQ ID NO: 3383071 - RNA, 21 nt, Pseudomonas aeruginosa PA01
ccuggcggucgccgccggcga

SEQ ID NO: 3383072 - RNA, 21 nt, Pseudomonas aeruginosa PA01
ccuggcgguugaugccgacgu

SEQ ID NO: 3383073 - RNA, 17 nt, Pseudomonas aeruginosa PA01
ccuggcgucgaugccga

SEQ ID NO: 3383074 - RNA, 16 nt, Pseudomonas aeruginosa PA01
ccuggcgucgcacugc

SEQ ID NO: 3383075 - RNA, 19 nt, Pseudomonas aeruginosa PA01
ccuggcgucgcacugcugc

SEQ ID NO: 3383076 - RNA, 21 nt, Pseudomonas aeruginosa PA01
ccuggcgucgcacugcugcuu

SEQ ID NO: 3383077 - RNA, 15 nt, Pseudomonas aeruginosa PA01
ccuggcguggccggc

SEQ ID NO: 3383078 - RNA, 16 nt, Pseudomonas aeruginosa PA01
ccuggcguggccggcg

SEQ ID NO: 3383079 - RNA, 16 nt, Pseudomonas aeruginosa PA01
ccuggcucaugucgug

SEQ ID NO: 3383080 - RNA, 19 nt, Pseudomonas aeruginosa PA01
ccuggcuccacugcuuggc

SEQ ID NO: 3383081 - RNA, 24 nt, Pseudomonas aeruginosa PA01
ccuggcuccacugcuuggccaggc

SEQ ID NO: 3383082 - RNA, 14 nt, Pseudomonas aeruginosa PA01
ccuggcucgaucgg

SEQ ID NO: 3383083 - RNA, 16 nt, Pseudomonas aeruginosa PA01
ccuggcucgaucggca

SEQ ID NO: 3383084 - RNA, 21 nt, Pseudomonas aeruginosa PA01
ccuggcucgaucggcagggcg

SEQ ID NO: 3383085 - RNA, 23 nt, Pseudomonas aeruginosa PA01
ccuggcucgaucggcagggcgcc

SEQ ID NO: 3383086 - RNA, 19 nt, Pseudomonas aeruginosa PA01
ccuggcucuguuccucggc

SEQ ID NO: 3383087 - RNA, 22 nt, Pseudomonas aeruginosa PA01
ccuggcucuguuccucggcggc

SEQ ID NO: 3383088 - RNA, 15 nt, Pseudomonas aeruginosa PA01
ccuggcucuugccgc

SEQ ID NO: 3383089 - RNA, 17 nt, Pseudomonas aeruginosa PA01
ccuggcucuugccgcga

SEQ ID NO: 3383090 - RNA, 19 nt, Pseudomonas aeruginosa PA01
ccuggcucuugccgcgagc

SEQ ID NO: 3383091 - RNA, 12 nt, Pseudomonas aeruginosa PA01
ccuggcuggcca

SEQ ID NO: 3383092 - RNA, 15 nt, Pseudomonas aeruginosa PA01
ccuggcuggccagca

SEQ ID NO: 3383093 - RNA, 19 nt, Pseudomonas aeruginosa PA01
ccuggcuuuccagggccug

SEQ ID NO: 3383094 - RNA, 20 nt, Pseudomonas aeruginosa PA01
ccuggcuuuccagggccugg

SEQ ID NO: 3383095 - RNA, 22 nt, Pseudomonas aeruginosa PA01
ccuggcuuuccagggccuggcg

SEQ ID NO: 3383096 - RNA, 22 nt, Pseudomonas aeruginosa PA01
ccugggaacccuugcgcaggua

SEQ ID NO: 3383097 - RNA, 18 nt, Pseudomonas aeruginosa PA01
ccugggaauugcgcacgc

SEQ ID NO: 3383098 - RNA, 22 nt, Pseudomonas aeruginosa PA01
ccugggacggaacgucggccug

SEQ ID NO: 3383099 - RNA, 13 nt, Pseudomonas aeruginosa PA01
ccugggagccgcc

SEQ ID NO: 3383100 - RNA, 15 nt, Pseudomonas aeruginosa PA01
ccugggagccgccgg

SEQ ID NO: 3383101 - RNA, 14 nt, Pseudomonas aeruginosa PA01
ccugggaugccgcc

SEQ ID NO: 3383102 - RNA, 20 nt, Pseudomonas aeruginosa PA01
ccugggaugccgccaagccc

SEQ ID NO: 3383103 - RNA, 18 nt, Pseudomonas aeruginosa PA01
ccugggaugccgggccga

SEQ ID NO: 3383104 - RNA, 20 nt, Pseudomonas aeruginosa PA01
ccugggcaagcugcacggcg

SEQ ID NO: 3383105 - RNA, 22 nt, Pseudomonas aeruginosa PA01
ccugggcaagcugcacggcgac

SEQ ID NO: 3383106 - RNA, 19 nt, Pseudomonas aeruginosa PA01
ccugggccauguccaccac

SEQ ID NO: 3383107 - RNA, 16 nt, Pseudomonas aeruginosa PA01
ccugggccccggccag

SEQ ID NO: 3383108 - RNA, 17 nt, Pseudomonas aeruginosa PA01
ccugggccccggccagg

SEQ ID NO: 3383109 - RNA, 13 nt, Pseudomonas aeruginosa PA01
ccugggccgcgcu

SEQ ID NO: 3383110 - RNA, 14 nt, Pseudomonas aeruginosa PA01
ccugggccgcgcug

SEQ ID NO: 3383111 - RNA, 15 nt, Pseudomonas aeruginosa PA01
ccugggccgcgcugu

SEQ ID NO: 3383112 - RNA, 18 nt, Pseudomonas aeruginosa PA01
ccugggccggcuucuuuc

SEQ ID NO: 3383113 - RNA, 22 nt, Pseudomonas aeruginosa PA01
ccugggccgguugcggcgccgg

SEQ ID NO: 3383114 - RNA, 14 nt, Pseudomonas aeruginosa PA01
ccugggccugcagg

SEQ ID NO: 3383115 - RNA, 18 nt, Pseudomonas aeruginosa PA01
ccugggccugucgggggc

SEQ ID NO: 3383116 - RNA, 16 nt, Pseudomonas aeruginosa PA01
ccugggcgcaggggcg

SEQ ID NO: 3383117 - RNA, 23 nt, Pseudomonas aeruginosa PA01
ccugggcgcaggggcgcgccggc

SEQ ID NO: 3383118 - RNA, 14 nt, Pseudomonas aeruginosa PA01
ccugggcgccagcc

SEQ ID NO: 3383119 - RNA, 23 nt, Pseudomonas aeruginosa PA01
ccugggcgccagccgccaucacc

SEQ ID NO: 3383120 - RNA, 13 nt, Pseudomonas aeruginosa PA01
ccugggcgccgcc

SEQ ID NO: 3383121 - RNA, 21 nt, Pseudomonas aeruginosa PA01
ccugggcgccgccggugcacc

SEQ ID NO: 3383122 - RNA, 12 nt, Pseudomonas aeruginosa PA01
ccugggcgcuca

SEQ ID NO: 3383123 - RNA, 16 nt, Pseudomonas aeruginosa PA01
ccugggcggcaacuga

SEQ ID NO: 3383124 - RNA, 13 nt, Pseudomonas aeruginosa PA01
ccugggcggcgac

SEQ ID NO: 3383125 - RNA, 14 nt, Pseudomonas aeruginosa PA01
ccugggcggcgacc

SEQ ID NO: 3383126 - RNA, 22 nt, Pseudomonas aeruginosa PA01
ccugggcggcgaccugcggcaa

SEQ ID NO: 3383127 - RNA, 14 nt, Pseudomonas aeruginosa PA01
ccugggcggcgggc

SEQ ID NO: 3383128 - RNA, 20 nt, Pseudomonas aeruginosa PA01
ccugggcguacaggccccag

SEQ ID NO: 3383129 - RNA, 14 nt, Pseudomonas aeruginosa PA01
ccugggcgucgcug

SEQ ID NO: 3383130 - RNA, 15 nt, Pseudomonas aeruginosa PA01
ccugggcgugcuugg

SEQ ID NO: 3383131 - RNA, 18 nt, Pseudomonas aeruginosa PA01
ccugggcgugcuuggcga

SEQ ID NO: 3383132 - RNA, 15 nt, Pseudomonas aeruginosa PA01
ccugggcguuggcca

SEQ ID NO: 3383133 - RNA, 20 nt, Pseudomonas aeruginosa PA01
ccugggcguuggccagcgcc

SEQ ID NO: 3383134 - RNA, 21 nt, Pseudomonas aeruginosa PA01
ccugggcuucguccgccuggg

SEQ ID NO: 3383135 - RNA, 15 nt, Pseudomonas aeruginosa PA01
ccuggggaaucugcg

SEQ ID NO: 3383136 - RNA, 13 nt, Pseudomonas aeruginosa PA01
ccuggggacggca

SEQ ID NO: 3383137 - RNA, 22 nt, Pseudomonas aeruginosa PA01
ccuggggauggccggcgcggcg

SEQ ID NO: 3383138 - RNA, 14 nt, Pseudomonas aeruginosa PA01
ccuggggcucggcu

SEQ ID NO: 3383139 - RNA, 23 nt, Pseudomonas aeruginosa PA01
ccuggggcucggcuuccaucacc

SEQ ID NO: 3383140 - RNA, 19 nt, Pseudomonas aeruginosa PA01
ccugggguagccggccgau

SEQ ID NO: 3383141 - RNA, 16 nt, Pseudomonas aeruginosa PA01
ccuggggugcagcagg

SEQ ID NO: 3383142 - RNA, 19 nt, Pseudomonas aeruginosa PA01
ccugggguuucugcuggcc

SEQ ID NO: 3383143 - RNA, 17 nt, Pseudomonas aeruginosa PA01
ccuggguaccgacgguc

SEQ ID NO: 3383144 - RNA, 21 nt, Pseudomonas aeruginosa PA01
ccuggguaccgacggucggca

SEQ ID NO: 3383145 - RNA, 15 nt, Pseudomonas aeruginosa PA01
ccuggguacgcaccg

SEQ ID NO: 3383146 - RNA, 17 nt, Pseudomonas aeruginosa PA01
ccuggguacgcaccggc

SEQ ID NO: 3383147 - RNA, 17 nt, Pseudomonas aeruginosa PA01
ccugggucgacugcugg

SEQ ID NO: 3383148 - RNA, 20 nt, Pseudomonas aeruginosa PA01
ccugggucgcguacagcggg

SEQ ID NO: 3383149 - RNA, 18 nt, Pseudomonas aeruginosa PA01
ccugggugaacagcggcc

SEQ ID NO: 3383150 - RNA, 18 nt, Pseudomonas aeruginosa PA01
ccugggugcuuuccugcu

SEQ ID NO: 3383151 - RNA, 17 nt, Pseudomonas aeruginosa PA01
ccuggguggcgacgccg

SEQ ID NO: 3383152 - RNA, 16 nt, Pseudomonas aeruginosa PA01
ccuggguugccgcgcc

SEQ ID NO: 3383153 - RNA, 19 nt, Pseudomonas aeruginosa PA01
ccuucaaccacuccagcgg

SEQ ID NO: 3383154 - RNA, 20 nt, Pseudomonas aeruginosa PA01
ccuucaaccacuccagcggg

SEQ ID NO: 3383155 - RNA, 15 nt, Pseudomonas aeruginosa PA01
ccuucaacggcgacc

SEQ ID NO: 3383156 - RNA, 16 nt, Pseudomonas aeruginosa PA01
ccuucaacggcgaccg

SEQ ID NO: 3383157 - RNA, 16 nt, Pseudomonas aeruginosa PA01
ccuucaccgcgccgcg

SEQ ID NO: 3383158 - RNA, 18 nt, Pseudomonas aeruginosa PA01
ccuucaccgcgccgcgcu

SEQ ID NO: 3383159 - RNA, 15 nt, Pseudomonas aeruginosa PA01
ccuucaccggacggc

SEQ ID NO: 3383160 - RNA, 14 nt, Pseudomonas aeruginosa PA01
ccuucaccggcgga

SEQ ID NO: 3383161 - RNA, 14 nt, Pseudomonas aeruginosa PA01
ccuucacggcaucc

SEQ ID NO: 3383162 - RNA, 21 nt, Pseudomonas aeruginosa PA01
ccuucacguaguugacccgcc

SEQ ID NO: 3383163 - RNA, 13 nt, Pseudomonas aeruginosa PA01
ccuucagccccag

SEQ ID NO: 3383164 - RNA, 16 nt, Pseudomonas aeruginosa PA01
ccuucagccccagcac

SEQ ID NO: 3383165 - RNA, 17 nt, Pseudomonas aeruginosa PA01
ccuucagccccagcacg

SEQ ID NO: 3383166 - RNA, 19 nt, Pseudomonas aeruginosa PA01
ccuucagccccagcacgcc

SEQ ID NO: 3383167 - RNA, 15 nt, Pseudomonas aeruginosa PA01
ccuucagcgcaccgc

SEQ ID NO: 3383168 - RNA, 13 nt, Pseudomonas aeruginosa PA01
ccuucagcgccag

SEQ ID NO: 3383169 - RNA, 16 nt, Pseudomonas aeruginosa PA01
ccuucagcgccagcag

SEQ ID NO: 3383170 - RNA, 14 nt, Pseudomonas aeruginosa PA01
ccuucagcgccgcc

SEQ ID NO: 3383171 - RNA, 17 nt, Pseudomonas aeruginosa PA01
ccuucagcgccgccagg

SEQ ID NO: 3383172 - RNA, 19 nt, Pseudomonas aeruginosa PA01
ccuucagcgccgccaggcc

SEQ ID NO: 3383173 - RNA, 19 nt, Pseudomonas aeruginosa PA01
ccuucagcgggucgagcca

SEQ ID NO: 3383174 - RNA, 21 nt, Pseudomonas aeruginosa PA01
ccuucagcgggucgagccagg

SEQ ID NO: 3383175 - RNA, 13 nt, Pseudomonas aeruginosa PA01
ccuucagcuccag

SEQ ID NO: 3383176 - RNA, 16 nt, Pseudomonas aeruginosa PA01
ccuucaggagggaacg

SEQ ID NO: 3383177 - RNA, 12 nt, Pseudomonas aeruginosa PA01
ccuucaggcgcu

SEQ ID NO: 3383178 - RNA, 15 nt, Pseudomonas aeruginosa PA01
ccuucaggcgcuccu

SEQ ID NO: 3383179 - RNA, 19 nt, Pseudomonas aeruginosa PA01
ccuucaggcgggcucuuug

SEQ ID NO: 3383180 - RNA, 20 nt, Pseudomonas aeruginosa PA01
ccuucagguaaggcaccacc

SEQ ID NO: 3383181 - RNA, 15 nt, Pseudomonas aeruginosa PA01
ccuucaucccuucuu

SEQ ID NO: 3383182 - RNA, 13 nt, Pseudomonas aeruginosa PA01
ccuucaucuuggc

SEQ ID NO: 3383183 - RNA, 19 nt, Pseudomonas aeruginosa PA01
ccuucaucuuggcccauuc

SEQ ID NO: 3383184 - RNA, 14 nt, Pseudomonas aeruginosa PA01
ccuucaugaacaca

SEQ ID NO: 3383185 - RNA, 17 nt, Pseudomonas aeruginosa PA01
ccuuccaccaccagggu

SEQ ID NO: 3383186 - RNA, 15 nt, Pseudomonas aeruginosa PA01
ccuuccaccggcguc

SEQ ID NO: 3383187 - RNA, 15 nt, Pseudomonas aeruginosa PA01
ccuuccagaacgccg

SEQ ID NO: 3383188 - RNA, 14 nt, Pseudomonas aeruginosa PA01
ccuuccagcagguc

SEQ ID NO: 3383189 - RNA, 18 nt, Pseudomonas aeruginosa PA01
ccuuccagcaggucgagg

SEQ ID NO: 3383190 - RNA, 15 nt, Pseudomonas aeruginosa PA01
ccuuccagcccuucg

SEQ ID NO: 3383191 - RNA, 20 nt, Pseudomonas aeruginosa PA01
ccuuccagcccuucgacguc

SEQ ID NO: 3383192 - RNA, 13 nt, Pseudomonas aeruginosa PA01
ccuuccagccgcc

SEQ ID NO: 3383193 - RNA, 15 nt, Pseudomonas aeruginosa PA01
ccuuccagccgcccu

SEQ ID NO: 3383194 - RNA, 18 nt, Pseudomonas aeruginosa PA01
ccuuccagcuugcgccag

SEQ ID NO: 3383195 - RNA, 12 nt, Pseudomonas aeruginosa PA01
ccuuccaggcgu

SEQ ID NO: 3383196 - RNA, 17 nt, Pseudomonas aeruginosa PA01
ccuuccaggcuguagcc

SEQ ID NO: 3383197 - RNA, 22 nt, Pseudomonas aeruginosa PA01
ccuuccaggcuguagccggcga

SEQ ID NO: 3383198 - RNA, 22 nt, Pseudomonas aeruginosa PA01
ccuucccacuccguccagugcg

SEQ ID NO: 3383199 - RNA, 21 nt, Pseudomonas aeruginosa PA01
ccuucccagacguccagcgcc

SEQ ID NO: 3383200 - RNA, 13 nt, Pseudomonas aeruginosa PA01
ccuucccggcgcu

SEQ ID NO: 3383201 - RNA, 12 nt, Pseudomonas aeruginosa PA01
ccuuccgccagc

SEQ ID NO: 3383202 - RNA, 15 nt, Pseudomonas aeruginosa PA01
ccuuccgccagcagg

SEQ ID NO: 3383203 - RNA, 16 nt, Pseudomonas aeruginosa PA01
ccuuccgccagcaggc

SEQ ID NO: 3383204 - RNA, 19 nt, Pseudomonas aeruginosa PA01
ccuuccgccagcaggcgcg

SEQ ID NO: 3383205 - RNA, 21 nt, Pseudomonas aeruginosa PA01
ccuuccgccagcaggcgcggg

SEQ ID NO: 3383206 - RNA, 21 nt, Pseudomonas aeruginosa PA01
ccuuccgcgcccaggcugccg

SEQ ID NO: 3383207 - RNA, 21 nt, Pseudomonas aeruginosa PA01
ccuuccggguugaaggcgcgg

SEQ ID NO: 3383208 - RNA, 21 nt, Pseudomonas aeruginosa PA01
ccuuccgucgucaccucggcg

SEQ ID NO: 3383209 - RNA, 23 nt, Pseudomonas aeruginosa PA01
ccuuccgucgucaccucggcgcc

SEQ ID NO: 3383210 - RNA, 18 nt, Pseudomonas aeruginosa PA01
ccuuccucggccgccagg

SEQ ID NO: 3383211 - RNA, 22 nt, Pseudomonas aeruginosa PA01
ccuuccucggccgccaggcgcg

SEQ ID NO: 3383212 - RNA, 13 nt, Pseudomonas aeruginosa PA01
ccuuccucggcga

SEQ ID NO: 3383213 - RNA, 16 nt, Pseudomonas aeruginosa PA01
ccuuccugccagcgcg

SEQ ID NO: 3383214 - RNA, 14 nt, Pseudomonas aeruginosa PA01
ccuuccugggcgug

SEQ ID NO: 3383215 - RNA, 17 nt, Pseudomonas aeruginosa PA01
ccuuccuugauccacuc

SEQ ID NO: 3383216 - RNA, 18 nt, Pseudomonas aeruginosa PA01
ccuuccuugucgaucagg

SEQ ID NO: 3383217 - RNA, 21 nt, Pseudomonas aeruginosa PA01
ccuucgaagacccccugccgc

SEQ ID NO: 3383218 - RNA, 21 nt, Pseudomonas aeruginosa PA01
ccuucgacaugggccgcgcag

SEQ ID NO: 3383219 - RNA, 19 nt, Pseudomonas aeruginosa PA01
ccuucgacggagagcagca

SEQ ID NO: 3383220 - RNA, 23 nt, Pseudomonas aeruginosa PA01
ccuucgacgguucgcgaacgguc

SEQ ID NO: 3383221 - RNA, 18 nt, Pseudomonas aeruginosa PA01
ccuucgagaaacugcagg

SEQ ID NO: 3383222 - RNA, 16 nt, Pseudomonas aeruginosa PA01
ccuucgagcaacacau

SEQ ID NO: 3383223 - RNA, 18 nt, Pseudomonas aeruginosa PA01
ccuucgagcaacacaugc

SEQ ID NO: 3383224 - RNA, 21 nt, Pseudomonas aeruginosa PA01
ccuucgagcaacacaugcagg

SEQ ID NO: 3383225 - RNA, 15 nt, Pseudomonas aeruginosa PA01
ccuucgagccuggcc

SEQ ID NO: 3383226 - RNA, 17 nt, Pseudomonas aeruginosa PA01
ccuucgagcgcgguuuu

SEQ ID NO: 3383227 - RNA, 15 nt, Pseudomonas aeruginosa PA01
ccuucgaugcuccuu

SEQ ID NO: 3383228 - RNA, 20 nt, Pseudomonas aeruginosa PA01
ccuucgcaaagcgagcgccc

SEQ ID NO: 3383229 - RNA, 18 nt, Pseudomonas aeruginosa PA01
ccuucgccagcggccagg

SEQ ID NO: 3383230 - RNA, 21 nt, Pseudomonas aeruginosa PA01
ccuucgccagcggccagggcg

SEQ ID NO: 3383231 - RNA, 12 nt, Pseudomonas aeruginosa PA01
ccuucgcccggc

SEQ ID NO: 3383232 - RNA, 13 nt, Pseudomonas aeruginosa PA01
ccuucgcccucag

SEQ ID NO: 3383233 - RNA, 15 nt, Pseudomonas aeruginosa PA01
ccuucgcccucagca

SEQ ID NO: 3383234 - RNA, 17 nt, Pseudomonas aeruginosa PA01
ccuucgcccucagcagc

SEQ ID NO: 3383235 - RNA, 18 nt, Pseudomonas aeruginosa PA01
ccuucgcccucagcagcg

SEQ ID NO: 3383236 - RNA, 20 nt, Pseudomonas aeruginosa PA01
ccuucgcccucagcagcgcc

SEQ ID NO: 3383237 - RNA, 18 nt, Pseudomonas aeruginosa PA01
ccuucgccgucagacgcg

SEQ ID NO: 3383238 - RNA, 17 nt, Pseudomonas aeruginosa PA01
ccuucgcggcggcgcgu

SEQ ID NO: 3383239 - RNA, 12 nt, Pseudomonas aeruginosa PA01
ccuucgcgggcc

SEQ ID NO: 3383240 - RNA, 20 nt, Pseudomonas aeruginosa PA01
ccuucgcguucgcuccgggc

SEQ ID NO: 3383241 - RNA, 12 nt, Pseudomonas aeruginosa PA01
ccuucgcugaaa

SEQ ID NO: 3383242 - RNA, 16 nt, Pseudomonas aeruginosa PA01
ccuucggcaccccuuc

SEQ ID NO: 3383243 - RNA, 22 nt, Pseudomonas aeruginosa PA01
ccuucggcgcauagccaccgcc

SEQ ID NO: 3383244 - RNA, 13 nt, Pseudomonas aeruginosa PA01
ccuucggcgccgg

SEQ ID NO: 3383245 - RNA, 21 nt, Pseudomonas aeruginosa PA01
ccuucggcgccggagcugguc

SEQ ID NO: 3383246 - RNA, 13 nt, Pseudomonas aeruginosa PA01
ccuucggcgcucu

SEQ ID NO: 3383247 - RNA, 23 nt, Pseudomonas aeruginosa PA01
ccuucggcgcucuucagcacgcc

SEQ ID NO: 3383248 - RNA, 19 nt, Pseudomonas aeruginosa PA01
ccuucggcggagccgucgg

SEQ ID NO: 3383249 - RNA, 15 nt, Pseudomonas aeruginosa PA01
ccuucggcggcgccu

SEQ ID NO: 3383250 - RNA, 17 nt, Pseudomonas aeruginosa PA01
ccuucgggagagcccgg

SEQ ID NO: 3383251 - RNA, 15 nt, Pseudomonas aeruginosa PA01
ccuucggucgcgccc

SEQ ID NO: 3383252 - RNA, 20 nt, Pseudomonas aeruginosa PA01
ccuucggucgcgccccgcca

SEQ ID NO: 3383253 - RNA, 21 nt, Pseudomonas aeruginosa PA01
ccuucggucgcgccccgccag

SEQ ID NO: 3383254 - RNA, 17 nt, Pseudomonas aeruginosa PA01
ccuucgguggcgaccag

SEQ ID NO: 3383255 - RNA, 18 nt, Pseudomonas aeruginosa PA01
ccuucgguggcgaccagg

SEQ ID NO: 3383256 - RNA, 15 nt, Pseudomonas aeruginosa PA01
ccuugcggcccgccu

SEQ ID NO: 3383257 - RNA, 20 nt, Pseudomonas aeruginosa PA01
ccuugcggccguucuccggg

SEQ ID NO: 3383258 - RNA, 17 nt, Pseudomonas aeruginosa PA01
ccuugcgggaacuggcg

SEQ ID NO: 3383259 - RNA, 20 nt, Pseudomonas aeruginosa PA01
ccuugcgggaacuggcguug

SEQ ID NO: 3383260 - RNA, 19 nt, Pseudomonas aeruginosa PA01
ccuugcgguagcgcucgcc

SEQ ID NO: 3383261 - RNA, 23 nt, Pseudomonas aeruginosa PA01
ccuugcgguccagcgagcgggcg

SEQ ID NO: 3383262 - RNA, 17 nt, Pseudomonas aeruginosa PA01
ccuugcguaccagcgcg

SEQ ID NO: 3383263 - RNA, 18 nt, Pseudomonas aeruginosa PA01
ccuugcguaccagcgcgc

SEQ ID NO: 3383264 - RNA, 19 nt, Pseudomonas aeruginosa PA01
ccuugcucaggucgucgag

SEQ ID NO: 3383265 - RNA, 20 nt, Pseudomonas aeruginosa PA01
ccuugcucaggucgucgagg

SEQ ID NO: 3383266 - RNA, 12 nt, Pseudomonas aeruginosa PA01
ccuugcucgcgg

SEQ ID NO: 3383267 - RNA, 19 nt, Pseudomonas aeruginosa PA01
ccuugcucucgcgcacgcu

SEQ ID NO: 3383268 - RNA, 19 nt, Pseudomonas aeruginosa PA01
ccuugcugaagcccaggcg

SEQ ID NO: 3383269 - RNA, 14 nt, Pseudomonas aeruginosa PA01
ccuugcuggacuuc

SEQ ID NO: 3383270 - RNA, 17 nt, Pseudomonas aeruginosa PA01
ccuugcuguucgccuuc

SEQ ID NO: 3383271 - RNA, 18 nt, Pseudomonas aeruginosa PA01
ccuuggagccgcccucgg

SEQ ID NO: 3383272 - RNA, 17 nt, Pseudomonas aeruginosa PA01
ccuuggcaucgccgccc

SEQ ID NO: 3383273 - RNA, 14 nt, Pseudomonas aeruginosa PA01
ccuuggccacggca

SEQ ID NO: 3383274 - RNA, 12 nt, Pseudomonas aeruginosa PA01
ccuuggccagca

SEQ ID NO: 3383275 - RNA, 16 nt, Pseudomonas aeruginosa PA01
ccuuggccagcgcggc

SEQ ID NO: 3383276 - RNA, 17 nt, Pseudomonas aeruginosa PA01
ccuuggccagcgcggcg

SEQ ID NO: 3383277 - RNA, 20 nt, Pseudomonas aeruginosa PA01
ccuuggccagcgcggcgcgg

SEQ ID NO: 3383278 - RNA, 23 nt, Pseudomonas aeruginosa PA01
ccuuggccaugaugugcgcaggc

SEQ ID NO: 3383279 - RNA, 15 nt, Pseudomonas aeruginosa PA01
ccuuggccaugggca

SEQ ID NO: 3383280 - RNA, 19 nt, Pseudomonas aeruginosa PA01
ccuuggccaugggcacgcc

SEQ ID NO: 3383281 - RNA, 13 nt, Pseudomonas aeruginosa PA01
ccuuggcgcgacu

SEQ ID NO: 3383282 - RNA, 13 nt, Pseudomonas aeruginosa PA01
ccuuggcuggcca

SEQ ID NO: 3383283 - RNA, 18 nt, Pseudomonas aeruginosa PA01
ccuuggcuuccuggcgcc

SEQ ID NO: 3383284 - RNA, 20 nt, Pseudomonas aeruginosa PA01
ccuuggcuuccuggcgccgg

SEQ ID NO: 3383285 - RNA, 15 nt, Pseudomonas aeruginosa PA01
ccuugggaucggcga

SEQ ID NO: 3383286 - RNA, 19 nt, Pseudomonas aeruginosa PA01
ccuugggaucggcgaucag

SEQ ID NO: 3383287 - RNA, 13 nt, Pseudomonas aeruginosa PA01
ccuugggccaggc

SEQ ID NO: 3383288 - RNA, 17 nt, Pseudomonas aeruginosa PA01
ccuugggccaggcaucc

SEQ ID NO: 3383289 - RNA, 14 nt, Pseudomonas aeruginosa PA01
ccuuggucaggccg

SEQ ID NO: 3383290 - RNA, 16 nt, Pseudomonas aeruginosa PA01
ccuuggucaggccgac

SEQ ID NO: 3383291 - RNA, 19 nt, Pseudomonas aeruginosa PA01
ccuuggucaggccgaccag

SEQ ID NO: 3383292 - RNA, 20 nt, Pseudomonas aeruginosa PA01
ccuuggucaggucgacgccg

SEQ ID NO: 3383293 - RNA, 20 nt, Pseudomonas aeruginosa PA01
ccuuggugaugaagucggcg

SEQ ID NO: 3383294 - RNA, 22 nt, Pseudomonas aeruginosa PA01
ccuuggugaugaagucggcgua

SEQ ID NO: 3383295 - RNA, 15 nt, Pseudomonas aeruginosa PA01
ccuuggugccgaccu

SEQ ID NO: 3383296 - RNA, 19 nt, Pseudomonas aeruginosa PA01
ccuuggugucgaugccgcc

SEQ ID NO: 3383297 - RNA, 21 nt, Pseudomonas aeruginosa PA01
ccuuggugucgaugccgcccg

SEQ ID NO: 3383298 - RNA, 17 nt, Pseudomonas aeruginosa PA01
ccuugguguuggucagg

SEQ ID NO: 3383299 - RNA, 18 nt, Pseudomonas aeruginosa PA01
ccuuguacagcuucaggc

SEQ ID NO: 3383300 - RNA, 21 nt, Pseudomonas aeruginosa PA01
ccuuguagaucgacagccacu

SEQ ID NO: 3383301 - RNA, 14 nt, Pseudomonas aeruginosa PA01
ccuuguccaggcgc

SEQ ID NO: 3383302 - RNA, 18 nt, Pseudomonas aeruginosa PA01
ccuuguccagggccggau

SEQ ID NO: 3383303 - RNA, 24 nt, Pseudomonas aeruginosa PA01
ccuugucgaugagccagccugcag

SEQ ID NO: 3383304 - RNA, 16 nt, Pseudomonas aeruginosa PA01
ccuugucgcaccagcc

SEQ ID NO: 3383305 - RNA, 15 nt, Pseudomonas aeruginosa PA01
ccuugucgcagcggc

SEQ ID NO: 3383306 - RNA, 13 nt, Pseudomonas aeruginosa PA01
ccuugucgccgcu

SEQ ID NO: 3383307 - RNA, 14 nt, Pseudomonas aeruginosa PA01
ccuugucgccgcug

SEQ ID NO: 3383308 - RNA, 16 nt, Pseudomonas aeruginosa PA01
ccuugucgccgcuggg

SEQ ID NO: 3383309 - RNA, 13 nt, Pseudomonas aeruginosa PA01
ccuugucgcugac

SEQ ID NO: 3383310 - RNA, 20 nt, Pseudomonas aeruginosa PA01
ccuugucguaugccugugca

SEQ ID NO: 3383311 - RNA, 23 nt, Pseudomonas aeruginosa PA01
ccuugugcacgaacaggugcugg

SEQ ID NO: 3383312 - RNA, 15 nt, Pseudomonas aeruginosa PA01
ccuugugcgccagcu

SEQ ID NO: 3383313 - RNA, 15 nt, Pseudomonas aeruginosa PA01
ccuugugcugccugc

SEQ ID NO: 3383314 - RNA, 21 nt, Pseudomonas aeruginosa PA01
ccuuguggccgaucuccuggu

SEQ ID NO: 3383315 - RNA, 19 nt, Pseudomonas aeruginosa PA01
ccuuguucaggguggcgac

SEQ ID NO: 3383316 - RNA, 13 nt, Pseudomonas aeruginosa PA01
ccuuguuccaggc

SEQ ID NO: 3383317 - RNA, 15 nt, Pseudomonas aeruginosa PA01
ccuuguuccugggcg

SEQ ID NO: 3383318 - RNA, 15 nt, Pseudomonas aeruginosa PA01
ccuuguucggcugga

SEQ ID NO: 3383319 - RNA, 14 nt, Pseudomonas aeruginosa PA01
ccuuguugacguuc

SEQ ID NO: 3383320 - RNA, 19 nt, Pseudomonas aeruginosa PA01
ccuuguuuuccuggcccug

SEQ ID NO: 3383321 - RNA, 18 nt, Pseudomonas aeruginosa PA01
ccuuucagcggcugcccg

SEQ ID NO: 3383322 - RNA, 16 nt, Pseudomonas aeruginosa PA01
ccuuucgcucaggccu

SEQ ID NO: 3383323 - RNA, 18 nt, Pseudomonas aeruginosa PA01
ccuuucggaacagcgccu

SEQ ID NO: 3383324 - RNA, 20 nt, Pseudomonas aeruginosa PA01
ccuuucuccccucaggcgcc

SEQ ID NO: 3383325 - RNA, 15 nt, Pseudomonas aeruginosa PA01
ccuuucugcccggcu

SEQ ID NO: 3383326 - RNA, 20 nt, Pseudomonas aeruginosa PA01
ccuuucuuuucugccacccg

SEQ ID NO: 3383327 - RNA, 20 nt, Pseudomonas aeruginosa PA01
ccuuuucgaacaaucccagc

SEQ ID NO: 3383328 - RNA, 19 nt, Pseudomonas aeruginosa PA01
ccuuuucggcggccaggcg

SEQ ID NO: 3383329 - RNA, 18 nt, Pseudomonas aeruginosa PA01
ccuuuucuuuggcgacga

SEQ ID NO: 3383330 - RNA, 10 nt, Pseudomonas aeruginosa PA01
ccuuuuucau

SEQ ID NO: 3383331 - RNA, 16 nt, Pseudomonas aeruginosa PA01
ccuuuuucauggccug

SEQ ID NO: 3383332 - RNA, 23 nt, Pseudomonas aeruginosa PA01
ccuuuuucauucuccagccgcac

SEQ ID NO: 3383333 - RNA, 18 nt, Pseudomonas aeruginosa PA01
cgaaaaaaaggcgcugcu

SEQ ID NO: 3383334 - RNA, 17 nt, Pseudomonas aeruginosa PA01
cgaaaaagaacgccccg

SEQ ID NO: 3383335 - RNA, 15 nt, Pseudomonas aeruginosa PA01
cgaaaaagccggcgc

SEQ ID NO: 3383336 - RNA, 12 nt, Pseudomonas aeruginosa PA01
cgaaaaccgcag

SEQ ID NO: 3383337 - RNA, 21 nt, Pseudomonas aeruginosa PA01
cgaaaagaagccccgcagccg

SEQ ID NO: 3383338 - RNA, 16 nt, Pseudomonas aeruginosa PA01
cgaaaagagccgcgcc

SEQ ID NO: 3383339 - RNA, 13 nt, Pseudomonas aeruginosa PA01
cgaaaagccgccc

SEQ ID NO: 3383340 - RNA, 15 nt, Pseudomonas aeruginosa PA01
cgaaaaucgaagggu

SEQ ID NO: 3383341 - RNA, 23 nt, Pseudomonas aeruginosa PA01
cgaaaaucgaaggguuggccgca

SEQ ID NO: 3383342 - RNA, 13 nt, Pseudomonas aeruginosa PA01
cgaaacgccgacg

SEQ ID NO: 3383343 - RNA, 14 nt, Pseudomonas aeruginosa PA01
cgaaacgccgacgg

SEQ ID NO: 3383344 - RNA, 18 nt, Pseudomonas aeruginosa PA01
cgaaacgcuggcggccga

SEQ ID NO: 3383345 - RNA, 14 nt, Pseudomonas aeruginosa PA01
cgaaacgcuugcgu

SEQ ID NO: 3383346 - RNA, 14 nt, Pseudomonas aeruginosa PA01
cgaaacggaacagg

SEQ ID NO: 3383347 - RNA, 16 nt, Pseudomonas aeruginosa PA01
cgaaacggcaggccag

SEQ ID NO: 3383348 - RNA, 20 nt, Pseudomonas aeruginosa PA01
cgaaacggcaggccagcagg

SEQ ID NO: 3383349 - RNA, 22 nt, Pseudomonas aeruginosa PA01
cgaaacgggcgcucuggccgcg

SEQ ID NO: 3383350 - RNA, 21 nt, Pseudomonas aeruginosa PA01
cgaaacgguccaccaggguac

SEQ ID NO: 3383351 - RNA, 15 nt, Pseudomonas aeruginosa PA01
cgaaacguccggcgu

SEQ ID NO: 3383352 - RNA, 15 nt, Pseudomonas aeruginosa PA01
cgaaacucaucaggc

SEQ ID NO: 3383353 - RNA, 21 nt, Pseudomonas aeruginosa PA01
cgaaacucaucaggcugccga

SEQ ID NO: 3383354 - RNA, 22 nt, Pseudomonas aeruginosa PA01
cgaaacucaucaggcugccgag

SEQ ID NO: 3383355 - RNA, 15 nt, Pseudomonas aeruginosa PA01
cgaaacuccagcagg

SEQ ID NO: 3383356 - RNA, 15 nt, Pseudomonas aeruginosa PA01
cgaaagaaacaacga

SEQ ID NO: 3383357 - RNA, 19 nt, Pseudomonas aeruginosa PA01
cgaaagaacaacuccugca

SEQ ID NO: 3383358 - RNA, 20 nt, Pseudomonas aeruginosa PA01
cgaaagaagccgcacuucca

SEQ ID NO: 3383359 - RNA, 19 nt, Pseudomonas aeruginosa PA01
cgaaccggaaaagaagccg

SEQ ID NO: 3383360 - RNA, 20 nt, Pseudomonas aeruginosa PA01
cgaaccggaaaagaagccgc

SEQ ID NO: 3383361 - RNA, 22 nt, Pseudomonas aeruginosa PA01
cgaaccggaaaagaagccgcgc

SEQ ID NO: 3383362 - RNA, 16 nt, Pseudomonas aeruginosa PA01
cgaaccguccgcagcg

SEQ ID NO: 3383363 - RNA, 17 nt, Pseudomonas aeruginosa PA01
cgaaccguggcggccgc

SEQ ID NO: 3383364 - RNA, 19 nt, Pseudomonas aeruginosa PA01
cgaaccguggcggccgccg

SEQ ID NO: 3383365 - RNA, 20 nt, Pseudomonas aeruginosa PA01
cgaaccguggcggccgccgc

SEQ ID NO: 3383366 - RNA, 23 nt, Pseudomonas aeruginosa PA01
cgaaccguggcggccgccgcgca

SEQ ID NO: 3383367 - RNA, 20 nt, Pseudomonas aeruginosa PA01
cgaaccgugguucucggucg

SEQ ID NO: 3383368 - RNA, 20 nt, Pseudomonas aeruginosa PA01
cgaaccucgguagccggcca

SEQ ID NO: 3383369 - RNA, 12 nt, Pseudomonas aeruginosa PA01
cgaacgacagca

SEQ ID NO: 3383370 - RNA, 13 nt, Pseudomonas aeruginosa PA01
cgaacgacagcac

SEQ ID NO: 3383371 - RNA, 21 nt, Pseudomonas aeruginosa PA01
cgaacgagaagccgaucaggu

SEQ ID NO: 3383372 - RNA, 14 nt, Pseudomonas aeruginosa PA01
cgaacgaggcgagg

SEQ ID NO: 3383373 - RNA, 22 nt, Pseudomonas aeruginosa PA01
cgaacgaggcucggucgcgcgg

SEQ ID NO: 3383374 - RNA, 22 nt, Pseudomonas aeruginosa PA01
cgaacgcacuucguccgccacc

SEQ ID NO: 3383375 - RNA, 18 nt, Pseudomonas aeruginosa PA01
cgaacgccaggcaggcgg

SEQ ID NO: 3383376 - RNA, 20 nt, Pseudomonas aeruginosa PA01
cgaacgccaggcaggcgguc

SEQ ID NO: 3383377 - RNA, 13 nt, Pseudomonas aeruginosa PA01
cgaacgccgcagc

SEQ ID NO: 3383378 - RNA, 14 nt, Pseudomonas aeruginosa PA01
cgaacgccgcagcu

SEQ ID NO: 3383379 - RNA, 18 nt, Pseudomonas aeruginosa PA01
cgaacgccgcagcucggc

SEQ ID NO: 3383380 - RNA, 19 nt, Pseudomonas aeruginosa PA01
cgaacgccgcagcucggcc

SEQ ID NO: 3383381 - RNA, 20 nt, Pseudomonas aeruginosa PA01
cgaacgccgcccgucgcgcc

SEQ ID NO: 3383382 - RNA, 15 nt, Pseudomonas aeruginosa PA01
cgaacgcgugaagcu

SEQ ID NO: 3383383 - RNA, 16 nt, Pseudomonas aeruginosa PA01
cgaacgcucccagccg

SEQ ID NO: 3383384 - RNA, 17 nt, Pseudomonas aeruginosa PA01
cgaacgcucccagccga

SEQ ID NO: 3383385 - RNA, 20 nt, Pseudomonas aeruginosa PA01
cgaacgcucccagccgacgu

SEQ ID NO: 3383386 - RNA, 21 nt, Pseudomonas aeruginosa PA01
cgaacgcuugagccccggcag

SEQ ID NO: 3383387 - RNA, 14 nt, Pseudomonas aeruginosa PA01
cgaacggaccgacg

SEQ ID NO: 3383388 - RNA, 13 nt, Pseudomonas aeruginosa PA01
cgaacggaucgcg

SEQ ID NO: 3383389 - RNA, 22 nt, Pseudomonas aeruginosa PA01
cgaacggaucgcgucgcaggcg

SEQ ID NO: 3383390 - RNA, 23 nt, Pseudomonas aeruginosa PA01
cgaacggaucgcgucgcaggcga

SEQ ID NO: 3383391 - RNA, 14 nt, Pseudomonas aeruginosa PA01
cgaacggcagcguc

SEQ ID NO: 3383392 - RNA, 22 nt, Pseudomonas aeruginosa PA01
cgaacggcgugagggucgcgcc

SEQ ID NO: 3383393 - RNA, 20 nt, Pseudomonas aeruginosa PA01
cgaacggcguuggcacgacg

SEQ ID NO: 3383394 - RNA, 16 nt, Pseudomonas aeruginosa PA01
cgaacggcuggucggc

SEQ ID NO: 3383395 - RNA, 23 nt, Pseudomonas aeruginosa PA01
cgaacgggaaguaggccuggccg

SEQ ID NO: 3383396 - RNA, 21 nt, Pseudomonas aeruginosa PA01
cgaacgggcguugccggcauu

SEQ ID NO: 3383397 - RNA, 13 nt, Pseudomonas aeruginosa PA01
cgaacgugcgcgc

SEQ ID NO: 3383398 - RNA, 18 nt, Pseudomonas aeruginosa PA01
cgaacgugcgcgcaacug

SEQ ID NO: 3383399 - RNA, 21 nt, Pseudomonas aeruginosa PA01
cgaacucaugcccagcuuggc

SEQ ID NO: 3383400 - RNA, 15 nt, Pseudomonas aeruginosa PA01
cgaacuccgagcagg

SEQ ID NO: 3383401 - RNA, 14 nt, Pseudomonas aeruginosa PA01
cgaacuccgccagc

SEQ ID NO: 3383402 - RNA, 16 nt, Pseudomonas aeruginosa PA01
cgaacuccgccagcuu

SEQ ID NO: 3383403 - RNA, 22 nt, Pseudomonas aeruginosa PA01
cgaacuccggugucaggccgag

SEQ ID NO: 3383404 - RNA, 18 nt, Pseudomonas aeruginosa PA01
cgaacucgaaggccagcu

SEQ ID NO: 3383405 - RNA, 18 nt, Pseudomonas aeruginosa PA01
cgaacucgacgcgccagg

SEQ ID NO: 3383406 - RNA, 22 nt, Pseudomonas aeruginosa PA01
cgaacucguagacgaauaccgg

SEQ ID NO: 3383407 - RNA, 12 nt, Pseudomonas aeruginosa PA01
cgaacucuggcg

SEQ ID NO: 3383408 - RNA, 16 nt, Pseudomonas aeruginosa PA01
cgaacucuggcggcgu

SEQ ID NO: 3383409 - RNA, 13 nt, Pseudomonas aeruginosa PA01
cgaacugaccacc

SEQ ID NO: 3383410 - RNA, 14 nt, Pseudomonas aeruginosa PA01
cgaacugaccacca

SEQ ID NO: 3383411 - RNA, 14 nt, Pseudomonas aeruginosa PA01
cgaacugcacccgc

SEQ ID NO: 3383412 - RNA, 16 nt, Pseudomonas aeruginosa PA01
cgaacugcacccgccg

SEQ ID NO: 3383413 - RNA, 19 nt, Pseudomonas aeruginosa PA01
cgaacugcacccgccgacc

SEQ ID NO: 3383414 - RNA, 20 nt, Pseudomonas aeruginosa PA01
cgaacugcacccgccgaccg

SEQ ID NO: 3383415 - RNA, 14 nt, Pseudomonas aeruginosa PA01
cgaacugcacgccc

SEQ ID NO: 3383416 - RNA, 12 nt, Pseudomonas aeruginosa PA01
cgaacugcaggg

SEQ ID NO: 3383417 - RNA, 16 nt, Pseudomonas aeruginosa PA01
cgaacugccgacggcg

SEQ ID NO: 3383418 - RNA, 13 nt, Pseudomonas aeruginosa PA01
cgaacugcuccug

SEQ ID NO: 3383419 - RNA, 18 nt, Pseudomonas aeruginosa PA01
cgaacuucuccgccaccc

SEQ ID NO: 3383420 - RNA, 22 nt, Pseudomonas aeruginosa PA01
cgaagaaaaggcccggcguccu

SEQ ID NO: 3383421 - RNA, 16 nt, Pseudomonas aeruginosa PA01
cgaagaacacgcccca

SEQ ID NO: 3383422 - RNA, 14 nt, Pseudomonas aeruginosa PA01
cgaagaacgccagc

SEQ ID NO: 3383423 - RNA, 14 nt, Pseudomonas aeruginosa PA01
cgaagaacggcgcg

SEQ ID NO: 3383424 - RNA, 17 nt, Pseudomonas aeruginosa PA01
cgaagaacggcgcgguc

SEQ ID NO: 3383425 - RNA, 14 nt, Pseudomonas aeruginosa PA01
cgaagaacuccauc

SEQ ID NO: 3383426 - RNA, 22 nt, Pseudomonas aeruginosa PA01
cgaagaacuccaucucgcggcg

SEQ ID NO: 3383427 - RNA, 16 nt, Pseudomonas aeruginosa PA01
cgaagaacucggcgcu

SEQ ID NO: 3383428 - RNA, 20 nt, Pseudomonas aeruginosa PA01
cgaagaacucggcgcugccg

SEQ ID NO: 3383429 - RNA, 17 nt, Pseudomonas aeruginosa PA01
cgaagaagccggccccu

SEQ ID NO: 3383430 - RNA, 23 nt, Pseudomonas aeruginosa PA01
cgaagaagcuucgcuggguuuuc

SEQ ID NO: 3383431 - RNA, 15 nt, Pseudomonas aeruginosa PA01
cgaagaaggcucacc

SEQ ID NO: 3383432 - RNA, 16 nt, Pseudomonas aeruginosa PA01
cgaagaccagcggagc

SEQ ID NO: 3383433 - RNA, 17 nt, Pseudomonas aeruginosa PA01
cgaagaccagggugggg

SEQ ID NO: 3383434 - RNA, 16 nt, Pseudomonas aeruginosa PA01
cgaagacccccugccg

SEQ ID NO: 3383435 - RNA, 20 nt, Pseudomonas aeruginosa PA01
cgaagacccccugccgcccu

SEQ ID NO: 3383436 - RNA, 18 nt, Pseudomonas aeruginosa PA01
cgaagacccccugcggcc

SEQ ID NO: 3383437 - RNA, 14 nt, Pseudomonas aeruginosa PA01
cgaagaccggccgg

SEQ ID NO: 3383438 - RNA, 20 nt, Pseudomonas aeruginosa PA01
cgaagaccuguugcagagcg

SEQ ID NO: 3383439 - RNA, 21 nt, Pseudomonas aeruginosa PA01
cgaagaccuguugcagagcgg

SEQ ID NO: 3383440 - RNA, 21 nt, Pseudomonas aeruginosa PA01
cgaagagcaccuugucgcuga

SEQ ID NO: 3383441 - RNA, 20 nt, Pseudomonas aeruginosa PA01
cgaagaggcccucggcgccg

SEQ ID NO: 3383442 - RNA, 21 nt, Pseudomonas aeruginosa PA01
cgaagaguaaaugcuugaaaa

SEQ ID NO: 3383443 - RNA, 18 nt, Pseudomonas aeruginosa PA01
cgaagauacccagcgggc

SEQ ID NO: 3383444 - RNA, 20 nt, Pseudomonas aeruginosa PA01
cgaagauacccagcgggcaa

SEQ ID NO: 3383445 - RNA, 22 nt, Pseudomonas aeruginosa PA01
cgaagaucacauacaccuugcg

SEQ ID NO: 3383446 - RNA, 18 nt, Pseudomonas aeruginosa PA01
cgaagaucaccggggccu

SEQ ID NO: 3383447 - RNA, 18 nt, Pseudomonas aeruginosa PA01
cgaagaucuuuucgaugg

SEQ ID NO: 3383448 - RNA, 19 nt, Pseudomonas aeruginosa PA01
cgaagcaauaccgguuggc

SEQ ID NO: 3383449 - RNA, 20 nt, Pseudomonas aeruginosa PA01
cgaagcagagggcguccugc

SEQ ID NO: 3383450 - RNA, 19 nt, Pseudomonas aeruginosa PA01
cgaagcagccguauggccc

SEQ ID NO: 3383451 - RNA, 14 nt, Pseudomonas aeruginosa PA01
cgaagccagcacgg

SEQ ID NO: 3383452 - RNA, 17 nt, Pseudomonas aeruginosa PA01
cgaagccaggcaccgga

SEQ ID NO: 3383453 - RNA, 16 nt, Pseudomonas aeruginosa PA01
cgaagcccagcgccug

SEQ ID NO: 3383454 - RNA, 17 nt, Pseudomonas aeruginosa PA01
cgaagcccagcgccugc

SEQ ID NO: 3383455 - RNA, 19 nt, Pseudomonas aeruginosa PA01
cgaagcccaggcugacccg

SEQ ID NO: 3383456 - RNA, 20 nt, Pseudomonas aeruginosa PA01
cgaagcccgugucgccuucc

SEQ ID NO: 3383457 - RNA, 11 nt, Pseudomonas aeruginosa PA01
cgaagcccugc

SEQ ID NO: 3383458 - RNA, 17 nt, Pseudomonas aeruginosa PA01
cgaagcccugcaaagcg

SEQ ID NO: 3383459 - RNA, 20 nt, Pseudomonas aeruginosa PA01
cgaagccgacgccgagcagc

SEQ ID NO: 3383460 - RNA, 12 nt, Pseudomonas aeruginosa PA01
cgaagccgagcu

SEQ ID NO: 3383461 - RNA, 17 nt, Pseudomonas aeruginosa PA01
cgaagggcacgccgcuc

SEQ ID NO: 3383462 - RNA, 14 nt, Pseudomonas aeruginosa PA01
cgaagggcaggccg

SEQ ID NO: 3383463 - RNA, 18 nt, Pseudomonas aeruginosa PA01
cgaagggcaggccgauca

SEQ ID NO: 3383464 - RNA, 20 nt, Pseudomonas aeruginosa PA01
cgaagggcaggccgaucauc

SEQ ID NO: 3383465 - RNA, 14 nt, Pseudomonas aeruginosa PA01
cgaagggccgcagg

SEQ ID NO: 3383466 - RNA, 18 nt, Pseudomonas aeruginosa PA01
cgaagggcgcuucggcgg

SEQ ID NO: 3383467 - RNA, 23 nt, Pseudomonas aeruginosa PA01
cgaagggcgcuucggcggauaac

SEQ ID NO: 3383468 - RNA, 17 nt, Pseudomonas aeruginosa PA01
cgaagggcucagcccag

SEQ ID NO: 3383469 - RNA, 21 nt, Pseudomonas aeruginosa PA01
cgaagggcucagcccaggcgc

SEQ ID NO: 3383470 - RNA, 22 nt, Pseudomonas aeruginosa PA01
cgaagggcucagcccaggcgcc

SEQ ID NO: 3383471 - RNA, 12 nt, Pseudomonas aeruginosa PA01
cgaaggguuggc

SEQ ID NO: 3383472 - RNA, 22 nt, Pseudomonas aeruginosa PA01
cgaaggguuggccgcagcagcg

SEQ ID NO: 3383473 - RNA, 19 nt, Pseudomonas aeruginosa PA01
cgaagguacugccgcuauc

SEQ ID NO: 3383474 - RNA, 15 nt, Pseudomonas aeruginosa PA01
cgaaggucggcggca

SEQ ID NO: 3383475 - RNA, 18 nt, Pseudomonas aeruginosa PA01
cgaaggucggcggcagcu

SEQ ID NO: 3383476 - RNA, 19 nt, Pseudomonas aeruginosa PA01
cgaaggucugccccggcuu

SEQ ID NO: 3383477 - RNA, 15 nt, Pseudomonas aeruginosa PA01
cgaaggucugcccgu

SEQ ID NO: 3383478 - RNA, 17 nt, Pseudomonas aeruginosa PA01
cgaaggugcaggccgcg

SEQ ID NO: 3383479 - RNA, 17 nt, Pseudomonas aeruginosa PA01
cgaagguggcgaccugg

SEQ ID NO: 3383480 - RNA, 18 nt, Pseudomonas aeruginosa PA01
cgaagguggcgaccuggu

SEQ ID NO: 3383481 - RNA, 15 nt, Pseudomonas aeruginosa PA01
cgaagguuucguccc

SEQ ID NO: 3383482 - RNA, 21 nt, Pseudomonas aeruginosa PA01
cgaaguacucguguuccggca

SEQ ID NO: 3383483 - RNA, 23 nt, Pseudomonas aeruginosa PA01
cgaaguacucguguuccggcagg

SEQ ID NO: 3383484 - RNA, 13 nt, Pseudomonas aeruginosa PA01
cgaaguagaagcg

SEQ ID NO: 3383485 - RNA, 18 nt, Pseudomonas aeruginosa PA01
cgaaguagaagcgcgcgg

SEQ ID NO: 3383486 - RNA, 23 nt, Pseudomonas aeruginosa PA01
cgaaguagcgacggaagcccucg

SEQ ID NO: 3383487 - RNA, 17 nt, Pseudomonas aeruginosa PA01
cgaaguagucgccccgg

SEQ ID NO: 3383488 - RNA, 15 nt, Pseudomonas aeruginosa PA01
cgaaguaucuggguc

SEQ ID NO: 3383489 - RNA, 18 nt, Pseudomonas aeruginosa PA01
cgaaguccaccaggcgcc

SEQ ID NO: 3383490 - RNA, 21 nt, Pseudomonas aeruginosa PA01
cgaaguccaccaggcgccggg

SEQ ID NO: 3383491 - RNA, 20 nt, Pseudomonas aeruginosa PA01
cgaaguccacugucucgccg

SEQ ID NO: 3383492 - RNA, 17 nt, Pseudomonas aeruginosa PA01
cgaaguccugcaacagg

SEQ ID NO: 3383493 - RNA, 20 nt, Pseudomonas aeruginosa PA01
cgaaguccugcaacagggca

SEQ ID NO: 3383494 - RNA, 18 nt, Pseudomonas aeruginosa PA01
cgaaguccugcaggaucg

SEQ ID NO: 3383495 - RNA, 22 nt, Pseudomonas aeruginosa PA01
cgaaguccuugugcugcucgca

SEQ ID NO: 3383496 - RNA, 15 nt, Pseudomonas aeruginosa PA01
cgaagucgccauccu

SEQ ID NO: 3383497 - RNA, 16 nt, Pseudomonas aeruginosa PA01
cgaagucgcccgccgg

SEQ ID NO: 3383498 - RNA, 20 nt, Pseudomonas aeruginosa PA01
cgaagucgccgucguccggg

SEQ ID NO: 3383499 - RNA, 21 nt, Pseudomonas aeruginosa PA01
cgaagucggcgagccggcgca

SEQ ID NO: 3383500 - RNA, 19 nt, Pseudomonas aeruginosa PA01
cgaagucguuguacuggcc

SEQ ID NO: 3383501 - RNA, 17 nt, Pseudomonas aeruginosa PA01
cgaagugaccgcgcgcc

SEQ ID NO: 3383502 - RNA, 13 nt, Pseudomonas aeruginosa PA01
cgaagugcgcugc

SEQ ID NO: 3383503 - RNA, 18 nt, Pseudomonas aeruginosa PA01
cgaaguguuacagcagga

SEQ ID NO: 3383504 - RNA, 15 nt, Pseudomonas aeruginosa PA01
cgaaguucuccagca

SEQ ID NO: 3383505 - RNA, 17 nt, Pseudomonas aeruginosa PA01
cgaaguucuccagcaag

SEQ ID NO: 3383506 - RNA, 20 nt, Pseudomonas aeruginosa PA01
cgaaguucuccagcaagccg

SEQ ID NO: 3383507 - RNA, 16 nt, Pseudomonas aeruginosa PA01
cgaaguugaaacggcg

SEQ ID NO: 3383508 - RNA, 21 nt, Pseudomonas aeruginosa PA01
cgaaguugcaggccagcgcca

SEQ ID NO: 3383509 - RNA, 14 nt, Pseudomonas aeruginosa PA01
cgaaguugccgccg

SEQ ID NO: 3383510 - RNA, 16 nt, Pseudomonas aeruginosa PA01
cgaaguugccgccgcu

SEQ ID NO: 3383511 - RNA, 18 nt, Pseudomonas aeruginosa PA01
cgaaguugccgccgcugg

SEQ ID NO: 3383512 - RNA, 20 nt, Pseudomonas aeruginosa PA01
cgaaguugccgccgcuggcc

SEQ ID NO: 3383513 - RNA, 22 nt, Pseudomonas aeruginosa PA01
cgaaguugccgccgcuggccug

SEQ ID NO: 3383514 - RNA, 15 nt, Pseudomonas aeruginosa PA01
cgaaguuggcggccg

SEQ ID NO: 3383515 - RNA, 18 nt, Pseudomonas aeruginosa PA01
cgaaguuggcggccgacg

SEQ ID NO: 3383516 - RNA, 13 nt, Pseudomonas aeruginosa PA01
cgaauaaccgcau

SEQ ID NO: 3383517 - RNA, 19 nt, Pseudomonas aeruginosa PA01
cgaauaaccgcaucgcggu

SEQ ID NO: 3383518 - RNA, 20 nt, Pseudomonas aeruginosa PA01
cgaauaaccgcucgcgguua

SEQ ID NO: 3383519 - RNA, 18 nt, Pseudomonas aeruginosa PA01
cgaauaacgccacaggcg

SEQ ID NO: 3383520 - RNA, 22 nt, Pseudomonas aeruginosa PA01
cgaauacccgguugccgaucag

SEQ ID NO: 3383521 - RNA, 14 nt, Pseudomonas aeruginosa PA01
cgaauaccggagcg

SEQ ID NO: 3383522 - RNA, 13 nt, Pseudomonas aeruginosa PA01
cgaauagccggcg

SEQ ID NO: 3383523 - RNA, 21 nt, Pseudomonas aeruginosa PA01
cgaauagcgccgcaggcgcua

SEQ ID NO: 3383524 - RNA, 21 nt, Pseudomonas aeruginosa PA01
cgaauagcgccgcgggcgcua

SEQ ID NO: 3383525 - RNA, 17 nt, Pseudomonas aeruginosa PA01
cgaauaggcgaucuccg

SEQ ID NO: 3383526 - RNA, 21 nt, Pseudomonas aeruginosa PA01
cgaauagggcggcgccaccgc

SEQ ID NO: 3383527 - RNA, 20 nt, Pseudomonas aeruginosa PA01
cgaauauccucgucgauccg

SEQ ID NO: 3383528 - RNA, 21 nt, Pseudomonas aeruginosa PA01
cgaauauccucgucgauccgc

SEQ ID NO: 3383529 - RNA, 17 nt, Pseudomonas aeruginosa PA01
cgaauaucgcggcgcga

SEQ ID NO: 3383530 - RNA, 18 nt, Pseudomonas aeruginosa PA01
cgaauccagcaacaccgg

SEQ ID NO: 3383531 - RNA, 15 nt, Pseudomonas aeruginosa PA01
cgaauccaggccgac

SEQ ID NO: 3383532 - RNA, 18 nt, Pseudomonas aeruginosa PA01
cgaaucccuuggcugcuc

SEQ ID NO: 3383533 - RNA, 14 nt, Pseudomonas aeruginosa PA01
cgaauccgccggcg

SEQ ID NO: 3383534 - RNA, 22 nt, Pseudomonas aeruginosa PA01
cgaauccgcggcccugcucgcc

SEQ ID NO: 3383535 - RNA, 20 nt, Pseudomonas aeruginosa PA01
cgaauccggucggacuccgc

SEQ ID NO: 3383536 - RNA, 21 nt, Pseudomonas aeruginosa PA01
cgaauccggucggacuccgcc

SEQ ID NO: 3383537 - RNA, 13 nt, Pseudomonas aeruginosa PA01
cgaauccuccagc

SEQ ID NO: 3383538 - RNA, 14 nt, Pseudomonas aeruginosa PA01
cgaauccuccagcc

SEQ ID NO: 3383539 - RNA, 15 nt, Pseudomonas aeruginosa PA01
cgaauccuugaucac

SEQ ID NO: 3383540 - RNA, 22 nt, Pseudomonas aeruginosa PA01
cgaaucgaugcuguaguugacg

SEQ ID NO: 3383541 - RNA, 20 nt, Pseudomonas aeruginosa PA01
cgaaucgccuaccagaccgc

SEQ ID NO: 3383542 - RNA, 13 nt, Pseudomonas aeruginosa PA01
cgaaucggcgcac

SEQ ID NO: 3383543 - RNA, 17 nt, Pseudomonas aeruginosa PA01
cgaaucgucgccggagg

SEQ ID NO: 3383544 - RNA, 18 nt, Pseudomonas aeruginosa PA01
cgaaucuucggcgcgccg

SEQ ID NO: 3383545 - RNA, 13 nt, Pseudomonas aeruginosa PA01
cgaaugcccggca

SEQ ID NO: 3383546 - RNA, 16 nt, Pseudomonas aeruginosa PA01
cgaaugcccggcagcg

SEQ ID NO: 3383547 - RNA, 18 nt, Pseudomonas aeruginosa PA01
cgaaugcccgugcgcugc

SEQ ID NO: 3383548 - RNA, 19 nt, Pseudomonas aeruginosa PA01
cgaaugcuugccggcgccu

SEQ ID NO: 3383549 - RNA, 20 nt, Pseudomonas aeruginosa PA01
cgaauggagggaucgcgcgg

SEQ ID NO: 3383550 - RNA, 23 nt, Pseudomonas aeruginosa PA01
cgaauggcagcaggcacagggcg

SEQ ID NO: 3383551 - RNA, 20 nt, Pseudomonas aeruginosa PA01
cgaauggcauucagcucgau

SEQ ID NO: 3383552 - RNA, 19 nt, Pseudomonas aeruginosa PA01
cgaaugugaauaacguguu

SEQ ID NO: 3383553 - RNA, 17 nt, Pseudomonas aeruginosa PA01
cgaauucgucgccgccg

SEQ ID NO: 3383554 - RNA, 16 nt, Pseudomonas aeruginosa PA01
cgaauuggacagcagg

SEQ ID NO: 3383555 - RNA, 21 nt, Pseudomonas aeruginosa PA01
cgaauuggacagcaggcugcc

SEQ ID NO: 3383556 - RNA, 22 nt, Pseudomonas aeruginosa PA01
cgaauuggacagcaggcugccg

SEQ ID NO: 3383557 - RNA, 21 nt, Pseudomonas aeruginosa PA01
cgaauuuccugcuggcgagcg

SEQ ID NO: 3383558 - RNA, 20 nt, Pseudomonas aeruginosa PA01
cgacaacgaaaagagccgcg

SEQ ID NO: 3383559 - RNA, 23 nt, Pseudomonas aeruginosa PA01
cgacaacgaaaagagccgcgccu

SEQ ID NO: 3383560 - RNA, 16 nt, Pseudomonas aeruginosa PA01
cgacaagccuccagcg

SEQ ID NO: 3383561 - RNA, 17 nt, Pseudomonas aeruginosa PA01
cgacaagccuccagcgc

SEQ ID NO: 3383562 - RNA, 19 nt, Pseudomonas aeruginosa PA01
cgacaaggagacucagcgc

SEQ ID NO: 3383563 - RNA, 20 nt, Pseudomonas aeruginosa PA01
cgaccacucgcgagauggcg

SEQ ID NO: 3383564 - RNA, 15 nt, Pseudomonas aeruginosa PA01
cgaccacuuccaggu

SEQ ID NO: 3383565 - RNA, 19 nt, Pseudomonas aeruginosa PA01
cgaccacuuccagguagcc

SEQ ID NO: 3383566 - RNA, 23 nt, Pseudomonas aeruginosa PA01
cgaccacuucggcgguggggccg

SEQ ID NO: 3383567 - RNA, 14 nt, Pseudomonas aeruginosa PA01
cgaccacuuuccac

SEQ ID NO: 3383568 - RNA, 14 nt, Pseudomonas aeruginosa PA01
cgaccagacgcagc

SEQ ID NO: 3383569 - RNA, 20 nt, Pseudomonas aeruginosa PA01
cgaccagaucggcauggccg

SEQ ID NO: 3383570 - RNA, 14 nt, Pseudomonas aeruginosa PA01
cgaccagcacggcg

SEQ ID NO: 3383571 - RNA, 13 nt, Pseudomonas aeruginosa PA01
cgaccagcagggc

SEQ ID NO: 3383572 - RNA, 15 nt, Pseudomonas aeruginosa PA01
cgaccagcagggcca

SEQ ID NO: 3383573 - RNA, 16 nt, Pseudomonas aeruginosa PA01
cgaccagcagggccag

SEQ ID NO: 3383574 - RNA, 18 nt, Pseudomonas aeruginosa PA01
cgaccagcagggccagca

SEQ ID NO: 3383575 - RNA, 20 nt, Pseudomonas aeruginosa PA01
cgaccagcagggccagcagc

SEQ ID NO: 3383576 - RNA, 21 nt, Pseudomonas aeruginosa PA01
cgaccagcagggccagcagcg

SEQ ID NO: 3383577 - RNA, 14 nt, Pseudomonas aeruginosa PA01
cgaccagcccgcgc

SEQ ID NO: 3383578 - RNA, 12 nt, Pseudomonas aeruginosa PA01
cgaccagccggg

SEQ ID NO: 3383579 - RNA, 12 nt, Pseudomonas aeruginosa PA01
cgaccagcgcca

SEQ ID NO: 3383580 - RNA, 17 nt, Pseudomonas aeruginosa PA01
cgaccagcgccaggcgc

SEQ ID NO: 3383581 - RNA, 13 nt, Pseudomonas aeruginosa PA01
cgaccagcgccga

SEQ ID NO: 3383582 - RNA, 16 nt, Pseudomonas aeruginosa PA01
cgaccagcgccgacuu

SEQ ID NO: 3383583 - RNA, 18 nt, Pseudomonas aeruginosa PA01
cgaccagcgccgcggcga

SEQ ID NO: 3383584 - RNA, 12 nt, Pseudomonas aeruginosa PA01
cgaccagcgcgc

SEQ ID NO: 3383585 - RNA, 14 nt, Pseudomonas aeruginosa PA01
cgaccagcggcggu

SEQ ID NO: 3383586 - RNA, 22 nt, Pseudomonas aeruginosa PA01
cgaccagcggcgguagcuccag

SEQ ID NO: 3383587 - RNA, 15 nt, Pseudomonas aeruginosa PA01
cgaccagcgucgcgc

SEQ ID NO: 3383588 - RNA, 20 nt, Pseudomonas aeruginosa PA01
cgaccagcgucgcgcgugcc

SEQ ID NO: 3383589 - RNA, 21 nt, Pseudomonas aeruginosa PA01
cgaccagcgucgcgcgugccc

SEQ ID NO: 3383590 - RNA, 23 nt, Pseudomonas aeruginosa PA01
cgaccagcgucgcgcgugccccg

SEQ ID NO: 3383591 - RNA, 20 nt, Pseudomonas aeruginosa PA01
cgaccagcucgaagccgccg

SEQ ID NO: 3383592 - RNA, 21 nt, Pseudomonas aeruginosa PA01
cgaccagcucgaagccgccgu

SEQ ID NO: 3383593 - RNA, 21 nt, Pseudomonas aeruginosa PA01
cgaccaggaauuccuggccgg

SEQ ID NO: 3383594 - RNA, 23 nt, Pseudomonas aeruginosa PA01
cgaccaggaauuccuggccggug

SEQ ID NO: 3383595 - RNA, 13 nt, Pseudomonas aeruginosa PA01
cgaccaggacagc

SEQ ID NO: 3383596 - RNA, 13 nt, Pseudomonas aeruginosa PA01
cgaccaggccgau

SEQ ID NO: 3383597 - RNA, 19 nt, Pseudomonas aeruginosa PA01
cgaccaggccguaggcgau

SEQ ID NO: 3383598 - RNA, 19 nt, Pseudomonas aeruginosa PA01
cgaccaggcguuccaccag

SEQ ID NO: 3383599 - RNA, 22 nt, Pseudomonas aeruginosa PA01
cgaccagggcauccagggucgc

SEQ ID NO: 3383600 - RNA, 15 nt, Pseudomonas aeruginosa PA01
cgaccagggccgggu

SEQ ID NO: 3383601 - RNA, 19 nt, Pseudomonas aeruginosa PA01
cgaccagguccggcagcgc

SEQ ID NO: 3383602 - RNA, 20 nt, Pseudomonas aeruginosa PA01
cgaccagguccggcagcgcc

SEQ ID NO: 3383603 - RNA, 21 nt, Pseudomonas aeruginosa PA01
cgaccagguccggcagcgccu

SEQ ID NO: 3383604 - RNA, 13 nt, Pseudomonas aeruginosa PA01
cgaccaggucgcc

SEQ ID NO: 3383605 - RNA, 18 nt, Pseudomonas aeruginosa PA01
cgaccaggucgcuggcac

SEQ ID NO: 3383606 - RNA, 13 nt, Pseudomonas aeruginosa PA01
cgaccaggugcug

SEQ ID NO: 3383607 - RNA, 15 nt, Pseudomonas aeruginosa PA01
cgaccaguaccagca

SEQ ID NO: 3383608 - RNA, 17 nt, Pseudomonas aeruginosa PA01
cgaccaguaccagcaau

SEQ ID NO: 3383609 - RNA, 21 nt, Pseudomonas aeruginosa PA01
cgaccaguugcucgcuccgag

SEQ ID NO: 3383610 - RNA, 14 nt, Pseudomonas aeruginosa PA01
cgaccaucaccagc

SEQ ID NO: 3383611 - RNA, 15 nt, Pseudomonas aeruginosa PA01
cgaccaucaccagcg

SEQ ID NO: 3383612 - RNA, 16 nt, Pseudomonas aeruginosa PA01
cgaccaucaccagcgc

SEQ ID NO: 3383613 - RNA, 18 nt, Pseudomonas aeruginosa PA01
cgaccaucaccagcgccg

SEQ ID NO: 3383614 - RNA, 15 nt, Pseudomonas aeruginosa PA01
cgaccaucauccgcg

SEQ ID NO: 3383615 - RNA, 20 nt, Pseudomonas aeruginosa PA01
cgaccaucauccgcguggcg

SEQ ID NO: 3383616 - RNA, 13 nt, Pseudomonas aeruginosa PA01
cgaccaucggcgg

SEQ ID NO: 3383617 - RNA, 20 nt, Pseudomonas aeruginosa PA01
cgaccaucggcggcggcccg

SEQ ID NO: 3383618 - RNA, 20 nt, Pseudomonas aeruginosa PA01
cgaccaugccguagaucagg

SEQ ID NO: 3383619 - RNA, 18 nt, Pseudomonas aeruginosa PA01
cgaccaugguguuggcgg

SEQ ID NO: 3383620 - RNA, 17 nt, Pseudomonas aeruginosa PA01
cgaccauguucaccagc

SEQ ID NO: 3383621 - RNA, 20 nt, Pseudomonas aeruginosa PA01
cgaccauguucaccagcgcu

SEQ ID NO: 3383622 - RNA, 15 nt, Pseudomonas aeruginosa PA01
cgacccagaccugcc

SEQ ID NO: 3383623 - RNA, 16 nt, Pseudomonas aeruginosa PA01
cgacccagaccugccg

SEQ ID NO: 3383624 - RNA, 17 nt, Pseudomonas aeruginosa PA01
cgacccagaccugccgc

SEQ ID NO: 3383625 - RNA, 19 nt, Pseudomonas aeruginosa PA01
cgacccagaccugccgccc

SEQ ID NO: 3383626 - RNA, 22 nt, Pseudomonas aeruginosa PA01
cgacccagaccugccgcccggc

SEQ ID NO: 3383627 - RNA, 13 nt, Pseudomonas aeruginosa PA01
cgacccagagcgc

SEQ ID NO: 3383628 - RNA, 17 nt, Pseudomonas aeruginosa PA01
cgacccagagcgcgccc

SEQ ID NO: 3383629 - RNA, 13 nt, Pseudomonas aeruginosa PA01
cgacccagccgca

SEQ ID NO: 3383630 - RNA, 17 nt, Pseudomonas aeruginosa PA01
cgacccagccgcacgcc

SEQ ID NO: 3383631 - RNA, 14 nt, Pseudomonas aeruginosa PA01
cgacccagcgcugg

SEQ ID NO: 3383632 - RNA, 14 nt, Pseudomonas aeruginosa PA01
cgacccaggccgac

SEQ ID NO: 3383633 - RNA, 15 nt, Pseudomonas aeruginosa PA01
cgacccaggccgaca

SEQ ID NO: 3383634 - RNA, 21 nt, Pseudomonas aeruginosa PA01
cgacccaggccgacagcggcu

SEQ ID NO: 3383635 - RNA, 16 nt, Pseudomonas aeruginosa PA01
cgacccaucgccgaag

SEQ ID NO: 3383636 - RNA, 17 nt, Pseudomonas aeruginosa PA01
cgacccaugccgcuagc

SEQ ID NO: 3383637 - RNA, 13 nt, Pseudomonas aeruginosa PA01
cgaccccacgccg

SEQ ID NO: 3383638 - RNA, 14 nt, Pseudomonas aeruginosa PA01
cgaccccacgccgg

SEQ ID NO: 3383639 - RNA, 17 nt, Pseudomonas aeruginosa PA01
cgaccccacgccggccg

SEQ ID NO: 3383640 - RNA, 20 nt, Pseudomonas aeruginosa PA01
cgaccccacgccggccggcu

SEQ ID NO: 3383641 - RNA, 21 nt, Pseudomonas aeruginosa PA01
cgaccccacgccggccggcuc

SEQ ID NO: 3383642 - RNA, 13 nt, Pseudomonas aeruginosa PA01
cgaccccgccggg

SEQ ID NO: 3383643 - RNA, 14 nt, Pseudomonas aeruginosa PA01
cgacccgcagcggc

SEQ ID NO: 3383644 - RNA, 14 nt, Pseudomonas aeruginosa PA01
cgacccgcaggccg

SEQ ID NO: 3383645 - RNA, 18 nt, Pseudomonas aeruginosa PA01
cgacccgcaggccggcca

SEQ ID NO: 3383646 - RNA, 16 nt, Pseudomonas aeruginosa PA01
cgacccgcccgccguc

SEQ ID NO: 3383647 - RNA, 22 nt, Pseudomonas aeruginosa PA01
cgacccgccgaccagcacggcg

SEQ ID NO: 3383648 - RNA, 23 nt, Pseudomonas aeruginosa PA01
cgacccgccguucgcccgccaug

SEQ ID NO: 3383649 - RNA, 14 nt, Pseudomonas aeruginosa PA01
cgacccgcuccgga

SEQ ID NO: 3383650 - RNA, 19 nt, Pseudomonas aeruginosa PA01
cgacccgcuccggacucgc

SEQ ID NO: 3383651 - RNA, 13 nt, Pseudomonas aeruginosa PA01
cgacccgcugaag

SEQ ID NO: 3383652 - RNA, 23 nt, Pseudomonas aeruginosa PA01
cgacccgcuugagccauucggcu

SEQ ID NO: 3383653 - RNA, 13 nt, Pseudomonas aeruginosa PA01
cgacccgggucag

SEQ ID NO: 3383654 - RNA, 18 nt, Pseudomonas aeruginosa PA01
cgacccgggucaggccga

SEQ ID NO: 3383655 - RNA, 19 nt, Pseudomonas aeruginosa PA01
cgacccgggucaggccgag

SEQ ID NO: 3383656 - RNA, 17 nt, Pseudomonas aeruginosa PA01
cgacccgguuaccggcg

SEQ ID NO: 3383657 - RNA, 20 nt, Pseudomonas aeruginosa PA01
cgacccgguuaccggcgacc

SEQ ID NO: 3383658 - RNA, 16 nt, Pseudomonas aeruginosa PA01
cgacccgugcgccgcg

SEQ ID NO: 3383659 - RNA, 12 nt, Pseudomonas aeruginosa PA01
cgacccucggcg

SEQ ID NO: 3383660 - RNA, 13 nt, Pseudomonas aeruginosa PA01
cgacccucggcga

SEQ ID NO: 3383661 - RNA, 15 nt, Pseudomonas aeruginosa PA01
cgacccugcuggccg

SEQ ID NO: 3383662 - RNA, 18 nt, Pseudomonas aeruginosa PA01
cgacccugcuggccggug

SEQ ID NO: 3383663 - RNA, 14 nt, Pseudomonas aeruginosa PA01
cgacccuggccgcg

SEQ ID NO: 3383664 - RNA, 17 nt, Pseudomonas aeruginosa PA01
cgacccuggccgcgcgg

SEQ ID NO: 3383665 - RNA, 14 nt, Pseudomonas aeruginosa PA01
cgacccuggcgccg

SEQ ID NO: 3383666 - RNA, 21 nt, Pseudomonas aeruginosa PA01
cgacgaaauagucgcgggccu

SEQ ID NO: 3383667 - RNA, 23 nt, Pseudomonas aeruginosa PA01
cgacgaaauagucgcgggccugg

SEQ ID NO: 3383668 - RNA, 15 nt, Pseudomonas aeruginosa PA01
cgacgaacggaucgc

SEQ ID NO: 3383669 - RNA, 14 nt, Pseudomonas aeruginosa PA01
cgacgaacggcgcu

SEQ ID NO: 3383670 - RNA, 15 nt, Pseudomonas aeruginosa PA01
cgacgaacucgacgc

SEQ ID NO: 3383671 - RNA, 19 nt, Pseudomonas aeruginosa PA01
cgacgaacucgacgcgcca

SEQ ID NO: 3383672 - RNA, 20 nt, Pseudomonas aeruginosa PA01
cgacgaacucgacgcgccag

SEQ ID NO: 3383673 - RNA, 20 nt, Pseudomonas aeruginosa PA01
cgacgaagaccuugaacucg

SEQ ID NO: 3383674 - RNA, 15 nt, Pseudomonas aeruginosa PA01
cgacgaagacgcugc

SEQ ID NO: 3383675 - RNA, 13 nt, Pseudomonas aeruginosa PA01
cgacgaagcccuc

SEQ ID NO: 3383676 - RNA, 18 nt, Pseudomonas aeruginosa PA01
cgacgaagcccucgcgac

SEQ ID NO: 3383677 - RNA, 19 nt, Pseudomonas aeruginosa PA01
cgacgaagcccucgcgacg

SEQ ID NO: 3383678 - RNA, 21 nt, Pseudomonas aeruginosa PA01
cgacgaagcccucgcgacggc

SEQ ID NO: 3383679 - RNA, 22 nt, Pseudomonas aeruginosa PA01
cgacgaagcccucgcgacggca

SEQ ID NO: 3383680 - RNA, 15 nt, Pseudomonas aeruginosa PA01
cgacgaagcgccggc

SEQ ID NO: 3383681 - RNA, 16 nt, Pseudomonas aeruginosa PA01
cgacgaagcgccggcg

SEQ ID NO: 3383682 - RNA, 19 nt, Pseudomonas aeruginosa PA01
cgacgaaggccgcggucgg

SEQ ID NO: 3383683 - RNA, 14 nt, Pseudomonas aeruginosa PA01
cgacgaaggcgcgc

SEQ ID NO: 3383684 - RNA, 13 nt, Pseudomonas aeruginosa PA01
cgacgaaggucgg

SEQ ID NO: 3383685 - RNA, 17 nt, Pseudomonas aeruginosa PA01
cgacgaaggucggcggc

SEQ ID NO: 3383686 - RNA, 18 nt, Pseudomonas aeruginosa PA01
cgacgaaggucggcggca

SEQ ID NO: 3383687 - RNA, 16 nt, Pseudomonas aeruginosa PA01
cgacgaagugaccgcg

SEQ ID NO: 3383688 - RNA, 20 nt, Pseudomonas aeruginosa PA01
cgacgaagugaccgcgcgcc

SEQ ID NO: 3383689 - RNA, 21 nt, Pseudomonas aeruginosa PA01
cgacgaagugaccgcgcgcca

SEQ ID NO: 3383690 - RNA, 22 nt, Pseudomonas aeruginosa PA01
cgacgaaguugcaggccagcgc

SEQ ID NO: 3383691 - RNA, 23 nt, Pseudomonas aeruginosa PA01
cgacgaaguugcaggccagcgcc

SEQ ID NO: 3383692 - RNA, 23 nt, Pseudomonas aeruginosa PA01
cgacgacaccugcaacgcccgcg

SEQ ID NO: 3383693 - RNA, 19 nt, Pseudomonas aeruginosa PA01
cgacgacgaaaggccgcgc

SEQ ID NO: 3383694 - RNA, 22 nt, Pseudomonas aeruginosa PA01
cgacgacgaaaggccgcgccgg

SEQ ID NO: 3383695 - RNA, 23 nt, Pseudomonas aeruginosa PA01
cgacgacgaaaggccgcgccgga

SEQ ID NO: 3383696 - RNA, 14 nt, Pseudomonas aeruginosa PA01
cgacgacgaucccg

SEQ ID NO: 3383697 - RNA, 16 nt, Pseudomonas aeruginosa PA01
cgacgacgaucccggc

SEQ ID NO: 3383698 - RNA, 15 nt, Pseudomonas aeruginosa PA01
cgacgacugcggcag

SEQ ID NO: 3383699 - RNA, 20 nt, Pseudomonas aeruginosa PA01
cgacgacuugcccaccccgg

SEQ ID NO: 3383700 - RNA, 13 nt, Pseudomonas aeruginosa PA01
cgacgagcagcuc

SEQ ID NO: 3383701 - RNA, 16 nt, Pseudomonas aeruginosa PA01
cgacgagcagcucgcc

SEQ ID NO: 3383702 - RNA, 21 nt, Pseudomonas aeruginosa PA01
cgacgagcagcucgccggcgu

SEQ ID NO: 3383703 - RNA, 13 nt, Pseudomonas aeruginosa PA01
cgacgagccgcga

SEQ ID NO: 3383704 - RNA, 15 nt, Pseudomonas aeruginosa PA01
cgacgagccgcgacg

SEQ ID NO: 3383705 - RNA, 18 nt, Pseudomonas aeruginosa PA01
cgacgagccgcgacgcga

SEQ ID NO: 3383706 - RNA, 19 nt, Pseudomonas aeruginosa PA01
cgacgagccggacggcggc

SEQ ID NO: 3383707 - RNA, 20 nt, Pseudomonas aeruginosa PA01
cgacgagccggacggcggcg

SEQ ID NO: 3383708 - RNA, 21 nt, Pseudomonas aeruginosa PA01
cgacgagccggacggcggcgu

SEQ ID NO: 3383709 - RNA, 13 nt, Pseudomonas aeruginosa PA01
cgacgaggcgcgg

SEQ ID NO: 3383710 - RNA, 18 nt, Pseudomonas aeruginosa PA01
cgacgagguugcucuggg

SEQ ID NO: 3383711 - RNA, 21 nt, Pseudomonas aeruginosa PA01
cgacgaguaaaacggcaggca

SEQ ID NO: 3383712 - RNA, 17 nt, Pseudomonas aeruginosa PA01
cgacgauauccacgccg

SEQ ID NO: 3383713 - RNA, 13 nt, Pseudomonas aeruginosa PA01
cgacgaucagccc

SEQ ID NO: 3383714 - RNA, 17 nt, Pseudomonas aeruginosa PA01
cgacgaucagcccgccg

SEQ ID NO: 3383715 - RNA, 20 nt, Pseudomonas aeruginosa PA01
cgacgaucagcccgccggcg

SEQ ID NO: 3383716 - RNA, 16 nt, Pseudomonas aeruginosa PA01
cgacgauccggccgau

SEQ ID NO: 3383717 - RNA, 13 nt, Pseudomonas aeruginosa PA01
cgacgaugccgcc

SEQ ID NO: 3383718 - RNA, 14 nt, Pseudomonas aeruginosa PA01
cgacgaugccgccg

SEQ ID NO: 3383719 - RNA, 15 nt, Pseudomonas aeruginosa PA01
cgacgaugccgccgc

SEQ ID NO: 3383720 - RNA, 19 nt, Pseudomonas aeruginosa PA01
cgacgaugcgccccagcgc

SEQ ID NO: 3383721 - RNA, 23 nt, Pseudomonas aeruginosa PA01
cgacgaugcucgguugccaggcc

SEQ ID NO: 3383722 - RNA, 23 nt, Pseudomonas aeruginosa PA01
cgacgaugugagaguccuugucc

SEQ ID NO: 3383723 - RNA, 19 nt, Pseudomonas aeruginosa PA01
cgacgauguucgaggcgcc

SEQ ID NO: 3383724 - RNA, 23 nt, Pseudomonas aeruginosa PA01
cgacgauguucgaggcgccgacc

SEQ ID NO: 3383725 - RNA, 24 nt, Pseudomonas aeruginosa PA01
cgacgauguucgaggcgccgacca

SEQ ID NO: 3383726 - RNA, 21 nt, Pseudomonas aeruginosa PA01
cgacgauguuguugcccacca

SEQ ID NO: 3383727 - RNA, 14 nt, Pseudomonas aeruginosa PA01
cgacgcagagcgcc

SEQ ID NO: 3383728 - RNA, 18 nt, Pseudomonas aeruginosa PA01
cgacgcagagcgccauga

SEQ ID NO: 3383729 - RNA, 14 nt, Pseudomonas aeruginosa PA01
cgacgcagcacggc

SEQ ID NO: 3383730 - RNA, 15 nt, Pseudomonas aeruginosa PA01
cgacgcagccgggcc

SEQ ID NO: 3383731 - RNA, 17 nt, Pseudomonas aeruginosa PA01
cgacgcagccgggccgc

SEQ ID NO: 3383732 - RNA, 22 nt, Pseudomonas aeruginosa PA01
cgacgcagccgggccgcagcgc

SEQ ID NO: 3383733 - RNA, 14 nt, Pseudomonas aeruginosa PA01
cgacgcaucgacgg

SEQ ID NO: 3383734 - RNA, 12 nt, Pseudomonas aeruginosa PA01
cgacgccacccg

SEQ ID NO: 3383735 - RNA, 13 nt, Pseudomonas aeruginosa PA01
cgacgccacccgc

SEQ ID NO: 3383736 - RNA, 14 nt, Pseudomonas aeruginosa PA01
cgacgccagcggcg

SEQ ID NO: 3383737 - RNA, 11 nt, Pseudomonas aeruginosa PA01
cgacgccagcu

SEQ ID NO: 3383738 - RNA, 15 nt, Pseudomonas aeruginosa PA01
cgacgccagcucggc

SEQ ID NO: 3383739 - RNA, 13 nt, Pseudomonas aeruginosa PA01
cgacgccauggcg

SEQ ID NO: 3383740 - RNA, 18 nt, Pseudomonas aeruginosa PA01
cgacgccauggcgcuuca

SEQ ID NO: 3383741 - RNA, 17 nt, Pseudomonas aeruginosa PA01
cgacgccauggguggaa

SEQ ID NO: 3383742 - RNA, 19 nt, Pseudomonas aeruginosa PA01
cgacgccauggguggaacc

SEQ ID NO: 3383743 - RNA, 19 nt, Pseudomonas aeruginosa PA01
cgacgcccgcagccagccu

SEQ ID NO: 3383744 - RNA, 19 nt, Pseudomonas aeruginosa PA01
cgacgcccgcuugcgccgc

SEQ ID NO: 3383745 - RNA, 21 nt, Pseudomonas aeruginosa PA01
cgacgcccgcuugcgccgccu

SEQ ID NO: 3383746 - RNA, 14 nt, Pseudomonas aeruginosa PA01
cgacgcccuccagc

SEQ ID NO: 3383747 - RNA, 16 nt, Pseudomonas aeruginosa PA01
cgacgcccuccagcac

SEQ ID NO: 3383748 - RNA, 17 nt, Pseudomonas aeruginosa PA01
cgacgcccuccagcacc

SEQ ID NO: 3383749 - RNA, 12 nt, Pseudomonas aeruginosa PA01
cgacgcccucgg

SEQ ID NO: 3383750 - RNA, 15 nt, Pseudomonas aeruginosa PA01
cgacgcccucggcga

SEQ ID NO: 3383751 - RNA, 19 nt, Pseudomonas aeruginosa PA01
cgacgcccucggcgacgag

SEQ ID NO: 3383752 - RNA, 23 nt, Pseudomonas aeruginosa PA01
cgacgcccucggcgacgaggacg

SEQ ID NO: 3383753 - RNA, 15 nt, Pseudomonas aeruginosa PA01
cgacgcccuggcgcu

SEQ ID NO: 3383754 - RNA, 15 nt, Pseudomonas aeruginosa PA01
cgacgcccugggcga

SEQ ID NO: 3383755 - RNA, 20 nt, Pseudomonas aeruginosa PA01
cgacgcccuugcggcgcggc

SEQ ID NO: 3383756 - RNA, 21 nt, Pseudomonas aeruginosa PA01
cgacgcccuugcggcgcggcc

SEQ ID NO: 3383757 - RNA, 13 nt, Pseudomonas aeruginosa PA01
cgacgccgaagcc

SEQ ID NO: 3383758 - RNA, 17 nt, Pseudomonas aeruginosa PA01
cgacgccgaaggacagg

SEQ ID NO: 3383759 - RNA, 13 nt, Pseudomonas aeruginosa PA01
cgacgccgagcag

SEQ ID NO: 3383760 - RNA, 17 nt, Pseudomonas aeruginosa PA01
cgacgccgagcagcacc

SEQ ID NO: 3383761 - RNA, 12 nt, Pseudomonas aeruginosa PA01
cgacgccgagcc

SEQ ID NO: 3383762 - RNA, 14 nt, Pseudomonas aeruginosa PA01
cgacgccgagccag

SEQ ID NO: 3383763 - RNA, 20 nt, Pseudomonas aeruginosa PA01
cgacgccgagccagccgcgg

SEQ ID NO: 3383764 - RNA, 22 nt, Pseudomonas aeruginosa PA01
cgacgccgagcugaccaccagg

SEQ ID NO: 3383765 - RNA, 11 nt, Pseudomonas aeruginosa PA01
cgacgccgaug

SEQ ID NO: 3383766 - RNA, 13 nt, Pseudomonas aeruginosa PA01
cgacgccgcccgg

SEQ ID NO: 3383767 - RNA, 17 nt, Pseudomonas aeruginosa PA01
cgacgccgcccggcacc

SEQ ID NO: 3383768 - RNA, 19 nt, Pseudomonas aeruginosa PA01
cgacgccgcccggcaccgg

SEQ ID NO: 3383769 - RNA, 21 nt, Pseudomonas aeruginosa PA01
cgacgucauaggccuuggcga

SEQ ID NO: 3383770 - RNA, 23 nt, Pseudomonas aeruginosa PA01
cgacgucauaggccuuggcgauc

SEQ ID NO: 3383771 - RNA, 20 nt, Pseudomonas aeruginosa PA01
cgacguccacugcguccugg

SEQ ID NO: 3383772 - RNA, 21 nt, Pseudomonas aeruginosa PA01
cgacguccacugcguccuggu

SEQ ID NO: 3383773 - RNA, 22 nt, Pseudomonas aeruginosa PA01
cgacguccacugcguccugguc

SEQ ID NO: 3383774 - RNA, 20 nt, Pseudomonas aeruginosa PA01
cgacguccaucagcgucugc

SEQ ID NO: 3383775 - RNA, 16 nt, Pseudomonas aeruginosa PA01
cgacgucccuuccccg

SEQ ID NO: 3383776 - RNA, 17 nt, Pseudomonas aeruginosa PA01
cgacguccuccaggacc

SEQ ID NO: 3383777 - RNA, 18 nt, Pseudomonas aeruginosa PA01
cgacguccuccaggacca

SEQ ID NO: 3383778 - RNA, 14 nt, Pseudomonas aeruginosa PA01
cgacguccugcggg

SEQ ID NO: 3383779 - RNA, 14 nt, Pseudomonas aeruginosa PA01
cgacgucgacuucg

SEQ ID NO: 3383780 - RNA, 14 nt, Pseudomonas aeruginosa PA01
cgacgucgaucuug

SEQ ID NO: 3383781 - RNA, 17 nt, Pseudomonas aeruginosa PA01
cgacgucgccccagccu

SEQ ID NO: 3383782 - RNA, 14 nt, Pseudomonas aeruginosa PA01
cgacgucggcggcg

SEQ ID NO: 3383783 - RNA, 15 nt, Pseudomonas aeruginosa PA01
cgacgucggcggcgg

SEQ ID NO: 3383784 - RNA, 17 nt, Pseudomonas aeruginosa PA01
cgacgucguggauaggc

SEQ ID NO: 3383785 - RNA, 20 nt, Pseudomonas aeruginosa PA01
cgacgugcaaaugcgcaacg

SEQ ID NO: 3383786 - RNA, 15 nt, Pseudomonas aeruginosa PA01
cgacguucugcucgc

SEQ ID NO: 3383787 - RNA, 14 nt, Pseudomonas aeruginosa PA01
cgacguugcaauug

SEQ ID NO: 3383788 - RNA, 22 nt, Pseudomonas aeruginosa PA01
cgacguugcgcaggggcgcggc

SEQ ID NO: 3383789 - RNA, 15 nt, Pseudomonas aeruginosa PA01
cgacucacccgcugc

SEQ ID NO: 3383790 - RNA, 14 nt, Pseudomonas aeruginosa PA01
cgacuccagccagg

SEQ ID NO: 3383791 - RNA, 15 nt, Pseudomonas aeruginosa PA01
cgacuccagccaggc

SEQ ID NO: 3383792 - RNA, 13 nt, Pseudomonas aeruginosa PA01
cgacuccagcuuc

SEQ ID NO: 3383793 - RNA, 14 nt, Pseudomonas aeruginosa PA01
cgacuccagcuucu

SEQ ID NO: 3383794 - RNA, 19 nt, Pseudomonas aeruginosa PA01
cgacucgaagcucuucgcc

SEQ ID NO: 3383795 - RNA, 15 nt, Pseudomonas aeruginosa PA01
cgacucgagcaccac

SEQ ID NO: 3383796 - RNA, 16 nt, Pseudomonas aeruginosa PA01
cgacucgauggcgcgg

SEQ ID NO: 3383797 - RNA, 22 nt, Pseudomonas aeruginosa PA01
cgacucgauggcgcggugggcc

SEQ ID NO: 3383798 - RNA, 13 nt, Pseudomonas aeruginosa PA01
cgacucgcgaucg

SEQ ID NO: 3383799 - RNA, 19 nt, Pseudomonas aeruginosa PA01
cgacucgcgaucgaucggc

SEQ ID NO: 3383800 - RNA, 17 nt, Pseudomonas aeruginosa PA01
cgacucgcugccggcgc

SEQ ID NO: 3383801 - RNA, 21 nt, Pseudomonas aeruginosa PA01
cgacucgcugggcgccggcag

SEQ ID NO: 3383802 - RNA, 21 nt, Pseudomonas aeruginosa PA01
cgacucggcugcaacgccgcg

SEQ ID NO: 3383803 - RNA, 19 nt, Pseudomonas aeruginosa PA01
cgacucgguaaagcccagg

SEQ ID NO: 3383804 - RNA, 21 nt, Pseudomonas aeruginosa PA01
cgacucgguaaagcccaggua

SEQ ID NO: 3383805 - RNA, 23 nt, Pseudomonas aeruginosa PA01
cgacucgguaaagcccagguacu

SEQ ID NO: 3383806 - RNA, 16 nt, Pseudomonas aeruginosa PA01
cgacucguugcacgca

SEQ ID NO: 3383807 - RNA, 17 nt, Pseudomonas aeruginosa PA01
cgacucguugcacgcag

SEQ ID NO: 3383808 - RNA, 18 nt, Pseudomonas aeruginosa PA01
cgacucuccgcgccgcgg

SEQ ID NO: 3383809 - RNA, 19 nt, Pseudomonas aeruginosa PA01
cgacucuccgcgccgcggc

SEQ ID NO: 3383810 - RNA, 18 nt, Pseudomonas aeruginosa PA01
cgacugacgguggaggcg

SEQ ID NO: 3383811 - RNA, 16 nt, Pseudomonas aeruginosa PA01
cgacugcaugaccucc

SEQ ID NO: 3383812 - RNA, 22 nt, Pseudomonas aeruginosa PA01
cgacugcaugaccuccagggcc

SEQ ID NO: 3383813 - RNA, 16 nt, Pseudomonas aeruginosa PA01
cgacugcaugaugccg

SEQ ID NO: 3383814 - RNA, 19 nt, Pseudomonas aeruginosa PA01
cgacugcaugaugccgugc

SEQ ID NO: 3383815 - RNA, 14 nt, Pseudomonas aeruginosa PA01
cgacugccgucggc

SEQ ID NO: 3383816 - RNA, 16 nt, Pseudomonas aeruginosa PA01
cgacugccgucggcgc

SEQ ID NO: 3383817 - RNA, 20 nt, Pseudomonas aeruginosa PA01
cgacugccgucggcgcccuu

SEQ ID NO: 3383818 - RNA, 15 nt, Pseudomonas aeruginosa PA01
cgacugcgagccgac

SEQ ID NO: 3383819 - RNA, 23 nt, Pseudomonas aeruginosa PA01
cgacugcgcuggccgagcugccg

SEQ ID NO: 3383820 - RNA, 21 nt, Pseudomonas aeruginosa PA01
cgacugcgguuuuccugcccc

SEQ ID NO: 3383821 - RNA, 16 nt, Pseudomonas aeruginosa PA01
cgacuggaugaacagc

SEQ ID NO: 3383822 - RNA, 20 nt, Pseudomonas aeruginosa PA01
cgacuggaugaacagcgaga

SEQ ID NO: 3383823 - RNA, 18 nt, Pseudomonas aeruginosa PA01
cgacuggaugcagccgau

SEQ ID NO: 3383824 - RNA, 13 nt, Pseudomonas aeruginosa PA01
cgacuggcagcga

SEQ ID NO: 3383825 - RNA, 18 nt, Pseudomonas aeruginosa PA01
cgacuggccguuggcgaa

SEQ ID NO: 3383826 - RNA, 20 nt, Pseudomonas aeruginosa PA01
cgacuggccguuggcgaacu

SEQ ID NO: 3383827 - RNA, 18 nt, Pseudomonas aeruginosa PA01
cgacugguccugcggcgg

SEQ ID NO: 3383828 - RNA, 20 nt, Pseudomonas aeruginosa PA01
cgacugguccugcggcggca

SEQ ID NO: 3383829 - RNA, 16 nt, Pseudomonas aeruginosa PA01
cgacugucgagcaggg

SEQ ID NO: 3383830 - RNA, 18 nt, Pseudomonas aeruginosa PA01
cgacugucgagcaggguc

SEQ ID NO: 3383831 - RNA, 20 nt, Pseudomonas aeruginosa PA01
cgacugucgagcagggucgc

SEQ ID NO: 3383832 - RNA, 14 nt, Pseudomonas aeruginosa PA01
cgacugucgugccu

SEQ ID NO: 3383833 - RNA, 15 nt, Pseudomonas aeruginosa PA01
cgacuuccaggcgca

SEQ ID NO: 3383834 - RNA, 17 nt, Pseudomonas aeruginosa PA01
cgacuuccaggcgcagg

SEQ ID NO: 3383835 - RNA, 17 nt, Pseudomonas aeruginosa PA01
cgacuuccgccuugucc

SEQ ID NO: 3383836 - RNA, 20 nt, Pseudomonas aeruginosa PA01
cgacuuccugggaugccggg

SEQ ID NO: 3383837 - RNA, 17 nt, Pseudomonas aeruginosa PA01
cgacuuccuugcgcggg

SEQ ID NO: 3383838 - RNA, 15 nt, Pseudomonas aeruginosa PA01
cgacuucgacgaacu

SEQ ID NO: 3383839 - RNA, 20 nt, Pseudomonas aeruginosa PA01
cgacuucgacgaacucgacg

SEQ ID NO: 3383840 - RNA, 23 nt, Pseudomonas aeruginosa PA01
cgacuucgcaccagccggccgcg

SEQ ID NO: 3383841 - RNA, 12 nt, Pseudomonas aeruginosa PA01
cgacuucgcauu

SEQ ID NO: 3383842 - RNA, 17 nt, Pseudomonas aeruginosa PA01
cgacuucggcaagcacc

SEQ ID NO: 3383843 - RNA, 19 nt, Pseudomonas aeruginosa PA01
cgacuucggcaagcaccuu

SEQ ID NO: 3383844 - RNA, 15 nt, Pseudomonas aeruginosa PA01
cgacuucuucgcugg

SEQ ID NO: 3383845 - RNA, 17 nt, Pseudomonas aeruginosa PA01
cgacuugccgaucaugg

SEQ ID NO: 3383846 - RNA, 16 nt, Pseudomonas aeruginosa PA01
cgacuuggcagucgcc

SEQ ID NO: 3383847 - RNA, 20 nt, Pseudomonas aeruginosa PA01
cgacuuggcagucgccgcca

SEQ ID NO: 3383848 - RNA, 17 nt, Pseudomonas aeruginosa PA01
cgagaaaccgccaucga

SEQ ID NO: 3383849 - RNA, 14 nt, Pseudomonas aeruginosa PA01
cgagaaacugcagg

SEQ ID NO: 3383850 - RNA, 14 nt, Pseudomonas aeruginosa PA01
cgagaaagcgcagg

SEQ ID NO: 3383851 - RNA, 16 nt, Pseudomonas aeruginosa PA01
cgagaaaguucccgca

SEQ ID NO: 3383852 - RNA, 21 nt, Pseudomonas aeruginosa PA01
cgagaaaguucccgcauggcu

SEQ ID NO: 3383853 - RNA, 22 nt, Pseudomonas aeruginosa PA01
cgagaaaguucccgcauggcuc

SEQ ID NO: 3383854 - RNA, 16 nt, Pseudomonas aeruginosa PA01
cgagaaauaggcgcug

SEQ ID NO: 3383855 - RNA, 15 nt, Pseudomonas aeruginosa PA01
cgagaacaggcggau

SEQ ID NO: 3383856 - RNA, 14 nt, Pseudomonas aeruginosa PA01
cgagaacgcggcga

SEQ ID NO: 3383857 - RNA, 16 nt, Pseudomonas aeruginosa PA01
cgagaacgcggcgaag

SEQ ID NO: 3383858 - RNA, 22 nt, Pseudomonas aeruginosa PA01
cgagaacucguccggucgcacc

SEQ ID NO: 3383859 - RNA, 16 nt, Pseudomonas aeruginosa PA01
cgagaacuugccggcg

SEQ ID NO: 3383860 - RNA, 17 nt, Pseudomonas aeruginosa PA01
cgagaacuugccggcgc

SEQ ID NO: 3383861 - RNA, 19 nt, Pseudomonas aeruginosa PA01
cgagaacuugccggcgcca

SEQ ID NO: 3383862 - RNA, 19 nt, Pseudomonas aeruginosa PA01
cgagaagcagaacgccccg

SEQ ID NO: 3383863 - RNA, 14 nt, Pseudomonas aeruginosa PA01
cgagaagccagcca

SEQ ID NO: 3383864 - RNA, 16 nt, Pseudomonas aeruginosa PA01
cgagaagccagccagg

SEQ ID NO: 3383865 - RNA, 17 nt, Pseudomonas aeruginosa PA01
cgagaagccggggcagg

SEQ ID NO: 3383866 - RNA, 24 nt, Pseudomonas aeruginosa PA01
cgagaaggaagucgagcuggugga

SEQ ID NO: 3383867 - RNA, 16 nt, Pseudomonas aeruginosa PA01
cgagaaggcugccggg

SEQ ID NO: 3383868 - RNA, 19 nt, Pseudomonas aeruginosa PA01
cgagaagguucucggccac

SEQ ID NO: 3383869 - RNA, 22 nt, Pseudomonas aeruginosa PA01
cgagaagguucucggccaccac

SEQ ID NO: 3383870 - RNA, 18 nt, Pseudomonas aeruginosa PA01
cgagaccaucuggaucag

SEQ ID NO: 3383871 - RNA, 15 nt, Pseudomonas aeruginosa PA01
cgagcaggucgcgga

SEQ ID NO: 3383872 - RNA, 17 nt, Pseudomonas aeruginosa PA01
cgagcaguucccccagc

SEQ ID NO: 3383873 - RNA, 21 nt, Pseudomonas aeruginosa PA01
cgagcaguucccccagcaccu

SEQ ID NO: 3383874 - RNA, 17 nt, Pseudomonas aeruginosa PA01
cgagcaguuccggcacg

SEQ ID NO: 3383875 - RNA, 18 nt, Pseudomonas aeruginosa PA01
cgagcaguugcuggaugu

SEQ ID NO: 3383876 - RNA, 20 nt, Pseudomonas aeruginosa PA01
cgagcaucagcaauuccgca

SEQ ID NO: 3383877 - RNA, 22 nt, Pseudomonas aeruginosa PA01
cgagcaucagcaauuccgcagc

SEQ ID NO: 3383878 - RNA, 13 nt, Pseudomonas aeruginosa PA01
cgagcaucagcga

SEQ ID NO: 3383879 - RNA, 22 nt, Pseudomonas aeruginosa PA01
cgagcaucuccggcaccguggu

SEQ ID NO: 3383880 - RNA, 15 nt, Pseudomonas aeruginosa PA01
cgagcaucucggcca

SEQ ID NO: 3383881 - RNA, 19 nt, Pseudomonas aeruginosa PA01
cgagcaucucggccaggcc

SEQ ID NO: 3383882 - RNA, 17 nt, Pseudomonas aeruginosa PA01
cgagcaucugccgggcg

SEQ ID NO: 3383883 - RNA, 19 nt, Pseudomonas aeruginosa PA01
cgagcaucugccgggcgcg

SEQ ID NO: 3383884 - RNA, 21 nt, Pseudomonas aeruginosa PA01
cgagcaucugccgggcgcgcu

SEQ ID NO: 3383885 - RNA, 23 nt, Pseudomonas aeruginosa PA01
cgagcaucuucuucaaccgcugg

SEQ ID NO: 3383886 - RNA, 18 nt, Pseudomonas aeruginosa PA01
cgagcaugaugcaggcag

SEQ ID NO: 3383887 - RNA, 14 nt, Pseudomonas aeruginosa PA01
cgagcaugccgagg

SEQ ID NO: 3383888 - RNA, 16 nt, Pseudomonas aeruginosa PA01
cgagcaugccgaggaa

SEQ ID NO: 3383889 - RNA, 14 nt, Pseudomonas aeruginosa PA01
cgagcaugcgggcg

SEQ ID NO: 3383890 - RNA, 17 nt, Pseudomonas aeruginosa PA01
cgagcauuccucagcgc

SEQ ID NO: 3383891 - RNA, 21 nt, Pseudomonas aeruginosa PA01
cgagcauuccucagcgccggu

SEQ ID NO: 3383892 - RNA, 21 nt, Pseudomonas aeruginosa PA01
cgagccacggauaugcgccgc

SEQ ID NO: 3383893 - RNA, 18 nt, Pseudomonas aeruginosa PA01
cgagccacucgugcaacg

SEQ ID NO: 3383894 - RNA, 18 nt, Pseudomonas aeruginosa PA01
cgagccagcccagcggcg

SEQ ID NO: 3383895 - RNA, 22 nt, Pseudomonas aeruginosa PA01
cgagccagcccagcggcgcggc

SEQ ID NO: 3383896 - RNA, 12 nt, Pseudomonas aeruginosa PA01
cgagccagccgc

SEQ ID NO: 3383897 - RNA, 19 nt, Pseudomonas aeruginosa PA01
cgagccagccgcggaucac

SEQ ID NO: 3383898 - RNA, 20 nt, Pseudomonas aeruginosa PA01
cgagccagccguggcaggcg

SEQ ID NO: 3383899 - RNA, 21 nt, Pseudomonas aeruginosa PA01
cgagccagccguggcaggcgc

SEQ ID NO: 3383900 - RNA, 12 nt, Pseudomonas aeruginosa PA01
cgagccagcgcu

SEQ ID NO: 3383901 - RNA, 13 nt, Pseudomonas aeruginosa PA01
cgagccagcgcuc

SEQ ID NO: 3383902 - RNA, 21 nt, Pseudomonas aeruginosa PA01
cgagccagcgcucgaacgccg

SEQ ID NO: 3383903 - RNA, 22 nt, Pseudomonas aeruginosa PA01
cgagccagcgcucgaacgccgc

SEQ ID NO: 3383904 - RNA, 20 nt, Pseudomonas aeruginosa PA01
cgagcccagcggcagggcgg

SEQ ID NO: 3383905 - RNA, 21 nt, Pseudomonas aeruginosa PA01
cgagcccagcggcagggcggc

SEQ ID NO: 3383906 - RNA, 13 nt, Pseudomonas aeruginosa PA01
cgagcccaggcag

SEQ ID NO: 3383907 - RNA, 14 nt, Pseudomonas aeruginosa PA01
cgagcccaggcaga

SEQ ID NO: 3383908 - RNA, 15 nt, Pseudomonas aeruginosa PA01
cgagcccccggcgcc

SEQ ID NO: 3383909 - RNA, 20 nt, Pseudomonas aeruginosa PA01
cgagcccgagugcgcccagc

SEQ ID NO: 3383910 - RNA, 14 nt, Pseudomonas aeruginosa PA01
cgagcccggccggg

SEQ ID NO: 3383911 - RNA, 14 nt, Pseudomonas aeruginosa PA01
cgagccgacuucca

SEQ ID NO: 3383912 - RNA, 11 nt, Pseudomonas aeruginosa PA01
cgagccgagca

SEQ ID NO: 3383913 - RNA, 13 nt, Pseudomonas aeruginosa PA01
cgagccgagcaug

SEQ ID NO: 3383914 - RNA, 15 nt, Pseudomonas aeruginosa PA01
cgagccgaucaccag

SEQ ID NO: 3383915 - RNA, 16 nt, Pseudomonas aeruginosa PA01
cgagccgaucaccagc

SEQ ID NO: 3383916 - RNA, 18 nt, Pseudomonas aeruginosa PA01
cgagccgaucaccagcaa

SEQ ID NO: 3383917 - RNA, 15 nt, Pseudomonas aeruginosa PA01
cgagccgccgggcgg

SEQ ID NO: 3383918 - RNA, 16 nt, Pseudomonas aeruginosa PA01
cgagccgcgacgcgac

SEQ ID NO: 3383919 - RNA, 14 nt, Pseudomonas aeruginosa PA01
cgagccgcgacggc

SEQ ID NO: 3383920 - RNA, 13 nt, Pseudomonas aeruginosa PA01
cgagccgcgcagc

SEQ ID NO: 3383921 - RNA, 13 nt, Pseudomonas aeruginosa PA01
cgagccgcgcugc

SEQ ID NO: 3383922 - RNA, 15 nt, Pseudomonas aeruginosa PA01
cgagccgcgcugcug

SEQ ID NO: 3383923 - RNA, 16 nt, Pseudomonas aeruginosa PA01
cgagccgcgcugcugg

SEQ ID NO: 3383924 - RNA, 17 nt, Pseudomonas aeruginosa PA01
cgagccgcgcugcuggu

SEQ ID NO: 3383925 - RNA, 18 nt, Pseudomonas aeruginosa PA01
cgagccgcgcugcuggua

SEQ ID NO: 3383926 - RNA, 14 nt, Pseudomonas aeruginosa PA01
cgagccgcugcggc

SEQ ID NO: 3383927 - RNA, 15 nt, Pseudomonas aeruginosa PA01
cgagccgcugcggcu

SEQ ID NO: 3383928 - RNA, 20 nt, Pseudomonas aeruginosa PA01
cgagccgcugcggcucgccg

SEQ ID NO: 3383929 - RNA, 13 nt, Pseudomonas aeruginosa PA01
cgagccgcuggca

SEQ ID NO: 3383930 - RNA, 19 nt, Pseudomonas aeruginosa PA01
cgagccgcuuggagcgggc

SEQ ID NO: 3383931 - RNA, 17 nt, Pseudomonas aeruginosa PA01
cgagccggacggcggcg

SEQ ID NO: 3383932 - RNA, 15 nt, Pseudomonas aeruginosa PA01
cgagccggaucggua

SEQ ID NO: 3383933 - RNA, 19 nt, Pseudomonas aeruginosa PA01
cgagccggcgcaucagcgc

SEQ ID NO: 3383934 - RNA, 20 nt, Pseudomonas aeruginosa PA01
cgagccggcgcaucagcgcc

SEQ ID NO: 3383935 - RNA, 16 nt, Pseudomonas aeruginosa PA01
cgagccggcugaugcc

SEQ ID NO: 3383936 - RNA, 17 nt, Pseudomonas aeruginosa PA01
cgagccggcugaugccc

SEQ ID NO: 3383937 - RNA, 19 nt, Pseudomonas aeruginosa PA01
cgagccggcugaugcccgg

SEQ ID NO: 3383938 - RNA, 16 nt, Pseudomonas aeruginosa PA01
cgagccguccugcggc

SEQ ID NO: 3383939 - RNA, 19 nt, Pseudomonas aeruginosa PA01
cgagccguccugcggccgc

SEQ ID NO: 3383940 - RNA, 20 nt, Pseudomonas aeruginosa PA01
cgagccguccugcggccgca

SEQ ID NO: 3383941 - RNA, 18 nt, Pseudomonas aeruginosa PA01
cgagccguuccaggcggg

SEQ ID NO: 3383942 - RNA, 21 nt, Pseudomonas aeruginosa PA01
cgagccguuccaggcggggcg

SEQ ID NO: 3383943 - RNA, 18 nt, Pseudomonas aeruginosa PA01
cgagccuggccaggcgcu

SEQ ID NO: 3383944 - RNA, 19 nt, Pseudomonas aeruginosa PA01
cgagccuggccaggcgcuc

SEQ ID NO: 3383945 - RNA, 18 nt, Pseudomonas aeruginosa PA01
cgagccuucagcacggcg

SEQ ID NO: 3383946 - RNA, 16 nt, Pseudomonas aeruginosa PA01
cgagccuugcggcgcu

SEQ ID NO: 3383947 - RNA, 17 nt, Pseudomonas aeruginosa PA01
cgagcgaaaucggcagg

SEQ ID NO: 3383948 - RNA, 19 nt, Pseudomonas aeruginosa PA01
cgagcgacggugauagagc

SEQ ID NO: 3383949 - RNA, 23 nt, Pseudomonas aeruginosa PA01
cgagcgacggugauagagcacgc

SEQ ID NO: 3383950 - RNA, 12 nt, Pseudomonas aeruginosa PA01
cgagcgacugga

SEQ ID NO: 3383951 - RNA, 16 nt, Pseudomonas aeruginosa PA01
cgagcgagggcgucga

SEQ ID NO: 3383952 - RNA, 18 nt, Pseudomonas aeruginosa PA01
cgagcgagggcgucgaug

SEQ ID NO: 3383953 - RNA, 16 nt, Pseudomonas aeruginosa PA01
cgagcgcacaacgccu

SEQ ID NO: 3383954 - RNA, 14 nt, Pseudomonas aeruginosa PA01
cgagcgcagcgcca

SEQ ID NO: 3383955 - RNA, 19 nt, Pseudomonas aeruginosa PA01
cgagcgcagcgccaccagg

SEQ ID NO: 3383956 - RNA, 15 nt, Pseudomonas aeruginosa PA01
cgagcgcccgccguc

SEQ ID NO: 3383957 - RNA, 21 nt, Pseudomonas aeruginosa PA01
cgagcgcccgccgucauggcg

SEQ ID NO: 3383958 - RNA, 18 nt, Pseudomonas aeruginosa PA01
cgagcgccgccaggcagg

SEQ ID NO: 3383959 - RNA, 15 nt, Pseudomonas aeruginosa PA01
cgagcgccgccuggg

SEQ ID NO: 3383960 - RNA, 15 nt, Pseudomonas aeruginosa PA01
cgagcgccgcggcga

SEQ ID NO: 3383961 - RNA, 15 nt, Pseudomonas aeruginosa PA01
cgagcgccuggcaac

SEQ ID NO: 3383962 - RNA, 17 nt, Pseudomonas aeruginosa PA01
cgagcgcgagugcagcg

SEQ ID NO: 3383963 - RNA, 17 nt, Pseudomonas aeruginosa PA01
cgagcgcgaucagccgc

SEQ ID NO: 3383964 - RNA, 20 nt, Pseudomonas aeruginosa PA01
cgagcgcgaucagccgcucc

SEQ ID NO: 3383965 - RNA, 22 nt, Pseudomonas aeruginosa PA01
cgagcgcgaucagccgcuccag

SEQ ID NO: 3383966 - RNA, 13 nt, Pseudomonas aeruginosa PA01
cgagcgcgccgcc

SEQ ID NO: 3383967 - RNA, 15 nt, Pseudomonas aeruginosa PA01
cgagcgcgccgccga

SEQ ID NO: 3383968 - RNA, 14 nt, Pseudomonas aeruginosa PA01
cgagcgcggccggc

SEQ ID NO: 3383969 - RNA, 15 nt, Pseudomonas aeruginosa PA01
cgagcgcggccggcc

SEQ ID NO: 3383970 - RNA, 16 nt, Pseudomonas aeruginosa PA01
cgagcgcggccggcca

SEQ ID NO: 3383971 - RNA, 14 nt, Pseudomonas aeruginosa PA01
cgagcgcuccaccg

SEQ ID NO: 3383972 - RNA, 17 nt, Pseudomonas aeruginosa PA01
cgagcgcuccaccgcgc

SEQ ID NO: 3383973 - RNA, 22 nt, Pseudomonas aeruginosa PA01
cgagcgcuccaccgcgcuccgc

SEQ ID NO: 3383974 - RNA, 21 nt, Pseudomonas aeruginosa PA01
cgaggaugaucagggcaccgc

SEQ ID NO: 3383975 - RNA, 14 nt, Pseudomonas aeruginosa PA01
cgaggaugaucggc

SEQ ID NO: 3383976 - RNA, 15 nt, Pseudomonas aeruginosa PA01
cgaggaugaucggcu

SEQ ID NO: 3383977 - RNA, 12 nt, Pseudomonas aeruginosa PA01
cgaggauggccg

SEQ ID NO: 3383978 - RNA, 14 nt, Pseudomonas aeruginosa PA01
cgaggauggucagg

SEQ ID NO: 3383979 - RNA, 20 nt, Pseudomonas aeruginosa PA01
cgaggauggucaggccggcg

SEQ ID NO: 3383980 - RNA, 21 nt, Pseudomonas aeruginosa PA01
cgaggauggucaggccggcgc

SEQ ID NO: 3383981 - RNA, 18 nt, Pseudomonas aeruginosa PA01
cgaggauguacagggucu

SEQ ID NO: 3383982 - RNA, 15 nt, Pseudomonas aeruginosa PA01
cgaggaugucggcga

SEQ ID NO: 3383983 - RNA, 15 nt, Pseudomonas aeruginosa PA01
cgaggauuuccgcgc

SEQ ID NO: 3383984 - RNA, 17 nt, Pseudomonas aeruginosa PA01
cgaggauuuccucgcgc

SEQ ID NO: 3383985 - RNA, 19 nt, Pseudomonas aeruginosa PA01
cgaggauuuccucgcgcac

SEQ ID NO: 3383986 - RNA, 14 nt, Pseudomonas aeruginosa PA01
cgaggcaaucugcc

SEQ ID NO: 3383987 - RNA, 18 nt, Pseudomonas aeruginosa PA01
cgaggcagccgucgguga

SEQ ID NO: 3383988 - RNA, 21 nt, Pseudomonas aeruginosa PA01
cgaggcauucucgcgacccug

SEQ ID NO: 3383989 - RNA, 23 nt, Pseudomonas aeruginosa PA01
cgaggccaccacuucgcggacca

SEQ ID NO: 3383990 - RNA, 14 nt, Pseudomonas aeruginosa PA01
cgaggccagcaggc

SEQ ID NO: 3383991 - RNA, 20 nt, Pseudomonas aeruginosa PA01
cgaggccaggaucgucggcc

SEQ ID NO: 3383992 - RNA, 21 nt, Pseudomonas aeruginosa PA01
cgaggccaggaucgucggccc

SEQ ID NO: 3383993 - RNA, 22 nt, Pseudomonas aeruginosa PA01
cgaggccaggaucgucggcccg

SEQ ID NO: 3383994 - RNA, 15 nt, Pseudomonas aeruginosa PA01
cgaggccaggccgag

SEQ ID NO: 3383995 - RNA, 16 nt, Pseudomonas aeruginosa PA01
cgaggccauccccgag

SEQ ID NO: 3383996 - RNA, 18 nt, Pseudomonas aeruginosa PA01
cgaggccauccccgaggc

SEQ ID NO: 3383997 - RNA, 20 nt, Pseudomonas aeruginosa PA01
cgaggccauccccgaggcga

SEQ ID NO: 3383998 - RNA, 21 nt, Pseudomonas aeruginosa PA01
cgaggccauccccgaggcgac

SEQ ID NO: 3383999 - RNA, 22 nt, Pseudomonas aeruginosa PA01
cgaggccauccccgaggcgacg

SEQ ID NO: 3384000 - RNA, 13 nt, Pseudomonas aeruginosa PA01
cgaggcccgccca

SEQ ID NO: 3384001 - RNA, 15 nt, Pseudomonas aeruginosa PA01
cgaggcccgcgccgc

SEQ ID NO: 3384002 - RNA, 14 nt, Pseudomonas aeruginosa PA01
cgaggcccucggcg

SEQ ID NO: 3384003 - RNA, 15 nt, Pseudomonas aeruginosa PA01
cgaggcccucggcgg

SEQ ID NO: 3384004 - RNA, 16 nt, Pseudomonas aeruginosa PA01
cgaggcccucggcggc

SEQ ID NO: 3384005 - RNA, 16 nt, Pseudomonas aeruginosa PA01
cgaggccgaaauggcg

SEQ ID NO: 3384006 - RNA, 23 nt, Pseudomonas aeruginosa PA01
cgaggccgaaauggcgguggccg

SEQ ID NO: 3384007 - RNA, 14 nt, Pseudomonas aeruginosa PA01
cgaggccgagccgg

SEQ ID NO: 3384008 - RNA, 15 nt, Pseudomonas aeruginosa PA01
cgaggccgagccggc

SEQ ID NO: 3384009 - RNA, 19 nt, Pseudomonas aeruginosa PA01
cgaggccgagccggcaucc

SEQ ID NO: 3384010 - RNA, 17 nt, Pseudomonas aeruginosa PA01
cgaggccgagguagacc

SEQ ID NO: 3384011 - RNA, 12 nt, Pseudomonas aeruginosa PA01
cgaggccgccca

SEQ ID NO: 3384012 - RNA, 17 nt, Pseudomonas aeruginosa PA01
cgaggccgcccagcgca

SEQ ID NO: 3384013 - RNA, 17 nt, Pseudomonas aeruginosa PA01
cgaggccgccgcgggca

SEQ ID NO: 3384014 - RNA, 21 nt, Pseudomonas aeruginosa PA01
cgaggccgcggagcaccgcgc

SEQ ID NO: 3384015 - RNA, 14 nt, Pseudomonas aeruginosa PA01
cgaggccggcgaag

SEQ ID NO: 3384016 - RNA, 22 nt, Pseudomonas aeruginosa PA01
cgaggccguaccagucgcccgc

SEQ ID NO: 3384017 - RNA, 14 nt, Pseudomonas aeruginosa PA01
cgaggcgacccggg

SEQ ID NO: 3384018 - RNA, 22 nt, Pseudomonas aeruginosa PA01
cgaggcgacccgggucaggccg

SEQ ID NO: 3384019 - RNA, 19 nt, Pseudomonas aeruginosa PA01
cgaggcgaccuuggccagc

SEQ ID NO: 3384020 - RNA, 20 nt, Pseudomonas aeruginosa PA01
cgaggcgaccuuggccagcc

SEQ ID NO: 3384021 - RNA, 15 nt, Pseudomonas aeruginosa PA01
cgaggcgaucgccgc

SEQ ID NO: 3384022 - RNA, 18 nt, Pseudomonas aeruginosa PA01
cgaggcgaucgccgcggc

SEQ ID NO: 3384023 - RNA, 19 nt, Pseudomonas aeruginosa PA01
cgaggcgaucgccgcggcg

SEQ ID NO: 3384024 - RNA, 20 nt, Pseudomonas aeruginosa PA01
cgaggcgaucgccgcggcga

SEQ ID NO: 3384025 - RNA, 13 nt, Pseudomonas aeruginosa PA01
cgaggcgcaggca

SEQ ID NO: 3384026 - RNA, 16 nt, Pseudomonas aeruginosa PA01
cgaggcgcccgccggc

SEQ ID NO: 3384027 - RNA, 13 nt, Pseudomonas aeruginosa PA01
cgaggcgccgacc

SEQ ID NO: 3384028 - RNA, 13 nt, Pseudomonas aeruginosa PA01
cgaggcgcgccga

SEQ ID NO: 3384029 - RNA, 14 nt, Pseudomonas aeruginosa PA01
cgaggcgcgccgac

SEQ ID NO: 3384030 - RNA, 20 nt, Pseudomonas aeruginosa PA01
cgaggcgcgccgacagcacg

SEQ ID NO: 3384031 - RNA, 12 nt, Pseudomonas aeruginosa PA01
cgaggcgcgccu

SEQ ID NO: 3384032 - RNA, 13 nt, Pseudomonas aeruginosa PA01
cgaggcgcgccug

SEQ ID NO: 3384033 - RNA, 14 nt, Pseudomonas aeruginosa PA01
cgaggcgcgccugg

SEQ ID NO: 3384034 - RNA, 12 nt, Pseudomonas aeruginosa PA01
cgaggcgcggcg

SEQ ID NO: 3384035 - RNA, 16 nt, Pseudomonas aeruginosa PA01
cgaggcgcuccaccgc

SEQ ID NO: 3384036 - RNA, 21 nt, Pseudomonas aeruginosa PA01
cgaggcgcuccaccgcccccg

SEQ ID NO: 3384037 - RNA, 18 nt, Pseudomonas aeruginosa PA01
cgaggcgcucgacgauca

SEQ ID NO: 3384038 - RNA, 21 nt, Pseudomonas aeruginosa PA01
cgaggcgcucgacgaucaggu

SEQ ID NO: 3384039 - RNA, 22 nt, Pseudomonas aeruginosa PA01
cgaggcgcucgacgaucaggug

SEQ ID NO: 3384040 - RNA, 22 nt, Pseudomonas aeruginosa PA01
cgaggcgcucuucacuuccagc

SEQ ID NO: 3384041 - RNA, 20 nt, Pseudomonas aeruginosa PA01
cgaggcgcuucugcucggcc

SEQ ID NO: 3384042 - RNA, 23 nt, Pseudomonas aeruginosa PA01
cgaggcgcuucugcucggccugg

SEQ ID NO: 3384043 - RNA, 12 nt, Pseudomonas aeruginosa PA01
cgaggcggaaac

SEQ ID NO: 3384044 - RNA, 18 nt, Pseudomonas aeruginosa PA01
cgaggcggauuugccgcc

SEQ ID NO: 3384045 - RNA, 20 nt, Pseudomonas aeruginosa PA01
cgaggcggauuugccgccga

SEQ ID NO: 3384046 - RNA, 13 nt, Pseudomonas aeruginosa PA01
cgaggcggccgua

SEQ ID NO: 3384047 - RNA, 13 nt, Pseudomonas aeruginosa PA01
cgaggcgggcgcg

SEQ ID NO: 3384048 - RNA, 16 nt, Pseudomonas aeruginosa PA01
cgaggcgucgaucauc

SEQ ID NO: 3384049 - RNA, 11 nt, Pseudomonas aeruginosa PA01
cgaggcgucgg

SEQ ID NO: 3384050 - RNA, 12 nt, Pseudomonas aeruginosa PA01
cgaggcgucggc

SEQ ID NO: 3384051 - RNA, 15 nt, Pseudomonas aeruginosa PA01
cgaggcguggaaggg

SEQ ID NO: 3384052 - RNA, 17 nt, Pseudomonas aeruginosa PA01
cgaggcguuccaggugg

SEQ ID NO: 3384053 - RNA, 22 nt, Pseudomonas aeruginosa PA01
cgaggcguuccaggugguggcg

SEQ ID NO: 3384054 - RNA, 15 nt, Pseudomonas aeruginosa PA01
cgaggcguucgucga

SEQ ID NO: 3384055 - RNA, 15 nt, Pseudomonas aeruginosa PA01
cgaggcucggucgcg

SEQ ID NO: 3384056 - RNA, 16 nt, Pseudomonas aeruginosa PA01
cgaggcucggucgcgc

SEQ ID NO: 3384057 - RNA, 19 nt, Pseudomonas aeruginosa PA01
cgaggcucggucgcgcggg

SEQ ID NO: 3384058 - RNA, 22 nt, Pseudomonas aeruginosa PA01
cgaggcucggucgcgcgggugc

SEQ ID NO: 3384059 - RNA, 16 nt, Pseudomonas aeruginosa PA01
cgaggcugccgaagcc

SEQ ID NO: 3384060 - RNA, 20 nt, Pseudomonas aeruginosa PA01
cgaggcugcgauauggccga

SEQ ID NO: 3384061 - RNA, 23 nt, Pseudomonas aeruginosa PA01
cgaggcugcgauauggccgauca

SEQ ID NO: 3384062 - RNA, 14 nt, Pseudomonas aeruginosa PA01
cgaggcugcgggcg

SEQ ID NO: 3384063 - RNA, 15 nt, Pseudomonas aeruginosa PA01
cgaggcugugggucg

SEQ ID NO: 3384064 - RNA, 22 nt, Pseudomonas aeruginosa PA01
cgaggcuuccucgaagaacucg

SEQ ID NO: 3384065 - RNA, 17 nt, Pseudomonas aeruginosa PA01
cgaggcuuuccagcagg

SEQ ID NO: 3384066 - RNA, 18 nt, Pseudomonas aeruginosa PA01
cgaggcuuuccagcaggc

SEQ ID NO: 3384067 - RNA, 19 nt, Pseudomonas aeruginosa PA01
cgaggcuuuccagcaggcg

SEQ ID NO: 3384068 - RNA, 15 nt, Pseudomonas aeruginosa PA01
cgagggacugaagag

SEQ ID NO: 3384069 - RNA, 22 nt, Pseudomonas aeruginosa PA01
cgagggaggucgcacgcagcgc

SEQ ID NO: 3384070 - RNA, 23 nt, Pseudomonas aeruginosa PA01
cgagggaggucgcacgcagcgcc

SEQ ID NO: 3384071 - RNA, 20 nt, Pseudomonas aeruginosa PA01
cgagggauguuccaggcccg

SEQ ID NO: 3384072 - RNA, 18 nt, Pseudomonas aeruginosa PA01
cgagggcaaaggcgcgca

SEQ ID NO: 3384073 - RNA, 19 nt, Pseudomonas aeruginosa PA01
cgagggcaaaggcgcgcag

SEQ ID NO: 3384074 - RNA, 16 nt, Pseudomonas aeruginosa PA01
cgagggcaccacguug

SEQ ID NO: 3384075 - RNA, 18 nt, Pseudomonas aeruginosa PA01
cgagggcacguugggauc

SEQ ID NO: 3384076 - RNA, 14 nt, Pseudomonas aeruginosa PA01
cgagggcaugaccg

SEQ ID NO: 3384077 - RNA, 16 nt, Pseudomonas aeruginosa PA01
cgagucccuugcggca

SEQ ID NO: 3384078 - RNA, 19 nt, Pseudomonas aeruginosa PA01
cgagucccuugcggcagac

SEQ ID NO: 3384079 - RNA, 15 nt, Pseudomonas aeruginosa PA01
cgaguccgcgcgcgc

SEQ ID NO: 3384080 - RNA, 19 nt, Pseudomonas aeruginosa PA01
cgaguccgcgcgcgcgcuc

SEQ ID NO: 3384081 - RNA, 22 nt, Pseudomonas aeruginosa PA01
cgaguccgcgcgcgcgcuccuc

SEQ ID NO: 3384082 - RNA, 15 nt, Pseudomonas aeruginosa PA01
cgagucgacccaggc

SEQ ID NO: 3384083 - RNA, 13 nt, Pseudomonas aeruginosa PA01
cgagucgaggcga

SEQ ID NO: 3384084 - RNA, 13 nt, Pseudomonas aeruginosa PA01
cgagucgaucagg

SEQ ID NO: 3384085 - RNA, 17 nt, Pseudomonas aeruginosa PA01
cgagucgaucaggucgc

SEQ ID NO: 3384086 - RNA, 20 nt, Pseudomonas aeruginosa PA01
cgagucgaucaggucgccgc

SEQ ID NO: 3384087 - RNA, 22 nt, Pseudomonas aeruginosa PA01
cgagucgaucaggucgccgccg

SEQ ID NO: 3384088 - RNA, 14 nt, Pseudomonas aeruginosa PA01
cgagucgccggcga

SEQ ID NO: 3384089 - RNA, 19 nt, Pseudomonas aeruginosa PA01
cgagugcagcgagucgccg

SEQ ID NO: 3384090 - RNA, 20 nt, Pseudomonas aeruginosa PA01
cgagugcagcgagucgccgu

SEQ ID NO: 3384091 - RNA, 14 nt, Pseudomonas aeruginosa PA01
cgagugcgcccagc

SEQ ID NO: 3384092 - RNA, 15 nt, Pseudomonas aeruginosa PA01
cgagugcgcccagca

SEQ ID NO: 3384093 - RNA, 17 nt, Pseudomonas aeruginosa PA01
cgagugcgcccagcagc

SEQ ID NO: 3384094 - RNA, 18 nt, Pseudomonas aeruginosa PA01
cgagugcgcccagcagca

SEQ ID NO: 3384095 - RNA, 20 nt, Pseudomonas aeruginosa PA01
cgagugcgcccagcagcagg

SEQ ID NO: 3384096 - RNA, 19 nt, Pseudomonas aeruginosa PA01
cgaguggcgaagccagcac

SEQ ID NO: 3384097 - RNA, 14 nt, Pseudomonas aeruginosa PA01
cgaguggcgcagcg

SEQ ID NO: 3384098 - RNA, 20 nt, Pseudomonas aeruginosa PA01
cgagugugccggccaugcag

SEQ ID NO: 3384099 - RNA, 12 nt, Pseudomonas aeruginosa PA01
cgaguucggcga

SEQ ID NO: 3384100 - RNA, 15 nt, Pseudomonas aeruginosa PA01
cgaguucggcgagca

SEQ ID NO: 3384101 - RNA, 21 nt, Pseudomonas aeruginosa PA01
cgaguucggcguuguccaggc

SEQ ID NO: 3384102 - RNA, 13 nt, Pseudomonas aeruginosa PA01
cgaguugcgcgag

SEQ ID NO: 3384103 - RNA, 16 nt, Pseudomonas aeruginosa PA01
cgaguugcgcgaggcg

SEQ ID NO: 3384104 - RNA, 17 nt, Pseudomonas aeruginosa PA01
cgaguugggcgaccugc

SEQ ID NO: 3384105 - RNA, 20 nt, Pseudomonas aeruginosa PA01
cgaguugggcgaccugcucg

SEQ ID NO: 3384106 - RNA, 21 nt, Pseudomonas aeruginosa PA01
cgaguugggcgaccugcucga

SEQ ID NO: 3384107 - RNA, 15 nt, Pseudomonas aeruginosa PA01
cgaguuucccggcgc

SEQ ID NO: 3384108 - RNA, 23 nt, Pseudomonas aeruginosa PA01
cgauaaaaagccccgcuucggcg

SEQ ID NO: 3384109 - RNA, 23 nt, Pseudomonas aeruginosa PA01
cgauaacaccaggagcgccagca

SEQ ID NO: 3384110 - RNA, 20 nt, Pseudomonas aeruginosa PA01
cgauaaccgcguugcgguua

SEQ ID NO: 3384111 - RNA, 17 nt, Pseudomonas aeruginosa PA01
cgauaccagcgccgcuc

SEQ ID NO: 3384112 - RNA, 18 nt, Pseudomonas aeruginosa PA01
cgauacccaggccgucga

SEQ ID NO: 3384113 - RNA, 18 nt, Pseudomonas aeruginosa PA01
cgauacccugggagccgc

SEQ ID NO: 3384114 - RNA, 20 nt, Pseudomonas aeruginosa PA01
cgauacccugggagccgccg

SEQ ID NO: 3384115 - RNA, 21 nt, Pseudomonas aeruginosa PA01
cgauacccugggagccgccgg

SEQ ID NO: 3384116 - RNA, 16 nt, Pseudomonas aeruginosa PA01
cgauaccgccgccggc

SEQ ID NO: 3384117 - RNA, 21 nt, Pseudomonas aeruginosa PA01
cgauacgagaucgagcgcgcc

SEQ ID NO: 3384118 - RNA, 16 nt, Pseudomonas aeruginosa PA01
cgauacgcaucugcuc

SEQ ID NO: 3384119 - RNA, 23 nt, Pseudomonas aeruginosa PA01
cgauacgcaucugcucgaggaug

SEQ ID NO: 3384120 - RNA, 16 nt, Pseudomonas aeruginosa PA01
cgauacgcucggcguc

SEQ ID NO: 3384121 - RNA, 17 nt, Pseudomonas aeruginosa PA01
cgauagaccaggaaggc

SEQ ID NO: 3384122 - RNA, 15 nt, Pseudomonas aeruginosa PA01
cgauagacgccggcg

SEQ ID NO: 3384123 - RNA, 16 nt, Pseudomonas aeruginosa PA01
cgauagacgccggcga

SEQ ID NO: 3384124 - RNA, 15 nt, Pseudomonas aeruginosa PA01
cgauagccgaccagg

SEQ ID NO: 3384125 - RNA, 17 nt, Pseudomonas aeruginosa PA01
cgauagccgaccaggcc

SEQ ID NO: 3384126 - RNA, 24 nt, Pseudomonas aeruginosa PA01
cgauagcggcgcgaggccguacca

SEQ ID NO: 3384127 - RNA, 21 nt, Pseudomonas aeruginosa PA01
cgauagcguccaggugcggcu

SEQ ID NO: 3384128 - RNA, 20 nt, Pseudomonas aeruginosa PA01
cgauagcucagucgguagag

SEQ ID NO: 3384129 - RNA, 15 nt, Pseudomonas aeruginosa PA01
cgauaggccuugccu

SEQ ID NO: 3384130 - RNA, 19 nt, Pseudomonas aeruginosa PA01
cgauauagcccugggcgcc

SEQ ID NO: 3384131 - RNA, 16 nt, Pseudomonas aeruginosa PA01
cgauauaggcgacgau

SEQ ID NO: 3384132 - RNA, 19 nt, Pseudomonas aeruginosa PA01
cgauauaggcgacgaucag

SEQ ID NO: 3384133 - RNA, 17 nt, Pseudomonas aeruginosa PA01
cgauauccacgccgucg

SEQ ID NO: 3384134 - RNA, 16 nt, Pseudomonas aeruginosa PA01
cgauaucccgccgccg

SEQ ID NO: 3384135 - RNA, 15 nt, Pseudomonas aeruginosa PA01
cgauauccguagccg

SEQ ID NO: 3384136 - RNA, 12 nt, Pseudomonas aeruginosa PA01
cgauaucggcgc

SEQ ID NO: 3384137 - RNA, 13 nt, Pseudomonas aeruginosa PA01
cgauaucggcgcc

SEQ ID NO: 3384138 - RNA, 19 nt, Pseudomonas aeruginosa PA01
cgauauggccgaucaccug

SEQ ID NO: 3384139 - RNA, 22 nt, Pseudomonas aeruginosa PA01
cgauauugaacgacucgucgcc

SEQ ID NO: 3384140 - RNA, 13 nt, Pseudomonas aeruginosa PA01
cgaucaccaccag

SEQ ID NO: 3384141 - RNA, 16 nt, Pseudomonas aeruginosa PA01
cgaucaccaccagcau

SEQ ID NO: 3384142 - RNA, 16 nt, Pseudomonas aeruginosa PA01
cgaucaccaccagcgc

SEQ ID NO: 3384143 - RNA, 19 nt, Pseudomonas aeruginosa PA01
cgaucaccaccagcgccgc

SEQ ID NO: 3384144 - RNA, 20 nt, Pseudomonas aeruginosa PA01
cgaucaccaccagcgccgcc

SEQ ID NO: 3384145 - RNA, 12 nt, Pseudomonas aeruginosa PA01
cgaucaccagcg

SEQ ID NO: 3384146 - RNA, 20 nt, Pseudomonas aeruginosa PA01
cgaucaccagcgccaggccg

SEQ ID NO: 3384147 - RNA, 23 nt, Pseudomonas aeruginosa PA01
cgaucaccagcgccaggccgccg

SEQ ID NO: 3384148 - RNA, 18 nt, Pseudomonas aeruginosa PA01
cgaucaccaggaucgccg

SEQ ID NO: 3384149 - RNA, 23 nt, Pseudomonas aeruginosa PA01
cgaucaccaggaucgccgggcuu

SEQ ID NO: 3384150 - RNA, 20 nt, Pseudomonas aeruginosa PA01
cgaucaccagggugcgcucg

SEQ ID NO: 3384151 - RNA, 14 nt, Pseudomonas aeruginosa PA01
cgaucacccccagc

SEQ ID NO: 3384152 - RNA, 13 nt, Pseudomonas aeruginosa PA01
cgaucaccccgcc

SEQ ID NO: 3384153 - RNA, 14 nt, Pseudomonas aeruginosa PA01
cgaucaccccgccc

SEQ ID NO: 3384154 - RNA, 15 nt, Pseudomonas aeruginosa PA01
cgaucaccccgccca

SEQ ID NO: 3384155 - RNA, 17 nt, Pseudomonas aeruginosa PA01
cgaucacccgcgaggcc

SEQ ID NO: 3384156 - RNA, 18 nt, Pseudomonas aeruginosa PA01
cgaucacccgcgaggccg

SEQ ID NO: 3384157 - RNA, 15 nt, Pseudomonas aeruginosa PA01
cgaucaccgcaucga

SEQ ID NO: 3384158 - RNA, 23 nt, Pseudomonas aeruginosa PA01
cgaucaccgccacuaccaccacc

SEQ ID NO: 3384159 - RNA, 23 nt, Pseudomonas aeruginosa PA01
cgaucaccgcguccauccccgcc

SEQ ID NO: 3384160 - RNA, 22 nt, Pseudomonas aeruginosa PA01
cgaucaccggaucgaugcccgg

SEQ ID NO: 3384161 - RNA, 14 nt, Pseudomonas aeruginosa PA01
cgaucaccuggcca

SEQ ID NO: 3384162 - RNA, 14 nt, Pseudomonas aeruginosa PA01
cgaucaccuggccg

SEQ ID NO: 3384163 - RNA, 12 nt, Pseudomonas aeruginosa PA01
cgaucaccuuca

SEQ ID NO: 3384164 - RNA, 19 nt, Pseudomonas aeruginosa PA01
cgaucaccuugcccucgcg

SEQ ID NO: 3384165 - RNA, 19 nt, Pseudomonas aeruginosa PA01
cgaucacgccgcgcaccag

SEQ ID NO: 3384166 - RNA, 20 nt, Pseudomonas aeruginosa PA01
cgaucacgccgcgcaccagc

SEQ ID NO: 3384167 - RNA, 16 nt, Pseudomonas aeruginosa PA01
cgaucacggcgccccg

SEQ ID NO: 3384168 - RNA, 15 nt, Pseudomonas aeruginosa PA01
cgaucacguccuuga

SEQ ID NO: 3384169 - RNA, 14 nt, Pseudomonas aeruginosa PA01
cgaucacgucguac

SEQ ID NO: 3384170 - RNA, 21 nt, Pseudomonas aeruginosa PA01
cgaucacgucguacucggcgg

SEQ ID NO: 3384171 - RNA, 16 nt, Pseudomonas aeruginosa PA01
cgaucacugccuggca

SEQ ID NO: 3384172 - RNA, 17 nt, Pseudomonas aeruginosa PA01
cgaucagaacgaugccg

SEQ ID NO: 3384173 - RNA, 14 nt, Pseudomonas aeruginosa PA01
cgaucagcaccagc

SEQ ID NO: 3384174 - RNA, 16 nt, Pseudomonas aeruginosa PA01
cgaucagcaccgccac

SEQ ID NO: 3384175 - RNA, 17 nt, Pseudomonas aeruginosa PA01
cgaucagcaccgccacc

SEQ ID NO: 3384176 - RNA, 14 nt, Pseudomonas aeruginosa PA01
cgaucagcagcagc

SEQ ID NO: 3384177 - RNA, 16 nt, Pseudomonas aeruginosa PA01
cgaucagcagcagcgc

SEQ ID NO: 3384178 - RNA, 14 nt, Pseudomonas aeruginosa PA01
cgaucagcagcgcc

SEQ ID NO: 3384179 - RNA, 21 nt, Pseudomonas aeruginosa PA01
cgaucagccauuggccgacgc

SEQ ID NO: 3384180 - RNA, 19 nt, Pseudomonas aeruginosa PA01
cgaucgccucggccaucga

SEQ ID NO: 3384181 - RNA, 18 nt, Pseudomonas aeruginosa PA01
cgaucgccucgggcgagc

SEQ ID NO: 3384182 - RNA, 17 nt, Pseudomonas aeruginosa PA01
cgaucgccucgucgagc

SEQ ID NO: 3384183 - RNA, 22 nt, Pseudomonas aeruginosa PA01
cgaucgccucgucgagcgcagc

SEQ ID NO: 3384184 - RNA, 13 nt, Pseudomonas aeruginosa PA01
cgaucgccucguu

SEQ ID NO: 3384185 - RNA, 21 nt, Pseudomonas aeruginosa PA01
cgaucgccucguucagcagca

SEQ ID NO: 3384186 - RNA, 22 nt, Pseudomonas aeruginosa PA01
cgaucgcggccagccgcuagcg

SEQ ID NO: 3384187 - RNA, 14 nt, Pseudomonas aeruginosa PA01
cgaucgcguuccag

SEQ ID NO: 3384188 - RNA, 20 nt, Pseudomonas aeruginosa PA01
cgaucggaugcacgugcagc

SEQ ID NO: 3384189 - RNA, 13 nt, Pseudomonas aeruginosa PA01
cgaucggcagggc

SEQ ID NO: 3384190 - RNA, 14 nt, Pseudomonas aeruginosa PA01
cgaucggcagggcg

SEQ ID NO: 3384191 - RNA, 22 nt, Pseudomonas aeruginosa PA01
cgaucggcagggcgccgaccag

SEQ ID NO: 3384192 - RNA, 16 nt, Pseudomonas aeruginosa PA01
cgaucggcccgggcgc

SEQ ID NO: 3384193 - RNA, 20 nt, Pseudomonas aeruginosa PA01
cgaucggcguccgcggccug

SEQ ID NO: 3384194 - RNA, 21 nt, Pseudomonas aeruginosa PA01
cgaucggcguccgcggccugc

SEQ ID NO: 3384195 - RNA, 17 nt, Pseudomonas aeruginosa PA01
cgaucggguagagcgcg

SEQ ID NO: 3384196 - RNA, 19 nt, Pseudomonas aeruginosa PA01
cgaucgucgagaugcugcg

SEQ ID NO: 3384197 - RNA, 17 nt, Pseudomonas aeruginosa PA01
cgaucguugccagccgg

SEQ ID NO: 3384198 - RNA, 18 nt, Pseudomonas aeruginosa PA01
cgaucguugccagccggc

SEQ ID NO: 3384199 - RNA, 20 nt, Pseudomonas aeruginosa PA01
cgaucguugccagccggccu

SEQ ID NO: 3384200 - RNA, 22 nt, Pseudomonas aeruginosa PA01
cgaucguugccagccggccuug

SEQ ID NO: 3384201 - RNA, 14 nt, Pseudomonas aeruginosa PA01
cgaucguuggcgaa

SEQ ID NO: 3384202 - RNA, 18 nt, Pseudomonas aeruginosa PA01
cgaucuaccugcgugcgc

SEQ ID NO: 3384203 - RNA, 12 nt, Pseudomonas aeruginosa PA01
cgaucucaucgc

SEQ ID NO: 3384204 - RNA, 13 nt, Pseudomonas aeruginosa PA01
cgaucucaucgcc

SEQ ID NO: 3384205 - RNA, 22 nt, Pseudomonas aeruginosa PA01
cgaucucccgcgauucgccggg

SEQ ID NO: 3384206 - RNA, 18 nt, Pseudomonas aeruginosa PA01
cgaucuccgccaggcggc

SEQ ID NO: 3384207 - RNA, 21 nt, Pseudomonas aeruginosa PA01
cgaucuccgccaggcggccga

SEQ ID NO: 3384208 - RNA, 16 nt, Pseudomonas aeruginosa PA01
cgaucuccgcuuccgc

SEQ ID NO: 3384209 - RNA, 17 nt, Pseudomonas aeruginosa PA01
cgaucuccuccucggcg

SEQ ID NO: 3384210 - RNA, 17 nt, Pseudomonas aeruginosa PA01
cgaucuccucgauccgc

SEQ ID NO: 3384211 - RNA, 12 nt, Pseudomonas aeruginosa PA01
cgaucuccucgc

SEQ ID NO: 3384212 - RNA, 13 nt, Pseudomonas aeruginosa PA01
cgaucuccugccg

SEQ ID NO: 3384213 - RNA, 16 nt, Pseudomonas aeruginosa PA01
cgaucuccugccgcgg

SEQ ID NO: 3384214 - RNA, 17 nt, Pseudomonas aeruginosa PA01
cgaucuccugccgcggc

SEQ ID NO: 3384215 - RNA, 15 nt, Pseudomonas aeruginosa PA01
cgaucuccugcuggg

SEQ ID NO: 3384216 - RNA, 23 nt, Pseudomonas aeruginosa PA01
cgaucuccugcugggcgucgaac

SEQ ID NO: 3384217 - RNA, 14 nt, Pseudomonas aeruginosa PA01
cgaucucgaagacc

SEQ ID NO: 3384218 - RNA, 15 nt, Pseudomonas aeruginosa PA01
cgaucucgaucgagu

SEQ ID NO: 3384219 - RNA, 20 nt, Pseudomonas aeruginosa PA01
cgaucucgaugaccuugccg

SEQ ID NO: 3384220 - RNA, 14 nt, Pseudomonas aeruginosa PA01
cgaucucgccgaag

SEQ ID NO: 3384221 - RNA, 23 nt, Pseudomonas aeruginosa PA01
cgaucucgcgggcuaccaggaag

SEQ ID NO: 3384222 - RNA, 23 nt, Pseudomonas aeruginosa PA01
cgaucucguagcggucgugcagc

SEQ ID NO: 3384223 - RNA, 14 nt, Pseudomonas aeruginosa PA01
cgaucucguccucg

SEQ ID NO: 3384224 - RNA, 13 nt, Pseudomonas aeruginosa PA01
cgaucucgucggc

SEQ ID NO: 3384225 - RNA, 23 nt, Pseudomonas aeruginosa PA01
cgaucucgucggcggggcgcacc

SEQ ID NO: 3384226 - RNA, 23 nt, Pseudomonas aeruginosa PA01
cgaucucgugcuuggugucggcc

SEQ ID NO: 3384227 - RNA, 18 nt, Pseudomonas aeruginosa PA01
cgaucucgugggccagca

SEQ ID NO: 3384228 - RNA, 20 nt, Pseudomonas aeruginosa PA01
cgaucucgugggccagcagg

SEQ ID NO: 3384229 - RNA, 16 nt, Pseudomonas aeruginosa PA01
cgaucucuacuaccgc

SEQ ID NO: 3384230 - RNA, 19 nt, Pseudomonas aeruginosa PA01
cgaucucuacuaccgccag

SEQ ID NO: 3384231 - RNA, 23 nt, Pseudomonas aeruginosa PA01
cgaucucuacuaccgccagcgca

SEQ ID NO: 3384232 - RNA, 15 nt, Pseudomonas aeruginosa PA01
cgaucucucagucca

SEQ ID NO: 3384233 - RNA, 17 nt, Pseudomonas aeruginosa PA01
cgaucugcgccgcaagc

SEQ ID NO: 3384234 - RNA, 14 nt, Pseudomonas aeruginosa PA01
cgaucugcuugcgc

SEQ ID NO: 3384235 - RNA, 16 nt, Pseudomonas aeruginosa PA01
cgaucugcuugcgcgc

SEQ ID NO: 3384236 - RNA, 21 nt, Pseudomonas aeruginosa PA01
cgaucuggcagucgucgcagc

SEQ ID NO: 3384237 - RNA, 23 nt, Pseudomonas aeruginosa PA01
cgaucuggcagucgucgcagccg

SEQ ID NO: 3384238 - RNA, 13 nt, Pseudomonas aeruginosa PA01
cgaucuggcugcc

SEQ ID NO: 3384239 - RNA, 17 nt, Pseudomonas aeruginosa PA01
cgaucuggcugcccagg

SEQ ID NO: 3384240 - RNA, 19 nt, Pseudomonas aeruginosa PA01
cgaucuggcugcccaggcu

SEQ ID NO: 3384241 - RNA, 21 nt, Pseudomonas aeruginosa PA01
cgaucugucgauaccagcgcc

SEQ ID NO: 3384242 - RNA, 22 nt, Pseudomonas aeruginosa PA01
cgaucugucgauaccagcgccg

SEQ ID NO: 3384243 - RNA, 14 nt, Pseudomonas aeruginosa PA01
cgaucuucgaguag

SEQ ID NO: 3384244 - RNA, 14 nt, Pseudomonas aeruginosa PA01
cgaucuucgccgac

SEQ ID NO: 3384245 - RNA, 14 nt, Pseudomonas aeruginosa PA01
cgaucuucuccgcc

SEQ ID NO: 3384246 - RNA, 17 nt, Pseudomonas aeruginosa PA01
cgaucuucuccgccgcg

SEQ ID NO: 3384247 - RNA, 17 nt, Pseudomonas aeruginosa PA01
cgaucuucuuccccgcc

SEQ ID NO: 3384248 - RNA, 19 nt, Pseudomonas aeruginosa PA01
cgaucuugaucgccagcgg

SEQ ID NO: 3384249 - RNA, 17 nt, Pseudomonas aeruginosa PA01
cgaucuugcccaugugc

SEQ ID NO: 3384250 - RNA, 18 nt, Pseudomonas aeruginosa PA01
cgaugaaaccggccucga

SEQ ID NO: 3384251 - RNA, 17 nt, Pseudomonas aeruginosa PA01
cgaugaaacgcagggcc

SEQ ID NO: 3384252 - RNA, 18 nt, Pseudomonas aeruginosa PA01
cgaugaaagagcccgcgg

SEQ ID NO: 3384253 - RNA, 23 nt, Pseudomonas aeruginosa PA01
cgaugaaauagccggcgaugccg

SEQ ID NO: 3384254 - RNA, 23 nt, Pseudomonas aeruginosa PA01
cgaugaacaagugcucgauggcg

SEQ ID NO: 3384255 - RNA, 22 nt, Pseudomonas aeruginosa PA01
cgaugaacaccgcuucgagcac

SEQ ID NO: 3384256 - RNA, 23 nt, Pseudomonas aeruginosa PA01
cgaugaacaccgcuucgagcacc

SEQ ID NO: 3384257 - RNA, 16 nt, Pseudomonas aeruginosa PA01
cgaugaacagcgcgaa

SEQ ID NO: 3384258 - RNA, 19 nt, Pseudomonas aeruginosa PA01
cgaugaacagugcgcccgu

SEQ ID NO: 3384259 - RNA, 21 nt, Pseudomonas aeruginosa PA01
cgaugaacagugcgcccgugg

SEQ ID NO: 3384260 - RNA, 14 nt, Pseudomonas aeruginosa PA01
cgaugaacgcgcgg

SEQ ID NO: 3384261 - RNA, 15 nt, Pseudomonas aeruginosa PA01
cgaugaacggcguca

SEQ ID NO: 3384262 - RNA, 20 nt, Pseudomonas aeruginosa PA01
cgaugaacggcgucacgccg

SEQ ID NO: 3384263 - RNA, 16 nt, Pseudomonas aeruginosa PA01
cgaugaagcugaugcc

SEQ ID NO: 3384264 - RNA, 16 nt, Pseudomonas aeruginosa PA01
cgaugaaggucagcac

SEQ ID NO: 3384265 - RNA, 14 nt, Pseudomonas aeruginosa PA01
cgaugaaugcgcag

SEQ ID NO: 3384266 - RNA, 21 nt, Pseudomonas aeruginosa PA01
cgaugacauggaaagcaucgu

SEQ ID NO: 3384267 - RNA, 22 nt, Pseudomonas aeruginosa PA01
cgaugaccaggguggcggcggc

SEQ ID NO: 3384268 - RNA, 23 nt, Pseudomonas aeruginosa PA01
cgaugaccaggguggcggcggcg

SEQ ID NO: 3384269 - RNA, 18 nt, Pseudomonas aeruginosa PA01
cgaugaccgccccggcag

SEQ ID NO: 3384270 - RNA, 19 nt, Pseudomonas aeruginosa PA01
cgaugaccgccccggcagc

SEQ ID NO: 3384271 - RNA, 17 nt, Pseudomonas aeruginosa PA01
cgaugaccuugccgcga

SEQ ID NO: 3384272 - RNA, 19 nt, Pseudomonas aeruginosa PA01
cgaugaccuugccgcgaau

SEQ ID NO: 3384273 - RNA, 21 nt, Pseudomonas aeruginosa PA01
cgaugacggugauucguccgg

SEQ ID NO: 3384274 - RNA, 22 nt, Pseudomonas aeruginosa PA01
cgaugacggugauucguccgga

SEQ ID NO: 3384275 - RNA, 19 nt, Pseudomonas aeruginosa PA01
cgaugacguugcugcccug

SEQ ID NO: 3384276 - RNA, 16 nt, Pseudomonas aeruginosa PA01
cgaugagcaugccgca

SEQ ID NO: 3384277 - RNA, 18 nt, Pseudomonas aeruginosa PA01
cgaugagcaugccgcaga

SEQ ID NO: 3384278 - RNA, 23 nt, Pseudomonas aeruginosa PA01
cgaugagccagccugcagccagc

SEQ ID NO: 3384279 - RNA, 17 nt, Pseudomonas aeruginosa PA01
cgaugagcuucgccggg

SEQ ID NO: 3384280 - RNA, 23 nt, Pseudomonas aeruginosa PA01
cgaugaggaugcugaucagcacc

SEQ ID NO: 3384281 - RNA, 21 nt, Pseudomonas aeruginosa PA01
cgaugaggcguggggaagacg

SEQ ID NO: 3384282 - RNA, 15 nt, Pseudomonas aeruginosa PA01
cgaugcuguucagca

SEQ ID NO: 3384283 - RNA, 17 nt, Pseudomonas aeruginosa PA01
cgauggaaaucggccac

SEQ ID NO: 3384284 - RNA, 20 nt, Pseudomonas aeruginosa PA01
cgauggaacgaagaaccccg

SEQ ID NO: 3384285 - RNA, 20 nt, Pseudomonas aeruginosa PA01
cgauggaaguugcgcacccg

SEQ ID NO: 3384286 - RNA, 20 nt, Pseudomonas aeruginosa PA01
cgauggacucgaucacaucg

SEQ ID NO: 3384287 - RNA, 22 nt, Pseudomonas aeruginosa PA01
cgauggagauguagucgacgcc

SEQ ID NO: 3384288 - RNA, 22 nt, Pseudomonas aeruginosa PA01
cgauggauaugaaccgucggca

SEQ ID NO: 3384289 - RNA, 15 nt, Pseudomonas aeruginosa PA01
cgauggaugacccgc

SEQ ID NO: 3384290 - RNA, 18 nt, Pseudomonas aeruginosa PA01
cgauggcagccuuggcca

SEQ ID NO: 3384291 - RNA, 19 nt, Pseudomonas aeruginosa PA01
cgauggcagccuuggccac

SEQ ID NO: 3384292 - RNA, 13 nt, Pseudomonas aeruginosa PA01
cgauggccagccc

SEQ ID NO: 3384293 - RNA, 17 nt, Pseudomonas aeruginosa PA01
cgauggccaucaggguc

SEQ ID NO: 3384294 - RNA, 12 nt, Pseudomonas aeruginosa PA01
cgauggcccaga

SEQ ID NO: 3384295 - RNA, 18 nt, Pseudomonas aeruginosa PA01
cgauggcccagaugauca

SEQ ID NO: 3384296 - RNA, 16 nt, Pseudomonas aeruginosa PA01
cgauggccccggcgau

SEQ ID NO: 3384297 - RNA, 11 nt, Pseudomonas aeruginosa PA01
cgauggccgcc

SEQ ID NO: 3384298 - RNA, 19 nt, Pseudomonas aeruginosa PA01
cgauggccgccagcaggcc

SEQ ID NO: 3384299 - RNA, 21 nt, Pseudomonas aeruginosa PA01
cgauggccgccagcaggccga

SEQ ID NO: 3384300 - RNA, 15 nt, Pseudomonas aeruginosa PA01
cgauggccggcacca

SEQ ID NO: 3384301 - RNA, 14 nt, Pseudomonas aeruginosa PA01
cgauggccggcagc

SEQ ID NO: 3384302 - RNA, 18 nt, Pseudomonas aeruginosa PA01
cgauggccggcagcagcg

SEQ ID NO: 3384303 - RNA, 23 nt, Pseudomonas aeruginosa PA01
cgauggccuggucggcgcggcgc

SEQ ID NO: 3384304 - RNA, 12 nt, Pseudomonas aeruginosa PA01
cgauggcgaagc

SEQ ID NO: 3384305 - RNA, 17 nt, Pseudomonas aeruginosa PA01
cgauggcgauauggccg

SEQ ID NO: 3384306 - RNA, 17 nt, Pseudomonas aeruginosa PA01
cgauggcgcaccacugc

SEQ ID NO: 3384307 - RNA, 13 nt, Pseudomonas aeruginosa PA01
cgauggcgccgcc

SEQ ID NO: 3384308 - RNA, 14 nt, Pseudomonas aeruginosa PA01
cgauggcgccgcga

SEQ ID NO: 3384309 - RNA, 13 nt, Pseudomonas aeruginosa PA01
cgauggcgcggug

SEQ ID NO: 3384310 - RNA, 20 nt, Pseudomonas aeruginosa PA01
cgauggcggcauugagcgcc

SEQ ID NO: 3384311 - RNA, 23 nt, Pseudomonas aeruginosa PA01
cgauggcggcauugagggcgagg

SEQ ID NO: 3384312 - RNA, 14 nt, Pseudomonas aeruginosa PA01
cgauggcggccgcc

SEQ ID NO: 3384313 - RNA, 15 nt, Pseudomonas aeruginosa PA01
cgauggcggccgcca

SEQ ID NO: 3384314 - RNA, 18 nt, Pseudomonas aeruginosa PA01
cgauggcggccugguagu

SEQ ID NO: 3384315 - RNA, 13 nt, Pseudomonas aeruginosa PA01
cgauggcggcggc

SEQ ID NO: 3384316 - RNA, 21 nt, Pseudomonas aeruginosa PA01
cgauggcguagaggcucggcg

SEQ ID NO: 3384317 - RNA, 23 nt, Pseudomonas aeruginosa PA01
cgauggcgugaaguagccgccgg

SEQ ID NO: 3384318 - RNA, 15 nt, Pseudomonas aeruginosa PA01
cgauggcguguucau

SEQ ID NO: 3384319 - RNA, 19 nt, Pseudomonas aeruginosa PA01
cgauggcguuguuggucag

SEQ ID NO: 3384320 - RNA, 13 nt, Pseudomonas aeruginosa PA01
cgauggcucgcgg

SEQ ID NO: 3384321 - RNA, 21 nt, Pseudomonas aeruginosa PA01
cgauggcugucggcgcccaau

SEQ ID NO: 3384322 - RNA, 20 nt, Pseudomonas aeruginosa PA01
cgaugggcacgaucugcgcc

SEQ ID NO: 3384323 - RNA, 16 nt, Pseudomonas aeruginosa PA01
cgaugggccguaggug

SEQ ID NO: 3384324 - RNA, 17 nt, Pseudomonas aeruginosa PA01
cgaugggccguagguga

SEQ ID NO: 3384325 - RNA, 19 nt, Pseudomonas aeruginosa PA01
cgaugggugccgcgcaggu

SEQ ID NO: 3384326 - RNA, 18 nt, Pseudomonas aeruginosa PA01
cgaugguauggcggucgg

SEQ ID NO: 3384327 - RNA, 19 nt, Pseudomonas aeruginosa PA01
cgauggucacuggcgaggc

SEQ ID NO: 3384328 - RNA, 21 nt, Pseudomonas aeruginosa PA01
cgauggucaggcuggccccgg

SEQ ID NO: 3384329 - RNA, 23 nt, Pseudomonas aeruginosa PA01
cgauggucagguaggagaugcag

SEQ ID NO: 3384330 - RNA, 23 nt, Pseudomonas aeruginosa PA01
cgaugguccccggccccgcggua

SEQ ID NO: 3384331 - RNA, 13 nt, Pseudomonas aeruginosa PA01
cgauggucgccgc

SEQ ID NO: 3384332 - RNA, 19 nt, Pseudomonas aeruginosa PA01
cgauggugauacgcaggaa

SEQ ID NO: 3384333 - RNA, 18 nt, Pseudomonas aeruginosa PA01
cgauggugaucacgucgg

SEQ ID NO: 3384334 - RNA, 22 nt, Pseudomonas aeruginosa PA01
cgauggugaucacgucggcguc

SEQ ID NO: 3384335 - RNA, 17 nt, Pseudomonas aeruginosa PA01
cgaugguggucggcagc

SEQ ID NO: 3384336 - RNA, 18 nt, Pseudomonas aeruginosa PA01
cgaugguuucgugccauu

SEQ ID NO: 3384337 - RNA, 16 nt, Pseudomonas aeruginosa PA01
cgauguacggcaccac

SEQ ID NO: 3384338 - RNA, 15 nt, Pseudomonas aeruginosa PA01
cgauguacugcucgg

SEQ ID NO: 3384339 - RNA, 20 nt, Pseudomonas aeruginosa PA01
cgauguaggccucggccugg

SEQ ID NO: 3384340 - RNA, 18 nt, Pseudomonas aeruginosa PA01
cgauguaggucaccgcgc

SEQ ID NO: 3384341 - RNA, 21 nt, Pseudomonas aeruginosa PA01
cgauguauccguacuggcgcc

SEQ ID NO: 3384342 - RNA, 16 nt, Pseudomonas aeruginosa PA01
cgauguccaggccgau

SEQ ID NO: 3384343 - RNA, 20 nt, Pseudomonas aeruginosa PA01
cgauguccccggccagcagc

SEQ ID NO: 3384344 - RNA, 17 nt, Pseudomonas aeruginosa PA01
cgauguccucgaacagc

SEQ ID NO: 3384345 - RNA, 12 nt, Pseudomonas aeruginosa PA01
cgauguccugga

SEQ ID NO: 3384346 - RNA, 23 nt, Pseudomonas aeruginosa PA01
cgauguccuggaucggcagcucg

SEQ ID NO: 3384347 - RNA, 14 nt, Pseudomonas aeruginosa PA01
cgauguccugggcc

SEQ ID NO: 3384348 - RNA, 22 nt, Pseudomonas aeruginosa PA01
cgauguccugggccaccuggcu

SEQ ID NO: 3384349 - RNA, 14 nt, Pseudomonas aeruginosa PA01
cgaugucgaccugg

SEQ ID NO: 3384350 - RNA, 15 nt, Pseudomonas aeruginosa PA01
cgaugucgaccuggg

SEQ ID NO: 3384351 - RNA, 18 nt, Pseudomonas aeruginosa PA01
cgaugucgcggcugaagg

SEQ ID NO: 3384352 - RNA, 22 nt, Pseudomonas aeruginosa PA01
cgaugucgcggcugaaggccga

SEQ ID NO: 3384353 - RNA, 23 nt, Pseudomonas aeruginosa PA01
cgaugucgcggcugaaggccgaa

SEQ ID NO: 3384354 - RNA, 13 nt, Pseudomonas aeruginosa PA01
cgaugucgcgggc

SEQ ID NO: 3384355 - RNA, 23 nt, Pseudomonas aeruginosa PA01
cgaugucgcggguuacuucgccg

SEQ ID NO: 3384356 - RNA, 18 nt, Pseudomonas aeruginosa PA01
cgaugucggccugcagcc

SEQ ID NO: 3384357 - RNA, 18 nt, Pseudomonas aeruginosa PA01
cgaugucguagccgcgcg

SEQ ID NO: 3384358 - RNA, 21 nt, Pseudomonas aeruginosa PA01
cgaugucguggucgccgucca

SEQ ID NO: 3384359 - RNA, 14 nt, Pseudomonas aeruginosa PA01
cgaugugcacgcug

SEQ ID NO: 3384360 - RNA, 22 nt, Pseudomonas aeruginosa PA01
cgaugugcuugagucgcaggcu

SEQ ID NO: 3384361 - RNA, 18 nt, Pseudomonas aeruginosa PA01
cgauguucgaggcgccga

SEQ ID NO: 3384362 - RNA, 21 nt, Pseudomonas aeruginosa PA01
cgauguucgaggcgccgacca

SEQ ID NO: 3384363 - RNA, 19 nt, Pseudomonas aeruginosa PA01
cgauguugacgauggcgcc

SEQ ID NO: 3384364 - RNA, 14 nt, Pseudomonas aeruginosa PA01
cgauguugcgcagg

SEQ ID NO: 3384365 - RNA, 20 nt, Pseudomonas aeruginosa PA01
cgauguuggcgucgaacagc

SEQ ID NO: 3384366 - RNA, 16 nt, Pseudomonas aeruginosa PA01
cgauguuuccgacccg

SEQ ID NO: 3384367 - RNA, 15 nt, Pseudomonas aeruginosa PA01
cgauucccagugcuc

SEQ ID NO: 3384368 - RNA, 18 nt, Pseudomonas aeruginosa PA01
cgauucccagugcucccg

SEQ ID NO: 3384369 - RNA, 11 nt, Pseudomonas aeruginosa PA01
cgauuccucua

SEQ ID NO: 3384370 - RNA, 12 nt, Pseudomonas aeruginosa PA01
cgauuccucuau

SEQ ID NO: 3384371 - RNA, 14 nt, Pseudomonas aeruginosa PA01
cgauuccugcggcu

SEQ ID NO: 3384372 - RNA, 18 nt, Pseudomonas aeruginosa PA01
cgauuccugcggcuugcc

SEQ ID NO: 3384373 - RNA, 17 nt, Pseudomonas aeruginosa PA01
cgauucgacgcagcgcg

SEQ ID NO: 3384374 - RNA, 18 nt, Pseudomonas aeruginosa PA01
cgauucgccggccaccag

SEQ ID NO: 3384375 - RNA, 13 nt, Pseudomonas aeruginosa PA01
cgauucgccgggc

SEQ ID NO: 3384376 - RNA, 13 nt, Pseudomonas aeruginosa PA01
cgauucgcggcga

SEQ ID NO: 3384377 - RNA, 17 nt, Pseudomonas aeruginosa PA01
cgauucguucgagcagc

SEQ ID NO: 3384378 - RNA, 19 nt, Pseudomonas aeruginosa PA01
cgauucuccugggcggucu

SEQ ID NO: 3384379 - RNA, 15 nt, Pseudomonas aeruginosa PA01
cgauugaccucccgc

SEQ ID NO: 3384380 - RNA, 18 nt, Pseudomonas aeruginosa PA01
cgauugaccucccgcgcc

SEQ ID NO: 3384381 - RNA, 14 nt, Pseudomonas aeruginosa PA01
cgauugcuacagca

SEQ ID NO: 3384382 - RNA, 21 nt, Pseudomonas aeruginosa PA01
cgauuggagaugcucaggcgc

SEQ ID NO: 3384383 - RNA, 20 nt, Pseudomonas aeruginosa PA01
cgauuguccaccggcccgga

SEQ ID NO: 3384384 - RNA, 13 nt, Pseudomonas aeruginosa PA01
cgcaccagccggc

SEQ ID NO: 3384385 - RNA, 15 nt, Pseudomonas aeruginosa PA01
cgcaccagccggcgc

SEQ ID NO: 3384386 - RNA, 16 nt, Pseudomonas aeruginosa PA01
cgcaccagccggcgcu

SEQ ID NO: 3384387 - RNA, 14 nt, Pseudomonas aeruginosa PA01
cgcaccagcggguc

SEQ ID NO: 3384388 - RNA, 21 nt, Pseudomonas aeruginosa PA01
cgcaccagcgguacguagcgc

SEQ ID NO: 3384389 - RNA, 13 nt, Pseudomonas aeruginosa PA01
cgcaccagcuccc

SEQ ID NO: 3384390 - RNA, 12 nt, Pseudomonas aeruginosa PA01
cgcaccaggcca

SEQ ID NO: 3384391 - RNA, 15 nt, Pseudomonas aeruginosa PA01
cgcaccaggccaggc

SEQ ID NO: 3384392 - RNA, 21 nt, Pseudomonas aeruginosa PA01
cgcaccaggccaggcugcgcu

SEQ ID NO: 3384393 - RNA, 20 nt, Pseudomonas aeruginosa PA01
cgcaccaggccagguggucg

SEQ ID NO: 3384394 - RNA, 15 nt, Pseudomonas aeruginosa PA01
cgcaccagggccagg

SEQ ID NO: 3384395 - RNA, 16 nt, Pseudomonas aeruginosa PA01
cgcaccagggccagga

SEQ ID NO: 3384396 - RNA, 19 nt, Pseudomonas aeruginosa PA01
cgcaccagggccaggagca

SEQ ID NO: 3384397 - RNA, 14 nt, Pseudomonas aeruginosa PA01
cgcaccagggucgg

SEQ ID NO: 3384398 - RNA, 16 nt, Pseudomonas aeruginosa PA01
cgcaccaggucgcgcu

SEQ ID NO: 3384399 - RNA, 12 nt, Pseudomonas aeruginosa PA01
cgcaccaggugc

SEQ ID NO: 3384400 - RNA, 21 nt, Pseudomonas aeruginosa PA01
cgcaccauagcgagccgcgcu

SEQ ID NO: 3384401 - RNA, 17 nt, Pseudomonas aeruginosa PA01
cgcaccauccgccgcag

SEQ ID NO: 3384402 - RNA, 18 nt, Pseudomonas aeruginosa PA01
cgcaccauccgccgcagg

SEQ ID NO: 3384403 - RNA, 13 nt, Pseudomonas aeruginosa PA01
cgcaccauccucg

SEQ ID NO: 3384404 - RNA, 17 nt, Pseudomonas aeruginosa PA01
cgcaccaugcccgcugg

SEQ ID NO: 3384405 - RNA, 17 nt, Pseudomonas aeruginosa PA01
cgcaccccauccucgcc

SEQ ID NO: 3384406 - RNA, 16 nt, Pseudomonas aeruginosa PA01
cgcacccgggcaacug

SEQ ID NO: 3384407 - RNA, 21 nt, Pseudomonas aeruginosa PA01
cgcaccgacgccgccugcgcc

SEQ ID NO: 3384408 - RNA, 12 nt, Pseudomonas aeruginosa PA01
cgcaccgccaag

SEQ ID NO: 3384409 - RNA, 12 nt, Pseudomonas aeruginosa PA01
cgcaccgccagc

SEQ ID NO: 3384410 - RNA, 13 nt, Pseudomonas aeruginosa PA01
cgcaccgccagca

SEQ ID NO: 3384411 - RNA, 17 nt, Pseudomonas aeruginosa PA01
cgcaccgccagcgucgc

SEQ ID NO: 3384412 - RNA, 20 nt, Pseudomonas aeruginosa PA01
cgcaccgccagcgucgccgc

SEQ ID NO: 3384413 - RNA, 15 nt, Pseudomonas aeruginosa PA01
cgcaccgccucgugc

SEQ ID NO: 3384414 - RNA, 22 nt, Pseudomonas aeruginosa PA01
cgcaccgccucgugcagcaagc

SEQ ID NO: 3384415 - RNA, 15 nt, Pseudomonas aeruginosa PA01
cgcaccgccugcagc

SEQ ID NO: 3384416 - RNA, 15 nt, Pseudomonas aeruginosa PA01
cgcaccgcgccggga

SEQ ID NO: 3384417 - RNA, 13 nt, Pseudomonas aeruginosa PA01
cgcaccgcggcga

SEQ ID NO: 3384418 - RNA, 14 nt, Pseudomonas aeruginosa PA01
cgcaccgcggcgag

SEQ ID NO: 3384419 - RNA, 15 nt, Pseudomonas aeruginosa PA01
cgcaccgcggcgagc

SEQ ID NO: 3384420 - RNA, 16 nt, Pseudomonas aeruginosa PA01
cgcaccgcggcgagcc

SEQ ID NO: 3384421 - RNA, 21 nt, Pseudomonas aeruginosa PA01
cgcaccggcauguagcgcgcc

SEQ ID NO: 3384422 - RNA, 15 nt, Pseudomonas aeruginosa PA01
cgcaccggcgcgccg

SEQ ID NO: 3384423 - RNA, 16 nt, Pseudomonas aeruginosa PA01
cgcaccggcgcgccgg

SEQ ID NO: 3384424 - RNA, 12 nt, Pseudomonas aeruginosa PA01
cgcaccggcuuc

SEQ ID NO: 3384425 - RNA, 16 nt, Pseudomonas aeruginosa PA01
cgcaccgggaggcgcc

SEQ ID NO: 3384426 - RNA, 18 nt, Pseudomonas aeruginosa PA01
cgcaccgggaggcgccgc

SEQ ID NO: 3384427 - RNA, 21 nt, Pseudomonas aeruginosa PA01
cgcaccgggaggcgccgcgcc

SEQ ID NO: 3384428 - RNA, 22 nt, Pseudomonas aeruginosa PA01
cgcaccgggaggcgccgcgcca

SEQ ID NO: 3384429 - RNA, 24 nt, Pseudomonas aeruginosa PA01
cgcaccgggaggcgccgcgccagg

SEQ ID NO: 3384430 - RNA, 17 nt, Pseudomonas aeruginosa PA01
cgcaccguagcggcugc

SEQ ID NO: 3384431 - RNA, 19 nt, Pseudomonas aeruginosa PA01
cgcaccuacccgagcaacu

SEQ ID NO: 3384432 - RNA, 14 nt, Pseudomonas aeruginosa PA01
cgcaccuccucggg

SEQ ID NO: 3384433 - RNA, 16 nt, Pseudomonas aeruginosa PA01
cgcaccuccucgggcg

SEQ ID NO: 3384434 - RNA, 17 nt, Pseudomonas aeruginosa PA01
cgcaccuccucgggcgg

SEQ ID NO: 3384435 - RNA, 14 nt, Pseudomonas aeruginosa PA01
cgcaccuccuuggg

SEQ ID NO: 3384436 - RNA, 22 nt, Pseudomonas aeruginosa PA01
cgcaccuccuugggaucggcga

SEQ ID NO: 3384437 - RNA, 13 nt, Pseudomonas aeruginosa PA01
cgcaccucgaccg

SEQ ID NO: 3384438 - RNA, 15 nt, Pseudomonas aeruginosa PA01
cgcaccucgaccgcg

SEQ ID NO: 3384439 - RNA, 17 nt, Pseudomonas aeruginosa PA01
cgcaccucgaccgcgcc

SEQ ID NO: 3384440 - RNA, 20 nt, Pseudomonas aeruginosa PA01
cgcaccucgaccgcgccggc

SEQ ID NO: 3384441 - RNA, 13 nt, Pseudomonas aeruginosa PA01
cgcaccucgcccu

SEQ ID NO: 3384442 - RNA, 13 nt, Pseudomonas aeruginosa PA01
cgcaccucggcca

SEQ ID NO: 3384443 - RNA, 14 nt, Pseudomonas aeruginosa PA01
cgcaccucggccag

SEQ ID NO: 3384444 - RNA, 15 nt, Pseudomonas aeruginosa PA01
cgcaccucggccagg

SEQ ID NO: 3384445 - RNA, 18 nt, Pseudomonas aeruginosa PA01
cgcaccucggccaggcgg

SEQ ID NO: 3384446 - RNA, 23 nt, Pseudomonas aeruginosa PA01
cgcaccucggccaggcgguucca

SEQ ID NO: 3384447 - RNA, 18 nt, Pseudomonas aeruginosa PA01
cgcaccucgucgagcagc

SEQ ID NO: 3384448 - RNA, 19 nt, Pseudomonas aeruginosa PA01
cgcaccucgucgagcagcg

SEQ ID NO: 3384449 - RNA, 22 nt, Pseudomonas aeruginosa PA01
cgcaccucgucgagcagcgcgc

SEQ ID NO: 3384450 - RNA, 16 nt, Pseudomonas aeruginosa PA01
cgcaccuggcggucgc

SEQ ID NO: 3384451 - RNA, 21 nt, Pseudomonas aeruginosa PA01
cgcaccuggcggucgccgccg

SEQ ID NO: 3384452 - RNA, 23 nt, Pseudomonas aeruginosa PA01
cgcaccuggcggucgccgccggc

SEQ ID NO: 3384453 - RNA, 21 nt, Pseudomonas aeruginosa PA01
cgcaccugggacucccgcaga

SEQ ID NO: 3384454 - RNA, 21 nt, Pseudomonas aeruginosa PA01
cgcaccugggcguuggccagc

SEQ ID NO: 3384455 - RNA, 21 nt, Pseudomonas aeruginosa PA01
cgcaccugguggacacccugc

SEQ ID NO: 3384456 - RNA, 22 nt, Pseudomonas aeruginosa PA01
cgcaccuguuccagcaacgccu

SEQ ID NO: 3384457 - RNA, 14 nt, Pseudomonas aeruginosa PA01
cgcaccuguuucag

SEQ ID NO: 3384458 - RNA, 15 nt, Pseudomonas aeruginosa PA01
cgcaccuugcccugc

SEQ ID NO: 3384459 - RNA, 19 nt, Pseudomonas aeruginosa PA01
cgcaccuugcccugcauca

SEQ ID NO: 3384460 - RNA, 20 nt, Pseudomonas aeruginosa PA01
cgcaccuuggcuugcaggua

SEQ ID NO: 3384461 - RNA, 22 nt, Pseudomonas aeruginosa PA01
cgcaccuuggcuugcagguagc

SEQ ID NO: 3384462 - RNA, 20 nt, Pseudomonas aeruginosa PA01
cgcacgcaauagugcagcuc

SEQ ID NO: 3384463 - RNA, 18 nt, Pseudomonas aeruginosa PA01
cgcacgcaauggcgcagc

SEQ ID NO: 3384464 - RNA, 19 nt, Pseudomonas aeruginosa PA01
cgcacgcaauggcgcagcc

SEQ ID NO: 3384465 - RNA, 22 nt, Pseudomonas aeruginosa PA01
cgcacgcaauggcgcagccgcu

SEQ ID NO: 3384466 - RNA, 14 nt, Pseudomonas aeruginosa PA01
cgcacgcagcgccg

SEQ ID NO: 3384467 - RNA, 15 nt, Pseudomonas aeruginosa PA01
cgcacgccgcggaag

SEQ ID NO: 3384468 - RNA, 16 nt, Pseudomonas aeruginosa PA01
cgcacgccggccucgc

SEQ ID NO: 3384469 - RNA, 15 nt, Pseudomonas aeruginosa PA01
cgcacgccguggacc

SEQ ID NO: 3384470 - RNA, 14 nt, Pseudomonas aeruginosa PA01
cgcacgcgccugcu

SEQ ID NO: 3384471 - RNA, 15 nt, Pseudomonas aeruginosa PA01
cgcacgcuggugccg

SEQ ID NO: 3384472 - RNA, 18 nt, Pseudomonas aeruginosa PA01
cgcacggaggcgcucagg

SEQ ID NO: 3384473 - RNA, 19 nt, Pseudomonas aeruginosa PA01
cgcacggcgaagaacagcg

SEQ ID NO: 3384474 - RNA, 17 nt, Pseudomonas aeruginosa PA01
cgcacggcgacgcuguc

SEQ ID NO: 3384475 - RNA, 19 nt, Pseudomonas aeruginosa PA01
cgcacggucguccugcgga

SEQ ID NO: 3384476 - RNA, 20 nt, Pseudomonas aeruginosa PA01
cgcacggucguccugcggau

SEQ ID NO: 3384477 - RNA, 14 nt, Pseudomonas aeruginosa PA01
cgcacucauagcuc

SEQ ID NO: 3384478 - RNA, 16 nt, Pseudomonas aeruginosa PA01
cgcacucauagcucag

SEQ ID NO: 3384479 - RNA, 22 nt, Pseudomonas aeruginosa PA01
cgcacuccgggcagaccagcag

SEQ ID NO: 3384480 - RNA, 23 nt, Pseudomonas aeruginosa PA01
cgcacuccgggcagaccagcagc

SEQ ID NO: 3384481 - RNA, 18 nt, Pseudomonas aeruginosa PA01
cgcacucuuccugggucg

SEQ ID NO: 3384482 - RNA, 14 nt, Pseudomonas aeruginosa PA01
cgcacugccaggag

SEQ ID NO: 3384483 - RNA, 17 nt, Pseudomonas aeruginosa PA01
cgcacugccaggagcac

SEQ ID NO: 3384484 - RNA, 20 nt, Pseudomonas aeruginosa PA01
cgcacugccaggagcacgcc

SEQ ID NO: 3384485 - RNA, 21 nt, Pseudomonas aeruginosa PA01
cgcacugccaggagcacgccg

SEQ ID NO: 3384486 - RNA, 16 nt, Pseudomonas aeruginosa PA01
cgcacuggucggccag

SEQ ID NO: 3384487 - RNA, 23 nt, Pseudomonas aeruginosa PA01
cgcagcagguagugcggcgggcg

SEQ ID NO: 3384488 - RNA, 18 nt, Pseudomonas aeruginosa PA01
cgcagcaguaccuggcgg

SEQ ID NO: 3384489 - RNA, 15 nt, Pseudomonas aeruginosa PA01
cgcagcaucaucucc

SEQ ID NO: 3384490 - RNA, 19 nt, Pseudomonas aeruginosa PA01
cgcagcaucuucucggcga

SEQ ID NO: 3384491 - RNA, 21 nt, Pseudomonas aeruginosa PA01
cgcagcaucuucucggcgauu

SEQ ID NO: 3384492 - RNA, 15 nt, Pseudomonas aeruginosa PA01
cgcagccacaggcgc

SEQ ID NO: 3384493 - RNA, 16 nt, Pseudomonas aeruginosa PA01
cgcagccacaggcgcc

SEQ ID NO: 3384494 - RNA, 21 nt, Pseudomonas aeruginosa PA01
cgcagccacccgcgggcagca

SEQ ID NO: 3384495 - RNA, 20 nt, Pseudomonas aeruginosa PA01
cgcagccacccgcucgaccu

SEQ ID NO: 3384496 - RNA, 13 nt, Pseudomonas aeruginosa PA01
cgcagccacggca

SEQ ID NO: 3384497 - RNA, 15 nt, Pseudomonas aeruginosa PA01
cgcagccacggcaca

SEQ ID NO: 3384498 - RNA, 20 nt, Pseudomonas aeruginosa PA01
cgcagccacggcacacgucg

SEQ ID NO: 3384499 - RNA, 22 nt, Pseudomonas aeruginosa PA01
cgcagccacggcacacgucggc

SEQ ID NO: 3384500 - RNA, 19 nt, Pseudomonas aeruginosa PA01
cgcagccacuggcggaccg

SEQ ID NO: 3384501 - RNA, 21 nt, Pseudomonas aeruginosa PA01
cgcagccagagcuccagggcu

SEQ ID NO: 3384502 - RNA, 21 nt, Pseudomonas aeruginosa PA01
cgcagccaugaaaaagccggg

SEQ ID NO: 3384503 - RNA, 18 nt, Pseudomonas aeruginosa PA01
cgcagccauucgccgcga

SEQ ID NO: 3384504 - RNA, 20 nt, Pseudomonas aeruginosa PA01
cgcagccauucgccgcgacg

SEQ ID NO: 3384505 - RNA, 21 nt, Pseudomonas aeruginosa PA01
cgcagccauucgccgcgacgc

SEQ ID NO: 3384506 - RNA, 22 nt, Pseudomonas aeruginosa PA01
cgcagccauucgccgcgacgcu

SEQ ID NO: 3384507 - RNA, 14 nt, Pseudomonas aeruginosa PA01
cgcagcccagccgc

SEQ ID NO: 3384508 - RNA, 15 nt, Pseudomonas aeruginosa PA01
cgcagcccagccgcu

SEQ ID NO: 3384509 - RNA, 22 nt, Pseudomonas aeruginosa PA01
cgcagcccagccgcucgcgucc

SEQ ID NO: 3384510 - RNA, 19 nt, Pseudomonas aeruginosa PA01
cgcagcccaguucgcgcag

SEQ ID NO: 3384511 - RNA, 13 nt, Pseudomonas aeruginosa PA01
cgcagccccgccg

SEQ ID NO: 3384512 - RNA, 14 nt, Pseudomonas aeruginosa PA01
cgcagccccgccgg

SEQ ID NO: 3384513 - RNA, 21 nt, Pseudomonas aeruginosa PA01
cgcagcccgguccguccagcg

SEQ ID NO: 3384514 - RNA, 21 nt, Pseudomonas aeruginosa PA01
cgcagcccuugcaaccgccgc

SEQ ID NO: 3384515 - RNA, 23 nt, Pseudomonas aeruginosa PA01
cgcagccgaauacccgguugccg

SEQ ID NO: 3384516 - RNA, 18 nt, Pseudomonas aeruginosa PA01
cgcagccgcaaggccagg

SEQ ID NO: 3384517 - RNA, 13 nt, Pseudomonas aeruginosa PA01
cgcagccgcgcaa

SEQ ID NO: 3384518 - RNA, 17 nt, Pseudomonas aeruginosa PA01
cgcagccgcgcucggcc

SEQ ID NO: 3384519 - RNA, 15 nt, Pseudomonas aeruginosa PA01
cgcagccgcggggcu

SEQ ID NO: 3384520 - RNA, 20 nt, Pseudomonas aeruginosa PA01
cgcagccgcgugcgcgccgc

SEQ ID NO: 3384521 - RNA, 21 nt, Pseudomonas aeruginosa PA01
cgcagccgcgugcgcgccgcc

SEQ ID NO: 3384522 - RNA, 23 nt, Pseudomonas aeruginosa PA01
cgcagccgcgugcgcgccgccgg

SEQ ID NO: 3384523 - RNA, 18 nt, Pseudomonas aeruginosa PA01
cgcagccgcucggccgcc

SEQ ID NO: 3384524 - RNA, 19 nt, Pseudomonas aeruginosa PA01
cgcagccgcucggccgcca

SEQ ID NO: 3384525 - RNA, 21 nt, Pseudomonas aeruginosa PA01
cgcagccgcucggccgccagc

SEQ ID NO: 3384526 - RNA, 15 nt, Pseudomonas aeruginosa PA01
cgcagccgcugcugc

SEQ ID NO: 3384527 - RNA, 12 nt, Pseudomonas aeruginosa PA01
cgcagccgcugg

SEQ ID NO: 3384528 - RNA, 13 nt, Pseudomonas aeruginosa PA01
cgcagccggcgaa

SEQ ID NO: 3384529 - RNA, 14 nt, Pseudomonas aeruginosa PA01
cgcagccggcgaac

SEQ ID NO: 3384530 - RNA, 15 nt, Pseudomonas aeruginosa PA01
cgcagccggcggcga

SEQ ID NO: 3384531 - RNA, 13 nt, Pseudomonas aeruginosa PA01
cgcagccgggccg

SEQ ID NO: 3384532 - RNA, 15 nt, Pseudomonas aeruginosa PA01
cgcagccgggccgca

SEQ ID NO: 3384533 - RNA, 17 nt, Pseudomonas aeruginosa PA01
cgcagccgggccgcagc

SEQ ID NO: 3384534 - RNA, 20 nt, Pseudomonas aeruginosa PA01
cgcagccgggccgcagcgca

SEQ ID NO: 3384535 - RNA, 20 nt, Pseudomonas aeruginosa PA01
cgcagccgguggucuucagc

SEQ ID NO: 3384536 - RNA, 21 nt, Pseudomonas aeruginosa PA01
cgcagccgguggucuucagca

SEQ ID NO: 3384537 - RNA, 23 nt, Pseudomonas aeruginosa PA01
cgcagccguuggccagcaggcgc

SEQ ID NO: 3384538 - RNA, 13 nt, Pseudomonas aeruginosa PA01
cgcagccucgcgc

SEQ ID NO: 3384539 - RNA, 14 nt, Pseudomonas aeruginosa PA01
cgcagccucgcgcu

SEQ ID NO: 3384540 - RNA, 20 nt, Pseudomonas aeruginosa PA01
cgcagccugcuggccuggga

SEQ ID NO: 3384541 - RNA, 22 nt, Pseudomonas aeruginosa PA01
cgcagccuuggcaugaccgagc

SEQ ID NO: 3384542 - RNA, 23 nt, Pseudomonas aeruginosa PA01
cgcagccuuggcaugaccgagca

SEQ ID NO: 3384543 - RNA, 16 nt, Pseudomonas aeruginosa PA01
cgcagcgaacgggcgu

SEQ ID NO: 3384544 - RNA, 21 nt, Pseudomonas aeruginosa PA01
cgcagcgaacgggcguugccg

SEQ ID NO: 3384545 - RNA, 19 nt, Pseudomonas aeruginosa PA01
cgcagcgacacaacgcugc

SEQ ID NO: 3384546 - RNA, 16 nt, Pseudomonas aeruginosa PA01
cgcagcgaucagcacc

SEQ ID NO: 3384547 - RNA, 22 nt, Pseudomonas aeruginosa PA01
cgcagcgaucagcaccagcgga

SEQ ID NO: 3384548 - RNA, 23 nt, Pseudomonas aeruginosa PA01
cgcagcgcaacgaaaagccgccc

SEQ ID NO: 3384549 - RNA, 15 nt, Pseudomonas aeruginosa PA01
cgcagcgcaagucgg

SEQ ID NO: 3384550 - RNA, 13 nt, Pseudomonas aeruginosa PA01
cgcagcgcagccg

SEQ ID NO: 3384551 - RNA, 18 nt, Pseudomonas aeruginosa PA01
cgcagcgcccgauaggcg

SEQ ID NO: 3384552 - RNA, 21 nt, Pseudomonas aeruginosa PA01
cgcagcgcccgauaggcgccg

SEQ ID NO: 3384553 - RNA, 14 nt, Pseudomonas aeruginosa PA01
cgcagcgccgccgc

SEQ ID NO: 3384554 - RNA, 15 nt, Pseudomonas aeruginosa PA01
cgcagcgccgccgcg

SEQ ID NO: 3384555 - RNA, 16 nt, Pseudomonas aeruginosa PA01
cgcagcgccgccgcgu

SEQ ID NO: 3384556 - RNA, 12 nt, Pseudomonas aeruginosa PA01
cgcagcgccucc

SEQ ID NO: 3384557 - RNA, 12 nt, Pseudomonas aeruginosa PA01
cgcagcgcgcgc

SEQ ID NO: 3384558 - RNA, 14 nt, Pseudomonas aeruginosa PA01
cgcagcgcgcgccg

SEQ ID NO: 3384559 - RNA, 18 nt, Pseudomonas aeruginosa PA01
cgcagcgcgcgccgagca

SEQ ID NO: 3384560 - RNA, 13 nt, Pseudomonas aeruginosa PA01
cgcagcgcuccuu

SEQ ID NO: 3384561 - RNA, 21 nt, Pseudomonas aeruginosa PA01
cgcagcgcuccuuucccagcg

SEQ ID NO: 3384562 - RNA, 20 nt, Pseudomonas aeruginosa PA01
cgcagcggcagcgccaggua

SEQ ID NO: 3384563 - RNA, 16 nt, Pseudomonas aeruginosa PA01
cgcagcggcagcggcu

SEQ ID NO: 3384564 - RNA, 17 nt, Pseudomonas aeruginosa PA01
cgcagcggcagcggcuc

SEQ ID NO: 3384565 - RNA, 14 nt, Pseudomonas aeruginosa PA01
cgcagcggcaggcc

SEQ ID NO: 3384566 - RNA, 17 nt, Pseudomonas aeruginosa PA01
cgcagcggcaggccacg

SEQ ID NO: 3384567 - RNA, 20 nt, Pseudomonas aeruginosa PA01
cgcagcggcaggccacggcc

SEQ ID NO: 3384568 - RNA, 23 nt, Pseudomonas aeruginosa PA01
cgcagcggcaggccacggccgcu

SEQ ID NO: 3384569 - RNA, 14 nt, Pseudomonas aeruginosa PA01
cgcagcggcaugcc

SEQ ID NO: 3384570 - RNA, 19 nt, Pseudomonas aeruginosa PA01
cgcagcggcaugcccugcc

SEQ ID NO: 3384571 - RNA, 14 nt, Pseudomonas aeruginosa PA01
cgcagcggccaggg

SEQ ID NO: 3384572 - RNA, 16 nt, Pseudomonas aeruginosa PA01
cgcagcggccccgagc

SEQ ID NO: 3384573 - RNA, 14 nt, Pseudomonas aeruginosa PA01
cgcagcggcgaacc

SEQ ID NO: 3384574 - RNA, 13 nt, Pseudomonas aeruginosa PA01
cgcagcggcgccg

SEQ ID NO: 3384575 - RNA, 16 nt, Pseudomonas aeruginosa PA01
cgcagcggcgccgagg

SEQ ID NO: 3384576 - RNA, 13 nt, Pseudomonas aeruginosa PA01
cgcagcggcgcgu

SEQ ID NO: 3384577 - RNA, 18 nt, Pseudomonas aeruginosa PA01
cgcagcggcgcgucgcuc

SEQ ID NO: 3384578 - RNA, 18 nt, Pseudomonas aeruginosa PA01
cgcagcggcucgugucga

SEQ ID NO: 3384579 - RNA, 23 nt, Pseudomonas aeruginosa PA01
cgcagcggcuguugccggaauca

SEQ ID NO: 3384580 - RNA, 23 nt, Pseudomonas aeruginosa PA01
cgcagcgggcauauggaucggcc

SEQ ID NO: 3384581 - RNA, 13 nt, Pseudomonas aeruginosa PA01
cgcagcgggucga

SEQ ID NO: 3384582 - RNA, 16 nt, Pseudomonas aeruginosa PA01
cgcagcgggucgauca

SEQ ID NO: 3384583 - RNA, 16 nt, Pseudomonas aeruginosa PA01
cgcagcgguacaggcg

SEQ ID NO: 3384584 - RNA, 19 nt, Pseudomonas aeruginosa PA01
cgcagcgguaguucagucg

SEQ ID NO: 3384585 - RNA, 20 nt, Pseudomonas aeruginosa PA01
cgcagcgguaguucagucgg

SEQ ID NO: 3384586 - RNA, 15 nt, Pseudomonas aeruginosa PA01
cgcagcgucaccgcg

SEQ ID NO: 3384587 - RNA, 12 nt, Pseudomonas aeruginosa PA01
cgcagcguccug

SEQ ID NO: 3384588 - RNA, 15 nt, Pseudomonas aeruginosa PA01
cgcagcguccugccc

SEQ ID NO: 3384589 - RNA, 12 nt, Pseudomonas aeruginosa PA01
cgcagggccgga

SEQ ID NO: 3384590 - RNA, 15 nt, Pseudomonas aeruginosa PA01
cgcagggcgccgucg

SEQ ID NO: 3384591 - RNA, 23 nt, Pseudomonas aeruginosa PA01
cgcagggcgccgucgggggcgcg

SEQ ID NO: 3384592 - RNA, 13 nt, Pseudomonas aeruginosa PA01
cgcagggcggcga

SEQ ID NO: 3384593 - RNA, 14 nt, Pseudomonas aeruginosa PA01
cgcagggcggcgag

SEQ ID NO: 3384594 - RNA, 16 nt, Pseudomonas aeruginosa PA01
cgcagggcggcgagcu

SEQ ID NO: 3384595 - RNA, 14 nt, Pseudomonas aeruginosa PA01
cgcagggcggcgcc

SEQ ID NO: 3384596 - RNA, 19 nt, Pseudomonas aeruginosa PA01
cgcagggcggcgccuggag

SEQ ID NO: 3384597 - RNA, 23 nt, Pseudomonas aeruginosa PA01
cgcagggcggcgccuggagcaga

SEQ ID NO: 3384598 - RNA, 19 nt, Pseudomonas aeruginosa PA01
cgcagggcgguacgccgcg

SEQ ID NO: 3384599 - RNA, 22 nt, Pseudomonas aeruginosa PA01
cgcagggcgguacgccgcgcug

SEQ ID NO: 3384600 - RNA, 18 nt, Pseudomonas aeruginosa PA01
cgcagggcgucgaaggcg

SEQ ID NO: 3384601 - RNA, 23 nt, Pseudomonas aeruginosa PA01
cgcagggcguucuucacccgcag

SEQ ID NO: 3384602 - RNA, 22 nt, Pseudomonas aeruginosa PA01
cgcagggcuauguauucggcgg

SEQ ID NO: 3384603 - RNA, 16 nt, Pseudomonas aeruginosa PA01
cgcaggggcaccggcg

SEQ ID NO: 3384604 - RNA, 15 nt, Pseudomonas aeruginosa PA01
cgcaggggcgcgccg

SEQ ID NO: 3384605 - RNA, 16 nt, Pseudomonas aeruginosa PA01
cgcaggggcgcgccgg

SEQ ID NO: 3384606 - RNA, 19 nt, Pseudomonas aeruginosa PA01
cgcaggggcgcgccggcuu

SEQ ID NO: 3384607 - RNA, 16 nt, Pseudomonas aeruginosa PA01
cgcaggggcgcggcgc

SEQ ID NO: 3384608 - RNA, 19 nt, Pseudomonas aeruginosa PA01
cgcagggucaggcccuuga

SEQ ID NO: 3384609 - RNA, 21 nt, Pseudomonas aeruginosa PA01
cgcagggucaggcccuugagg

SEQ ID NO: 3384610 - RNA, 16 nt, Pseudomonas aeruginosa PA01
cgcaggguccauggac

SEQ ID NO: 3384611 - RNA, 21 nt, Pseudomonas aeruginosa PA01
cgcagggucgcguuggcgugc

SEQ ID NO: 3384612 - RNA, 23 nt, Pseudomonas aeruginosa PA01
cgcagggucgcguuggcgugcuc

SEQ ID NO: 3384613 - RNA, 16 nt, Pseudomonas aeruginosa PA01
cgcagggugcccucgu

SEQ ID NO: 3384614 - RNA, 16 nt, Pseudomonas aeruginosa PA01
cgcagguaacccgcgg

SEQ ID NO: 3384615 - RNA, 19 nt, Pseudomonas aeruginosa PA01
cgcagguaacccgcggcga

SEQ ID NO: 3384616 - RNA, 20 nt, Pseudomonas aeruginosa PA01
cgcagguaacccgcggcgag

SEQ ID NO: 3384617 - RNA, 22 nt, Pseudomonas aeruginosa PA01
cgcagguaacccgcggcgaggu

SEQ ID NO: 3384618 - RNA, 21 nt, Pseudomonas aeruginosa PA01
cgcagguacucgccggcgauc

SEQ ID NO: 3384619 - RNA, 16 nt, Pseudomonas aeruginosa PA01
cgcagguagcggcgaa

SEQ ID NO: 3384620 - RNA, 17 nt, Pseudomonas aeruginosa PA01
cgcagguagcggcgaag

SEQ ID NO: 3384621 - RNA, 20 nt, Pseudomonas aeruginosa PA01
cgcagguagcggcgaagcgc

SEQ ID NO: 3384622 - RNA, 22 nt, Pseudomonas aeruginosa PA01
cgcagguagcggcgaagcgcag

SEQ ID NO: 3384623 - RNA, 18 nt, Pseudomonas aeruginosa PA01
cgcagguagcugagcagg

SEQ ID NO: 3384624 - RNA, 19 nt, Pseudomonas aeruginosa PA01
cgcagguagcugagcaggc

SEQ ID NO: 3384625 - RNA, 21 nt, Pseudomonas aeruginosa PA01
cgcagguagcugagcaggccg

SEQ ID NO: 3384626 - RNA, 13 nt, Pseudomonas aeruginosa PA01
cgcagguagucgc

SEQ ID NO: 3384627 - RNA, 16 nt, Pseudomonas aeruginosa PA01
cgcaggucgcuggcgu

SEQ ID NO: 3384628 - RNA, 21 nt, Pseudomonas aeruginosa PA01
cgcaggucgcuggcgucgacc

SEQ ID NO: 3384629 - RNA, 13 nt, Pseudomonas aeruginosa PA01
cgcaggucgcugu

SEQ ID NO: 3384630 - RNA, 15 nt, Pseudomonas aeruginosa PA01
cgcaggucgcugucg

SEQ ID NO: 3384631 - RNA, 14 nt, Pseudomonas aeruginosa PA01
cgcaggucggccuc

SEQ ID NO: 3384632 - RNA, 15 nt, Pseudomonas aeruginosa PA01
cgcaggucggccucg

SEQ ID NO: 3384633 - RNA, 19 nt, Pseudomonas aeruginosa PA01
cgcaggucggccucggcga

SEQ ID NO: 3384634 - RNA, 13 nt, Pseudomonas aeruginosa PA01
cgcaggucggcgu

SEQ ID NO: 3384635 - RNA, 18 nt, Pseudomonas aeruginosa PA01
cgcaggucuugucgcggg

SEQ ID NO: 3384636 - RNA, 16 nt, Pseudomonas aeruginosa PA01
cgcaggugcaccgcgc

SEQ ID NO: 3384637 - RNA, 14 nt, Pseudomonas aeruginosa PA01
cgcaggugcccugg

SEQ ID NO: 3384638 - RNA, 19 nt, Pseudomonas aeruginosa PA01
cgcaggugcuuggcaccgc

SEQ ID NO: 3384639 - RNA, 22 nt, Pseudomonas aeruginosa PA01
cgcaggugcuuggcaccgcgca

SEQ ID NO: 3384640 - RNA, 15 nt, Pseudomonas aeruginosa PA01
cgcagguucaucgcc

SEQ ID NO: 3384641 - RNA, 19 nt, Pseudomonas aeruginosa PA01
cgcagguucaucgccgcca

SEQ ID NO: 3384642 - RNA, 19 nt, Pseudomonas aeruginosa PA01
cgcagguugagggccgcgc

SEQ ID NO: 3384643 - RNA, 20 nt, Pseudomonas aeruginosa PA01
cgcagguugagggccgcgcu

SEQ ID NO: 3384644 - RNA, 22 nt, Pseudomonas aeruginosa PA01
cgcagguugagggccgcgcugc

SEQ ID NO: 3384645 - RNA, 20 nt, Pseudomonas aeruginosa PA01
cgcagguugcgcuggcgcag

SEQ ID NO: 3384646 - RNA, 15 nt, Pseudomonas aeruginosa PA01
cgcagguuggccccg

SEQ ID NO: 3384647 - RNA, 15 nt, Pseudomonas aeruginosa PA01
cgcaguacagcucgg

SEQ ID NO: 3384648 - RNA, 17 nt, Pseudomonas aeruginosa PA01
cgcaguacagcucggcg

SEQ ID NO: 3384649 - RNA, 18 nt, Pseudomonas aeruginosa PA01
cgcaguacagcucggcgc

SEQ ID NO: 3384650 - RNA, 20 nt, Pseudomonas aeruginosa PA01
cgcaguacagcucggcgccc

SEQ ID NO: 3384651 - RNA, 19 nt, Pseudomonas aeruginosa PA01
cgcaguacagcugcaccgc

SEQ ID NO: 3384652 - RNA, 21 nt, Pseudomonas aeruginosa PA01
cgcaguacagcugcaccgcgc

SEQ ID NO: 3384653 - RNA, 16 nt, Pseudomonas aeruginosa PA01
cgcaguacccggccgc

SEQ ID NO: 3384654 - RNA, 17 nt, Pseudomonas aeruginosa PA01
cgcaguacgaggggccg

SEQ ID NO: 3384655 - RNA, 15 nt, Pseudomonas aeruginosa PA01
cgcaguacgaucagc

SEQ ID NO: 3384656 - RNA, 19 nt, Pseudomonas aeruginosa PA01
cgcaguacgaucagccagg

SEQ ID NO: 3384657 - RNA, 22 nt, Pseudomonas aeruginosa PA01
cgcaguacgaucagccagggca

SEQ ID NO: 3384658 - RNA, 19 nt, Pseudomonas aeruginosa PA01
cgcaguagaagcaguagua

SEQ ID NO: 3384659 - RNA, 15 nt, Pseudomonas aeruginosa PA01
cgcaguagaugccgc

SEQ ID NO: 3384660 - RNA, 16 nt, Pseudomonas aeruginosa PA01
cgcaguagaugccgcg

SEQ ID NO: 3384661 - RNA, 21 nt, Pseudomonas aeruginosa PA01
cgcaguagaugccgcgucggc

SEQ ID NO: 3384662 - RNA, 17 nt, Pseudomonas aeruginosa PA01
cgcaguagcucgccgag

SEQ ID NO: 3384663 - RNA, 22 nt, Pseudomonas aeruginosa PA01
cgcaguagcuggaucugguuga

SEQ ID NO: 3384664 - RNA, 16 nt, Pseudomonas aeruginosa PA01
cgcaguagucgaccgg

SEQ ID NO: 3384665 - RNA, 13 nt, Pseudomonas aeruginosa PA01
cgcagucccgcgc

SEQ ID NO: 3384666 - RNA, 17 nt, Pseudomonas aeruginosa PA01
cgcagucccgcgcggcc

SEQ ID NO: 3384667 - RNA, 14 nt, Pseudomonas aeruginosa PA01
cgcagugucgcgaa

SEQ ID NO: 3384668 - RNA, 16 nt, Pseudomonas aeruginosa PA01
cgcaguuccgcggcgu

SEQ ID NO: 3384669 - RNA, 16 nt, Pseudomonas aeruginosa PA01
cgcaguuccucgccgc

SEQ ID NO: 3384670 - RNA, 19 nt, Pseudomonas aeruginosa PA01
cgcaguuccucgccgcugc

SEQ ID NO: 3384671 - RNA, 23 nt, Pseudomonas aeruginosa PA01
cgcaguuccucgccgcugcuggc

SEQ ID NO: 3384672 - RNA, 15 nt, Pseudomonas aeruginosa PA01
cgcaguucgccccgc

SEQ ID NO: 3384673 - RNA, 17 nt, Pseudomonas aeruginosa PA01
cgcaguucgccccgccg

SEQ ID NO: 3384674 - RNA, 19 nt, Pseudomonas aeruginosa PA01
cgcaguucgccccgccgcc

SEQ ID NO: 3384675 - RNA, 20 nt, Pseudomonas aeruginosa PA01
cgcaguucgccccgccgcca

SEQ ID NO: 3384676 - RNA, 13 nt, Pseudomonas aeruginosa PA01
cgcaguucgccgc

SEQ ID NO: 3384677 - RNA, 17 nt, Pseudomonas aeruginosa PA01
cgcaguucgccgccgag

SEQ ID NO: 3384678 - RNA, 18 nt, Pseudomonas aeruginosa PA01
cgcaguucgccgccgagc

SEQ ID NO: 3384679 - RNA, 14 nt, Pseudomonas aeruginosa PA01
cgcaguucgcgggc

SEQ ID NO: 3384680 - RNA, 18 nt, Pseudomonas aeruginosa PA01
cgcaguucgcgggccgcg

SEQ ID NO: 3384681 - RNA, 22 nt, Pseudomonas aeruginosa PA01
cgcaguucguccaucgccaggc

SEQ ID NO: 3384682 - RNA, 19 nt, Pseudomonas aeruginosa PA01
cgcaguucgucgagggucu

SEQ ID NO: 3384683 - RNA, 22 nt, Pseudomonas aeruginosa PA01
cgcaguucgucuuccagcggcc

SEQ ID NO: 3384684 - RNA, 13 nt, Pseudomonas aeruginosa PA01
cgcaguugccagg

SEQ ID NO: 3384685 - RNA, 23 nt, Pseudomonas aeruginosa PA01
cgcaguuguuccucgcggcucac

SEQ ID NO: 3384686 - RNA, 20 nt, Pseudomonas aeruginosa PA01
cgcauaaccgcuugcgguua

SEQ ID NO: 3384687 - RNA, 15 nt, Pseudomonas aeruginosa PA01
cgcauaacgccaacg

SEQ ID NO: 3384688 - RNA, 18 nt, Pseudomonas aeruginosa PA01
cgcauaacgccaacggcg

SEQ ID NO: 3384689 - RNA, 23 nt, Pseudomonas aeruginosa PA01
cgcauaacgccccucuuccacgc

SEQ ID NO: 3384690 - RNA, 16 nt, Pseudomonas aeruginosa PA01
cgcauagccaccgccg

SEQ ID NO: 3384691 - RNA, 22 nt, Pseudomonas aeruginosa PA01
cgccacaggcguuauccgccgc

SEQ ID NO: 3384692 - RNA, 19 nt, Pseudomonas aeruginosa PA01
cgccaccacgaucaggccc

SEQ ID NO: 3384693 - RNA, 19 nt, Pseudomonas aeruginosa PA01
cgccaccacggcgaagccg

SEQ ID NO: 3384694 - RNA, 22 nt, Pseudomonas aeruginosa PA01
cgccaccagcaggaagccgacc

SEQ ID NO: 3384695 - RNA, 15 nt, Pseudomonas aeruginosa PA01
cgccaccagcagggc

SEQ ID NO: 3384696 - RNA, 22 nt, Pseudomonas aeruginosa PA01
cgccaccagcagggccaggccg

SEQ ID NO: 3384697 - RNA, 12 nt, Pseudomonas aeruginosa PA01
cgccaccagcca

SEQ ID NO: 3384698 - RNA, 14 nt, Pseudomonas aeruginosa PA01
cgccaccagccagg

SEQ ID NO: 3384699 - RNA, 15 nt, Pseudomonas aeruginosa PA01
cgccaccagcgaguc

SEQ ID NO: 3384700 - RNA, 14 nt, Pseudomonas aeruginosa PA01
cgccaccagcgugg

SEQ ID NO: 3384701 - RNA, 16 nt, Pseudomonas aeruginosa PA01
cgccaccagcguggcg

SEQ ID NO: 3384702 - RNA, 12 nt, Pseudomonas aeruginosa PA01
cgccaccaggaa

SEQ ID NO: 3384703 - RNA, 23 nt, Pseudomonas aeruginosa PA01
cgccaccaggaaaucgccguugc

SEQ ID NO: 3384704 - RNA, 13 nt, Pseudomonas aeruginosa PA01
cgccaccaggccg

SEQ ID NO: 3384705 - RNA, 22 nt, Pseudomonas aeruginosa PA01
cgccaccaggccgcugccgccg

SEQ ID NO: 3384706 - RNA, 22 nt, Pseudomonas aeruginosa PA01
cgccaccagggccuugccgcga

SEQ ID NO: 3384707 - RNA, 16 nt, Pseudomonas aeruginosa PA01
cgccaccccgccgcgc

SEQ ID NO: 3384708 - RNA, 17 nt, Pseudomonas aeruginosa PA01
cgccaccccgccgcgca

SEQ ID NO: 3384709 - RNA, 18 nt, Pseudomonas aeruginosa PA01
cgccaccccgccgcgcau

SEQ ID NO: 3384710 - RNA, 20 nt, Pseudomonas aeruginosa PA01
cgccaccccgccgcgcauca

SEQ ID NO: 3384711 - RNA, 15 nt, Pseudomonas aeruginosa PA01
cgccaccccgccgcu

SEQ ID NO: 3384712 - RNA, 16 nt, Pseudomonas aeruginosa PA01
cgccaccccgccgcug

SEQ ID NO: 3384713 - RNA, 18 nt, Pseudomonas aeruginosa PA01
cgccaccccgccggcguu

SEQ ID NO: 3384714 - RNA, 16 nt, Pseudomonas aeruginosa PA01
cgccaccccgcuccgc

SEQ ID NO: 3384715 - RNA, 17 nt, Pseudomonas aeruginosa PA01
cgccacccgcuccggcu

SEQ ID NO: 3384716 - RNA, 14 nt, Pseudomonas aeruginosa PA01
cgccacccguuccu

SEQ ID NO: 3384717 - RNA, 20 nt, Pseudomonas aeruginosa PA01
cgccacccguuccuugcgcg

SEQ ID NO: 3384718 - RNA, 22 nt, Pseudomonas aeruginosa PA01
cgccacccguuccuugcgcggc

SEQ ID NO: 3384719 - RNA, 17 nt, Pseudomonas aeruginosa PA01
cgccacccucggcuucg

SEQ ID NO: 3384720 - RNA, 17 nt, Pseudomonas aeruginosa PA01
cgccaccgauagcggcg

SEQ ID NO: 3384721 - RNA, 18 nt, Pseudomonas aeruginosa PA01
cgccaccgauagcggcgc

SEQ ID NO: 3384722 - RNA, 19 nt, Pseudomonas aeruginosa PA01
cgccaccgauagcggcgcg

SEQ ID NO: 3384723 - RNA, 14 nt, Pseudomonas aeruginosa PA01
cgccaccgauucgc

SEQ ID NO: 3384724 - RNA, 20 nt, Pseudomonas aeruginosa PA01
cgccaccgauucgccggcca

SEQ ID NO: 3384725 - RNA, 14 nt, Pseudomonas aeruginosa PA01
cgccaccgccaccg

SEQ ID NO: 3384726 - RNA, 15 nt, Pseudomonas aeruginosa PA01
cgccaccgccaccgc

SEQ ID NO: 3384727 - RNA, 13 nt, Pseudomonas aeruginosa PA01
cgccaccgccgga

SEQ ID NO: 3384728 - RNA, 15 nt, Pseudomonas aeruginosa PA01
cgccaccgccggaac

SEQ ID NO: 3384729 - RNA, 13 nt, Pseudomonas aeruginosa PA01
cgccaccgcgacg

SEQ ID NO: 3384730 - RNA, 17 nt, Pseudomonas aeruginosa PA01
cgccaccgcgacgcgcu

SEQ ID NO: 3384731 - RNA, 22 nt, Pseudomonas aeruginosa PA01
cgccaccgcgacgcgcuggacc

SEQ ID NO: 3384732 - RNA, 15 nt, Pseudomonas aeruginosa PA01
cgccaccgcgcgccc

SEQ ID NO: 3384733 - RNA, 19 nt, Pseudomonas aeruginosa PA01
cgccaccgcguugacgcgg

SEQ ID NO: 3384734 - RNA, 21 nt, Pseudomonas aeruginosa PA01
cgccaccggcguuauccgccg

SEQ ID NO: 3384735 - RNA, 22 nt, Pseudomonas aeruginosa PA01
cgccaccggcguuauccgccga

SEQ ID NO: 3384736 - RNA, 22 nt, Pseudomonas aeruginosa PA01
cgccaccgguacgcucaccacc

SEQ ID NO: 3384737 - RNA, 21 nt, Pseudomonas aeruginosa PA01
cgccaccugagcgacguggca

SEQ ID NO: 3384738 - RNA, 15 nt, Pseudomonas aeruginosa PA01
cgccaccugccccgg

SEQ ID NO: 3384739 - RNA, 20 nt, Pseudomonas aeruginosa PA01
cgccaccugccccgggcgcc

SEQ ID NO: 3384740 - RNA, 12 nt, Pseudomonas aeruginosa PA01
cgccaccuggcg

SEQ ID NO: 3384741 - RNA, 23 nt, Pseudomonas aeruginosa PA01
cgccaccugguucaucgagcggc

SEQ ID NO: 3384742 - RNA, 16 nt, Pseudomonas aeruginosa PA01
cgccaccuguagcagg

SEQ ID NO: 3384743 - RNA, 14 nt, Pseudomonas aeruginosa PA01
cgccaccuucccaa

SEQ ID NO: 3384744 - RNA, 22 nt, Pseudomonas aeruginosa PA01
cgccaccuugcgucccugggcc

SEQ ID NO: 3384745 - RNA, 21 nt, Pseudomonas aeruginosa PA01
cgccacgcaauccucggugcg

SEQ ID NO: 3384746 - RNA, 19 nt, Pseudomonas aeruginosa PA01
cgccacgcaggaacagcuc

SEQ ID NO: 3384747 - RNA, 18 nt, Pseudomonas aeruginosa PA01
cgccacgcaguucgcggg

SEQ ID NO: 3384748 - RNA, 21 nt, Pseudomonas aeruginosa PA01
cgccacgcaguucgcgggccg

SEQ ID NO: 3384749 - RNA, 23 nt, Pseudomonas aeruginosa PA01
cgccacgcaguucgcgggccgcg

SEQ ID NO: 3384750 - RNA, 13 nt, Pseudomonas aeruginosa PA01
cgccacgcccgcc

SEQ ID NO: 3384751 - RNA, 16 nt, Pseudomonas aeruginosa PA01
cgccacgccgcugucg

SEQ ID NO: 3384752 - RNA, 12 nt, Pseudomonas aeruginosa PA01
cgccacgccggc

SEQ ID NO: 3384753 - RNA, 14 nt, Pseudomonas aeruginosa PA01
cgccacgccggcgc

SEQ ID NO: 3384754 - RNA, 20 nt, Pseudomonas aeruginosa PA01
cgccacgcugaucaucagca

SEQ ID NO: 3384755 - RNA, 14 nt, Pseudomonas aeruginosa PA01
cgccacgcugcugc

SEQ ID NO: 3384756 - RNA, 22 nt, Pseudomonas aeruginosa PA01
cgccacgcuucugcgccuccuc

SEQ ID NO: 3384757 - RNA, 14 nt, Pseudomonas aeruginosa PA01
cgccacgcuugucg

SEQ ID NO: 3384758 - RNA, 20 nt, Pseudomonas aeruginosa PA01
cgccacgcuugucguggcgg

SEQ ID NO: 3384759 - RNA, 19 nt, Pseudomonas aeruginosa PA01
cgccacggaugcagucccg

SEQ ID NO: 3384760 - RNA, 20 nt, Pseudomonas aeruginosa PA01
cgccacggaugcagucccgc

SEQ ID NO: 3384761 - RNA, 21 nt, Pseudomonas aeruginosa PA01
cgccacggaugcagucccgcc

SEQ ID NO: 3384762 - RNA, 22 nt, Pseudomonas aeruginosa PA01
cgccacggaugcagucccgcca

SEQ ID NO: 3384763 - RNA, 23 nt, Pseudomonas aeruginosa PA01
cgccacggaugcagucccgccag

SEQ ID NO: 3384764 - RNA, 13 nt, Pseudomonas aeruginosa PA01
cgccacggccagc

SEQ ID NO: 3384765 - RNA, 15 nt, Pseudomonas aeruginosa PA01
cgccacggccagcag

SEQ ID NO: 3384766 - RNA, 12 nt, Pseudomonas aeruginosa PA01
cgccacggcgcg

SEQ ID NO: 3384767 - RNA, 16 nt, Pseudomonas aeruginosa PA01
cgccacggcgcgcucc

SEQ ID NO: 3384768 - RNA, 20 nt, Pseudomonas aeruginosa PA01
cgccacggcgcgcuccggcg

SEQ ID NO: 3384769 - RNA, 23 nt, Pseudomonas aeruginosa PA01
cgccacggcgcgcuccggcgcgc

SEQ ID NO: 3384770 - RNA, 14 nt, Pseudomonas aeruginosa PA01
cgccacggcgcgga

SEQ ID NO: 3384771 - RNA, 22 nt, Pseudomonas aeruginosa PA01
cgccacggcgcggaacaucgcc

SEQ ID NO: 3384772 - RNA, 22 nt, Pseudomonas aeruginosa PA01
cgccacggcgguuucgucgaag

SEQ ID NO: 3384773 - RNA, 19 nt, Pseudomonas aeruginosa PA01
cgccacgggcagaccuucg

SEQ ID NO: 3384774 - RNA, 23 nt, Pseudomonas aeruginosa PA01
cgccacggguaacgguagcggca

SEQ ID NO: 3384775 - RNA, 15 nt, Pseudomonas aeruginosa PA01
cgccacguacagcgc

SEQ ID NO: 3384776 - RNA, 13 nt, Pseudomonas aeruginosa PA01
cgccacgugcacg

SEQ ID NO: 3384777 - RNA, 16 nt, Pseudomonas aeruginosa PA01
cgccacgugcacgccg

SEQ ID NO: 3384778 - RNA, 16 nt, Pseudomonas aeruginosa PA01
cgccacuaccaccacc

SEQ ID NO: 3384779 - RNA, 17 nt, Pseudomonas aeruginosa PA01
cgccacuaccaccacca

SEQ ID NO: 3384780 - RNA, 13 nt, Pseudomonas aeruginosa PA01
cgccacucggcgu

SEQ ID NO: 3384781 - RNA, 15 nt, Pseudomonas aeruginosa PA01
cgccacucggcgugc

SEQ ID NO: 3384782 - RNA, 17 nt, Pseudomonas aeruginosa PA01
cgccacucggcgugccg

SEQ ID NO: 3384783 - RNA, 18 nt, Pseudomonas aeruginosa PA01
cgccacucggcgugccgg

SEQ ID NO: 3384784 - RNA, 22 nt, Pseudomonas aeruginosa PA01
cgccacugauaccgcuggccag

SEQ ID NO: 3384785 - RNA, 22 nt, Pseudomonas aeruginosa PA01
cgccacugcucccaugagcgac

SEQ ID NO: 3384786 - RNA, 18 nt, Pseudomonas aeruginosa PA01
cgccacuucaagcuggcg

SEQ ID NO: 3384787 - RNA, 22 nt, Pseudomonas aeruginosa PA01
cgccacuucaagcuggcgcaca

SEQ ID NO: 3384788 - RNA, 15 nt, Pseudomonas aeruginosa PA01
cgccacuuccagcac

SEQ ID NO: 3384789 - RNA, 18 nt, Pseudomonas aeruginosa PA01
cgccacuuccagcacgcc

SEQ ID NO: 3384790 - RNA, 21 nt, Pseudomonas aeruginosa PA01
cgccacuuccagcacgccgau

SEQ ID NO: 3384791 - RNA, 17 nt, Pseudomonas aeruginosa PA01
cgccacuuccagcuugc

SEQ ID NO: 3384792 - RNA, 19 nt, Pseudomonas aeruginosa PA01
cgccacuuccagcuugcgc

SEQ ID NO: 3384793 - RNA, 11 nt, Pseudomonas aeruginosa PA01
cgccagccggc

SEQ ID NO: 3384794 - RNA, 17 nt, Pseudomonas aeruginosa PA01
cgccagccggcugugac

SEQ ID NO: 3384795 - RNA, 22 nt, Pseudomonas aeruginosa PA01
cgccagccuacugggcguggcg

SEQ ID NO: 3384796 - RNA, 13 nt, Pseudomonas aeruginosa PA01
cgccagccucggc

SEQ ID NO: 3384797 - RNA, 15 nt, Pseudomonas aeruginosa PA01
cgccagccucggcga

SEQ ID NO: 3384798 - RNA, 19 nt, Pseudomonas aeruginosa PA01
cgccagccucggcgaaguc

SEQ ID NO: 3384799 - RNA, 22 nt, Pseudomonas aeruginosa PA01
cgccagcgagacgggcgaggcu

SEQ ID NO: 3384800 - RNA, 14 nt, Pseudomonas aeruginosa PA01
cgccagcgccacgg

SEQ ID NO: 3384801 - RNA, 19 nt, Pseudomonas aeruginosa PA01
cgccagcgccacggcgauc

SEQ ID NO: 3384802 - RNA, 13 nt, Pseudomonas aeruginosa PA01
cgccagcgccagc

SEQ ID NO: 3384803 - RNA, 14 nt, Pseudomonas aeruginosa PA01
cgccagcgccagca

SEQ ID NO: 3384804 - RNA, 16 nt, Pseudomonas aeruginosa PA01
cgccagcgccagcagg

SEQ ID NO: 3384805 - RNA, 19 nt, Pseudomonas aeruginosa PA01
cgccagcgccagcagguac

SEQ ID NO: 3384806 - RNA, 13 nt, Pseudomonas aeruginosa PA01
cgccagcgccgcc

SEQ ID NO: 3384807 - RNA, 14 nt, Pseudomonas aeruginosa PA01
cgccagcgccgcca

SEQ ID NO: 3384808 - RNA, 15 nt, Pseudomonas aeruginosa PA01
cgccagcgccgccag

SEQ ID NO: 3384809 - RNA, 15 nt, Pseudomonas aeruginosa PA01
cgccagcgccggcca

SEQ ID NO: 3384810 - RNA, 16 nt, Pseudomonas aeruginosa PA01
cgccagcgcgcgccga

SEQ ID NO: 3384811 - RNA, 12 nt, Pseudomonas aeruginosa PA01
cgccagcgcggc

SEQ ID NO: 3384812 - RNA, 15 nt, Pseudomonas aeruginosa PA01
cgccagcgcggcgcu

SEQ ID NO: 3384813 - RNA, 21 nt, Pseudomonas aeruginosa PA01
cgccagcgcggcgcuuggcga

SEQ ID NO: 3384814 - RNA, 14 nt, Pseudomonas aeruginosa PA01
cgccagcggcagcg

SEQ ID NO: 3384815 - RNA, 21 nt, Pseudomonas aeruginosa PA01
cgccagcggcauucgaacggc

SEQ ID NO: 3384816 - RNA, 14 nt, Pseudomonas aeruginosa PA01
cgccagcggcccgg

SEQ ID NO: 3384817 - RNA, 16 nt, Pseudomonas aeruginosa PA01
cgccagcggcccggca

SEQ ID NO: 3384818 - RNA, 14 nt, Pseudomonas aeruginosa PA01
cgccagcggcgauc

SEQ ID NO: 3384819 - RNA, 16 nt, Pseudomonas aeruginosa PA01
cgccagcggcgaucgc

SEQ ID NO: 3384820 - RNA, 20 nt, Pseudomonas aeruginosa PA01
cgccagcggcgaucgccugg

SEQ ID NO: 3384821 - RNA, 22 nt, Pseudomonas aeruginosa PA01
cgccagcgggacgaugccgauc

SEQ ID NO: 3384822 - RNA, 19 nt, Pseudomonas aeruginosa PA01
cgccagcgguacccgccgg

SEQ ID NO: 3384823 - RNA, 22 nt, Pseudomonas aeruginosa PA01
cgccagcgguacccgccggcca

SEQ ID NO: 3384824 - RNA, 15 nt, Pseudomonas aeruginosa PA01
cgccagcgguucagg

SEQ ID NO: 3384825 - RNA, 13 nt, Pseudomonas aeruginosa PA01
cgccagcgucgcc

SEQ ID NO: 3384826 - RNA, 16 nt, Pseudomonas aeruginosa PA01
cgccagcgucgccgcc

SEQ ID NO: 3384827 - RNA, 20 nt, Pseudomonas aeruginosa PA01
cgccagcgucgccgccgcgg

SEQ ID NO: 3384828 - RNA, 17 nt, Pseudomonas aeruginosa PA01
cgccagcguugcagguc

SEQ ID NO: 3384829 - RNA, 20 nt, Pseudomonas aeruginosa PA01
cgccagcguugcaggucgau

SEQ ID NO: 3384830 - RNA, 22 nt, Pseudomonas aeruginosa PA01
cgccagcguuucgaagccgccg

SEQ ID NO: 3384831 - RNA, 14 nt, Pseudomonas aeruginosa PA01
cgccagcuaccggc

SEQ ID NO: 3384832 - RNA, 18 nt, Pseudomonas aeruginosa PA01
cgccagcuaccggcaggg

SEQ ID NO: 3384833 - RNA, 21 nt, Pseudomonas aeruginosa PA01
cgccagcuaccggcaggguca

SEQ ID NO: 3384834 - RNA, 22 nt, Pseudomonas aeruginosa PA01
cgccagcucauggagcaacagc

SEQ ID NO: 3384835 - RNA, 16 nt, Pseudomonas aeruginosa PA01
cgccagcuccagcgcc

SEQ ID NO: 3384836 - RNA, 19 nt, Pseudomonas aeruginosa PA01
cgccagcuccagcgcccag

SEQ ID NO: 3384837 - RNA, 21 nt, Pseudomonas aeruginosa PA01
cgccagcuccagcgcccaggu

SEQ ID NO: 3384838 - RNA, 20 nt, Pseudomonas aeruginosa PA01
cgccagcucgaacagcaccg

SEQ ID NO: 3384839 - RNA, 24 nt, Pseudomonas aeruginosa PA01
cgccagcucgaacagcaccgagca

SEQ ID NO: 3384840 - RNA, 13 nt, Pseudomonas aeruginosa PA01
cgccagcucgccg

SEQ ID NO: 3384841 - RNA, 17 nt, Pseudomonas aeruginosa PA01
cgccagcucgccgcgcu

SEQ ID NO: 3384842 - RNA, 20 nt, Pseudomonas aeruginosa PA01
cgccagcucgccgcgcucca

SEQ ID NO: 3384843 - RNA, 17 nt, Pseudomonas aeruginosa PA01
cgccagcucgcugucca

SEQ ID NO: 3384844 - RNA, 14 nt, Pseudomonas aeruginosa PA01
cgccagcucggccg

SEQ ID NO: 3384845 - RNA, 22 nt, Pseudomonas aeruginosa PA01
cgccagcucggccggcaggcug

SEQ ID NO: 3384846 - RNA, 14 nt, Pseudomonas aeruginosa PA01
cgccagcucggccu

SEQ ID NO: 3384847 - RNA, 17 nt, Pseudomonas aeruginosa PA01
cgccagcuuguccgccg

SEQ ID NO: 3384848 - RNA, 19 nt, Pseudomonas aeruginosa PA01
cgccagcuuguccgccgga

SEQ ID NO: 3384849 - RNA, 21 nt, Pseudomonas aeruginosa PA01
cgccaggaacgccucugcgcu

SEQ ID NO: 3384850 - RNA, 16 nt, Pseudomonas aeruginosa PA01
cgccaggaagccgcgc

SEQ ID NO: 3384851 - RNA, 17 nt, Pseudomonas aeruginosa PA01
cgccaggaagccgcgcc

SEQ ID NO: 3384852 - RNA, 18 nt, Pseudomonas aeruginosa PA01
cgccaggaagccgcgccc

SEQ ID NO: 3384853 - RNA, 18 nt, Pseudomonas aeruginosa PA01
cgccaggaccauuugcgc

SEQ ID NO: 3384854 - RNA, 19 nt, Pseudomonas aeruginosa PA01
cgccaggaccuccugcaca

SEQ ID NO: 3384855 - RNA, 14 nt, Pseudomonas aeruginosa PA01
cgccaggaccucga

SEQ ID NO: 3384856 - RNA, 21 nt, Pseudomonas aeruginosa PA01
cgccaggaccucgaagcuggc

SEQ ID NO: 3384857 - RNA, 22 nt, Pseudomonas aeruginosa PA01
cgccaggaccucgaagcuggcc

SEQ ID NO: 3384858 - RNA, 13 nt, Pseudomonas aeruginosa PA01
cgccaggacucgc

SEQ ID NO: 3384859 - RNA, 16 nt, Pseudomonas aeruginosa PA01
cgccaggacucgccau

SEQ ID NO: 3384860 - RNA, 23 nt, Pseudomonas aeruginosa PA01
cgccaggacucgccaucggccug

SEQ ID NO: 3384861 - RNA, 15 nt, Pseudomonas aeruginosa PA01
cgccaggagcagggc

SEQ ID NO: 3384862 - RNA, 18 nt, Pseudomonas aeruginosa PA01
cgccaggagcagggcgcc

SEQ ID NO: 3384863 - RNA, 21 nt, Pseudomonas aeruginosa PA01
cgccaggagcagggcgccgau

SEQ ID NO: 3384864 - RNA, 15 nt, Pseudomonas aeruginosa PA01
cgccaggaucggcau

SEQ ID NO: 3384865 - RNA, 13 nt, Pseudomonas aeruginosa PA01
cgccaggcagacc

SEQ ID NO: 3384866 - RNA, 14 nt, Pseudomonas aeruginosa PA01
cgccaggcagacca

SEQ ID NO: 3384867 - RNA, 20 nt, Pseudomonas aeruginosa PA01
cgccaggcagaccaggccga

SEQ ID NO: 3384868 - RNA, 21 nt, Pseudomonas aeruginosa PA01
cgccaggcagaccaggccgag

SEQ ID NO: 3384869 - RNA, 14 nt, Pseudomonas aeruginosa PA01
cgccaggcagaccu

SEQ ID NO: 3384870 - RNA, 20 nt, Pseudomonas aeruginosa PA01
cgccaggcagaccugcagca

SEQ ID NO: 3384871 - RNA, 22 nt, Pseudomonas aeruginosa PA01
cgccaggcagaccugcagcagg

SEQ ID NO: 3384872 - RNA, 15 nt, Pseudomonas aeruginosa PA01
cgccaggcaggccgg

SEQ ID NO: 3384873 - RNA, 21 nt, Pseudomonas aeruginosa PA01
cgccaggcaggccgggcuggc

SEQ ID NO: 3384874 - RNA, 22 nt, Pseudomonas aeruginosa PA01
cgccaggcaggccgggcuggcc

SEQ ID NO: 3384875 - RNA, 13 nt, Pseudomonas aeruginosa PA01
cgccaggcaggcg

SEQ ID NO: 3384876 - RNA, 18 nt, Pseudomonas aeruginosa PA01
cgccaggcaggcggucag

SEQ ID NO: 3384877 - RNA, 21 nt, Pseudomonas aeruginosa PA01
cgccaggcaggcggucagcgc

SEQ ID NO: 3384878 - RNA, 23 nt, Pseudomonas aeruginosa PA01
cgccaggcaggcggucagcgcgu

SEQ ID NO: 3384879 - RNA, 22 nt, Pseudomonas aeruginosa PA01
cgccaggccauugaaggccgac

SEQ ID NO: 3384880 - RNA, 16 nt, Pseudomonas aeruginosa PA01
cgccaggcccacgccc

SEQ ID NO: 3384881 - RNA, 16 nt, Pseudomonas aeruginosa PA01
cgccaggcccggcgcu

SEQ ID NO: 3384882 - RNA, 19 nt, Pseudomonas aeruginosa PA01
cgccaggcccggcgcugcu

SEQ ID NO: 3384883 - RNA, 19 nt, Pseudomonas aeruginosa PA01
cgccaggcccucggcgacc

SEQ ID NO: 3384884 - RNA, 21 nt, Pseudomonas aeruginosa PA01
cgccaggcccugggcggcggg

SEQ ID NO: 3384885 - RNA, 16 nt, Pseudomonas aeruginosa PA01
cgccaggccgacccgc

SEQ ID NO: 3384886 - RNA, 12 nt, Pseudomonas aeruginosa PA01
cgccaggccgau

SEQ ID NO: 3384887 - RNA, 16 nt, Pseudomonas aeruginosa PA01
cgccaggccgaucagc

SEQ ID NO: 3384888 - RNA, 19 nt, Pseudomonas aeruginosa PA01
cgccaggccgaucagcgcc

SEQ ID NO: 3384889 - RNA, 22 nt, Pseudomonas aeruginosa PA01
cgccaggccgaucagcgccucg

SEQ ID NO: 3384890 - RNA, 13 nt, Pseudomonas aeruginosa PA01
cgccaggccgccg

SEQ ID NO: 3384891 - RNA, 16 nt, Pseudomonas aeruginosa PA01
cgccaggccgccgaag

SEQ ID NO: 3384892 - RNA, 17 nt, Pseudomonas aeruginosa PA01
cgccaggccgccgaaga

SEQ ID NO: 3384893 - RNA, 14 nt, Pseudomonas aeruginosa PA01
cgccaggccgcgca

SEQ ID NO: 3384894 - RNA, 16 nt, Pseudomonas aeruginosa PA01
cgccaggccgcgcagu

SEQ ID NO: 3384895 - RNA, 19 nt, Pseudomonas aeruginosa PA01
cgccaguucgccggugacg

SEQ ID NO: 3384896 - RNA, 17 nt, Pseudomonas aeruginosa PA01
cgccaguucgcgcaggu

SEQ ID NO: 3384897 - RNA, 17 nt, Pseudomonas aeruginosa PA01
cgccaguucggccauca

SEQ ID NO: 3384898 - RNA, 19 nt, Pseudomonas aeruginosa PA01
cgccaguucggccaucagc

SEQ ID NO: 3384899 - RNA, 17 nt, Pseudomonas aeruginosa PA01
cgccaguucucgcagca

SEQ ID NO: 3384900 - RNA, 19 nt, Pseudomonas aeruginosa PA01
cgccaguucucgcagcagg

SEQ ID NO: 3384901 - RNA, 20 nt, Pseudomonas aeruginosa PA01
cgccaguucucgcagcaggc

SEQ ID NO: 3384902 - RNA, 22 nt, Pseudomonas aeruginosa PA01
cgccaguugcuugaucgccagc

SEQ ID NO: 3384903 - RNA, 19 nt, Pseudomonas aeruginosa PA01
cgccaguuggacgcggccu

SEQ ID NO: 3384904 - RNA, 22 nt, Pseudomonas aeruginosa PA01
cgccauaccggcaaggcggccu

SEQ ID NO: 3384905 - RNA, 14 nt, Pseudomonas aeruginosa PA01
cgccauagagugcc

SEQ ID NO: 3384906 - RNA, 23 nt, Pseudomonas aeruginosa PA01
cgccauagagugcccaggcgcug

SEQ ID NO: 3384907 - RNA, 19 nt, Pseudomonas aeruginosa PA01
cgccauaggccagcaccuc

SEQ ID NO: 3384908 - RNA, 13 nt, Pseudomonas aeruginosa PA01
cgccauaggcggc

SEQ ID NO: 3384909 - RNA, 14 nt, Pseudomonas aeruginosa PA01
cgccauaggcggcg

SEQ ID NO: 3384910 - RNA, 15 nt, Pseudomonas aeruginosa PA01
cgccauaggcggcgc

SEQ ID NO: 3384911 - RNA, 20 nt, Pseudomonas aeruginosa PA01
cgccauaggcggcgcagacg

SEQ ID NO: 3384912 - RNA, 17 nt, Pseudomonas aeruginosa PA01
cgccauauuucgaaggg

SEQ ID NO: 3384913 - RNA, 21 nt, Pseudomonas aeruginosa PA01
cgccaucaacggauauccccg

SEQ ID NO: 3384914 - RNA, 14 nt, Pseudomonas aeruginosa PA01
cgccaucagcacga

SEQ ID NO: 3384915 - RNA, 21 nt, Pseudomonas aeruginosa PA01
cgccaucagcacgaaagccau

SEQ ID NO: 3384916 - RNA, 15 nt, Pseudomonas aeruginosa PA01
cgccaucagcgacca

SEQ ID NO: 3384917 - RNA, 14 nt, Pseudomonas aeruginosa PA01
cgccaucaggcccu

SEQ ID NO: 3384918 - RNA, 17 nt, Pseudomonas aeruginosa PA01
cgccaucaguuccucgc

SEQ ID NO: 3384919 - RNA, 15 nt, Pseudomonas aeruginosa PA01
cgccauccuccagcg

SEQ ID NO: 3384920 - RNA, 17 nt, Pseudomonas aeruginosa PA01
cgccauccuccagcgcc

SEQ ID NO: 3384921 - RNA, 18 nt, Pseudomonas aeruginosa PA01
cgccauccuccagcgccg

SEQ ID NO: 3384922 - RNA, 15 nt, Pseudomonas aeruginosa PA01
cgccauccuccgagg

SEQ ID NO: 3384923 - RNA, 15 nt, Pseudomonas aeruginosa PA01
cgccauccuggucgc

SEQ ID NO: 3384924 - RNA, 16 nt, Pseudomonas aeruginosa PA01
cgccauccuggucgcg

SEQ ID NO: 3384925 - RNA, 16 nt, Pseudomonas aeruginosa PA01
cgccauccuucggcgu

SEQ ID NO: 3384926 - RNA, 15 nt, Pseudomonas aeruginosa PA01
cgccaucgaccagga

SEQ ID NO: 3384927 - RNA, 20 nt, Pseudomonas aeruginosa PA01
cgccaucgacguagaggauc

SEQ ID NO: 3384928 - RNA, 17 nt, Pseudomonas aeruginosa PA01
cgccaucgaucagcagc

SEQ ID NO: 3384929 - RNA, 19 nt, Pseudomonas aeruginosa PA01
cgccaucgaucagcagcgc

SEQ ID NO: 3384930 - RNA, 20 nt, Pseudomonas aeruginosa PA01
cgccaucgaucagcagcgcc

SEQ ID NO: 3384931 - RNA, 21 nt, Pseudomonas aeruginosa PA01
cgccaucgaucagcagcgcca

SEQ ID NO: 3384932 - RNA, 23 nt, Pseudomonas aeruginosa PA01
cgccaucgauggucacuggcgag

SEQ ID NO: 3384933 - RNA, 20 nt, Pseudomonas aeruginosa PA01
cgccaucgauggucaggcug

SEQ ID NO: 3384934 - RNA, 16 nt, Pseudomonas aeruginosa PA01
cgccaucgcccgguug

SEQ ID NO: 3384935 - RNA, 18 nt, Pseudomonas aeruginosa PA01
cgccaucgcuuuccuggc

SEQ ID NO: 3384936 - RNA, 15 nt, Pseudomonas aeruginosa PA01
cgccaucggucgcgc

SEQ ID NO: 3384937 - RNA, 20 nt, Pseudomonas aeruginosa PA01
cgccaucggucgcgccccca

SEQ ID NO: 3384938 - RNA, 18 nt, Pseudomonas aeruginosa PA01
cgccaugacacaccacgc

SEQ ID NO: 3384939 - RNA, 15 nt, Pseudomonas aeruginosa PA01
cgccaugacccgcgg

SEQ ID NO: 3384940 - RNA, 16 nt, Pseudomonas aeruginosa PA01
cgccaugacccgcggc

SEQ ID NO: 3384941 - RNA, 17 nt, Pseudomonas aeruginosa PA01
cgccaugacccgcggca

SEQ ID NO: 3384942 - RNA, 18 nt, Pseudomonas aeruginosa PA01
cgccaugacccgcggcag

SEQ ID NO: 3384943 - RNA, 19 nt, Pseudomonas aeruginosa PA01
cgccaugacccgcggcagg

SEQ ID NO: 3384944 - RNA, 21 nt, Pseudomonas aeruginosa PA01
cgccaugacccgcggcagguc

SEQ ID NO: 3384945 - RNA, 22 nt, Pseudomonas aeruginosa PA01
cgccaugacccgcggcaggucc

SEQ ID NO: 3384946 - RNA, 22 nt, Pseudomonas aeruginosa PA01
cgccaugcaagaacgccgaccc

SEQ ID NO: 3384947 - RNA, 22 nt, Pseudomonas aeruginosa PA01
cgccaugcaugauuucguuggc

SEQ ID NO: 3384948 - RNA, 12 nt, Pseudomonas aeruginosa PA01
cgccaugccggc

SEQ ID NO: 3384949 - RNA, 15 nt, Pseudomonas aeruginosa PA01
cgccaugccguucag

SEQ ID NO: 3384950 - RNA, 19 nt, Pseudomonas aeruginosa PA01
cgccaugccguucaggccg

SEQ ID NO: 3384951 - RNA, 20 nt, Pseudomonas aeruginosa PA01
cgccaugccguucaggccgg

SEQ ID NO: 3384952 - RNA, 21 nt, Pseudomonas aeruginosa PA01
cgccaugccguucaggccggc

SEQ ID NO: 3384953 - RNA, 22 nt, Pseudomonas aeruginosa PA01
cgccaugccguucaggccggcg

SEQ ID NO: 3384954 - RNA, 14 nt, Pseudomonas aeruginosa PA01
cgccaugcggcagg

SEQ ID NO: 3384955 - RNA, 15 nt, Pseudomonas aeruginosa PA01
cgccaugcggcaggc

SEQ ID NO: 3384956 - RNA, 15 nt, Pseudomonas aeruginosa PA01
cgccaugcucggcca

SEQ ID NO: 3384957 - RNA, 18 nt, Pseudomonas aeruginosa PA01
cgccaugcucggccagcu

SEQ ID NO: 3384958 - RNA, 21 nt, Pseudomonas aeruginosa PA01
cgccaugcucggccagcucgc

SEQ ID NO: 3384959 - RNA, 19 nt, Pseudomonas aeruginosa PA01
cgccaugcuguugccgugg

SEQ ID NO: 3384960 - RNA, 23 nt, Pseudomonas aeruginosa PA01
cgccaugcuguugccguggcggc

SEQ ID NO: 3384961 - RNA, 14 nt, Pseudomonas aeruginosa PA01
cgccauggcgcuga

SEQ ID NO: 3384962 - RNA, 14 nt, Pseudomonas aeruginosa PA01
cgccauggcgcugc

SEQ ID NO: 3384963 - RNA, 15 nt, Pseudomonas aeruginosa PA01
cgccauggcgcuuca

SEQ ID NO: 3384964 - RNA, 19 nt, Pseudomonas aeruginosa PA01
cgccauggcgguuccucca

SEQ ID NO: 3384965 - RNA, 23 nt, Pseudomonas aeruginosa PA01
cgccauggguggaacccgcuucg

SEQ ID NO: 3384966 - RNA, 19 nt, Pseudomonas aeruginosa PA01
cgccauggucguucagcgg

SEQ ID NO: 3384967 - RNA, 19 nt, Pseudomonas aeruginosa PA01
cgccauguuccacaugcgc

SEQ ID NO: 3384968 - RNA, 21 nt, Pseudomonas aeruginosa PA01
cgccauguuggccuugagcag

SEQ ID NO: 3384969 - RNA, 22 nt, Pseudomonas aeruginosa PA01
cgccauguuggccuugagcagg

SEQ ID NO: 3384970 - RNA, 23 nt, Pseudomonas aeruginosa PA01
cgccauguuggccuugagcaggc

SEQ ID NO: 3384971 - RNA, 18 nt, Pseudomonas aeruginosa PA01
cgccauucacuuccccuc

SEQ ID NO: 3384972 - RNA, 19 nt, Pseudomonas aeruginosa PA01
cgccauucaggcggaucac

SEQ ID NO: 3384973 - RNA, 16 nt, Pseudomonas aeruginosa PA01
cgccauucgaauggcg

SEQ ID NO: 3384974 - RNA, 18 nt, Pseudomonas aeruginosa PA01
cgccauucgaauggcgcc

SEQ ID NO: 3384975 - RNA, 22 nt, Pseudomonas aeruginosa PA01
cgccauucgaauggcgccggcc

SEQ ID NO: 3384976 - RNA, 13 nt, Pseudomonas aeruginosa PA01
cgccauucggcga

SEQ ID NO: 3384977 - RNA, 14 nt, Pseudomonas aeruginosa PA01
cgccauucggcgac

SEQ ID NO: 3384978 - RNA, 18 nt, Pseudomonas aeruginosa PA01
cgccauucggcgacgggc

SEQ ID NO: 3384979 - RNA, 14 nt, Pseudomonas aeruginosa PA01
cgccauucucgcca

SEQ ID NO: 3384980 - RNA, 22 nt, Pseudomonas aeruginosa PA01
cgccauugacgaaauacucguc

SEQ ID NO: 3384981 - RNA, 14 nt, Pseudomonas aeruginosa PA01
cgccauugccgcca

SEQ ID NO: 3384982 - RNA, 16 nt, Pseudomonas aeruginosa PA01
cgccauugccgccagg

SEQ ID NO: 3384983 - RNA, 17 nt, Pseudomonas aeruginosa PA01
cgccauugugcgcgcgc

SEQ ID NO: 3384984 - RNA, 19 nt, Pseudomonas aeruginosa PA01
cgccauugugcgcgcgcag

SEQ ID NO: 3384985 - RNA, 16 nt, Pseudomonas aeruginosa PA01
cgccauuucaaggcga

SEQ ID NO: 3384986 - RNA, 18 nt, Pseudomonas aeruginosa PA01
cgccauuucaaggcgacg

SEQ ID NO: 3384987 - RNA, 18 nt, Pseudomonas aeruginosa PA01
cgcccaacgucuucaggc

SEQ ID NO: 3384988 - RNA, 14 nt, Pseudomonas aeruginosa PA01
cgcccaaggccagg

SEQ ID NO: 3384989 - RNA, 17 nt, Pseudomonas aeruginosa PA01
cgcccaaggccaggucg

SEQ ID NO: 3384990 - RNA, 19 nt, Pseudomonas aeruginosa PA01
cgcccaaugcaucggccgg

SEQ ID NO: 3384991 - RNA, 11 nt, Pseudomonas aeruginosa PA01
cgcccaccagg

SEQ ID NO: 3384992 - RNA, 12 nt, Pseudomonas aeruginosa PA01
cgcccaccaggu

SEQ ID NO: 3384993 - RNA, 16 nt, Pseudomonas aeruginosa PA01
cgcccacccugcgcga

SEQ ID NO: 3384994 - RNA, 20 nt, Pseudomonas aeruginosa PA01
cgcccacgccuugcagcacc

SEQ ID NO: 3384995 - RNA, 11 nt, Pseudomonas aeruginosa PA01
cgcccacgggc

SEQ ID NO: 3384996 - RNA, 15 nt, Pseudomonas aeruginosa PA01
cgcccacgggcggcu

SEQ ID NO: 3384997 - RNA, 22 nt, Pseudomonas aeruginosa PA01
cgccccacggcgcggccgugcc

SEQ ID NO: 3384998 - RNA, 19 nt, Pseudomonas aeruginosa PA01
cgccccagacccaggugcg

SEQ ID NO: 3384999 - RNA, 22 nt, Pseudomonas aeruginosa PA01
cgccccagacccaggugcgcag

SEQ ID NO: 3385000 - RNA, 18 nt, Pseudomonas aeruginosa PA01
cgccccagaucgccagcg

SEQ ID NO: 3385001 - RNA, 20 nt, Pseudomonas aeruginosa PA01
cgccccagaucgccagcgcc

SEQ ID NO: 3385002 - RNA, 19 nt, Pseudomonas aeruginosa PA01
cgccccagcaacugaccug

SEQ ID NO: 3385003 - RNA, 15 nt, Pseudomonas aeruginosa PA01
cgccccagcaccucg

SEQ ID NO: 3385004 - RNA, 19 nt, Pseudomonas aeruginosa PA01
cgccccagcaccucgccgu

SEQ ID NO: 3385005 - RNA, 12 nt, Pseudomonas aeruginosa PA01
cgccccagcgcc

SEQ ID NO: 3385006 - RNA, 13 nt, Pseudomonas aeruginosa PA01
cgccccagcgccu

SEQ ID NO: 3385007 - RNA, 18 nt, Pseudomonas aeruginosa PA01
cgccccagcgccugggcc

SEQ ID NO: 3385008 - RNA, 13 nt, Pseudomonas aeruginosa PA01
cgccccagcggca

SEQ ID NO: 3385009 - RNA, 14 nt, Pseudomonas aeruginosa PA01
cgccccagcggcag

SEQ ID NO: 3385010 - RNA, 13 nt, Pseudomonas aeruginosa PA01
cgccccaggcgcc

SEQ ID NO: 3385011 - RNA, 14 nt, Pseudomonas aeruginosa PA01
cgccccaggcgccc

SEQ ID NO: 3385012 - RNA, 12 nt, Pseudomonas aeruginosa PA01
cgccccaggcgg

SEQ ID NO: 3385013 - RNA, 19 nt, Pseudomonas aeruginosa PA01
cgccccaggcgggcacguc

SEQ ID NO: 3385014 - RNA, 15 nt, Pseudomonas aeruginosa PA01
cgccccaggugcagc

SEQ ID NO: 3385015 - RNA, 12 nt, Pseudomonas aeruginosa PA01
cgccccauccgg

SEQ ID NO: 3385016 - RNA, 19 nt, Pseudomonas aeruginosa PA01
cgccccauccgggcggcgg

SEQ ID NO: 3385017 - RNA, 20 nt, Pseudomonas aeruginosa PA01
cgccccauccgggcggcggg

SEQ ID NO: 3385018 - RNA, 13 nt, Pseudomonas aeruginosa PA01
cgcccccagcgcc

SEQ ID NO: 3385019 - RNA, 14 nt, Pseudomonas aeruginosa PA01
cgcccccagcgccc

SEQ ID NO: 3385020 - RNA, 12 nt, Pseudomonas aeruginosa PA01
cgcccccucccc

SEQ ID NO: 3385021 - RNA, 23 nt, Pseudomonas aeruginosa PA01
cgccccgcaaggugcgggccguc

SEQ ID NO: 3385022 - RNA, 15 nt, Pseudomonas aeruginosa PA01
cgccccgcaccagcc

SEQ ID NO: 3385023 - RNA, 20 nt, Pseudomonas aeruginosa PA01
cgccccgcaccagccagccc

SEQ ID NO: 3385024 - RNA, 22 nt, Pseudomonas aeruginosa PA01
cgccccgcaccagccagcccgc

SEQ ID NO: 3385025 - RNA, 12 nt, Pseudomonas aeruginosa PA01
cgccccgccagg

SEQ ID NO: 3385026 - RNA, 14 nt, Pseudomonas aeruginosa PA01
cgccccgccaggag

SEQ ID NO: 3385027 - RNA, 13 nt, Pseudomonas aeruginosa PA01
cgccccgccgcca

SEQ ID NO: 3385028 - RNA, 14 nt, Pseudomonas aeruginosa PA01
cgccccgccgccag

SEQ ID NO: 3385029 - RNA, 15 nt, Pseudomonas aeruginosa PA01
cgccccgccgccagg

SEQ ID NO: 3385030 - RNA, 12 nt, Pseudomonas aeruginosa PA01
cgccccgccggg

SEQ ID NO: 3385031 - RNA, 22 nt, Pseudomonas aeruginosa PA01
cgccccgcuacccugccccagc

SEQ ID NO: 3385032 - RNA, 14 nt, Pseudomonas aeruginosa PA01
cgccccgcuugccg

SEQ ID NO: 3385033 - RNA, 17 nt, Pseudomonas aeruginosa PA01
cgccccgcuugccgucg

SEQ ID NO: 3385034 - RNA, 13 nt, Pseudomonas aeruginosa PA01
cgccccggcagcc

SEQ ID NO: 3385035 - RNA, 17 nt, Pseudomonas aeruginosa PA01
cgccccggcagccacca

SEQ ID NO: 3385036 - RNA, 19 nt, Pseudomonas aeruginosa PA01
cgccccggcagccaccagg

SEQ ID NO: 3385037 - RNA, 17 nt, Pseudomonas aeruginosa PA01
cgccccggcccagccgc

SEQ ID NO: 3385038 - RNA, 19 nt, Pseudomonas aeruginosa PA01
cgccccggcccagccgcgg

SEQ ID NO: 3385039 - RNA, 12 nt, Pseudomonas aeruginosa PA01
cgccccggccgc

SEQ ID NO: 3385040 - RNA, 13 nt, Pseudomonas aeruginosa PA01
cgccccggccgcg

SEQ ID NO: 3385041 - RNA, 16 nt, Pseudomonas aeruginosa PA01
cgccccggccgcgcca

SEQ ID NO: 3385042 - RNA, 19 nt, Pseudomonas aeruginosa PA01
cgccccggccgcgccagcc

SEQ ID NO: 3385043 - RNA, 19 nt, Pseudomonas aeruginosa PA01
cgccccggcgagcgagcgg

SEQ ID NO: 3385044 - RNA, 14 nt, Pseudomonas aeruginosa PA01
cgccccggcggcga

SEQ ID NO: 3385045 - RNA, 12 nt, Pseudomonas aeruginosa PA01
cgccccgggcgu

SEQ ID NO: 3385046 - RNA, 13 nt, Pseudomonas aeruginosa PA01
cgccccgggucgc

SEQ ID NO: 3385047 - RNA, 14 nt, Pseudomonas aeruginosa PA01
cgccccgggucgcu

SEQ ID NO: 3385048 - RNA, 16 nt, Pseudomonas aeruginosa PA01
cgccccgggucggcac

SEQ ID NO: 3385049 - RNA, 14 nt, Pseudomonas aeruginosa PA01
cgccccggucucgc

SEQ ID NO: 3385050 - RNA, 16 nt, Pseudomonas aeruginosa PA01
cgccccggucucgcgc

SEQ ID NO: 3385051 - RNA, 20 nt, Pseudomonas aeruginosa PA01
cgccccgucgacgcaucgac

SEQ ID NO: 3385052 - RNA, 23 nt, Pseudomonas aeruginosa PA01
cgccccgucggcccuccccuggc

SEQ ID NO: 3385053 - RNA, 13 nt, Pseudomonas aeruginosa PA01
cgccccguuggcg

SEQ ID NO: 3385054 - RNA, 20 nt, Pseudomonas aeruginosa PA01
cgccccguuggcgcgggcga

SEQ ID NO: 3385055 - RNA, 18 nt, Pseudomonas aeruginosa PA01
cgccccguuugccgucgg

SEQ ID NO: 3385056 - RNA, 22 nt, Pseudomonas aeruginosa PA01
cgccccguuugccgucggcgcg

SEQ ID NO: 3385057 - RNA, 23 nt, Pseudomonas aeruginosa PA01
cgccccguuugccgucggcgcgg

SEQ ID NO: 3385058 - RNA, 16 nt, Pseudomonas aeruginosa PA01
cgccccucacuccguc

SEQ ID NO: 3385059 - RNA, 13 nt, Pseudomonas aeruginosa PA01
cgccccucccagc

SEQ ID NO: 3385060 - RNA, 17 nt, Pseudomonas aeruginosa PA01
cgccccucccagccaca

SEQ ID NO: 3385061 - RNA, 13 nt, Pseudomonas aeruginosa PA01
cgccccugcgccc

SEQ ID NO: 3385062 - RNA, 13 nt, Pseudomonas aeruginosa PA01
cgccccugcggcg

SEQ ID NO: 3385063 - RNA, 16 nt, Pseudomonas aeruginosa PA01
cgccccugcggcgccg

SEQ ID NO: 3385064 - RNA, 17 nt, Pseudomonas aeruginosa PA01
cgccccugcuccucgcc

SEQ ID NO: 3385065 - RNA, 18 nt, Pseudomonas aeruginosa PA01
cgccccuuggccagcacc

SEQ ID NO: 3385066 - RNA, 19 nt, Pseudomonas aeruginosa PA01
cgccccuuggccagcacca

SEQ ID NO: 3385067 - RNA, 22 nt, Pseudomonas aeruginosa PA01
cgccccuuuuuuuugccugccg

SEQ ID NO: 3385068 - RNA, 14 nt, Pseudomonas aeruginosa PA01
cgcccgaacgccga

SEQ ID NO: 3385069 - RNA, 16 nt, Pseudomonas aeruginosa PA01
cgcccgaccccacgcc

SEQ ID NO: 3385070 - RNA, 21 nt, Pseudomonas aeruginosa PA01
cgcccgaccccacgccggccg

SEQ ID NO: 3385071 - RNA, 22 nt, Pseudomonas aeruginosa PA01
cgcccgaccccacgccggccgg

SEQ ID NO: 3385072 - RNA, 11 nt, Pseudomonas aeruginosa PA01
cgcccgacgaa

SEQ ID NO: 3385073 - RNA, 21 nt, Pseudomonas aeruginosa PA01
cgcccgacgaaauagucgcgg

SEQ ID NO: 3385074 - RNA, 17 nt, Pseudomonas aeruginosa PA01
cgcccgagagggugguc

SEQ ID NO: 3385075 - RNA, 21 nt, Pseudomonas aeruginosa PA01
cgcccgagaggguggucgcgc

SEQ ID NO: 3385076 - RNA, 17 nt, Pseudomonas aeruginosa PA01
cgcccgagcuuugcgca

SEQ ID NO: 3385077 - RNA, 23 nt, Pseudomonas aeruginosa PA01
cgcccgagcuuugcgcagccacc

SEQ ID NO: 3385078 - RNA, 21 nt, Pseudomonas aeruginosa PA01
cgcccgaggcgaccuuggcca

SEQ ID NO: 3385079 - RNA, 13 nt, Pseudomonas aeruginosa PA01
cgcccgagggcgc

SEQ ID NO: 3385080 - RNA, 17 nt, Pseudomonas aeruginosa PA01
cgcccgagggcgccguu

SEQ ID NO: 3385081 - RNA, 17 nt, Pseudomonas aeruginosa PA01
cgcccgagucccuugcg

SEQ ID NO: 3385082 - RNA, 16 nt, Pseudomonas aeruginosa PA01
cgcccgauaggcgccg

SEQ ID NO: 3385083 - RNA, 19 nt, Pseudomonas aeruginosa PA01
cgcccgauaggcgccggcg

SEQ ID NO: 3385084 - RNA, 21 nt, Pseudomonas aeruginosa PA01
cgcccgauaggcgccggcgcg

SEQ ID NO: 3385085 - RNA, 15 nt, Pseudomonas aeruginosa PA01
cgcccgaucgccucg

SEQ ID NO: 3385086 - RNA, 21 nt, Pseudomonas aeruginosa PA01
cgcccgaugaucgagcgcacg

SEQ ID NO: 3385087 - RNA, 17 nt, Pseudomonas aeruginosa PA01
cgcccgcagccacaggc

SEQ ID NO: 3385088 - RNA, 19 nt, Pseudomonas aeruginosa PA01
cgcccgcagccacaggcgc

SEQ ID NO: 3385089 - RNA, 16 nt, Pseudomonas aeruginosa PA01
cgcccgcagccacggc

SEQ ID NO: 3385090 - RNA, 17 nt, Pseudomonas aeruginosa PA01
cgcccgcagccacggca

SEQ ID NO: 3385091 - RNA, 16 nt, Pseudomonas aeruginosa PA01
cgcccgcaguuccucg

SEQ ID NO: 3385092 - RNA, 18 nt, Pseudomonas aeruginosa PA01
cgcccgcaguuccucgcc

SEQ ID NO: 3385093 - RNA, 21 nt, Pseudomonas aeruginosa PA01
cgcccgcaguuccucgccgcu

SEQ ID NO: 3385094 - RNA, 21 nt, Pseudomonas aeruginosa PA01
cgcccgccaaggcccugcugc

SEQ ID NO: 3385095 - RNA, 22 nt, Pseudomonas aeruginosa PA01
cgcccgccaaggcccugcugca

SEQ ID NO: 3385096 - RNA, 14 nt, Pseudomonas aeruginosa PA01
cgcccgccaagggc

SEQ ID NO: 3385097 - RNA, 20 nt, Pseudomonas aeruginosa PA01
cgcccgccaagggcgccgcc

SEQ ID NO: 3385098 - RNA, 22 nt, Pseudomonas aeruginosa PA01
cgcccgccaagggcgccgccga

SEQ ID NO: 3385099 - RNA, 19 nt, Pseudomonas aeruginosa PA01
cgcccgccacggcgcgcuc

SEQ ID NO: 3385100 - RNA, 13 nt, Pseudomonas aeruginosa PA01
cgcccggcuggcc

SEQ ID NO: 3385101 - RNA, 18 nt, Pseudomonas aeruginosa PA01
cgcccggcuggccaucca

SEQ ID NO: 3385102 - RNA, 18 nt, Pseudomonas aeruginosa PA01
cgcccggcugugcucgac

SEQ ID NO: 3385103 - RNA, 21 nt, Pseudomonas aeruginosa PA01
cgcccggcuucggcggcgcgc

SEQ ID NO: 3385104 - RNA, 22 nt, Pseudomonas aeruginosa PA01
cgcccggcuucggcggcgcgcu

SEQ ID NO: 3385105 - RNA, 24 nt, Pseudomonas aeruginosa PA01
cgcccggcuucggcggcgcgcugc

SEQ ID NO: 3385106 - RNA, 14 nt, Pseudomonas aeruginosa PA01
cgcccggcuugagg

SEQ ID NO: 3385107 - RNA, 19 nt, Pseudomonas aeruginosa PA01
cgcccggcuuuccucggcc

SEQ ID NO: 3385108 - RNA, 13 nt, Pseudomonas aeruginosa PA01
cgcccgggccggg

SEQ ID NO: 3385109 - RNA, 15 nt, Pseudomonas aeruginosa PA01
cgcccgggccggggg

SEQ ID NO: 3385110 - RNA, 16 nt, Pseudomonas aeruginosa PA01
cgcccgggcgccaccg

SEQ ID NO: 3385111 - RNA, 22 nt, Pseudomonas aeruginosa PA01
cgcccgggcgccaccgauagcg

SEQ ID NO: 3385112 - RNA, 16 nt, Pseudomonas aeruginosa PA01
cgcccggucagguugg

SEQ ID NO: 3385113 - RNA, 20 nt, Pseudomonas aeruginosa PA01
cgcccggucuagcgccccgg

SEQ ID NO: 3385114 - RNA, 19 nt, Pseudomonas aeruginosa PA01
cgcccggucucagccggcg

SEQ ID NO: 3385115 - RNA, 20 nt, Pseudomonas aeruginosa PA01
cgcccggucucagccggcgc

SEQ ID NO: 3385116 - RNA, 18 nt, Pseudomonas aeruginosa PA01
cgcccggugucgacgacg

SEQ ID NO: 3385117 - RNA, 16 nt, Pseudomonas aeruginosa PA01
cgcccgguugccuucg

SEQ ID NO: 3385118 - RNA, 15 nt, Pseudomonas aeruginosa PA01
cgcccguagcacaug

SEQ ID NO: 3385119 - RNA, 14 nt, Pseudomonas aeruginosa PA01
cgcccgucacuuca

SEQ ID NO: 3385120 - RNA, 14 nt, Pseudomonas aeruginosa PA01
cgcccgucaugacc

SEQ ID NO: 3385121 - RNA, 17 nt, Pseudomonas aeruginosa PA01
cgcccgucaugaccaga

SEQ ID NO: 3385122 - RNA, 23 nt, Pseudomonas aeruginosa PA01
cgcccguccuccaaagccuggag

SEQ ID NO: 3385123 - RNA, 22 nt, Pseudomonas aeruginosa PA01
cgcccgucgccauucggcgacg

SEQ ID NO: 3385124 - RNA, 16 nt, Pseudomonas aeruginosa PA01
cgcccgucgcgccggc

SEQ ID NO: 3385125 - RNA, 17 nt, Pseudomonas aeruginosa PA01
cgcccgucgcgccggcc

SEQ ID NO: 3385126 - RNA, 18 nt, Pseudomonas aeruginosa PA01
cgcccgucgcgccggcca

SEQ ID NO: 3385127 - RNA, 14 nt, Pseudomonas aeruginosa PA01
cgcccgucgucgug

SEQ ID NO: 3385128 - RNA, 18 nt, Pseudomonas aeruginosa PA01
cgcccgucgucguggcga

SEQ ID NO: 3385129 - RNA, 15 nt, Pseudomonas aeruginosa PA01
cgcccgugccgacua

SEQ ID NO: 3385130 - RNA, 13 nt, Pseudomonas aeruginosa PA01
cgcccgugccucg

SEQ ID NO: 3385131 - RNA, 14 nt, Pseudomonas aeruginosa PA01
cgcccgugccucgg

SEQ ID NO: 3385132 - RNA, 16 nt, Pseudomonas aeruginosa PA01
cgcccgugccucggcg

SEQ ID NO: 3385133 - RNA, 18 nt, Pseudomonas aeruginosa PA01
cgcccgugccucggcgga

SEQ ID NO: 3385134 - RNA, 22 nt, Pseudomonas aeruginosa PA01
cgcccgugggguauuccaggcg

SEQ ID NO: 3385135 - RNA, 17 nt, Pseudomonas aeruginosa PA01
cgcccuaccccaggggu

SEQ ID NO: 3385136 - RNA, 15 nt, Pseudomonas aeruginosa PA01
cgcccuaccccccaa

SEQ ID NO: 3385137 - RNA, 15 nt, Pseudomonas aeruginosa PA01
cgcccuaccgcccac

SEQ ID NO: 3385138 - RNA, 16 nt, Pseudomonas aeruginosa PA01
cgcccuaccgcccacc

SEQ ID NO: 3385139 - RNA, 22 nt, Pseudomonas aeruginosa PA01
cgcccuaccgcccacccugcgc

SEQ ID NO: 3385140 - RNA, 17 nt, Pseudomonas aeruginosa PA01
cgcccuaccguccgcag

SEQ ID NO: 3385141 - RNA, 21 nt, Pseudomonas aeruginosa PA01
cgcccuaccguccgcagcaca

SEQ ID NO: 3385142 - RNA, 21 nt, Pseudomonas aeruginosa PA01
cgcccuaccugucccggacga

SEQ ID NO: 3385143 - RNA, 23 nt, Pseudomonas aeruginosa PA01
cgcccuaccugucccggacgacg

SEQ ID NO: 3385144 - RNA, 14 nt, Pseudomonas aeruginosa PA01
cgcccuacgaaagc

SEQ ID NO: 3385145 - RNA, 15 nt, Pseudomonas aeruginosa PA01
cgcccuacgaaagcg

SEQ ID NO: 3385146 - RNA, 22 nt, Pseudomonas aeruginosa PA01
cgcccuacgcaacccgcccggc

SEQ ID NO: 3385147 - RNA, 20 nt, Pseudomonas aeruginosa PA01
cgcccuacgccaccugagcg

SEQ ID NO: 3385148 - RNA, 15 nt, Pseudomonas aeruginosa PA01
cgcccuacgcggcac

SEQ ID NO: 3385149 - RNA, 19 nt, Pseudomonas aeruginosa PA01
cgcccuacgcggcaccgcu

SEQ ID NO: 3385150 - RNA, 16 nt, Pseudomonas aeruginosa PA01
cgcccuacggaucggg

SEQ ID NO: 3385151 - RNA, 17 nt, Pseudomonas aeruginosa PA01
cgcccuacggccccagg

SEQ ID NO: 3385152 - RNA, 23 nt, Pseudomonas aeruginosa PA01
cgcccuacggggacaugucgagg

SEQ ID NO: 3385153 - RNA, 22 nt, Pseudomonas aeruginosa PA01
cgcccuacggggcgugucgagg

SEQ ID NO: 3385154 - RNA, 14 nt, Pseudomonas aeruginosa PA01
cgcccuacgggggc

SEQ ID NO: 3385155 - RNA, 17 nt, Pseudomonas aeruginosa PA01
cgcccuacuccaggggu

SEQ ID NO: 3385156 - RNA, 15 nt, Pseudomonas aeruginosa PA01
cgcccuagcgguccg

SEQ ID NO: 3385157 - RNA, 15 nt, Pseudomonas aeruginosa PA01
cgcccucagcagcgc

SEQ ID NO: 3385158 - RNA, 16 nt, Pseudomonas aeruginosa PA01
cgcccucagcagcgcc

SEQ ID NO: 3385159 - RNA, 17 nt, Pseudomonas aeruginosa PA01
cgcccucagcagcgccg

SEQ ID NO: 3385160 - RNA, 22 nt, Pseudomonas aeruginosa PA01
cgcccucagcagcgccgcccug

SEQ ID NO: 3385161 - RNA, 12 nt, Pseudomonas aeruginosa PA01
cgcccuccagca

SEQ ID NO: 3385162 - RNA, 14 nt, Pseudomonas aeruginosa PA01
cgcccuccagcacc

SEQ ID NO: 3385163 - RNA, 15 nt, Pseudomonas aeruginosa PA01
cgcccuccagcaccc

SEQ ID NO: 3385164 - RNA, 22 nt, Pseudomonas aeruginosa PA01
cgcccuccagcaccgccuggcg

SEQ ID NO: 3385165 - RNA, 15 nt, Pseudomonas aeruginosa PA01
cgcccuccaucagcg

SEQ ID NO: 3385166 - RNA, 17 nt, Pseudomonas aeruginosa PA01
cgcccucgaagcccugc

SEQ ID NO: 3385167 - RNA, 13 nt, Pseudomonas aeruginosa PA01
cgcccucgcggag

SEQ ID NO: 3385168 - RNA, 19 nt, Pseudomonas aeruginosa PA01
cgcccucgcucguuccgcg

SEQ ID NO: 3385169 - RNA, 20 nt, Pseudomonas aeruginosa PA01
cgcccucgcucguuccgcgg

SEQ ID NO: 3385170 - RNA, 16 nt, Pseudomonas aeruginosa PA01
cgcccucgcugagcag

SEQ ID NO: 3385171 - RNA, 18 nt, Pseudomonas aeruginosa PA01
cgcccucggcgacgagga

SEQ ID NO: 3385172 - RNA, 20 nt, Pseudomonas aeruginosa PA01
cgcccucggcgacgaggacg

SEQ ID NO: 3385173 - RNA, 12 nt, Pseudomonas aeruginosa PA01
cgcccucggcgc

SEQ ID NO: 3385174 - RNA, 15 nt, Pseudomonas aeruginosa PA01
cgcccucggcgcugg

SEQ ID NO: 3385175 - RNA, 13 nt, Pseudomonas aeruginosa PA01
cgcccucgggccg

SEQ ID NO: 3385176 - RNA, 18 nt, Pseudomonas aeruginosa PA01
cgcccucgggccgcaggg

SEQ ID NO: 3385177 - RNA, 17 nt, Pseudomonas aeruginosa PA01
cgcccucggggccgagg

SEQ ID NO: 3385178 - RNA, 23 nt, Pseudomonas aeruginosa PA01
cgcccucggugauaccgccggcg

SEQ ID NO: 3385179 - RNA, 14 nt, Pseudomonas aeruginosa PA01
cgcccucguggcgg

SEQ ID NO: 3385180 - RNA, 15 nt, Pseudomonas aeruginosa PA01
cgcccucguggcggg

SEQ ID NO: 3385181 - RNA, 21 nt, Pseudomonas aeruginosa PA01
cgcccucucaggagcgccgcg

SEQ ID NO: 3385182 - RNA, 15 nt, Pseudomonas aeruginosa PA01
cgcccugacgaugca

SEQ ID NO: 3385183 - RNA, 18 nt, Pseudomonas aeruginosa PA01
cgcccugcaccuugggau

SEQ ID NO: 3385184 - RNA, 22 nt, Pseudomonas aeruginosa PA01
cgcccugcaccuugggaucguc

SEQ ID NO: 3385185 - RNA, 23 nt, Pseudomonas aeruginosa PA01
cgcccugcacggauaccacccgc

SEQ ID NO: 3385186 - RNA, 17 nt, Pseudomonas aeruginosa PA01
cgcccugcagcgcgcgc

SEQ ID NO: 3385187 - RNA, 21 nt, Pseudomonas aeruginosa PA01
cgcccugcccgguggggcggg

SEQ ID NO: 3385188 - RNA, 11 nt, Pseudomonas aeruginosa PA01
cgcccugcgcc

SEQ ID NO: 3385189 - RNA, 14 nt, Pseudomonas aeruginosa PA01
cgcccugcgccagc

SEQ ID NO: 3385190 - RNA, 14 nt, Pseudomonas aeruginosa PA01
cgcccugcgcgauc

SEQ ID NO: 3385191 - RNA, 17 nt, Pseudomonas aeruginosa PA01
cgcccugcgcgaucccc

SEQ ID NO: 3385192 - RNA, 12 nt, Pseudomonas aeruginosa PA01
cgcccugcggau

SEQ ID NO: 3385193 - RNA, 18 nt, Pseudomonas aeruginosa PA01
cgcccugcggauggcgcg

SEQ ID NO: 3385194 - RNA, 22 nt, Pseudomonas aeruginosa PA01
cgcccugcggauggcgcggggc

SEQ ID NO: 3385195 - RNA, 12 nt, Pseudomonas aeruginosa PA01
cgcccugcggca

SEQ ID NO: 3385196 - RNA, 15 nt, Pseudomonas aeruginosa PA01
cgcccugcggcaggc

SEQ ID NO: 3385197 - RNA, 17 nt, Pseudomonas aeruginosa PA01
cgcccugcggcaggcgc

SEQ ID NO: 3385198 - RNA, 18 nt, Pseudomonas aeruginosa PA01
cgcccugcggcaggcgcc

SEQ ID NO: 3385199 - RNA, 16 nt, Pseudomonas aeruginosa PA01
cgcccugcucuugccg

SEQ ID NO: 3385200 - RNA, 20 nt, Pseudomonas aeruginosa PA01
cgcccuggagcggaaacccg

SEQ ID NO: 3385201 - RNA, 22 nt, Pseudomonas aeruginosa PA01
cgcccuggccgaucagcuuggc

SEQ ID NO: 3385202 - RNA, 14 nt, Pseudomonas aeruginosa PA01
cgcccuggccgucg

SEQ ID NO: 3385203 - RNA, 21 nt, Pseudomonas aeruginosa PA01
cgccgaaguucuucagcagca

SEQ ID NO: 3385204 - RNA, 15 nt, Pseudomonas aeruginosa PA01
cgccgaauccaggcc

SEQ ID NO: 3385205 - RNA, 16 nt, Pseudomonas aeruginosa PA01
cgccgaauccaggccg

SEQ ID NO: 3385206 - RNA, 17 nt, Pseudomonas aeruginosa PA01
cgccgaauccaggccga

SEQ ID NO: 3385207 - RNA, 18 nt, Pseudomonas aeruginosa PA01
cgccgaauccaggccgac

SEQ ID NO: 3385208 - RNA, 23 nt, Pseudomonas aeruginosa PA01
cgccgacaacgaaaagagccgcg

SEQ ID NO: 3385209 - RNA, 18 nt, Pseudomonas aeruginosa PA01
cgccgacacccgcgccgc

SEQ ID NO: 3385210 - RNA, 19 nt, Pseudomonas aeruginosa PA01
cgccgacacccgcgccgcc

SEQ ID NO: 3385211 - RNA, 22 nt, Pseudomonas aeruginosa PA01
cgccgacacccgcgccgccgcg

SEQ ID NO: 3385212 - RNA, 17 nt, Pseudomonas aeruginosa PA01
cgccgacacgggugccg

SEQ ID NO: 3385213 - RNA, 14 nt, Pseudomonas aeruginosa PA01
cgccgacagcacga

SEQ ID NO: 3385214 - RNA, 19 nt, Pseudomonas aeruginosa PA01
cgccgacaggccggugccg

SEQ ID NO: 3385215 - RNA, 21 nt, Pseudomonas aeruginosa PA01
cgccgacaggccggugccgcc

SEQ ID NO: 3385216 - RNA, 22 nt, Pseudomonas aeruginosa PA01
cgccgacaggccggugccgccg

SEQ ID NO: 3385217 - RNA, 14 nt, Pseudomonas aeruginosa PA01
cgccgacaggucgc

SEQ ID NO: 3385218 - RNA, 18 nt, Pseudomonas aeruginosa PA01
cgccgacaggucggccgg

SEQ ID NO: 3385219 - RNA, 20 nt, Pseudomonas aeruginosa PA01
cgccgacaggucggccggca

SEQ ID NO: 3385220 - RNA, 17 nt, Pseudomonas aeruginosa PA01
cgccgacaucggagugc

SEQ ID NO: 3385221 - RNA, 23 nt, Pseudomonas aeruginosa PA01
cgccgacaucggagugcaugccg

SEQ ID NO: 3385222 - RNA, 17 nt, Pseudomonas aeruginosa PA01
cgccgaccacgaccgcg

SEQ ID NO: 3385223 - RNA, 21 nt, Pseudomonas aeruginosa PA01
cgccgaccacuuccagguagc

SEQ ID NO: 3385224 - RNA, 15 nt, Pseudomonas aeruginosa PA01
cgccgaccagcaaca

SEQ ID NO: 3385225 - RNA, 16 nt, Pseudomonas aeruginosa PA01
cgccgaccagcacggc

SEQ ID NO: 3385226 - RNA, 14 nt, Pseudomonas aeruginosa PA01
cgccgaccagccgc

SEQ ID NO: 3385227 - RNA, 15 nt, Pseudomonas aeruginosa PA01
cgccgaccagccgca

SEQ ID NO: 3385228 - RNA, 16 nt, Pseudomonas aeruginosa PA01
cgccgaccagccgcag

SEQ ID NO: 3385229 - RNA, 17 nt, Pseudomonas aeruginosa PA01
cgccgaccagccgcagg

SEQ ID NO: 3385230 - RNA, 12 nt, Pseudomonas aeruginosa PA01
cgccgaccagcu

SEQ ID NO: 3385231 - RNA, 17 nt, Pseudomonas aeruginosa PA01
cgccgaccaggcggccg

SEQ ID NO: 3385232 - RNA, 23 nt, Pseudomonas aeruginosa PA01
cgccgaccaggcggccgucggcc

SEQ ID NO: 3385233 - RNA, 15 nt, Pseudomonas aeruginosa PA01
cgccgaccagguccg

SEQ ID NO: 3385234 - RNA, 19 nt, Pseudomonas aeruginosa PA01
cgccgaccagguccgccac

SEQ ID NO: 3385235 - RNA, 23 nt, Pseudomonas aeruginosa PA01
cgccgacccagagcgcgcccugc

SEQ ID NO: 3385236 - RNA, 21 nt, Pseudomonas aeruginosa PA01
cgccgacccugcacccuuggc

SEQ ID NO: 3385237 - RNA, 24 nt, Pseudomonas aeruginosa PA01
cgccgacccugcacccuuggcgca

SEQ ID NO: 3385238 - RNA, 19 nt, Pseudomonas aeruginosa PA01
cgccgaccgcaccgccagc

SEQ ID NO: 3385239 - RNA, 23 nt, Pseudomonas aeruginosa PA01
cgccgaccgcaccgccagcgucg

SEQ ID NO: 3385240 - RNA, 13 nt, Pseudomonas aeruginosa PA01
cgccgaccgcgcg

SEQ ID NO: 3385241 - RNA, 16 nt, Pseudomonas aeruginosa PA01
cgccgaccgcgcgccu

SEQ ID NO: 3385242 - RNA, 12 nt, Pseudomonas aeruginosa PA01
cgccgaccucca

SEQ ID NO: 3385243 - RNA, 16 nt, Pseudomonas aeruginosa PA01
cgccgaccucggccgc

SEQ ID NO: 3385244 - RNA, 18 nt, Pseudomonas aeruginosa PA01
cgccgacgccaccagcca

SEQ ID NO: 3385245 - RNA, 20 nt, Pseudomonas aeruginosa PA01
cgccgacgccaccagccagg

SEQ ID NO: 3385246 - RNA, 12 nt, Pseudomonas aeruginosa PA01
cgccgacgccau

SEQ ID NO: 3385247 - RNA, 14 nt, Pseudomonas aeruginosa PA01
cgccgacgccgagu

SEQ ID NO: 3385248 - RNA, 18 nt, Pseudomonas aeruginosa PA01
cgccgacggacguccucc

SEQ ID NO: 3385249 - RNA, 18 nt, Pseudomonas aeruginosa PA01
cgccgacggcgugccgug

SEQ ID NO: 3385250 - RNA, 19 nt, Pseudomonas aeruginosa PA01
cgccgacggcgugccgugg

SEQ ID NO: 3385251 - RNA, 19 nt, Pseudomonas aeruginosa PA01
cgccgacguccuccaggac

SEQ ID NO: 3385252 - RNA, 23 nt, Pseudomonas aeruginosa PA01
cgccgacgucguggauaggcggc

SEQ ID NO: 3385253 - RNA, 22 nt, Pseudomonas aeruginosa PA01
cgccgacugcaacuggccgaga

SEQ ID NO: 3385254 - RNA, 18 nt, Pseudomonas aeruginosa PA01
cgccgacuugcucaucgc

SEQ ID NO: 3385255 - RNA, 23 nt, Pseudomonas aeruginosa PA01
cgccgacuugcucaucgcguagg

SEQ ID NO: 3385256 - RNA, 23 nt, Pseudomonas aeruginosa PA01
cgccgagaaaguucccgcauggc

SEQ ID NO: 3385257 - RNA, 18 nt, Pseudomonas aeruginosa PA01
cgccgagaacccggccag

SEQ ID NO: 3385258 - RNA, 21 nt, Pseudomonas aeruginosa PA01
cgccgagaacccggccaggcc

SEQ ID NO: 3385259 - RNA, 20 nt, Pseudomonas aeruginosa PA01
cgccgagaacgcggcgaagg

SEQ ID NO: 3385260 - RNA, 21 nt, Pseudomonas aeruginosa PA01
cgccgagaacgcggcgaaggg

SEQ ID NO: 3385261 - RNA, 22 nt, Pseudomonas aeruginosa PA01
cgccgagaacgcggcgaagggc

SEQ ID NO: 3385262 - RNA, 13 nt, Pseudomonas aeruginosa PA01
cgccgagacgauc

SEQ ID NO: 3385263 - RNA, 18 nt, Pseudomonas aeruginosa PA01
cgccgagacgaucagcag

SEQ ID NO: 3385264 - RNA, 20 nt, Pseudomonas aeruginosa PA01
cgccgagacgaucagcagga

SEQ ID NO: 3385265 - RNA, 13 nt, Pseudomonas aeruginosa PA01
cgccgagcaaccg

SEQ ID NO: 3385266 - RNA, 14 nt, Pseudomonas aeruginosa PA01
cgccgagcaacggc

SEQ ID NO: 3385267 - RNA, 17 nt, Pseudomonas aeruginosa PA01
cgccgagcaacggcagc

SEQ ID NO: 3385268 - RNA, 18 nt, Pseudomonas aeruginosa PA01
cgccgagcaacggcagca

SEQ ID NO: 3385269 - RNA, 20 nt, Pseudomonas aeruginosa PA01
cgccgagcaacggcagcaug

SEQ ID NO: 3385270 - RNA, 13 nt, Pseudomonas aeruginosa PA01
cgccgagcaagcc

SEQ ID NO: 3385271 - RNA, 16 nt, Pseudomonas aeruginosa PA01
cgccgagcaccccgac

SEQ ID NO: 3385272 - RNA, 13 nt, Pseudomonas aeruginosa PA01
cgccgagcagcac

SEQ ID NO: 3385273 - RNA, 15 nt, Pseudomonas aeruginosa PA01
cgccgagcagcacca

SEQ ID NO: 3385274 - RNA, 16 nt, Pseudomonas aeruginosa PA01
cgccgagcagcaccag

SEQ ID NO: 3385275 - RNA, 13 nt, Pseudomonas aeruginosa PA01
cgccgagcagcgg

SEQ ID NO: 3385276 - RNA, 16 nt, Pseudomonas aeruginosa PA01
cgccgagcagcggcgc

SEQ ID NO: 3385277 - RNA, 15 nt, Pseudomonas aeruginosa PA01
cgccgagcauccagg

SEQ ID NO: 3385278 - RNA, 21 nt, Pseudomonas aeruginosa PA01
cgccgagcaugcgggcgaucu

SEQ ID NO: 3385279 - RNA, 23 nt, Pseudomonas aeruginosa PA01
cgccgagcaugcgggcgaucucc

SEQ ID NO: 3385280 - RNA, 18 nt, Pseudomonas aeruginosa PA01
cgccgagcauuccgacaa

SEQ ID NO: 3385281 - RNA, 20 nt, Pseudomonas aeruginosa PA01
cgccgagcauuccgacaagg

SEQ ID NO: 3385282 - RNA, 23 nt, Pseudomonas aeruginosa PA01
cgccgagcauuccgacaaggagc

SEQ ID NO: 3385283 - RNA, 12 nt, Pseudomonas aeruginosa PA01
cgccgagccagg

SEQ ID NO: 3385284 - RNA, 13 nt, Pseudomonas aeruginosa PA01
cgccgagccaggu

SEQ ID NO: 3385285 - RNA, 19 nt, Pseudomonas aeruginosa PA01
cgccgagcccccggcgccc

SEQ ID NO: 3385286 - RNA, 15 nt, Pseudomonas aeruginosa PA01
cgccgagccggcugc

SEQ ID NO: 3385287 - RNA, 17 nt, Pseudomonas aeruginosa PA01
cgccgagccggcugccg

SEQ ID NO: 3385288 - RNA, 13 nt, Pseudomonas aeruginosa PA01
cgccgagcgccgc

SEQ ID NO: 3385289 - RNA, 15 nt, Pseudomonas aeruginosa PA01
cgccgagcgcucgcc

SEQ ID NO: 3385290 - RNA, 16 nt, Pseudomonas aeruginosa PA01
cgccgagcgcucgccg

SEQ ID NO: 3385291 - RNA, 18 nt, Pseudomonas aeruginosa PA01
cgccgagcguugggccuc

SEQ ID NO: 3385292 - RNA, 14 nt, Pseudomonas aeruginosa PA01
cgccgagcugacca

SEQ ID NO: 3385293 - RNA, 20 nt, Pseudomonas aeruginosa PA01
cgccgagcugaccaccaggg

SEQ ID NO: 3385294 - RNA, 18 nt, Pseudomonas aeruginosa PA01
cgccgagcuggcgcgcgu

SEQ ID NO: 3385295 - RNA, 17 nt, Pseudomonas aeruginosa PA01
cgccgaggaacauccgc

SEQ ID NO: 3385296 - RNA, 22 nt, Pseudomonas aeruginosa PA01
cgccgaggaacauccgcggccc

SEQ ID NO: 3385297 - RNA, 12 nt, Pseudomonas aeruginosa PA01
cgccgaggaacu

SEQ ID NO: 3385298 - RNA, 22 nt, Pseudomonas aeruginosa PA01
cgccgaggaacuucaugaugcg

SEQ ID NO: 3385299 - RNA, 24 nt, Pseudomonas aeruginosa PA01
cgccgaggaacuucaugaugcgcc

SEQ ID NO: 3385300 - RNA, 13 nt, Pseudomonas aeruginosa PA01
cgccgaggaagcc

SEQ ID NO: 3385301 - RNA, 16 nt, Pseudomonas aeruginosa PA01
cgccgaggaagccgac

SEQ ID NO: 3385302 - RNA, 24 nt, Pseudomonas aeruginosa PA01
cgccgaggaagccgaccggcgccg

SEQ ID NO: 3385303 - RNA, 16 nt, Pseudomonas aeruginosa PA01
cgccgaggagacgcgg

SEQ ID NO: 3385304 - RNA, 20 nt, Pseudomonas aeruginosa PA01
cgccgaggaggaucucgcgc

SEQ ID NO: 3385305 - RNA, 18 nt, Pseudomonas aeruginosa PA01
cgccgcaguacgaggggc

SEQ ID NO: 3385306 - RNA, 20 nt, Pseudomonas aeruginosa PA01
cgccgcaguacgaggggccg

SEQ ID NO: 3385307 - RNA, 20 nt, Pseudomonas aeruginosa PA01
cgccgcaucgcugaccucga

SEQ ID NO: 3385308 - RNA, 17 nt, Pseudomonas aeruginosa PA01
cgccgcauuggccaggc

SEQ ID NO: 3385309 - RNA, 24 nt, Pseudomonas aeruginosa PA01
cgccgcauuggccaggccccaggc

SEQ ID NO: 3385310 - RNA, 21 nt, Pseudomonas aeruginosa PA01
cgccgccaaccacuccgccac

SEQ ID NO: 3385311 - RNA, 16 nt, Pseudomonas aeruginosa PA01
cgccgccaacuggcug

SEQ ID NO: 3385312 - RNA, 15 nt, Pseudomonas aeruginosa PA01
cgccgccaccgccac

SEQ ID NO: 3385313 - RNA, 21 nt, Pseudomonas aeruginosa PA01
cgccgccaccgccaccgccgg

SEQ ID NO: 3385314 - RNA, 13 nt, Pseudomonas aeruginosa PA01
cgccgccacgccg

SEQ ID NO: 3385315 - RNA, 13 nt, Pseudomonas aeruginosa PA01
cgccgccagcaac

SEQ ID NO: 3385316 - RNA, 12 nt, Pseudomonas aeruginosa PA01
cgccgccagcag

SEQ ID NO: 3385317 - RNA, 13 nt, Pseudomonas aeruginosa PA01
cgccgccagcagg

SEQ ID NO: 3385318 - RNA, 15 nt, Pseudomonas aeruginosa PA01
cgccgccagcaggau

SEQ ID NO: 3385319 - RNA, 18 nt, Pseudomonas aeruginosa PA01
cgccgccagcaggaucgg

SEQ ID NO: 3385320 - RNA, 21 nt, Pseudomonas aeruginosa PA01
cgccgccagcaggucggccug

SEQ ID NO: 3385321 - RNA, 11 nt, Pseudomonas aeruginosa PA01
cgccgccagcc

SEQ ID NO: 3385322 - RNA, 13 nt, Pseudomonas aeruginosa PA01
cgccgccagccag

SEQ ID NO: 3385323 - RNA, 14 nt, Pseudomonas aeruginosa PA01
cgccgccagccaga

SEQ ID NO: 3385324 - RNA, 12 nt, Pseudomonas aeruginosa PA01
cgccgccaggca

SEQ ID NO: 3385325 - RNA, 20 nt, Pseudomonas aeruginosa PA01
cgccgccaggcagaccaggc

SEQ ID NO: 3385326 - RNA, 23 nt, Pseudomonas aeruginosa PA01
cgccgccaggcagaccaggccga

SEQ ID NO: 3385327 - RNA, 14 nt, Pseudomonas aeruginosa PA01
cgccgccaggcagg

SEQ ID NO: 3385328 - RNA, 17 nt, Pseudomonas aeruginosa PA01
cgccgccaggcaggccg

SEQ ID NO: 3385329 - RNA, 23 nt, Pseudomonas aeruginosa PA01
cgccgccaggcaggccgggcugg

SEQ ID NO: 3385330 - RNA, 13 nt, Pseudomonas aeruginosa PA01
cgccgccaggcgc

SEQ ID NO: 3385331 - RNA, 15 nt, Pseudomonas aeruginosa PA01
cgccgccaggcgcgu

SEQ ID NO: 3385332 - RNA, 19 nt, Pseudomonas aeruginosa PA01
cgccgccaggcgcgucucc

SEQ ID NO: 3385333 - RNA, 20 nt, Pseudomonas aeruginosa PA01
cgccgccaggcgcgucucca

SEQ ID NO: 3385334 - RNA, 15 nt, Pseudomonas aeruginosa PA01
cgccgccaggcgcug

SEQ ID NO: 3385335 - RNA, 15 nt, Pseudomonas aeruginosa PA01
cgccgccaggcggca

SEQ ID NO: 3385336 - RNA, 18 nt, Pseudomonas aeruginosa PA01
cgccgccagguccgccug

SEQ ID NO: 3385337 - RNA, 24 nt, Pseudomonas aeruginosa PA01
cgccgccagguccgccugguccag

SEQ ID NO: 3385338 - RNA, 18 nt, Pseudomonas aeruginosa PA01
cgccgccaguucgcgcag

SEQ ID NO: 3385339 - RNA, 19 nt, Pseudomonas aeruginosa PA01
cgccgccaguucgcgcagg

SEQ ID NO: 3385340 - RNA, 14 nt, Pseudomonas aeruginosa PA01
cgccgccaguucgg

SEQ ID NO: 3385341 - RNA, 23 nt, Pseudomonas aeruginosa PA01
cgccgccaguucggccaucagca

SEQ ID NO: 3385342 - RNA, 22 nt, Pseudomonas aeruginosa PA01
cgccgccaguugcuugaucgcc

SEQ ID NO: 3385343 - RNA, 16 nt, Pseudomonas aeruginosa PA01
cgccgccauugacgaa

SEQ ID NO: 3385344 - RNA, 14 nt, Pseudomonas aeruginosa PA01
cgccgcccacgccu

SEQ ID NO: 3385345 - RNA, 14 nt, Pseudomonas aeruginosa PA01
cgccgcccagcagc

SEQ ID NO: 3385346 - RNA, 22 nt, Pseudomonas aeruginosa PA01
cgccgcccaguccugggugucg

SEQ ID NO: 3385347 - RNA, 17 nt, Pseudomonas aeruginosa PA01
cgccgcccccagcgcgc

SEQ ID NO: 3385348 - RNA, 20 nt, Pseudomonas aeruginosa PA01
cgccgcccccagcgcgccgc

SEQ ID NO: 3385349 - RNA, 23 nt, Pseudomonas aeruginosa PA01
cgccgcccccagcgcgccgccga

SEQ ID NO: 3385350 - RNA, 16 nt, Pseudomonas aeruginosa PA01
cgccgcccccggcccg

SEQ ID NO: 3385351 - RNA, 15 nt, Pseudomonas aeruginosa PA01
cgccgccccguuggc

SEQ ID NO: 3385352 - RNA, 16 nt, Pseudomonas aeruginosa PA01
cgccgccccguuggcg

SEQ ID NO: 3385353 - RNA, 21 nt, Pseudomonas aeruginosa PA01
cgccgcccgagaggguggucg

SEQ ID NO: 3385354 - RNA, 14 nt, Pseudomonas aeruginosa PA01
cgccgcccgaggcg

SEQ ID NO: 3385355 - RNA, 15 nt, Pseudomonas aeruginosa PA01
cgccgcccgaggcga

SEQ ID NO: 3385356 - RNA, 17 nt, Pseudomonas aeruginosa PA01
cgccgcccgaggcgacc

SEQ ID NO: 3385357 - RNA, 12 nt, Pseudomonas aeruginosa PA01
cgccgcccgcgc

SEQ ID NO: 3385358 - RNA, 17 nt, Pseudomonas aeruginosa PA01
cgccgcccgcgccucca

SEQ ID NO: 3385359 - RNA, 14 nt, Pseudomonas aeruginosa PA01
cgccgcccggcacc

SEQ ID NO: 3385360 - RNA, 13 nt, Pseudomonas aeruginosa PA01
cgccgcccggcag

SEQ ID NO: 3385361 - RNA, 14 nt, Pseudomonas aeruginosa PA01
cgccgcccggcagc

SEQ ID NO: 3385362 - RNA, 16 nt, Pseudomonas aeruginosa PA01
cgccgcccggcucgcc

SEQ ID NO: 3385363 - RNA, 18 nt, Pseudomonas aeruginosa PA01
cgccgcccggcucgccgc

SEQ ID NO: 3385364 - RNA, 19 nt, Pseudomonas aeruginosa PA01
cgccgcccggcucgccgcc

SEQ ID NO: 3385365 - RNA, 21 nt, Pseudomonas aeruginosa PA01
cgccgcccggcucgccgccgg

SEQ ID NO: 3385366 - RNA, 15 nt, Pseudomonas aeruginosa PA01
cgccgcccgucgcgc

SEQ ID NO: 3385367 - RNA, 17 nt, Pseudomonas aeruginosa PA01
cgccgcccgucgcgccg

SEQ ID NO: 3385368 - RNA, 18 nt, Pseudomonas aeruginosa PA01
cgccgcccgucgcgccgg

SEQ ID NO: 3385369 - RNA, 15 nt, Pseudomonas aeruginosa PA01
cgccgcccuggccgc

SEQ ID NO: 3385370 - RNA, 16 nt, Pseudomonas aeruginosa PA01
cgccgccgaacaugcc

SEQ ID NO: 3385371 - RNA, 23 nt, Pseudomonas aeruginosa PA01
cgccgccgaacaugccgaagagc

SEQ ID NO: 3385372 - RNA, 16 nt, Pseudomonas aeruginosa PA01
cgccgccgaagccgac

SEQ ID NO: 3385373 - RNA, 23 nt, Pseudomonas aeruginosa PA01
cgccgccgaagccgacgccgagc

SEQ ID NO: 3385374 - RNA, 16 nt, Pseudomonas aeruginosa PA01
cgccgccgacacccgc

SEQ ID NO: 3385375 - RNA, 19 nt, Pseudomonas aeruginosa PA01
cgccgccgacacccgcgcc

SEQ ID NO: 3385376 - RNA, 20 nt, Pseudomonas aeruginosa PA01
cgccgccgacacccgcgccg

SEQ ID NO: 3385377 - RNA, 21 nt, Pseudomonas aeruginosa PA01
cgccgccgacacccgcgccgc

SEQ ID NO: 3385378 - RNA, 14 nt, Pseudomonas aeruginosa PA01
cgccgccgaccggg

SEQ ID NO: 3385379 - RNA, 12 nt, Pseudomonas aeruginosa PA01
cgccgccgagaa

SEQ ID NO: 3385380 - RNA, 16 nt, Pseudomonas aeruginosa PA01
cgccgccgagaacccg

SEQ ID NO: 3385381 - RNA, 21 nt, Pseudomonas aeruginosa PA01
cgccgccgagaacccggccag

SEQ ID NO: 3385382 - RNA, 17 nt, Pseudomonas aeruginosa PA01
cgccgccgagcaggccc

SEQ ID NO: 3385383 - RNA, 22 nt, Pseudomonas aeruginosa PA01
cgccgccgagcaugcgggcgau

SEQ ID NO: 3385384 - RNA, 13 nt, Pseudomonas aeruginosa PA01
cgccgccgagcgc

SEQ ID NO: 3385385 - RNA, 14 nt, Pseudomonas aeruginosa PA01
cgccgccgagcgcc

SEQ ID NO: 3385386 - RNA, 16 nt, Pseudomonas aeruginosa PA01
cgccgccgaggaggau

SEQ ID NO: 3385387 - RNA, 14 nt, Pseudomonas aeruginosa PA01
cgccgccgaggcgc

SEQ ID NO: 3385388 - RNA, 15 nt, Pseudomonas aeruginosa PA01
cgccgccgaggcgcg

SEQ ID NO: 3385389 - RNA, 14 nt, Pseudomonas aeruginosa PA01
cgccgccgaggugc

SEQ ID NO: 3385390 - RNA, 16 nt, Pseudomonas aeruginosa PA01
cgccgccgaggugcgg

SEQ ID NO: 3385391 - RNA, 12 nt, Pseudomonas aeruginosa PA01
cgccgccgcaac

SEQ ID NO: 3385392 - RNA, 14 nt, Pseudomonas aeruginosa PA01
cgccgccgcagccg

SEQ ID NO: 3385393 - RNA, 12 nt, Pseudomonas aeruginosa PA01
cgccgccgccag

SEQ ID NO: 3385394 - RNA, 12 nt, Pseudomonas aeruginosa PA01
cgccgccgccga

SEQ ID NO: 3385395 - RNA, 14 nt, Pseudomonas aeruginosa PA01
cgccgccgccgacc

SEQ ID NO: 3385396 - RNA, 13 nt, Pseudomonas aeruginosa PA01
cgccgccgccgcg

SEQ ID NO: 3385397 - RNA, 14 nt, Pseudomonas aeruginosa PA01
cgccgccgccgcgg

SEQ ID NO: 3385398 - RNA, 13 nt, Pseudomonas aeruginosa PA01
cgccgccgccggg

SEQ ID NO: 3385399 - RNA, 15 nt, Pseudomonas aeruginosa PA01
cgccgccgccgucga

SEQ ID NO: 3385400 - RNA, 12 nt, Pseudomonas aeruginosa PA01
cgccgccgcgcg

SEQ ID NO: 3385401 - RNA, 21 nt, Pseudomonas aeruginosa PA01
cgccgccgcgcuucaggcagu

SEQ ID NO: 3385402 - RNA, 16 nt, Pseudomonas aeruginosa PA01
cgccgccgcggccagc

SEQ ID NO: 3385403 - RNA, 13 nt, Pseudomonas aeruginosa PA01
cgccgccgcgggc

SEQ ID NO: 3385404 - RNA, 15 nt, Pseudomonas aeruginosa PA01
cgccgccgcgggcga

SEQ ID NO: 3385405 - RNA, 13 nt, Pseudomonas aeruginosa PA01
cgccgccgcgucg

SEQ ID NO: 3385406 - RNA, 15 nt, Pseudomonas aeruginosa PA01
cgccgccgcgugggc

SEQ ID NO: 3385407 - RNA, 12 nt, Pseudomonas aeruginosa PA01
cgccgccgcugg

SEQ ID NO: 3385408 - RNA, 13 nt, Pseudomonas aeruginosa PA01
cgccgccggccag

SEQ ID NO: 3385409 - RNA, 15 nt, Pseudomonas aeruginosa PA01
cgccgcgcugcgugg

SEQ ID NO: 3385410 - RNA, 15 nt, Pseudomonas aeruginosa PA01
cgccgcgcuuggccu

SEQ ID NO: 3385411 - RNA, 23 nt, Pseudomonas aeruginosa PA01
cgccgcggaaaacgccgcgaagc

SEQ ID NO: 3385412 - RNA, 21 nt, Pseudomonas aeruginosa PA01
cgccgcggaaggcccgcgagc

SEQ ID NO: 3385413 - RNA, 16 nt, Pseudomonas aeruginosa PA01
cgccgcggacggccgg

SEQ ID NO: 3385414 - RNA, 20 nt, Pseudomonas aeruginosa PA01
cgccgcggcaaugcggcgau

SEQ ID NO: 3385415 - RNA, 15 nt, Pseudomonas aeruginosa PA01
cgccgcggcaccggc

SEQ ID NO: 3385416 - RNA, 16 nt, Pseudomonas aeruginosa PA01
cgccgcggcaccggcg

SEQ ID NO: 3385417 - RNA, 20 nt, Pseudomonas aeruginosa PA01
cgccgcggcaccggcgacga

SEQ ID NO: 3385418 - RNA, 18 nt, Pseudomonas aeruginosa PA01
cgccgcggcagaucccau

SEQ ID NO: 3385419 - RNA, 13 nt, Pseudomonas aeruginosa PA01
cgccgcggccagc

SEQ ID NO: 3385420 - RNA, 15 nt, Pseudomonas aeruginosa PA01
cgccgcggccagccc

SEQ ID NO: 3385421 - RNA, 17 nt, Pseudomonas aeruginosa PA01
cgccgcggccagccccc

SEQ ID NO: 3385422 - RNA, 19 nt, Pseudomonas aeruginosa PA01
cgccgcggccagcccccuc

SEQ ID NO: 3385423 - RNA, 22 nt, Pseudomonas aeruginosa PA01
cgccgcggccagcccccucgcc

SEQ ID NO: 3385424 - RNA, 14 nt, Pseudomonas aeruginosa PA01
cgccgcggcccggc

SEQ ID NO: 3385425 - RNA, 17 nt, Pseudomonas aeruginosa PA01
cgccgcggcccggcgcu

SEQ ID NO: 3385426 - RNA, 12 nt, Pseudomonas aeruginosa PA01
cgccgcggccgg

SEQ ID NO: 3385427 - RNA, 17 nt, Pseudomonas aeruginosa PA01
cgccgcggccggcgacc

SEQ ID NO: 3385428 - RNA, 12 nt, Pseudomonas aeruginosa PA01
cgccgcggcgaa

SEQ ID NO: 3385429 - RNA, 14 nt, Pseudomonas aeruginosa PA01
cgccgcggcgaaca

SEQ ID NO: 3385430 - RNA, 13 nt, Pseudomonas aeruginosa PA01
cgccgcggcgaag

SEQ ID NO: 3385431 - RNA, 14 nt, Pseudomonas aeruginosa PA01
cgccgcggcgaagc

SEQ ID NO: 3385432 - RNA, 18 nt, Pseudomonas aeruginosa PA01
cgccgcggcgaagcgcuc

SEQ ID NO: 3385433 - RNA, 20 nt, Pseudomonas aeruginosa PA01
cgccgcggcgaagcgcucga

SEQ ID NO: 3385434 - RNA, 13 nt, Pseudomonas aeruginosa PA01
cgccgcggcgacc

SEQ ID NO: 3385435 - RNA, 17 nt, Pseudomonas aeruginosa PA01
cgccgcggcgaccagcg

SEQ ID NO: 3385436 - RNA, 12 nt, Pseudomonas aeruginosa PA01
cgccgcggcgag

SEQ ID NO: 3385437 - RNA, 22 nt, Pseudomonas aeruginosa PA01
cgccgcggcgagcaucucggcc

SEQ ID NO: 3385438 - RNA, 15 nt, Pseudomonas aeruginosa PA01
cgccgcggcgcggag

SEQ ID NO: 3385439 - RNA, 12 nt, Pseudomonas aeruginosa PA01
cgccgcggcggc

SEQ ID NO: 3385440 - RNA, 23 nt, Pseudomonas aeruginosa PA01
cgccgcggcggcgugcaggccga

SEQ ID NO: 3385441 - RNA, 13 nt, Pseudomonas aeruginosa PA01
cgccgcggcugau

SEQ ID NO: 3385442 - RNA, 17 nt, Pseudomonas aeruginosa PA01
cgccgcggcugaugccg

SEQ ID NO: 3385443 - RNA, 20 nt, Pseudomonas aeruginosa PA01
cgccgcggcugaugccgcgg

SEQ ID NO: 3385444 - RNA, 14 nt, Pseudomonas aeruginosa PA01
cgccgcggcuggcc

SEQ ID NO: 3385445 - RNA, 12 nt, Pseudomonas aeruginosa PA01
cgccgcgggacg

SEQ ID NO: 3385446 - RNA, 14 nt, Pseudomonas aeruginosa PA01
cgccgcgggcaacc

SEQ ID NO: 3385447 - RNA, 20 nt, Pseudomonas aeruginosa PA01
cgccgcgggcaaccgcggcg

SEQ ID NO: 3385448 - RNA, 21 nt, Pseudomonas aeruginosa PA01
cgccgcgggccagccguucgc

SEQ ID NO: 3385449 - RNA, 20 nt, Pseudomonas aeruginosa PA01
cgccgcgggcgaacggcagc

SEQ ID NO: 3385450 - RNA, 13 nt, Pseudomonas aeruginosa PA01
cgccgcgggcgcu

SEQ ID NO: 3385451 - RNA, 19 nt, Pseudomonas aeruginosa PA01
cgccgcgggcguugcgcgc

SEQ ID NO: 3385452 - RNA, 21 nt, Pseudomonas aeruginosa PA01
cgccgcgggcguugcgcgccu

SEQ ID NO: 3385453 - RNA, 19 nt, Pseudomonas aeruginosa PA01
cgccgcgggucaccagcgc

SEQ ID NO: 3385454 - RNA, 20 nt, Pseudomonas aeruginosa PA01
cgccgcgggucaccagcgcc

SEQ ID NO: 3385455 - RNA, 21 nt, Pseudomonas aeruginosa PA01
cgccgcgggucaccagcgccg

SEQ ID NO: 3385456 - RNA, 21 nt, Pseudomonas aeruginosa PA01
cgccgcgggucugcucggcgc

SEQ ID NO: 3385457 - RNA, 23 nt, Pseudomonas aeruginosa PA01
cgccgcgggucugcucggcgccc

SEQ ID NO: 3385458 - RNA, 20 nt, Pseudomonas aeruginosa PA01
cgccgcggguuccucacggc

SEQ ID NO: 3385459 - RNA, 22 nt, Pseudomonas aeruginosa PA01
cgccgcggguuccucacggcgc

SEQ ID NO: 3385460 - RNA, 17 nt, Pseudomonas aeruginosa PA01
cgccgcggugucggcga

SEQ ID NO: 3385461 - RNA, 19 nt, Pseudomonas aeruginosa PA01
cgccgcggugucggcgauu

SEQ ID NO: 3385462 - RNA, 19 nt, Pseudomonas aeruginosa PA01
cgccgcguagcgccaggcc

SEQ ID NO: 3385463 - RNA, 19 nt, Pseudomonas aeruginosa PA01
cgccgcgucgccgccagcg

SEQ ID NO: 3385464 - RNA, 15 nt, Pseudomonas aeruginosa PA01
cgccgcgucgucggc

SEQ ID NO: 3385465 - RNA, 17 nt, Pseudomonas aeruginosa PA01
cgccgcgucgucggcga

SEQ ID NO: 3385466 - RNA, 19 nt, Pseudomonas aeruginosa PA01
cgccgcgucgucggcgacg

SEQ ID NO: 3385467 - RNA, 23 nt, Pseudomonas aeruginosa PA01
cgccgcgucgucggcgacgcuga

SEQ ID NO: 3385468 - RNA, 15 nt, Pseudomonas aeruginosa PA01
cgccgcgugccgccg

SEQ ID NO: 3385469 - RNA, 12 nt, Pseudomonas aeruginosa PA01
cgccgcgugcgc

SEQ ID NO: 3385470 - RNA, 13 nt, Pseudomonas aeruginosa PA01
cgccgcgugcgcg

SEQ ID NO: 3385471 - RNA, 16 nt, Pseudomonas aeruginosa PA01
cgccgcgugcgcgccc

SEQ ID NO: 3385472 - RNA, 17 nt, Pseudomonas aeruginosa PA01
cgccgcgugcgcgcccu

SEQ ID NO: 3385473 - RNA, 15 nt, Pseudomonas aeruginosa PA01
cgccgcuacugcgcg

SEQ ID NO: 3385474 - RNA, 17 nt, Pseudomonas aeruginosa PA01
cgccgcuacugcgcggg

SEQ ID NO: 3385475 - RNA, 18 nt, Pseudomonas aeruginosa PA01
cgccgcuacugcgcgggc

SEQ ID NO: 3385476 - RNA, 18 nt, Pseudomonas aeruginosa PA01
cgccgcuagggcgcccuc

SEQ ID NO: 3385477 - RNA, 21 nt, Pseudomonas aeruginosa PA01
cgccgcuagggcgcccucgcc

SEQ ID NO: 3385478 - RNA, 13 nt, Pseudomonas aeruginosa PA01
cgccgcuaucgcc

SEQ ID NO: 3385479 - RNA, 16 nt, Pseudomonas aeruginosa PA01
cgccgcuaucgccgcc

SEQ ID NO: 3385480 - RNA, 19 nt, Pseudomonas aeruginosa PA01
cgccgcuaucgccgccgca

SEQ ID NO: 3385481 - RNA, 21 nt, Pseudomonas aeruginosa PA01
cgccgcuaucgccgccgcagc

SEQ ID NO: 3385482 - RNA, 16 nt, Pseudomonas aeruginosa PA01
cgccgcuaugggcacc

SEQ ID NO: 3385483 - RNA, 15 nt, Pseudomonas aeruginosa PA01
cgccgcucacccugu

SEQ ID NO: 3385484 - RNA, 12 nt, Pseudomonas aeruginosa PA01
cgccgcucaucc

SEQ ID NO: 3385485 - RNA, 17 nt, Pseudomonas aeruginosa PA01
cgccgcucauccgcugg

SEQ ID NO: 3385486 - RNA, 21 nt, Pseudomonas aeruginosa PA01
cgccgcucaucugcaccacgu

SEQ ID NO: 3385487 - RNA, 17 nt, Pseudomonas aeruginosa PA01
cgccgcuccacacccgg

SEQ ID NO: 3385488 - RNA, 13 nt, Pseudomonas aeruginosa PA01
cgccgcucccggc

SEQ ID NO: 3385489 - RNA, 13 nt, Pseudomonas aeruginosa PA01
cgccgcuccgcgc

SEQ ID NO: 3385490 - RNA, 18 nt, Pseudomonas aeruginosa PA01
cgccgcuccggcugcgcg

SEQ ID NO: 3385491 - RNA, 15 nt, Pseudomonas aeruginosa PA01
cgccgcuccuccucg

SEQ ID NO: 3385492 - RNA, 16 nt, Pseudomonas aeruginosa PA01
cgccgcuccuccucgc

SEQ ID NO: 3385493 - RNA, 20 nt, Pseudomonas aeruginosa PA01
cgccgcuccuccucgcucug

SEQ ID NO: 3385494 - RNA, 14 nt, Pseudomonas aeruginosa PA01
cgccgcuccuggca

SEQ ID NO: 3385495 - RNA, 15 nt, Pseudomonas aeruginosa PA01
cgccgcuccuggcag

SEQ ID NO: 3385496 - RNA, 14 nt, Pseudomonas aeruginosa PA01
cgccgcucgaugcc

SEQ ID NO: 3385497 - RNA, 21 nt, Pseudomonas aeruginosa PA01
cgccgcucgaugcccgccagc

SEQ ID NO: 3385498 - RNA, 22 nt, Pseudomonas aeruginosa PA01
cgccgcucgaugcccgccagca

SEQ ID NO: 3385499 - RNA, 17 nt, Pseudomonas aeruginosa PA01
cgccgcucgcgcacggc

SEQ ID NO: 3385500 - RNA, 19 nt, Pseudomonas aeruginosa PA01
cgccgcucgcgcacggcga

SEQ ID NO: 3385501 - RNA, 15 nt, Pseudomonas aeruginosa PA01
cgccgcucggcgagc

SEQ ID NO: 3385502 - RNA, 21 nt, Pseudomonas aeruginosa PA01
cgccgcucggcgagccgccgg

SEQ ID NO: 3385503 - RNA, 23 nt, Pseudomonas aeruginosa PA01
cgccgcucggcgagccgccgggc

SEQ ID NO: 3385504 - RNA, 15 nt, Pseudomonas aeruginosa PA01
cgccgcucugcccga

SEQ ID NO: 3385505 - RNA, 12 nt, Pseudomonas aeruginosa PA01
cgccgcucugcu

SEQ ID NO: 3385506 - RNA, 16 nt, Pseudomonas aeruginosa PA01
cgccgcucugcuggcc

SEQ ID NO: 3385507 - RNA, 21 nt, Pseudomonas aeruginosa PA01
cgccgcucugcuggccgcccu

SEQ ID NO: 3385508 - RNA, 19 nt, Pseudomonas aeruginosa PA01
cgccgcugaaguccuggcc

SEQ ID NO: 3385509 - RNA, 21 nt, Pseudomonas aeruginosa PA01
cgccgcugaaguccuggccga

SEQ ID NO: 3385510 - RNA, 22 nt, Pseudomonas aeruginosa PA01
cgccgcugaaguccuggccgag

SEQ ID NO: 3385511 - RNA, 23 nt, Pseudomonas aeruginosa PA01
cgccgcugaaguccuggccgagc

SEQ ID NO: 3385512 - RNA, 18 nt, Pseudomonas aeruginosa PA01
cgccggccagagcuucug

SEQ ID NO: 3385513 - RNA, 13 nt, Pseudomonas aeruginosa PA01
cgccggccagcac

SEQ ID NO: 3385514 - RNA, 21 nt, Pseudomonas aeruginosa PA01
cgccggccagcaccuucaccg

SEQ ID NO: 3385515 - RNA, 14 nt, Pseudomonas aeruginosa PA01
cgccggccagccgc

SEQ ID NO: 3385516 - RNA, 11 nt, Pseudomonas aeruginosa PA01
cgccggccagg

SEQ ID NO: 3385517 - RNA, 14 nt, Pseudomonas aeruginosa PA01
cgccggccagguag

SEQ ID NO: 3385518 - RNA, 13 nt, Pseudomonas aeruginosa PA01
cgccggccaggug

SEQ ID NO: 3385519 - RNA, 20 nt, Pseudomonas aeruginosa PA01
cgccggccauugccgccaga

SEQ ID NO: 3385520 - RNA, 13 nt, Pseudomonas aeruginosa PA01
cgccggcccagca

SEQ ID NO: 3385521 - RNA, 19 nt, Pseudomonas aeruginosa PA01
cgccggcccagcaggccgg

SEQ ID NO: 3385522 - RNA, 21 nt, Pseudomonas aeruginosa PA01
cgccggcccagcaggccggcc

SEQ ID NO: 3385523 - RNA, 12 nt, Pseudomonas aeruginosa PA01
cgccggcccgcg

SEQ ID NO: 3385524 - RNA, 13 nt, Pseudomonas aeruginosa PA01
cgccggcccgcgc

SEQ ID NO: 3385525 - RNA, 14 nt, Pseudomonas aeruginosa PA01
cgccggcccgcgcg

SEQ ID NO: 3385526 - RNA, 15 nt, Pseudomonas aeruginosa PA01
cgccggcccgcgcgg

SEQ ID NO: 3385527 - RNA, 16 nt, Pseudomonas aeruginosa PA01
cgccggcccgcgcggc

SEQ ID NO: 3385528 - RNA, 22 nt, Pseudomonas aeruginosa PA01
cgccggcccgcgcggcaacguc

SEQ ID NO: 3385529 - RNA, 18 nt, Pseudomonas aeruginosa PA01
cgccggcccgugcccguc

SEQ ID NO: 3385530 - RNA, 13 nt, Pseudomonas aeruginosa PA01
cgccggccgcugu

SEQ ID NO: 3385531 - RNA, 15 nt, Pseudomonas aeruginosa PA01
cgccggccggcucag

SEQ ID NO: 3385532 - RNA, 14 nt, Pseudomonas aeruginosa PA01
cgccggccgggagc

SEQ ID NO: 3385533 - RNA, 15 nt, Pseudomonas aeruginosa PA01
cgccggccgggagcu

SEQ ID NO: 3385534 - RNA, 14 nt, Pseudomonas aeruginosa PA01
cgccggccgggcua

SEQ ID NO: 3385535 - RNA, 15 nt, Pseudomonas aeruginosa PA01
cgccggccggggcgc

SEQ ID NO: 3385536 - RNA, 16 nt, Pseudomonas aeruginosa PA01
cgccggccuccagcac

SEQ ID NO: 3385537 - RNA, 14 nt, Pseudomonas aeruginosa PA01
cgccggccucgcgc

SEQ ID NO: 3385538 - RNA, 16 nt, Pseudomonas aeruginosa PA01
cgccggccucgcgcaa

SEQ ID NO: 3385539 - RNA, 17 nt, Pseudomonas aeruginosa PA01
cgccggccucgcgcaac

SEQ ID NO: 3385540 - RNA, 16 nt, Pseudomonas aeruginosa PA01
cgccggccucgcugcc

SEQ ID NO: 3385541 - RNA, 24 nt, Pseudomonas aeruginosa PA01
cgccggccucgcugccgccgcaga

SEQ ID NO: 3385542 - RNA, 11 nt, Pseudomonas aeruginosa PA01
cgccggccugc

SEQ ID NO: 3385543 - RNA, 17 nt, Pseudomonas aeruginosa PA01
cgccggccugcgcgcac

SEQ ID NO: 3385544 - RNA, 19 nt, Pseudomonas aeruginosa PA01
cgccggccugcgcgcacca

SEQ ID NO: 3385545 - RNA, 20 nt, Pseudomonas aeruginosa PA01
cgccggccugcgcgcaccag

SEQ ID NO: 3385546 - RNA, 22 nt, Pseudomonas aeruginosa PA01
cgccggccuggaucucggcggc

SEQ ID NO: 3385547 - RNA, 23 nt, Pseudomonas aeruginosa PA01
cgccggccuggaucucggcggcc

SEQ ID NO: 3385548 - RNA, 15 nt, Pseudomonas aeruginosa PA01
cgccggcgaacagcc

SEQ ID NO: 3385549 - RNA, 22 nt, Pseudomonas aeruginosa PA01
cgccggcgaacucguagacgaa

SEQ ID NO: 3385550 - RNA, 14 nt, Pseudomonas aeruginosa PA01
cgccggcgaccgcg

SEQ ID NO: 3385551 - RNA, 15 nt, Pseudomonas aeruginosa PA01
cgccggcgagccgcu

SEQ ID NO: 3385552 - RNA, 16 nt, Pseudomonas aeruginosa PA01
cgccggcgagccgcug

SEQ ID NO: 3385553 - RNA, 20 nt, Pseudomonas aeruginosa PA01
cgccggcgaggaucgcgcug

SEQ ID NO: 3385554 - RNA, 11 nt, Pseudomonas aeruginosa PA01
cgccggcgauc

SEQ ID NO: 3385555 - RNA, 19 nt, Pseudomonas aeruginosa PA01
cgccggcgaucuccgccag

SEQ ID NO: 3385556 - RNA, 21 nt, Pseudomonas aeruginosa PA01
cgccggcgaugcccaggccgc

SEQ ID NO: 3385557 - RNA, 23 nt, Pseudomonas aeruginosa PA01
cgccggcgaugcccaggccgccg

SEQ ID NO: 3385558 - RNA, 13 nt, Pseudomonas aeruginosa PA01
cgccggcgaugcg

SEQ ID NO: 3385559 - RNA, 16 nt, Pseudomonas aeruginosa PA01
cgccggcgaugcgcag

SEQ ID NO: 3385560 - RNA, 21 nt, Pseudomonas aeruginosa PA01
cgccggcgaugcgcaggccgg

SEQ ID NO: 3385561 - RNA, 22 nt, Pseudomonas aeruginosa PA01
cgccggcgaugcgcaggccggg

SEQ ID NO: 3385562 - RNA, 12 nt, Pseudomonas aeruginosa PA01
cgccggcgcccu

SEQ ID NO: 3385563 - RNA, 14 nt, Pseudomonas aeruginosa PA01
cgccggcgcccugg

SEQ ID NO: 3385564 - RNA, 18 nt, Pseudomonas aeruginosa PA01
cgccggcgcccugggcgc

SEQ ID NO: 3385565 - RNA, 13 nt, Pseudomonas aeruginosa PA01
cgccggcgccgcc

SEQ ID NO: 3385566 - RNA, 14 nt, Pseudomonas aeruginosa PA01
cgccggcgccgccg

SEQ ID NO: 3385567 - RNA, 16 nt, Pseudomonas aeruginosa PA01
cgccggcgccgccggg

SEQ ID NO: 3385568 - RNA, 20 nt, Pseudomonas aeruginosa PA01
cgccggcgccgccucgggca

SEQ ID NO: 3385569 - RNA, 22 nt, Pseudomonas aeruginosa PA01
cgccggcgccgccucgggcagc

SEQ ID NO: 3385570 - RNA, 13 nt, Pseudomonas aeruginosa PA01
cgccggcgcgccc

SEQ ID NO: 3385571 - RNA, 15 nt, Pseudomonas aeruginosa PA01
cgccggcgcgcccag

SEQ ID NO: 3385572 - RNA, 16 nt, Pseudomonas aeruginosa PA01
cgccggcgcgcccagg

SEQ ID NO: 3385573 - RNA, 14 nt, Pseudomonas aeruginosa PA01
cgccggcgcgcggc

SEQ ID NO: 3385574 - RNA, 16 nt, Pseudomonas aeruginosa PA01
cgccggcgcgcggcgg

SEQ ID NO: 3385575 - RNA, 13 nt, Pseudomonas aeruginosa PA01
cgccggcgcgcuu

SEQ ID NO: 3385576 - RNA, 23 nt, Pseudomonas aeruginosa PA01
cgccggcgcgggcggccucgaug

SEQ ID NO: 3385577 - RNA, 12 nt, Pseudomonas aeruginosa PA01
cgccggcgcggu

SEQ ID NO: 3385578 - RNA, 17 nt, Pseudomonas aeruginosa PA01
cgccggcgcuccuccuc

SEQ ID NO: 3385579 - RNA, 17 nt, Pseudomonas aeruginosa PA01
cgccggcgcugcgagcg

SEQ ID NO: 3385580 - RNA, 21 nt, Pseudomonas aeruginosa PA01
cgccggcggaucacaggcucu

SEQ ID NO: 3385581 - RNA, 21 nt, Pseudomonas aeruginosa PA01
cgccggcggaucagcccgcug

SEQ ID NO: 3385582 - RNA, 15 nt, Pseudomonas aeruginosa PA01
cgccggcggccaggg

SEQ ID NO: 3385583 - RNA, 13 nt, Pseudomonas aeruginosa PA01
cgccggcggccug

SEQ ID NO: 3385584 - RNA, 22 nt, Pseudomonas aeruginosa PA01
cgccggcggccugccccgccgg

SEQ ID NO: 3385585 - RNA, 14 nt, Pseudomonas aeruginosa PA01
cgccggcggcgaug

SEQ ID NO: 3385586 - RNA, 22 nt, Pseudomonas aeruginosa PA01
cgccggcggcgaugaucggcag

SEQ ID NO: 3385587 - RNA, 15 nt, Pseudomonas aeruginosa PA01
cgccggcggcgcguc

SEQ ID NO: 3385588 - RNA, 21 nt, Pseudomonas aeruginosa PA01
cgccggcggcgcguccaccug

SEQ ID NO: 3385589 - RNA, 22 nt, Pseudomonas aeruginosa PA01
cgccggcggcgcguccaccugg

SEQ ID NO: 3385590 - RNA, 23 nt, Pseudomonas aeruginosa PA01
cgccggcggggaagccuucgccc

SEQ ID NO: 3385591 - RNA, 16 nt, Pseudomonas aeruginosa PA01
cgccggcguccuccuc

SEQ ID NO: 3385592 - RNA, 15 nt, Pseudomonas aeruginosa PA01
cgccggcgugccgac

SEQ ID NO: 3385593 - RNA, 16 nt, Pseudomonas aeruginosa PA01
cgccggcgugccgacc

SEQ ID NO: 3385594 - RNA, 19 nt, Pseudomonas aeruginosa PA01
cgccggcguuauccgccga

SEQ ID NO: 3385595 - RNA, 20 nt, Pseudomonas aeruginosa PA01
cgccggcguucgacgccuug

SEQ ID NO: 3385596 - RNA, 21 nt, Pseudomonas aeruginosa PA01
cgccggcguucgacgccuugc

SEQ ID NO: 3385597 - RNA, 14 nt, Pseudomonas aeruginosa PA01
cgccggcguugcgc

SEQ ID NO: 3385598 - RNA, 14 nt, Pseudomonas aeruginosa PA01
cgccggcucccugc

SEQ ID NO: 3385599 - RNA, 15 nt, Pseudomonas aeruginosa PA01
cgccggcucgcccag

SEQ ID NO: 3385600 - RNA, 16 nt, Pseudomonas aeruginosa PA01
cgccggcucgcccagc

SEQ ID NO: 3385601 - RNA, 22 nt, Pseudomonas aeruginosa PA01
cgccggcucgcccagcaggcgc

SEQ ID NO: 3385602 - RNA, 13 nt, Pseudomonas aeruginosa PA01
cgccggcucgugc

SEQ ID NO: 3385603 - RNA, 15 nt, Pseudomonas aeruginosa PA01
cgccggcucgugcga

SEQ ID NO: 3385604 - RNA, 20 nt, Pseudomonas aeruginosa PA01
cgccggcugacgcuggcgaa

SEQ ID NO: 3385605 - RNA, 20 nt, Pseudomonas aeruginosa PA01
cgccggcugugcagggcagc

SEQ ID NO: 3385606 - RNA, 22 nt, Pseudomonas aeruginosa PA01
cgccggcugugcagggcagcgg

SEQ ID NO: 3385607 - RNA, 21 nt, Pseudomonas aeruginosa PA01
cgccggcuuccaccagacgca

SEQ ID NO: 3385608 - RNA, 22 nt, Pseudomonas aeruginosa PA01
cgccggcuuccaccagacgcag

SEQ ID NO: 3385609 - RNA, 16 nt, Pseudomonas aeruginosa PA01
cgccgggaaacagggc

SEQ ID NO: 3385610 - RNA, 18 nt, Pseudomonas aeruginosa PA01
cgccgggaaacagggcga

SEQ ID NO: 3385611 - RNA, 23 nt, Pseudomonas aeruginosa PA01
cgccgggaaacagggcgacgccg

SEQ ID NO: 3385612 - RNA, 14 nt, Pseudomonas aeruginosa PA01
cgccgggaagcacc

SEQ ID NO: 3385613 - RNA, 15 nt, Pseudomonas aeruginosa PA01
cgccgggaagcaccg

SEQ ID NO: 3385614 - RNA, 21 nt, Pseudomonas aeruginosa PA01
cgccgggaagcaccgacucgc

SEQ ID NO: 3385615 - RNA, 13 nt, Pseudomonas aeruginosa PA01
cgccggucgggca

SEQ ID NO: 3385616 - RNA, 15 nt, Pseudomonas aeruginosa PA01
cgccggucgggcacu

SEQ ID NO: 3385617 - RNA, 19 nt, Pseudomonas aeruginosa PA01
cgccggucgguucggucga

SEQ ID NO: 3385618 - RNA, 16 nt, Pseudomonas aeruginosa PA01
cgccggucucgauggc

SEQ ID NO: 3385619 - RNA, 17 nt, Pseudomonas aeruginosa PA01
cgccggucucgauggca

SEQ ID NO: 3385620 - RNA, 22 nt, Pseudomonas aeruginosa PA01
cgccggucucgauggcagccuu

SEQ ID NO: 3385621 - RNA, 16 nt, Pseudomonas aeruginosa PA01
cgccggucucggcgau

SEQ ID NO: 3385622 - RNA, 17 nt, Pseudomonas aeruginosa PA01
cgccggucucggcgaug

SEQ ID NO: 3385623 - RNA, 16 nt, Pseudomonas aeruginosa PA01
cgccggucuucacgcc

SEQ ID NO: 3385624 - RNA, 14 nt, Pseudomonas aeruginosa PA01
cgccggugaacagg

SEQ ID NO: 3385625 - RNA, 12 nt, Pseudomonas aeruginosa PA01
cgccggugaccc

SEQ ID NO: 3385626 - RNA, 13 nt, Pseudomonas aeruginosa PA01
cgccggugaccca

SEQ ID NO: 3385627 - RNA, 20 nt, Pseudomonas aeruginosa PA01
cgccggugacccacuccggc

SEQ ID NO: 3385628 - RNA, 14 nt, Pseudomonas aeruginosa PA01
cgccggugacgcug

SEQ ID NO: 3385629 - RNA, 16 nt, Pseudomonas aeruginosa PA01
cgccggugacgcugcu

SEQ ID NO: 3385630 - RNA, 23 nt, Pseudomonas aeruginosa PA01
cgccggugacgcugcucaccagg

SEQ ID NO: 3385631 - RNA, 16 nt, Pseudomonas aeruginosa PA01
cgccggugaggaugcg

SEQ ID NO: 3385632 - RNA, 20 nt, Pseudomonas aeruginosa PA01
cgccggugaggcgcagcagc

SEQ ID NO: 3385633 - RNA, 22 nt, Pseudomonas aeruginosa PA01
cgccggugaggcgcagcagcgc

SEQ ID NO: 3385634 - RNA, 15 nt, Pseudomonas aeruginosa PA01
cgccggugaucgagc

SEQ ID NO: 3385635 - RNA, 20 nt, Pseudomonas aeruginosa PA01
cgccggugauguaggacgcc

SEQ ID NO: 3385636 - RNA, 23 nt, Pseudomonas aeruginosa PA01
cgccggugauguaggacgccucg

SEQ ID NO: 3385637 - RNA, 17 nt, Pseudomonas aeruginosa PA01
cgccggugcaccaggcg

SEQ ID NO: 3385638 - RNA, 18 nt, Pseudomonas aeruginosa PA01
cgccggugcaccaggcga

SEQ ID NO: 3385639 - RNA, 21 nt, Pseudomonas aeruginosa PA01
cgccggugcaugaaggcgcug

SEQ ID NO: 3385640 - RNA, 14 nt, Pseudomonas aeruginosa PA01
cgccggugccagga

SEQ ID NO: 3385641 - RNA, 16 nt, Pseudomonas aeruginosa PA01
cgccggugccaggacc

SEQ ID NO: 3385642 - RNA, 22 nt, Pseudomonas aeruginosa PA01
cgccggugccaggaccagcccg

SEQ ID NO: 3385643 - RNA, 13 nt, Pseudomonas aeruginosa PA01
cgccggugcgcga

SEQ ID NO: 3385644 - RNA, 18 nt, Pseudomonas aeruginosa PA01
cgccggugcuggcgagca

SEQ ID NO: 3385645 - RNA, 18 nt, Pseudomonas aeruginosa PA01
cgccgguggccaggacgc

SEQ ID NO: 3385646 - RNA, 20 nt, Pseudomonas aeruginosa PA01
cgccgguggcguacccgccc

SEQ ID NO: 3385647 - RNA, 19 nt, Pseudomonas aeruginosa PA01
cgccgguucaguucagccg

SEQ ID NO: 3385648 - RNA, 20 nt, Pseudomonas aeruginosa PA01
cgccgguucaguucagccgg

SEQ ID NO: 3385649 - RNA, 21 nt, Pseudomonas aeruginosa PA01
cgccgguucaguucagccggu

SEQ ID NO: 3385650 - RNA, 22 nt, Pseudomonas aeruginosa PA01
cgccgguucgcaggccaggcgc

SEQ ID NO: 3385651 - RNA, 15 nt, Pseudomonas aeruginosa PA01
cgccgguugcugcug

SEQ ID NO: 3385652 - RNA, 16 nt, Pseudomonas aeruginosa PA01
cgccgguugcugcugc

SEQ ID NO: 3385653 - RNA, 17 nt, Pseudomonas aeruginosa PA01
cgccgguugcugcugcg

SEQ ID NO: 3385654 - RNA, 15 nt, Pseudomonas aeruginosa PA01
cgccgguugcugcuu

SEQ ID NO: 3385655 - RNA, 23 nt, Pseudomonas aeruginosa PA01
cgccgguugcugcuugcgcgcgg

SEQ ID NO: 3385656 - RNA, 21 nt, Pseudomonas aeruginosa PA01
cgccguaaccaacagcguuca

SEQ ID NO: 3385657 - RNA, 15 nt, Pseudomonas aeruginosa PA01
cgccguacagcaggc

SEQ ID NO: 3385658 - RNA, 17 nt, Pseudomonas aeruginosa PA01
cgccguacagcaggcag

SEQ ID NO: 3385659 - RNA, 20 nt, Pseudomonas aeruginosa PA01
cgccguacagcaggcaggca

SEQ ID NO: 3385660 - RNA, 24 nt, Pseudomonas aeruginosa PA01
cgccguacaggccaccgcgcagcu

SEQ ID NO: 3385661 - RNA, 15 nt, Pseudomonas aeruginosa PA01
cgccguacgcaccgc

SEQ ID NO: 3385662 - RNA, 19 nt, Pseudomonas aeruginosa PA01
cgccguagaacagcacguc

SEQ ID NO: 3385663 - RNA, 23 nt, Pseudomonas aeruginosa PA01
cgccguagaacagcacgucgaua

SEQ ID NO: 3385664 - RNA, 22 nt, Pseudomonas aeruginosa PA01
cgccguagccgucguagcgcag

SEQ ID NO: 3385665 - RNA, 23 nt, Pseudomonas aeruginosa PA01
cgccguagccgucguagcgcagc

SEQ ID NO: 3385666 - RNA, 13 nt, Pseudomonas aeruginosa PA01
cgccguagcgcag

SEQ ID NO: 3385667 - RNA, 15 nt, Pseudomonas aeruginosa PA01
cgccguagcggccuc

SEQ ID NO: 3385668 - RNA, 21 nt, Pseudomonas aeruginosa PA01
cgccguaggccacuucccggc

SEQ ID NO: 3385669 - RNA, 13 nt, Pseudomonas aeruginosa PA01
cgccgucaccagc

SEQ ID NO: 3385670 - RNA, 14 nt, Pseudomonas aeruginosa PA01
cgccgucaccagca

SEQ ID NO: 3385671 - RNA, 20 nt, Pseudomonas aeruginosa PA01
cgccgucaccagcagccccg

SEQ ID NO: 3385672 - RNA, 15 nt, Pseudomonas aeruginosa PA01
cgccgucaccgcguu

SEQ ID NO: 3385673 - RNA, 13 nt, Pseudomonas aeruginosa PA01
cgccgucagacgc

SEQ ID NO: 3385674 - RNA, 14 nt, Pseudomonas aeruginosa PA01
cgccgucaucgagc

SEQ ID NO: 3385675 - RNA, 16 nt, Pseudomonas aeruginosa PA01
cgccgucaucgagcag

SEQ ID NO: 3385676 - RNA, 17 nt, Pseudomonas aeruginosa PA01
cgccgucaucgagcagu

SEQ ID NO: 3385677 - RNA, 20 nt, Pseudomonas aeruginosa PA01
cgccgucaucgagcaguucc

SEQ ID NO: 3385678 - RNA, 17 nt, Pseudomonas aeruginosa PA01
cgccgucaucgcugacc

SEQ ID NO: 3385679 - RNA, 17 nt, Pseudomonas aeruginosa PA01
cgccgucauggcgggcg

SEQ ID NO: 3385680 - RNA, 18 nt, Pseudomonas aeruginosa PA01
cgccgucauggcgggcgu

SEQ ID NO: 3385681 - RNA, 16 nt, Pseudomonas aeruginosa PA01
cgccguccaccaagcg

SEQ ID NO: 3385682 - RNA, 14 nt, Pseudomonas aeruginosa PA01
cgccguccaccagc

SEQ ID NO: 3385683 - RNA, 15 nt, Pseudomonas aeruginosa PA01
cgccguccaccagcc

SEQ ID NO: 3385684 - RNA, 18 nt, Pseudomonas aeruginosa PA01
cgccguccaccagccagc

SEQ ID NO: 3385685 - RNA, 15 nt, Pseudomonas aeruginosa PA01
cgccguccaucaggc

SEQ ID NO: 3385686 - RNA, 15 nt, Pseudomonas aeruginosa PA01
cgccguccuccagca

SEQ ID NO: 3385687 - RNA, 17 nt, Pseudomonas aeruginosa PA01
cgccguccuccagcaag

SEQ ID NO: 3385688 - RNA, 23 nt, Pseudomonas aeruginosa PA01
cgccguccuggagaacguugccc

SEQ ID NO: 3385689 - RNA, 14 nt, Pseudomonas aeruginosa PA01
cgccguccugugga

SEQ ID NO: 3385690 - RNA, 18 nt, Pseudomonas aeruginosa PA01
cgccguccuugucgcagc

SEQ ID NO: 3385691 - RNA, 14 nt, Pseudomonas aeruginosa PA01
cgccgucgacaccg

SEQ ID NO: 3385692 - RNA, 13 nt, Pseudomonas aeruginosa PA01
cgccgucgagcca

SEQ ID NO: 3385693 - RNA, 18 nt, Pseudomonas aeruginosa PA01
cgccgucgagccagccca

SEQ ID NO: 3385694 - RNA, 22 nt, Pseudomonas aeruginosa PA01
cgccgucgagccagcccagcgg

SEQ ID NO: 3385695 - RNA, 14 nt, Pseudomonas aeruginosa PA01
cgccgucgaucagg

SEQ ID NO: 3385696 - RNA, 14 nt, Pseudomonas aeruginosa PA01
cgccgucgcccaug

SEQ ID NO: 3385697 - RNA, 15 nt, Pseudomonas aeruginosa PA01
cgccgucgccgcuga

SEQ ID NO: 3385698 - RNA, 22 nt, Pseudomonas aeruginosa PA01
cgccgucgccgcugaugcgcug

SEQ ID NO: 3385699 - RNA, 14 nt, Pseudomonas aeruginosa PA01
cgccgucgcgaccu

SEQ ID NO: 3385700 - RNA, 17 nt, Pseudomonas aeruginosa PA01
cgccgucgcgcucuucc

SEQ ID NO: 3385701 - RNA, 14 nt, Pseudomonas aeruginosa PA01
cgccgucgcggcca

SEQ ID NO: 3385702 - RNA, 20 nt, Pseudomonas aeruginosa PA01
cgccgucgcggccaucggcg

SEQ ID NO: 3385703 - RNA, 21 nt, Pseudomonas aeruginosa PA01
cgccgucgcggccaucggcga

SEQ ID NO: 3385704 - RNA, 14 nt, Pseudomonas aeruginosa PA01
cgccgucgcuggcg

SEQ ID NO: 3385705 - RNA, 12 nt, Pseudomonas aeruginosa PA01
cgccgucggcgg

SEQ ID NO: 3385706 - RNA, 15 nt, Pseudomonas aeruginosa PA01
cgccgucggcgguca

SEQ ID NO: 3385707 - RNA, 22 nt, Pseudomonas aeruginosa PA01
cgccgucggcggucagcuugcc

SEQ ID NO: 3385708 - RNA, 13 nt, Pseudomonas aeruginosa PA01
cgccgucgggggc

SEQ ID NO: 3385709 - RNA, 14 nt, Pseudomonas aeruginosa PA01
cgccgucuccgccg

SEQ ID NO: 3385710 - RNA, 19 nt, Pseudomonas aeruginosa PA01
cgccgucuccgccgcuauc

SEQ ID NO: 3385711 - RNA, 21 nt, Pseudomonas aeruginosa PA01
cgccgucuccgccgcuaucgc

SEQ ID NO: 3385712 - RNA, 13 nt, Pseudomonas aeruginosa PA01
cgccgucucguag

SEQ ID NO: 3385713 - RNA, 17 nt, Pseudomonas aeruginosa PA01
cgccgucuuauucgacg

SEQ ID NO: 3385714 - RNA, 23 nt, Pseudomonas aeruginosa PA01
cgccgucuuauucgacgcucugc

SEQ ID NO: 3385715 - RNA, 14 nt, Pseudomonas aeruginosa PA01
cgccgucuuccacc

SEQ ID NO: 3385716 - RNA, 18 nt, Pseudomonas aeruginosa PA01
cgccgucuuccucgaagg

SEQ ID NO: 3385717 - RNA, 19 nt, Pseudomonas aeruginosa PA01
cgccgucuugccgcugcgc

SEQ ID NO: 3385718 - RNA, 20 nt, Pseudomonas aeruginosa PA01
cgccucgaagaaaaggcccg

SEQ ID NO: 3385719 - RNA, 22 nt, Pseudomonas aeruginosa PA01
cgccucgaagaaaaggcccggc

SEQ ID NO: 3385720 - RNA, 14 nt, Pseudomonas aeruginosa PA01
cgccucgaaggccg

SEQ ID NO: 3385721 - RNA, 15 nt, Pseudomonas aeruginosa PA01
cgccucgaaggccgg

SEQ ID NO: 3385722 - RNA, 20 nt, Pseudomonas aeruginosa PA01
cgccucgaaggccucgguca

SEQ ID NO: 3385723 - RNA, 15 nt, Pseudomonas aeruginosa PA01
cgccucgaaggucag

SEQ ID NO: 3385724 - RNA, 17 nt, Pseudomonas aeruginosa PA01
cgccucgaaggucagcc

SEQ ID NO: 3385725 - RNA, 13 nt, Pseudomonas aeruginosa PA01
cgccucgaccaga

SEQ ID NO: 3385726 - RNA, 17 nt, Pseudomonas aeruginosa PA01
cgccucgaccagcgccg

SEQ ID NO: 3385727 - RNA, 22 nt, Pseudomonas aeruginosa PA01
cgccucgaccagcgccgcggcg

SEQ ID NO: 3385728 - RNA, 23 nt, Pseudomonas aeruginosa PA01
cgccucgaccagcgccgcggcga

SEQ ID NO: 3385729 - RNA, 18 nt, Pseudomonas aeruginosa PA01
cgccucgaccucggccgc

SEQ ID NO: 3385730 - RNA, 19 nt, Pseudomonas aeruginosa PA01
cgccucgaccucggccgca

SEQ ID NO: 3385731 - RNA, 22 nt, Pseudomonas aeruginosa PA01
cgccucgaccucggccgcaucg

SEQ ID NO: 3385732 - RNA, 15 nt, Pseudomonas aeruginosa PA01
cgccucgaccuggcc

SEQ ID NO: 3385733 - RNA, 14 nt, Pseudomonas aeruginosa PA01
cgccucgaucuucu

SEQ ID NO: 3385734 - RNA, 20 nt, Pseudomonas aeruginosa PA01
cgccucgcaaaggucggcga

SEQ ID NO: 3385735 - RNA, 15 nt, Pseudomonas aeruginosa PA01
cgccucgcagagcgc

SEQ ID NO: 3385736 - RNA, 18 nt, Pseudomonas aeruginosa PA01
cgccucgcagagcgccag

SEQ ID NO: 3385737 - RNA, 22 nt, Pseudomonas aeruginosa PA01
cgccucgcagagcgccagccag

SEQ ID NO: 3385738 - RNA, 23 nt, Pseudomonas aeruginosa PA01
cgccucgcagagcgccagccagc

SEQ ID NO: 3385739 - RNA, 15 nt, Pseudomonas aeruginosa PA01
cgccucgccaaccag

SEQ ID NO: 3385740 - RNA, 22 nt, Pseudomonas aeruginosa PA01
cgccucgccaaccaggaaggcg

SEQ ID NO: 3385741 - RNA, 15 nt, Pseudomonas aeruginosa PA01
cgccucgccccagac

SEQ ID NO: 3385742 - RNA, 14 nt, Pseudomonas aeruginosa PA01
cgccucgccgagca

SEQ ID NO: 3385743 - RNA, 15 nt, Pseudomonas aeruginosa PA01
cgccucgccgagcau

SEQ ID NO: 3385744 - RNA, 15 nt, Pseudomonas aeruginosa PA01
cgccucgccgcccga

SEQ ID NO: 3385745 - RNA, 13 nt, Pseudomonas aeruginosa PA01
cgccucgccggcc

SEQ ID NO: 3385746 - RNA, 15 nt, Pseudomonas aeruginosa PA01
cgccucgccggccag

SEQ ID NO: 3385747 - RNA, 20 nt, Pseudomonas aeruginosa PA01
cgccucgcgcaacgccgacg

SEQ ID NO: 3385748 - RNA, 22 nt, Pseudomonas aeruginosa PA01
cgccucgcgcaacugcucgaac

SEQ ID NO: 3385749 - RNA, 14 nt, Pseudomonas aeruginosa PA01
cgccucgcgccaga

SEQ ID NO: 3385750 - RNA, 15 nt, Pseudomonas aeruginosa PA01
cgccucgcgccagag

SEQ ID NO: 3385751 - RNA, 22 nt, Pseudomonas aeruginosa PA01
cgccucgcgccagagaucgccc

SEQ ID NO: 3385752 - RNA, 14 nt, Pseudomonas aeruginosa PA01
cgccucgcgccgcg

SEQ ID NO: 3385753 - RNA, 16 nt, Pseudomonas aeruginosa PA01
cgccucgcgccgcgcc

SEQ ID NO: 3385754 - RNA, 17 nt, Pseudomonas aeruginosa PA01
cgccucgcgccgcgcca

SEQ ID NO: 3385755 - RNA, 19 nt, Pseudomonas aeruginosa PA01
cgccucgcgccgcgccagc

SEQ ID NO: 3385756 - RNA, 20 nt, Pseudomonas aeruginosa PA01
cgccucgcggaccucgggca

SEQ ID NO: 3385757 - RNA, 22 nt, Pseudomonas aeruginosa PA01
cgccucgcgggucugcgccucg

SEQ ID NO: 3385758 - RNA, 19 nt, Pseudomonas aeruginosa PA01
cgccucgcuagucuuccug

SEQ ID NO: 3385759 - RNA, 20 nt, Pseudomonas aeruginosa PA01
cgccucgcuagucuuccugc

SEQ ID NO: 3385760 - RNA, 22 nt, Pseudomonas aeruginosa PA01
cgccucgcuagucuuccugcac

SEQ ID NO: 3385761 - RNA, 23 nt, Pseudomonas aeruginosa PA01
cgccucgcuagucuuccugcacg

SEQ ID NO: 3385762 - RNA, 19 nt, Pseudomonas aeruginosa PA01
cgccucgcugagcaccggg

SEQ ID NO: 3385763 - RNA, 13 nt, Pseudomonas aeruginosa PA01
cgccucgcugggc

SEQ ID NO: 3385764 - RNA, 22 nt, Pseudomonas aeruginosa PA01
cgccucgcugggcgggcguccg

SEQ ID NO: 3385765 - RNA, 16 nt, Pseudomonas aeruginosa PA01
cgccucggaaucggcg

SEQ ID NO: 3385766 - RNA, 18 nt, Pseudomonas aeruginosa PA01
cgccucggagaacagcag

SEQ ID NO: 3385767 - RNA, 20 nt, Pseudomonas aeruginosa PA01
cgccucggagaacagcagcg

SEQ ID NO: 3385768 - RNA, 23 nt, Pseudomonas aeruginosa PA01
cgccucggagaacagcagcggca

SEQ ID NO: 3385769 - RNA, 21 nt, Pseudomonas aeruginosa PA01
cgccucggccaucgagcgcuc

SEQ ID NO: 3385770 - RNA, 23 nt, Pseudomonas aeruginosa PA01
cgccucggccaucgagcgcucca

SEQ ID NO: 3385771 - RNA, 20 nt, Pseudomonas aeruginosa PA01
cgccucggcccuggcggcga

SEQ ID NO: 3385772 - RNA, 17 nt, Pseudomonas aeruginosa PA01
cgccucggcgcaguagu

SEQ ID NO: 3385773 - RNA, 22 nt, Pseudomonas aeruginosa PA01
cgccucggcgcgauccuccgcc

SEQ ID NO: 3385774 - RNA, 13 nt, Pseudomonas aeruginosa PA01
cgccucggcgcgc

SEQ ID NO: 3385775 - RNA, 19 nt, Pseudomonas aeruginosa PA01
cgccucggcgcgcgccccc

SEQ ID NO: 3385776 - RNA, 14 nt, Pseudomonas aeruginosa PA01
cgccucggcggcgu

SEQ ID NO: 3385777 - RNA, 12 nt, Pseudomonas aeruginosa PA01
cgccucggcggg

SEQ ID NO: 3385778 - RNA, 13 nt, Pseudomonas aeruginosa PA01
cgccucggcggga

SEQ ID NO: 3385779 - RNA, 22 nt, Pseudomonas aeruginosa PA01
cgccucggcgggagagggcggc

SEQ ID NO: 3385780 - RNA, 14 nt, Pseudomonas aeruginosa PA01
cgccucggcguaga

SEQ ID NO: 3385781 - RNA, 14 nt, Pseudomonas aeruginosa PA01
cgccucgggccgga

SEQ ID NO: 3385782 - RNA, 21 nt, Pseudomonas aeruginosa PA01
cgccucgggccggagcaggcc

SEQ ID NO: 3385783 - RNA, 12 nt, Pseudomonas aeruginosa PA01
cgccucgggcga

SEQ ID NO: 3385784 - RNA, 17 nt, Pseudomonas aeruginosa PA01
cgccucgggcgagcgca

SEQ ID NO: 3385785 - RNA, 23 nt, Pseudomonas aeruginosa PA01
cgccucgucgaaacggaacagga

SEQ ID NO: 3385786 - RNA, 21 nt, Pseudomonas aeruginosa PA01
cgccucgucgacgcccuggcg

SEQ ID NO: 3385787 - RNA, 17 nt, Pseudomonas aeruginosa PA01
cgccucgucgacgcuca

SEQ ID NO: 3385788 - RNA, 14 nt, Pseudomonas aeruginosa PA01
cgccucgucgagcg

SEQ ID NO: 3385789 - RNA, 16 nt, Pseudomonas aeruginosa PA01
cgccucgucgagcgca

SEQ ID NO: 3385790 - RNA, 17 nt, Pseudomonas aeruginosa PA01
cgccucgucgagcgcag

SEQ ID NO: 3385791 - RNA, 21 nt, Pseudomonas aeruginosa PA01
cgccucgucgagcgcagcgac

SEQ ID NO: 3385792 - RNA, 13 nt, Pseudomonas aeruginosa PA01
cgccucgucgcca

SEQ ID NO: 3385793 - RNA, 17 nt, Pseudomonas aeruginosa PA01
cgccucgucgccaugcg

SEQ ID NO: 3385794 - RNA, 19 nt, Pseudomonas aeruginosa PA01
cgccucgucgcgccaggcg

SEQ ID NO: 3385795 - RNA, 17 nt, Pseudomonas aeruginosa PA01
cgccucgucggaggcga

SEQ ID NO: 3385796 - RNA, 22 nt, Pseudomonas aeruginosa PA01
cgccucgugcagcaagccgcag

SEQ ID NO: 3385797 - RNA, 23 nt, Pseudomonas aeruginosa PA01
cgccucgugcagcaagccgcagc

SEQ ID NO: 3385798 - RNA, 15 nt, Pseudomonas aeruginosa PA01
cgccucguggaacag

SEQ ID NO: 3385799 - RNA, 22 nt, Pseudomonas aeruginosa PA01
cgccucguggaacagcgcgucg

SEQ ID NO: 3385800 - RNA, 18 nt, Pseudomonas aeruginosa PA01
cgccucguucagcagcau

SEQ ID NO: 3385801 - RNA, 19 nt, Pseudomonas aeruginosa PA01
cgccucuaugaaccggggc

SEQ ID NO: 3385802 - RNA, 18 nt, Pseudomonas aeruginosa PA01
cgccucugcgcugagcag

SEQ ID NO: 3385803 - RNA, 12 nt, Pseudomonas aeruginosa PA01
cgccucuuccug

SEQ ID NO: 3385804 - RNA, 15 nt, Pseudomonas aeruginosa PA01
cgccucuuccuggac

SEQ ID NO: 3385805 - RNA, 23 nt, Pseudomonas aeruginosa PA01
cgccucuucgcaggagucgacga

SEQ ID NO: 3385806 - RNA, 17 nt, Pseudomonas aeruginosa PA01
cgccugagcagcgcuug

SEQ ID NO: 3385807 - RNA, 15 nt, Pseudomonas aeruginosa PA01
cgccugagcuggccc

SEQ ID NO: 3385808 - RNA, 16 nt, Pseudomonas aeruginosa PA01
cgccugcaacgccagc

SEQ ID NO: 3385809 - RNA, 22 nt, Pseudomonas aeruginosa PA01
cgccugcaacgccagcaggcgc

SEQ ID NO: 3385810 - RNA, 22 nt, Pseudomonas aeruginosa PA01
cgccugcaacguccucgcgccg

SEQ ID NO: 3385811 - RNA, 13 nt, Pseudomonas aeruginosa PA01
cgccugcaacucg

SEQ ID NO: 3385812 - RNA, 22 nt, Pseudomonas aeruginosa PA01
cgccugcagcaccaccucgcca

SEQ ID NO: 3385813 - RNA, 12 nt, Pseudomonas aeruginosa PA01
cgccugcagcuc

SEQ ID NO: 3385814 - RNA, 13 nt, Pseudomonas aeruginosa PA01
cgccugcagcucg

SEQ ID NO: 3385815 - RNA, 19 nt, Pseudomonas aeruginosa PA01
cgccugcaggaaggcuucc

SEQ ID NO: 3385816 - RNA, 22 nt, Pseudomonas aeruginosa PA01
cgccugcaggaaggcuuccggc

SEQ ID NO: 3385817 - RNA, 16 nt, Pseudomonas aeruginosa PA01
cgccugcagggcguag

SEQ ID NO: 3385818 - RNA, 19 nt, Pseudomonas aeruginosa PA01
cgccugcaggucgaggcgc

SEQ ID NO: 3385819 - RNA, 22 nt, Pseudomonas aeruginosa PA01
cgccugcaggucgaggcgcucc

SEQ ID NO: 3385820 - RNA, 15 nt, Pseudomonas aeruginosa PA01
cgccuucagcgccag

SEQ ID NO: 3385821 - RNA, 21 nt, Pseudomonas aeruginosa PA01
cgccuucagcgccgccaggcc

SEQ ID NO: 3385822 - RNA, 14 nt, Pseudomonas aeruginosa PA01
cgccuucagcgccu

SEQ ID NO: 3385823 - RNA, 16 nt, Pseudomonas aeruginosa PA01
cgccuucagcgccucc

SEQ ID NO: 3385824 - RNA, 19 nt, Pseudomonas aeruginosa PA01
cgccuucagcgccuccagc

SEQ ID NO: 3385825 - RNA, 23 nt, Pseudomonas aeruginosa PA01
cgccuucagcgccuccagcaccg

SEQ ID NO: 3385826 - RNA, 16 nt, Pseudomonas aeruginosa PA01
cgccuucaucgccacc

SEQ ID NO: 3385827 - RNA, 15 nt, Pseudomonas aeruginosa PA01
cgccuuccaccacca

SEQ ID NO: 3385828 - RNA, 17 nt, Pseudomonas aeruginosa PA01
cgccuuccaccaccagg

SEQ ID NO: 3385829 - RNA, 16 nt, Pseudomonas aeruginosa PA01
cgccuuccagaucguc

SEQ ID NO: 3385830 - RNA, 13 nt, Pseudomonas aeruginosa PA01
cgccuuccagccc

SEQ ID NO: 3385831 - RNA, 15 nt, Pseudomonas aeruginosa PA01
cgccuuccagcccuu

SEQ ID NO: 3385832 - RNA, 16 nt, Pseudomonas aeruginosa PA01
cgccuuccagcuugcg

SEQ ID NO: 3385833 - RNA, 19 nt, Pseudomonas aeruginosa PA01
cgccuuccagcuugcgcca

SEQ ID NO: 3385834 - RNA, 22 nt, Pseudomonas aeruginosa PA01
cgccuuccagcuugcgccagag

SEQ ID NO: 3385835 - RNA, 15 nt, Pseudomonas aeruginosa PA01
cgccuucccggucga

SEQ ID NO: 3385836 - RNA, 20 nt, Pseudomonas aeruginosa PA01
cgccuucccggucgacggcg

SEQ ID NO: 3385837 - RNA, 17 nt, Pseudomonas aeruginosa PA01
cgccuuccggcagguuc

SEQ ID NO: 3385838 - RNA, 18 nt, Pseudomonas aeruginosa PA01
cgccuuccggcagguuca

SEQ ID NO: 3385839 - RNA, 19 nt, Pseudomonas aeruginosa PA01
cgccuuccggguugaaggc

SEQ ID NO: 3385840 - RNA, 17 nt, Pseudomonas aeruginosa PA01
cgccuuccucggccgcc

SEQ ID NO: 3385841 - RNA, 14 nt, Pseudomonas aeruginosa PA01
cgccuuccucggcg

SEQ ID NO: 3385842 - RNA, 17 nt, Pseudomonas aeruginosa PA01
cgccuuccucggcgauc

SEQ ID NO: 3385843 - RNA, 18 nt, Pseudomonas aeruginosa PA01
cgccuuccucggcgauca

SEQ ID NO: 3385844 - RNA, 14 nt, Pseudomonas aeruginosa PA01
cgccuuccugcuuc

SEQ ID NO: 3385845 - RNA, 22 nt, Pseudomonas aeruginosa PA01
cgccuuccuugucgaucaggaa

SEQ ID NO: 3385846 - RNA, 18 nt, Pseudomonas aeruginosa PA01
cgccuucgcgggccaggc

SEQ ID NO: 3385847 - RNA, 12 nt, Pseudomonas aeruginosa PA01
cgccuucggcga

SEQ ID NO: 3385848 - RNA, 13 nt, Pseudomonas aeruginosa PA01
cgccuucggcgac

SEQ ID NO: 3385849 - RNA, 14 nt, Pseudomonas aeruginosa PA01
cgccuucggcgugc

SEQ ID NO: 3385850 - RNA, 20 nt, Pseudomonas aeruginosa PA01
cgccuucggcgugcauggcc

SEQ ID NO: 3385851 - RNA, 13 nt, Pseudomonas aeruginosa PA01
cgccuucgggcga

SEQ ID NO: 3385852 - RNA, 13 nt, Pseudomonas aeruginosa PA01
cgccuucgggcgc

SEQ ID NO: 3385853 - RNA, 14 nt, Pseudomonas aeruginosa PA01
cgccuucgggcgcc

SEQ ID NO: 3385854 - RNA, 15 nt, Pseudomonas aeruginosa PA01
cgccuucgggcgccu

SEQ ID NO: 3385855 - RNA, 18 nt, Pseudomonas aeruginosa PA01
cgccuucguggccgcggg

SEQ ID NO: 3385856 - RNA, 22 nt, Pseudomonas aeruginosa PA01
cgccuucugcaauugcuugcgc

SEQ ID NO: 3385857 - RNA, 17 nt, Pseudomonas aeruginosa PA01
cgccuucuuuucuuccg

SEQ ID NO: 3385858 - RNA, 16 nt, Pseudomonas aeruginosa PA01
cgccuugaaaccggcg

SEQ ID NO: 3385859 - RNA, 14 nt, Pseudomonas aeruginosa PA01
cgccuugaccagcg

SEQ ID NO: 3385860 - RNA, 16 nt, Pseudomonas aeruginosa PA01
cgccuugaccagcggc

SEQ ID NO: 3385861 - RNA, 18 nt, Pseudomonas aeruginosa PA01
cgccuugaccagcggccc

SEQ ID NO: 3385862 - RNA, 21 nt, Pseudomonas aeruginosa PA01
cgccuugaccagcggcccggc

SEQ ID NO: 3385863 - RNA, 22 nt, Pseudomonas aeruginosa PA01
cgccuugaccagcggcccggcg

SEQ ID NO: 3385864 - RNA, 13 nt, Pseudomonas aeruginosa PA01
cgccuugaccucg

SEQ ID NO: 3385865 - RNA, 20 nt, Pseudomonas aeruginosa PA01
cgccuugaccucgacgccga

SEQ ID NO: 3385866 - RNA, 23 nt, Pseudomonas aeruginosa PA01
cgccuugaccucgacgccgagcc

SEQ ID NO: 3385867 - RNA, 14 nt, Pseudomonas aeruginosa PA01
cgccuugaccugcu

SEQ ID NO: 3385868 - RNA, 16 nt, Pseudomonas aeruginosa PA01
cgccuugagcggcgcc

SEQ ID NO: 3385869 - RNA, 21 nt, Pseudomonas aeruginosa PA01
cgccuugagcggcgcccuggc

SEQ ID NO: 3385870 - RNA, 15 nt, Pseudomonas aeruginosa PA01
cgccuugcagcaccg

SEQ ID NO: 3385871 - RNA, 16 nt, Pseudomonas aeruginosa PA01
cgccuugcagcaccgc

SEQ ID NO: 3385872 - RNA, 15 nt, Pseudomonas aeruginosa PA01
cgccuugcagggggc

SEQ ID NO: 3385873 - RNA, 16 nt, Pseudomonas aeruginosa PA01
cgccuugcccggcgcg

SEQ ID NO: 3385874 - RNA, 13 nt, Pseudomonas aeruginosa PA01
cgccuugcccugg

SEQ ID NO: 3385875 - RNA, 14 nt, Pseudomonas aeruginosa PA01
cgccuugcccuggc

SEQ ID NO: 3385876 - RNA, 23 nt, Pseudomonas aeruginosa PA01
cgccuugcccuggccggcacccu

SEQ ID NO: 3385877 - RNA, 17 nt, Pseudomonas aeruginosa PA01
cgccuugcgcagcaacg

SEQ ID NO: 3385878 - RNA, 14 nt, Pseudomonas aeruginosa PA01
cgccuugcggcgcc

SEQ ID NO: 3385879 - RNA, 15 nt, Pseudomonas aeruginosa PA01
cgccuugcggcgccg

SEQ ID NO: 3385880 - RNA, 16 nt, Pseudomonas aeruginosa PA01
cgccuugcggcgccga

SEQ ID NO: 3385881 - RNA, 21 nt, Pseudomonas aeruginosa PA01
cgccuugcggcgccgaggccc

SEQ ID NO: 3385882 - RNA, 13 nt, Pseudomonas aeruginosa PA01
cgccuugcggggc

SEQ ID NO: 3385883 - RNA, 18 nt, Pseudomonas aeruginosa PA01
cgccuugcggggcggcgc

SEQ ID NO: 3385884 - RNA, 22 nt, Pseudomonas aeruginosa PA01
cgccuugcggggcggcgcaucg

SEQ ID NO: 3385885 - RNA, 23 nt, Pseudomonas aeruginosa PA01
cgccuugcggggcggcgcaucgg

SEQ ID NO: 3385886 - RNA, 23 nt, Pseudomonas aeruginosa PA01
cgccuugcgguccagcgagcggg

SEQ ID NO: 3385887 - RNA, 18 nt, Pseudomonas aeruginosa PA01
cgccuugcguaccagcgc

SEQ ID NO: 3385888 - RNA, 16 nt, Pseudomonas aeruginosa PA01
cgccuuggcaucgccg

SEQ ID NO: 3385889 - RNA, 17 nt, Pseudomonas aeruginosa PA01
cgccuuggcaucgccgc

SEQ ID NO: 3385890 - RNA, 19 nt, Pseudomonas aeruginosa PA01
cgccuuggcaucgccgccc

SEQ ID NO: 3385891 - RNA, 23 nt, Pseudomonas aeruginosa PA01
cgccuugguguagccgagcacgc

SEQ ID NO: 3385892 - RNA, 15 nt, Pseudomonas aeruginosa PA01
cgccuuucgcucagg

SEQ ID NO: 3385893 - RNA, 21 nt, Pseudomonas aeruginosa PA01
cgccuuucugcccggcuucgc

SEQ ID NO: 3385894 - RNA, 13 nt, Pseudomonas aeruginosa PA01
cgccuuuucggca

SEQ ID NO: 3385895 - RNA, 21 nt, Pseudomonas aeruginosa PA01
cgccuuuugacuugacccgac

SEQ ID NO: 3385896 - RNA, 18 nt, Pseudomonas aeruginosa PA01
cgccuuuuucauggccug

SEQ ID NO: 3385897 - RNA, 23 nt, Pseudomonas aeruginosa PA01
cgccuuuuucauggccuggcgcu

SEQ ID NO: 3385898 - RNA, 17 nt, Pseudomonas aeruginosa PA01
cgccuuuuuucauccug

SEQ ID NO: 3385899 - RNA, 20 nt, Pseudomonas aeruginosa PA01
cgccuuuuuucauccugcgg

SEQ ID NO: 3385900 - RNA, 22 nt, Pseudomonas aeruginosa PA01
cgccuuuuuucauccugcggaa

SEQ ID NO: 3385901 - RNA, 23 nt, Pseudomonas aeruginosa PA01
cgccuuuuuucauuucguugcgc

SEQ ID NO: 3385902 - RNA, 21 nt, Pseudomonas aeruginosa PA01
cgcgaaaacucccggccuggu

SEQ ID NO: 3385903 - RNA, 21 nt, Pseudomonas aeruginosa PA01
cgcgaaauggcagaacaucgc

SEQ ID NO: 3385904 - RNA, 17 nt, Pseudomonas aeruginosa PA01
cgcgaacacacccugcg

SEQ ID NO: 3385905 - RNA, 19 nt, Pseudomonas aeruginosa PA01
cgcgaacacacccugcgca

SEQ ID NO: 3385906 - RNA, 21 nt, Pseudomonas aeruginosa PA01
cgcgaacacacccugcgcaag

SEQ ID NO: 3385907 - RNA, 22 nt, Pseudomonas aeruginosa PA01
cgcgaacacacccugcgcaagg

SEQ ID NO: 3385908 - RNA, 16 nt, Pseudomonas aeruginosa PA01
cgcgaacaguuccgac

SEQ ID NO: 3385909 - RNA, 19 nt, Pseudomonas aeruginosa PA01
cgcgaacaguuccgacugc

SEQ ID NO: 3385910 - RNA, 20 nt, Pseudomonas aeruginosa PA01
cgcgaacaguuccgacugcg

SEQ ID NO: 3385911 - RNA, 23 nt, Pseudomonas aeruginosa PA01
cgcgaacaguuccgacugcgagc

SEQ ID NO: 3385912 - RNA, 19 nt, Pseudomonas aeruginosa PA01
cgcgaaccacauccuugcc

SEQ ID NO: 3385913 - RNA, 20 nt, Pseudomonas aeruginosa PA01
cgcgaaccacauccuugccg

SEQ ID NO: 3385914 - RNA, 15 nt, Pseudomonas aeruginosa PA01
cgcgaaccagcagca

SEQ ID NO: 3385915 - RNA, 16 nt, Pseudomonas aeruginosa PA01
cgcgaaccagcagcag

SEQ ID NO: 3385916 - RNA, 16 nt, Pseudomonas aeruginosa PA01
cgcgaaccgcugguga

SEQ ID NO: 3385917 - RNA, 18 nt, Pseudomonas aeruginosa PA01
cgcgaaccucgguagccg

SEQ ID NO: 3385918 - RNA, 20 nt, Pseudomonas aeruginosa PA01
cgcgaaccucgguagccggc

SEQ ID NO: 3385919 - RNA, 20 nt, Pseudomonas aeruginosa PA01
cgcgaacgcucccagccgac

SEQ ID NO: 3385920 - RNA, 16 nt, Pseudomonas aeruginosa PA01
cgcgaacgguccugcg

SEQ ID NO: 3385921 - RNA, 17 nt, Pseudomonas aeruginosa PA01
cgcgaacgguccugcgg

SEQ ID NO: 3385922 - RNA, 16 nt, Pseudomonas aeruginosa PA01
cgcgacugucgagcag

SEQ ID NO: 3385923 - RNA, 18 nt, Pseudomonas aeruginosa PA01
cgcgacugucgagcaggg

SEQ ID NO: 3385924 - RNA, 20 nt, Pseudomonas aeruginosa PA01
cgcgacuguucucuacgccg

SEQ ID NO: 3385925 - RNA, 23 nt, Pseudomonas aeruginosa PA01
cgcgacuguucucuacgccguag

SEQ ID NO: 3385926 - RNA, 16 nt, Pseudomonas aeruginosa PA01
cgcgacuuggacagcg

SEQ ID NO: 3385927 - RNA, 19 nt, Pseudomonas aeruginosa PA01
cgcgacuuggacagcgucu

SEQ ID NO: 3385928 - RNA, 18 nt, Pseudomonas aeruginosa PA01
cgcgagaagccagccagg

SEQ ID NO: 3385929 - RNA, 23 nt, Pseudomonas aeruginosa PA01
cgcgagaagccagccaggucgga

SEQ ID NO: 3385930 - RNA, 13 nt, Pseudomonas aeruginosa PA01
cgcgagaagccgc

SEQ ID NO: 3385931 - RNA, 15 nt, Pseudomonas aeruginosa PA01
cgcgagaaggcguag

SEQ ID NO: 3385932 - RNA, 13 nt, Pseudomonas aeruginosa PA01
cgcgagaccccgg

SEQ ID NO: 3385933 - RNA, 17 nt, Pseudomonas aeruginosa PA01
cgcgagaccccggcggc

SEQ ID NO: 3385934 - RNA, 18 nt, Pseudomonas aeruginosa PA01
cgcgagaccccggcggcg

SEQ ID NO: 3385935 - RNA, 19 nt, Pseudomonas aeruginosa PA01
cgcgagaccccggcggcgc

SEQ ID NO: 3385936 - RNA, 20 nt, Pseudomonas aeruginosa PA01
cgcgagaccccggcggcgcg

SEQ ID NO: 3385937 - RNA, 19 nt, Pseudomonas aeruginosa PA01
cgcgagagguucaccgacc

SEQ ID NO: 3385938 - RNA, 17 nt, Pseudomonas aeruginosa PA01
cgcgagaugaagcgccg

SEQ ID NO: 3385939 - RNA, 20 nt, Pseudomonas aeruginosa PA01
cgcgagauggcgucgauccc

SEQ ID NO: 3385940 - RNA, 12 nt, Pseudomonas aeruginosa PA01
cgcgagcaccgc

SEQ ID NO: 3385941 - RNA, 13 nt, Pseudomonas aeruginosa PA01
cgcgagcaccgcg

SEQ ID NO: 3385942 - RNA, 14 nt, Pseudomonas aeruginosa PA01
cgcgagcaccgcgc

SEQ ID NO: 3385943 - RNA, 18 nt, Pseudomonas aeruginosa PA01
cgcgagcagccgacgauc

SEQ ID NO: 3385944 - RNA, 21 nt, Pseudomonas aeruginosa PA01
cgcgagcagccgacgauccgg

SEQ ID NO: 3385945 - RNA, 19 nt, Pseudomonas aeruginosa PA01
cgcgagcagggcgaugccg

SEQ ID NO: 3385946 - RNA, 20 nt, Pseudomonas aeruginosa PA01
cgcgagcagggcgaugccga

SEQ ID NO: 3385947 - RNA, 13 nt, Pseudomonas aeruginosa PA01
cgcgagccguccu

SEQ ID NO: 3385948 - RNA, 15 nt, Pseudomonas aeruginosa PA01
cgcgagccguccugc

SEQ ID NO: 3385949 - RNA, 21 nt, Pseudomonas aeruginosa PA01
cgcgagccguccugcggccgc

SEQ ID NO: 3385950 - RNA, 19 nt, Pseudomonas aeruginosa PA01
cgcgagccuucagcacggc

SEQ ID NO: 3385951 - RNA, 21 nt, Pseudomonas aeruginosa PA01
cgcgagccuucagcacggcgc

SEQ ID NO: 3385952 - RNA, 18 nt, Pseudomonas aeruginosa PA01
cgcgagcgauccgcugca

SEQ ID NO: 3385953 - RNA, 14 nt, Pseudomonas aeruginosa PA01
cgcgagcgccgccu

SEQ ID NO: 3385954 - RNA, 15 nt, Pseudomonas aeruginosa PA01
cgcgagcgcggccgg

SEQ ID NO: 3385955 - RNA, 16 nt, Pseudomonas aeruginosa PA01
cgcgagcgcggccggc

SEQ ID NO: 3385956 - RNA, 17 nt, Pseudomonas aeruginosa PA01
cgcgagcgcggccggcc

SEQ ID NO: 3385957 - RNA, 13 nt, Pseudomonas aeruginosa PA01
cgcgagcggcaga

SEQ ID NO: 3385958 - RNA, 12 nt, Pseudomonas aeruginosa PA01
cgcgagcuggcg

SEQ ID NO: 3385959 - RNA, 17 nt, Pseudomonas aeruginosa PA01
cgcgagcuggcgccguc

SEQ ID NO: 3385960 - RNA, 12 nt, Pseudomonas aeruginosa PA01
cgcgaggagccg

SEQ ID NO: 3385961 - RNA, 17 nt, Pseudomonas aeruginosa PA01
cgcgaggagccguaggg

SEQ ID NO: 3385962 - RNA, 20 nt, Pseudomonas aeruginosa PA01
cgcgaggagccguagggcgc

SEQ ID NO: 3385963 - RNA, 21 nt, Pseudomonas aeruginosa PA01
cgcgaggagccguagggcgca

SEQ ID NO: 3385964 - RNA, 13 nt, Pseudomonas aeruginosa PA01
cgcgaggaucagc

SEQ ID NO: 3385965 - RNA, 15 nt, Pseudomonas aeruginosa PA01
cgcgaggaucagcca

SEQ ID NO: 3385966 - RNA, 12 nt, Pseudomonas aeruginosa PA01
cgcgaggccggc

SEQ ID NO: 3385967 - RNA, 21 nt, Pseudomonas aeruginosa PA01
cgcgaggccggccccaccagc

SEQ ID NO: 3385968 - RNA, 20 nt, Pseudomonas aeruginosa PA01
cgcgaggccguaccagucgc

SEQ ID NO: 3385969 - RNA, 13 nt, Pseudomonas aeruginosa PA01
cgcgaggcgcagg

SEQ ID NO: 3385970 - RNA, 13 nt, Pseudomonas aeruginosa PA01
cgcgaggcgcccg

SEQ ID NO: 3385971 - RNA, 16 nt, Pseudomonas aeruginosa PA01
cgcgaggcgcccgccg

SEQ ID NO: 3385972 - RNA, 19 nt, Pseudomonas aeruginosa PA01
cgcgaggcguucgucgacc

SEQ ID NO: 3385973 - RNA, 19 nt, Pseudomonas aeruginosa PA01
cgcgaggggcggagcagcc

SEQ ID NO: 3385974 - RNA, 21 nt, Pseudomonas aeruginosa PA01
cgcgagggggccucggccagc

SEQ ID NO: 3385975 - RNA, 13 nt, Pseudomonas aeruginosa PA01
cgcgagguccggc

SEQ ID NO: 3385976 - RNA, 18 nt, Pseudomonas aeruginosa PA01
cgcgaggucucgauggug

SEQ ID NO: 3385977 - RNA, 20 nt, Pseudomonas aeruginosa PA01
cgcgagguggaugaacagcg

SEQ ID NO: 3385978 - RNA, 22 nt, Pseudomonas aeruginosa PA01
cgcgagguggaugaacagcgga

SEQ ID NO: 3385979 - RNA, 22 nt, Pseudomonas aeruginosa PA01
cgcgagguuucgcuuuccucgg

SEQ ID NO: 3385980 - RNA, 23 nt, Pseudomonas aeruginosa PA01
cgcgagguuucgcuuuccucggu

SEQ ID NO: 3385981 - RNA, 18 nt, Pseudomonas aeruginosa PA01
cgcgaguccuucggcgca

SEQ ID NO: 3385982 - RNA, 13 nt, Pseudomonas aeruginosa PA01
cgcgagugcagcg

SEQ ID NO: 3385983 - RNA, 15 nt, Pseudomonas aeruginosa PA01
cgcgagugcagcgag

SEQ ID NO: 3385984 - RNA, 15 nt, Pseudomonas aeruginosa PA01
cgcgaguggaugaag

SEQ ID NO: 3385985 - RNA, 14 nt, Pseudomonas aeruginosa PA01
cgcgaguucgccgg

SEQ ID NO: 3385986 - RNA, 17 nt, Pseudomonas aeruginosa PA01
cgcgaguucgccggcca

SEQ ID NO: 3385987 - RNA, 20 nt, Pseudomonas aeruginosa PA01
cgcgaguucgccggccaggu

SEQ ID NO: 3385988 - RNA, 17 nt, Pseudomonas aeruginosa PA01
cgcgauaaaaagccccg

SEQ ID NO: 3385989 - RNA, 20 nt, Pseudomonas aeruginosa PA01
cgcgauaaaaagccccgcuu

SEQ ID NO: 3385990 - RNA, 16 nt, Pseudomonas aeruginosa PA01
cgcgauacccuggccg

SEQ ID NO: 3385991 - RNA, 17 nt, Pseudomonas aeruginosa PA01
cgcgauacccuggccgg

SEQ ID NO: 3385992 - RNA, 19 nt, Pseudomonas aeruginosa PA01
cgcgauacccuggccggcc

SEQ ID NO: 3385993 - RNA, 13 nt, Pseudomonas aeruginosa PA01
cgcgauaccgaca

SEQ ID NO: 3385994 - RNA, 14 nt, Pseudomonas aeruginosa PA01
cgcgauaucacgcc

SEQ ID NO: 3385995 - RNA, 15 nt, Pseudomonas aeruginosa PA01
cgcgauaucacgccc

SEQ ID NO: 3385996 - RNA, 18 nt, Pseudomonas aeruginosa PA01
cgcgauauccgccaggcg

SEQ ID NO: 3385997 - RNA, 16 nt, Pseudomonas aeruginosa PA01
cgcgauaucgcaggcc

SEQ ID NO: 3385998 - RNA, 13 nt, Pseudomonas aeruginosa PA01
cgcgaucaccgcg

SEQ ID NO: 3385999 - RNA, 18 nt, Pseudomonas aeruginosa PA01
cgcgaucagccgcuccag

SEQ ID NO: 3386000 - RNA, 13 nt, Pseudomonas aeruginosa PA01
cgcgauccaccgc

SEQ ID NO: 3386001 - RNA, 14 nt, Pseudomonas aeruginosa PA01
cgcgauccaccgcc

SEQ ID NO: 3386002 - RNA, 20 nt, Pseudomonas aeruginosa PA01
cgcgauccaccgccagggcg

SEQ ID NO: 3386003 - RNA, 15 nt, Pseudomonas aeruginosa PA01
cgcgaucccccgccc

SEQ ID NO: 3386004 - RNA, 16 nt, Pseudomonas aeruginosa PA01
cgcgauccgcgcggca

SEQ ID NO: 3386005 - RNA, 22 nt, Pseudomonas aeruginosa PA01
cgcgauccgcgcggcaaccugu

SEQ ID NO: 3386006 - RNA, 15 nt, Pseudomonas aeruginosa PA01
cgcgauccuccgcca

SEQ ID NO: 3386007 - RNA, 22 nt, Pseudomonas aeruginosa PA01
cgcgauccuggcggcacuccag

SEQ ID NO: 3386008 - RNA, 19 nt, Pseudomonas aeruginosa PA01
cgcgauccuucggaggucg

SEQ ID NO: 3386009 - RNA, 22 nt, Pseudomonas aeruginosa PA01
cgcgaucgaggccuacccgcgc

SEQ ID NO: 3386010 - RNA, 19 nt, Pseudomonas aeruginosa PA01
cgcgaucgcggccagccgc

SEQ ID NO: 3386011 - RNA, 15 nt, Pseudomonas aeruginosa PA01
cgcgaucggcguccg

SEQ ID NO: 3386012 - RNA, 23 nt, Pseudomonas aeruginosa PA01
cgcgaucggcguccgcggccugc

SEQ ID NO: 3386013 - RNA, 17 nt, Pseudomonas aeruginosa PA01
cgcgaucuaccugcgug

SEQ ID NO: 3386014 - RNA, 20 nt, Pseudomonas aeruginosa PA01
cgcgaucuaccugcgugcgc

SEQ ID NO: 3386015 - RNA, 22 nt, Pseudomonas aeruginosa PA01
cgcgaucucuacuaccgccagc

SEQ ID NO: 3386016 - RNA, 16 nt, Pseudomonas aeruginosa PA01
cgcgaugaugccgccg

SEQ ID NO: 3386017 - RNA, 17 nt, Pseudomonas aeruginosa PA01
cgcgaugaugccgccgu

SEQ ID NO: 3386018 - RNA, 18 nt, Pseudomonas aeruginosa PA01
cgcgaugaugccgccguu

SEQ ID NO: 3386019 - RNA, 21 nt, Pseudomonas aeruginosa PA01
cgcgaugccgaugccgccgac

SEQ ID NO: 3386020 - RNA, 18 nt, Pseudomonas aeruginosa PA01
cgcgaugcguuccagggc

SEQ ID NO: 3386021 - RNA, 19 nt, Pseudomonas aeruginosa PA01
cgcgaugcguuccagggcg

SEQ ID NO: 3386022 - RNA, 12 nt, Pseudomonas aeruginosa PA01
cgcgauggccgg

SEQ ID NO: 3386023 - RNA, 14 nt, Pseudomonas aeruginosa PA01
cgcgauggccggcg

SEQ ID NO: 3386024 - RNA, 18 nt, Pseudomonas aeruginosa PA01
cgcgauggcucgcggcgc

SEQ ID NO: 3386025 - RNA, 16 nt, Pseudomonas aeruginosa PA01
cgcgcaggcgcuggcg

SEQ ID NO: 3386026 - RNA, 22 nt, Pseudomonas aeruginosa PA01
cgcgcaggcgcuggcgggcgcu

SEQ ID NO: 3386027 - RNA, 19 nt, Pseudomonas aeruginosa PA01
cgcgcaggcgggcggcguc

SEQ ID NO: 3386028 - RNA, 21 nt, Pseudomonas aeruginosa PA01
cgcgcaggcggucggaaagca

SEQ ID NO: 3386029 - RNA, 17 nt, Pseudomonas aeruginosa PA01
cgcgcagggcagcgcga

SEQ ID NO: 3386030 - RNA, 14 nt, Pseudomonas aeruginosa PA01
cgcgcagggcaucg

SEQ ID NO: 3386031 - RNA, 14 nt, Pseudomonas aeruginosa PA01
cgcgcagggccagg

SEQ ID NO: 3386032 - RNA, 15 nt, Pseudomonas aeruginosa PA01
cgcgcagggccgcgg

SEQ ID NO: 3386033 - RNA, 16 nt, Pseudomonas aeruginosa PA01
cgcgcagggccgcggc

SEQ ID NO: 3386034 - RNA, 17 nt, Pseudomonas aeruginosa PA01
cgcgcagggccgcggcg

SEQ ID NO: 3386035 - RNA, 18 nt, Pseudomonas aeruginosa PA01
cgcgcagggccgcggcgu

SEQ ID NO: 3386036 - RNA, 19 nt, Pseudomonas aeruginosa PA01
cgcgcagggucaggcccuu

SEQ ID NO: 3386037 - RNA, 19 nt, Pseudomonas aeruginosa PA01
cgcgcagggucgaggcaau

SEQ ID NO: 3386038 - RNA, 20 nt, Pseudomonas aeruginosa PA01
cgcgcaggugcuuggcaccg

SEQ ID NO: 3386039 - RNA, 22 nt, Pseudomonas aeruginosa PA01
cgcgcaggugcuuggcaccgcg

SEQ ID NO: 3386040 - RNA, 18 nt, Pseudomonas aeruginosa PA01
cgcgcagguucaucgccg

SEQ ID NO: 3386041 - RNA, 22 nt, Pseudomonas aeruginosa PA01
cgcgcagguucaucgccgccag

SEQ ID NO: 3386042 - RNA, 20 nt, Pseudomonas aeruginosa PA01
cgcgcaguacgaucagccag

SEQ ID NO: 3386043 - RNA, 24 nt, Pseudomonas aeruginosa PA01
cgcgcaguacgaucagccagggca

SEQ ID NO: 3386044 - RNA, 19 nt, Pseudomonas aeruginosa PA01
cgcgcaguagcuggaucug

SEQ ID NO: 3386045 - RNA, 14 nt, Pseudomonas aeruginosa PA01
cgcgcagucccgcg

SEQ ID NO: 3386046 - RNA, 15 nt, Pseudomonas aeruginosa PA01
cgcgcagucccgcgc

SEQ ID NO: 3386047 - RNA, 18 nt, Pseudomonas aeruginosa PA01
cgcgcagucccgcgcggc

SEQ ID NO: 3386048 - RNA, 19 nt, Pseudomonas aeruginosa PA01
cgcgcagucccgcgcggcc

SEQ ID NO: 3386049 - RNA, 15 nt, Pseudomonas aeruginosa PA01
cgcgcaguucagggc

SEQ ID NO: 3386050 - RNA, 18 nt, Pseudomonas aeruginosa PA01
cgcgcaguuccuucaccg

SEQ ID NO: 3386051 - RNA, 20 nt, Pseudomonas aeruginosa PA01
cgcgcaguucgucuuccagc

SEQ ID NO: 3386052 - RNA, 22 nt, Pseudomonas aeruginosa PA01
cgcgcaguucgucuuccagcgg

SEQ ID NO: 3386053 - RNA, 23 nt, Pseudomonas aeruginosa PA01
cgcgcaguucgucuuccagcggc

SEQ ID NO: 3386054 - RNA, 22 nt, Pseudomonas aeruginosa PA01
cgcgcauagcaggccuggagcg

SEQ ID NO: 3386055 - RNA, 15 nt, Pseudomonas aeruginosa PA01
cgcgcauaggaggcg

SEQ ID NO: 3386056 - RNA, 19 nt, Pseudomonas aeruginosa PA01
cgcgcaucgaugccuugcg

SEQ ID NO: 3386057 - RNA, 22 nt, Pseudomonas aeruginosa PA01
cgcgcaucgaugccuugcggcc

SEQ ID NO: 3386058 - RNA, 14 nt, Pseudomonas aeruginosa PA01
cgcgcaucgcggac

SEQ ID NO: 3386059 - RNA, 17 nt, Pseudomonas aeruginosa PA01
cgcgcaucgcggacacc

SEQ ID NO: 3386060 - RNA, 19 nt, Pseudomonas aeruginosa PA01
cgcgcaucggugccggcag

SEQ ID NO: 3386061 - RNA, 20 nt, Pseudomonas aeruginosa PA01
cgcgcaucggugccggcagg

SEQ ID NO: 3386062 - RNA, 19 nt, Pseudomonas aeruginosa PA01
cgcgcaucgugcagccaga

SEQ ID NO: 3386063 - RNA, 18 nt, Pseudomonas aeruginosa PA01
cgcgcaucuggcugcgcg

SEQ ID NO: 3386064 - RNA, 15 nt, Pseudomonas aeruginosa PA01
cgcgcaucuggugcg

SEQ ID NO: 3386065 - RNA, 19 nt, Pseudomonas aeruginosa PA01
cgcgcaucuggugcgcguc

SEQ ID NO: 3386066 - RNA, 23 nt, Pseudomonas aeruginosa PA01
cgcgcaugaaaaagcccggcaau

SEQ ID NO: 3386067 - RNA, 19 nt, Pseudomonas aeruginosa PA01
cgcgcaugaccuucagcac

SEQ ID NO: 3386068 - RNA, 23 nt, Pseudomonas aeruginosa PA01
cgcgcaugaccuucagcaccugc

SEQ ID NO: 3386069 - RNA, 17 nt, Pseudomonas aeruginosa PA01
cgcgcaugaucgccucg

SEQ ID NO: 3386070 - RNA, 22 nt, Pseudomonas aeruginosa PA01
cgcgcaugaucgccucggcgcg

SEQ ID NO: 3386071 - RNA, 19 nt, Pseudomonas aeruginosa PA01
cgcgcauggagacggcccg

SEQ ID NO: 3386072 - RNA, 23 nt, Pseudomonas aeruginosa PA01
cgcgcauggagacggcccgcccc

SEQ ID NO: 3386073 - RNA, 13 nt, Pseudomonas aeruginosa PA01
cgcgcauggcggc

SEQ ID NO: 3386074 - RNA, 17 nt, Pseudomonas aeruginosa PA01
cgcgcauggcggcgacc

SEQ ID NO: 3386075 - RNA, 20 nt, Pseudomonas aeruginosa PA01
cgcgcauggcggcgaccgca

SEQ ID NO: 3386076 - RNA, 15 nt, Pseudomonas aeruginosa PA01
cgcgcaugucgaggu

SEQ ID NO: 3386077 - RNA, 17 nt, Pseudomonas aeruginosa PA01
cgcgccaaggccgccag

SEQ ID NO: 3386078 - RNA, 19 nt, Pseudomonas aeruginosa PA01
cgcgccaaggccgccaggc

SEQ ID NO: 3386079 - RNA, 19 nt, Pseudomonas aeruginosa PA01
cgcgccaagguuccagccc

SEQ ID NO: 3386080 - RNA, 13 nt, Pseudomonas aeruginosa PA01
cgcgccaaugccg

SEQ ID NO: 3386081 - RNA, 21 nt, Pseudomonas aeruginosa PA01
cgcgccaaugccuuccgacgc

SEQ ID NO: 3386082 - RNA, 24 nt, Pseudomonas aeruginosa PA01
cgcgccaaugccuuccgacgccgc

SEQ ID NO: 3386083 - RNA, 13 nt, Pseudomonas aeruginosa PA01
cgcgccaccaccg

SEQ ID NO: 3386084 - RNA, 21 nt, Pseudomonas aeruginosa PA01
cgcgccaccagcguggcgcgc

SEQ ID NO: 3386085 - RNA, 13 nt, Pseudomonas aeruginosa PA01
cgcgccaccuggu

SEQ ID NO: 3386086 - RNA, 15 nt, Pseudomonas aeruginosa PA01
cgcgccacgcgcauc

SEQ ID NO: 3386087 - RNA, 17 nt, Pseudomonas aeruginosa PA01
cgcgccacgcucuccgu

SEQ ID NO: 3386088 - RNA, 19 nt, Pseudomonas aeruginosa PA01
cgcgccacggaaggccacg

SEQ ID NO: 3386089 - RNA, 20 nt, Pseudomonas aeruginosa PA01
cgcgccacggaaggccacgc

SEQ ID NO: 3386090 - RNA, 21 nt, Pseudomonas aeruginosa PA01
cgcgccacggaugcagucccg

SEQ ID NO: 3386091 - RNA, 20 nt, Pseudomonas aeruginosa PA01
cgcgccagagaucgcccagc

SEQ ID NO: 3386092 - RNA, 21 nt, Pseudomonas aeruginosa PA01
cgcgccagagaucgcccagcg

SEQ ID NO: 3386093 - RNA, 23 nt, Pseudomonas aeruginosa PA01
cgcgccagagaucgcccagcggc

SEQ ID NO: 3386094 - RNA, 16 nt, Pseudomonas aeruginosa PA01
cgcgccagcaacgccu

SEQ ID NO: 3386095 - RNA, 21 nt, Pseudomonas aeruginosa PA01
cgcgccagcaacgccuucugc

SEQ ID NO: 3386096 - RNA, 13 nt, Pseudomonas aeruginosa PA01
cgcgccagcaccg

SEQ ID NO: 3386097 - RNA, 20 nt, Pseudomonas aeruginosa PA01
cgcgccagcacggcgcaggg

SEQ ID NO: 3386098 - RNA, 21 nt, Pseudomonas aeruginosa PA01
cgcgccagcacggcgcagggc

SEQ ID NO: 3386099 - RNA, 12 nt, Pseudomonas aeruginosa PA01
cgcgccagcagg

SEQ ID NO: 3386100 - RNA, 15 nt, Pseudomonas aeruginosa PA01
cgcgccagcaggcgc

SEQ ID NO: 3386101 - RNA, 19 nt, Pseudomonas aeruginosa PA01
cgcgccagcaggcgcagca

SEQ ID NO: 3386102 - RNA, 21 nt, Pseudomonas aeruginosa PA01
cgcgccagcaggcgcagcagc

SEQ ID NO: 3386103 - RNA, 19 nt, Pseudomonas aeruginosa PA01
cgcgccagccacucccggc

SEQ ID NO: 3386104 - RNA, 12 nt, Pseudomonas aeruginosa PA01
cgcgccagcccc

SEQ ID NO: 3386105 - RNA, 16 nt, Pseudomonas aeruginosa PA01
cgcgccagccccaggc

SEQ ID NO: 3386106 - RNA, 13 nt, Pseudomonas aeruginosa PA01
cgcgccagcgcca

SEQ ID NO: 3386107 - RNA, 14 nt, Pseudomonas aeruginosa PA01
cgcgccagcgccac

SEQ ID NO: 3386108 - RNA, 19 nt, Pseudomonas aeruginosa PA01
cgcgccagcgccacggcga

SEQ ID NO: 3386109 - RNA, 14 nt, Pseudomonas aeruginosa PA01
cgcgccagcgccgc

SEQ ID NO: 3386110 - RNA, 17 nt, Pseudomonas aeruginosa PA01
cgcgccaggcccacgcc

SEQ ID NO: 3386111 - RNA, 14 nt, Pseudomonas aeruginosa PA01
cgcgccaggccgca

SEQ ID NO: 3386112 - RNA, 23 nt, Pseudomonas aeruginosa PA01
cgcgccaggucgagacgcgggcc

SEQ ID NO: 3386113 - RNA, 20 nt, Pseudomonas aeruginosa PA01
cgcgccaguccacgacgaac

SEQ ID NO: 3386114 - RNA, 24 nt, Pseudomonas aeruginosa PA01
cgcgccagugccugcaccacgcag

SEQ ID NO: 3386115 - RNA, 15 nt, Pseudomonas aeruginosa PA01
cgcgccaucggucgc

SEQ ID NO: 3386116 - RNA, 15 nt, Pseudomonas aeruginosa PA01
cgcgccaugccggcg

SEQ ID NO: 3386117 - RNA, 19 nt, Pseudomonas aeruginosa PA01
cgcgccaugccggcgccga

SEQ ID NO: 3386118 - RNA, 15 nt, Pseudomonas aeruginosa PA01
cgcgccauuccgcgg

SEQ ID NO: 3386119 - RNA, 16 nt, Pseudomonas aeruginosa PA01
cgcgccauuccgcggc

SEQ ID NO: 3386120 - RNA, 22 nt, Pseudomonas aeruginosa PA01
cgcgccauuccgcggcacuccg

SEQ ID NO: 3386121 - RNA, 12 nt, Pseudomonas aeruginosa PA01
cgcgcccacucc

SEQ ID NO: 3386122 - RNA, 17 nt, Pseudomonas aeruginosa PA01
cgcgcccacuccuccgc

SEQ ID NO: 3386123 - RNA, 20 nt, Pseudomonas aeruginosa PA01
cgcgcccacuccuccgccug

SEQ ID NO: 3386124 - RNA, 21 nt, Pseudomonas aeruginosa PA01
cgcgcccacuccuccgccugc

SEQ ID NO: 3386125 - RNA, 12 nt, Pseudomonas aeruginosa PA01
cgcgcccaggca

SEQ ID NO: 3386126 - RNA, 17 nt, Pseudomonas aeruginosa PA01
cgcgcccaggcaggcga

SEQ ID NO: 3386127 - RNA, 15 nt, Pseudomonas aeruginosa PA01
cgcgccucagcggcu

SEQ ID NO: 3386128 - RNA, 16 nt, Pseudomonas aeruginosa PA01
cgcgccucagcggcug

SEQ ID NO: 3386129 - RNA, 12 nt, Pseudomonas aeruginosa PA01
cgcgccuccggc

SEQ ID NO: 3386130 - RNA, 19 nt, Pseudomonas aeruginosa PA01
cgcgccuccggcagcgucg

SEQ ID NO: 3386131 - RNA, 13 nt, Pseudomonas aeruginosa PA01
cgcgccucgcccc

SEQ ID NO: 3386132 - RNA, 12 nt, Pseudomonas aeruginosa PA01
cgcgccucgcgc

SEQ ID NO: 3386133 - RNA, 13 nt, Pseudomonas aeruginosa PA01
cgcgccucgcgca

SEQ ID NO: 3386134 - RNA, 14 nt, Pseudomonas aeruginosa PA01
cgcgccucgcgcaa

SEQ ID NO: 3386135 - RNA, 15 nt, Pseudomonas aeruginosa PA01
cgcgccucgcgcaac

SEQ ID NO: 3386136 - RNA, 19 nt, Pseudomonas aeruginosa PA01
cgcgccucgcgcaacgccg

SEQ ID NO: 3386137 - RNA, 21 nt, Pseudomonas aeruginosa PA01
cgcgccucgcgcaacgccgac

SEQ ID NO: 3386138 - RNA, 19 nt, Pseudomonas aeruginosa PA01
cgcgccucgucgcgccagg

SEQ ID NO: 3386139 - RNA, 20 nt, Pseudomonas aeruginosa PA01
cgcgccucgucgcgccaggc

SEQ ID NO: 3386140 - RNA, 19 nt, Pseudomonas aeruginosa PA01
cgcgccucugagacgcgaa

SEQ ID NO: 3386141 - RNA, 16 nt, Pseudomonas aeruginosa PA01
cgcgccucuucgcagg

SEQ ID NO: 3386142 - RNA, 16 nt, Pseudomonas aeruginosa PA01
cgcgccugagcuggcc

SEQ ID NO: 3386143 - RNA, 21 nt, Pseudomonas aeruginosa PA01
cgcgccugcaacgccagcagg

SEQ ID NO: 3386144 - RNA, 20 nt, Pseudomonas aeruginosa PA01
cgcgccugcaggucgaggcg

SEQ ID NO: 3386145 - RNA, 21 nt, Pseudomonas aeruginosa PA01
cgcgccugcucuucggcggcc

SEQ ID NO: 3386146 - RNA, 15 nt, Pseudomonas aeruginosa PA01
cgcgccuggaucagc

SEQ ID NO: 3386147 - RNA, 20 nt, Pseudomonas aeruginosa PA01
cgcgccuggaucagcgccuc

SEQ ID NO: 3386148 - RNA, 11 nt, Pseudomonas aeruginosa PA01
cgcgccuggcc

SEQ ID NO: 3386149 - RNA, 14 nt, Pseudomonas aeruginosa PA01
cgcgccuggcccug

SEQ ID NO: 3386150 - RNA, 13 nt, Pseudomonas aeruginosa PA01
cgcgccuggccgu

SEQ ID NO: 3386151 - RNA, 14 nt, Pseudomonas aeruginosa PA01
cgcgccuggccguc

SEQ ID NO: 3386152 - RNA, 14 nt, Pseudomonas aeruginosa PA01
cgcgccuggcuggc

SEQ ID NO: 3386153 - RNA, 15 nt, Pseudomonas aeruginosa PA01
cgcgccuggcuggcc

SEQ ID NO: 3386154 - RNA, 16 nt, Pseudomonas aeruginosa PA01
cgcgccuggcuggcca

SEQ ID NO: 3386155 - RNA, 20 nt, Pseudomonas aeruginosa PA01
cgcgccuggcuggccagcag

SEQ ID NO: 3386156 - RNA, 20 nt, Pseudomonas aeruginosa PA01
cgcgccugggccgcgagguc

SEQ ID NO: 3386157 - RNA, 14 nt, Pseudomonas aeruginosa PA01
cgcgccuucagccc

SEQ ID NO: 3386158 - RNA, 16 nt, Pseudomonas aeruginosa PA01
cgcgccuucagcccca

SEQ ID NO: 3386159 - RNA, 15 nt, Pseudomonas aeruginosa PA01
cgcgccuucagcgcc

SEQ ID NO: 3386160 - RNA, 19 nt, Pseudomonas aeruginosa PA01
cgcgccuucagcgccagca

SEQ ID NO: 3386161 - RNA, 20 nt, Pseudomonas aeruginosa PA01
cgcgccuucagcgccagcag

SEQ ID NO: 3386162 - RNA, 21 nt, Pseudomonas aeruginosa PA01
cgcgccuucagcgccagcagg

SEQ ID NO: 3386163 - RNA, 16 nt, Pseudomonas aeruginosa PA01
cgcgccuucagcgccu

SEQ ID NO: 3386164 - RNA, 14 nt, Pseudomonas aeruginosa PA01
cgcgccuuccagcc

SEQ ID NO: 3386165 - RNA, 22 nt, Pseudomonas aeruginosa PA01
cgcgccuuccagcccuucgacg

SEQ ID NO: 3386166 - RNA, 14 nt, Pseudomonas aeruginosa PA01
cgcgccuucugcac

SEQ ID NO: 3386167 - RNA, 17 nt, Pseudomonas aeruginosa PA01
cgcgccuucugcaccuu

SEQ ID NO: 3386168 - RNA, 21 nt, Pseudomonas aeruginosa PA01
cgcgccuucugcaccuuggcc

SEQ ID NO: 3386169 - RNA, 15 nt, Pseudomonas aeruginosa PA01
cgcgccuugaaaccg

SEQ ID NO: 3386170 - RNA, 21 nt, Pseudomonas aeruginosa PA01
cgcgccuugaaaccggcgaac

SEQ ID NO: 3386171 - RNA, 21 nt, Pseudomonas aeruginosa PA01
cgcgccuugcucaggucgucg

SEQ ID NO: 3386172 - RNA, 21 nt, Pseudomonas aeruginosa PA01
cgcgccuuucgcucaggccuc

SEQ ID NO: 3386173 - RNA, 20 nt, Pseudomonas aeruginosa PA01
cgcgcgacacauggucggcc

SEQ ID NO: 3386174 - RNA, 22 nt, Pseudomonas aeruginosa PA01
cgcgcgacacauggucggccag

SEQ ID NO: 3386175 - RNA, 23 nt, Pseudomonas aeruginosa PA01
cgcgcgacacauggucggccagg

SEQ ID NO: 3386176 - RNA, 15 nt, Pseudomonas aeruginosa PA01
cgcgcgaccgcggcg

SEQ ID NO: 3386177 - RNA, 22 nt, Pseudomonas aeruginosa PA01
cgcgcgacgagaaaaagcccgg

SEQ ID NO: 3386178 - RNA, 13 nt, Pseudomonas aeruginosa PA01
cgcgcgaggcgcu

SEQ ID NO: 3386179 - RNA, 19 nt, Pseudomonas aeruginosa PA01
cgcgcgauaaaaagccccg

SEQ ID NO: 3386180 - RNA, 19 nt, Pseudomonas aeruginosa PA01
cgcgcgauaccgacaagca

SEQ ID NO: 3386181 - RNA, 12 nt, Pseudomonas aeruginosa PA01
cgcgcgaucaca

SEQ ID NO: 3386182 - RNA, 15 nt, Pseudomonas aeruginosa PA01
cgcgcgauggccggc

SEQ ID NO: 3386183 - RNA, 16 nt, Pseudomonas aeruginosa PA01
cgcgcgauggccggcg

SEQ ID NO: 3386184 - RNA, 14 nt, Pseudomonas aeruginosa PA01
cgcgcgcaggacca

SEQ ID NO: 3386185 - RNA, 21 nt, Pseudomonas aeruginosa PA01
cgcgcgcaggaccagacgcgg

SEQ ID NO: 3386186 - RNA, 15 nt, Pseudomonas aeruginosa PA01
cgcgcgccagcaacg

SEQ ID NO: 3386187 - RNA, 16 nt, Pseudomonas aeruginosa PA01
cgcgcgccagcaacgc

SEQ ID NO: 3386188 - RNA, 16 nt, Pseudomonas aeruginosa PA01
cgcgcgccauggccug

SEQ ID NO: 3386189 - RNA, 14 nt, Pseudomonas aeruginosa PA01
cgcgcgcccguacc

SEQ ID NO: 3386190 - RNA, 16 nt, Pseudomonas aeruginosa PA01
cgcgcgcccucgcucg

SEQ ID NO: 3386191 - RNA, 19 nt, Pseudomonas aeruginosa PA01
cgcgcgcccuugagcacgu

SEQ ID NO: 3386192 - RNA, 13 nt, Pseudomonas aeruginosa PA01
cgcgcgccgagca

SEQ ID NO: 3386193 - RNA, 12 nt, Pseudomonas aeruginosa PA01
cgcgcgccgcau

SEQ ID NO: 3386194 - RNA, 13 nt, Pseudomonas aeruginosa PA01
cgcgcgccgggcu

SEQ ID NO: 3386195 - RNA, 13 nt, Pseudomonas aeruginosa PA01
cgcgcgccucagc

SEQ ID NO: 3386196 - RNA, 16 nt, Pseudomonas aeruginosa PA01
cgcgcgccucagcggc

SEQ ID NO: 3386197 - RNA, 16 nt, Pseudomonas aeruginosa PA01
cgcgcgccuggcuggc

SEQ ID NO: 3386198 - RNA, 14 nt, Pseudomonas aeruginosa PA01
cgcgcgccuucagc

SEQ ID NO: 3386199 - RNA, 20 nt, Pseudomonas aeruginosa PA01
cgcgcgccuucagccccagc

SEQ ID NO: 3386200 - RNA, 13 nt, Pseudomonas aeruginosa PA01
cgcgcgcgccagg

SEQ ID NO: 3386201 - RNA, 14 nt, Pseudomonas aeruginosa PA01
cgcgcgcgccaggu

SEQ ID NO: 3386202 - RNA, 16 nt, Pseudomonas aeruginosa PA01
cgcgcgcgccugcaac

SEQ ID NO: 3386203 - RNA, 12 nt, Pseudomonas aeruginosa PA01
cgcgcgcggcca

SEQ ID NO: 3386204 - RNA, 18 nt, Pseudomonas aeruginosa PA01
cgcgcgcggucgagcagc

SEQ ID NO: 3386205 - RNA, 14 nt, Pseudomonas aeruginosa PA01
cgcgcgcuccucga

SEQ ID NO: 3386206 - RNA, 14 nt, Pseudomonas aeruginosa PA01
cgcgcgcucucgcc

SEQ ID NO: 3386207 - RNA, 16 nt, Pseudomonas aeruginosa PA01
cgcgcgcucucgccgg

SEQ ID NO: 3386208 - RNA, 22 nt, Pseudomonas aeruginosa PA01
cgcgcgcuggauuucgccgagu

SEQ ID NO: 3386209 - RNA, 14 nt, Pseudomonas aeruginosa PA01
cgcgcgcuggcgca

SEQ ID NO: 3386210 - RNA, 16 nt, Pseudomonas aeruginosa PA01
cgcgcgcuggcgcagc

SEQ ID NO: 3386211 - RNA, 17 nt, Pseudomonas aeruginosa PA01
cgcgcgcuggcgcagcg

SEQ ID NO: 3386212 - RNA, 23 nt, Pseudomonas aeruginosa PA01
cgcgcgcuggucgacguaggcgg

SEQ ID NO: 3386213 - RNA, 22 nt, Pseudomonas aeruginosa PA01
cgcgcgcuggucguaggcgcgg

SEQ ID NO: 3386214 - RNA, 13 nt, Pseudomonas aeruginosa PA01
cgcgcgcugugca

SEQ ID NO: 3386215 - RNA, 23 nt, Pseudomonas aeruginosa PA01
cgcgcgcuuuuccggcgccggca

SEQ ID NO: 3386216 - RNA, 22 nt, Pseudomonas aeruginosa PA01
cgcgcggaccgaaggcaacagc

SEQ ID NO: 3386217 - RNA, 14 nt, Pseudomonas aeruginosa PA01
cgcgcggaccuucg

SEQ ID NO: 3386218 - RNA, 17 nt, Pseudomonas aeruginosa PA01
cgcgcggaccuucgacg

SEQ ID NO: 3386219 - RNA, 15 nt, Pseudomonas aeruginosa PA01
cgcgcggauccccuc

SEQ ID NO: 3386220 - RNA, 13 nt, Pseudomonas aeruginosa PA01
cgcgcggcacagg

SEQ ID NO: 3386221 - RNA, 16 nt, Pseudomonas aeruginosa PA01
cgcgcggccagcgcgg

SEQ ID NO: 3386222 - RNA, 20 nt, Pseudomonas aeruginosa PA01
cgcgcggccagcgcggccgc

SEQ ID NO: 3386223 - RNA, 12 nt, Pseudomonas aeruginosa PA01
cgcgcggccagu

SEQ ID NO: 3386224 - RNA, 13 nt, Pseudomonas aeruginosa PA01
cgcgcggccaguu

SEQ ID NO: 3386225 - RNA, 17 nt, Pseudomonas aeruginosa PA01
cgcgcggccaguucggg

SEQ ID NO: 3386226 - RNA, 14 nt, Pseudomonas aeruginosa PA01
cgcgcggcccuucg

SEQ ID NO: 3386227 - RNA, 16 nt, Pseudomonas aeruginosa PA01
cgcgcggcccuucgac

SEQ ID NO: 3386228 - RNA, 19 nt, Pseudomonas aeruginosa PA01
cgcgcggcccuucgacgac

SEQ ID NO: 3386229 - RNA, 11 nt, Pseudomonas aeruginosa PA01
cgcgcggcgag

SEQ ID NO: 3386230 - RNA, 12 nt, Pseudomonas aeruginosa PA01
cgcgcggcgagc

SEQ ID NO: 3386231 - RNA, 18 nt, Pseudomonas aeruginosa PA01
cgcggagcaggcggagau

SEQ ID NO: 3386232 - RNA, 18 nt, Pseudomonas aeruginosa PA01
cgcggagcguccaccagc

SEQ ID NO: 3386233 - RNA, 19 nt, Pseudomonas aeruginosa PA01
cgcggagcguccaccagcg

SEQ ID NO: 3386234 - RNA, 21 nt, Pseudomonas aeruginosa PA01
cgcggagcguccaccagcgcc

SEQ ID NO: 3386235 - RNA, 22 nt, Pseudomonas aeruginosa PA01
cgcggagcguccaccagcgccc

SEQ ID NO: 3386236 - RNA, 17 nt, Pseudomonas aeruginosa PA01
cgcggauaucgcuggcg

SEQ ID NO: 3386237 - RNA, 19 nt, Pseudomonas aeruginosa PA01
cgcggauaucgcuggcgcc

SEQ ID NO: 3386238 - RNA, 18 nt, Pseudomonas aeruginosa PA01
cgcggaucaacgggcccu

SEQ ID NO: 3386239 - RNA, 20 nt, Pseudomonas aeruginosa PA01
cgcggaucaccuggccgugc

SEQ ID NO: 3386240 - RNA, 16 nt, Pseudomonas aeruginosa PA01
cgcggaucagucagga

SEQ ID NO: 3386241 - RNA, 22 nt, Pseudomonas aeruginosa PA01
cgcggauccccucccgcgccag

SEQ ID NO: 3386242 - RNA, 23 nt, Pseudomonas aeruginosa PA01
cgcggauccccucccgcgccagc

SEQ ID NO: 3386243 - RNA, 19 nt, Pseudomonas aeruginosa PA01
cgcggaucguccgggcggu

SEQ ID NO: 3386244 - RNA, 18 nt, Pseudomonas aeruginosa PA01
cgcggaucugcuccugca

SEQ ID NO: 3386245 - RNA, 19 nt, Pseudomonas aeruginosa PA01
cgcggaucugcuccugcag

SEQ ID NO: 3386246 - RNA, 16 nt, Pseudomonas aeruginosa PA01
cgcggaugaccuucgg

SEQ ID NO: 3386247 - RNA, 16 nt, Pseudomonas aeruginosa PA01
cgcggaugacgggcga

SEQ ID NO: 3386248 - RNA, 14 nt, Pseudomonas aeruginosa PA01
cgcggaugcccugg

SEQ ID NO: 3386249 - RNA, 19 nt, Pseudomonas aeruginosa PA01
cgcggaugcccuggucggc

SEQ ID NO: 3386250 - RNA, 20 nt, Pseudomonas aeruginosa PA01
cgcggaugucgggcucgacg

SEQ ID NO: 3386251 - RNA, 21 nt, Pseudomonas aeruginosa PA01
cgcggaugucgggcucgacga

SEQ ID NO: 3386252 - RNA, 18 nt, Pseudomonas aeruginosa PA01
cgcggauuggccgggccg

SEQ ID NO: 3386253 - RNA, 19 nt, Pseudomonas aeruginosa PA01
cgcggauuggccgggccga

SEQ ID NO: 3386254 - RNA, 16 nt, Pseudomonas aeruginosa PA01
cgcggcaaugcggcga

SEQ ID NO: 3386255 - RNA, 18 nt, Pseudomonas aeruginosa PA01
cgcggcaaugcggcgaug

SEQ ID NO: 3386256 - RNA, 19 nt, Pseudomonas aeruginosa PA01
cgcggcacagcguggccag

SEQ ID NO: 3386257 - RNA, 22 nt, Pseudomonas aeruginosa PA01
cgcggcacagcguggccagcgc

SEQ ID NO: 3386258 - RNA, 21 nt, Pseudomonas aeruginosa PA01
cgcggcacaggcggcuguugc

SEQ ID NO: 3386259 - RNA, 21 nt, Pseudomonas aeruginosa PA01
cgcggcaccgcuuucguaggg

SEQ ID NO: 3386260 - RNA, 14 nt, Pseudomonas aeruginosa PA01
cgcggcacuccggc

SEQ ID NO: 3386261 - RNA, 20 nt, Pseudomonas aeruginosa PA01
cgcggcagaucccaucgccc

SEQ ID NO: 3386262 - RNA, 14 nt, Pseudomonas aeruginosa PA01
cgcggcagcaccag

SEQ ID NO: 3386263 - RNA, 15 nt, Pseudomonas aeruginosa PA01
cgcggcagcaccagg

SEQ ID NO: 3386264 - RNA, 18 nt, Pseudomonas aeruginosa PA01
cgcggcagcaccaggcca

SEQ ID NO: 3386265 - RNA, 13 nt, Pseudomonas aeruginosa PA01
cgcggcagcaggc

SEQ ID NO: 3386266 - RNA, 15 nt, Pseudomonas aeruginosa PA01
cgcggcagcaggcgg

SEQ ID NO: 3386267 - RNA, 16 nt, Pseudomonas aeruginosa PA01
cgcggcagcaggcggg

SEQ ID NO: 3386268 - RNA, 22 nt, Pseudomonas aeruginosa PA01
cgcggcagcgccaucaggcccu

SEQ ID NO: 3386269 - RNA, 19 nt, Pseudomonas aeruginosa PA01
cgcggcaggaaauccgccg

SEQ ID NO: 3386270 - RNA, 13 nt, Pseudomonas aeruginosa PA01
cgcggcaggccgu

SEQ ID NO: 3386271 - RNA, 12 nt, Pseudomonas aeruginosa PA01
cgcggcaggcgg

SEQ ID NO: 3386272 - RNA, 17 nt, Pseudomonas aeruginosa PA01
cgcggcaggcggcggcg

SEQ ID NO: 3386273 - RNA, 12 nt, Pseudomonas aeruginosa PA01
cgcggcaggggc

SEQ ID NO: 3386274 - RNA, 19 nt, Pseudomonas aeruginosa PA01
cgcggcagguagccgccuu

SEQ ID NO: 3386275 - RNA, 22 nt, Pseudomonas aeruginosa PA01
cgcggcagguggcuggccauga

SEQ ID NO: 3386276 - RNA, 14 nt, Pseudomonas aeruginosa PA01
cgcggcagugcucg

SEQ ID NO: 3386277 - RNA, 19 nt, Pseudomonas aeruginosa PA01
cgcggcauagaugccggcc

SEQ ID NO: 3386278 - RNA, 20 nt, Pseudomonas aeruginosa PA01
cgcggcauagaugccggccu

SEQ ID NO: 3386279 - RNA, 18 nt, Pseudomonas aeruginosa PA01
cgcggcauagcgcagccg

SEQ ID NO: 3386280 - RNA, 18 nt, Pseudomonas aeruginosa PA01
cgcggcaucccgcccggu

SEQ ID NO: 3386281 - RNA, 13 nt, Pseudomonas aeruginosa PA01
cgcggcaucggcc

SEQ ID NO: 3386282 - RNA, 15 nt, Pseudomonas aeruginosa PA01
cgcggcaucggccug

SEQ ID NO: 3386283 - RNA, 17 nt, Pseudomonas aeruginosa PA01
cgcggcaucggccuggu

SEQ ID NO: 3386284 - RNA, 17 nt, Pseudomonas aeruginosa PA01
cgcggccacuucguccg

SEQ ID NO: 3386285 - RNA, 22 nt, Pseudomonas aeruginosa PA01
cgcggccacuucguccggccgc

SEQ ID NO: 3386286 - RNA, 14 nt, Pseudomonas aeruginosa PA01
cgcggccagcagca

SEQ ID NO: 3386287 - RNA, 15 nt, Pseudomonas aeruginosa PA01
cgcggccagcagcac

SEQ ID NO: 3386288 - RNA, 19 nt, Pseudomonas aeruginosa PA01
cgcggccagcagcacgccc

SEQ ID NO: 3386289 - RNA, 22 nt, Pseudomonas aeruginosa PA01
cgcggccagcagcacgcccugg

SEQ ID NO: 3386290 - RNA, 16 nt, Pseudomonas aeruginosa PA01
cgcggccagcccccuc

SEQ ID NO: 3386291 - RNA, 20 nt, Pseudomonas aeruginosa PA01
cgcggccagcccccucgccc

SEQ ID NO: 3386292 - RNA, 21 nt, Pseudomonas aeruginosa PA01
cgcggccagcccccucgcccu

SEQ ID NO: 3386293 - RNA, 14 nt, Pseudomonas aeruginosa PA01
cgcggccagccgcu

SEQ ID NO: 3386294 - RNA, 21 nt, Pseudomonas aeruginosa PA01
cgcggccagcgcggccgccgc

SEQ ID NO: 3386295 - RNA, 11 nt, Pseudomonas aeruginosa PA01
cgcggccagcu

SEQ ID NO: 3386296 - RNA, 15 nt, Pseudomonas aeruginosa PA01
cgcggccagcucgcc

SEQ ID NO: 3386297 - RNA, 14 nt, Pseudomonas aeruginosa PA01
cgcggccagcuucu

SEQ ID NO: 3386298 - RNA, 22 nt, Pseudomonas aeruginosa PA01
cgcggccagcuucuccagcagg

SEQ ID NO: 3386299 - RNA, 15 nt, Pseudomonas aeruginosa PA01
cgcggccaucggcga

SEQ ID NO: 3386300 - RNA, 18 nt, Pseudomonas aeruginosa PA01
cgcggccaucggcgaagc

SEQ ID NO: 3386301 - RNA, 17 nt, Pseudomonas aeruginosa PA01
cgcggccccagcacugg

SEQ ID NO: 3386302 - RNA, 22 nt, Pseudomonas aeruginosa PA01
cgcggcccgccgccggggcggg

SEQ ID NO: 3386303 - RNA, 13 nt, Pseudomonas aeruginosa PA01
cgcggcccggcgc

SEQ ID NO: 3386304 - RNA, 14 nt, Pseudomonas aeruginosa PA01
cgcggcccggcgcu

SEQ ID NO: 3386305 - RNA, 21 nt, Pseudomonas aeruginosa PA01
cgcggcccggcgcugcccggg

SEQ ID NO: 3386306 - RNA, 14 nt, Pseudomonas aeruginosa PA01
cgcggcccguccgc

SEQ ID NO: 3386307 - RNA, 18 nt, Pseudomonas aeruginosa PA01
cgcggcccguccgcgcca

SEQ ID NO: 3386308 - RNA, 19 nt, Pseudomonas aeruginosa PA01
cgcggcccguccgcgccac

SEQ ID NO: 3386309 - RNA, 15 nt, Pseudomonas aeruginosa PA01
cgcggcccugcgccg

SEQ ID NO: 3386310 - RNA, 18 nt, Pseudomonas aeruginosa PA01
cgcggcccugcgccgcag

SEQ ID NO: 3386311 - RNA, 19 nt, Pseudomonas aeruginosa PA01
cgcggcccugcgccgcagc

SEQ ID NO: 3386312 - RNA, 20 nt, Pseudomonas aeruginosa PA01
cgcggcccugcgccgcagcg

SEQ ID NO: 3386313 - RNA, 16 nt, Pseudomonas aeruginosa PA01
cgcggcccugcucgcc

SEQ ID NO: 3386314 - RNA, 18 nt, Pseudomonas aeruginosa PA01
cgcggcccugcucgccgg

SEQ ID NO: 3386315 - RNA, 23 nt, Pseudomonas aeruginosa PA01
cgcggcccugcucgccggcgcgg

SEQ ID NO: 3386316 - RNA, 17 nt, Pseudomonas aeruginosa PA01
cgcggccgaggaaggcg

SEQ ID NO: 3386317 - RNA, 20 nt, Pseudomonas aeruginosa PA01
cgcggccgaggaaggcgcug

SEQ ID NO: 3386318 - RNA, 14 nt, Pseudomonas aeruginosa PA01
cgcggccgccgccg

SEQ ID NO: 3386319 - RNA, 16 nt, Pseudomonas aeruginosa PA01
cgcggccggcaggccg

SEQ ID NO: 3386320 - RNA, 22 nt, Pseudomonas aeruginosa PA01
cgcggccggcaggccgauggcc

SEQ ID NO: 3386321 - RNA, 22 nt, Pseudomonas aeruginosa PA01
cgcggccggccacgcgaccagc

SEQ ID NO: 3386322 - RNA, 17 nt, Pseudomonas aeruginosa PA01
cgcggccggcgaccuug

SEQ ID NO: 3386323 - RNA, 14 nt, Pseudomonas aeruginosa PA01
cgcggccggcgccg

SEQ ID NO: 3386324 - RNA, 15 nt, Pseudomonas aeruginosa PA01
cgcggccggcgccgc

SEQ ID NO: 3386325 - RNA, 16 nt, Pseudomonas aeruginosa PA01
cgcggccggcuucagc

SEQ ID NO: 3386326 - RNA, 23 nt, Pseudomonas aeruginosa PA01
cgcggccguuguccagggugauc

SEQ ID NO: 3386327 - RNA, 16 nt, Pseudomonas aeruginosa PA01
cgcggccucgcuggcg

SEQ ID NO: 3386328 - RNA, 20 nt, Pseudomonas aeruginosa PA01
cgcggccucuucgucggcga

SEQ ID NO: 3386329 - RNA, 12 nt, Pseudomonas aeruginosa PA01
cgcggccugcag

SEQ ID NO: 3386330 - RNA, 15 nt, Pseudomonas aeruginosa PA01
cgcggccugcagcga

SEQ ID NO: 3386331 - RNA, 16 nt, Pseudomonas aeruginosa PA01
cgcggccugcagcgac

SEQ ID NO: 3386332 - RNA, 17 nt, Pseudomonas aeruginosa PA01
cgcggccugcagcgacu

SEQ ID NO: 3386333 - RNA, 22 nt, Pseudomonas aeruginosa PA01
cgcggcguugucggccagcagc

SEQ ID NO: 3386334 - RNA, 23 nt, Pseudomonas aeruginosa PA01
cgcggcguugucggccagcagca

SEQ ID NO: 3386335 - RNA, 17 nt, Pseudomonas aeruginosa PA01
cgcggcuacccucuccc

SEQ ID NO: 3386336 - RNA, 18 nt, Pseudomonas aeruginosa PA01
cgcggcuacccucucccc

SEQ ID NO: 3386337 - RNA, 19 nt, Pseudomonas aeruginosa PA01
cgcggcuacccucucccca

SEQ ID NO: 3386338 - RNA, 16 nt, Pseudomonas aeruginosa PA01
cgcggcuaucgaucac

SEQ ID NO: 3386339 - RNA, 22 nt, Pseudomonas aeruginosa PA01
cgcggcuaucgaucacugccug

SEQ ID NO: 3386340 - RNA, 14 nt, Pseudomonas aeruginosa PA01
cgcggcuccagccg

SEQ ID NO: 3386341 - RNA, 18 nt, Pseudomonas aeruginosa PA01
cgcggcuccagccgcugc

SEQ ID NO: 3386342 - RNA, 19 nt, Pseudomonas aeruginosa PA01
cgcggcuccagccgcugca

SEQ ID NO: 3386343 - RNA, 13 nt, Pseudomonas aeruginosa PA01
cgcggcucggcgg

SEQ ID NO: 3386344 - RNA, 14 nt, Pseudomonas aeruginosa PA01
cgcggcucggcggg

SEQ ID NO: 3386345 - RNA, 22 nt, Pseudomonas aeruginosa PA01
cgcggcucggcgggcugccgcg

SEQ ID NO: 3386346 - RNA, 15 nt, Pseudomonas aeruginosa PA01
cgcggcucuggcgca

SEQ ID NO: 3386347 - RNA, 16 nt, Pseudomonas aeruginosa PA01
cgcggcucuggcgcag

SEQ ID NO: 3386348 - RNA, 12 nt, Pseudomonas aeruginosa PA01
cgcggcugaaga

SEQ ID NO: 3386349 - RNA, 15 nt, Pseudomonas aeruginosa PA01
cgcggcugaagaagc

SEQ ID NO: 3386350 - RNA, 13 nt, Pseudomonas aeruginosa PA01
cgcggcugaaggc

SEQ ID NO: 3386351 - RNA, 13 nt, Pseudomonas aeruginosa PA01
cgcggcugacgaa

SEQ ID NO: 3386352 - RNA, 16 nt, Pseudomonas aeruginosa PA01
cgcggcugaucggccg

SEQ ID NO: 3386353 - RNA, 18 nt, Pseudomonas aeruginosa PA01
cgcggcugaucggccgcc

SEQ ID NO: 3386354 - RNA, 19 nt, Pseudomonas aeruginosa PA01
cgcggcugaucggccgcca

SEQ ID NO: 3386355 - RNA, 15 nt, Pseudomonas aeruginosa PA01
cgcggcugaugccgc

SEQ ID NO: 3386356 - RNA, 12 nt, Pseudomonas aeruginosa PA01
cgcggcugcgcg

SEQ ID NO: 3386357 - RNA, 14 nt, Pseudomonas aeruginosa PA01
cgcggcugcgcgcc

SEQ ID NO: 3386358 - RNA, 15 nt, Pseudomonas aeruginosa PA01
cgcggcugcgcgccg

SEQ ID NO: 3386359 - RNA, 17 nt, Pseudomonas aeruginosa PA01
cgcggcugcgcgccggg

SEQ ID NO: 3386360 - RNA, 16 nt, Pseudomonas aeruginosa PA01
cgcggcugcuugccgc

SEQ ID NO: 3386361 - RNA, 18 nt, Pseudomonas aeruginosa PA01
cgcggcuggaagucgccc

SEQ ID NO: 3386362 - RNA, 22 nt, Pseudomonas aeruginosa PA01
cgcggcuggccauccgcccugc

SEQ ID NO: 3386363 - RNA, 13 nt, Pseudomonas aeruginosa PA01
cgcggcuggccgc

SEQ ID NO: 3386364 - RNA, 19 nt, Pseudomonas aeruginosa PA01
cgcggcuggccgccucgcg

SEQ ID NO: 3386365 - RNA, 16 nt, Pseudomonas aeruginosa PA01
cgcggcuggccgccug

SEQ ID NO: 3386366 - RNA, 16 nt, Pseudomonas aeruginosa PA01
cgcggcuggcgcagga

SEQ ID NO: 3386367 - RNA, 22 nt, Pseudomonas aeruginosa PA01
cgcggcuggcgcaggaccgcca

SEQ ID NO: 3386368 - RNA, 12 nt, Pseudomonas aeruginosa PA01
cgcggcuggcug

SEQ ID NO: 3386369 - RNA, 12 nt, Pseudomonas aeruginosa PA01
cgcggcuggugc

SEQ ID NO: 3386370 - RNA, 17 nt, Pseudomonas aeruginosa PA01
cgcggcuguagccacgg

SEQ ID NO: 3386371 - RNA, 20 nt, Pseudomonas aeruginosa PA01
cgcggcuguagccacggcga

SEQ ID NO: 3386372 - RNA, 22 nt, Pseudomonas aeruginosa PA01
cgcggcuguagccacggcgaga

SEQ ID NO: 3386373 - RNA, 21 nt, Pseudomonas aeruginosa PA01
cgcggcuucagagcuggacga

SEQ ID NO: 3386374 - RNA, 12 nt, Pseudomonas aeruginosa PA01
cgcgggaacggc

SEQ ID NO: 3386375 - RNA, 17 nt, Pseudomonas aeruginosa PA01
cgcgggacgccgcagga

SEQ ID NO: 3386376 - RNA, 13 nt, Pseudomonas aeruginosa PA01
cgcgggacgcggc

SEQ ID NO: 3386377 - RNA, 18 nt, Pseudomonas aeruginosa PA01
cgcgggauaaacggcgga

SEQ ID NO: 3386378 - RNA, 19 nt, Pseudomonas aeruginosa PA01
cgcgggauagacggcggau

SEQ ID NO: 3386379 - RNA, 19 nt, Pseudomonas aeruginosa PA01
cgcgggcaaccgcggcggc

SEQ ID NO: 3386380 - RNA, 12 nt, Pseudomonas aeruginosa PA01
cgcgggcagcuc

SEQ ID NO: 3386381 - RNA, 14 nt, Pseudomonas aeruginosa PA01
cgcgggccagccgu

SEQ ID NO: 3386382 - RNA, 12 nt, Pseudomonas aeruginosa PA01
cgcgggccaggc

SEQ ID NO: 3386383 - RNA, 13 nt, Pseudomonas aeruginosa PA01
cgcgggccaggcc

SEQ ID NO: 3386384 - RNA, 17 nt, Pseudomonas aeruginosa PA01
cgcgggccaggcccuug

SEQ ID NO: 3386385 - RNA, 14 nt, Pseudomonas aeruginosa PA01
cgcgggccaggccg

SEQ ID NO: 3386386 - RNA, 17 nt, Pseudomonas aeruginosa PA01
cgcgggccaggccgagc

SEQ ID NO: 3386387 - RNA, 12 nt, Pseudomonas aeruginosa PA01
cgcgggccgacg

SEQ ID NO: 3386388 - RNA, 22 nt, Pseudomonas aeruginosa PA01
cgcgggccgacggcccuccggc

SEQ ID NO: 3386389 - RNA, 19 nt, Pseudomonas aeruginosa PA01
cgcgggccgaggucgcggg

SEQ ID NO: 3386390 - RNA, 15 nt, Pseudomonas aeruginosa PA01
cgcgggccgcggcga

SEQ ID NO: 3386391 - RNA, 16 nt, Pseudomonas aeruginosa PA01
cgcgggccgcggcgac

SEQ ID NO: 3386392 - RNA, 13 nt, Pseudomonas aeruginosa PA01
cgcgggccggcga

SEQ ID NO: 3386393 - RNA, 14 nt, Pseudomonas aeruginosa PA01
cgcgggccggcgau

SEQ ID NO: 3386394 - RNA, 18 nt, Pseudomonas aeruginosa PA01
cgcgggccggcgauggcc

SEQ ID NO: 3386395 - RNA, 17 nt, Pseudomonas aeruginosa PA01
cgcgggccuucaggcug

SEQ ID NO: 3386396 - RNA, 22 nt, Pseudomonas aeruginosa PA01
cgcgggccuucaggcugcgcgc

SEQ ID NO: 3386397 - RNA, 23 nt, Pseudomonas aeruginosa PA01
cgcgggccuucaggcugcgcgca

SEQ ID NO: 3386398 - RNA, 17 nt, Pseudomonas aeruginosa PA01
cgcgggcgacgaagccc

SEQ ID NO: 3386399 - RNA, 21 nt, Pseudomonas aeruginosa PA01
cgcgggcgacgugggccugcu

SEQ ID NO: 3386400 - RNA, 21 nt, Pseudomonas aeruginosa PA01
cgcgggcgauggcccguucca

SEQ ID NO: 3386401 - RNA, 12 nt, Pseudomonas aeruginosa PA01
cgcgggcgccga

SEQ ID NO: 3386402 - RNA, 17 nt, Pseudomonas aeruginosa PA01
cgcgggcgccgaugccg

SEQ ID NO: 3386403 - RNA, 13 nt, Pseudomonas aeruginosa PA01
cgcgggcgccgug

SEQ ID NO: 3386404 - RNA, 23 nt, Pseudomonas aeruginosa PA01
cgcgggcgccguggaucgcccgg

SEQ ID NO: 3386405 - RNA, 15 nt, Pseudomonas aeruginosa PA01
cgcgggcgcgcgcca

SEQ ID NO: 3386406 - RNA, 18 nt, Pseudomonas aeruginosa PA01
cgcgggcgcgcgccaccg

SEQ ID NO: 3386407 - RNA, 19 nt, Pseudomonas aeruginosa PA01
cgcgggcgcgcgccaccgc

SEQ ID NO: 3386408 - RNA, 21 nt, Pseudomonas aeruginosa PA01
cgcgggcgcgcgccaccgccu

SEQ ID NO: 3386409 - RNA, 15 nt, Pseudomonas aeruginosa PA01
cgcgggcggccucga

SEQ ID NO: 3386410 - RNA, 23 nt, Pseudomonas aeruginosa PA01
cgcgggcggccucgauggcggca

SEQ ID NO: 3386411 - RNA, 12 nt, Pseudomonas aeruginosa PA01
cgcgggcggcgg

SEQ ID NO: 3386412 - RNA, 13 nt, Pseudomonas aeruginosa PA01
cgcgggcggcggc

SEQ ID NO: 3386413 - RNA, 14 nt, Pseudomonas aeruginosa PA01
cgcgggcggcggcg

SEQ ID NO: 3386414 - RNA, 17 nt, Pseudomonas aeruginosa PA01
cgcgggcggcggcgcgg

SEQ ID NO: 3386415 - RNA, 18 nt, Pseudomonas aeruginosa PA01
cgcgggcgugcuccagca

SEQ ID NO: 3386416 - RNA, 18 nt, Pseudomonas aeruginosa PA01
cgcgggcguuggccugga

SEQ ID NO: 3386417 - RNA, 17 nt, Pseudomonas aeruginosa PA01
cgcgggcuauucccgcc

SEQ ID NO: 3386418 - RNA, 19 nt, Pseudomonas aeruginosa PA01
cgcgggcuauucccgccgc

SEQ ID NO: 3386419 - RNA, 14 nt, Pseudomonas aeruginosa PA01
cgcgggcugccccu

SEQ ID NO: 3386420 - RNA, 13 nt, Pseudomonas aeruginosa PA01
cgcgggcuggcca

SEQ ID NO: 3386421 - RNA, 16 nt, Pseudomonas aeruginosa PA01
cgcgggcuggccaccg

SEQ ID NO: 3386422 - RNA, 21 nt, Pseudomonas aeruginosa PA01
cgcggggcccggcuccagccg

SEQ ID NO: 3386423 - RNA, 22 nt, Pseudomonas aeruginosa PA01
cgcggggcccggcuccagccgg

SEQ ID NO: 3386424 - RNA, 13 nt, Pseudomonas aeruginosa PA01
cgcggggcgaggu

SEQ ID NO: 3386425 - RNA, 15 nt, Pseudomonas aeruginosa PA01
cgcggggcgaggucg

SEQ ID NO: 3386426 - RNA, 13 nt, Pseudomonas aeruginosa PA01
cgcggggcgcgcu

SEQ ID NO: 3386427 - RNA, 23 nt, Pseudomonas aeruginosa PA01
cgcggggcguuccuucaacagcg

SEQ ID NO: 3386428 - RNA, 22 nt, Pseudomonas aeruginosa PA01
cgcgggggcucggucgagcccc

SEQ ID NO: 3386429 - RNA, 21 nt, Pseudomonas aeruginosa PA01
cgcgggguagggguggccagg

SEQ ID NO: 3386430 - RNA, 23 nt, Pseudomonas aeruginosa PA01
cgcgggguagggguggccaggcg

SEQ ID NO: 3386431 - RNA, 18 nt, Pseudomonas aeruginosa PA01
cgcggggucuggccggcg

SEQ ID NO: 3386432 - RNA, 18 nt, Pseudomonas aeruginosa PA01
cgcggguaccgcaaugac

SEQ ID NO: 3386433 - RNA, 17 nt, Pseudomonas aeruginosa PA01
cgcggguaucgauccag

SEQ ID NO: 3386434 - RNA, 21 nt, Pseudomonas aeruginosa PA01
cgcggguaucgauccagccgg

SEQ ID NO: 3386435 - RNA, 14 nt, Pseudomonas aeruginosa PA01
cgcgggucaccacc

SEQ ID NO: 3386436 - RNA, 19 nt, Pseudomonas aeruginosa PA01
cgcguacucaggccgggcg

SEQ ID NO: 3386437 - RNA, 18 nt, Pseudomonas aeruginosa PA01
cgcguacuugccagggca

SEQ ID NO: 3386438 - RNA, 14 nt, Pseudomonas aeruginosa PA01
cgcguagaccaccu

SEQ ID NO: 3386439 - RNA, 18 nt, Pseudomonas aeruginosa PA01
cgcguagaccaucgccgg

SEQ ID NO: 3386440 - RNA, 22 nt, Pseudomonas aeruginosa PA01
cgcguagaccaucgccggcgag

SEQ ID NO: 3386441 - RNA, 23 nt, Pseudomonas aeruginosa PA01
cgcguagaccaucgccggcgagc

SEQ ID NO: 3386442 - RNA, 20 nt, Pseudomonas aeruginosa PA01
cgcguagaggaugccggccu

SEQ ID NO: 3386443 - RNA, 20 nt, Pseudomonas aeruginosa PA01
cgcguagcugggcgaucacg

SEQ ID NO: 3386444 - RNA, 20 nt, Pseudomonas aeruginosa PA01
cgcguaggcgaacacgucgg

SEQ ID NO: 3386445 - RNA, 22 nt, Pseudomonas aeruginosa PA01
cgcguaggcgaacacgucggcg

SEQ ID NO: 3386446 - RNA, 23 nt, Pseudomonas aeruginosa PA01
cgcguaggcgaacacgucggcgc

SEQ ID NO: 3386447 - RNA, 22 nt, Pseudomonas aeruginosa PA01
cgcguaggcuuggucgggcgcc

SEQ ID NO: 3386448 - RNA, 17 nt, Pseudomonas aeruginosa PA01
cgcguaggggaccaccc

SEQ ID NO: 3386449 - RNA, 18 nt, Pseudomonas aeruginosa PA01
cgcguaggggaccacccc

SEQ ID NO: 3386450 - RNA, 20 nt, Pseudomonas aeruginosa PA01
cgcguagguggcgccgccgg

SEQ ID NO: 3386451 - RNA, 21 nt, Pseudomonas aeruginosa PA01
cgcguagguggcgccgccggc

SEQ ID NO: 3386452 - RNA, 23 nt, Pseudomonas aeruginosa PA01
cgcguagguggcgccgccggcga

SEQ ID NO: 3386453 - RNA, 14 nt, Pseudomonas aeruginosa PA01
cgcgucacucgaca

SEQ ID NO: 3386454 - RNA, 20 nt, Pseudomonas aeruginosa PA01
cgcgucagcgagcuaucgcc

SEQ ID NO: 3386455 - RNA, 19 nt, Pseudomonas aeruginosa PA01
cgcgucaucaggcucaggc

SEQ ID NO: 3386456 - RNA, 21 nt, Pseudomonas aeruginosa PA01
cgcgucaucaggcucaggccg

SEQ ID NO: 3386457 - RNA, 23 nt, Pseudomonas aeruginosa PA01
cgcgucaucaggcucaggccggg

SEQ ID NO: 3386458 - RNA, 22 nt, Pseudomonas aeruginosa PA01
cgcgucaugccgccgucgcggc

SEQ ID NO: 3386459 - RNA, 15 nt, Pseudomonas aeruginosa PA01
cgcguccaccuggcg

SEQ ID NO: 3386460 - RNA, 19 nt, Pseudomonas aeruginosa PA01
cgcguccaccuggcggcug

SEQ ID NO: 3386461 - RNA, 14 nt, Pseudomonas aeruginosa PA01
cgcguccagccggu

SEQ ID NO: 3386462 - RNA, 21 nt, Pseudomonas aeruginosa PA01
cgcguccagcuccaccaggcc

SEQ ID NO: 3386463 - RNA, 15 nt, Pseudomonas aeruginosa PA01
cgcguccagggugcu

SEQ ID NO: 3386464 - RNA, 23 nt, Pseudomonas aeruginosa PA01
cgcguccagggugcugaccuuca

SEQ ID NO: 3386465 - RNA, 14 nt, Pseudomonas aeruginosa PA01
cgcguccauccccg

SEQ ID NO: 3386466 - RNA, 18 nt, Pseudomonas aeruginosa PA01
cgcguccauccccgccuc

SEQ ID NO: 3386467 - RNA, 23 nt, Pseudomonas aeruginosa PA01
cgcguccaugccguacaggucgg

SEQ ID NO: 3386468 - RNA, 17 nt, Pseudomonas aeruginosa PA01
cgcgucccugcacaggg

SEQ ID NO: 3386469 - RNA, 20 nt, Pseudomonas aeruginosa PA01
cgcgucccugcccgcgccuc

SEQ ID NO: 3386470 - RNA, 14 nt, Pseudomonas aeruginosa PA01
cgcgucccugggcg

SEQ ID NO: 3386471 - RNA, 21 nt, Pseudomonas aeruginosa PA01
cgcgucccugggcgcaggggc

SEQ ID NO: 3386472 - RNA, 18 nt, Pseudomonas aeruginosa PA01
cgcguccgaccauuuccc

SEQ ID NO: 3386473 - RNA, 20 nt, Pseudomonas aeruginosa PA01
cgcguccgcaguucgccccg

SEQ ID NO: 3386474 - RNA, 21 nt, Pseudomonas aeruginosa PA01
cgcguccgcaguucgccccgc

SEQ ID NO: 3386475 - RNA, 21 nt, Pseudomonas aeruginosa PA01
cgcguccggagugaugccgau

SEQ ID NO: 3386476 - RNA, 13 nt, Pseudomonas aeruginosa PA01
cgcguccggccag

SEQ ID NO: 3386477 - RNA, 17 nt, Pseudomonas aeruginosa PA01
cgcguccggccagccug

SEQ ID NO: 3386478 - RNA, 18 nt, Pseudomonas aeruginosa PA01
cgcguccggccagccugg

SEQ ID NO: 3386479 - RNA, 15 nt, Pseudomonas aeruginosa PA01
cgcguccuccuggag

SEQ ID NO: 3386480 - RNA, 23 nt, Pseudomonas aeruginosa PA01
cgcguccuccuggaggacgcggg

SEQ ID NO: 3386481 - RNA, 20 nt, Pseudomonas aeruginosa PA01
cgcgucgaagcugucggccc

SEQ ID NO: 3386482 - RNA, 16 nt, Pseudomonas aeruginosa PA01
cgcgucgaccaccgcg

SEQ ID NO: 3386483 - RNA, 17 nt, Pseudomonas aeruginosa PA01
cgcgucgaccaccgcgu

SEQ ID NO: 3386484 - RNA, 22 nt, Pseudomonas aeruginosa PA01
cgcgucgaguaccgcugcggcc

SEQ ID NO: 3386485 - RNA, 21 nt, Pseudomonas aeruginosa PA01
cgcgucgaugcuuucgagcaa

SEQ ID NO: 3386486 - RNA, 21 nt, Pseudomonas aeruginosa PA01
cgcgucgcacccggcccaugg

SEQ ID NO: 3386487 - RNA, 23 nt, Pseudomonas aeruginosa PA01
cgcgucgcacccggcccauggcg

SEQ ID NO: 3386488 - RNA, 19 nt, Pseudomonas aeruginosa PA01
cgcgucgcaggcgaugccg

SEQ ID NO: 3386489 - RNA, 21 nt, Pseudomonas aeruginosa PA01
cgcgucgcaggcgaugccgac

SEQ ID NO: 3386490 - RNA, 13 nt, Pseudomonas aeruginosa PA01
cgcgucgcccagg

SEQ ID NO: 3386491 - RNA, 14 nt, Pseudomonas aeruginosa PA01
cgcgucgcccaggc

SEQ ID NO: 3386492 - RNA, 17 nt, Pseudomonas aeruginosa PA01
cgcgucgcccaggccgc

SEQ ID NO: 3386493 - RNA, 20 nt, Pseudomonas aeruginosa PA01
cgcgucgcccaggccgcugg

SEQ ID NO: 3386494 - RNA, 14 nt, Pseudomonas aeruginosa PA01
cgcgucgccgccag

SEQ ID NO: 3386495 - RNA, 15 nt, Pseudomonas aeruginosa PA01
cgcgucgccgccagc

SEQ ID NO: 3386496 - RNA, 15 nt, Pseudomonas aeruginosa PA01
cgcgucgcgcgcggc

SEQ ID NO: 3386497 - RNA, 17 nt, Pseudomonas aeruginosa PA01
cgcgucgcgcgcggcau

SEQ ID NO: 3386498 - RNA, 17 nt, Pseudomonas aeruginosa PA01
cgcgucgcugccgccgc

SEQ ID NO: 3386499 - RNA, 12 nt, Pseudomonas aeruginosa PA01
cgcgucgcugcg

SEQ ID NO: 3386500 - RNA, 16 nt, Pseudomonas aeruginosa PA01
cgcgucgcugcgcaac

SEQ ID NO: 3386501 - RNA, 13 nt, Pseudomonas aeruginosa PA01
cgcgucggcacgc

SEQ ID NO: 3386502 - RNA, 18 nt, Pseudomonas aeruginosa PA01
cgcgucggcacgccgaag

SEQ ID NO: 3386503 - RNA, 22 nt, Pseudomonas aeruginosa PA01
cgcgucggcggcacccucuucc

SEQ ID NO: 3386504 - RNA, 18 nt, Pseudomonas aeruginosa PA01
cgcgucggcucgguucca

SEQ ID NO: 3386505 - RNA, 21 nt, Pseudomonas aeruginosa PA01
cgcgucgggaaaggccgccac

SEQ ID NO: 3386506 - RNA, 22 nt, Pseudomonas aeruginosa PA01
cgcgucgggaaaggccgccacg

SEQ ID NO: 3386507 - RNA, 16 nt, Pseudomonas aeruginosa PA01
cgcgucggugccgccc

SEQ ID NO: 3386508 - RNA, 20 nt, Pseudomonas aeruginosa PA01
cgcgucggugccgcccggcg

SEQ ID NO: 3386509 - RNA, 16 nt, Pseudomonas aeruginosa PA01
cgcgucguccagggcg

SEQ ID NO: 3386510 - RNA, 14 nt, Pseudomonas aeruginosa PA01
cgcgucguccgagg

SEQ ID NO: 3386511 - RNA, 18 nt, Pseudomonas aeruginosa PA01
cgcgucguccgaggcgga

SEQ ID NO: 3386512 - RNA, 19 nt, Pseudomonas aeruginosa PA01
cgcgucgucggcgacgcug

SEQ ID NO: 3386513 - RNA, 13 nt, Pseudomonas aeruginosa PA01
cgcgucuccagcu

SEQ ID NO: 3386514 - RNA, 21 nt, Pseudomonas aeruginosa PA01
cgcgucuccagcucggcgauc

SEQ ID NO: 3386515 - RNA, 22 nt, Pseudomonas aeruginosa PA01
cgcgugaaaacaagaagccccg

SEQ ID NO: 3386516 - RNA, 15 nt, Pseudomonas aeruginosa PA01
cgcgugaagcuggag

SEQ ID NO: 3386517 - RNA, 16 nt, Pseudomonas aeruginosa PA01
cgcgugaagcuggagc

SEQ ID NO: 3386518 - RNA, 23 nt, Pseudomonas aeruginosa PA01
cgcgugaagcuggagcagcagcg

SEQ ID NO: 3386519 - RNA, 16 nt, Pseudomonas aeruginosa PA01
cgcgugauacagcucg

SEQ ID NO: 3386520 - RNA, 13 nt, Pseudomonas aeruginosa PA01
cgcgugcaggcgc

SEQ ID NO: 3386521 - RNA, 16 nt, Pseudomonas aeruginosa PA01
cgcgugcaggcgcccu

SEQ ID NO: 3386522 - RNA, 21 nt, Pseudomonas aeruginosa PA01
cgcgugccccguggcgggcca

SEQ ID NO: 3386523 - RNA, 22 nt, Pseudomonas aeruginosa PA01
cgcgugcccgagaagccggggc

SEQ ID NO: 3386524 - RNA, 14 nt, Pseudomonas aeruginosa PA01
cgcgugccgccgga

SEQ ID NO: 3386525 - RNA, 15 nt, Pseudomonas aeruginosa PA01
cgcgugccgccggac

SEQ ID NO: 3386526 - RNA, 20 nt, Pseudomonas aeruginosa PA01
cgcgugccgccggaccgucg

SEQ ID NO: 3386527 - RNA, 13 nt, Pseudomonas aeruginosa PA01
cgcgugcgcgccc

SEQ ID NO: 3386528 - RNA, 20 nt, Pseudomonas aeruginosa PA01
cgcgugcgcgcccucgguga

SEQ ID NO: 3386529 - RNA, 16 nt, Pseudomonas aeruginosa PA01
cgcgugcgcgccgccg

SEQ ID NO: 3386530 - RNA, 19 nt, Pseudomonas aeruginosa PA01
cgcgugcgcgccgccgggc

SEQ ID NO: 3386531 - RNA, 22 nt, Pseudomonas aeruginosa PA01
cgcgugcuccgugucggcggcg

SEQ ID NO: 3386532 - RNA, 21 nt, Pseudomonas aeruginosa PA01
cgcguggcccggcgcggcggc

SEQ ID NO: 3386533 - RNA, 13 nt, Pseudomonas aeruginosa PA01
cgcguggccgcca

SEQ ID NO: 3386534 - RNA, 12 nt, Pseudomonas aeruginosa PA01
cgcguggcgucg

SEQ ID NO: 3386535 - RNA, 13 nt, Pseudomonas aeruginosa PA01
cgcguggcgucgg

SEQ ID NO: 3386536 - RNA, 18 nt, Pseudomonas aeruginosa PA01
cgcguggcgucggcgcuu

SEQ ID NO: 3386537 - RNA, 14 nt, Pseudomonas aeruginosa PA01
cgcgugggccacca

SEQ ID NO: 3386538 - RNA, 16 nt, Pseudomonas aeruginosa PA01
cgcgugggccaccauc

SEQ ID NO: 3386539 - RNA, 14 nt, Pseudomonas aeruginosa PA01
cgcgugggccaggg

SEQ ID NO: 3386540 - RNA, 15 nt, Pseudomonas aeruginosa PA01
cgcgugggccggcau

SEQ ID NO: 3386541 - RNA, 15 nt, Pseudomonas aeruginosa PA01
cgcgugggcuucgcc

SEQ ID NO: 3386542 - RNA, 16 nt, Pseudomonas aeruginosa PA01
cgcgugggcuucgccg

SEQ ID NO: 3386543 - RNA, 22 nt, Pseudomonas aeruginosa PA01
cgcgugguaucggcgcucaccg

SEQ ID NO: 3386544 - RNA, 14 nt, Pseudomonas aeruginosa PA01
cgcguguucgcggc

SEQ ID NO: 3386545 - RNA, 16 nt, Pseudomonas aeruginosa PA01
cgcguguucgcggcuc

SEQ ID NO: 3386546 - RNA, 14 nt, Pseudomonas aeruginosa PA01
cgcguucaccccgc

SEQ ID NO: 3386547 - RNA, 22 nt, Pseudomonas aeruginosa PA01
cgcguucaccguggcgcuggcc

SEQ ID NO: 3386548 - RNA, 13 nt, Pseudomonas aeruginosa PA01
cgcguucacucca

SEQ ID NO: 3386549 - RNA, 13 nt, Pseudomonas aeruginosa PA01
cgcguucaguccc

SEQ ID NO: 3386550 - RNA, 15 nt, Pseudomonas aeruginosa PA01
cgcguucaucgucgg

SEQ ID NO: 3386551 - RNA, 13 nt, Pseudomonas aeruginosa PA01
cgcguuccagcac

SEQ ID NO: 3386552 - RNA, 18 nt, Pseudomonas aeruginosa PA01
cgcguuccagcaccucgc

SEQ ID NO: 3386553 - RNA, 13 nt, Pseudomonas aeruginosa PA01
cgcguuccagguc

SEQ ID NO: 3386554 - RNA, 17 nt, Pseudomonas aeruginosa PA01
cgcguuccaggucgcug

SEQ ID NO: 3386555 - RNA, 22 nt, Pseudomonas aeruginosa PA01
cgcguuccaggucgcugcugaa

SEQ ID NO: 3386556 - RNA, 17 nt, Pseudomonas aeruginosa PA01
cgcguucccacucgcga

SEQ ID NO: 3386557 - RNA, 21 nt, Pseudomonas aeruginosa PA01
cgcguucccacucgcgacugc

SEQ ID NO: 3386558 - RNA, 13 nt, Pseudomonas aeruginosa PA01
cgcguucgccgag

SEQ ID NO: 3386559 - RNA, 14 nt, Pseudomonas aeruginosa PA01
cgcguucgccgagg

SEQ ID NO: 3386560 - RNA, 16 nt, Pseudomonas aeruginosa PA01
cgcguucgcggucggu

SEQ ID NO: 3386561 - RNA, 13 nt, Pseudomonas aeruginosa PA01
cgcguucggcgau

SEQ ID NO: 3386562 - RNA, 14 nt, Pseudomonas aeruginosa PA01
cgcguucggcgaug

SEQ ID NO: 3386563 - RNA, 17 nt, Pseudomonas aeruginosa PA01
cgcguucggcgaugccg

SEQ ID NO: 3386564 - RNA, 20 nt, Pseudomonas aeruginosa PA01
cgcguucggcgaugccgcgc

SEQ ID NO: 3386565 - RNA, 22 nt, Pseudomonas aeruginosa PA01
cgcguucggcgaugccgcgcca

SEQ ID NO: 3386566 - RNA, 21 nt, Pseudomonas aeruginosa PA01
cgcguugcagcgccuguucca

SEQ ID NO: 3386567 - RNA, 21 nt, Pseudomonas aeruginosa PA01
cgcguugcauguccucggcgc

SEQ ID NO: 3386568 - RNA, 15 nt, Pseudomonas aeruginosa PA01
cgcguugcccagccc

SEQ ID NO: 3386569 - RNA, 17 nt, Pseudomonas aeruginosa PA01
cgcguugcccagcccca

SEQ ID NO: 3386570 - RNA, 23 nt, Pseudomonas aeruginosa PA01
cgcguugcuuguguccgccgagg

SEQ ID NO: 3386571 - RNA, 17 nt, Pseudomonas aeruginosa PA01
cgcguuggcgugcucgc

SEQ ID NO: 3386572 - RNA, 13 nt, Pseudomonas aeruginosa PA01
cgcguuggcuggc

SEQ ID NO: 3386573 - RNA, 16 nt, Pseudomonas aeruginosa PA01
cgcguuggcuggcggg

SEQ ID NO: 3386574 - RNA, 21 nt, Pseudomonas aeruginosa PA01
cgcguuguagaaacgguccag

SEQ ID NO: 3386575 - RNA, 23 nt, Pseudomonas aeruginosa PA01
cgcguuguagaaacgguccaggg

SEQ ID NO: 3386576 - RNA, 16 nt, Pseudomonas aeruginosa PA01
cgcguuucucagcgcc

SEQ ID NO: 3386577 - RNA, 22 nt, Pseudomonas aeruginosa PA01
cgcuaagcgucacucccaggcu

SEQ ID NO: 3386578 - RNA, 17 nt, Pseudomonas aeruginosa PA01
cgcuacccucaggggug

SEQ ID NO: 3386579 - RNA, 14 nt, Pseudomonas aeruginosa PA01
cgcuacccugcccc

SEQ ID NO: 3386580 - RNA, 17 nt, Pseudomonas aeruginosa PA01
cgcuacccugccccagc

SEQ ID NO: 3386581 - RNA, 22 nt, Pseudomonas aeruginosa PA01
cgcuaccgcgcauggcggcgac

SEQ ID NO: 3386582 - RNA, 13 nt, Pseudomonas aeruginosa PA01
cgcuacgaaggcg

SEQ ID NO: 3386583 - RNA, 15 nt, Pseudomonas aeruginosa PA01
cgcuacgcaggcccu

SEQ ID NO: 3386584 - RNA, 14 nt, Pseudomonas aeruginosa PA01
cgcuacgcggcggg

SEQ ID NO: 3386585 - RNA, 18 nt, Pseudomonas aeruginosa PA01
cgcuacgcggcgggaggu

SEQ ID NO: 3386586 - RNA, 20 nt, Pseudomonas aeruginosa PA01
cgcuacgcggcgggagguca

SEQ ID NO: 3386587 - RNA, 15 nt, Pseudomonas aeruginosa PA01
cgcuacggcaucacc

SEQ ID NO: 3386588 - RNA, 18 nt, Pseudomonas aeruginosa PA01
cgcuacggcaucaccggc

SEQ ID NO: 3386589 - RNA, 20 nt, Pseudomonas aeruginosa PA01
cgcuacguuccagggccugg

SEQ ID NO: 3386590 - RNA, 17 nt, Pseudomonas aeruginosa PA01
cgcuagcccugcugcuc

SEQ ID NO: 3386591 - RNA, 14 nt, Pseudomonas aeruginosa PA01
cgcuagcgcauggc

SEQ ID NO: 3386592 - RNA, 14 nt, Pseudomonas aeruginosa PA01
cgcuagggcgcccu

SEQ ID NO: 3386593 - RNA, 21 nt, Pseudomonas aeruginosa PA01
cgcuagucuuccugcacgcug

SEQ ID NO: 3386594 - RNA, 18 nt, Pseudomonas aeruginosa PA01
cgcuauccaccgucgcgg

SEQ ID NO: 3386595 - RNA, 14 nt, Pseudomonas aeruginosa PA01
cgcuauccgccgcu

SEQ ID NO: 3386596 - RNA, 17 nt, Pseudomonas aeruginosa PA01
cgcuauccgccgcuacu

SEQ ID NO: 3386597 - RNA, 21 nt, Pseudomonas aeruginosa PA01
cgcuauccgccgcuacugcgc

SEQ ID NO: 3386598 - RNA, 22 nt, Pseudomonas aeruginosa PA01
cgcuauccgccgcuacugcgcg

SEQ ID NO: 3386599 - RNA, 14 nt, Pseudomonas aeruginosa PA01
cgcuaucgccgccg

SEQ ID NO: 3386600 - RNA, 19 nt, Pseudomonas aeruginosa PA01
cgcuaucgccgccgcagcc

SEQ ID NO: 3386601 - RNA, 19 nt, Pseudomonas aeruginosa PA01
cgcuaucgcuggcgcagcc

SEQ ID NO: 3386602 - RNA, 16 nt, Pseudomonas aeruginosa PA01
cgcuaugggcaccgcg

SEQ ID NO: 3386603 - RNA, 18 nt, Pseudomonas aeruginosa PA01
cgcuaugggcaccgcgcc

SEQ ID NO: 3386604 - RNA, 21 nt, Pseudomonas aeruginosa PA01
cgcuaugggcaccgcgccggc

SEQ ID NO: 3386605 - RNA, 20 nt, Pseudomonas aeruginosa PA01
cgcucaaccgaacaggcgac

SEQ ID NO: 3386606 - RNA, 16 nt, Pseudomonas aeruginosa PA01
cgcucaacggcgugcc

SEQ ID NO: 3386607 - RNA, 17 nt, Pseudomonas aeruginosa PA01
cgcucaagacggcccgc

SEQ ID NO: 3386608 - RNA, 13 nt, Pseudomonas aeruginosa PA01
cgcucaccaccac

SEQ ID NO: 3386609 - RNA, 16 nt, Pseudomonas aeruginosa PA01
cgcucaccaccaccgc

SEQ ID NO: 3386610 - RNA, 18 nt, Pseudomonas aeruginosa PA01
cgcucaccaccaccgcgc

SEQ ID NO: 3386611 - RNA, 19 nt, Pseudomonas aeruginosa PA01
cgcucaccaccaccgcgcc

SEQ ID NO: 3386612 - RNA, 14 nt, Pseudomonas aeruginosa PA01
cgcucaccaggccc

SEQ ID NO: 3386613 - RNA, 19 nt, Pseudomonas aeruginosa PA01
cgcucaccaggcccgccgg

SEQ ID NO: 3386614 - RNA, 17 nt, Pseudomonas aeruginosa PA01
cgcucacccacauggcg

SEQ ID NO: 3386615 - RNA, 13 nt, Pseudomonas aeruginosa PA01
cgcucaccgccac

SEQ ID NO: 3386616 - RNA, 14 nt, Pseudomonas aeruginosa PA01
cgcucaccgccacc

SEQ ID NO: 3386617 - RNA, 20 nt, Pseudomonas aeruginosa PA01
cgcucaccgccaccccgccg

SEQ ID NO: 3386618 - RNA, 20 nt, Pseudomonas aeruginosa PA01
cgcucacgcaccucgucgag

SEQ ID NO: 3386619 - RNA, 21 nt, Pseudomonas aeruginosa PA01
cgcucacgcaccucgucgagc

SEQ ID NO: 3386620 - RNA, 14 nt, Pseudomonas aeruginosa PA01
cgcucacguagccc

SEQ ID NO: 3386621 - RNA, 21 nt, Pseudomonas aeruginosa PA01
cgcucacgugaccguccagcg

SEQ ID NO: 3386622 - RNA, 15 nt, Pseudomonas aeruginosa PA01
cgcucagcacccugg

SEQ ID NO: 3386623 - RNA, 13 nt, Pseudomonas aeruginosa PA01
cgcucagccccga

SEQ ID NO: 3386624 - RNA, 21 nt, Pseudomonas aeruginosa PA01
cgcucagccgaggucgccgcc

SEQ ID NO: 3386625 - RNA, 12 nt, Pseudomonas aeruginosa PA01
cgcucagcgcga

SEQ ID NO: 3386626 - RNA, 13 nt, Pseudomonas aeruginosa PA01
cgcucagcgcgag

SEQ ID NO: 3386627 - RNA, 14 nt, Pseudomonas aeruginosa PA01
cgcucagcgcuucu

SEQ ID NO: 3386628 - RNA, 16 nt, Pseudomonas aeruginosa PA01
cgcucagcgcuucucg

SEQ ID NO: 3386629 - RNA, 21 nt, Pseudomonas aeruginosa PA01
cgcucagcgcuucucggcagc

SEQ ID NO: 3386630 - RNA, 24 nt, Pseudomonas aeruginosa PA01
cgcucagcggaacauuuccuugac

SEQ ID NO: 3386631 - RNA, 14 nt, Pseudomonas aeruginosa PA01
cgcucagcgggccg

SEQ ID NO: 3386632 - RNA, 19 nt, Pseudomonas aeruginosa PA01
cgcucagcgggccgauccg

SEQ ID NO: 3386633 - RNA, 17 nt, Pseudomonas aeruginosa PA01
cgcucaggcagcgaucg

SEQ ID NO: 3386634 - RNA, 21 nt, Pseudomonas aeruginosa PA01
cgcucaggcagcgaucgccgc

SEQ ID NO: 3386635 - RNA, 13 nt, Pseudomonas aeruginosa PA01
cgcucaggcgcag

SEQ ID NO: 3386636 - RNA, 15 nt, Pseudomonas aeruginosa PA01
cgcucaggcgcagcg

SEQ ID NO: 3386637 - RNA, 21 nt, Pseudomonas aeruginosa PA01
cgcucaggcgcagcguccugc

SEQ ID NO: 3386638 - RNA, 23 nt, Pseudomonas aeruginosa PA01
cgcucaggcgucccgcuccagcc

SEQ ID NO: 3386639 - RNA, 14 nt, Pseudomonas aeruginosa PA01
cgcucaggcugugc

SEQ ID NO: 3386640 - RNA, 22 nt, Pseudomonas aeruginosa PA01
cgcucgagcuugaggucggccu

SEQ ID NO: 3386641 - RNA, 23 nt, Pseudomonas aeruginosa PA01
cgcucgagcuugaggucggccuc

SEQ ID NO: 3386642 - RNA, 21 nt, Pseudomonas aeruginosa PA01
cgcucgagggcgaccgccagg

SEQ ID NO: 3386643 - RNA, 23 nt, Pseudomonas aeruginosa PA01
cgcucgauagcguccaggugcgg

SEQ ID NO: 3386644 - RNA, 14 nt, Pseudomonas aeruginosa PA01
cgcucgaucaggua

SEQ ID NO: 3386645 - RNA, 19 nt, Pseudomonas aeruginosa PA01
cgcucgaucagguagucgc

SEQ ID NO: 3386646 - RNA, 22 nt, Pseudomonas aeruginosa PA01
cgcucgaucagguagucgcccg

SEQ ID NO: 3386647 - RNA, 14 nt, Pseudomonas aeruginosa PA01
cgcucgaucccggc

SEQ ID NO: 3386648 - RNA, 15 nt, Pseudomonas aeruginosa PA01
cgcucgaucccggcg

SEQ ID NO: 3386649 - RNA, 17 nt, Pseudomonas aeruginosa PA01
cgcucgaucccggcgcg

SEQ ID NO: 3386650 - RNA, 18 nt, Pseudomonas aeruginosa PA01
cgcucgaugcccgccagc

SEQ ID NO: 3386651 - RNA, 21 nt, Pseudomonas aeruginosa PA01
cgcucgaugcccgccagcagg

SEQ ID NO: 3386652 - RNA, 23 nt, Pseudomonas aeruginosa PA01
cgcucgaugcccgccagcaggcg

SEQ ID NO: 3386653 - RNA, 16 nt, Pseudomonas aeruginosa PA01
cgcucgccagaugacg

SEQ ID NO: 3386654 - RNA, 19 nt, Pseudomonas aeruginosa PA01
cgcucgccagaugacgaug

SEQ ID NO: 3386655 - RNA, 14 nt, Pseudomonas aeruginosa PA01
cgcucgcccuugcg

SEQ ID NO: 3386656 - RNA, 19 nt, Pseudomonas aeruginosa PA01
cgcucgcccuugcgccgcg

SEQ ID NO: 3386657 - RNA, 18 nt, Pseudomonas aeruginosa PA01
cgcucgccgggucgccgc

SEQ ID NO: 3386658 - RNA, 20 nt, Pseudomonas aeruginosa PA01
cgcucgccuaccggcgccgc

SEQ ID NO: 3386659 - RNA, 15 nt, Pseudomonas aeruginosa PA01
cgcucgcgcacggcg

SEQ ID NO: 3386660 - RNA, 16 nt, Pseudomonas aeruginosa PA01
cgcucgcgcacggcga

SEQ ID NO: 3386661 - RNA, 20 nt, Pseudomonas aeruginosa PA01
cgcucgcgcagccacuggcg

SEQ ID NO: 3386662 - RNA, 16 nt, Pseudomonas aeruginosa PA01
cgcucgcgcaugaccu

SEQ ID NO: 3386663 - RNA, 14 nt, Pseudomonas aeruginosa PA01
cgcucgcgcggcac

SEQ ID NO: 3386664 - RNA, 16 nt, Pseudomonas aeruginosa PA01
cgcucgcgcggcaccc

SEQ ID NO: 3386665 - RNA, 17 nt, Pseudomonas aeruginosa PA01
cgcucgcggaccucugc

SEQ ID NO: 3386666 - RNA, 16 nt, Pseudomonas aeruginosa PA01
cgcucgcggcaucccg

SEQ ID NO: 3386667 - RNA, 13 nt, Pseudomonas aeruginosa PA01
cgcucgcgggccg

SEQ ID NO: 3386668 - RNA, 21 nt, Pseudomonas aeruginosa PA01
cgcucgcgggccgccuggucg

SEQ ID NO: 3386669 - RNA, 21 nt, Pseudomonas aeruginosa PA01
cgcucgcgguuauccgccgcc

SEQ ID NO: 3386670 - RNA, 22 nt, Pseudomonas aeruginosa PA01
cgcucgcgguuauccgccgccg

SEQ ID NO: 3386671 - RNA, 16 nt, Pseudomonas aeruginosa PA01
cgcucgcuacagccgg

SEQ ID NO: 3386672 - RNA, 14 nt, Pseudomonas aeruginosa PA01
cgcucgcugcgugc

SEQ ID NO: 3386673 - RNA, 17 nt, Pseudomonas aeruginosa PA01
cgcucgcugucgcucag

SEQ ID NO: 3386674 - RNA, 19 nt, Pseudomonas aeruginosa PA01
cgcucggauuccagcgcgg

SEQ ID NO: 3386675 - RNA, 21 nt, Pseudomonas aeruginosa PA01
cgcucggauuccagcgcggug

SEQ ID NO: 3386676 - RNA, 15 nt, Pseudomonas aeruginosa PA01
cgcucggccaaugcc

SEQ ID NO: 3386677 - RNA, 11 nt, Pseudomonas aeruginosa PA01
cgcucggccag

SEQ ID NO: 3386678 - RNA, 12 nt, Pseudomonas aeruginosa PA01
cgcucggccagc

SEQ ID NO: 3386679 - RNA, 17 nt, Pseudomonas aeruginosa PA01
cgcucggccagcguccu

SEQ ID NO: 3386680 - RNA, 23 nt, Pseudomonas aeruginosa PA01
cgcucggccagcguccuucggcg

SEQ ID NO: 3386681 - RNA, 16 nt, Pseudomonas aeruginosa PA01
cgcucggccaggucgc

SEQ ID NO: 3386682 - RNA, 18 nt, Pseudomonas aeruginosa PA01
cgcucggccaggucgcga

SEQ ID NO: 3386683 - RNA, 21 nt, Pseudomonas aeruginosa PA01
cgcucggccaguucgucgagc

SEQ ID NO: 3386684 - RNA, 12 nt, Pseudomonas aeruginosa PA01
cgcucggccgcc

SEQ ID NO: 3386685 - RNA, 14 nt, Pseudomonas aeruginosa PA01
cgcucggccgccag

SEQ ID NO: 3386686 - RNA, 16 nt, Pseudomonas aeruginosa PA01
cgcucggccgccagca

SEQ ID NO: 3386687 - RNA, 17 nt, Pseudomonas aeruginosa PA01
cgcucggccgccuggcg

SEQ ID NO: 3386688 - RNA, 20 nt, Pseudomonas aeruginosa PA01
cgcucggccgccuggcgugc

SEQ ID NO: 3386689 - RNA, 12 nt, Pseudomonas aeruginosa PA01
cgcucggccugc

SEQ ID NO: 3386690 - RNA, 18 nt, Pseudomonas aeruginosa PA01
cgcucggccuugagcgcc

SEQ ID NO: 3386691 - RNA, 20 nt, Pseudomonas aeruginosa PA01
cgcucggccuugagcgccga

SEQ ID NO: 3386692 - RNA, 13 nt, Pseudomonas aeruginosa PA01
cgcucggccuugu

SEQ ID NO: 3386693 - RNA, 12 nt, Pseudomonas aeruginosa PA01
cgcucggcgacg

SEQ ID NO: 3386694 - RNA, 17 nt, Pseudomonas aeruginosa PA01
cgcucggcgagccgccg

SEQ ID NO: 3386695 - RNA, 18 nt, Pseudomonas aeruginosa PA01
cgcucggcgaggccggcg

SEQ ID NO: 3386696 - RNA, 20 nt, Pseudomonas aeruginosa PA01
cgcucggcgaguucgcgcag

SEQ ID NO: 3386697 - RNA, 23 nt, Pseudomonas aeruginosa PA01
cgcucggcgaguucgcgcaggcg

SEQ ID NO: 3386698 - RNA, 20 nt, Pseudomonas aeruginosa PA01
cgcucggcgcucggcuccag

SEQ ID NO: 3386699 - RNA, 12 nt, Pseudomonas aeruginosa PA01
cgcucggcggcc

SEQ ID NO: 3386700 - RNA, 13 nt, Pseudomonas aeruginosa PA01
cgcucggcggccu

SEQ ID NO: 3386701 - RNA, 14 nt, Pseudomonas aeruginosa PA01
cgcucggcggccuc

SEQ ID NO: 3386702 - RNA, 15 nt, Pseudomonas aeruginosa PA01
cgcucggcggcgcgc

SEQ ID NO: 3386703 - RNA, 17 nt, Pseudomonas aeruginosa PA01
cgcucggcggcgcgcag

SEQ ID NO: 3386704 - RNA, 18 nt, Pseudomonas aeruginosa PA01
cgcucggcggcgcgcagc

SEQ ID NO: 3386705 - RNA, 22 nt, Pseudomonas aeruginosa PA01
cgcucggcggucaggccaagcu

SEQ ID NO: 3386706 - RNA, 18 nt, Pseudomonas aeruginosa PA01
cgcucggcguagccggcg

SEQ ID NO: 3386707 - RNA, 13 nt, Pseudomonas aeruginosa PA01
cgcucggcgucgu

SEQ ID NO: 3386708 - RNA, 16 nt, Pseudomonas aeruginosa PA01
cgcucggcgucgucga

SEQ ID NO: 3386709 - RNA, 16 nt, Pseudomonas aeruginosa PA01
cgcucggcuccagcca

SEQ ID NO: 3386710 - RNA, 17 nt, Pseudomonas aeruginosa PA01
cgcucggcuccagccag

SEQ ID NO: 3386711 - RNA, 19 nt, Pseudomonas aeruginosa PA01
cgcucggcuccagccaggc

SEQ ID NO: 3386712 - RNA, 16 nt, Pseudomonas aeruginosa PA01
cgcucggcuucgcguu

SEQ ID NO: 3386713 - RNA, 16 nt, Pseudomonas aeruginosa PA01
cgcucgggaucgccuc

SEQ ID NO: 3386714 - RNA, 19 nt, Pseudomonas aeruginosa PA01
cgcucgggauggcccccac

SEQ ID NO: 3386715 - RNA, 16 nt, Pseudomonas aeruginosa PA01
cgcucgggcccuccca

SEQ ID NO: 3386716 - RNA, 18 nt, Pseudomonas aeruginosa PA01
cgcucggggauguccgcc

SEQ ID NO: 3386717 - RNA, 19 nt, Pseudomonas aeruginosa PA01
cgcucggggauguccgccg

SEQ ID NO: 3386718 - RNA, 22 nt, Pseudomonas aeruginosa PA01
cgcucggggauguccgccgccc

SEQ ID NO: 3386719 - RNA, 20 nt, Pseudomonas aeruginosa PA01
cgcucggggcaucggccauu

SEQ ID NO: 3386720 - RNA, 20 nt, Pseudomonas aeruginosa PA01
cgcucggggugcgcggcgaa

SEQ ID NO: 3386721 - RNA, 21 nt, Pseudomonas aeruginosa PA01
cgcucggggugcgcggcgaag

SEQ ID NO: 3386722 - RNA, 21 nt, Pseudomonas aeruginosa PA01
cgcucggugccuucccagccg

SEQ ID NO: 3386723 - RNA, 22 nt, Pseudomonas aeruginosa PA01
cgcucggugccuucccagccga

SEQ ID NO: 3386724 - RNA, 18 nt, Pseudomonas aeruginosa PA01
cgcucguagaacucgccc

SEQ ID NO: 3386725 - RNA, 20 nt, Pseudomonas aeruginosa PA01
cgcucguagaacucgcccuc

SEQ ID NO: 3386726 - RNA, 21 nt, Pseudomonas aeruginosa PA01
cgcucguagaacucgcccucg

SEQ ID NO: 3386727 - RNA, 22 nt, Pseudomonas aeruginosa PA01
cgcucguagaacucgcccucga

SEQ ID NO: 3386728 - RNA, 12 nt, Pseudomonas aeruginosa PA01
cgcucguagccg

SEQ ID NO: 3386729 - RNA, 19 nt, Pseudomonas aeruginosa PA01
cgcucguagccggcgcggc

SEQ ID NO: 3386730 - RNA, 20 nt, Pseudomonas aeruginosa PA01
cgcucguagguuuccggguc

SEQ ID NO: 3386731 - RNA, 13 nt, Pseudomonas aeruginosa PA01
cgcucgucaggcg

SEQ ID NO: 3386732 - RNA, 20 nt, Pseudomonas aeruginosa PA01
cgcucgucauggcgcacgcc

SEQ ID NO: 3386733 - RNA, 15 nt, Pseudomonas aeruginosa PA01
cgcucguugauccgc

SEQ ID NO: 3386734 - RNA, 20 nt, Pseudomonas aeruginosa PA01
cgcucguugauccgcguggc

SEQ ID NO: 3386735 - RNA, 21 nt, Pseudomonas aeruginosa PA01
cgcucguugauccgcguggcg

SEQ ID NO: 3386736 - RNA, 15 nt, Pseudomonas aeruginosa PA01
cgcucguuggcggcc

SEQ ID NO: 3386737 - RNA, 16 nt, Pseudomonas aeruginosa PA01
cgcucguuggcggcca

SEQ ID NO: 3386738 - RNA, 18 nt, Pseudomonas aeruginosa PA01
cgcucuaucgacgguuuc

SEQ ID NO: 3386739 - RNA, 22 nt, Pseudomonas aeruginosa PA01
cgcucuaucgacgguuucaggc

SEQ ID NO: 3386740 - RNA, 20 nt, Pseudomonas aeruginosa PA01
cgcucucgaacaccaggcgc

SEQ ID NO: 3386741 - RNA, 21 nt, Pseudomonas aeruginosa PA01
cgcucucgaacaccaggcgcc

SEQ ID NO: 3386742 - RNA, 18 nt, Pseudomonas aeruginosa PA01
cgcugaggccgcccuggc

SEQ ID NO: 3386743 - RNA, 22 nt, Pseudomonas aeruginosa PA01
cgcugaggccgcccuggccgag

SEQ ID NO: 3386744 - RNA, 13 nt, Pseudomonas aeruginosa PA01
cgcugaggcucag

SEQ ID NO: 3386745 - RNA, 14 nt, Pseudomonas aeruginosa PA01
cgcugaggcucagc

SEQ ID NO: 3386746 - RNA, 18 nt, Pseudomonas aeruginosa PA01
cgcugaggcucagcgcgc

SEQ ID NO: 3386747 - RNA, 23 nt, Pseudomonas aeruginosa PA01
cgcugaggcucagcgcgccgagu

SEQ ID NO: 3386748 - RNA, 17 nt, Pseudomonas aeruginosa PA01
cgcugaggcucgccggg

SEQ ID NO: 3386749 - RNA, 19 nt, Pseudomonas aeruginosa PA01
cgcugaggcucgccggguu

SEQ ID NO: 3386750 - RNA, 23 nt, Pseudomonas aeruginosa PA01
cgcugaggguggaacccauggcg

SEQ ID NO: 3386751 - RNA, 16 nt, Pseudomonas aeruginosa PA01
cgcugaguuugcccag

SEQ ID NO: 3386752 - RNA, 20 nt, Pseudomonas aeruginosa PA01
cgcugaucaguaccggcagc

SEQ ID NO: 3386753 - RNA, 21 nt, Pseudomonas aeruginosa PA01
cgcugaucaguaccggcagcg

SEQ ID NO: 3386754 - RNA, 16 nt, Pseudomonas aeruginosa PA01
cgcugaucaucagcag

SEQ ID NO: 3386755 - RNA, 17 nt, Pseudomonas aeruginosa PA01
cgcugaucaucagcagg

SEQ ID NO: 3386756 - RNA, 13 nt, Pseudomonas aeruginosa PA01
cgcugaucucggu

SEQ ID NO: 3386757 - RNA, 15 nt, Pseudomonas aeruginosa PA01
cgcugaugaugccgc

SEQ ID NO: 3386758 - RNA, 15 nt, Pseudomonas aeruginosa PA01
cgcugaugccggcga

SEQ ID NO: 3386759 - RNA, 17 nt, Pseudomonas aeruginosa PA01
cgcugaugccggcgaac

SEQ ID NO: 3386760 - RNA, 17 nt, Pseudomonas aeruginosa PA01
cgcugaugccggcgucg

SEQ ID NO: 3386761 - RNA, 18 nt, Pseudomonas aeruginosa PA01
cgcugaugccggcgucgg

SEQ ID NO: 3386762 - RNA, 22 nt, Pseudomonas aeruginosa PA01
cgcugaugccggcgucggcgag

SEQ ID NO: 3386763 - RNA, 15 nt, Pseudomonas aeruginosa PA01
cgcugaugugccgca

SEQ ID NO: 3386764 - RNA, 19 nt, Pseudomonas aeruginosa PA01
cgcugcaaaaaagcgcgcc

SEQ ID NO: 3386765 - RNA, 16 nt, Pseudomonas aeruginosa PA01
cgcugcaacuccgccu

SEQ ID NO: 3386766 - RNA, 22 nt, Pseudomonas aeruginosa PA01
cgcugcaaucgcugccggucag

SEQ ID NO: 3386767 - RNA, 16 nt, Pseudomonas aeruginosa PA01
cgcugcaccagcuucu

SEQ ID NO: 3386768 - RNA, 13 nt, Pseudomonas aeruginosa PA01
cgcugcaccgcgg

SEQ ID NO: 3386769 - RNA, 14 nt, Pseudomonas aeruginosa PA01
cgcugcaccgcggc

SEQ ID NO: 3386770 - RNA, 15 nt, Pseudomonas aeruginosa PA01
cgcugcaccgcggcg

SEQ ID NO: 3386771 - RNA, 18 nt, Pseudomonas aeruginosa PA01
cgcugcaccgcggcgcgg

SEQ ID NO: 3386772 - RNA, 16 nt, Pseudomonas aeruginosa PA01
cgcugcacgcacgcgc

SEQ ID NO: 3386773 - RNA, 15 nt, Pseudomonas aeruginosa PA01
cgcugcacgccuucc

SEQ ID NO: 3386774 - RNA, 15 nt, Pseudomonas aeruginosa PA01
cgcugcagccacugu

SEQ ID NO: 3386775 - RNA, 13 nt, Pseudomonas aeruginosa PA01
cgcugcagggcgg

SEQ ID NO: 3386776 - RNA, 14 nt, Pseudomonas aeruginosa PA01
cgcugcagggcggc

SEQ ID NO: 3386777 - RNA, 18 nt, Pseudomonas aeruginosa PA01
cgcugcagggcggcgcug

SEQ ID NO: 3386778 - RNA, 14 nt, Pseudomonas aeruginosa PA01
cgcugcaucggcgc

SEQ ID NO: 3386779 - RNA, 16 nt, Pseudomonas aeruginosa PA01
cgcugcaucggcgcgc

SEQ ID NO: 3386780 - RNA, 14 nt, Pseudomonas aeruginosa PA01
cgcugcaugcggaa

SEQ ID NO: 3386781 - RNA, 18 nt, Pseudomonas aeruginosa PA01
cgcugcaugggcucgcgc

SEQ ID NO: 3386782 - RNA, 22 nt, Pseudomonas aeruginosa PA01
cgcugcauggggauggucgaga

SEQ ID NO: 3386783 - RNA, 16 nt, Pseudomonas aeruginosa PA01
cgcugcauguccgcag

SEQ ID NO: 3386784 - RNA, 13 nt, Pseudomonas aeruginosa PA01
cgcugccagcagg

SEQ ID NO: 3386785 - RNA, 15 nt, Pseudomonas aeruginosa PA01
cgcugccagcaggcc

SEQ ID NO: 3386786 - RNA, 16 nt, Pseudomonas aeruginosa PA01
cgcugccagcaggccg

SEQ ID NO: 3386787 - RNA, 18 nt, Pseudomonas aeruginosa PA01
cgcugccagcaggccgag

SEQ ID NO: 3386788 - RNA, 14 nt, Pseudomonas aeruginosa PA01
cgcugccagcgccg

SEQ ID NO: 3386789 - RNA, 18 nt, Pseudomonas aeruginosa PA01
cgcugccagcgccgccgc

SEQ ID NO: 3386790 - RNA, 16 nt, Pseudomonas aeruginosa PA01
cgcugcccagcccgcc

SEQ ID NO: 3386791 - RNA, 19 nt, Pseudomonas aeruginosa PA01
cgcugcccagcccgccuuc

SEQ ID NO: 3386792 - RNA, 15 nt, Pseudomonas aeruginosa PA01
cgcugcccaucgccu

SEQ ID NO: 3386793 - RNA, 18 nt, Pseudomonas aeruginosa PA01
cgcugcccaucgccucca

SEQ ID NO: 3386794 - RNA, 21 nt, Pseudomonas aeruginosa PA01
cgcugccccuggcucaggcac

SEQ ID NO: 3386795 - RNA, 14 nt, Pseudomonas aeruginosa PA01
cgcugcccggcgcg

SEQ ID NO: 3386796 - RNA, 15 nt, Pseudomonas aeruginosa PA01
cgcugcccggcgcga

SEQ ID NO: 3386797 - RNA, 14 nt, Pseudomonas aeruginosa PA01
cgcugcccucgacc

SEQ ID NO: 3386798 - RNA, 19 nt, Pseudomonas aeruginosa PA01
cgcugccgaacagcaggga

SEQ ID NO: 3386799 - RNA, 15 nt, Pseudomonas aeruginosa PA01
cgcugccgaucagcc

SEQ ID NO: 3386800 - RNA, 16 nt, Pseudomonas aeruginosa PA01
cgcugccgcaugcagu

SEQ ID NO: 3386801 - RNA, 13 nt, Pseudomonas aeruginosa PA01
cgcugccgccgca

SEQ ID NO: 3386802 - RNA, 14 nt, Pseudomonas aeruginosa PA01
cgcugccgccgcag

SEQ ID NO: 3386803 - RNA, 13 nt, Pseudomonas aeruginosa PA01
cgcugccgccgcg

SEQ ID NO: 3386804 - RNA, 20 nt, Pseudomonas aeruginosa PA01
cgcugccgccgcgcaggcgg

SEQ ID NO: 3386805 - RNA, 15 nt, Pseudomonas aeruginosa PA01
cgcugccgccgcgcc

SEQ ID NO: 3386806 - RNA, 15 nt, Pseudomonas aeruginosa PA01
cgcugccgccgcgcu

SEQ ID NO: 3386807 - RNA, 17 nt, Pseudomonas aeruginosa PA01
cgcugccgccgcgcugc

SEQ ID NO: 3386808 - RNA, 21 nt, Pseudomonas aeruginosa PA01
cgcugccgccgcgcugcaggc

SEQ ID NO: 3386809 - RNA, 16 nt, Pseudomonas aeruginosa PA01
cgcugccgcucuggcu

SEQ ID NO: 3386810 - RNA, 23 nt, Pseudomonas aeruginosa PA01
cgcugccggccagggucgccagc

SEQ ID NO: 3386811 - RNA, 13 nt, Pseudomonas aeruginosa PA01
cgcugccggcgcg

SEQ ID NO: 3386812 - RNA, 14 nt, Pseudomonas aeruginosa PA01
cgcugccggcgcgc

SEQ ID NO: 3386813 - RNA, 15 nt, Pseudomonas aeruginosa PA01
cgcugccggcgcgca

SEQ ID NO: 3386814 - RNA, 17 nt, Pseudomonas aeruginosa PA01
cgcugccggcgcgcacg

SEQ ID NO: 3386815 - RNA, 13 nt, Pseudomonas aeruginosa PA01
cgcugccggucag

SEQ ID NO: 3386816 - RNA, 17 nt, Pseudomonas aeruginosa PA01
cgcugccggucaggcug

SEQ ID NO: 3386817 - RNA, 21 nt, Pseudomonas aeruginosa PA01
cgcugccggucaggcuggugc

SEQ ID NO: 3386818 - RNA, 19 nt, Pseudomonas aeruginosa PA01
cgcugccguacagcccccg

SEQ ID NO: 3386819 - RNA, 22 nt, Pseudomonas aeruginosa PA01
cgcugccguacagcccccgccg

SEQ ID NO: 3386820 - RNA, 21 nt, Pseudomonas aeruginosa PA01
cgcugccguucgcccgcggcg

SEQ ID NO: 3386821 - RNA, 22 nt, Pseudomonas aeruginosa PA01
cgcugccguucgcccgcggcgg

SEQ ID NO: 3386822 - RNA, 16 nt, Pseudomonas aeruginosa PA01
cgcugccguugcaggc

SEQ ID NO: 3386823 - RNA, 17 nt, Pseudomonas aeruginosa PA01
cgcugccguugcaggcc

SEQ ID NO: 3386824 - RNA, 22 nt, Pseudomonas aeruginosa PA01
cgcugccguugcaggcccagcu

SEQ ID NO: 3386825 - RNA, 18 nt, Pseudomonas aeruginosa PA01
cgcugccuaccgucacgc

SEQ ID NO: 3386826 - RNA, 22 nt, Pseudomonas aeruginosa PA01
cgcugccucgguuuccggccag

SEQ ID NO: 3386827 - RNA, 23 nt, Pseudomonas aeruginosa PA01
cgcugccucgguuuccggccagg

SEQ ID NO: 3386828 - RNA, 16 nt, Pseudomonas aeruginosa PA01
cgcugccugcaccggg

SEQ ID NO: 3386829 - RNA, 17 nt, Pseudomonas aeruginosa PA01
cgcugccugcaccgggc

SEQ ID NO: 3386830 - RNA, 22 nt, Pseudomonas aeruginosa PA01
cgcugccugcaccgggccgacc

SEQ ID NO: 3386831 - RNA, 13 nt, Pseudomonas aeruginosa PA01
cgcugccugggga

SEQ ID NO: 3386832 - RNA, 19 nt, Pseudomonas aeruginosa PA01
cgcugccuucgaagccggc

SEQ ID NO: 3386833 - RNA, 13 nt, Pseudomonas aeruginosa PA01
cgcugcgaccugg

SEQ ID NO: 3386834 - RNA, 14 nt, Pseudomonas aeruginosa PA01
cgcugcgaccuggc

SEQ ID NO: 3386835 - RNA, 15 nt, Pseudomonas aeruginosa PA01
cgcugcgaccuggcg

SEQ ID NO: 3386836 - RNA, 21 nt, Pseudomonas aeruginosa PA01
cgcugcgaccuggcgccgaaa

SEQ ID NO: 3386837 - RNA, 16 nt, Pseudomonas aeruginosa PA01
cgcugcgagcaggucc

SEQ ID NO: 3386838 - RNA, 23 nt, Pseudomonas aeruginosa PA01
cgcugcgagcagguccuguccca

SEQ ID NO: 3386839 - RNA, 14 nt, Pseudomonas aeruginosa PA01
cgcugcgcaacugc

SEQ ID NO: 3386840 - RNA, 19 nt, Pseudomonas aeruginosa PA01
cgcugcgcaacugccgguc

SEQ ID NO: 3386841 - RNA, 21 nt, Pseudomonas aeruginosa PA01
cgcugcgcaacugccggucgg

SEQ ID NO: 3386842 - RNA, 20 nt, Pseudomonas aeruginosa PA01
cgcugcgcagaugcggggcg

SEQ ID NO: 3386843 - RNA, 12 nt, Pseudomonas aeruginosa PA01
cgcugcgccagg

SEQ ID NO: 3386844 - RNA, 14 nt, Pseudomonas aeruginosa PA01
cgcugcgccaggcc

SEQ ID NO: 3386845 - RNA, 19 nt, Pseudomonas aeruginosa PA01
cgcuggcgaggacgccggg

SEQ ID NO: 3386846 - RNA, 13 nt, Pseudomonas aeruginosa PA01
cgcuggcgaucac

SEQ ID NO: 3386847 - RNA, 13 nt, Pseudomonas aeruginosa PA01
cgcuggcgaucau

SEQ ID NO: 3386848 - RNA, 15 nt, Pseudomonas aeruginosa PA01
cgcuggcgcagcagc

SEQ ID NO: 3386849 - RNA, 14 nt, Pseudomonas aeruginosa PA01
cgcuggcgcagccg

SEQ ID NO: 3386850 - RNA, 15 nt, Pseudomonas aeruginosa PA01
cgcuggcgcagccgc

SEQ ID NO: 3386851 - RNA, 19 nt, Pseudomonas aeruginosa PA01
cgcuggcgcagccgcugcu

SEQ ID NO: 3386852 - RNA, 22 nt, Pseudomonas aeruginosa PA01
cgcuggcgcagccgcugcugca

SEQ ID NO: 3386853 - RNA, 17 nt, Pseudomonas aeruginosa PA01
cgcuggcgccaguaaug

SEQ ID NO: 3386854 - RNA, 13 nt, Pseudomonas aeruginosa PA01
cgcuggcgccgau

SEQ ID NO: 3386855 - RNA, 16 nt, Pseudomonas aeruginosa PA01
cgcuggcggcaugccg

SEQ ID NO: 3386856 - RNA, 12 nt, Pseudomonas aeruginosa PA01
cgcuggcggccg

SEQ ID NO: 3386857 - RNA, 14 nt, Pseudomonas aeruginosa PA01
cgcuggcggccuuc

SEQ ID NO: 3386858 - RNA, 15 nt, Pseudomonas aeruginosa PA01
cgcuggcggcgacga

SEQ ID NO: 3386859 - RNA, 17 nt, Pseudomonas aeruginosa PA01
cgcuggcggcgacgaag

SEQ ID NO: 3386860 - RNA, 19 nt, Pseudomonas aeruginosa PA01
cgcuggcggcgacgaaggu

SEQ ID NO: 3386861 - RNA, 13 nt, Pseudomonas aeruginosa PA01
cgcuggcgggcgc

SEQ ID NO: 3386862 - RNA, 21 nt, Pseudomonas aeruginosa PA01
cgcuggcguuauucgcccuac

SEQ ID NO: 3386863 - RNA, 22 nt, Pseudomonas aeruginosa PA01
cgcuggcguuauucgcccuacc

SEQ ID NO: 3386864 - RNA, 15 nt, Pseudomonas aeruginosa PA01
cgcugggacggcggc

SEQ ID NO: 3386865 - RNA, 13 nt, Pseudomonas aeruginosa PA01
cgcugggcaggug

SEQ ID NO: 3386866 - RNA, 20 nt, Pseudomonas aeruginosa PA01
cgcugggccuugagcaggcg

SEQ ID NO: 3386867 - RNA, 24 nt, Pseudomonas aeruginosa PA01
cgcugggccuugagcaggcguucc

SEQ ID NO: 3386868 - RNA, 13 nt, Pseudomonas aeruginosa PA01
cgcugggcgcagc

SEQ ID NO: 3386869 - RNA, 16 nt, Pseudomonas aeruginosa PA01
cgcugggcgcagcccu

SEQ ID NO: 3386870 - RNA, 14 nt, Pseudomonas aeruginosa PA01
cgcugggcgccggc

SEQ ID NO: 3386871 - RNA, 15 nt, Pseudomonas aeruginosa PA01
cgcugggcgccggca

SEQ ID NO: 3386872 - RNA, 17 nt, Pseudomonas aeruginosa PA01
cgcugggcgccggcagg

SEQ ID NO: 3386873 - RNA, 13 nt, Pseudomonas aeruginosa PA01
cgcugggcgccuc

SEQ ID NO: 3386874 - RNA, 23 nt, Pseudomonas aeruginosa PA01
cgcuggggaccgcaccuggugga

SEQ ID NO: 3386875 - RNA, 21 nt, Pseudomonas aeruginosa PA01
cgcugguaccugccggcacgc

SEQ ID NO: 3386876 - RNA, 19 nt, Pseudomonas aeruginosa PA01
cgcugguagcccaggccga

SEQ ID NO: 3386877 - RNA, 16 nt, Pseudomonas aeruginosa PA01
cgcugguagcgcucca

SEQ ID NO: 3386878 - RNA, 21 nt, Pseudomonas aeruginosa PA01
cgcugguccagcacgcuggcg

SEQ ID NO: 3386879 - RNA, 22 nt, Pseudomonas aeruginosa PA01
cgcugguccagcacgcuggcga

SEQ ID NO: 3386880 - RNA, 23 nt, Pseudomonas aeruginosa PA01
cgcugguccagcacgcuggcgag

SEQ ID NO: 3386881 - RNA, 15 nt, Pseudomonas aeruginosa PA01
cgcugguccagcugg

SEQ ID NO: 3386882 - RNA, 17 nt, Pseudomonas aeruginosa PA01
cgcugguccagcuggcg

SEQ ID NO: 3386883 - RNA, 23 nt, Pseudomonas aeruginosa PA01
cgcugguccagcuggcgcagccg

SEQ ID NO: 3386884 - RNA, 13 nt, Pseudomonas aeruginosa PA01
cgcuggucggcau

SEQ ID NO: 3386885 - RNA, 14 nt, Pseudomonas aeruginosa PA01
cgcuggucggcauc

SEQ ID NO: 3386886 - RNA, 22 nt, Pseudomonas aeruginosa PA01
cgcuggucucuuccagcaugcu

SEQ ID NO: 3386887 - RNA, 18 nt, Pseudomonas aeruginosa PA01
cgcuggugacggugaccu

SEQ ID NO: 3386888 - RNA, 14 nt, Pseudomonas aeruginosa PA01
cgcuggugaucgac

SEQ ID NO: 3386889 - RNA, 15 nt, Pseudomonas aeruginosa PA01
cgcuggugaucgacc

SEQ ID NO: 3386890 - RNA, 21 nt, Pseudomonas aeruginosa PA01
cgcuggugaucgaccacacau

SEQ ID NO: 3386891 - RNA, 14 nt, Pseudomonas aeruginosa PA01
cgcuggugaugucg

SEQ ID NO: 3386892 - RNA, 13 nt, Pseudomonas aeruginosa PA01
cgcuggugccgac

SEQ ID NO: 3386893 - RNA, 14 nt, Pseudomonas aeruginosa PA01
cgcuggugccgacg

SEQ ID NO: 3386894 - RNA, 22 nt, Pseudomonas aeruginosa PA01
cgcuggugccgacgcugaucau

SEQ ID NO: 3386895 - RNA, 16 nt, Pseudomonas aeruginosa PA01
cgcugguugcccaggg

SEQ ID NO: 3386896 - RNA, 23 nt, Pseudomonas aeruginosa PA01
cgcugguuggcgaggucgcggac

SEQ ID NO: 3386897 - RNA, 20 nt, Pseudomonas aeruginosa PA01
cgcugguuuagcucggcgau

SEQ ID NO: 3386898 - RNA, 21 nt, Pseudomonas aeruginosa PA01
cgcuguacaagcgcaacgcgc

SEQ ID NO: 3386899 - RNA, 23 nt, Pseudomonas aeruginosa PA01
cgcuguacaagcgcaacgcgcgc

SEQ ID NO: 3386900 - RNA, 14 nt, Pseudomonas aeruginosa PA01
cgcuguagaaugcg

SEQ ID NO: 3386901 - RNA, 14 nt, Pseudomonas aeruginosa PA01
cgcuguagccggcg

SEQ ID NO: 3386902 - RNA, 17 nt, Pseudomonas aeruginosa PA01
cgcuguagccggcgccg

SEQ ID NO: 3386903 - RNA, 20 nt, Pseudomonas aeruginosa PA01
cgcuguagcggcucgccgaa

SEQ ID NO: 3386904 - RNA, 15 nt, Pseudomonas aeruginosa PA01
cgcuguaggcgagca

SEQ ID NO: 3386905 - RNA, 18 nt, Pseudomonas aeruginosa PA01
cgcuguaggcgagcagcg

SEQ ID NO: 3386906 - RNA, 17 nt, Pseudomonas aeruginosa PA01
cgcugucaaucgcgcaa

SEQ ID NO: 3386907 - RNA, 14 nt, Pseudomonas aeruginosa PA01
cgcugucagggcuu

SEQ ID NO: 3386908 - RNA, 19 nt, Pseudomonas aeruginosa PA01
cgcugucagggcuugcgcg

SEQ ID NO: 3386909 - RNA, 20 nt, Pseudomonas aeruginosa PA01
cgcuguccgccaucccucua

SEQ ID NO: 3386910 - RNA, 13 nt, Pseudomonas aeruginosa PA01
cgcuguccgccgc

SEQ ID NO: 3386911 - RNA, 17 nt, Pseudomonas aeruginosa PA01
cgcuguccuccagcggc

SEQ ID NO: 3386912 - RNA, 16 nt, Pseudomonas aeruginosa PA01
cgcugucgcccagcuc

SEQ ID NO: 3386913 - RNA, 14 nt, Pseudomonas aeruginosa PA01
cgcugucgcccggg

SEQ ID NO: 3386914 - RNA, 23 nt, Pseudomonas aeruginosa PA01
cgcugucgcccgggcgccaccga

SEQ ID NO: 3386915 - RNA, 12 nt, Pseudomonas aeruginosa PA01
cgcugucgccga

SEQ ID NO: 3386916 - RNA, 19 nt, Pseudomonas aeruginosa PA01
cgcugucgccggucaggcu

SEQ ID NO: 3386917 - RNA, 17 nt, Pseudomonas aeruginosa PA01
cgcugucggccucgacg

SEQ ID NO: 3386918 - RNA, 16 nt, Pseudomonas aeruginosa PA01
cgcugucguccagcgg

SEQ ID NO: 3386919 - RNA, 18 nt, Pseudomonas aeruginosa PA01
cgcugucguccagcgggu

SEQ ID NO: 3386920 - RNA, 15 nt, Pseudomonas aeruginosa PA01
cgcugucgucggcgc

SEQ ID NO: 3386921 - RNA, 17 nt, Pseudomonas aeruginosa PA01
cgcugucgucggcgcgg

SEQ ID NO: 3386922 - RNA, 19 nt, Pseudomonas aeruginosa PA01
cgcugucgucuucggccag

SEQ ID NO: 3386923 - RNA, 21 nt, Pseudomonas aeruginosa PA01
cgcugucuaucccgugccggg

SEQ ID NO: 3386924 - RNA, 19 nt, Pseudomonas aeruginosa PA01
cgcugucucgccagcccgg

SEQ ID NO: 3386925 - RNA, 19 nt, Pseudomonas aeruginosa PA01
cgcugugaggugggcgcgc

SEQ ID NO: 3386926 - RNA, 21 nt, Pseudomonas aeruginosa PA01
cgcugugcagggucagucgag

SEQ ID NO: 3386927 - RNA, 13 nt, Pseudomonas aeruginosa PA01
cgcugugcggcag

SEQ ID NO: 3386928 - RNA, 16 nt, Pseudomonas aeruginosa PA01
cgcugugcggcagcag

SEQ ID NO: 3386929 - RNA, 18 nt, Pseudomonas aeruginosa PA01
cgcugugcggcagcaggc

SEQ ID NO: 3386930 - RNA, 20 nt, Pseudomonas aeruginosa PA01
cgcuguggaaguacggcgcg

SEQ ID NO: 3386931 - RNA, 23 nt, Pseudomonas aeruginosa PA01
cgcugugggugaggcguucgagg

SEQ ID NO: 3386932 - RNA, 22 nt, Pseudomonas aeruginosa PA01
cgcuguuacugagcgugacccg

SEQ ID NO: 3386933 - RNA, 15 nt, Pseudomonas aeruginosa PA01
cgcuguuccgccgug

SEQ ID NO: 3386934 - RNA, 17 nt, Pseudomonas aeruginosa PA01
cgcuguuccgccguggg

SEQ ID NO: 3386935 - RNA, 15 nt, Pseudomonas aeruginosa PA01
cgcuguucgggucgc

SEQ ID NO: 3386936 - RNA, 14 nt, Pseudomonas aeruginosa PA01
cgcuguucuucagu

SEQ ID NO: 3386937 - RNA, 15 nt, Pseudomonas aeruginosa PA01
cgcuguugccgcgcu

SEQ ID NO: 3386938 - RNA, 14 nt, Pseudomonas aeruginosa PA01
cgcuguuggcguga

SEQ ID NO: 3386939 - RNA, 16 nt, Pseudomonas aeruginosa PA01
cgcuguuugcggcgca

SEQ ID NO: 3386940 - RNA, 14 nt, Pseudomonas aeruginosa PA01
cgcuucaagcggcc

SEQ ID NO: 3386941 - RNA, 16 nt, Pseudomonas aeruginosa PA01
cgcuucagcgcgccga

SEQ ID NO: 3386942 - RNA, 18 nt, Pseudomonas aeruginosa PA01
cgcuucagcgcgccgagc

SEQ ID NO: 3386943 - RNA, 20 nt, Pseudomonas aeruginosa PA01
cgcuucagcgguucggcacg

SEQ ID NO: 3386944 - RNA, 12 nt, Pseudomonas aeruginosa PA01
cgcuucagcucg

SEQ ID NO: 3386945 - RNA, 17 nt, Pseudomonas aeruginosa PA01
cgcuucaggcaguccuu

SEQ ID NO: 3386946 - RNA, 16 nt, Pseudomonas aeruginosa PA01
cgcuucauccugcgcg

SEQ ID NO: 3386947 - RNA, 18 nt, Pseudomonas aeruginosa PA01
cgcuucauccugcgcgcc

SEQ ID NO: 3386948 - RNA, 18 nt, Pseudomonas aeruginosa PA01
cgcuuguccuucggccag

SEQ ID NO: 3386949 - RNA, 16 nt, Pseudomonas aeruginosa PA01
cgcuugucguggcggg

SEQ ID NO: 3386950 - RNA, 18 nt, Pseudomonas aeruginosa PA01
cgcuugucguggcgggcu

SEQ ID NO: 3386951 - RNA, 22 nt, Pseudomonas aeruginosa PA01
cgcuuguugaugguuucuuccc

SEQ ID NO: 3386952 - RNA, 23 nt, Pseudomonas aeruginosa PA01
cgcuuguugaugguuucuuccca

SEQ ID NO: 3386953 - RNA, 13 nt, Pseudomonas aeruginosa PA01
cgcuuucagcgcc

SEQ ID NO: 3386954 - RNA, 24 nt, Pseudomonas aeruginosa PA01
cgcuuucagcgccgcucggcgagc

SEQ ID NO: 3386955 - RNA, 22 nt, Pseudomonas aeruginosa PA01
cgcuuucaggcgcucgucgagg

SEQ ID NO: 3386956 - RNA, 18 nt, Pseudomonas aeruginosa PA01
cgcuuucaucaggcgcuu

SEQ ID NO: 3386957 - RNA, 23 nt, Pseudomonas aeruginosa PA01
cgcuuuccacccgaaagccgaag

SEQ ID NO: 3386958 - RNA, 16 nt, Pseudomonas aeruginosa PA01
cgcuuuccccggcggc

SEQ ID NO: 3386959 - RNA, 22 nt, Pseudomonas aeruginosa PA01
cgcuuucccgcuucggcccgcu

SEQ ID NO: 3386960 - RNA, 17 nt, Pseudomonas aeruginosa PA01
cgcuuuccggcgcggcc

SEQ ID NO: 3386961 - RNA, 18 nt, Pseudomonas aeruginosa PA01
cgcuuuccggcgcggccu

SEQ ID NO: 3386962 - RNA, 22 nt, Pseudomonas aeruginosa PA01
cgcuuuccggcgcggccugcag

SEQ ID NO: 3386963 - RNA, 23 nt, Pseudomonas aeruginosa PA01
cgcuuuccggcgcggccugcagc

SEQ ID NO: 3386964 - RNA, 13 nt, Pseudomonas aeruginosa PA01
cgcuuuccucggu

SEQ ID NO: 3386965 - RNA, 14 nt, Pseudomonas aeruginosa PA01
cgcuuuccuggccg

SEQ ID NO: 3386966 - RNA, 19 nt, Pseudomonas aeruginosa PA01
cgcuuucgagaaagcgcag

SEQ ID NO: 3386967 - RNA, 13 nt, Pseudomonas aeruginosa PA01
cgcuuucgcgcag

SEQ ID NO: 3386968 - RNA, 15 nt, Pseudomonas aeruginosa PA01
cgcuuugcgcgcagu

SEQ ID NO: 3386969 - RNA, 17 nt, Pseudomonas aeruginosa PA01
cgcuuuuuccgcugccg

SEQ ID NO: 3386970 - RNA, 20 nt, Pseudomonas aeruginosa PA01
cgcuuuuuucuugccgccag

SEQ ID NO: 3386971 - RNA, 23 nt, Pseudomonas aeruginosa PA01
cggaaaaauaccccgggucgcgc

SEQ ID NO: 3386972 - RNA, 21 nt, Pseudomonas aeruginosa PA01
cggaaaacgccgcgaagccca

SEQ ID NO: 3386973 - RNA, 23 nt, Pseudomonas aeruginosa PA01
cggaaaagaagccgcgcaaggca

SEQ ID NO: 3386974 - RNA, 15 nt, Pseudomonas aeruginosa PA01
cggaaacacagcacg

SEQ ID NO: 3386975 - RNA, 22 nt, Pseudomonas aeruginosa PA01
cggaaacccgugguccgccagc

SEQ ID NO: 3386976 - RNA, 23 nt, Pseudomonas aeruginosa PA01
cggaaacccgugguccgccagca

SEQ ID NO: 3386977 - RNA, 19 nt, Pseudomonas aeruginosa PA01
cggaaacccuuccagccgc

SEQ ID NO: 3386978 - RNA, 16 nt, Pseudomonas aeruginosa PA01
cggaaaccgcauugac

SEQ ID NO: 3386979 - RNA, 18 nt, Pseudomonas aeruginosa PA01
cggaaaccgcggccggcu

SEQ ID NO: 3386980 - RNA, 20 nt, Pseudomonas aeruginosa PA01
cggaaaccucgccggucagg

SEQ ID NO: 3386981 - RNA, 22 nt, Pseudomonas aeruginosa PA01
cggaaaccugugcugcgcgccg

SEQ ID NO: 3386982 - RNA, 21 nt, Pseudomonas aeruginosa PA01
cggaaacgaaaaagcccggcg

SEQ ID NO: 3386983 - RNA, 21 nt, Pseudomonas aeruginosa PA01
cggaaacgcgcgcucucgccg

SEQ ID NO: 3386984 - RNA, 18 nt, Pseudomonas aeruginosa PA01
cggaaacucuugaucccg

SEQ ID NO: 3386985 - RNA, 16 nt, Pseudomonas aeruginosa PA01
cggaaagcagggcgau

SEQ ID NO: 3386986 - RNA, 18 nt, Pseudomonas aeruginosa PA01
cggaaagcaguucgcccg

SEQ ID NO: 3386987 - RNA, 15 nt, Pseudomonas aeruginosa PA01
cggaaagccuggccg

SEQ ID NO: 3386988 - RNA, 16 nt, Pseudomonas aeruginosa PA01
cggaaagccuggccgg

SEQ ID NO: 3386989 - RNA, 19 nt, Pseudomonas aeruginosa PA01
cggaaagccuggccggcga

SEQ ID NO: 3386990 - RNA, 18 nt, Pseudomonas aeruginosa PA01
cggaaagcgacgccgcga

SEQ ID NO: 3386991 - RNA, 18 nt, Pseudomonas aeruginosa PA01
cggaaauacggcuccggc

SEQ ID NO: 3386992 - RNA, 19 nt, Pseudomonas aeruginosa PA01
cggaaaugaaaaaggccgg

SEQ ID NO: 3386993 - RNA, 15 nt, Pseudomonas aeruginosa PA01
cggaaaugcucgccg

SEQ ID NO: 3386994 - RNA, 15 nt, Pseudomonas aeruginosa PA01
cggaacaagccgccu

SEQ ID NO: 3386995 - RNA, 20 nt, Pseudomonas aeruginosa PA01
cggaacacacgcuucugcug

SEQ ID NO: 3386996 - RNA, 23 nt, Pseudomonas aeruginosa PA01
cggaacacacgcuucugcuggcc

SEQ ID NO: 3386997 - RNA, 12 nt, Pseudomonas aeruginosa PA01
cggaacagcgcc

SEQ ID NO: 3386998 - RNA, 16 nt, Pseudomonas aeruginosa PA01
cggaacaugguguugg

SEQ ID NO: 3386999 - RNA, 21 nt, Pseudomonas aeruginosa PA01
cggaaccagugcgcgguccgc

SEQ ID NO: 3387000 - RNA, 12 nt, Pseudomonas aeruginosa PA01
cggaacccgcgc

SEQ ID NO: 3387001 - RNA, 14 nt, Pseudomonas aeruginosa PA01
cggaacccgcgcag

SEQ ID NO: 3387002 - RNA, 20 nt, Pseudomonas aeruginosa PA01
cggaaccgaguuucccggcg

SEQ ID NO: 3387003 - RNA, 19 nt, Pseudomonas aeruginosa PA01
cggaacgaaggacaggucg

SEQ ID NO: 3387004 - RNA, 18 nt, Pseudomonas aeruginosa PA01
cggaacgaccacgccugc

SEQ ID NO: 3387005 - RNA, 16 nt, Pseudomonas aeruginosa PA01
cggaacgagagguugc

SEQ ID NO: 3387006 - RNA, 21 nt, Pseudomonas aeruginosa PA01
cggaacgcggcuucggucagg

SEQ ID NO: 3387007 - RNA, 18 nt, Pseudomonas aeruginosa PA01
cggaacggcucgcgaccg

SEQ ID NO: 3387008 - RNA, 20 nt, Pseudomonas aeruginosa PA01
cggaacgggacgccuggcgu

SEQ ID NO: 3387009 - RNA, 13 nt, Pseudomonas aeruginosa PA01
cggaacgucggcc

SEQ ID NO: 3387010 - RNA, 14 nt, Pseudomonas aeruginosa PA01
cggaacgucggccu

SEQ ID NO: 3387011 - RNA, 16 nt, Pseudomonas aeruginosa PA01
cggaacgucggccugg

SEQ ID NO: 3387012 - RNA, 14 nt, Pseudomonas aeruginosa PA01
cggaacuucgcaua

SEQ ID NO: 3387013 - RNA, 18 nt, Pseudomonas aeruginosa PA01
cggaacuugucgccgcug

SEQ ID NO: 3387014 - RNA, 21 nt, Pseudomonas aeruginosa PA01
cggaacuugucgccgcuggac

SEQ ID NO: 3387015 - RNA, 22 nt, Pseudomonas aeruginosa PA01
cggaacuugucgccgcuggacg

SEQ ID NO: 3387016 - RNA, 17 nt, Pseudomonas aeruginosa PA01
cggaagaaaagaaggcg

SEQ ID NO: 3387017 - RNA, 22 nt, Pseudomonas aeruginosa PA01
cggaagaaaagaaggcggaugg

SEQ ID NO: 3387018 - RNA, 14 nt, Pseudomonas aeruginosa PA01
cggaagaaacugcg

SEQ ID NO: 3387019 - RNA, 13 nt, Pseudomonas aeruginosa PA01
cggaagaagcccu

SEQ ID NO: 3387020 - RNA, 19 nt, Pseudomonas aeruginosa PA01
cggaagaauaccgccagcu

SEQ ID NO: 3387021 - RNA, 22 nt, Pseudomonas aeruginosa PA01
cggaagacgaaguugagcaccg

SEQ ID NO: 3387022 - RNA, 13 nt, Pseudomonas aeruginosa PA01
cggaagcacggcu

SEQ ID NO: 3387023 - RNA, 16 nt, Pseudomonas aeruginosa PA01
cggaagcacggcucgg

SEQ ID NO: 3387024 - RNA, 17 nt, Pseudomonas aeruginosa PA01
cggaagcacggcucggc

SEQ ID NO: 3387025 - RNA, 18 nt, Pseudomonas aeruginosa PA01
cggaagcacggcucggcg

SEQ ID NO: 3387026 - RNA, 21 nt, Pseudomonas aeruginosa PA01
cggaagcacggcucggcgagg

SEQ ID NO: 3387027 - RNA, 17 nt, Pseudomonas aeruginosa PA01
cggaagcagccauggcu

SEQ ID NO: 3387028 - RNA, 15 nt, Pseudomonas aeruginosa PA01
cggaagcauggccgg

SEQ ID NO: 3387029 - RNA, 16 nt, Pseudomonas aeruginosa PA01
cggaagcauggccggc

SEQ ID NO: 3387030 - RNA, 18 nt, Pseudomonas aeruginosa PA01
cggaagcauggccggcua

SEQ ID NO: 3387031 - RNA, 14 nt, Pseudomonas aeruginosa PA01
cggaagcccagcag

SEQ ID NO: 3387032 - RNA, 15 nt, Pseudomonas aeruginosa PA01
cggaagcccagcagg

SEQ ID NO: 3387033 - RNA, 18 nt, Pseudomonas aeruginosa PA01
cggaagcccagcaggucg

SEQ ID NO: 3387034 - RNA, 15 nt, Pseudomonas aeruginosa PA01
cggaagcccugcugg

SEQ ID NO: 3387035 - RNA, 24 nt, Pseudomonas aeruginosa PA01
cggaagcccugcuggcgcagccag

SEQ ID NO: 3387036 - RNA, 16 nt, Pseudomonas aeruginosa PA01
cggaagccgucggcga

SEQ ID NO: 3387037 - RNA, 17 nt, Pseudomonas aeruginosa PA01
cggaagccgucggcgau

SEQ ID NO: 3387038 - RNA, 18 nt, Pseudomonas aeruginosa PA01
cggaagccgucggcgauc

SEQ ID NO: 3387039 - RNA, 21 nt, Pseudomonas aeruginosa PA01
cggaagccgucggcgaucgcc

SEQ ID NO: 3387040 - RNA, 13 nt, Pseudomonas aeruginosa PA01
cggaagccgugca

SEQ ID NO: 3387041 - RNA, 12 nt, Pseudomonas aeruginosa PA01
cggaagcgcucg

SEQ ID NO: 3387042 - RNA, 15 nt, Pseudomonas aeruginosa PA01
cggaagcgcucgcgc

SEQ ID NO: 3387043 - RNA, 16 nt, Pseudomonas aeruginosa PA01
cggaagcgcucgcgcu

SEQ ID NO: 3387044 - RNA, 17 nt, Pseudomonas aeruginosa PA01
cggaagcgcucgcgcuu

SEQ ID NO: 3387045 - RNA, 15 nt, Pseudomonas aeruginosa PA01
cggaagcggccgagc

SEQ ID NO: 3387046 - RNA, 18 nt, Pseudomonas aeruginosa PA01
cggaagcgucagccgcgg

SEQ ID NO: 3387047 - RNA, 22 nt, Pseudomonas aeruginosa PA01
cggaagcgucagccgcggccgg

SEQ ID NO: 3387048 - RNA, 15 nt, Pseudomonas aeruginosa PA01
cggaagcguccaggg

SEQ ID NO: 3387049 - RNA, 22 nt, Pseudomonas aeruginosa PA01
cggaagcuucaggcucggccug

SEQ ID NO: 3387050 - RNA, 20 nt, Pseudomonas aeruginosa PA01
cggacguuccaccuggcgca

SEQ ID NO: 3387051 - RNA, 17 nt, Pseudomonas aeruginosa PA01
cggacguuuccagcggc

SEQ ID NO: 3387052 - RNA, 21 nt, Pseudomonas aeruginosa PA01
cggacuaccuucgaucacccg

SEQ ID NO: 3387053 - RNA, 22 nt, Pseudomonas aeruginosa PA01
cggacuaccuucgaucacccgg

SEQ ID NO: 3387054 - RNA, 17 nt, Pseudomonas aeruginosa PA01
cggacuccgacgcgucg

SEQ ID NO: 3387055 - RNA, 22 nt, Pseudomonas aeruginosa PA01
cggacuccggaggcgcacaggc

SEQ ID NO: 3387056 - RNA, 17 nt, Pseudomonas aeruginosa PA01
cggacugaaaccccacc

SEQ ID NO: 3387057 - RNA, 17 nt, Pseudomonas aeruginosa PA01
cggacugcccagcgccg

SEQ ID NO: 3387058 - RNA, 19 nt, Pseudomonas aeruginosa PA01
cggacugcccagcgccgcc

SEQ ID NO: 3387059 - RNA, 21 nt, Pseudomonas aeruginosa PA01
cggacugcccagcgccgccag

SEQ ID NO: 3387060 - RNA, 22 nt, Pseudomonas aeruginosa PA01
cggacugcccagcgccgccagc

SEQ ID NO: 3387061 - RNA, 24 nt, Pseudomonas aeruginosa PA01
cggacugcccagcgccgccagcag

SEQ ID NO: 3387062 - RNA, 15 nt, Pseudomonas aeruginosa PA01
cggacugcccgacga

SEQ ID NO: 3387063 - RNA, 15 nt, Pseudomonas aeruginosa PA01
cggacugcucgccgc

SEQ ID NO: 3387064 - RNA, 16 nt, Pseudomonas aeruginosa PA01
cggacugcucgccgcc

SEQ ID NO: 3387065 - RNA, 18 nt, Pseudomonas aeruginosa PA01
cggacugcucgccgccgg

SEQ ID NO: 3387066 - RNA, 16 nt, Pseudomonas aeruginosa PA01
cggacuggauucggcc

SEQ ID NO: 3387067 - RNA, 18 nt, Pseudomonas aeruginosa PA01
cggacuggauucggccug

SEQ ID NO: 3387068 - RNA, 16 nt, Pseudomonas aeruginosa PA01
cggacugguaggacag

SEQ ID NO: 3387069 - RNA, 21 nt, Pseudomonas aeruginosa PA01
cggacugguaggacagggcca

SEQ ID NO: 3387070 - RNA, 22 nt, Pseudomonas aeruginosa PA01
cggacugguaggacagggccag

SEQ ID NO: 3387071 - RNA, 23 nt, Pseudomonas aeruginosa PA01
cggacugguaggacagggccagg

SEQ ID NO: 3387072 - RNA, 21 nt, Pseudomonas aeruginosa PA01
cggacuuuucgcuuugcgcgc

SEQ ID NO: 3387073 - RNA, 13 nt, Pseudomonas aeruginosa PA01
cggagaacagcag

SEQ ID NO: 3387074 - RNA, 16 nt, Pseudomonas aeruginosa PA01
cggagaacagcagcgg

SEQ ID NO: 3387075 - RNA, 23 nt, Pseudomonas aeruginosa PA01
cggagaacagcagcggcaccagc

SEQ ID NO: 3387076 - RNA, 13 nt, Pseudomonas aeruginosa PA01
cggagaacagcga

SEQ ID NO: 3387077 - RNA, 15 nt, Pseudomonas aeruginosa PA01
cggagaacagcgaga

SEQ ID NO: 3387078 - RNA, 22 nt, Pseudomonas aeruginosa PA01
cggagaacagcgagaccucgcc

SEQ ID NO: 3387079 - RNA, 15 nt, Pseudomonas aeruginosa PA01
cggagaacgccgcca

SEQ ID NO: 3387080 - RNA, 18 nt, Pseudomonas aeruginosa PA01
cggagaacgccgccacgc

SEQ ID NO: 3387081 - RNA, 23 nt, Pseudomonas aeruginosa PA01
cggagaacgccgccacgccgaua

SEQ ID NO: 3387082 - RNA, 11 nt, Pseudomonas aeruginosa PA01
cggagaagggc

SEQ ID NO: 3387083 - RNA, 16 nt, Pseudomonas aeruginosa PA01
cggagaagggcgcgcc

SEQ ID NO: 3387084 - RNA, 17 nt, Pseudomonas aeruginosa PA01
cggagaagggcgcgccc

SEQ ID NO: 3387085 - RNA, 19 nt, Pseudomonas aeruginosa PA01
cggagaagggcgcgccccg

SEQ ID NO: 3387086 - RNA, 14 nt, Pseudomonas aeruginosa PA01
cggagaauucgcgu

SEQ ID NO: 3387087 - RNA, 17 nt, Pseudomonas aeruginosa PA01
cggagacgauggcgacg

SEQ ID NO: 3387088 - RNA, 22 nt, Pseudomonas aeruginosa PA01
cggagacguuggugauguugcg

SEQ ID NO: 3387089 - RNA, 16 nt, Pseudomonas aeruginosa PA01
cggagacuucagcgca

SEQ ID NO: 3387090 - RNA, 17 nt, Pseudomonas aeruginosa PA01
cggagagacccgccagc

SEQ ID NO: 3387091 - RNA, 21 nt, Pseudomonas aeruginosa PA01
cggagagacccgccagcggca

SEQ ID NO: 3387092 - RNA, 16 nt, Pseudomonas aeruginosa PA01
cggagagcagcagcuc

SEQ ID NO: 3387093 - RNA, 18 nt, Pseudomonas aeruginosa PA01
cggagagcagccaagcca

SEQ ID NO: 3387094 - RNA, 21 nt, Pseudomonas aeruginosa PA01
cggagagcagccaagccacca

SEQ ID NO: 3387095 - RNA, 23 nt, Pseudomonas aeruginosa PA01
cggagagcagccaagccaccagc

SEQ ID NO: 3387096 - RNA, 22 nt, Pseudomonas aeruginosa PA01
cggagagcgaauacaccgagcg

SEQ ID NO: 3387097 - RNA, 22 nt, Pseudomonas aeruginosa PA01
cggagaggaucagcgaacccgg

SEQ ID NO: 3387098 - RNA, 17 nt, Pseudomonas aeruginosa PA01
cggagagggagcgccug

SEQ ID NO: 3387099 - RNA, 16 nt, Pseudomonas aeruginosa PA01
cggagauagccuccuc

SEQ ID NO: 3387100 - RNA, 13 nt, Pseudomonas aeruginosa PA01
cggagcaccgcgc

SEQ ID NO: 3387101 - RNA, 17 nt, Pseudomonas aeruginosa PA01
cggagcauggugucgcu

SEQ ID NO: 3387102 - RNA, 14 nt, Pseudomonas aeruginosa PA01
cggagccaacgccc

SEQ ID NO: 3387103 - RNA, 16 nt, Pseudomonas aeruginosa PA01
cggagccaacgcccgg

SEQ ID NO: 3387104 - RNA, 19 nt, Pseudomonas aeruginosa PA01
cggagccaacgcccgggcc

SEQ ID NO: 3387105 - RNA, 21 nt, Pseudomonas aeruginosa PA01
cggagccaccgggaucuggcc

SEQ ID NO: 3387106 - RNA, 12 nt, Pseudomonas aeruginosa PA01
cggagccgucgg

SEQ ID NO: 3387107 - RNA, 13 nt, Pseudomonas aeruginosa PA01
cggagccgucggc

SEQ ID NO: 3387108 - RNA, 21 nt, Pseudomonas aeruginosa PA01
cggagccuucuagcgaaggcu

SEQ ID NO: 3387109 - RNA, 17 nt, Pseudomonas aeruginosa PA01
cggagcgaccggauggc

SEQ ID NO: 3387110 - RNA, 13 nt, Pseudomonas aeruginosa PA01
cggagcgcgaggc

SEQ ID NO: 3387111 - RNA, 12 nt, Pseudomonas aeruginosa PA01
cggagcggcugc

SEQ ID NO: 3387112 - RNA, 17 nt, Pseudomonas aeruginosa PA01
cggagcggcugccgagg

SEQ ID NO: 3387113 - RNA, 18 nt, Pseudomonas aeruginosa PA01
cggagcggcugccgaggc

SEQ ID NO: 3387114 - RNA, 19 nt, Pseudomonas aeruginosa PA01
cggagcggcugccgaggcu

SEQ ID NO: 3387115 - RNA, 16 nt, Pseudomonas aeruginosa PA01
cggagcgucggaagcg

SEQ ID NO: 3387116 - RNA, 18 nt, Pseudomonas aeruginosa PA01
cggagcgucggaagcguc

SEQ ID NO: 3387117 - RNA, 15 nt, Pseudomonas aeruginosa PA01
cggagcgucgggcgg

SEQ ID NO: 3387118 - RNA, 22 nt, Pseudomonas aeruginosa PA01
cggagcugcaugagugucgcca

SEQ ID NO: 3387119 - RNA, 19 nt, Pseudomonas aeruginosa PA01
cggagcuuugcagggcgau

SEQ ID NO: 3387120 - RNA, 23 nt, Pseudomonas aeruginosa PA01
cggagcuuugcagggcgauccag

SEQ ID NO: 3387121 - RNA, 23 nt, Pseudomonas aeruginosa PA01
cggaggaaacccaugcccgcccc

SEQ ID NO: 3387122 - RNA, 13 nt, Pseudomonas aeruginosa PA01
cggaggcagcgau

SEQ ID NO: 3387123 - RNA, 21 nt, Pseudomonas aeruginosa PA01
cggaggcagcgaugccuccgg

SEQ ID NO: 3387124 - RNA, 16 nt, Pseudomonas aeruginosa PA01
cggaggcgaggucgcc

SEQ ID NO: 3387125 - RNA, 13 nt, Pseudomonas aeruginosa PA01
cggaggcgcacag

SEQ ID NO: 3387126 - RNA, 20 nt, Pseudomonas aeruginosa PA01
cggagggaaugaagaagccc

SEQ ID NO: 3387127 - RNA, 13 nt, Pseudomonas aeruginosa PA01
cggaggggcggcc

SEQ ID NO: 3387128 - RNA, 14 nt, Pseudomonas aeruginosa PA01
cggaggggcggccg

SEQ ID NO: 3387129 - RNA, 22 nt, Pseudomonas aeruginosa PA01
cggaggggcggccgccgagcaa

SEQ ID NO: 3387130 - RNA, 18 nt, Pseudomonas aeruginosa PA01
cggagggucaggccgagg

SEQ ID NO: 3387131 - RNA, 20 nt, Pseudomonas aeruginosa PA01
cggagggucaggccgagggc

SEQ ID NO: 3387132 - RNA, 17 nt, Pseudomonas aeruginosa PA01
cggaggucgagcagagu

SEQ ID NO: 3387133 - RNA, 16 nt, Pseudomonas aeruginosa PA01
cggaguagccggcggc

SEQ ID NO: 3387134 - RNA, 18 nt, Pseudomonas aeruginosa PA01
cggaguagccggcggcga

SEQ ID NO: 3387135 - RNA, 19 nt, Pseudomonas aeruginosa PA01
cggaguagccggcggcgaa

SEQ ID NO: 3387136 - RNA, 20 nt, Pseudomonas aeruginosa PA01
cggagucggugugaccuuca

SEQ ID NO: 3387137 - RNA, 19 nt, Pseudomonas aeruginosa PA01
cggagucguagcgcgcggc

SEQ ID NO: 3387138 - RNA, 21 nt, Pseudomonas aeruginosa PA01
cggagucguagcgcgcggcga

SEQ ID NO: 3387139 - RNA, 13 nt, Pseudomonas aeruginosa PA01
cggagucucggga

SEQ ID NO: 3387140 - RNA, 17 nt, Pseudomonas aeruginosa PA01
cggagugcucgaucagg

SEQ ID NO: 3387141 - RNA, 14 nt, Pseudomonas aeruginosa PA01
cggagugggccgcg

SEQ ID NO: 3387142 - RNA, 16 nt, Pseudomonas aeruginosa PA01
cggagugugucggggc

SEQ ID NO: 3387143 - RNA, 21 nt, Pseudomonas aeruginosa PA01
cggagugugucggggccguga

SEQ ID NO: 3387144 - RNA, 16 nt, Pseudomonas aeruginosa PA01
cggauaaaauccacaa

SEQ ID NO: 3387145 - RNA, 16 nt, Pseudomonas aeruginosa PA01
cggauaaacggcaugc

SEQ ID NO: 3387146 - RNA, 20 nt, Pseudomonas aeruginosa PA01
cggauaaccgcgagcgguua

SEQ ID NO: 3387147 - RNA, 14 nt, Pseudomonas aeruginosa PA01
cggauaacgccggu

SEQ ID NO: 3387148 - RNA, 16 nt, Pseudomonas aeruginosa PA01
cggauaacgccggugg

SEQ ID NO: 3387149 - RNA, 18 nt, Pseudomonas aeruginosa PA01
cggauaacgccugcggcg

SEQ ID NO: 3387150 - RNA, 19 nt, Pseudomonas aeruginosa PA01
cggauaacgccugcggcgu

SEQ ID NO: 3387151 - RNA, 17 nt, Pseudomonas aeruginosa PA01
cggauaaucgcagcgcg

SEQ ID NO: 3387152 - RNA, 19 nt, Pseudomonas aeruginosa PA01
cggauguaguccagcgccg

SEQ ID NO: 3387153 - RNA, 21 nt, Pseudomonas aeruginosa PA01
cggauguaguccagcgccgcg

SEQ ID NO: 3387154 - RNA, 18 nt, Pseudomonas aeruginosa PA01
cggaugucgggcucgacg

SEQ ID NO: 3387155 - RNA, 19 nt, Pseudomonas aeruginosa PA01
cggauguucuucaccuugg

SEQ ID NO: 3387156 - RNA, 15 nt, Pseudomonas aeruginosa PA01
cggauucaggcgcgc

SEQ ID NO: 3387157 - RNA, 19 nt, Pseudomonas aeruginosa PA01
cggauucaucggcggcagg

SEQ ID NO: 3387158 - RNA, 14 nt, Pseudomonas aeruginosa PA01
cggauucgccgagg

SEQ ID NO: 3387159 - RNA, 20 nt, Pseudomonas aeruginosa PA01
cggauucgccgaggaacuuc

SEQ ID NO: 3387160 - RNA, 21 nt, Pseudomonas aeruginosa PA01
cggauugacgauggccagccc

SEQ ID NO: 3387161 - RNA, 22 nt, Pseudomonas aeruginosa PA01
cggauugcguacgcccagcagc

SEQ ID NO: 3387162 - RNA, 18 nt, Pseudomonas aeruginosa PA01
cggauuggccgaggugga

SEQ ID NO: 3387163 - RNA, 19 nt, Pseudomonas aeruginosa PA01
cggcaaacgccgccaccaa

SEQ ID NO: 3387164 - RNA, 14 nt, Pseudomonas aeruginosa PA01
cggcaaagccgcug

SEQ ID NO: 3387165 - RNA, 14 nt, Pseudomonas aeruginosa PA01
cggcaaaggcccgg

SEQ ID NO: 3387166 - RNA, 18 nt, Pseudomonas aeruginosa PA01
cggcaaaggcccggcgcg

SEQ ID NO: 3387167 - RNA, 16 nt, Pseudomonas aeruginosa PA01
cggcaaaugccgggcu

SEQ ID NO: 3387168 - RNA, 13 nt, Pseudomonas aeruginosa PA01
cggcaacaggucg

SEQ ID NO: 3387169 - RNA, 14 nt, Pseudomonas aeruginosa PA01
cggcaacaggucga

SEQ ID NO: 3387170 - RNA, 13 nt, Pseudomonas aeruginosa PA01
cggcaaccgggcg

SEQ ID NO: 3387171 - RNA, 14 nt, Pseudomonas aeruginosa PA01
cggcaaccgggcgg

SEQ ID NO: 3387172 - RNA, 17 nt, Pseudomonas aeruginosa PA01
cggcaacgaaaacgccc

SEQ ID NO: 3387173 - RNA, 22 nt, Pseudomonas aeruginosa PA01
cggcaacgaaaacgcccggcag

SEQ ID NO: 3387174 - RNA, 17 nt, Pseudomonas aeruginosa PA01
cggcaacgacgaggccu

SEQ ID NO: 3387175 - RNA, 14 nt, Pseudomonas aeruginosa PA01
cggcaacgacggca

SEQ ID NO: 3387176 - RNA, 15 nt, Pseudomonas aeruginosa PA01
cggcaacgagcagga

SEQ ID NO: 3387177 - RNA, 15 nt, Pseudomonas aeruginosa PA01
cggcaacgauaccgc

SEQ ID NO: 3387178 - RNA, 17 nt, Pseudomonas aeruginosa PA01
cggcaacgauaccgccg

SEQ ID NO: 3387179 - RNA, 18 nt, Pseudomonas aeruginosa PA01
cggcaacgauaccgccgc

SEQ ID NO: 3387180 - RNA, 20 nt, Pseudomonas aeruginosa PA01
cggcaacgauaccgccgccg

SEQ ID NO: 3387181 - RNA, 21 nt, Pseudomonas aeruginosa PA01
cggcaacgauaccgccgccgg

SEQ ID NO: 3387182 - RNA, 14 nt, Pseudomonas aeruginosa PA01
cggcaacgcgccca

SEQ ID NO: 3387183 - RNA, 17 nt, Pseudomonas aeruginosa PA01
cggcaacgucaggcugu

SEQ ID NO: 3387184 - RNA, 13 nt, Pseudomonas aeruginosa PA01
cggcaagcaccuu

SEQ ID NO: 3387185 - RNA, 14 nt, Pseudomonas aeruginosa PA01
cggcaagcaggccg

SEQ ID NO: 3387186 - RNA, 18 nt, Pseudomonas aeruginosa PA01
cggcaagcgaaccgagga

SEQ ID NO: 3387187 - RNA, 14 nt, Pseudomonas aeruginosa PA01
cggcaagcgccggc

SEQ ID NO: 3387188 - RNA, 14 nt, Pseudomonas aeruginosa PA01
cggcaagcgugccc

SEQ ID NO: 3387189 - RNA, 21 nt, Pseudomonas aeruginosa PA01
cggcaagcuccgcgauguccc

SEQ ID NO: 3387190 - RNA, 19 nt, Pseudomonas aeruginosa PA01
cggcaagcugaagcgccgc

SEQ ID NO: 3387191 - RNA, 20 nt, Pseudomonas aeruginosa PA01
cggcaagcugaagcgccgcg

SEQ ID NO: 3387192 - RNA, 21 nt, Pseudomonas aeruginosa PA01
cggcaagcugaagcgccgcgg

SEQ ID NO: 3387193 - RNA, 15 nt, Pseudomonas aeruginosa PA01
cggcaaggaccugcu

SEQ ID NO: 3387194 - RNA, 21 nt, Pseudomonas aeruginosa PA01
cggcaaggaccugcugcccgg

SEQ ID NO: 3387195 - RNA, 15 nt, Pseudomonas aeruginosa PA01
cggcaaggcacacgc

SEQ ID NO: 3387196 - RNA, 19 nt, Pseudomonas aeruginosa PA01
cggcaaggcacacgcccgg

SEQ ID NO: 3387197 - RNA, 14 nt, Pseudomonas aeruginosa PA01
cggcaaggccaagu

SEQ ID NO: 3387198 - RNA, 20 nt, Pseudomonas aeruginosa PA01
cggcaaggcgaucccggcgu

SEQ ID NO: 3387199 - RNA, 13 nt, Pseudomonas aeruginosa PA01
cggcaaggcgcug

SEQ ID NO: 3387200 - RNA, 14 nt, Pseudomonas aeruginosa PA01
cggcaaggcgcuga

SEQ ID NO: 3387201 - RNA, 14 nt, Pseudomonas aeruginosa PA01
cggcaaggcggccu

SEQ ID NO: 3387202 - RNA, 16 nt, Pseudomonas aeruginosa PA01
cggcaagggcacgugc

SEQ ID NO: 3387203 - RNA, 23 nt, Pseudomonas aeruginosa PA01
cggcaagggcacgugcagcggca

SEQ ID NO: 3387204 - RNA, 15 nt, Pseudomonas aeruginosa PA01
cggcaagggccugcu

SEQ ID NO: 3387205 - RNA, 18 nt, Pseudomonas aeruginosa PA01
cggcaagggccugcucag

SEQ ID NO: 3387206 - RNA, 23 nt, Pseudomonas aeruginosa PA01
cggcaaguucgcauaggcggcca

SEQ ID NO: 3387207 - RNA, 15 nt, Pseudomonas aeruginosa PA01
cggcaauagccgggc

SEQ ID NO: 3387208 - RNA, 16 nt, Pseudomonas aeruginosa PA01
cggcaauagccgggcu

SEQ ID NO: 3387209 - RNA, 21 nt, Pseudomonas aeruginosa PA01
cggcaaucaggcgcgaucgcg

SEQ ID NO: 3387210 - RNA, 19 nt, Pseudomonas aeruginosa PA01
cggcaauucuucaaggucu

SEQ ID NO: 3387211 - RNA, 15 nt, Pseudomonas aeruginosa PA01
cggcacacgucggca

SEQ ID NO: 3387212 - RNA, 16 nt, Pseudomonas aeruginosa PA01
cggcacagcguggcca

SEQ ID NO: 3387213 - RNA, 19 nt, Pseudomonas aeruginosa PA01
cggcacagcguggccagcg

SEQ ID NO: 3387214 - RNA, 21 nt, Pseudomonas aeruginosa PA01
cggcacagcguggccagcgcc

SEQ ID NO: 3387215 - RNA, 22 nt, Pseudomonas aeruginosa PA01
cggcacagcguggccagcgccc

SEQ ID NO: 3387216 - RNA, 16 nt, Pseudomonas aeruginosa PA01
cggcacaggcggcugu

SEQ ID NO: 3387217 - RNA, 12 nt, Pseudomonas aeruginosa PA01
cggcaccaccac

SEQ ID NO: 3387218 - RNA, 13 nt, Pseudomonas aeruginosa PA01
cggcaccaccacc

SEQ ID NO: 3387219 - RNA, 15 nt, Pseudomonas aeruginosa PA01
cggcaccaccaccga

SEQ ID NO: 3387220 - RNA, 17 nt, Pseudomonas aeruginosa PA01
cggcaccaccaccgaca

SEQ ID NO: 3387221 - RNA, 18 nt, Pseudomonas aeruginosa PA01
cggcaccaccaccgacag

SEQ ID NO: 3387222 - RNA, 19 nt, Pseudomonas aeruginosa PA01
cggcaccaccaccgacagg

SEQ ID NO: 3387223 - RNA, 15 nt, Pseudomonas aeruginosa PA01
cggcaccaccaccgg

SEQ ID NO: 3387224 - RNA, 15 nt, Pseudomonas aeruginosa PA01
cggcaccaccagcgc

SEQ ID NO: 3387225 - RNA, 19 nt, Pseudomonas aeruginosa PA01
cggcaccaccagcgcgcgc

SEQ ID NO: 3387226 - RNA, 23 nt, Pseudomonas aeruginosa PA01
cggcaccaccagcgcgcgcuggc

SEQ ID NO: 3387227 - RNA, 16 nt, Pseudomonas aeruginosa PA01
cggcaccacgugcagc

SEQ ID NO: 3387228 - RNA, 23 nt, Pseudomonas aeruginosa PA01
cggcaccagcacguugccaucca

SEQ ID NO: 3387229 - RNA, 16 nt, Pseudomonas aeruginosa PA01
cggcaccagcaguagu

SEQ ID NO: 3387230 - RNA, 13 nt, Pseudomonas aeruginosa PA01
cggcaccagccag

SEQ ID NO: 3387231 - RNA, 14 nt, Pseudomonas aeruginosa PA01
cggcaccagccagg

SEQ ID NO: 3387232 - RNA, 16 nt, Pseudomonas aeruginosa PA01
cggcaccagcgcgucg

SEQ ID NO: 3387233 - RNA, 13 nt, Pseudomonas aeruginosa PA01
cggcaccagggcu

SEQ ID NO: 3387234 - RNA, 22 nt, Pseudomonas aeruginosa PA01
cggcaccccuugcagccagccg

SEQ ID NO: 3387235 - RNA, 15 nt, Pseudomonas aeruginosa PA01
cggcacccggcuggg

SEQ ID NO: 3387236 - RNA, 17 nt, Pseudomonas aeruginosa PA01
cggcacccucuuccgcg

SEQ ID NO: 3387237 - RNA, 20 nt, Pseudomonas aeruginosa PA01
cggcacccucuuccgcgcug

SEQ ID NO: 3387238 - RNA, 18 nt, Pseudomonas aeruginosa PA01
cggcacccugaccgcgag

SEQ ID NO: 3387239 - RNA, 20 nt, Pseudomonas aeruginosa PA01
cggcacccugaccgcgagcg

SEQ ID NO: 3387240 - RNA, 17 nt, Pseudomonas aeruginosa PA01
cggcaccgacgccgaag

SEQ ID NO: 3387241 - RNA, 22 nt, Pseudomonas aeruginosa PA01
cggcaccgagagcugcaaggcu

SEQ ID NO: 3387242 - RNA, 13 nt, Pseudomonas aeruginosa PA01
cggcaccgagccg

SEQ ID NO: 3387243 - RNA, 14 nt, Pseudomonas aeruginosa PA01
cggcaccgaucgcc

SEQ ID NO: 3387244 - RNA, 16 nt, Pseudomonas aeruginosa PA01
cggcaccgaucgcccg

SEQ ID NO: 3387245 - RNA, 18 nt, Pseudomonas aeruginosa PA01
cggcaccgaucgcccgcg

SEQ ID NO: 3387246 - RNA, 13 nt, Pseudomonas aeruginosa PA01
cggcaccgcucug

SEQ ID NO: 3387247 - RNA, 21 nt, Pseudomonas aeruginosa PA01
cggcaccgcucugcagugcgu

SEQ ID NO: 3387248 - RNA, 14 nt, Pseudomonas aeruginosa PA01
cggcaccgcuuucg

SEQ ID NO: 3387249 - RNA, 23 nt, Pseudomonas aeruginosa PA01
cggcaccggggugauccagcugg

SEQ ID NO: 3387250 - RNA, 14 nt, Pseudomonas aeruginosa PA01
cggcaccgucgagc

SEQ ID NO: 3387251 - RNA, 13 nt, Pseudomonas aeruginosa PA01
cggcaccugcaga

SEQ ID NO: 3387252 - RNA, 22 nt, Pseudomonas aeruginosa PA01
cggcaccuugcgaaaagcccgc

SEQ ID NO: 3387253 - RNA, 21 nt, Pseudomonas aeruginosa PA01
cggcacgaaccauugcggccc

SEQ ID NO: 3387254 - RNA, 12 nt, Pseudomonas aeruginosa PA01
cggcacgaccac

SEQ ID NO: 3387255 - RNA, 20 nt, Pseudomonas aeruginosa PA01
cggcagcgcguagaccaccu

SEQ ID NO: 3387256 - RNA, 13 nt, Pseudomonas aeruginosa PA01
cggcagcgcuggc

SEQ ID NO: 3387257 - RNA, 14 nt, Pseudomonas aeruginosa PA01
cggcagcgcuggcg

SEQ ID NO: 3387258 - RNA, 15 nt, Pseudomonas aeruginosa PA01
cggcagcgcuggcga

SEQ ID NO: 3387259 - RNA, 18 nt, Pseudomonas aeruginosa PA01
cggcagcgcuggcgauca

SEQ ID NO: 3387260 - RNA, 22 nt, Pseudomonas aeruginosa PA01
cggcagcgcuggcgaucaccag

SEQ ID NO: 3387261 - RNA, 12 nt, Pseudomonas aeruginosa PA01
cggcagcggcgu

SEQ ID NO: 3387262 - RNA, 23 nt, Pseudomonas aeruginosa PA01
cggcagcggcgugaagccgccgc

SEQ ID NO: 3387263 - RNA, 12 nt, Pseudomonas aeruginosa PA01
cggcagcggcug

SEQ ID NO: 3387264 - RNA, 13 nt, Pseudomonas aeruginosa PA01
cggcagcggcugg

SEQ ID NO: 3387265 - RNA, 16 nt, Pseudomonas aeruginosa PA01
cggcagcggcuggccg

SEQ ID NO: 3387266 - RNA, 18 nt, Pseudomonas aeruginosa PA01
cggcagcggcuggccguc

SEQ ID NO: 3387267 - RNA, 12 nt, Pseudomonas aeruginosa PA01
cggcagcgguga

SEQ ID NO: 3387268 - RNA, 21 nt, Pseudomonas aeruginosa PA01
cggcagcggugaagguccgcg

SEQ ID NO: 3387269 - RNA, 22 nt, Pseudomonas aeruginosa PA01
cggcagcggugaagguccgcgc

SEQ ID NO: 3387270 - RNA, 18 nt, Pseudomonas aeruginosa PA01
cggcagcgucgagcuggc

SEQ ID NO: 3387271 - RNA, 21 nt, Pseudomonas aeruginosa PA01
cggcagcgucgagcuggcgca

SEQ ID NO: 3387272 - RNA, 18 nt, Pseudomonas aeruginosa PA01
cggcagcgucggaaaacc

SEQ ID NO: 3387273 - RNA, 15 nt, Pseudomonas aeruginosa PA01
cggcagcgucucagc

SEQ ID NO: 3387274 - RNA, 18 nt, Pseudomonas aeruginosa PA01
cggcagcgucucagcccu

SEQ ID NO: 3387275 - RNA, 19 nt, Pseudomonas aeruginosa PA01
cggcagcgucucggcugcc

SEQ ID NO: 3387276 - RNA, 20 nt, Pseudomonas aeruginosa PA01
cggcagcgucucggcugccg

SEQ ID NO: 3387277 - RNA, 18 nt, Pseudomonas aeruginosa PA01
cggcagcucauaggucag

SEQ ID NO: 3387278 - RNA, 17 nt, Pseudomonas aeruginosa PA01
cggcagcucccuugccg

SEQ ID NO: 3387279 - RNA, 20 nt, Pseudomonas aeruginosa PA01
cggcagcuccggcgggcggu

SEQ ID NO: 3387280 - RNA, 14 nt, Pseudomonas aeruginosa PA01
cggcagcucggccg

SEQ ID NO: 3387281 - RNA, 16 nt, Pseudomonas aeruginosa PA01
cggcagcucggccgag

SEQ ID NO: 3387282 - RNA, 20 nt, Pseudomonas aeruginosa PA01
cggcagcucggccgagggca

SEQ ID NO: 3387283 - RNA, 13 nt, Pseudomonas aeruginosa PA01
cggcagcucggcg

SEQ ID NO: 3387284 - RNA, 14 nt, Pseudomonas aeruginosa PA01
cggcagcucggcga

SEQ ID NO: 3387285 - RNA, 15 nt, Pseudomonas aeruginosa PA01
cggcagcucggcgac

SEQ ID NO: 3387286 - RNA, 16 nt, Pseudomonas aeruginosa PA01
cggcagcucggcgaca

SEQ ID NO: 3387287 - RNA, 17 nt, Pseudomonas aeruginosa PA01
cggcagcugcggcggca

SEQ ID NO: 3387288 - RNA, 20 nt, Pseudomonas aeruginosa PA01
cggcagcugcggcggcacca

SEQ ID NO: 3387289 - RNA, 15 nt, Pseudomonas aeruginosa PA01
cggcagcuggauccg

SEQ ID NO: 3387290 - RNA, 18 nt, Pseudomonas aeruginosa PA01
cggcagcuuggcgacguc

SEQ ID NO: 3387291 - RNA, 23 nt, Pseudomonas aeruginosa PA01
cggcagcuuggcgacguccugcg

SEQ ID NO: 3387292 - RNA, 20 nt, Pseudomonas aeruginosa PA01
cggcaggaaauccgccgcgc

SEQ ID NO: 3387293 - RNA, 21 nt, Pseudomonas aeruginosa PA01
cggcaggaaauccgccgcgca

SEQ ID NO: 3387294 - RNA, 13 nt, Pseudomonas aeruginosa PA01
cggcaggaacgcc

SEQ ID NO: 3387295 - RNA, 15 nt, Pseudomonas aeruginosa PA01
cggcaggaacgcccg

SEQ ID NO: 3387296 - RNA, 22 nt, Pseudomonas aeruginosa PA01
cggcaggaacgcccgcggcagc

SEQ ID NO: 3387297 - RNA, 23 nt, Pseudomonas aeruginosa PA01
cggcaggaacgcccgcggcagca

SEQ ID NO: 3387298 - RNA, 11 nt, Pseudomonas aeruginosa PA01
cggcaggaccu

SEQ ID NO: 3387299 - RNA, 18 nt, Pseudomonas aeruginosa PA01
cggcaggaccucgggcga

SEQ ID NO: 3387300 - RNA, 11 nt, Pseudomonas aeruginosa PA01
cggcaggagca

SEQ ID NO: 3387301 - RNA, 15 nt, Pseudomonas aeruginosa PA01
cggcaggagcaugaa

SEQ ID NO: 3387302 - RNA, 12 nt, Pseudomonas aeruginosa PA01
cggcaggagcgu

SEQ ID NO: 3387303 - RNA, 17 nt, Pseudomonas aeruginosa PA01
cggcaggagcguugcgg

SEQ ID NO: 3387304 - RNA, 14 nt, Pseudomonas aeruginosa PA01
cggcaggaucaggc

SEQ ID NO: 3387305 - RNA, 19 nt, Pseudomonas aeruginosa PA01
cggcaggaucaggcucgag

SEQ ID NO: 3387306 - RNA, 20 nt, Pseudomonas aeruginosa PA01
cggcaggaucaggcucgagc

SEQ ID NO: 3387307 - RNA, 21 nt, Pseudomonas aeruginosa PA01
cggcaggaucaggcucgagcc

SEQ ID NO: 3387308 - RNA, 15 nt, Pseudomonas aeruginosa PA01
cggcaggaucggcgc

SEQ ID NO: 3387309 - RNA, 17 nt, Pseudomonas aeruginosa PA01
cggcaggaucggcgcgg

SEQ ID NO: 3387310 - RNA, 21 nt, Pseudomonas aeruginosa PA01
cggcaggaucggcgcggucgg

SEQ ID NO: 3387311 - RNA, 16 nt, Pseudomonas aeruginosa PA01
cggcaggcacgcugcc

SEQ ID NO: 3387312 - RNA, 18 nt, Pseudomonas aeruginosa PA01
cggcaggcacgcugccag

SEQ ID NO: 3387313 - RNA, 14 nt, Pseudomonas aeruginosa PA01
cggcaggcaggccu

SEQ ID NO: 3387314 - RNA, 15 nt, Pseudomonas aeruginosa PA01
cggcaggcaggccug

SEQ ID NO: 3387315 - RNA, 20 nt, Pseudomonas aeruginosa PA01
cggcaggcagugccgggcgu

SEQ ID NO: 3387316 - RNA, 13 nt, Pseudomonas aeruginosa PA01
cggcaggccagca

SEQ ID NO: 3387317 - RNA, 19 nt, Pseudomonas aeruginosa PA01
cggcaggccagcagguagc

SEQ ID NO: 3387318 - RNA, 23 nt, Pseudomonas aeruginosa PA01
cggcaggccagcuuccaggcgcg

SEQ ID NO: 3387319 - RNA, 12 nt, Pseudomonas aeruginosa PA01
cggcaggccgau

SEQ ID NO: 3387320 - RNA, 17 nt, Pseudomonas aeruginosa PA01
cggcaggccgauggccc

SEQ ID NO: 3387321 - RNA, 14 nt, Pseudomonas aeruginosa PA01
cggcaggccgaugu

SEQ ID NO: 3387322 - RNA, 20 nt, Pseudomonas aeruginosa PA01
cggcaggccgauguccucga

SEQ ID NO: 3387323 - RNA, 14 nt, Pseudomonas aeruginosa PA01
cggcaggccgccga

SEQ ID NO: 3387324 - RNA, 18 nt, Pseudomonas aeruginosa PA01
cggcaggccgccgauccc

SEQ ID NO: 3387325 - RNA, 17 nt, Pseudomonas aeruginosa PA01
cggcaggccguccuuga

SEQ ID NO: 3387326 - RNA, 18 nt, Pseudomonas aeruginosa PA01
cggcaggccuuccacgcc

SEQ ID NO: 3387327 - RNA, 19 nt, Pseudomonas aeruginosa PA01
cggcaggccuucggcgccg

SEQ ID NO: 3387328 - RNA, 14 nt, Pseudomonas aeruginosa PA01
cggcaggcgcacgc

SEQ ID NO: 3387329 - RNA, 17 nt, Pseudomonas aeruginosa PA01
cggcaggcgcacgcgca

SEQ ID NO: 3387330 - RNA, 18 nt, Pseudomonas aeruginosa PA01
cggcaggcgcaucaggcc

SEQ ID NO: 3387331 - RNA, 16 nt, Pseudomonas aeruginosa PA01
cggcaggcgccggccg

SEQ ID NO: 3387332 - RNA, 14 nt, Pseudomonas aeruginosa PA01
cggcaggcggcggc

SEQ ID NO: 3387333 - RNA, 16 nt, Pseudomonas aeruginosa PA01
cggcaggcucagcgca

SEQ ID NO: 3387334 - RNA, 17 nt, Pseudomonas aeruginosa PA01
cggcaggcucagcgcau

SEQ ID NO: 3387335 - RNA, 18 nt, Pseudomonas aeruginosa PA01
cggcaggcucagcgcaug

SEQ ID NO: 3387336 - RNA, 12 nt, Pseudomonas aeruginosa PA01
cggcaggcugca

SEQ ID NO: 3387337 - RNA, 15 nt, Pseudomonas aeruginosa PA01
cggcaggcugcaucg

SEQ ID NO: 3387338 - RNA, 16 nt, Pseudomonas aeruginosa PA01
cggcaggcugcaucgg

SEQ ID NO: 3387339 - RNA, 17 nt, Pseudomonas aeruginosa PA01
cggcaggcugcaucggc

SEQ ID NO: 3387340 - RNA, 21 nt, Pseudomonas aeruginosa PA01
cggcaggcugcaucggcucgg

SEQ ID NO: 3387341 - RNA, 19 nt, Pseudomonas aeruginosa PA01
cggcaggcugcgccgcugc

SEQ ID NO: 3387342 - RNA, 13 nt, Pseudomonas aeruginosa PA01
cggcaggcuggcg

SEQ ID NO: 3387343 - RNA, 19 nt, Pseudomonas aeruginosa PA01
cggcagggaucacgaagcg

SEQ ID NO: 3387344 - RNA, 16 nt, Pseudomonas aeruginosa PA01
cggcagggccagcgga

SEQ ID NO: 3387345 - RNA, 20 nt, Pseudomonas aeruginosa PA01
cggcagggccagcggaacga

SEQ ID NO: 3387346 - RNA, 16 nt, Pseudomonas aeruginosa PA01
cggcagggcgauccgc

SEQ ID NO: 3387347 - RNA, 20 nt, Pseudomonas aeruginosa PA01
cggcagggcgauccgcccgc

SEQ ID NO: 3387348 - RNA, 21 nt, Pseudomonas aeruginosa PA01
cggcagggcgauccgcccgca

SEQ ID NO: 3387349 - RNA, 13 nt, Pseudomonas aeruginosa PA01
cggcagggcgccc

SEQ ID NO: 3387350 - RNA, 14 nt, Pseudomonas aeruginosa PA01
cggcagggcgcccg

SEQ ID NO: 3387351 - RNA, 16 nt, Pseudomonas aeruginosa PA01
cggcagggcgcccgcc

SEQ ID NO: 3387352 - RNA, 21 nt, Pseudomonas aeruginosa PA01
cggcagggcgcccgcccggca

SEQ ID NO: 3387353 - RNA, 14 nt, Pseudomonas aeruginosa PA01
cggcagggcggcga

SEQ ID NO: 3387354 - RNA, 16 nt, Pseudomonas aeruginosa PA01
cggcagggcggcgaug

SEQ ID NO: 3387355 - RNA, 18 nt, Pseudomonas aeruginosa PA01
cggcagggcggcgaugac

SEQ ID NO: 3387356 - RNA, 20 nt, Pseudomonas aeruginosa PA01
cggcagggggucuucgaagg

SEQ ID NO: 3387357 - RNA, 18 nt, Pseudomonas aeruginosa PA01
cggcaggguacgggucgg

SEQ ID NO: 3387358 - RNA, 12 nt, Pseudomonas aeruginosa PA01
cggccaccagcg

SEQ ID NO: 3387359 - RNA, 18 nt, Pseudomonas aeruginosa PA01
cggccaccagcgaaagcg

SEQ ID NO: 3387360 - RNA, 22 nt, Pseudomonas aeruginosa PA01
cggccaccaucacgucgcgcac

SEQ ID NO: 3387361 - RNA, 20 nt, Pseudomonas aeruginosa PA01
cggccaccgacgcgcgcgca

SEQ ID NO: 3387362 - RNA, 14 nt, Pseudomonas aeruginosa PA01
cggccaccuucgcc

SEQ ID NO: 3387363 - RNA, 15 nt, Pseudomonas aeruginosa PA01
cggccacgcgaccag

SEQ ID NO: 3387364 - RNA, 16 nt, Pseudomonas aeruginosa PA01
cggccacgcgaccagc

SEQ ID NO: 3387365 - RNA, 17 nt, Pseudomonas aeruginosa PA01
cggccacgcgaccagcg

SEQ ID NO: 3387366 - RNA, 14 nt, Pseudomonas aeruginosa PA01
cggccacuaucgcc

SEQ ID NO: 3387367 - RNA, 14 nt, Pseudomonas aeruginosa PA01
cggccacuccagcc

SEQ ID NO: 3387368 - RNA, 15 nt, Pseudomonas aeruginosa PA01
cggccacuccagccc

SEQ ID NO: 3387369 - RNA, 19 nt, Pseudomonas aeruginosa PA01
cggccacuccagccccgcg

SEQ ID NO: 3387370 - RNA, 15 nt, Pseudomonas aeruginosa PA01
cggccacucgcagcc

SEQ ID NO: 3387371 - RNA, 17 nt, Pseudomonas aeruginosa PA01
cggccacucgcagccgc

SEQ ID NO: 3387372 - RNA, 19 nt, Pseudomonas aeruginosa PA01
cggccacucgcagccgcgc

SEQ ID NO: 3387373 - RNA, 20 nt, Pseudomonas aeruginosa PA01
cggccacucgcagccgcgcu

SEQ ID NO: 3387374 - RNA, 21 nt, Pseudomonas aeruginosa PA01
cggccacucgcagccgcgcuc

SEQ ID NO: 3387375 - RNA, 22 nt, Pseudomonas aeruginosa PA01
cggccacucgcagccgcgcucg

SEQ ID NO: 3387376 - RNA, 17 nt, Pseudomonas aeruginosa PA01
cggccacuucguccggc

SEQ ID NO: 3387377 - RNA, 18 nt, Pseudomonas aeruginosa PA01
cggccacuucguccggcc

SEQ ID NO: 3387378 - RNA, 19 nt, Pseudomonas aeruginosa PA01
cggccacuucguccggccg

SEQ ID NO: 3387379 - RNA, 23 nt, Pseudomonas aeruginosa PA01
cggccacuucguccggccgcccg

SEQ ID NO: 3387380 - RNA, 19 nt, Pseudomonas aeruginosa PA01
cggccagagcuucugcugg

SEQ ID NO: 3387381 - RNA, 19 nt, Pseudomonas aeruginosa PA01
cggccagcaaugcccgcgc

SEQ ID NO: 3387382 - RNA, 20 nt, Pseudomonas aeruginosa PA01
cggccagcaaugcccgcgcc

SEQ ID NO: 3387383 - RNA, 14 nt, Pseudomonas aeruginosa PA01
cggccagcaccuuc

SEQ ID NO: 3387384 - RNA, 13 nt, Pseudomonas aeruginosa PA01
cggccagcagcac

SEQ ID NO: 3387385 - RNA, 15 nt, Pseudomonas aeruginosa PA01
cggccagcagcacgg

SEQ ID NO: 3387386 - RNA, 16 nt, Pseudomonas aeruginosa PA01
cggccagcagcacggc

SEQ ID NO: 3387387 - RNA, 23 nt, Pseudomonas aeruginosa PA01
cggccagcagcacggcgacgaag

SEQ ID NO: 3387388 - RNA, 14 nt, Pseudomonas aeruginosa PA01
cggccagcagcaug

SEQ ID NO: 3387389 - RNA, 14 nt, Pseudomonas aeruginosa PA01
cggccagcagcgcc

SEQ ID NO: 3387390 - RNA, 16 nt, Pseudomonas aeruginosa PA01
cggccagcagcgccuc

SEQ ID NO: 3387391 - RNA, 17 nt, Pseudomonas aeruginosa PA01
cggccagcagcgccucc

SEQ ID NO: 3387392 - RNA, 19 nt, Pseudomonas aeruginosa PA01
cggccagcagcgccuccuc

SEQ ID NO: 3387393 - RNA, 20 nt, Pseudomonas aeruginosa PA01
cggccagcagcgccuccucu

SEQ ID NO: 3387394 - RNA, 17 nt, Pseudomonas aeruginosa PA01
cggccagcaggaugcug

SEQ ID NO: 3387395 - RNA, 13 nt, Pseudomonas aeruginosa PA01
cggccagccaggc

SEQ ID NO: 3387396 - RNA, 15 nt, Pseudomonas aeruginosa PA01
cggccagccagggca

SEQ ID NO: 3387397 - RNA, 17 nt, Pseudomonas aeruginosa PA01
cggccagccagggcagc

SEQ ID NO: 3387398 - RNA, 20 nt, Pseudomonas aeruginosa PA01
cggccagccagggcagcagg

SEQ ID NO: 3387399 - RNA, 15 nt, Pseudomonas aeruginosa PA01
cggccagccccugcg

SEQ ID NO: 3387400 - RNA, 15 nt, Pseudomonas aeruginosa PA01
cggccagcccggccu

SEQ ID NO: 3387401 - RNA, 16 nt, Pseudomonas aeruginosa PA01
cggccagcccggccuc

SEQ ID NO: 3387402 - RNA, 13 nt, Pseudomonas aeruginosa PA01
cggccagccgcgc

SEQ ID NO: 3387403 - RNA, 12 nt, Pseudomonas aeruginosa PA01
cggccagccgcu

SEQ ID NO: 3387404 - RNA, 14 nt, Pseudomonas aeruginosa PA01
cggccagccgcuag

SEQ ID NO: 3387405 - RNA, 16 nt, Pseudomonas aeruginosa PA01
cggccagccggcgccg

SEQ ID NO: 3387406 - RNA, 21 nt, Pseudomonas aeruginosa PA01
cggccagccuggccagcgcuu

SEQ ID NO: 3387407 - RNA, 17 nt, Pseudomonas aeruginosa PA01
cggccagccuucccggc

SEQ ID NO: 3387408 - RNA, 20 nt, Pseudomonas aeruginosa PA01
cggccagccuucccggcgcu

SEQ ID NO: 3387409 - RNA, 10 nt, Pseudomonas aeruginosa PA01
cggccagcgc

SEQ ID NO: 3387410 - RNA, 11 nt, Pseudomonas aeruginosa PA01
cggccagcgca

SEQ ID NO: 3387411 - RNA, 17 nt, Pseudomonas aeruginosa PA01
cggccagcgcaucgagg

SEQ ID NO: 3387412 - RNA, 19 nt, Pseudomonas aeruginosa PA01
cggccagcgcaucgaggcc

SEQ ID NO: 3387413 - RNA, 16 nt, Pseudomonas aeruginosa PA01
cggccagcgccacggc

SEQ ID NO: 3387414 - RNA, 17 nt, Pseudomonas aeruginosa PA01
cggccagcgccgccgcu

SEQ ID NO: 3387415 - RNA, 12 nt, Pseudomonas aeruginosa PA01
cggccagcgcgg

SEQ ID NO: 3387416 - RNA, 14 nt, Pseudomonas aeruginosa PA01
cggccagcgcggcc

SEQ ID NO: 3387417 - RNA, 15 nt, Pseudomonas aeruginosa PA01
cggccagcgcggccg

SEQ ID NO: 3387418 - RNA, 17 nt, Pseudomonas aeruginosa PA01
cggccagcgcggccgcc

SEQ ID NO: 3387419 - RNA, 19 nt, Pseudomonas aeruginosa PA01
cggccagcgcggccgccgc

SEQ ID NO: 3387420 - RNA, 16 nt, Pseudomonas aeruginosa PA01
cggccagcgcggcgcg

SEQ ID NO: 3387421 - RNA, 17 nt, Pseudomonas aeruginosa PA01
cggccagcgcggcgcgc

SEQ ID NO: 3387422 - RNA, 15 nt, Pseudomonas aeruginosa PA01
cggccagcgcggcgg

SEQ ID NO: 3387423 - RNA, 16 nt, Pseudomonas aeruginosa PA01
cggccagcgcggcgga

SEQ ID NO: 3387424 - RNA, 21 nt, Pseudomonas aeruginosa PA01
cggccagcggaugcuggcgga

SEQ ID NO: 3387425 - RNA, 15 nt, Pseudomonas aeruginosa PA01
cggccagcguccuuc

SEQ ID NO: 3387426 - RNA, 19 nt, Pseudomonas aeruginosa PA01
cggccagcguccuucggcg

SEQ ID NO: 3387427 - RNA, 21 nt, Pseudomonas aeruginosa PA01
cggccagcguccuucggcgcu

SEQ ID NO: 3387428 - RNA, 19 nt, Pseudomonas aeruginosa PA01
cggccagcgugaagaccug

SEQ ID NO: 3387429 - RNA, 21 nt, Pseudomonas aeruginosa PA01
cggccagcgugaagaccuggu

SEQ ID NO: 3387430 - RNA, 23 nt, Pseudomonas aeruginosa PA01
cggccagcgugaagaccuggucc

SEQ ID NO: 3387431 - RNA, 13 nt, Pseudomonas aeruginosa PA01
cggccagcuucuc

SEQ ID NO: 3387432 - RNA, 18 nt, Pseudomonas aeruginosa PA01
cggccagcuucuccagca

SEQ ID NO: 3387433 - RNA, 14 nt, Pseudomonas aeruginosa PA01
cggccaggaccagg

SEQ ID NO: 3387434 - RNA, 16 nt, Pseudomonas aeruginosa PA01
cggccaggacgccacc

SEQ ID NO: 3387435 - RNA, 19 nt, Pseudomonas aeruginosa PA01
cggccaggacgccaccagg

SEQ ID NO: 3387436 - RNA, 22 nt, Pseudomonas aeruginosa PA01
cggccaggacgccaccaggccg

SEQ ID NO: 3387437 - RNA, 17 nt, Pseudomonas aeruginosa PA01
cggccaggauguucgcc

SEQ ID NO: 3387438 - RNA, 19 nt, Pseudomonas aeruginosa PA01
cggccaggcauuccuccag

SEQ ID NO: 3387439 - RNA, 15 nt, Pseudomonas aeruginosa PA01
cggccaggccacggc

SEQ ID NO: 3387440 - RNA, 17 nt, Pseudomonas aeruginosa PA01
cggccaggccacggccg

SEQ ID NO: 3387441 - RNA, 19 nt, Pseudomonas aeruginosa PA01
cggccaggccacggccggc

SEQ ID NO: 3387442 - RNA, 20 nt, Pseudomonas aeruginosa PA01
cggccaggccacggccggcg

SEQ ID NO: 3387443 - RNA, 16 nt, Pseudomonas aeruginosa PA01
cggccaggccacggcg

SEQ ID NO: 3387444 - RNA, 18 nt, Pseudomonas aeruginosa PA01
cggccaggccacggcgga

SEQ ID NO: 3387445 - RNA, 16 nt, Pseudomonas aeruginosa PA01
cggccaggcccacgcc

SEQ ID NO: 3387446 - RNA, 17 nt, Pseudomonas aeruginosa PA01
cggccaggcccacgccg

SEQ ID NO: 3387447 - RNA, 18 nt, Pseudomonas aeruginosa PA01
cggccaggcccacgccga

SEQ ID NO: 3387448 - RNA, 19 nt, Pseudomonas aeruginosa PA01
cggccaggcccucagcggc

SEQ ID NO: 3387449 - RNA, 12 nt, Pseudomonas aeruginosa PA01
cggccaggccgc

SEQ ID NO: 3387450 - RNA, 14 nt, Pseudomonas aeruginosa PA01
cggccaggccgccc

SEQ ID NO: 3387451 - RNA, 14 nt, Pseudomonas aeruginosa PA01
cggccaggcgaaug

SEQ ID NO: 3387452 - RNA, 20 nt, Pseudomonas aeruginosa PA01
cggccaggcgaauggaggga

SEQ ID NO: 3387453 - RNA, 14 nt, Pseudomonas aeruginosa PA01
cggccaggcgccag

SEQ ID NO: 3387454 - RNA, 15 nt, Pseudomonas aeruginosa PA01
cggccaggcgccagg

SEQ ID NO: 3387455 - RNA, 21 nt, Pseudomonas aeruginosa PA01
cggccaggcgccagggccggg

SEQ ID NO: 3387456 - RNA, 22 nt, Pseudomonas aeruginosa PA01
cggccaggcgccagggccgggu

SEQ ID NO: 3387457 - RNA, 23 nt, Pseudomonas aeruginosa PA01
cggccaggcgccagggccggguc

SEQ ID NO: 3387458 - RNA, 17 nt, Pseudomonas aeruginosa PA01
cggccaggcgcggcgcc

SEQ ID NO: 3387459 - RNA, 15 nt, Pseudomonas aeruginosa PA01
cggccaggcggccga

SEQ ID NO: 3387460 - RNA, 16 nt, Pseudomonas aeruginosa PA01
cggccaggcggccgac

SEQ ID NO: 3387461 - RNA, 20 nt, Pseudomonas aeruginosa PA01
cggcccagccgcggcgccac

SEQ ID NO: 3387462 - RNA, 14 nt, Pseudomonas aeruginosa PA01
cggcccagcgcccc

SEQ ID NO: 3387463 - RNA, 15 nt, Pseudomonas aeruginosa PA01
cggcccagcgccccg

SEQ ID NO: 3387464 - RNA, 16 nt, Pseudomonas aeruginosa PA01
cggcccagcgccccgc

SEQ ID NO: 3387465 - RNA, 19 nt, Pseudomonas aeruginosa PA01
cggcccagcggcaggucgu

SEQ ID NO: 3387466 - RNA, 20 nt, Pseudomonas aeruginosa PA01
cggcccagcguucggcgcug

SEQ ID NO: 3387467 - RNA, 12 nt, Pseudomonas aeruginosa PA01
cggcccaggccg

SEQ ID NO: 3387468 - RNA, 13 nt, Pseudomonas aeruginosa PA01
cggcccaggccgg

SEQ ID NO: 3387469 - RNA, 14 nt, Pseudomonas aeruginosa PA01
cggcccaggccggg

SEQ ID NO: 3387470 - RNA, 15 nt, Pseudomonas aeruginosa PA01
cggcccaggccgggu

SEQ ID NO: 3387471 - RNA, 14 nt, Pseudomonas aeruginosa PA01
cggcccauccgccg

SEQ ID NO: 3387472 - RNA, 14 nt, Pseudomonas aeruginosa PA01
cggcccaugcggau

SEQ ID NO: 3387473 - RNA, 18 nt, Pseudomonas aeruginosa PA01
cggcccaugcggaucgcc

SEQ ID NO: 3387474 - RNA, 13 nt, Pseudomonas aeruginosa PA01
cggcccauggcga

SEQ ID NO: 3387475 - RNA, 14 nt, Pseudomonas aeruginosa PA01
cggcccauggcgac

SEQ ID NO: 3387476 - RNA, 15 nt, Pseudomonas aeruginosa PA01
cggcccauggcgacg

SEQ ID NO: 3387477 - RNA, 16 nt, Pseudomonas aeruginosa PA01
cggcccauggcgacgc

SEQ ID NO: 3387478 - RNA, 19 nt, Pseudomonas aeruginosa PA01
cggccccaaggggccgcgc

SEQ ID NO: 3387479 - RNA, 20 nt, Pseudomonas aeruginosa PA01
cggccccaaggggccgcgcu

SEQ ID NO: 3387480 - RNA, 13 nt, Pseudomonas aeruginosa PA01
cggccccaccagc

SEQ ID NO: 3387481 - RNA, 15 nt, Pseudomonas aeruginosa PA01
cggccccaccgcacu

SEQ ID NO: 3387482 - RNA, 23 nt, Pseudomonas aeruginosa PA01
cggccccaccgcacugguggcga

SEQ ID NO: 3387483 - RNA, 20 nt, Pseudomonas aeruginosa PA01
cggccccaccuggcgacagg

SEQ ID NO: 3387484 - RNA, 19 nt, Pseudomonas aeruginosa PA01
cggccccaggcugcccagg

SEQ ID NO: 3387485 - RNA, 15 nt, Pseudomonas aeruginosa PA01
cggccccgagcgggc

SEQ ID NO: 3387486 - RNA, 22 nt, Pseudomonas aeruginosa PA01
cggccccgcgguacccggcagg

SEQ ID NO: 3387487 - RNA, 12 nt, Pseudomonas aeruginosa PA01
cggccccggcca

SEQ ID NO: 3387488 - RNA, 14 nt, Pseudomonas aeruginosa PA01
cggccccggccagg

SEQ ID NO: 3387489 - RNA, 18 nt, Pseudomonas aeruginosa PA01
cggccccggccagguacc

SEQ ID NO: 3387490 - RNA, 13 nt, Pseudomonas aeruginosa PA01
cggccccugggcc

SEQ ID NO: 3387491 - RNA, 14 nt, Pseudomonas aeruginosa PA01
cggccccugggccg

SEQ ID NO: 3387492 - RNA, 21 nt, Pseudomonas aeruginosa PA01
cggccccuucagcuccagcag

SEQ ID NO: 3387493 - RNA, 16 nt, Pseudomonas aeruginosa PA01
cggcccgacgccgccc

SEQ ID NO: 3387494 - RNA, 18 nt, Pseudomonas aeruginosa PA01
cggcccgacgccgcccgg

SEQ ID NO: 3387495 - RNA, 20 nt, Pseudomonas aeruginosa PA01
cggcccgacgccgcccggca

SEQ ID NO: 3387496 - RNA, 13 nt, Pseudomonas aeruginosa PA01
cggcccgagcagg

SEQ ID NO: 3387497 - RNA, 14 nt, Pseudomonas aeruginosa PA01
cggcccgagcaggc

SEQ ID NO: 3387498 - RNA, 15 nt, Pseudomonas aeruginosa PA01
cggcccgagcaggcu

SEQ ID NO: 3387499 - RNA, 16 nt, Pseudomonas aeruginosa PA01
cggcccgagcaggcug

SEQ ID NO: 3387500 - RNA, 14 nt, Pseudomonas aeruginosa PA01
cggcccgagggcgg

SEQ ID NO: 3387501 - RNA, 15 nt, Pseudomonas aeruginosa PA01
cggcccgagggcggc

SEQ ID NO: 3387502 - RNA, 19 nt, Pseudomonas aeruginosa PA01
cggcccgagggcggcaggg

SEQ ID NO: 3387503 - RNA, 21 nt, Pseudomonas aeruginosa PA01
cggcccgagggcggcaggggg

SEQ ID NO: 3387504 - RNA, 17 nt, Pseudomonas aeruginosa PA01
cggcccgcacagguaga

SEQ ID NO: 3387505 - RNA, 13 nt, Pseudomonas aeruginosa PA01
cggcccgcagauc

SEQ ID NO: 3387506 - RNA, 17 nt, Pseudomonas aeruginosa PA01
cggcccgcaugaacgcc

SEQ ID NO: 3387507 - RNA, 20 nt, Pseudomonas aeruginosa PA01
cggcccgcaugaacgccucg

SEQ ID NO: 3387508 - RNA, 23 nt, Pseudomonas aeruginosa PA01
cggcccgcaugaacgccucgcca

SEQ ID NO: 3387509 - RNA, 17 nt, Pseudomonas aeruginosa PA01
cggcccgccccgcaagg

SEQ ID NO: 3387510 - RNA, 15 nt, Pseudomonas aeruginosa PA01
cggcccgccgccggg

SEQ ID NO: 3387511 - RNA, 16 nt, Pseudomonas aeruginosa PA01
cggcccgccgccgggg

SEQ ID NO: 3387512 - RNA, 14 nt, Pseudomonas aeruginosa PA01
cggcccgccggcga

SEQ ID NO: 3387513 - RNA, 15 nt, Pseudomonas aeruginosa PA01
cggcccgccucggcg

SEQ ID NO: 3387514 - RNA, 17 nt, Pseudomonas aeruginosa PA01
cggcccgccucggcggc

SEQ ID NO: 3387515 - RNA, 14 nt, Pseudomonas aeruginosa PA01
cggcccgcgccaug

SEQ ID NO: 3387516 - RNA, 14 nt, Pseudomonas aeruginosa PA01
cggcccgcgccgcc

SEQ ID NO: 3387517 - RNA, 16 nt, Pseudomonas aeruginosa PA01
cggcccgcgccgccuc

SEQ ID NO: 3387518 - RNA, 17 nt, Pseudomonas aeruginosa PA01
cggcccgcgccgccucg

SEQ ID NO: 3387519 - RNA, 23 nt, Pseudomonas aeruginosa PA01
cggcccgcgccgccucgauggcg

SEQ ID NO: 3387520 - RNA, 13 nt, Pseudomonas aeruginosa PA01
cggcccgcgcggc

SEQ ID NO: 3387521 - RNA, 14 nt, Pseudomonas aeruginosa PA01
cggcccgcgcggca

SEQ ID NO: 3387522 - RNA, 17 nt, Pseudomonas aeruginosa PA01
cggcccgcggaucgcgc

SEQ ID NO: 3387523 - RNA, 22 nt, Pseudomonas aeruginosa PA01
cggcccgcggucacucggccuc

SEQ ID NO: 3387524 - RNA, 17 nt, Pseudomonas aeruginosa PA01
cggcccggaagcucugc

SEQ ID NO: 3387525 - RNA, 18 nt, Pseudomonas aeruginosa PA01
cggcccggaagcucugca

SEQ ID NO: 3387526 - RNA, 17 nt, Pseudomonas aeruginosa PA01
cggcccggagaccgugc

SEQ ID NO: 3387527 - RNA, 19 nt, Pseudomonas aeruginosa PA01
cggcccggagaucgccgcg

SEQ ID NO: 3387528 - RNA, 20 nt, Pseudomonas aeruginosa PA01
cggcccggagaucgccgcgc

SEQ ID NO: 3387529 - RNA, 20 nt, Pseudomonas aeruginosa PA01
cggcccggagcgcgaggcga

SEQ ID NO: 3387530 - RNA, 21 nt, Pseudomonas aeruginosa PA01
cggcccggagcgcgaggcgag

SEQ ID NO: 3387531 - RNA, 13 nt, Pseudomonas aeruginosa PA01
cggcccggcaggc

SEQ ID NO: 3387532 - RNA, 14 nt, Pseudomonas aeruginosa PA01
cggcccggcaggcg

SEQ ID NO: 3387533 - RNA, 16 nt, Pseudomonas aeruginosa PA01
cggcccggcaggcgca

SEQ ID NO: 3387534 - RNA, 19 nt, Pseudomonas aeruginosa PA01
cggcccggccaggcgauag

SEQ ID NO: 3387535 - RNA, 14 nt, Pseudomonas aeruginosa PA01
cggcccggccaggu

SEQ ID NO: 3387536 - RNA, 15 nt, Pseudomonas aeruginosa PA01
cggcccggccauccu

SEQ ID NO: 3387537 - RNA, 14 nt, Pseudomonas aeruginosa PA01
cggcccggcgcugc

SEQ ID NO: 3387538 - RNA, 16 nt, Pseudomonas aeruginosa PA01
cggcccggcgcugccc

SEQ ID NO: 3387539 - RNA, 18 nt, Pseudomonas aeruginosa PA01
cggcccggcgcugcccgg

SEQ ID NO: 3387540 - RNA, 19 nt, Pseudomonas aeruginosa PA01
cggcccggcgcugcccggg

SEQ ID NO: 3387541 - RNA, 13 nt, Pseudomonas aeruginosa PA01
cggcccgggcgcc

SEQ ID NO: 3387542 - RNA, 23 nt, Pseudomonas aeruginosa PA01
cggcccgggcguuggcuccgggc

SEQ ID NO: 3387543 - RNA, 22 nt, Pseudomonas aeruginosa PA01
cggcccgggucacggucagcuc

SEQ ID NO: 3387544 - RNA, 19 nt, Pseudomonas aeruginosa PA01
cggcccggucagcuucgcc

SEQ ID NO: 3387545 - RNA, 22 nt, Pseudomonas aeruginosa PA01
cggcccggucagcuucgccgcc

SEQ ID NO: 3387546 - RNA, 20 nt, Pseudomonas aeruginosa PA01
cggcccguccgcgccacggg

SEQ ID NO: 3387547 - RNA, 22 nt, Pseudomonas aeruginosa PA01
cggcccguggcuggggccggcc

SEQ ID NO: 3387548 - RNA, 12 nt, Pseudomonas aeruginosa PA01
cggcccuccggc

SEQ ID NO: 3387549 - RNA, 13 nt, Pseudomonas aeruginosa PA01
cggcccugcgccg

SEQ ID NO: 3387550 - RNA, 15 nt, Pseudomonas aeruginosa PA01
cggcccugcucgccg

SEQ ID NO: 3387551 - RNA, 18 nt, Pseudomonas aeruginosa PA01
cggcccugcucgccggcg

SEQ ID NO: 3387552 - RNA, 20 nt, Pseudomonas aeruginosa PA01
cggcccugcucgccggcgcg

SEQ ID NO: 3387553 - RNA, 22 nt, Pseudomonas aeruginosa PA01
cggcccugcucgccggcgcggg

SEQ ID NO: 3387554 - RNA, 14 nt, Pseudomonas aeruginosa PA01
cggcccuggcggcg

SEQ ID NO: 3387555 - RNA, 19 nt, Pseudomonas aeruginosa PA01
cggcccuggcggcgaaaug

SEQ ID NO: 3387556 - RNA, 17 nt, Pseudomonas aeruginosa PA01
cggcccuucacgagacc

SEQ ID NO: 3387557 - RNA, 15 nt, Pseudomonas aeruginosa PA01
cggcccuucgacgac

SEQ ID NO: 3387558 - RNA, 20 nt, Pseudomonas aeruginosa PA01
cggcccuugucgccgcuggg

SEQ ID NO: 3387559 - RNA, 21 nt, Pseudomonas aeruginosa PA01
cggcccuugucgccgcugggc

SEQ ID NO: 3387560 - RNA, 22 nt, Pseudomonas aeruginosa PA01
cggcccuugucgccgcugggca

SEQ ID NO: 3387561 - RNA, 19 nt, Pseudomonas aeruginosa PA01
cggcccuuguucgcggcga

SEQ ID NO: 3387562 - RNA, 21 nt, Pseudomonas aeruginosa PA01
cggcccuuguucgcggcgaug

SEQ ID NO: 3387563 - RNA, 20 nt, Pseudomonas aeruginosa PA01
cggccgaacagacgcaggca

SEQ ID NO: 3387564 - RNA, 13 nt, Pseudomonas aeruginosa PA01
cggccgcugccgg

SEQ ID NO: 3387565 - RNA, 14 nt, Pseudomonas aeruginosa PA01
cggccgcugccggg

SEQ ID NO: 3387566 - RNA, 14 nt, Pseudomonas aeruginosa PA01
cggccgcugcgcag

SEQ ID NO: 3387567 - RNA, 16 nt, Pseudomonas aeruginosa PA01
cggccgcugcgcaggc

SEQ ID NO: 3387568 - RNA, 17 nt, Pseudomonas aeruginosa PA01
cggccgcugcgcaggcc

SEQ ID NO: 3387569 - RNA, 18 nt, Pseudomonas aeruginosa PA01
cggccgcugcgcaggccg

SEQ ID NO: 3387570 - RNA, 19 nt, Pseudomonas aeruginosa PA01
cggccgcugcgcaggccga

SEQ ID NO: 3387571 - RNA, 21 nt, Pseudomonas aeruginosa PA01
cggccgcugcgcaggccgaga

SEQ ID NO: 3387572 - RNA, 13 nt, Pseudomonas aeruginosa PA01
cggccgcuggcga

SEQ ID NO: 3387573 - RNA, 23 nt, Pseudomonas aeruginosa PA01
cggccgcuugaucuuguccugga

SEQ ID NO: 3387574 - RNA, 20 nt, Pseudomonas aeruginosa PA01
cggccggaggggaugugcuc

SEQ ID NO: 3387575 - RNA, 17 nt, Pseudomonas aeruginosa PA01
cggccggauggccgccg

SEQ ID NO: 3387576 - RNA, 14 nt, Pseudomonas aeruginosa PA01
cggccggcagcgag

SEQ ID NO: 3387577 - RNA, 15 nt, Pseudomonas aeruginosa PA01
cggccggcagcuccg

SEQ ID NO: 3387578 - RNA, 16 nt, Pseudomonas aeruginosa PA01
cggccggcagcuccgg

SEQ ID NO: 3387579 - RNA, 17 nt, Pseudomonas aeruginosa PA01
cggccggcagcuccggc

SEQ ID NO: 3387580 - RNA, 18 nt, Pseudomonas aeruginosa PA01
cggccggcagcuccggcg

SEQ ID NO: 3387581 - RNA, 14 nt, Pseudomonas aeruginosa PA01
cggccggcaggccg

SEQ ID NO: 3387582 - RNA, 15 nt, Pseudomonas aeruginosa PA01
cggccggcaggccga

SEQ ID NO: 3387583 - RNA, 16 nt, Pseudomonas aeruginosa PA01
cggccggcaggccgau

SEQ ID NO: 3387584 - RNA, 14 nt, Pseudomonas aeruginosa PA01
cggccggcaggcug

SEQ ID NO: 3387585 - RNA, 19 nt, Pseudomonas aeruginosa PA01
cggccggcaggcugugcca

SEQ ID NO: 3387586 - RNA, 20 nt, Pseudomonas aeruginosa PA01
cggccggccacgcgaccagc

SEQ ID NO: 3387587 - RNA, 21 nt, Pseudomonas aeruginosa PA01
cggccggccacgcgaccagcg

SEQ ID NO: 3387588 - RNA, 12 nt, Pseudomonas aeruginosa PA01
cggccggccagg

SEQ ID NO: 3387589 - RNA, 14 nt, Pseudomonas aeruginosa PA01
cggccggcgaggcg

SEQ ID NO: 3387590 - RNA, 15 nt, Pseudomonas aeruginosa PA01
cggccggcgcagucg

SEQ ID NO: 3387591 - RNA, 14 nt, Pseudomonas aeruginosa PA01
cggccggcgccgcg

SEQ ID NO: 3387592 - RNA, 15 nt, Pseudomonas aeruginosa PA01
cggccggcgcggcgc

SEQ ID NO: 3387593 - RNA, 17 nt, Pseudomonas aeruginosa PA01
cggccggcgcggcgcgu

SEQ ID NO: 3387594 - RNA, 20 nt, Pseudomonas aeruginosa PA01
cggccggcgcggcgcguucc

SEQ ID NO: 3387595 - RNA, 14 nt, Pseudomonas aeruginosa PA01
cggccggcggccug

SEQ ID NO: 3387596 - RNA, 21 nt, Pseudomonas aeruginosa PA01
cggccggcggccugagccggc

SEQ ID NO: 3387597 - RNA, 21 nt, Pseudomonas aeruginosa PA01
cggccggcggugagggcgacg

SEQ ID NO: 3387598 - RNA, 14 nt, Pseudomonas aeruginosa PA01
cggccggcucagaa

SEQ ID NO: 3387599 - RNA, 19 nt, Pseudomonas aeruginosa PA01
cggccggcucagcgcuucg

SEQ ID NO: 3387600 - RNA, 20 nt, Pseudomonas aeruginosa PA01
cggccggcuucuacgccuug

SEQ ID NO: 3387601 - RNA, 19 nt, Pseudomonas aeruginosa PA01
cggccgggauacagcagcc

SEQ ID NO: 3387602 - RNA, 14 nt, Pseudomonas aeruginosa PA01
cggccggggaacag

SEQ ID NO: 3387603 - RNA, 15 nt, Pseudomonas aeruginosa PA01
cggccggggccggca

SEQ ID NO: 3387604 - RNA, 19 nt, Pseudomonas aeruginosa PA01
cggccggggccggcacccg

SEQ ID NO: 3387605 - RNA, 14 nt, Pseudomonas aeruginosa PA01
cggccggggcggau

SEQ ID NO: 3387606 - RNA, 15 nt, Pseudomonas aeruginosa PA01
cggccggggucaggc

SEQ ID NO: 3387607 - RNA, 18 nt, Pseudomonas aeruginosa PA01
cggccggggucaggccga

SEQ ID NO: 3387608 - RNA, 22 nt, Pseudomonas aeruginosa PA01
cggccggggucaggccgaggcg

SEQ ID NO: 3387609 - RNA, 15 nt, Pseudomonas aeruginosa PA01
cggccgggucgaggu

SEQ ID NO: 3387610 - RNA, 19 nt, Pseudomonas aeruginosa PA01
cggccgggucgaggucgag

SEQ ID NO: 3387611 - RNA, 18 nt, Pseudomonas aeruginosa PA01
cggccgguagucggggca

SEQ ID NO: 3387612 - RNA, 13 nt, Pseudomonas aeruginosa PA01
cggccggugccuu

SEQ ID NO: 3387613 - RNA, 21 nt, Pseudomonas aeruginosa PA01
cggccggugccuucggcggcg

SEQ ID NO: 3387614 - RNA, 18 nt, Pseudomonas aeruginosa PA01
cggccguagccgucgaac

SEQ ID NO: 3387615 - RNA, 15 nt, Pseudomonas aeruginosa PA01
cggccgucacggccu

SEQ ID NO: 3387616 - RNA, 17 nt, Pseudomonas aeruginosa PA01
cggccgucacggccucc

SEQ ID NO: 3387617 - RNA, 18 nt, Pseudomonas aeruginosa PA01
cggccgucacggccuccg

SEQ ID NO: 3387618 - RNA, 17 nt, Pseudomonas aeruginosa PA01
cggccgucccagguugg

SEQ ID NO: 3387619 - RNA, 16 nt, Pseudomonas aeruginosa PA01
cggccgucccagucgg

SEQ ID NO: 3387620 - RNA, 18 nt, Pseudomonas aeruginosa PA01
cggccgucccagucggcg

SEQ ID NO: 3387621 - RNA, 22 nt, Pseudomonas aeruginosa PA01
cggccgucccagucggcguccg

SEQ ID NO: 3387622 - RNA, 16 nt, Pseudomonas aeruginosa PA01
cggccgucgcgcacca

SEQ ID NO: 3387623 - RNA, 13 nt, Pseudomonas aeruginosa PA01
cggccgucggccu

SEQ ID NO: 3387624 - RNA, 16 nt, Pseudomonas aeruginosa PA01
cggccgucggccuggc

SEQ ID NO: 3387625 - RNA, 17 nt, Pseudomonas aeruginosa PA01
cggccgucggccuggcg

SEQ ID NO: 3387626 - RNA, 19 nt, Pseudomonas aeruginosa PA01
cggccgugcaugccgacga

SEQ ID NO: 3387627 - RNA, 21 nt, Pseudomonas aeruginosa PA01
cggccgugcaugccgacgagc

SEQ ID NO: 3387628 - RNA, 22 nt, Pseudomonas aeruginosa PA01
cggccgugcaugccgacgagca

SEQ ID NO: 3387629 - RNA, 18 nt, Pseudomonas aeruginosa PA01
cggccgugugccugagcu

SEQ ID NO: 3387630 - RNA, 22 nt, Pseudomonas aeruginosa PA01
cggccgugugccugagcuggcu

SEQ ID NO: 3387631 - RNA, 21 nt, Pseudomonas aeruginosa PA01
cggccguucuccgggucgggc

SEQ ID NO: 3387632 - RNA, 16 nt, Pseudomonas aeruginosa PA01
cggccguugcgggcga

SEQ ID NO: 3387633 - RNA, 20 nt, Pseudomonas aeruginosa PA01
cggccuacgguacaguucag

SEQ ID NO: 3387634 - RNA, 16 nt, Pseudomonas aeruginosa PA01
cggccucaacgaccgc

SEQ ID NO: 3387635 - RNA, 17 nt, Pseudomonas aeruginosa PA01
cggccucaacgaccgcc

SEQ ID NO: 3387636 - RNA, 22 nt, Pseudomonas aeruginosa PA01
cggccucaacgaccgcccaggc

SEQ ID NO: 3387637 - RNA, 14 nt, Pseudomonas aeruginosa PA01
cggccucaggccug

SEQ ID NO: 3387638 - RNA, 17 nt, Pseudomonas aeruginosa PA01
cggccucaggccuggcg

SEQ ID NO: 3387639 - RNA, 17 nt, Pseudomonas aeruginosa PA01
cggccuccagcacucgc

SEQ ID NO: 3387640 - RNA, 22 nt, Pseudomonas aeruginosa PA01
cggccuccagcacucgcuccuc

SEQ ID NO: 3387641 - RNA, 13 nt, Pseudomonas aeruginosa PA01
cggccuccagcgc

SEQ ID NO: 3387642 - RNA, 14 nt, Pseudomonas aeruginosa PA01
cggccuccagcgcc

SEQ ID NO: 3387643 - RNA, 15 nt, Pseudomonas aeruginosa PA01
cggccuccagcgccu

SEQ ID NO: 3387644 - RNA, 18 nt, Pseudomonas aeruginosa PA01
cggccuccagcgccucgc

SEQ ID NO: 3387645 - RNA, 20 nt, Pseudomonas aeruginosa PA01
cggccuccagcgccucgccg

SEQ ID NO: 3387646 - RNA, 17 nt, Pseudomonas aeruginosa PA01
cggccuccagcgccugg

SEQ ID NO: 3387647 - RNA, 15 nt, Pseudomonas aeruginosa PA01
cggccuccaggcugg

SEQ ID NO: 3387648 - RNA, 17 nt, Pseudomonas aeruginosa PA01
cggccuccaggcuggcc

SEQ ID NO: 3387649 - RNA, 21 nt, Pseudomonas aeruginosa PA01
cggccuccaggcuggccuugg

SEQ ID NO: 3387650 - RNA, 17 nt, Pseudomonas aeruginosa PA01
cggccuccccggcccgc

SEQ ID NO: 3387651 - RNA, 12 nt, Pseudomonas aeruginosa PA01
cggccucgacgc

SEQ ID NO: 3387652 - RNA, 24 nt, Pseudomonas aeruginosa PA01
cggccucgacgcagagcgccauga

SEQ ID NO: 3387653 - RNA, 13 nt, Pseudomonas aeruginosa PA01
cggccucgagcau

SEQ ID NO: 3387654 - RNA, 19 nt, Pseudomonas aeruginosa PA01
cggccucgagcaucuccgg

SEQ ID NO: 3387655 - RNA, 21 nt, Pseudomonas aeruginosa PA01
cggccucgagcaucuccggca

SEQ ID NO: 3387656 - RNA, 17 nt, Pseudomonas aeruginosa PA01
cggccucgaggaacagg

SEQ ID NO: 3387657 - RNA, 19 nt, Pseudomonas aeruginosa PA01
cggccucgaggucggccug

SEQ ID NO: 3387658 - RNA, 20 nt, Pseudomonas aeruginosa PA01
cggccucgaggucggccugg

SEQ ID NO: 3387659 - RNA, 21 nt, Pseudomonas aeruginosa PA01
cggccucgaggucggccuggc

SEQ ID NO: 3387660 - RNA, 23 nt, Pseudomonas aeruginosa PA01
cggccucgaggucggccuggcug

SEQ ID NO: 3387661 - RNA, 19 nt, Pseudomonas aeruginosa PA01
cggccucgaucucguccuc

SEQ ID NO: 3387662 - RNA, 22 nt, Pseudomonas aeruginosa PA01
cggccucgaucucguccucggc

SEQ ID NO: 3387663 - RNA, 23 nt, Pseudomonas aeruginosa PA01
cggccucgaucucguccucggcg

SEQ ID NO: 3387664 - RNA, 18 nt, Pseudomonas aeruginosa PA01
cggccucgccugcggcgc

SEQ ID NO: 3387665 - RNA, 19 nt, Pseudomonas aeruginosa PA01
cggccucgccugcggcgcc

SEQ ID NO: 3387666 - RNA, 20 nt, Pseudomonas aeruginosa PA01
cggccugguuguaggcgccg

SEQ ID NO: 3387667 - RNA, 16 nt, Pseudomonas aeruginosa PA01
cggccuguaccgcuuc

SEQ ID NO: 3387668 - RNA, 17 nt, Pseudomonas aeruginosa PA01
cggccuguaccgcuucc

SEQ ID NO: 3387669 - RNA, 20 nt, Pseudomonas aeruginosa PA01
cggccuguaccgcuuccugg

SEQ ID NO: 3387670 - RNA, 22 nt, Pseudomonas aeruginosa PA01
cggccuguaccgcuuccugggc

SEQ ID NO: 3387671 - RNA, 16 nt, Pseudomonas aeruginosa PA01
cggccugucacgccgg

SEQ ID NO: 3387672 - RNA, 19 nt, Pseudomonas aeruginosa PA01
cggccugucacgccggggg

SEQ ID NO: 3387673 - RNA, 17 nt, Pseudomonas aeruginosa PA01
cggccuguucgcccaag

SEQ ID NO: 3387674 - RNA, 18 nt, Pseudomonas aeruginosa PA01
cggccuguucgcccaagg

SEQ ID NO: 3387675 - RNA, 19 nt, Pseudomonas aeruginosa PA01
cggccuguucgcccaaggc

SEQ ID NO: 3387676 - RNA, 21 nt, Pseudomonas aeruginosa PA01
cggccuguucgcccaaggcca

SEQ ID NO: 3387677 - RNA, 22 nt, Pseudomonas aeruginosa PA01
cggccuguucgcccaaggccag

SEQ ID NO: 3387678 - RNA, 16 nt, Pseudomonas aeruginosa PA01
cggccuguucggccuu

SEQ ID NO: 3387679 - RNA, 18 nt, Pseudomonas aeruginosa PA01
cggccuguuuccagaagg

SEQ ID NO: 3387680 - RNA, 14 nt, Pseudomonas aeruginosa PA01
cggccuucaccgcg

SEQ ID NO: 3387681 - RNA, 20 nt, Pseudomonas aeruginosa PA01
cggccuucaccgcgccgcgc

SEQ ID NO: 3387682 - RNA, 22 nt, Pseudomonas aeruginosa PA01
cggccuucagcgguggcguugu

SEQ ID NO: 3387683 - RNA, 13 nt, Pseudomonas aeruginosa PA01
cggccuucgacga

SEQ ID NO: 3387684 - RNA, 13 nt, Pseudomonas aeruginosa PA01
cggccuucggcag

SEQ ID NO: 3387685 - RNA, 18 nt, Pseudomonas aeruginosa PA01
cggccuucggcgucgaag

SEQ ID NO: 3387686 - RNA, 19 nt, Pseudomonas aeruginosa PA01
cggccuucucgucgccgcc

SEQ ID NO: 3387687 - RNA, 21 nt, Pseudomonas aeruginosa PA01
cggccuucucgucgccgcccg

SEQ ID NO: 3387688 - RNA, 22 nt, Pseudomonas aeruginosa PA01
cggccuucucgucgccgcccgg

SEQ ID NO: 3387689 - RNA, 23 nt, Pseudomonas aeruginosa PA01
cggccuucucgucgccgcccggc

SEQ ID NO: 3387690 - RNA, 24 nt, Pseudomonas aeruginosa PA01
cggccuucucgucgccgcccggca

SEQ ID NO: 3387691 - RNA, 16 nt, Pseudomonas aeruginosa PA01
cggccuucuugcugcc

SEQ ID NO: 3387692 - RNA, 17 nt, Pseudomonas aeruginosa PA01
cggccuucuugcugccg

SEQ ID NO: 3387693 - RNA, 16 nt, Pseudomonas aeruginosa PA01
cggccuugagcgccga

SEQ ID NO: 3387694 - RNA, 21 nt, Pseudomonas aeruginosa PA01
cggccuugagcgccgaaggcg

SEQ ID NO: 3387695 - RNA, 19 nt, Pseudomonas aeruginosa PA01
cggccuugaggcgggccag

SEQ ID NO: 3387696 - RNA, 22 nt, Pseudomonas aeruginosa PA01
cggccuugcucuugaggucggc

SEQ ID NO: 3387697 - RNA, 16 nt, Pseudomonas aeruginosa PA01
cggccuugcuggcgac

SEQ ID NO: 3387698 - RNA, 20 nt, Pseudomonas aeruginosa PA01
cggccuugcuuugcgccucg

SEQ ID NO: 3387699 - RNA, 22 nt, Pseudomonas aeruginosa PA01
cggccuugcuuugcgccucgcg

SEQ ID NO: 3387700 - RNA, 19 nt, Pseudomonas aeruginosa PA01
cggccuuggucucgcgggc

SEQ ID NO: 3387701 - RNA, 23 nt, Pseudomonas aeruginosa PA01
cggccuuggucucgcgggcgacg

SEQ ID NO: 3387702 - RNA, 21 nt, Pseudomonas aeruginosa PA01
cggccuuguagaguuugccga

SEQ ID NO: 3387703 - RNA, 17 nt, Pseudomonas aeruginosa PA01
cggccuuguccgcgcgc

SEQ ID NO: 3387704 - RNA, 18 nt, Pseudomonas aeruginosa PA01
cggccuuguccggcacca

SEQ ID NO: 3387705 - RNA, 15 nt, Pseudomonas aeruginosa PA01
cggccuuuucggcgg

SEQ ID NO: 3387706 - RNA, 20 nt, Pseudomonas aeruginosa PA01
cggccuuuucggcggccagg

SEQ ID NO: 3387707 - RNA, 16 nt, Pseudomonas aeruginosa PA01
cggccuuuucucugca

SEQ ID NO: 3387708 - RNA, 19 nt, Pseudomonas aeruginosa PA01
cggccuuuucucugcaucu

SEQ ID NO: 3387709 - RNA, 15 nt, Pseudomonas aeruginosa PA01
cggccuuuugcauuu

SEQ ID NO: 3387710 - RNA, 21 nt, Pseudomonas aeruginosa PA01
cggccuuuuucaugggugcug

SEQ ID NO: 3387711 - RNA, 16 nt, Pseudomonas aeruginosa PA01
cggcgaaaccggccag

SEQ ID NO: 3387712 - RNA, 20 nt, Pseudomonas aeruginosa PA01
cggcgaaaccggccagcgcg

SEQ ID NO: 3387713 - RNA, 15 nt, Pseudomonas aeruginosa PA01
cggcgaaacggcgga

SEQ ID NO: 3387714 - RNA, 16 nt, Pseudomonas aeruginosa PA01
cggcgaaacggcggau

SEQ ID NO: 3387715 - RNA, 17 nt, Pseudomonas aeruginosa PA01
cggcgaaagccggaccu

SEQ ID NO: 3387716 - RNA, 19 nt, Pseudomonas aeruginosa PA01
cggcgaaauccucgcgcac

SEQ ID NO: 3387717 - RNA, 22 nt, Pseudomonas aeruginosa PA01
cggcgaaauccucgcgcaccgc

SEQ ID NO: 3387718 - RNA, 18 nt, Pseudomonas aeruginosa PA01
cggcgaaaugcaggccgg

SEQ ID NO: 3387719 - RNA, 21 nt, Pseudomonas aeruginosa PA01
cggcgaaaugcaggccggugg

SEQ ID NO: 3387720 - RNA, 21 nt, Pseudomonas aeruginosa PA01
cggcgaaauggguucccagca

SEQ ID NO: 3387721 - RNA, 22 nt, Pseudomonas aeruginosa PA01
cggcgaaauggguucccagcag

SEQ ID NO: 3387722 - RNA, 24 nt, Pseudomonas aeruginosa PA01
cggcgaaauggguucccagcagca

SEQ ID NO: 3387723 - RNA, 20 nt, Pseudomonas aeruginosa PA01
cggcgaacaccgggccgccg

SEQ ID NO: 3387724 - RNA, 21 nt, Pseudomonas aeruginosa PA01
cggcgaacaccgggccgccgg

SEQ ID NO: 3387725 - RNA, 20 nt, Pseudomonas aeruginosa PA01
cggcgaacaggguggugucg

SEQ ID NO: 3387726 - RNA, 20 nt, Pseudomonas aeruginosa PA01
cggcgaacagguagccccgg

SEQ ID NO: 3387727 - RNA, 20 nt, Pseudomonas aeruginosa PA01
cggcgaacaucauccacagc

SEQ ID NO: 3387728 - RNA, 13 nt, Pseudomonas aeruginosa PA01
cggcgaaccaggc

SEQ ID NO: 3387729 - RNA, 14 nt, Pseudomonas aeruginosa PA01
cggcgaaccaggcg

SEQ ID NO: 3387730 - RNA, 16 nt, Pseudomonas aeruginosa PA01
cggcgaaccaggcggc

SEQ ID NO: 3387731 - RNA, 17 nt, Pseudomonas aeruginosa PA01
cggcgaaccaggcggcc

SEQ ID NO: 3387732 - RNA, 23 nt, Pseudomonas aeruginosa PA01
cggcgaaccagugcaccgccggg

SEQ ID NO: 3387733 - RNA, 21 nt, Pseudomonas aeruginosa PA01
cggcgaacccucggugcggcc

SEQ ID NO: 3387734 - RNA, 14 nt, Pseudomonas aeruginosa PA01
cggcgaacgacagc

SEQ ID NO: 3387735 - RNA, 18 nt, Pseudomonas aeruginosa PA01
cggcgaacgacagcacca

SEQ ID NO: 3387736 - RNA, 21 nt, Pseudomonas aeruginosa PA01
cggcgaacgacagcaccaugc

SEQ ID NO: 3387737 - RNA, 16 nt, Pseudomonas aeruginosa PA01
cggcgaacgccggguc

SEQ ID NO: 3387738 - RNA, 17 nt, Pseudomonas aeruginosa PA01
cggcgaacggaccgacg

SEQ ID NO: 3387739 - RNA, 15 nt, Pseudomonas aeruginosa PA01
cggcgaacggcaugc

SEQ ID NO: 3387740 - RNA, 16 nt, Pseudomonas aeruginosa PA01
cggcgaacuccgccag

SEQ ID NO: 3387741 - RNA, 20 nt, Pseudomonas aeruginosa PA01
cggcgaacucguagacgaau

SEQ ID NO: 3387742 - RNA, 16 nt, Pseudomonas aeruginosa PA01
cggcgaacuggccacc

SEQ ID NO: 3387743 - RNA, 15 nt, Pseudomonas aeruginosa PA01
cggcgaagccgcgcc

SEQ ID NO: 3387744 - RNA, 16 nt, Pseudomonas aeruginosa PA01
cggcgaagccgcgccc

SEQ ID NO: 3387745 - RNA, 21 nt, Pseudomonas aeruginosa PA01
cggcgaagccgcgcccggccu

SEQ ID NO: 3387746 - RNA, 17 nt, Pseudomonas aeruginosa PA01
cggcgaagccugcggcg

SEQ ID NO: 3387747 - RNA, 20 nt, Pseudomonas aeruginosa PA01
cggcgaagccugcggcgaga

SEQ ID NO: 3387748 - RNA, 17 nt, Pseudomonas aeruginosa PA01
cggcgaagcgcaggcug

SEQ ID NO: 3387749 - RNA, 20 nt, Pseudomonas aeruginosa PA01
cggcgaagcggaagcgcagc

SEQ ID NO: 3387750 - RNA, 14 nt, Pseudomonas aeruginosa PA01
cggcgaagcggccc

SEQ ID NO: 3387751 - RNA, 18 nt, Pseudomonas aeruginosa PA01
cggcgaagcggcccuugu

SEQ ID NO: 3387752 - RNA, 21 nt, Pseudomonas aeruginosa PA01
cggcgaaggcgaaccacacca

SEQ ID NO: 3387753 - RNA, 22 nt, Pseudomonas aeruginosa PA01
cggcgaagggcgcuucggcgga

SEQ ID NO: 3387754 - RNA, 18 nt, Pseudomonas aeruginosa PA01
cggcgaagguggcgaccu

SEQ ID NO: 3387755 - RNA, 13 nt, Pseudomonas aeruginosa PA01
cggcgaaguccac

SEQ ID NO: 3387756 - RNA, 16 nt, Pseudomonas aeruginosa PA01
cggcgaaguccaccag

SEQ ID NO: 3387757 - RNA, 17 nt, Pseudomonas aeruginosa PA01
cggcgaaguccaccagg

SEQ ID NO: 3387758 - RNA, 22 nt, Pseudomonas aeruginosa PA01
cggcgaaguccggguugagcac

SEQ ID NO: 3387759 - RNA, 18 nt, Pseudomonas aeruginosa PA01
cggcgaagucgccgucgu

SEQ ID NO: 3387760 - RNA, 16 nt, Pseudomonas aeruginosa PA01
cggcgaaucgucgaug

SEQ ID NO: 3387761 - RNA, 16 nt, Pseudomonas aeruginosa PA01
cggcgaaugccgggcu

SEQ ID NO: 3387762 - RNA, 18 nt, Pseudomonas aeruginosa PA01
cggcgaauucgucgccgc

SEQ ID NO: 3387763 - RNA, 21 nt, Pseudomonas aeruginosa PA01
cggcgaauucgucgccgccga

SEQ ID NO: 3387764 - RNA, 22 nt, Pseudomonas aeruginosa PA01
cggcgaauucgucgccgccgag

SEQ ID NO: 3387765 - RNA, 21 nt, Pseudomonas aeruginosa PA01
cggcgacacagacgcagccgu

SEQ ID NO: 3387766 - RNA, 16 nt, Pseudomonas aeruginosa PA01
cggcgacaccccgaag

SEQ ID NO: 3387767 - RNA, 15 nt, Pseudomonas aeruginosa PA01
cggcgagcagcggcg

SEQ ID NO: 3387768 - RNA, 16 nt, Pseudomonas aeruginosa PA01
cggcgagcagcggcgc

SEQ ID NO: 3387769 - RNA, 18 nt, Pseudomonas aeruginosa PA01
cggcgagcagcggcgcuu

SEQ ID NO: 3387770 - RNA, 12 nt, Pseudomonas aeruginosa PA01
cggcgagcaggc

SEQ ID NO: 3387771 - RNA, 13 nt, Pseudomonas aeruginosa PA01
cggcgagcaggcg

SEQ ID NO: 3387772 - RNA, 15 nt, Pseudomonas aeruginosa PA01
cggcgagcaggcgaa

SEQ ID NO: 3387773 - RNA, 15 nt, Pseudomonas aeruginosa PA01
cggcgagcaggcggg

SEQ ID NO: 3387774 - RNA, 23 nt, Pseudomonas aeruginosa PA01
cggcgagcaggcgggaguccagg

SEQ ID NO: 3387775 - RNA, 13 nt, Pseudomonas aeruginosa PA01
cggcgagcaggua

SEQ ID NO: 3387776 - RNA, 14 nt, Pseudomonas aeruginosa PA01
cggcgagcagguag

SEQ ID NO: 3387777 - RNA, 21 nt, Pseudomonas aeruginosa PA01
cggcgagcagguagaccgccu

SEQ ID NO: 3387778 - RNA, 18 nt, Pseudomonas aeruginosa PA01
cggcgagcaucucggcca

SEQ ID NO: 3387779 - RNA, 21 nt, Pseudomonas aeruginosa PA01
cggcgagcauuccucagcgcc

SEQ ID NO: 3387780 - RNA, 22 nt, Pseudomonas aeruginosa PA01
cggcgagcauuccucagcgccg

SEQ ID NO: 3387781 - RNA, 23 nt, Pseudomonas aeruginosa PA01
cggcgagcauuccucagcgccgg

SEQ ID NO: 3387782 - RNA, 22 nt, Pseudomonas aeruginosa PA01
cggcgagccagguuuccggcag

SEQ ID NO: 3387783 - RNA, 14 nt, Pseudomonas aeruginosa PA01
cggcgagccgccgg

SEQ ID NO: 3387784 - RNA, 16 nt, Pseudomonas aeruginosa PA01
cggcgagccgccgggc

SEQ ID NO: 3387785 - RNA, 20 nt, Pseudomonas aeruginosa PA01
cggcgagccgccgggcggcg

SEQ ID NO: 3387786 - RNA, 21 nt, Pseudomonas aeruginosa PA01
cggcgagccgccgggcggcgu

SEQ ID NO: 3387787 - RNA, 13 nt, Pseudomonas aeruginosa PA01
cggcgagccgcga

SEQ ID NO: 3387788 - RNA, 15 nt, Pseudomonas aeruginosa PA01
cggcgagccgcgacg

SEQ ID NO: 3387789 - RNA, 15 nt, Pseudomonas aeruginosa PA01
cggcgagccggcgca

SEQ ID NO: 3387790 - RNA, 23 nt, Pseudomonas aeruginosa PA01
cggcgagccggcgcaucagcgcc

SEQ ID NO: 3387791 - RNA, 15 nt, Pseudomonas aeruginosa PA01
cggcgagccgguagu

SEQ ID NO: 3387792 - RNA, 16 nt, Pseudomonas aeruginosa PA01
cggcgagccgguagug

SEQ ID NO: 3387793 - RNA, 15 nt, Pseudomonas aeruginosa PA01
cggcgagcgccgcgg

SEQ ID NO: 3387794 - RNA, 14 nt, Pseudomonas aeruginosa PA01
cggcgagcgccugg

SEQ ID NO: 3387795 - RNA, 15 nt, Pseudomonas aeruginosa PA01
cggcgagcgccugga

SEQ ID NO: 3387796 - RNA, 23 nt, Pseudomonas aeruginosa PA01
cggcgagcuggaucggcaggcug

SEQ ID NO: 3387797 - RNA, 12 nt, Pseudomonas aeruginosa PA01
cggcgaggaaca

SEQ ID NO: 3387798 - RNA, 14 nt, Pseudomonas aeruginosa PA01
cggcgaggaacagc

SEQ ID NO: 3387799 - RNA, 15 nt, Pseudomonas aeruginosa PA01
cggcgaggaacagca

SEQ ID NO: 3387800 - RNA, 22 nt, Pseudomonas aeruginosa PA01
cggcgaggaucagucgcugcuc

SEQ ID NO: 3387801 - RNA, 23 nt, Pseudomonas aeruginosa PA01
cggcgaggaucagucgcugcucg

SEQ ID NO: 3387802 - RNA, 14 nt, Pseudomonas aeruginosa PA01
cggcgaggaucgcc

SEQ ID NO: 3387803 - RNA, 15 nt, Pseudomonas aeruginosa PA01
cggcgaggaucgcca

SEQ ID NO: 3387804 - RNA, 16 nt, Pseudomonas aeruginosa PA01
cggcgaggaucgccag

SEQ ID NO: 3387805 - RNA, 17 nt, Pseudomonas aeruginosa PA01
cggcgaggaucgccagc

SEQ ID NO: 3387806 - RNA, 18 nt, Pseudomonas aeruginosa PA01
cggcgaggaucgccagca

SEQ ID NO: 3387807 - RNA, 19 nt, Pseudomonas aeruginosa PA01
cggcgaggaucgccagcaa

SEQ ID NO: 3387808 - RNA, 20 nt, Pseudomonas aeruginosa PA01
cggcgaggaucgccagcaau

SEQ ID NO: 3387809 - RNA, 13 nt, Pseudomonas aeruginosa PA01
cggcgaggccgac

SEQ ID NO: 3387810 - RNA, 12 nt, Pseudomonas aeruginosa PA01
cggcgaggccgg

SEQ ID NO: 3387811 - RNA, 13 nt, Pseudomonas aeruginosa PA01
cggcgaggccggc

SEQ ID NO: 3387812 - RNA, 23 nt, Pseudomonas aeruginosa PA01
cggcgaggccggcgaucagcucg

SEQ ID NO: 3387813 - RNA, 14 nt, Pseudomonas aeruginosa PA01
cggcgaggcguucc

SEQ ID NO: 3387814 - RNA, 18 nt, Pseudomonas aeruginosa PA01
cggcgaggcguuccaggu

SEQ ID NO: 3387815 - RNA, 19 nt, Pseudomonas aeruginosa PA01
cggcgaggcguuccaggug

SEQ ID NO: 3387816 - RNA, 15 nt, Pseudomonas aeruginosa PA01
cggcgagggcgccgg

SEQ ID NO: 3387817 - RNA, 18 nt, Pseudomonas aeruginosa PA01
cggcgagggcggcgaccu

SEQ ID NO: 3387818 - RNA, 20 nt, Pseudomonas aeruginosa PA01
cggcgagggcggcgaccugg

SEQ ID NO: 3387819 - RNA, 12 nt, Pseudomonas aeruginosa PA01
cggcgaggugau

SEQ ID NO: 3387820 - RNA, 23 nt, Pseudomonas aeruginosa PA01
cggcgagguugcccacggccagg

SEQ ID NO: 3387821 - RNA, 17 nt, Pseudomonas aeruginosa PA01
cggcgaguucgcgcagg

SEQ ID NO: 3387822 - RNA, 15 nt, Pseudomonas aeruginosa PA01
cggcgaguucggcgu

SEQ ID NO: 3387823 - RNA, 17 nt, Pseudomonas aeruginosa PA01
cggcgaguugcgcgagg

SEQ ID NO: 3387824 - RNA, 19 nt, Pseudomonas aeruginosa PA01
cggcgaguugcgcgaggcg

SEQ ID NO: 3387825 - RNA, 18 nt, Pseudomonas aeruginosa PA01
cggcgaguuggccgaacu

SEQ ID NO: 3387826 - RNA, 18 nt, Pseudomonas aeruginosa PA01
cggcgauacccaggccgu

SEQ ID NO: 3387827 - RNA, 19 nt, Pseudomonas aeruginosa PA01
cggcgauacccaggccguc

SEQ ID NO: 3387828 - RNA, 20 nt, Pseudomonas aeruginosa PA01
cggcgauacccaggccgucg

SEQ ID NO: 3387829 - RNA, 21 nt, Pseudomonas aeruginosa PA01
cggcgauacccaggccgucga

SEQ ID NO: 3387830 - RNA, 16 nt, Pseudomonas aeruginosa PA01
cggcgauaggcgcgca

SEQ ID NO: 3387831 - RNA, 17 nt, Pseudomonas aeruginosa PA01
cggcgauaggcgcgcaa

SEQ ID NO: 3387832 - RNA, 18 nt, Pseudomonas aeruginosa PA01
cggcgauaggcgcgcaac

SEQ ID NO: 3387833 - RNA, 20 nt, Pseudomonas aeruginosa PA01
cggcgauaggcgcgcaacgc

SEQ ID NO: 3387834 - RNA, 13 nt, Pseudomonas aeruginosa PA01
cggcgauauccuc

SEQ ID NO: 3387835 - RNA, 15 nt, Pseudomonas aeruginosa PA01
cggcgaucacccggc

SEQ ID NO: 3387836 - RNA, 23 nt, Pseudomonas aeruginosa PA01
cggcgaucacccggcgaagcucc

SEQ ID NO: 3387837 - RNA, 20 nt, Pseudomonas aeruginosa PA01
cggcgaucagaacgaugccg

SEQ ID NO: 3387838 - RNA, 17 nt, Pseudomonas aeruginosa PA01
cggcgaucagcgcuucc

SEQ ID NO: 3387839 - RNA, 13 nt, Pseudomonas aeruginosa PA01
cggcgaucagcgg

SEQ ID NO: 3387840 - RNA, 15 nt, Pseudomonas aeruginosa PA01
cggcgaucagcucgc

SEQ ID NO: 3387841 - RNA, 19 nt, Pseudomonas aeruginosa PA01
cggcgaucagcucgcggua

SEQ ID NO: 3387842 - RNA, 17 nt, Pseudomonas aeruginosa PA01
cggcgaucaggccgaug

SEQ ID NO: 3387843 - RNA, 14 nt, Pseudomonas aeruginosa PA01
cggcgaucauccag

SEQ ID NO: 3387844 - RNA, 17 nt, Pseudomonas aeruginosa PA01
cggcgaucauccagccc

SEQ ID NO: 3387845 - RNA, 19 nt, Pseudomonas aeruginosa PA01
cggcgaucauccagccccc

SEQ ID NO: 3387846 - RNA, 13 nt, Pseudomonas aeruginosa PA01
cggcgauccgcgc

SEQ ID NO: 3387847 - RNA, 14 nt, Pseudomonas aeruginosa PA01
cggcgauccgcgca

SEQ ID NO: 3387848 - RNA, 15 nt, Pseudomonas aeruginosa PA01
cggcgauccgcugca

SEQ ID NO: 3387849 - RNA, 14 nt, Pseudomonas aeruginosa PA01
cggcgaucgccagg

SEQ ID NO: 3387850 - RNA, 15 nt, Pseudomonas aeruginosa PA01
cggcgaucgccaggc

SEQ ID NO: 3387851 - RNA, 16 nt, Pseudomonas aeruginosa PA01
cggcgaucgccaggcg

SEQ ID NO: 3387852 - RNA, 15 nt, Pseudomonas aeruginosa PA01
cggcgaucgccaggu

SEQ ID NO: 3387853 - RNA, 14 nt, Pseudomonas aeruginosa PA01
cggcgaucgccccg

SEQ ID NO: 3387854 - RNA, 16 nt, Pseudomonas aeruginosa PA01
cggcgaucgccggcgu

SEQ ID NO: 3387855 - RNA, 14 nt, Pseudomonas aeruginosa PA01
cggcgaucgccggg

SEQ ID NO: 3387856 - RNA, 15 nt, Pseudomonas aeruginosa PA01
cggcgaucgccgggu

SEQ ID NO: 3387857 - RNA, 13 nt, Pseudomonas aeruginosa PA01
cggcgaucgccug

SEQ ID NO: 3387858 - RNA, 15 nt, Pseudomonas aeruginosa PA01
cggcgaucgccuggu

SEQ ID NO: 3387859 - RNA, 21 nt, Pseudomonas aeruginosa PA01
cggcgaucggguagagcgcgg

SEQ ID NO: 3387860 - RNA, 22 nt, Pseudomonas aeruginosa PA01
cggcgaucggguagagcgcggc

SEQ ID NO: 3387861 - RNA, 19 nt, Pseudomonas aeruginosa PA01
cggcgaucuccgccaggcg

SEQ ID NO: 3387862 - RNA, 13 nt, Pseudomonas aeruginosa PA01
cggcgaucucgcc

SEQ ID NO: 3387863 - RNA, 14 nt, Pseudomonas aeruginosa PA01
cggcgaucucgccc

SEQ ID NO: 3387864 - RNA, 16 nt, Pseudomonas aeruginosa PA01
cggcgaucucgcccag

SEQ ID NO: 3387865 - RNA, 13 nt, Pseudomonas aeruginosa PA01
cggcgaucuucag

SEQ ID NO: 3387866 - RNA, 22 nt, Pseudomonas aeruginosa PA01
cggcgaucuucagguaggcgcg

SEQ ID NO: 3387867 - RNA, 23 nt, Pseudomonas aeruginosa PA01
cggcgaucuucagguaggcgcgg

SEQ ID NO: 3387868 - RNA, 15 nt, Pseudomonas aeruginosa PA01
cggcgaucuucuccg

SEQ ID NO: 3387869 - RNA, 19 nt, Pseudomonas aeruginosa PA01
cggcgaucuucuccgccgc

SEQ ID NO: 3387870 - RNA, 17 nt, Pseudomonas aeruginosa PA01
cggcgccaccccgccgc

SEQ ID NO: 3387871 - RNA, 20 nt, Pseudomonas aeruginosa PA01
cggcgccaccccgccgcgca

SEQ ID NO: 3387872 - RNA, 22 nt, Pseudomonas aeruginosa PA01
cggcgccaccccgccgcgcauc

SEQ ID NO: 3387873 - RNA, 12 nt, Pseudomonas aeruginosa PA01
cggcgccaccgc

SEQ ID NO: 3387874 - RNA, 15 nt, Pseudomonas aeruginosa PA01
cggcgccaccgcguu

SEQ ID NO: 3387875 - RNA, 14 nt, Pseudomonas aeruginosa PA01
cggcgccacgcuca

SEQ ID NO: 3387876 - RNA, 13 nt, Pseudomonas aeruginosa PA01
cggcgccagcagg

SEQ ID NO: 3387877 - RNA, 14 nt, Pseudomonas aeruginosa PA01
cggcgccagcaggc

SEQ ID NO: 3387878 - RNA, 15 nt, Pseudomonas aeruginosa PA01
cggcgccagcgcccc

SEQ ID NO: 3387879 - RNA, 16 nt, Pseudomonas aeruginosa PA01
cggcgccagcgcccca

SEQ ID NO: 3387880 - RNA, 17 nt, Pseudomonas aeruginosa PA01
cggcgccagcgccccac

SEQ ID NO: 3387881 - RNA, 18 nt, Pseudomonas aeruginosa PA01
cggcgccagcgccccacc

SEQ ID NO: 3387882 - RNA, 22 nt, Pseudomonas aeruginosa PA01
cggcgccagcgccccaccaggc

SEQ ID NO: 3387883 - RNA, 15 nt, Pseudomonas aeruginosa PA01
cggcgccagcuccag

SEQ ID NO: 3387884 - RNA, 16 nt, Pseudomonas aeruginosa PA01
cggcgccagcuccagc

SEQ ID NO: 3387885 - RNA, 13 nt, Pseudomonas aeruginosa PA01
cggcgccaggccc

SEQ ID NO: 3387886 - RNA, 18 nt, Pseudomonas aeruginosa PA01
cggcgccaggcccucggc

SEQ ID NO: 3387887 - RNA, 20 nt, Pseudomonas aeruginosa PA01
cggcgccaggcccucggcga

SEQ ID NO: 3387888 - RNA, 22 nt, Pseudomonas aeruginosa PA01
cggcgccaggccggagccgcgu

SEQ ID NO: 3387889 - RNA, 16 nt, Pseudomonas aeruginosa PA01
cggcgccaggcguucc

SEQ ID NO: 3387890 - RNA, 24 nt, Pseudomonas aeruginosa PA01
cggcgccaggcugaccgcgugggc

SEQ ID NO: 3387891 - RNA, 14 nt, Pseudomonas aeruginosa PA01
cggcgccaguucgc

SEQ ID NO: 3387892 - RNA, 22 nt, Pseudomonas aeruginosa PA01
cggcgccaguucgccggugacg

SEQ ID NO: 3387893 - RNA, 23 nt, Pseudomonas aeruginosa PA01
cggcgccauaccggcaaggcggc

SEQ ID NO: 3387894 - RNA, 16 nt, Pseudomonas aeruginosa PA01
cggcgccauaggccag

SEQ ID NO: 3387895 - RNA, 21 nt, Pseudomonas aeruginosa PA01
cggcgccauaggccagcaccu

SEQ ID NO: 3387896 - RNA, 19 nt, Pseudomonas aeruginosa PA01
cggcgccauagggcacccg

SEQ ID NO: 3387897 - RNA, 20 nt, Pseudomonas aeruginosa PA01
cggcgccaucgaucagcagc

SEQ ID NO: 3387898 - RNA, 21 nt, Pseudomonas aeruginosa PA01
cggcgccaucgaucagcagcg

SEQ ID NO: 3387899 - RNA, 23 nt, Pseudomonas aeruginosa PA01
cggcgccaucgaucagcagcgcc

SEQ ID NO: 3387900 - RNA, 21 nt, Pseudomonas aeruginosa PA01
cggcgcccaaugcaucggccg

SEQ ID NO: 3387901 - RNA, 22 nt, Pseudomonas aeruginosa PA01
cggcgcccaaugcaucggccgg

SEQ ID NO: 3387902 - RNA, 15 nt, Pseudomonas aeruginosa PA01
cggcgcccacaaccu

SEQ ID NO: 3387903 - RNA, 21 nt, Pseudomonas aeruginosa PA01
cggcgcccacaaccugccgau

SEQ ID NO: 3387904 - RNA, 14 nt, Pseudomonas aeruginosa PA01
cggcgcccagcacc

SEQ ID NO: 3387905 - RNA, 15 nt, Pseudomonas aeruginosa PA01
cggcgcccagcacca

SEQ ID NO: 3387906 - RNA, 19 nt, Pseudomonas aeruginosa PA01
cggcgcccagcaccacagc

SEQ ID NO: 3387907 - RNA, 12 nt, Pseudomonas aeruginosa PA01
cggcgcccaggg

SEQ ID NO: 3387908 - RNA, 15 nt, Pseudomonas aeruginosa PA01
cggcgcccagguagg

SEQ ID NO: 3387909 - RNA, 15 nt, Pseudomonas aeruginosa PA01
cggcgccccaggcgc

SEQ ID NO: 3387910 - RNA, 20 nt, Pseudomonas aeruginosa PA01
cggcgccccggcccagccgc

SEQ ID NO: 3387911 - RNA, 14 nt, Pseudomonas aeruginosa PA01
cggcgccccgucca

SEQ ID NO: 3387912 - RNA, 16 nt, Pseudomonas aeruginosa PA01
cggcgccccugcggcg

SEQ ID NO: 3387913 - RNA, 17 nt, Pseudomonas aeruginosa PA01
cggcgccccugcggcgc

SEQ ID NO: 3387914 - RNA, 18 nt, Pseudomonas aeruginosa PA01
cggcgccccugcggcgcc

SEQ ID NO: 3387915 - RNA, 22 nt, Pseudomonas aeruginosa PA01
cggcgccccugcggcgccgguu

SEQ ID NO: 3387916 - RNA, 15 nt, Pseudomonas aeruginosa PA01
cggcgcccgagggcg

SEQ ID NO: 3387917 - RNA, 14 nt, Pseudomonas aeruginosa PA01
cggcgcccgccaag

SEQ ID NO: 3387918 - RNA, 17 nt, Pseudomonas aeruginosa PA01
cggcgcccgccugcagg

SEQ ID NO: 3387919 - RNA, 20 nt, Pseudomonas aeruginosa PA01
cggcgcccgccugcaggaag

SEQ ID NO: 3387920 - RNA, 13 nt, Pseudomonas aeruginosa PA01
cggcgcccggcgc

SEQ ID NO: 3387921 - RNA, 20 nt, Pseudomonas aeruginosa PA01
cggcgcccggcgcaugccgc

SEQ ID NO: 3387922 - RNA, 17 nt, Pseudomonas aeruginosa PA01
cggcgcccucgggcgcc

SEQ ID NO: 3387923 - RNA, 15 nt, Pseudomonas aeruginosa PA01
cggcgcccucugccg

SEQ ID NO: 3387924 - RNA, 17 nt, Pseudomonas aeruginosa PA01
cggcgcccucugccggu

SEQ ID NO: 3387925 - RNA, 15 nt, Pseudomonas aeruginosa PA01
cggcgcccuggccgc

SEQ ID NO: 3387926 - RNA, 15 nt, Pseudomonas aeruginosa PA01
cggcgcccuggcucu

SEQ ID NO: 3387927 - RNA, 14 nt, Pseudomonas aeruginosa PA01
cggcgcccugggug

SEQ ID NO: 3387928 - RNA, 14 nt, Pseudomonas aeruginosa PA01
cggcgcccuucgag

SEQ ID NO: 3387929 - RNA, 19 nt, Pseudomonas aeruginosa PA01
cggcgcccuugacccggua

SEQ ID NO: 3387930 - RNA, 18 nt, Pseudomonas aeruginosa PA01
cggcgccgaacagggcga

SEQ ID NO: 3387931 - RNA, 22 nt, Pseudomonas aeruginosa PA01
cggcgccgaacagggcgagcag

SEQ ID NO: 3387932 - RNA, 23 nt, Pseudomonas aeruginosa PA01
cggcgccgaacagggcgagcagg

SEQ ID NO: 3387933 - RNA, 16 nt, Pseudomonas aeruginosa PA01
cggcgccgaggcccua

SEQ ID NO: 3387934 - RNA, 14 nt, Pseudomonas aeruginosa PA01
cggcgccgaugccg

SEQ ID NO: 3387935 - RNA, 15 nt, Pseudomonas aeruginosa PA01
cggcgccgaugccgc

SEQ ID NO: 3387936 - RNA, 13 nt, Pseudomonas aeruginosa PA01
cggcgccgaugcg

SEQ ID NO: 3387937 - RNA, 16 nt, Pseudomonas aeruginosa PA01
cggcgccgauuccugg

SEQ ID NO: 3387938 - RNA, 17 nt, Pseudomonas aeruginosa PA01
cggcgccgcccuugccu

SEQ ID NO: 3387939 - RNA, 12 nt, Pseudomonas aeruginosa PA01
cggcgccgccga

SEQ ID NO: 3387940 - RNA, 14 nt, Pseudomonas aeruginosa PA01
cggcgccgccgggg

SEQ ID NO: 3387941 - RNA, 13 nt, Pseudomonas aeruginosa PA01
cggcgccgccucg

SEQ ID NO: 3387942 - RNA, 19 nt, Pseudomonas aeruginosa PA01
cggcgccgccucgggcagc

SEQ ID NO: 3387943 - RNA, 22 nt, Pseudomonas aeruginosa PA01
cggcgccgccucgggcagcccc

SEQ ID NO: 3387944 - RNA, 14 nt, Pseudomonas aeruginosa PA01
cggcgccgccuggc

SEQ ID NO: 3387945 - RNA, 18 nt, Pseudomonas aeruginosa PA01
cggcgccgccuggccggu

SEQ ID NO: 3387946 - RNA, 13 nt, Pseudomonas aeruginosa PA01
cggcgccgcgcac

SEQ ID NO: 3387947 - RNA, 14 nt, Pseudomonas aeruginosa PA01
cggcgccgcgcacc

SEQ ID NO: 3387948 - RNA, 21 nt, Pseudomonas aeruginosa PA01
cggcgccgcuagggcgcccuc

SEQ ID NO: 3387949 - RNA, 13 nt, Pseudomonas aeruginosa PA01
cggcgccgcugcc

SEQ ID NO: 3387950 - RNA, 15 nt, Pseudomonas aeruginosa PA01
cggcgccggagcugg

SEQ ID NO: 3387951 - RNA, 11 nt, Pseudomonas aeruginosa PA01
cggcgccggcc

SEQ ID NO: 3387952 - RNA, 14 nt, Pseudomonas aeruginosa PA01
cggcgccggccucc

SEQ ID NO: 3387953 - RNA, 19 nt, Pseudomonas aeruginosa PA01
cggcgccgggaucaccucg

SEQ ID NO: 3387954 - RNA, 12 nt, Pseudomonas aeruginosa PA01
cggcgccgggcu

SEQ ID NO: 3387955 - RNA, 18 nt, Pseudomonas aeruginosa PA01
cggcgccggugcuggcga

SEQ ID NO: 3387956 - RNA, 19 nt, Pseudomonas aeruginosa PA01
cggcgccggugcuggcgag

SEQ ID NO: 3387957 - RNA, 23 nt, Pseudomonas aeruginosa PA01
cggcgccggugcuggcgagcagg

SEQ ID NO: 3387958 - RNA, 15 nt, Pseudomonas aeruginosa PA01
cggcgccgguugcgu

SEQ ID NO: 3387959 - RNA, 18 nt, Pseudomonas aeruginosa PA01
cggcgccgguugcugcug

SEQ ID NO: 3387960 - RNA, 20 nt, Pseudomonas aeruginosa PA01
cggcgccgguugcugcugcg

SEQ ID NO: 3387961 - RNA, 15 nt, Pseudomonas aeruginosa PA01
cggcgccgucgauca

SEQ ID NO: 3387962 - RNA, 24 nt, Pseudomonas aeruginosa PA01
cggcgccuccaggaauccuccgcc

SEQ ID NO: 3387963 - RNA, 14 nt, Pseudomonas aeruginosa PA01
cggcgccucccagg

SEQ ID NO: 3387964 - RNA, 20 nt, Pseudomonas aeruginosa PA01
cggcgccucccagggucgcc

SEQ ID NO: 3387965 - RNA, 14 nt, Pseudomonas aeruginosa PA01
cggcgccucgaagc

SEQ ID NO: 3387966 - RNA, 15 nt, Pseudomonas aeruginosa PA01
cggcgccucgaagcg

SEQ ID NO: 3387967 - RNA, 20 nt, Pseudomonas aeruginosa PA01
cggcgccugcggaccacagg

SEQ ID NO: 3387968 - RNA, 16 nt, Pseudomonas aeruginosa PA01
cggcgccuggagcaga

SEQ ID NO: 3387969 - RNA, 16 nt, Pseudomonas aeruginosa PA01
cggcgccuucagagca

SEQ ID NO: 3387970 - RNA, 16 nt, Pseudomonas aeruginosa PA01
cggcgccuucagcgcc

SEQ ID NO: 3387971 - RNA, 17 nt, Pseudomonas aeruginosa PA01
cggcgccuucagcgccg

SEQ ID NO: 3387972 - RNA, 19 nt, Pseudomonas aeruginosa PA01
cggcgccuucagcgccgcc

SEQ ID NO: 3387973 - RNA, 24 nt, Pseudomonas aeruginosa PA01
cggcgcgucccugggcgcaggggc

SEQ ID NO: 3387974 - RNA, 13 nt, Pseudomonas aeruginosa PA01
cggcgcgucgcuc

SEQ ID NO: 3387975 - RNA, 15 nt, Pseudomonas aeruginosa PA01
cggcgcgucgcucau

SEQ ID NO: 3387976 - RNA, 19 nt, Pseudomonas aeruginosa PA01
cggcgcgucgcucauccgc

SEQ ID NO: 3387977 - RNA, 19 nt, Pseudomonas aeruginosa PA01
cggcgcgucgcugcgcaac

SEQ ID NO: 3387978 - RNA, 13 nt, Pseudomonas aeruginosa PA01
cggcgcgucggcg

SEQ ID NO: 3387979 - RNA, 22 nt, Pseudomonas aeruginosa PA01
cggcgcgucggugccgcccggc

SEQ ID NO: 3387980 - RNA, 14 nt, Pseudomonas aeruginosa PA01
cggcgcgucuccau

SEQ ID NO: 3387981 - RNA, 17 nt, Pseudomonas aeruginosa PA01
cggcgcgucuccaugcg

SEQ ID NO: 3387982 - RNA, 19 nt, Pseudomonas aeruginosa PA01
cggcgcguucacuccacga

SEQ ID NO: 3387983 - RNA, 16 nt, Pseudomonas aeruginosa PA01
cggcgcguuggcuggc

SEQ ID NO: 3387984 - RNA, 17 nt, Pseudomonas aeruginosa PA01
cggcgcguuggcuggcg

SEQ ID NO: 3387985 - RNA, 18 nt, Pseudomonas aeruginosa PA01
cggcgcguuggcuggcgg

SEQ ID NO: 3387986 - RNA, 21 nt, Pseudomonas aeruginosa PA01
cggcgcuacgaaggcgugccg

SEQ ID NO: 3387987 - RNA, 22 nt, Pseudomonas aeruginosa PA01
cggcgcuacgaaggcgugccgc

SEQ ID NO: 3387988 - RNA, 23 nt, Pseudomonas aeruginosa PA01
cggcgcuacgaaggcgugccgcu

SEQ ID NO: 3387989 - RNA, 19 nt, Pseudomonas aeruginosa PA01
cggcgcucacccacauggc

SEQ ID NO: 3387990 - RNA, 12 nt, Pseudomonas aeruginosa PA01
cggcgcucaccg

SEQ ID NO: 3387991 - RNA, 14 nt, Pseudomonas aeruginosa PA01
cggcgcucaccgca

SEQ ID NO: 3387992 - RNA, 16 nt, Pseudomonas aeruginosa PA01
cggcgcuccaacagca

SEQ ID NO: 3387993 - RNA, 17 nt, Pseudomonas aeruginosa PA01
cggcgcuccaacagcag

SEQ ID NO: 3387994 - RNA, 18 nt, Pseudomonas aeruginosa PA01
cggcgcuccaacagcagg

SEQ ID NO: 3387995 - RNA, 14 nt, Pseudomonas aeruginosa PA01
cggcgcuccacagc

SEQ ID NO: 3387996 - RNA, 18 nt, Pseudomonas aeruginosa PA01
cggcgcuccacagcugcc

SEQ ID NO: 3387997 - RNA, 22 nt, Pseudomonas aeruginosa PA01
cggcgcuccacagcugccagcc

SEQ ID NO: 3387998 - RNA, 13 nt, Pseudomonas aeruginosa PA01
cggcgcuccaggc

SEQ ID NO: 3387999 - RNA, 14 nt, Pseudomonas aeruginosa PA01
cggcgcuccaggcg

SEQ ID NO: 3388000 - RNA, 14 nt, Pseudomonas aeruginosa PA01
cggcgcuccgccga

SEQ ID NO: 3388001 - RNA, 16 nt, Pseudomonas aeruginosa PA01
cggcgcuccgccgaac

SEQ ID NO: 3388002 - RNA, 19 nt, Pseudomonas aeruginosa PA01
cggcgcuccgccgaacgcc

SEQ ID NO: 3388003 - RNA, 14 nt, Pseudomonas aeruginosa PA01
cggcgcuccuccuc

SEQ ID NO: 3388004 - RNA, 15 nt, Pseudomonas aeruginosa PA01
cggcgcucgaggggc

SEQ ID NO: 3388005 - RNA, 14 nt, Pseudomonas aeruginosa PA01
cggcgcucggccag

SEQ ID NO: 3388006 - RNA, 16 nt, Pseudomonas aeruginosa PA01
cggcgcucggccaggu

SEQ ID NO: 3388007 - RNA, 19 nt, Pseudomonas aeruginosa PA01
cggcgcucggccaggucgc

SEQ ID NO: 3388008 - RNA, 17 nt, Pseudomonas aeruginosa PA01
cggcgcucggcuccagc

SEQ ID NO: 3388009 - RNA, 18 nt, Pseudomonas aeruginosa PA01
cggcgcucggcuccagcc

SEQ ID NO: 3388010 - RNA, 21 nt, Pseudomonas aeruginosa PA01
cggcgcucggcuccagccagg

SEQ ID NO: 3388011 - RNA, 23 nt, Pseudomonas aeruginosa PA01
cggcgcucggcuccagccaggcc

SEQ ID NO: 3388012 - RNA, 12 nt, Pseudomonas aeruginosa PA01
cggcgcucggga

SEQ ID NO: 3388013 - RNA, 17 nt, Pseudomonas aeruginosa PA01
cggcgcucgggauggcc

SEQ ID NO: 3388014 - RNA, 16 nt, Pseudomonas aeruginosa PA01
cggcgcucuucagcac

SEQ ID NO: 3388015 - RNA, 17 nt, Pseudomonas aeruginosa PA01
cggcgcucuucagcacg

SEQ ID NO: 3388016 - RNA, 18 nt, Pseudomonas aeruginosa PA01
cggcgcucuucagcacgc

SEQ ID NO: 3388017 - RNA, 22 nt, Pseudomonas aeruginosa PA01
cggcgcucuucagcacgcccag

SEQ ID NO: 3388018 - RNA, 17 nt, Pseudomonas aeruginosa PA01
cggcgcugaacagcugg

SEQ ID NO: 3388019 - RNA, 18 nt, Pseudomonas aeruginosa PA01
cggcgcugaacagcuggc

SEQ ID NO: 3388020 - RNA, 22 nt, Pseudomonas aeruginosa PA01
cggcgcugaacagcuggcgcgu

SEQ ID NO: 3388021 - RNA, 12 nt, Pseudomonas aeruginosa PA01
cggcgcugaagg

SEQ ID NO: 3388022 - RNA, 15 nt, Pseudomonas aeruginosa PA01
cggcgcugaaggcgg

SEQ ID NO: 3388023 - RNA, 14 nt, Pseudomonas aeruginosa PA01
cggcgcugaccucg

SEQ ID NO: 3388024 - RNA, 15 nt, Pseudomonas aeruginosa PA01
cggcgcugagcgaga

SEQ ID NO: 3388025 - RNA, 21 nt, Pseudomonas aeruginosa PA01
cggcgcugaggaucagccagc

SEQ ID NO: 3388026 - RNA, 23 nt, Pseudomonas aeruginosa PA01
cggcgcugaggaucagccagccg

SEQ ID NO: 3388027 - RNA, 12 nt, Pseudomonas aeruginosa PA01
cggcgcugccga

SEQ ID NO: 3388028 - RNA, 15 nt, Pseudomonas aeruginosa PA01
cggcgcugccggcca

SEQ ID NO: 3388029 - RNA, 17 nt, Pseudomonas aeruginosa PA01
cggcgcugccggccagg

SEQ ID NO: 3388030 - RNA, 23 nt, Pseudomonas aeruginosa PA01
cggcgcugccggccagggucgcc

SEQ ID NO: 3388031 - RNA, 14 nt, Pseudomonas aeruginosa PA01
cggcgcuggagaga

SEQ ID NO: 3388032 - RNA, 20 nt, Pseudomonas aeruginosa PA01
cggcgcuggagagauagagc

SEQ ID NO: 3388033 - RNA, 13 nt, Pseudomonas aeruginosa PA01
cggcgcuggccgc

SEQ ID NO: 3388034 - RNA, 14 nt, Pseudomonas aeruginosa PA01
cggcgcuggccgcg

SEQ ID NO: 3388035 - RNA, 15 nt, Pseudomonas aeruginosa PA01
cggcgcuggccgcgc

SEQ ID NO: 3388036 - RNA, 19 nt, Pseudomonas aeruginosa PA01
cggcgcuggucucuuccag

SEQ ID NO: 3388037 - RNA, 22 nt, Pseudomonas aeruginosa PA01
cggcgcuggucucuuccagcau

SEQ ID NO: 3388038 - RNA, 23 nt, Pseudomonas aeruginosa PA01
cggcgcuggucucuuccagcaug

SEQ ID NO: 3388039 - RNA, 21 nt, Pseudomonas aeruginosa PA01
cggcgcugucgccguuggccu

SEQ ID NO: 3388040 - RNA, 16 nt, Pseudomonas aeruginosa PA01
cggcgcugucucgcca

SEQ ID NO: 3388041 - RNA, 24 nt, Pseudomonas aeruginosa PA01
cggcgcugugggugaggcguucga

SEQ ID NO: 3388042 - RNA, 19 nt, Pseudomonas aeruginosa PA01
cggcgcuguuugcggcgca

SEQ ID NO: 3388043 - RNA, 14 nt, Pseudomonas aeruginosa PA01
cggcgcuucaacug

SEQ ID NO: 3388044 - RNA, 16 nt, Pseudomonas aeruginosa PA01
cggcgcuucgcgcagg

SEQ ID NO: 3388045 - RNA, 21 nt, Pseudomonas aeruginosa PA01
cggcgcuucgcgcaggacgag

SEQ ID NO: 3388046 - RNA, 13 nt, Pseudomonas aeruginosa PA01
cggcgcuucugcg

SEQ ID NO: 3388047 - RNA, 16 nt, Pseudomonas aeruginosa PA01
cggcgcuucugcgagc

SEQ ID NO: 3388048 - RNA, 13 nt, Pseudomonas aeruginosa PA01
cggcgcuuggcga

SEQ ID NO: 3388049 - RNA, 14 nt, Pseudomonas aeruginosa PA01
cggcgcuuggcgaa

SEQ ID NO: 3388050 - RNA, 19 nt, Pseudomonas aeruginosa PA01
cggcgcuuucaucaggcgc

SEQ ID NO: 3388051 - RNA, 13 nt, Pseudomonas aeruginosa PA01
cggcgcuuuccac

SEQ ID NO: 3388052 - RNA, 14 nt, Pseudomonas aeruginosa PA01
cggcgcuuuccacu

SEQ ID NO: 3388053 - RNA, 13 nt, Pseudomonas aeruginosa PA01
cggcgcuuugcug

SEQ ID NO: 3388054 - RNA, 19 nt, Pseudomonas aeruginosa PA01
cggcgcuuugcugcacgcu

SEQ ID NO: 3388055 - RNA, 22 nt, Pseudomonas aeruginosa PA01
cggcgcuuuuuucuugccgcca

SEQ ID NO: 3388056 - RNA, 19 nt, Pseudomonas aeruginosa PA01
cggcggaacauggucgaga

SEQ ID NO: 3388057 - RNA, 19 nt, Pseudomonas aeruginosa PA01
cggcggaacuugucgccgc

SEQ ID NO: 3388058 - RNA, 21 nt, Pseudomonas aeruginosa PA01
cggcggaacuugucgccgcug

SEQ ID NO: 3388059 - RNA, 14 nt, Pseudomonas aeruginosa PA01
cggcggaaggcggc

SEQ ID NO: 3388060 - RNA, 16 nt, Pseudomonas aeruginosa PA01
cggcggaaggcggcgu

SEQ ID NO: 3388061 - RNA, 21 nt, Pseudomonas aeruginosa PA01
cggcggaagucgaagcagccg

SEQ ID NO: 3388062 - RNA, 22 nt, Pseudomonas aeruginosa PA01
cggcggaagucgaagcagccgu

SEQ ID NO: 3388063 - RNA, 16 nt, Pseudomonas aeruginosa PA01
cggcggaauuccugcu

SEQ ID NO: 3388064 - RNA, 20 nt, Pseudomonas aeruginosa PA01
cggcggacaaccaccaugcg

SEQ ID NO: 3388065 - RNA, 13 nt, Pseudomonas aeruginosa PA01
cggcggacagccc

SEQ ID NO: 3388066 - RNA, 17 nt, Pseudomonas aeruginosa PA01
cggcggacagcccgcgc

SEQ ID NO: 3388067 - RNA, 14 nt, Pseudomonas aeruginosa PA01
cggcggacagcgga

SEQ ID NO: 3388068 - RNA, 17 nt, Pseudomonas aeruginosa PA01
cggcggacagcggaaac

SEQ ID NO: 3388069 - RNA, 14 nt, Pseudomonas aeruginosa PA01
cggcggacaggcag

SEQ ID NO: 3388070 - RNA, 17 nt, Pseudomonas aeruginosa PA01
cggcggacaggcagccg

SEQ ID NO: 3388071 - RNA, 19 nt, Pseudomonas aeruginosa PA01
cggcggacaggcagccggc

SEQ ID NO: 3388072 - RNA, 19 nt, Pseudomonas aeruginosa PA01
cggcggaccuccgccaggu

SEQ ID NO: 3388073 - RNA, 23 nt, Pseudomonas aeruginosa PA01
cggcggaccuccgccaggucgau

SEQ ID NO: 3388074 - RNA, 19 nt, Pseudomonas aeruginosa PA01
cggcggacgcaggccgacc

SEQ ID NO: 3388075 - RNA, 18 nt, Pseudomonas aeruginosa PA01
cggcggagccgucggcuc

SEQ ID NO: 3388076 - RNA, 14 nt, Pseudomonas aeruginosa PA01
cggcggcgccggca

SEQ ID NO: 3388077 - RNA, 15 nt, Pseudomonas aeruginosa PA01
cggcggcgccggcag

SEQ ID NO: 3388078 - RNA, 13 nt, Pseudomonas aeruginosa PA01
cggcggcgccggu

SEQ ID NO: 3388079 - RNA, 16 nt, Pseudomonas aeruginosa PA01
cggcggcgccggugag

SEQ ID NO: 3388080 - RNA, 16 nt, Pseudomonas aeruginosa PA01
cggcggcgccuucgcc

SEQ ID NO: 3388081 - RNA, 16 nt, Pseudomonas aeruginosa PA01
cggcggcgcgcagcga

SEQ ID NO: 3388082 - RNA, 22 nt, Pseudomonas aeruginosa PA01
cggcggcgcgcagcgaacgggc

SEQ ID NO: 3388083 - RNA, 14 nt, Pseudomonas aeruginosa PA01
cggcggcgcggcag

SEQ ID NO: 3388084 - RNA, 15 nt, Pseudomonas aeruginosa PA01
cggcggcgcggcagu

SEQ ID NO: 3388085 - RNA, 12 nt, Pseudomonas aeruginosa PA01
cggcggcgcggg

SEQ ID NO: 3388086 - RNA, 22 nt, Pseudomonas aeruginosa PA01
cggcggcgcguccaccuggcgg

SEQ ID NO: 3388087 - RNA, 19 nt, Pseudomonas aeruginosa PA01
cggcggcgcgucggugccg

SEQ ID NO: 3388088 - RNA, 15 nt, Pseudomonas aeruginosa PA01
cggcggcgcugagga

SEQ ID NO: 3388089 - RNA, 16 nt, Pseudomonas aeruginosa PA01
cggcggcgcugaggau

SEQ ID NO: 3388090 - RNA, 16 nt, Pseudomonas aeruginosa PA01
cggcggcggaccuccg

SEQ ID NO: 3388091 - RNA, 21 nt, Pseudomonas aeruginosa PA01
cggcggcggaccuccgccagg

SEQ ID NO: 3388092 - RNA, 13 nt, Pseudomonas aeruginosa PA01
cggcggcggacgc

SEQ ID NO: 3388093 - RNA, 20 nt, Pseudomonas aeruginosa PA01
cggcggcggauaacgccugu

SEQ ID NO: 3388094 - RNA, 16 nt, Pseudomonas aeruginosa PA01
cggcggcggccagcag

SEQ ID NO: 3388095 - RNA, 17 nt, Pseudomonas aeruginosa PA01
cggcggcggccagcagc

SEQ ID NO: 3388096 - RNA, 12 nt, Pseudomonas aeruginosa PA01
cggcggcggccc

SEQ ID NO: 3388097 - RNA, 14 nt, Pseudomonas aeruginosa PA01
cggcggcggcccgc

SEQ ID NO: 3388098 - RNA, 13 nt, Pseudomonas aeruginosa PA01
cggcggcggccgc

SEQ ID NO: 3388099 - RNA, 12 nt, Pseudomonas aeruginosa PA01
cggcggcggccu

SEQ ID NO: 3388100 - RNA, 15 nt, Pseudomonas aeruginosa PA01
cggcggcggccugcu

SEQ ID NO: 3388101 - RNA, 21 nt, Pseudomonas aeruginosa PA01
cggcggcggggaaggcgucgg

SEQ ID NO: 3388102 - RNA, 16 nt, Pseudomonas aeruginosa PA01
cggcggcgugcaggcc

SEQ ID NO: 3388103 - RNA, 19 nt, Pseudomonas aeruginosa PA01
cggcggcgugcaggccgau

SEQ ID NO: 3388104 - RNA, 15 nt, Pseudomonas aeruginosa PA01
cggcggcgugcaggg

SEQ ID NO: 3388105 - RNA, 18 nt, Pseudomonas aeruginosa PA01
cggcggcgugcaggguau

SEQ ID NO: 3388106 - RNA, 23 nt, Pseudomonas aeruginosa PA01
cggcggcuaccagcgcuucggcg

SEQ ID NO: 3388107 - RNA, 19 nt, Pseudomonas aeruginosa PA01
cggcggcucaacgggaccg

SEQ ID NO: 3388108 - RNA, 15 nt, Pseudomonas aeruginosa PA01
cggcggcucaggccg

SEQ ID NO: 3388109 - RNA, 19 nt, Pseudomonas aeruginosa PA01
cggcggcucaggccgccgc

SEQ ID NO: 3388110 - RNA, 14 nt, Pseudomonas aeruginosa PA01
cggcggcugcugcg

SEQ ID NO: 3388111 - RNA, 18 nt, Pseudomonas aeruginosa PA01
cggcggcugcugcgccug

SEQ ID NO: 3388112 - RNA, 22 nt, Pseudomonas aeruginosa PA01
cggcggcugcugcgccuggccg

SEQ ID NO: 3388113 - RNA, 19 nt, Pseudomonas aeruginosa PA01
cggcggcuucagccagacc

SEQ ID NO: 3388114 - RNA, 20 nt, Pseudomonas aeruginosa PA01
cggcggcuuccuccaucgcc

SEQ ID NO: 3388115 - RNA, 21 nt, Pseudomonas aeruginosa PA01
cggcggcuuccuccaucgccu

SEQ ID NO: 3388116 - RNA, 20 nt, Pseudomonas aeruginosa PA01
cggcggcuucgcgcuccagg

SEQ ID NO: 3388117 - RNA, 21 nt, Pseudomonas aeruginosa PA01
cggcggcuucgcgcuccaggc

SEQ ID NO: 3388118 - RNA, 17 nt, Pseudomonas aeruginosa PA01
cggcgggaaacgcagcg

SEQ ID NO: 3388119 - RNA, 12 nt, Pseudomonas aeruginosa PA01
cggcgggaacgc

SEQ ID NO: 3388120 - RNA, 13 nt, Pseudomonas aeruginosa PA01
cggcgggaacgcc

SEQ ID NO: 3388121 - RNA, 15 nt, Pseudomonas aeruginosa PA01
cggcgggaacgccgg

SEQ ID NO: 3388122 - RNA, 16 nt, Pseudomonas aeruginosa PA01
cggcgggaacgccggg

SEQ ID NO: 3388123 - RNA, 17 nt, Pseudomonas aeruginosa PA01
cggcgggaacgccgggc

SEQ ID NO: 3388124 - RNA, 13 nt, Pseudomonas aeruginosa PA01
cggcgggacggcg

SEQ ID NO: 3388125 - RNA, 18 nt, Pseudomonas aeruginosa PA01
cggcgggagagggcggcg

SEQ ID NO: 3388126 - RNA, 20 nt, Pseudomonas aeruginosa PA01
cggcgggagagggcggcgac

SEQ ID NO: 3388127 - RNA, 14 nt, Pseudomonas aeruginosa PA01
cggcgggagcggcc

SEQ ID NO: 3388128 - RNA, 14 nt, Pseudomonas aeruginosa PA01
cggcgggcaccgcc

SEQ ID NO: 3388129 - RNA, 17 nt, Pseudomonas aeruginosa PA01
cggcgggcaccgccagc

SEQ ID NO: 3388130 - RNA, 16 nt, Pseudomonas aeruginosa PA01
cggcgggcccguggca

SEQ ID NO: 3388131 - RNA, 19 nt, Pseudomonas aeruginosa PA01
cggcgggcccguggcaggu

SEQ ID NO: 3388132 - RNA, 13 nt, Pseudomonas aeruginosa PA01
cggcgggccggcg

SEQ ID NO: 3388133 - RNA, 20 nt, Pseudomonas aeruginosa PA01
cggcgggccggcguccagga

SEQ ID NO: 3388134 - RNA, 16 nt, Pseudomonas aeruginosa PA01
cggcgggcgcccgcca

SEQ ID NO: 3388135 - RNA, 13 nt, Pseudomonas aeruginosa PA01
cggcgggcgcgag

SEQ ID NO: 3388136 - RNA, 20 nt, Pseudomonas aeruginosa PA01
cggcgggcgguagcgggcca

SEQ ID NO: 3388137 - RNA, 21 nt, Pseudomonas aeruginosa PA01
cggcgggcucgcaaucagcgc

SEQ ID NO: 3388138 - RNA, 16 nt, Pseudomonas aeruginosa PA01
cggcgggcugccgcgg

SEQ ID NO: 3388139 - RNA, 14 nt, Pseudomonas aeruginosa PA01
cggcggggaaggcg

SEQ ID NO: 3388140 - RNA, 18 nt, Pseudomonas aeruginosa PA01
cggcggggaaggcgucgg

SEQ ID NO: 3388141 - RNA, 18 nt, Pseudomonas aeruginosa PA01
cggcggggcgcaccgccu

SEQ ID NO: 3388142 - RNA, 20 nt, Pseudomonas aeruginosa PA01
cggcggggcgcaccgccucg

SEQ ID NO: 3388143 - RNA, 21 nt, Pseudomonas aeruginosa PA01
cggcggggcgcaccgccucga

SEQ ID NO: 3388144 - RNA, 14 nt, Pseudomonas aeruginosa PA01
cggcggggcgcagc

SEQ ID NO: 3388145 - RNA, 15 nt, Pseudomonas aeruginosa PA01
cggcggggcgcagca

SEQ ID NO: 3388146 - RNA, 17 nt, Pseudomonas aeruginosa PA01
cggcggggcgcagcagg

SEQ ID NO: 3388147 - RNA, 20 nt, Pseudomonas aeruginosa PA01
cggcggggcuuuuuuucgcc

SEQ ID NO: 3388148 - RNA, 15 nt, Pseudomonas aeruginosa PA01
cggcggggucgggca

SEQ ID NO: 3388149 - RNA, 22 nt, Pseudomonas aeruginosa PA01
cggcggguaguguuugcgcagg

SEQ ID NO: 3388150 - RNA, 18 nt, Pseudomonas aeruginosa PA01
cggcggguauccgccggg

SEQ ID NO: 3388151 - RNA, 22 nt, Pseudomonas aeruginosa PA01
cggcggguauccgccgggccgc

SEQ ID NO: 3388152 - RNA, 17 nt, Pseudomonas aeruginosa PA01
cggcgggucacgccgag

SEQ ID NO: 3388153 - RNA, 20 nt, Pseudomonas aeruginosa PA01
cggcgggucacgccgagggc

SEQ ID NO: 3388154 - RNA, 21 nt, Pseudomonas aeruginosa PA01
cggcgggucacgccgagggcg

SEQ ID NO: 3388155 - RNA, 23 nt, Pseudomonas aeruginosa PA01
cggcgggugcguggugcauccgc

SEQ ID NO: 3388156 - RNA, 22 nt, Pseudomonas aeruginosa PA01
cggcggguggcgcugucgccgg

SEQ ID NO: 3388157 - RNA, 22 nt, Pseudomonas aeruginosa PA01
cggcgggugugguccgcggugu

SEQ ID NO: 3388158 - RNA, 19 nt, Pseudomonas aeruginosa PA01
cggcggguucagcccgccg

SEQ ID NO: 3388159 - RNA, 19 nt, Pseudomonas aeruginosa PA01
cggcgguacauggccuucu

SEQ ID NO: 3388160 - RNA, 16 nt, Pseudomonas aeruginosa PA01
cggcgguagccgaggc

SEQ ID NO: 3388161 - RNA, 17 nt, Pseudomonas aeruginosa PA01
cggcgguagccgaggcg

SEQ ID NO: 3388162 - RNA, 18 nt, Pseudomonas aeruginosa PA01
cggcgguagcuccaggcc

SEQ ID NO: 3388163 - RNA, 13 nt, Pseudomonas aeruginosa PA01
cggcggucaggcu

SEQ ID NO: 3388164 - RNA, 18 nt, Pseudomonas aeruginosa PA01
cggcggucaggcucagcu

SEQ ID NO: 3388165 - RNA, 21 nt, Pseudomonas aeruginosa PA01
cggcggucaggcucagcucgg

SEQ ID NO: 3388166 - RNA, 13 nt, Pseudomonas aeruginosa PA01
cggcggucagguu

SEQ ID NO: 3388167 - RNA, 14 nt, Pseudomonas aeruginosa PA01
cggcggucaucgcg

SEQ ID NO: 3388168 - RNA, 15 nt, Pseudomonas aeruginosa PA01
cggcggucaucgcgc

SEQ ID NO: 3388169 - RNA, 18 nt, Pseudomonas aeruginosa PA01
cggcggucaucgcgccgc

SEQ ID NO: 3388170 - RNA, 11 nt, Pseudomonas aeruginosa PA01
cggcgguccag

SEQ ID NO: 3388171 - RNA, 13 nt, Pseudomonas aeruginosa PA01
cggcgguccaggg

SEQ ID NO: 3388172 - RNA, 20 nt, Pseudomonas aeruginosa PA01
cggcgguccaggggccgaug

SEQ ID NO: 3388173 - RNA, 22 nt, Pseudomonas aeruginosa PA01
cggcgguccaggggccgaugcc

SEQ ID NO: 3388174 - RNA, 23 nt, Pseudomonas aeruginosa PA01
cggcgguccaggggccgaugccg

SEQ ID NO: 3388175 - RNA, 22 nt, Pseudomonas aeruginosa PA01
cggcggucccagaccagcagcg

SEQ ID NO: 3388176 - RNA, 23 nt, Pseudomonas aeruginosa PA01
cggcggucccagaccagcagcgg

SEQ ID NO: 3388177 - RNA, 17 nt, Pseudomonas aeruginosa PA01
cggcggucccaucagca

SEQ ID NO: 3388178 - RNA, 21 nt, Pseudomonas aeruginosa PA01
cggcggucccaucagcagucc

SEQ ID NO: 3388179 - RNA, 18 nt, Pseudomonas aeruginosa PA01
cggcucacgccccagcgc

SEQ ID NO: 3388180 - RNA, 17 nt, Pseudomonas aeruginosa PA01
cggcucagaaauccacc

SEQ ID NO: 3388181 - RNA, 23 nt, Pseudomonas aeruginosa PA01
cggcucagaaauccaccuugccg

SEQ ID NO: 3388182 - RNA, 16 nt, Pseudomonas aeruginosa PA01
cggcucagccgcuggc

SEQ ID NO: 3388183 - RNA, 17 nt, Pseudomonas aeruginosa PA01
cggcucagccgcuggcg

SEQ ID NO: 3388184 - RNA, 20 nt, Pseudomonas aeruginosa PA01
cggcucagccgcuggcgucg

SEQ ID NO: 3388185 - RNA, 18 nt, Pseudomonas aeruginosa PA01
cggcucaggccgccgcgu

SEQ ID NO: 3388186 - RNA, 23 nt, Pseudomonas aeruginosa PA01
cggcucaggccgccgcgucgaag

SEQ ID NO: 3388187 - RNA, 15 nt, Pseudomonas aeruginosa PA01
cggcucauggccggg

SEQ ID NO: 3388188 - RNA, 14 nt, Pseudomonas aeruginosa PA01
cggcuccaacggcc

SEQ ID NO: 3388189 - RNA, 16 nt, Pseudomonas aeruginosa PA01
cggcuccaacggcccu

SEQ ID NO: 3388190 - RNA, 19 nt, Pseudomonas aeruginosa PA01
cggcuccagcaccagcacg

SEQ ID NO: 3388191 - RNA, 16 nt, Pseudomonas aeruginosa PA01
cggcuccagccaggcc

SEQ ID NO: 3388192 - RNA, 17 nt, Pseudomonas aeruginosa PA01
cggcuccagccaggccc

SEQ ID NO: 3388193 - RNA, 18 nt, Pseudomonas aeruginosa PA01
cggcuccagccaggcccg

SEQ ID NO: 3388194 - RNA, 19 nt, Pseudomonas aeruginosa PA01
cggcuccagccaggcccgg

SEQ ID NO: 3388195 - RNA, 14 nt, Pseudomonas aeruginosa PA01
cggcuccagccggg

SEQ ID NO: 3388196 - RNA, 15 nt, Pseudomonas aeruginosa PA01
cggcuccagccgggc

SEQ ID NO: 3388197 - RNA, 20 nt, Pseudomonas aeruginosa PA01
cggcuccagccgggcuccgc

SEQ ID NO: 3388198 - RNA, 23 nt, Pseudomonas aeruginosa PA01
cggcuccagcuugucgucggccu

SEQ ID NO: 3388199 - RNA, 15 nt, Pseudomonas aeruginosa PA01
cggcuccaggaccgg

SEQ ID NO: 3388200 - RNA, 18 nt, Pseudomonas aeruginosa PA01
cggcuccaguugcagcac

SEQ ID NO: 3388201 - RNA, 21 nt, Pseudomonas aeruginosa PA01
cggcuccccuggaaugccggc

SEQ ID NO: 3388202 - RNA, 16 nt, Pseudomonas aeruginosa PA01
cggcuccgcgcacgga

SEQ ID NO: 3388203 - RNA, 22 nt, Pseudomonas aeruginosa PA01
cggcuccgcgcacggaucgcgc

SEQ ID NO: 3388204 - RNA, 14 nt, Pseudomonas aeruginosa PA01
cggcuccggcgcca

SEQ ID NO: 3388205 - RNA, 17 nt, Pseudomonas aeruginosa PA01
cggcuccggcgccaggc

SEQ ID NO: 3388206 - RNA, 18 nt, Pseudomonas aeruginosa PA01
cggcuccggcgccaggcc

SEQ ID NO: 3388207 - RNA, 17 nt, Pseudomonas aeruginosa PA01
cggcuccggcuccgcgc

SEQ ID NO: 3388208 - RNA, 18 nt, Pseudomonas aeruginosa PA01
cggcuccggguacuggcg

SEQ ID NO: 3388209 - RNA, 14 nt, Pseudomonas aeruginosa PA01
cggcuccucggccu

SEQ ID NO: 3388210 - RNA, 23 nt, Pseudomonas aeruginosa PA01
cggcuccucggccugggcgcagg

SEQ ID NO: 3388211 - RNA, 13 nt, Pseudomonas aeruginosa PA01
cggcuccucugcc

SEQ ID NO: 3388212 - RNA, 19 nt, Pseudomonas aeruginosa PA01
cggcuccucugccugcgcc

SEQ ID NO: 3388213 - RNA, 21 nt, Pseudomonas aeruginosa PA01
cggcuccucugccugcgcccu

SEQ ID NO: 3388214 - RNA, 16 nt, Pseudomonas aeruginosa PA01
cggcuccuugcgccgu

SEQ ID NO: 3388215 - RNA, 21 nt, Pseudomonas aeruginosa PA01
cggcuccuugcgccguugccg

SEQ ID NO: 3388216 - RNA, 22 nt, Pseudomonas aeruginosa PA01
cggcucgaacgaguggggcgga

SEQ ID NO: 3388217 - RNA, 13 nt, Pseudomonas aeruginosa PA01
cggcucgaccuug

SEQ ID NO: 3388218 - RNA, 20 nt, Pseudomonas aeruginosa PA01
cggcucgcccagcaggcgcg

SEQ ID NO: 3388219 - RNA, 15 nt, Pseudomonas aeruginosa PA01
cggcucgcccaugcg

SEQ ID NO: 3388220 - RNA, 17 nt, Pseudomonas aeruginosa PA01
cggcucgcccaugcgcg

SEQ ID NO: 3388221 - RNA, 13 nt, Pseudomonas aeruginosa PA01
cggcucgccgaaa

SEQ ID NO: 3388222 - RNA, 21 nt, Pseudomonas aeruginosa PA01
cggcucgccgacuuccaggcg

SEQ ID NO: 3388223 - RNA, 15 nt, Pseudomonas aeruginosa PA01
cggcucgccgccggg

SEQ ID NO: 3388224 - RNA, 16 nt, Pseudomonas aeruginosa PA01
cggcucgccgcgcugc

SEQ ID NO: 3388225 - RNA, 13 nt, Pseudomonas aeruginosa PA01
cggcucgcgcagc

SEQ ID NO: 3388226 - RNA, 16 nt, Pseudomonas aeruginosa PA01
cggcucgcgcagcggc

SEQ ID NO: 3388227 - RNA, 15 nt, Pseudomonas aeruginosa PA01
cggcucgcgccggcg

SEQ ID NO: 3388228 - RNA, 17 nt, Pseudomonas aeruginosa PA01
cggcucgcgccggcgcg

SEQ ID NO: 3388229 - RNA, 18 nt, Pseudomonas aeruginosa PA01
cggcucgcgguucgagga

SEQ ID NO: 3388230 - RNA, 21 nt, Pseudomonas aeruginosa PA01
cggcucgcugaaauccaccag

SEQ ID NO: 3388231 - RNA, 22 nt, Pseudomonas aeruginosa PA01
cggcucgcugaaauccaccagc

SEQ ID NO: 3388232 - RNA, 16 nt, Pseudomonas aeruginosa PA01
cggcucgcugacgcca

SEQ ID NO: 3388233 - RNA, 13 nt, Pseudomonas aeruginosa PA01
cggcucggcaagc

SEQ ID NO: 3388234 - RNA, 18 nt, Pseudomonas aeruginosa PA01
cggcucggcacgcguggc

SEQ ID NO: 3388235 - RNA, 22 nt, Pseudomonas aeruginosa PA01
cggcucggcacgcguggcgagu

SEQ ID NO: 3388236 - RNA, 13 nt, Pseudomonas aeruginosa PA01
cggcucggccagg

SEQ ID NO: 3388237 - RNA, 14 nt, Pseudomonas aeruginosa PA01
cggcucggccaggg

SEQ ID NO: 3388238 - RNA, 16 nt, Pseudomonas aeruginosa PA01
cggcucggccagggcc

SEQ ID NO: 3388239 - RNA, 19 nt, Pseudomonas aeruginosa PA01
cggcucggccagggccgcu

SEQ ID NO: 3388240 - RNA, 22 nt, Pseudomonas aeruginosa PA01
cggcucggccgugugccugagc

SEQ ID NO: 3388241 - RNA, 20 nt, Pseudomonas aeruginosa PA01
cggcucggcgaggaacagca

SEQ ID NO: 3388242 - RNA, 22 nt, Pseudomonas aeruginosa PA01
cggcucggcuccaggaccggca

SEQ ID NO: 3388243 - RNA, 17 nt, Pseudomonas aeruginosa PA01
cggcucggcugcuugcc

SEQ ID NO: 3388244 - RNA, 14 nt, Pseudomonas aeruginosa PA01
cggcucgggcggca

SEQ ID NO: 3388245 - RNA, 21 nt, Pseudomonas aeruginosa PA01
cggcucgguguaggcgaucug

SEQ ID NO: 3388246 - RNA, 22 nt, Pseudomonas aeruginosa PA01
cggcucgguuccagcucgucga

SEQ ID NO: 3388247 - RNA, 14 nt, Pseudomonas aeruginosa PA01
cggcucgucggcgu

SEQ ID NO: 3388248 - RNA, 21 nt, Pseudomonas aeruginosa PA01
cggcucguucaugucggcucc

SEQ ID NO: 3388249 - RNA, 15 nt, Pseudomonas aeruginosa PA01
cggcucuccccgcuc

SEQ ID NO: 3388250 - RNA, 17 nt, Pseudomonas aeruginosa PA01
cggcucucuucggccga

SEQ ID NO: 3388251 - RNA, 13 nt, Pseudomonas aeruginosa PA01
cggcucugcuucu

SEQ ID NO: 3388252 - RNA, 17 nt, Pseudomonas aeruginosa PA01
cggcucugcuucugucc

SEQ ID NO: 3388253 - RNA, 21 nt, Pseudomonas aeruginosa PA01
cggcucugcuucugucccugg

SEQ ID NO: 3388254 - RNA, 12 nt, Pseudomonas aeruginosa PA01
cggcucuucccc

SEQ ID NO: 3388255 - RNA, 16 nt, Pseudomonas aeruginosa PA01
cggcugaaggccgaac

SEQ ID NO: 3388256 - RNA, 21 nt, Pseudomonas aeruginosa PA01
cggcugaaggugagauggucg

SEQ ID NO: 3388257 - RNA, 16 nt, Pseudomonas aeruginosa PA01
cggcugaccggcaucg

SEQ ID NO: 3388258 - RNA, 21 nt, Pseudomonas aeruginosa PA01
cggcugaccggcaucgaccag

SEQ ID NO: 3388259 - RNA, 22 nt, Pseudomonas aeruginosa PA01
cggcugaccggcaucgaccagc

SEQ ID NO: 3388260 - RNA, 20 nt, Pseudomonas aeruginosa PA01
cggcugacgaagugauggaa

SEQ ID NO: 3388261 - RNA, 17 nt, Pseudomonas aeruginosa PA01
cggcugacgcuggcgaa

SEQ ID NO: 3388262 - RNA, 22 nt, Pseudomonas aeruginosa PA01
cggcugagaccuuccugccagc

SEQ ID NO: 3388263 - RNA, 13 nt, Pseudomonas aeruginosa PA01
cggcugagcgcca

SEQ ID NO: 3388264 - RNA, 17 nt, Pseudomonas aeruginosa PA01
cggcugagcgccaggcg

SEQ ID NO: 3388265 - RNA, 21 nt, Pseudomonas aeruginosa PA01
cggcugagcuguuucagccca

SEQ ID NO: 3388266 - RNA, 14 nt, Pseudomonas aeruginosa PA01
cggcugaggcuggc

SEQ ID NO: 3388267 - RNA, 15 nt, Pseudomonas aeruginosa PA01
cggcugaggcuggcg

SEQ ID NO: 3388268 - RNA, 23 nt, Pseudomonas aeruginosa PA01
cggcugaugcccgggucgucggu

SEQ ID NO: 3388269 - RNA, 15 nt, Pseudomonas aeruginosa PA01
cggcugcaacgccgc

SEQ ID NO: 3388270 - RNA, 16 nt, Pseudomonas aeruginosa PA01
cggcugcaacgccggc

SEQ ID NO: 3388271 - RNA, 17 nt, Pseudomonas aeruginosa PA01
cggcugcaacgccggcc

SEQ ID NO: 3388272 - RNA, 18 nt, Pseudomonas aeruginosa PA01
cggcugcaacuuccacuc

SEQ ID NO: 3388273 - RNA, 19 nt, Pseudomonas aeruginosa PA01
cggcugcaacuuccacucg

SEQ ID NO: 3388274 - RNA, 18 nt, Pseudomonas aeruginosa PA01
cggcugcacagguugacg

SEQ ID NO: 3388275 - RNA, 19 nt, Pseudomonas aeruginosa PA01
cggcugcacguuguucacc

SEQ ID NO: 3388276 - RNA, 20 nt, Pseudomonas aeruginosa PA01
cggcugcacguuguucaccg

SEQ ID NO: 3388277 - RNA, 13 nt, Pseudomonas aeruginosa PA01
cggcugcagggcc

SEQ ID NO: 3388278 - RNA, 17 nt, Pseudomonas aeruginosa PA01
cggcugcagggccaggg

SEQ ID NO: 3388279 - RNA, 17 nt, Pseudomonas aeruginosa PA01
cggcugcauguccgcca

SEQ ID NO: 3388280 - RNA, 18 nt, Pseudomonas aeruginosa PA01
cggcugcauguccgccag

SEQ ID NO: 3388281 - RNA, 12 nt, Pseudomonas aeruginosa PA01
cggcuucggcgg

SEQ ID NO: 3388282 - RNA, 16 nt, Pseudomonas aeruginosa PA01
cggcuugacgaugccg

SEQ ID NO: 3388283 - RNA, 21 nt, Pseudomonas aeruginosa PA01
cggcuugacuggcaguccagg

SEQ ID NO: 3388284 - RNA, 13 nt, Pseudomonas aeruginosa PA01
cggcuugaggaaa

SEQ ID NO: 3388285 - RNA, 22 nt, Pseudomonas aeruginosa PA01
cggcuugaucgagcccuugcgc

SEQ ID NO: 3388286 - RNA, 16 nt, Pseudomonas aeruginosa PA01
cggcuugcccaucuuc

SEQ ID NO: 3388287 - RNA, 22 nt, Pseudomonas aeruginosa PA01
cggcuugcccaucuucagcauc

SEQ ID NO: 3388288 - RNA, 22 nt, Pseudomonas aeruginosa PA01
cggcuugccgaugucgccggca

SEQ ID NO: 3388289 - RNA, 18 nt, Pseudomonas aeruginosa PA01
cggcuugccggcagcgac

SEQ ID NO: 3388290 - RNA, 22 nt, Pseudomonas aeruginosa PA01
cggcuugccggcagcgaccacc

SEQ ID NO: 3388291 - RNA, 15 nt, Pseudomonas aeruginosa PA01
cggcuugccggcgcg

SEQ ID NO: 3388292 - RNA, 20 nt, Pseudomonas aeruginosa PA01
cggcuugccggcgcgcgguu

SEQ ID NO: 3388293 - RNA, 14 nt, Pseudomonas aeruginosa PA01
cggcuugccggcgg

SEQ ID NO: 3388294 - RNA, 16 nt, Pseudomonas aeruginosa PA01
cggcuugccggcggcg

SEQ ID NO: 3388295 - RNA, 17 nt, Pseudomonas aeruginosa PA01
cggcuugccgucggugu

SEQ ID NO: 3388296 - RNA, 14 nt, Pseudomonas aeruginosa PA01
cggcuugcguucgc

SEQ ID NO: 3388297 - RNA, 19 nt, Pseudomonas aeruginosa PA01
cggcuuggcgggcucgccc

SEQ ID NO: 3388298 - RNA, 13 nt, Pseudomonas aeruginosa PA01
cggcuuggcucag

SEQ ID NO: 3388299 - RNA, 20 nt, Pseudomonas aeruginosa PA01
cggcuuggcucaguugcuga

SEQ ID NO: 3388300 - RNA, 16 nt, Pseudomonas aeruginosa PA01
cggcuugguucgcgcg

SEQ ID NO: 3388301 - RNA, 23 nt, Pseudomonas aeruginosa PA01
cggcuugguucgcgcgcuggucg

SEQ ID NO: 3388302 - RNA, 22 nt, Pseudomonas aeruginosa PA01
cggcuuguccuggcgcaugucg

SEQ ID NO: 3388303 - RNA, 22 nt, Pseudomonas aeruginosa PA01
cggcuuguucagcucggcguag

SEQ ID NO: 3388304 - RNA, 14 nt, Pseudomonas aeruginosa PA01
cggcuuuccucggc

SEQ ID NO: 3388305 - RNA, 19 nt, Pseudomonas aeruginosa PA01
cggcuuuccucggccaugc

SEQ ID NO: 3388306 - RNA, 15 nt, Pseudomonas aeruginosa PA01
cggcuuuuucauuuc

SEQ ID NO: 3388307 - RNA, 21 nt, Pseudomonas aeruginosa PA01
cggcuuuuucauuucuucggg

SEQ ID NO: 3388308 - RNA, 20 nt, Pseudomonas aeruginosa PA01
cggcuuuuucuugcgugcga

SEQ ID NO: 3388309 - RNA, 19 nt, Pseudomonas aeruginosa PA01
cgggaaacagggcgacgcc

SEQ ID NO: 3388310 - RNA, 20 nt, Pseudomonas aeruginosa PA01
cgggaaacagggcgacgccg

SEQ ID NO: 3388311 - RNA, 21 nt, Pseudomonas aeruginosa PA01
cgggaaacagggcgacgccga

SEQ ID NO: 3388312 - RNA, 22 nt, Pseudomonas aeruginosa PA01
cgggaaacagggcgacgccgau

SEQ ID NO: 3388313 - RNA, 16 nt, Pseudomonas aeruginosa PA01
cgggaaaccaccagga

SEQ ID NO: 3388314 - RNA, 14 nt, Pseudomonas aeruginosa PA01
cgggaaacgcgagu

SEQ ID NO: 3388315 - RNA, 17 nt, Pseudomonas aeruginosa PA01
cgggaaacgcgagugga

SEQ ID NO: 3388316 - RNA, 22 nt, Pseudomonas aeruginosa PA01
cgggaaacgcgaguggaggauc

SEQ ID NO: 3388317 - RNA, 17 nt, Pseudomonas aeruginosa PA01
cgggaaaggccgccacg

SEQ ID NO: 3388318 - RNA, 16 nt, Pseudomonas aeruginosa PA01
cgggaacagcccgucg

SEQ ID NO: 3388319 - RNA, 18 nt, Pseudomonas aeruginosa PA01
cgggaacagcccgucgcg

SEQ ID NO: 3388320 - RNA, 20 nt, Pseudomonas aeruginosa PA01
cgggaacagcccgucgcgcg

SEQ ID NO: 3388321 - RNA, 23 nt, Pseudomonas aeruginosa PA01
cgggaacagcccgucgcgcgccg

SEQ ID NO: 3388322 - RNA, 14 nt, Pseudomonas aeruginosa PA01
cgggaaccagcaug

SEQ ID NO: 3388323 - RNA, 15 nt, Pseudomonas aeruginosa PA01
cgggaacgccgggca

SEQ ID NO: 3388324 - RNA, 19 nt, Pseudomonas aeruginosa PA01
cgggaacuggcguugcuga

SEQ ID NO: 3388325 - RNA, 17 nt, Pseudomonas aeruginosa PA01
cgggaacuuggcgcgca

SEQ ID NO: 3388326 - RNA, 22 nt, Pseudomonas aeruginosa PA01
cgggaacuuggcgcgcagggca

SEQ ID NO: 3388327 - RNA, 21 nt, Pseudomonas aeruginosa PA01
cgggaagaaauagggccucaa

SEQ ID NO: 3388328 - RNA, 11 nt, Pseudomonas aeruginosa PA01
cgggaagcagg

SEQ ID NO: 3388329 - RNA, 15 nt, Pseudomonas aeruginosa PA01
cgggaagccgcucgg

SEQ ID NO: 3388330 - RNA, 18 nt, Pseudomonas aeruginosa PA01
cgggaagccgcucggcgu

SEQ ID NO: 3388331 - RNA, 21 nt, Pseudomonas aeruginosa PA01
cgggaagccgcucggcguagc

SEQ ID NO: 3388332 - RNA, 17 nt, Pseudomonas aeruginosa PA01
cgggaagcgaaccaggc

SEQ ID NO: 3388333 - RNA, 22 nt, Pseudomonas aeruginosa PA01
cgggaagcgaaccaggcaaugg

SEQ ID NO: 3388334 - RNA, 16 nt, Pseudomonas aeruginosa PA01
cgggaagcgcaggccg

SEQ ID NO: 3388335 - RNA, 19 nt, Pseudomonas aeruginosa PA01
cgggaaggauuccacccgc

SEQ ID NO: 3388336 - RNA, 13 nt, Pseudomonas aeruginosa PA01
cgggaagggucug

SEQ ID NO: 3388337 - RNA, 16 nt, Pseudomonas aeruginosa PA01
cgggaaggucggcagc

SEQ ID NO: 3388338 - RNA, 20 nt, Pseudomonas aeruginosa PA01
cgggaaggucggcagcagcu

SEQ ID NO: 3388339 - RNA, 15 nt, Pseudomonas aeruginosa PA01
cgggaaguaggccug

SEQ ID NO: 3388340 - RNA, 18 nt, Pseudomonas aeruginosa PA01
cgggaaguaggccuggcc

SEQ ID NO: 3388341 - RNA, 20 nt, Pseudomonas aeruginosa PA01
cgggaaguaggccuggccgc

SEQ ID NO: 3388342 - RNA, 22 nt, Pseudomonas aeruginosa PA01
cgggaaguaggccuggccgccc

SEQ ID NO: 3388343 - RNA, 23 nt, Pseudomonas aeruginosa PA01
cgggaaguaggccuggccgccca

SEQ ID NO: 3388344 - RNA, 21 nt, Pseudomonas aeruginosa PA01
cgggaaguccgggcgcggcug

SEQ ID NO: 3388345 - RNA, 15 nt, Pseudomonas aeruginosa PA01
cgggaagucguuccc

SEQ ID NO: 3388346 - RNA, 14 nt, Pseudomonas aeruginosa PA01
cgggaaucgccagc

SEQ ID NO: 3388347 - RNA, 15 nt, Pseudomonas aeruginosa PA01
cgggaaucgccagca

SEQ ID NO: 3388348 - RNA, 17 nt, Pseudomonas aeruginosa PA01
cgggaaucgccagcagg

SEQ ID NO: 3388349 - RNA, 19 nt, Pseudomonas aeruginosa PA01
cgggaaucgccagcaggcu

SEQ ID NO: 3388350 - RNA, 15 nt, Pseudomonas aeruginosa PA01
cgggaaucuggccga

SEQ ID NO: 3388351 - RNA, 17 nt, Pseudomonas aeruginosa PA01
cgggaaucuggccgaug

SEQ ID NO: 3388352 - RNA, 20 nt, Pseudomonas aeruginosa PA01
cgggaaucuggccgaugccg

SEQ ID NO: 3388353 - RNA, 22 nt, Pseudomonas aeruginosa PA01
cgggaaugcucagcacggcgac

SEQ ID NO: 3388354 - RNA, 12 nt, Pseudomonas aeruginosa PA01
cgggaauggcgg

SEQ ID NO: 3388355 - RNA, 23 nt, Pseudomonas aeruginosa PA01
cgggacagcuugacccguugcgc

SEQ ID NO: 3388356 - RNA, 16 nt, Pseudomonas aeruginosa PA01
cgggacagcuugccgu

SEQ ID NO: 3388357 - RNA, 21 nt, Pseudomonas aeruginosa PA01
cgggacagcuugccguccagc

SEQ ID NO: 3388358 - RNA, 23 nt, Pseudomonas aeruginosa PA01
cgggacagcuugccguccagcga

SEQ ID NO: 3388359 - RNA, 14 nt, Pseudomonas aeruginosa PA01
cgggacccugguag

SEQ ID NO: 3388360 - RNA, 23 nt, Pseudomonas aeruginosa PA01
cgggaccggcugcuuggccaggu

SEQ ID NO: 3388361 - RNA, 12 nt, Pseudomonas aeruginosa PA01
cgggacgaugcc

SEQ ID NO: 3388362 - RNA, 19 nt, Pseudomonas aeruginosa PA01
cgggacgcaugcgcggcgu

SEQ ID NO: 3388363 - RNA, 13 nt, Pseudomonas aeruginosa PA01
cgggacgccaggc

SEQ ID NO: 3388364 - RNA, 16 nt, Pseudomonas aeruginosa PA01
cgggacgccaggcguc

SEQ ID NO: 3388365 - RNA, 14 nt, Pseudomonas aeruginosa PA01
cgggacgccuggcg

SEQ ID NO: 3388366 - RNA, 16 nt, Pseudomonas aeruginosa PA01
cgggacgcgcaugcag

SEQ ID NO: 3388367 - RNA, 20 nt, Pseudomonas aeruginosa PA01
cgggacgcgcaugcagggcg

SEQ ID NO: 3388368 - RNA, 15 nt, Pseudomonas aeruginosa PA01
cgggacgcggcgugg

SEQ ID NO: 3388369 - RNA, 15 nt, Pseudomonas aeruginosa PA01
cgggacuggggcaug

SEQ ID NO: 3388370 - RNA, 18 nt, Pseudomonas aeruginosa PA01
cgggacuggggcaugggc

SEQ ID NO: 3388371 - RNA, 21 nt, Pseudomonas aeruginosa PA01
cgggacuggggcaugggcgcg

SEQ ID NO: 3388372 - RNA, 18 nt, Pseudomonas aeruginosa PA01
cgggacuuguacucgccg

SEQ ID NO: 3388373 - RNA, 22 nt, Pseudomonas aeruginosa PA01
cgggacuuguacucgccggugc

SEQ ID NO: 3388374 - RNA, 20 nt, Pseudomonas aeruginosa PA01
cgggacuuuccgaagccccg

SEQ ID NO: 3388375 - RNA, 17 nt, Pseudomonas aeruginosa PA01
cgggagagcccgggcgc

SEQ ID NO: 3388376 - RNA, 18 nt, Pseudomonas aeruginosa PA01
cgggagagcccgggcgca

SEQ ID NO: 3388377 - RNA, 17 nt, Pseudomonas aeruginosa PA01
cgggagagggcggcgac

SEQ ID NO: 3388378 - RNA, 15 nt, Pseudomonas aeruginosa PA01
cgggagcgcgaggcg

SEQ ID NO: 3388379 - RNA, 20 nt, Pseudomonas aeruginosa PA01
cgggagcgcgaggcgcaggc

SEQ ID NO: 3388380 - RNA, 19 nt, Pseudomonas aeruginosa PA01
cgggagcggccgugcaugc

SEQ ID NO: 3388381 - RNA, 13 nt, Pseudomonas aeruginosa PA01
cgggagcggccug

SEQ ID NO: 3388382 - RNA, 14 nt, Pseudomonas aeruginosa PA01
cgggagcggccuga

SEQ ID NO: 3388383 - RNA, 16 nt, Pseudomonas aeruginosa PA01
cgggagcuacagcgau

SEQ ID NO: 3388384 - RNA, 20 nt, Pseudomonas aeruginosa PA01
cgggagcuaugcaaaagugc

SEQ ID NO: 3388385 - RNA, 16 nt, Pseudomonas aeruginosa PA01
cgggaggcgccgcgcc

SEQ ID NO: 3388386 - RNA, 18 nt, Pseudomonas aeruginosa PA01
cgggaggcgccgcgccag

SEQ ID NO: 3388387 - RNA, 20 nt, Pseudomonas aeruginosa PA01
cgggaggcgccgcgccaggu

SEQ ID NO: 3388388 - RNA, 16 nt, Pseudomonas aeruginosa PA01
cgggaguucauggucg

SEQ ID NO: 3388389 - RNA, 15 nt, Pseudomonas aeruginosa PA01
cgggauacagcagcc

SEQ ID NO: 3388390 - RNA, 16 nt, Pseudomonas aeruginosa PA01
cgggauacagcagcca

SEQ ID NO: 3388391 - RNA, 17 nt, Pseudomonas aeruginosa PA01
cgggauacagcagccaa

SEQ ID NO: 3388392 - RNA, 19 nt, Pseudomonas aeruginosa PA01
cgggauacagcagccaagg

SEQ ID NO: 3388393 - RNA, 13 nt, Pseudomonas aeruginosa PA01
cgggauaccggcc

SEQ ID NO: 3388394 - RNA, 19 nt, Pseudomonas aeruginosa PA01
cgggauaccggccaucagc

SEQ ID NO: 3388395 - RNA, 23 nt, Pseudomonas aeruginosa PA01
cgggauaccggccaucagcacca

SEQ ID NO: 3388396 - RNA, 23 nt, Pseudomonas aeruginosa PA01
cgggaucagccgcgacucggcug

SEQ ID NO: 3388397 - RNA, 18 nt, Pseudomonas aeruginosa PA01
cgggaucaggucgccagc

SEQ ID NO: 3388398 - RNA, 21 nt, Pseudomonas aeruginosa PA01
cgggaucaggucgccagcgcc

SEQ ID NO: 3388399 - RNA, 20 nt, Pseudomonas aeruginosa PA01
cgggaucgagcaacagcagg

SEQ ID NO: 3388400 - RNA, 23 nt, Pseudomonas aeruginosa PA01
cgggaucgaguaagugccgacca

SEQ ID NO: 3388401 - RNA, 13 nt, Pseudomonas aeruginosa PA01
cgggaucgaugcg

SEQ ID NO: 3388402 - RNA, 14 nt, Pseudomonas aeruginosa PA01
cgggaucgccucgu

SEQ ID NO: 3388403 - RNA, 17 nt, Pseudomonas aeruginosa PA01
cgggaucguaggcgcgc

SEQ ID NO: 3388404 - RNA, 14 nt, Pseudomonas aeruginosa PA01
cgggaucuccgcgc

SEQ ID NO: 3388405 - RNA, 16 nt, Pseudomonas aeruginosa PA01
cgggaucuccgcgcca

SEQ ID NO: 3388406 - RNA, 20 nt, Pseudomonas aeruginosa PA01
cgggaucuccgcgccacgcg

SEQ ID NO: 3388407 - RNA, 15 nt, Pseudomonas aeruginosa PA01
cgggaucuccucgac

SEQ ID NO: 3388408 - RNA, 19 nt, Pseudomonas aeruginosa PA01
cgggaucuccucgacggcg

SEQ ID NO: 3388409 - RNA, 22 nt, Pseudomonas aeruginosa PA01
cgggaucuccucgacggcggga

SEQ ID NO: 3388410 - RNA, 20 nt, Pseudomonas aeruginosa PA01
cgggaucuggcccugcaaca

SEQ ID NO: 3388411 - RNA, 22 nt, Pseudomonas aeruginosa PA01
cgggaucuggcccugcaacagg

SEQ ID NO: 3388412 - RNA, 16 nt, Pseudomonas aeruginosa PA01
cgggaucuucuaccug

SEQ ID NO: 3388413 - RNA, 19 nt, Pseudomonas aeruginosa PA01
cgggaucuucuaccuggcg

SEQ ID NO: 3388414 - RNA, 20 nt, Pseudomonas aeruginosa PA01
cgggaugaacugcagcuugu

SEQ ID NO: 3388415 - RNA, 15 nt, Pseudomonas aeruginosa PA01
cgggaugcccggccg

SEQ ID NO: 3388416 - RNA, 17 nt, Pseudomonas aeruginosa PA01
cgggaugcccggccgca

SEQ ID NO: 3388417 - RNA, 20 nt, Pseudomonas aeruginosa PA01
cgggaugcccggccgcaggc

SEQ ID NO: 3388418 - RNA, 22 nt, Pseudomonas aeruginosa PA01
cgggaugcccggccgcaggcag

SEQ ID NO: 3388419 - RNA, 19 nt, Pseudomonas aeruginosa PA01
cgggaugccgugccgugga

SEQ ID NO: 3388420 - RNA, 20 nt, Pseudomonas aeruginosa PA01
cgggaugcucaccgcgcuug

SEQ ID NO: 3388421 - RNA, 15 nt, Pseudomonas aeruginosa PA01
cgggauggucgaggg

SEQ ID NO: 3388422 - RNA, 17 nt, Pseudomonas aeruginosa PA01
cgggauggucgagggcg

SEQ ID NO: 3388423 - RNA, 14 nt, Pseudomonas aeruginosa PA01
cgggaugugcacca

SEQ ID NO: 3388424 - RNA, 17 nt, Pseudomonas aeruginosa PA01
cgggaugugcaccagca

SEQ ID NO: 3388425 - RNA, 15 nt, Pseudomonas aeruginosa PA01
cgggauugucgccgc

SEQ ID NO: 3388426 - RNA, 18 nt, Pseudomonas aeruginosa PA01
cgggauugucgccgccga

SEQ ID NO: 3388427 - RNA, 19 nt, Pseudomonas aeruginosa PA01
cgggauugucgccgccgag

SEQ ID NO: 3388428 - RNA, 20 nt, Pseudomonas aeruginosa PA01
cgggauugucgccgccgagu

SEQ ID NO: 3388429 - RNA, 18 nt, Pseudomonas aeruginosa PA01
cgggauuguugcggcggg

SEQ ID NO: 3388430 - RNA, 15 nt, Pseudomonas aeruginosa PA01
cgggcaaccgcggcg

SEQ ID NO: 3388431 - RNA, 16 nt, Pseudomonas aeruginosa PA01
cgggcaaccgcggcgg

SEQ ID NO: 3388432 - RNA, 18 nt, Pseudomonas aeruginosa PA01
cgggcaaccgcggcggcc

SEQ ID NO: 3388433 - RNA, 21 nt, Pseudomonas aeruginosa PA01
cgggcaaccgcggcggccuca

SEQ ID NO: 3388434 - RNA, 20 nt, Pseudomonas aeruginosa PA01
cgggcaacgauucgacgcag

SEQ ID NO: 3388435 - RNA, 15 nt, Pseudomonas aeruginosa PA01
cgggcaacgcgcaga

SEQ ID NO: 3388436 - RNA, 16 nt, Pseudomonas aeruginosa PA01
cgggcaacugaucagc

SEQ ID NO: 3388437 - RNA, 17 nt, Pseudomonas aeruginosa PA01
cgggcaacugaucagcc

SEQ ID NO: 3388438 - RNA, 18 nt, Pseudomonas aeruginosa PA01
cgggcaacugccgauggu

SEQ ID NO: 3388439 - RNA, 14 nt, Pseudomonas aeruginosa PA01
cgggcaagcucgac

SEQ ID NO: 3388440 - RNA, 18 nt, Pseudomonas aeruginosa PA01
cgggcaagcucgacgagc

SEQ ID NO: 3388441 - RNA, 14 nt, Pseudomonas aeruginosa PA01
cgggcaccagcacg

SEQ ID NO: 3388442 - RNA, 19 nt, Pseudomonas aeruginosa PA01
cgggcaccccgagcggcgc

SEQ ID NO: 3388443 - RNA, 20 nt, Pseudomonas aeruginosa PA01
cgggcaccccgagcggcgcg

SEQ ID NO: 3388444 - RNA, 22 nt, Pseudomonas aeruginosa PA01
cgggcaccgagucggcaacgau

SEQ ID NO: 3388445 - RNA, 14 nt, Pseudomonas aeruginosa PA01
cgggcaccgccagc

SEQ ID NO: 3388446 - RNA, 15 nt, Pseudomonas aeruginosa PA01
cgggcaccgccagcc

SEQ ID NO: 3388447 - RNA, 16 nt, Pseudomonas aeruginosa PA01
cgggcaccgccagccc

SEQ ID NO: 3388448 - RNA, 18 nt, Pseudomonas aeruginosa PA01
cgggcaccgccagcccgc

SEQ ID NO: 3388449 - RNA, 19 nt, Pseudomonas aeruginosa PA01
cgggcaccgccagcccgcc

SEQ ID NO: 3388450 - RNA, 23 nt, Pseudomonas aeruginosa PA01
cgggcacuucucgaacagcuccu

SEQ ID NO: 3388451 - RNA, 17 nt, Pseudomonas aeruginosa PA01
cgggcacuugucgacgu

SEQ ID NO: 3388452 - RNA, 18 nt, Pseudomonas aeruginosa PA01
cgggcagacaccaccagg

SEQ ID NO: 3388453 - RNA, 12 nt, Pseudomonas aeruginosa PA01
cgggcagaccag

SEQ ID NO: 3388454 - RNA, 16 nt, Pseudomonas aeruginosa PA01
cgggcagaguggcgcg

SEQ ID NO: 3388455 - RNA, 18 nt, Pseudomonas aeruginosa PA01
cgggcagaguggcgcggc

SEQ ID NO: 3388456 - RNA, 21 nt, Pseudomonas aeruginosa PA01
cgggcagaguggcgcggcuga

SEQ ID NO: 3388457 - RNA, 16 nt, Pseudomonas aeruginosa PA01
cgggcagauguccagg

SEQ ID NO: 3388458 - RNA, 17 nt, Pseudomonas aeruginosa PA01
cgggcagauguccaggc

SEQ ID NO: 3388459 - RNA, 20 nt, Pseudomonas aeruginosa PA01
cgggcagauguccaggcagg

SEQ ID NO: 3388460 - RNA, 21 nt, Pseudomonas aeruginosa PA01
cgggcagauguccaggcaggc

SEQ ID NO: 3388461 - RNA, 14 nt, Pseudomonas aeruginosa PA01
cgggcagcagccgg

SEQ ID NO: 3388462 - RNA, 15 nt, Pseudomonas aeruginosa PA01
cgggcagcagccgga

SEQ ID NO: 3388463 - RNA, 12 nt, Pseudomonas aeruginosa PA01
cgggcagccccu

SEQ ID NO: 3388464 - RNA, 14 nt, Pseudomonas aeruginosa PA01
cgggcagccuggcu

SEQ ID NO: 3388465 - RNA, 23 nt, Pseudomonas aeruginosa PA01
cgggcagcucguugcacagcgcc

SEQ ID NO: 3388466 - RNA, 16 nt, Pseudomonas aeruginosa PA01
cgggcaggccgaggcc

SEQ ID NO: 3388467 - RNA, 20 nt, Pseudomonas aeruginosa PA01
cgggcaggccgaggccggcg

SEQ ID NO: 3388468 - RNA, 15 nt, Pseudomonas aeruginosa PA01
cgggcaguccuggcg

SEQ ID NO: 3388469 - RNA, 16 nt, Pseudomonas aeruginosa PA01
cgggcaguccuggcgg

SEQ ID NO: 3388470 - RNA, 12 nt, Pseudomonas aeruginosa PA01
cgggcaguucca

SEQ ID NO: 3388471 - RNA, 16 nt, Pseudomonas aeruginosa PA01
cgggcaguuccaggcc

SEQ ID NO: 3388472 - RNA, 18 nt, Pseudomonas aeruginosa PA01
cgggcaguuccgccagau

SEQ ID NO: 3388473 - RNA, 18 nt, Pseudomonas aeruginosa PA01
cgggcauauggaucggcc

SEQ ID NO: 3388474 - RNA, 19 nt, Pseudomonas aeruginosa PA01
cgggcaucaugccgagcau

SEQ ID NO: 3388475 - RNA, 23 nt, Pseudomonas aeruginosa PA01
cgggcaucaugccgagcaucagc

SEQ ID NO: 3388476 - RNA, 12 nt, Pseudomonas aeruginosa PA01
cgggcauccagc

SEQ ID NO: 3388477 - RNA, 14 nt, Pseudomonas aeruginosa PA01
cgggcaucgccgac

SEQ ID NO: 3388478 - RNA, 17 nt, Pseudomonas aeruginosa PA01
cgggcaucgucgaaggg

SEQ ID NO: 3388479 - RNA, 21 nt, Pseudomonas aeruginosa PA01
cgggcaucuugcccagccgac

SEQ ID NO: 3388480 - RNA, 19 nt, Pseudomonas aeruginosa PA01
cgggcaugccgugggcgcc

SEQ ID NO: 3388481 - RNA, 15 nt, Pseudomonas aeruginosa PA01
cgggcauggaucucc

SEQ ID NO: 3388482 - RNA, 19 nt, Pseudomonas aeruginosa PA01
cgggccagcagcuccgggc

SEQ ID NO: 3388483 - RNA, 13 nt, Pseudomonas aeruginosa PA01
cgggccagcaggc

SEQ ID NO: 3388484 - RNA, 14 nt, Pseudomonas aeruginosa PA01
cgggccagcaggcg

SEQ ID NO: 3388485 - RNA, 15 nt, Pseudomonas aeruginosa PA01
cgggcucaggcucuu

SEQ ID NO: 3388486 - RNA, 12 nt, Pseudomonas aeruginosa PA01
cgggcuccgccg

SEQ ID NO: 3388487 - RNA, 14 nt, Pseudomonas aeruginosa PA01
cgggcuccgccgcg

SEQ ID NO: 3388488 - RNA, 17 nt, Pseudomonas aeruginosa PA01
cgggcucgacgaggaac

SEQ ID NO: 3388489 - RNA, 21 nt, Pseudomonas aeruginosa PA01
cgggcucgcaaucagcgcgau

SEQ ID NO: 3388490 - RNA, 22 nt, Pseudomonas aeruginosa PA01
cgggcucgugcccucgcuacgg

SEQ ID NO: 3388491 - RNA, 16 nt, Pseudomonas aeruginosa PA01
cgggcucuaugcgcgg

SEQ ID NO: 3388492 - RNA, 16 nt, Pseudomonas aeruginosa PA01
cgggcucugguagccg

SEQ ID NO: 3388493 - RNA, 18 nt, Pseudomonas aeruginosa PA01
cgggcucugguagccgca

SEQ ID NO: 3388494 - RNA, 14 nt, Pseudomonas aeruginosa PA01
cgggcucugugcuu

SEQ ID NO: 3388495 - RNA, 13 nt, Pseudomonas aeruginosa PA01
cgggcugccagca

SEQ ID NO: 3388496 - RNA, 12 nt, Pseudomonas aeruginosa PA01
cgggcugccccu

SEQ ID NO: 3388497 - RNA, 13 nt, Pseudomonas aeruginosa PA01
cgggcugccgcgg

SEQ ID NO: 3388498 - RNA, 17 nt, Pseudomonas aeruginosa PA01
cgggcugcgcucggcgc

SEQ ID NO: 3388499 - RNA, 16 nt, Pseudomonas aeruginosa PA01
cgggcuggaaaacgcc

SEQ ID NO: 3388500 - RNA, 13 nt, Pseudomonas aeruginosa PA01
cgggcuggccacc

SEQ ID NO: 3388501 - RNA, 14 nt, Pseudomonas aeruginosa PA01
cgggcuggccacca

SEQ ID NO: 3388502 - RNA, 17 nt, Pseudomonas aeruginosa PA01
cgggcuggccaccagca

SEQ ID NO: 3388503 - RNA, 18 nt, Pseudomonas aeruginosa PA01
cgggcuggccaccagcac

SEQ ID NO: 3388504 - RNA, 19 nt, Pseudomonas aeruginosa PA01
cgggcuggccaccagcacc

SEQ ID NO: 3388505 - RNA, 20 nt, Pseudomonas aeruginosa PA01
cgggcuggccaccagcaccu

SEQ ID NO: 3388506 - RNA, 14 nt, Pseudomonas aeruginosa PA01
cgggcuggccaccg

SEQ ID NO: 3388507 - RNA, 15 nt, Pseudomonas aeruginosa PA01
cgggcuggccaccgc

SEQ ID NO: 3388508 - RNA, 17 nt, Pseudomonas aeruginosa PA01
cgggcuggccaccgcca

SEQ ID NO: 3388509 - RNA, 17 nt, Pseudomonas aeruginosa PA01
cgggcuggccaccggga

SEQ ID NO: 3388510 - RNA, 14 nt, Pseudomonas aeruginosa PA01
cgggcuggccgucg

SEQ ID NO: 3388511 - RNA, 18 nt, Pseudomonas aeruginosa PA01
cgggcuggucguagcagc

SEQ ID NO: 3388512 - RNA, 21 nt, Pseudomonas aeruginosa PA01
cgggcuggucguagcagcgga

SEQ ID NO: 3388513 - RNA, 21 nt, Pseudomonas aeruginosa PA01
cgggcuguagugcuccggggc

SEQ ID NO: 3388514 - RNA, 16 nt, Pseudomonas aeruginosa PA01
cgggcuucagcgccgg

SEQ ID NO: 3388515 - RNA, 18 nt, Pseudomonas aeruginosa PA01
cgggcuucagcgccgggu

SEQ ID NO: 3388516 - RNA, 16 nt, Pseudomonas aeruginosa PA01
cgggcuuccuggccgg

SEQ ID NO: 3388517 - RNA, 17 nt, Pseudomonas aeruginosa PA01
cgggcuuccuggccggg

SEQ ID NO: 3388518 - RNA, 20 nt, Pseudomonas aeruginosa PA01
cgggcuucgguguaucggcg

SEQ ID NO: 3388519 - RNA, 21 nt, Pseudomonas aeruginosa PA01
cgggcuucgguguaucggcgg

SEQ ID NO: 3388520 - RNA, 16 nt, Pseudomonas aeruginosa PA01
cgggcuucuucaccag

SEQ ID NO: 3388521 - RNA, 13 nt, Pseudomonas aeruginosa PA01
cgggcuugcaauc

SEQ ID NO: 3388522 - RNA, 19 nt, Pseudomonas aeruginosa PA01
cgggcuuuuucauggcugg

SEQ ID NO: 3388523 - RNA, 20 nt, Pseudomonas aeruginosa PA01
cgggcuuuuucauggcuggc

SEQ ID NO: 3388524 - RNA, 22 nt, Pseudomonas aeruginosa PA01
cgggcuuuuucauuuccuccga

SEQ ID NO: 3388525 - RNA, 14 nt, Pseudomonas aeruginosa PA01
cgggcuuuuucucg

SEQ ID NO: 3388526 - RNA, 24 nt, Pseudomonas aeruginosa PA01
cgggcuuuuuucauucauggcgcc

SEQ ID NO: 3388527 - RNA, 20 nt, Pseudomonas aeruginosa PA01
cggggaaaccuucgguggcg

SEQ ID NO: 3388528 - RNA, 22 nt, Pseudomonas aeruginosa PA01
cggggaaauccuugagcacccg

SEQ ID NO: 3388529 - RNA, 15 nt, Pseudomonas aeruginosa PA01
cggggaaccacaccu

SEQ ID NO: 3388530 - RNA, 18 nt, Pseudomonas aeruginosa PA01
cggggaaccacaccugca

SEQ ID NO: 3388531 - RNA, 21 nt, Pseudomonas aeruginosa PA01
cggggaaccacaccugcaaca

SEQ ID NO: 3388532 - RNA, 23 nt, Pseudomonas aeruginosa PA01
cggggaagauguucgccgccgcc

SEQ ID NO: 3388533 - RNA, 18 nt, Pseudomonas aeruginosa PA01
cggggaagccuucgcccg

SEQ ID NO: 3388534 - RNA, 22 nt, Pseudomonas aeruginosa PA01
cggggaagcugccuuccagcag

SEQ ID NO: 3388535 - RNA, 23 nt, Pseudomonas aeruginosa PA01
cggggaagcugccuuccagcagg

SEQ ID NO: 3388536 - RNA, 17 nt, Pseudomonas aeruginosa PA01
cggggaagggacgucgc

SEQ ID NO: 3388537 - RNA, 19 nt, Pseudomonas aeruginosa PA01
cggggaagggacgucgcca

SEQ ID NO: 3388538 - RNA, 18 nt, Pseudomonas aeruginosa PA01
cggggacaugucgagggu

SEQ ID NO: 3388539 - RNA, 20 nt, Pseudomonas aeruginosa PA01
cggggaccugucggcucgcg

SEQ ID NO: 3388540 - RNA, 19 nt, Pseudomonas aeruginosa PA01
cggggacgcugucccggcc

SEQ ID NO: 3388541 - RNA, 21 nt, Pseudomonas aeruginosa PA01
cggggacgcugucccggccau

SEQ ID NO: 3388542 - RNA, 22 nt, Pseudomonas aeruginosa PA01
cggggagauguccaucagccgc

SEQ ID NO: 3388543 - RNA, 19 nt, Pseudomonas aeruginosa PA01
cggggagggugccguggaa

SEQ ID NO: 3388544 - RNA, 13 nt, Pseudomonas aeruginosa PA01
cggggaucacucg

SEQ ID NO: 3388545 - RNA, 19 nt, Pseudomonas aeruginosa PA01
cggggaucacucgccgccg

SEQ ID NO: 3388546 - RNA, 17 nt, Pseudomonas aeruginosa PA01
cggggauguccgccgcc

SEQ ID NO: 3388547 - RNA, 19 nt, Pseudomonas aeruginosa PA01
cggggauguccgccgccca

SEQ ID NO: 3388548 - RNA, 15 nt, Pseudomonas aeruginosa PA01
cggggcagcagggcg

SEQ ID NO: 3388549 - RNA, 13 nt, Pseudomonas aeruginosa PA01
cggggcaggcaug

SEQ ID NO: 3388550 - RNA, 16 nt, Pseudomonas aeruginosa PA01
cggggcaggcaugcgg

SEQ ID NO: 3388551 - RNA, 23 nt, Pseudomonas aeruginosa PA01
cggggcaggcaugcggccccggc

SEQ ID NO: 3388552 - RNA, 11 nt, Pseudomonas aeruginosa PA01
cggggcaggcg

SEQ ID NO: 3388553 - RNA, 13 nt, Pseudomonas aeruginosa PA01
cggggcaggcgca

SEQ ID NO: 3388554 - RNA, 16 nt, Pseudomonas aeruginosa PA01
cggggcaggcgcaggc

SEQ ID NO: 3388555 - RNA, 17 nt, Pseudomonas aeruginosa PA01
cggggcaggcgcaggcg

SEQ ID NO: 3388556 - RNA, 18 nt, Pseudomonas aeruginosa PA01
cggggcaggcgcaggcga

SEQ ID NO: 3388557 - RNA, 19 nt, Pseudomonas aeruginosa PA01
cggggcaggcgcaggcgaa

SEQ ID NO: 3388558 - RNA, 19 nt, Pseudomonas aeruginosa PA01
cggggcauucguccagccg

SEQ ID NO: 3388559 - RNA, 20 nt, Pseudomonas aeruginosa PA01
cggggcauucguccagccgc

SEQ ID NO: 3388560 - RNA, 23 nt, Pseudomonas aeruginosa PA01
cggggcauucguccagccgccgc

SEQ ID NO: 3388561 - RNA, 14 nt, Pseudomonas aeruginosa PA01
cggggccaggucgg

SEQ ID NO: 3388562 - RNA, 22 nt, Pseudomonas aeruginosa PA01
cggggccaggucgguccgccga

SEQ ID NO: 3388563 - RNA, 15 nt, Pseudomonas aeruginosa PA01
cggggccaucagugc

SEQ ID NO: 3388564 - RNA, 21 nt, Pseudomonas aeruginosa PA01
cggggccaucagugccugcac

SEQ ID NO: 3388565 - RNA, 22 nt, Pseudomonas aeruginosa PA01
cggggccaucagugccugcacg

SEQ ID NO: 3388566 - RNA, 13 nt, Pseudomonas aeruginosa PA01
cggggccccggca

SEQ ID NO: 3388567 - RNA, 20 nt, Pseudomonas aeruginosa PA01
cggggccccggcaagggccu

SEQ ID NO: 3388568 - RNA, 21 nt, Pseudomonas aeruginosa PA01
cggggccccggcaagggccug

SEQ ID NO: 3388569 - RNA, 14 nt, Pseudomonas aeruginosa PA01
cggggcccggcucc

SEQ ID NO: 3388570 - RNA, 17 nt, Pseudomonas aeruginosa PA01
cggggcccggcuccagc

SEQ ID NO: 3388571 - RNA, 15 nt, Pseudomonas aeruginosa PA01
cggggcccuccaggc

SEQ ID NO: 3388572 - RNA, 16 nt, Pseudomonas aeruginosa PA01
cggggcccuccaggcg

SEQ ID NO: 3388573 - RNA, 18 nt, Pseudomonas aeruginosa PA01
cggggcccuccaggcgaa

SEQ ID NO: 3388574 - RNA, 20 nt, Pseudomonas aeruginosa PA01
cggggccgaggucgaccagc

SEQ ID NO: 3388575 - RNA, 15 nt, Pseudomonas aeruginosa PA01
cggggccggacgcga

SEQ ID NO: 3388576 - RNA, 18 nt, Pseudomonas aeruginosa PA01
cggggccggacgcgacug

SEQ ID NO: 3388577 - RNA, 23 nt, Pseudomonas aeruginosa PA01
cggggccggacgcgacugcugcu

SEQ ID NO: 3388578 - RNA, 15 nt, Pseudomonas aeruginosa PA01
cggggccggcacccg

SEQ ID NO: 3388579 - RNA, 12 nt, Pseudomonas aeruginosa PA01
cggggccggcga

SEQ ID NO: 3388580 - RNA, 17 nt, Pseudomonas aeruginosa PA01
cggggccguccgccagg

SEQ ID NO: 3388581 - RNA, 16 nt, Pseudomonas aeruginosa PA01
cggggccgugagcacg

SEQ ID NO: 3388582 - RNA, 17 nt, Pseudomonas aeruginosa PA01
cggggccguucaggaag

SEQ ID NO: 3388583 - RNA, 19 nt, Pseudomonas aeruginosa PA01
cggggccguucaggaagac

SEQ ID NO: 3388584 - RNA, 17 nt, Pseudomonas aeruginosa PA01
cggggccuacugcugga

SEQ ID NO: 3388585 - RNA, 21 nt, Pseudomonas aeruginosa PA01
cggggccuacugcuggacggc

SEQ ID NO: 3388586 - RNA, 18 nt, Pseudomonas aeruginosa PA01
cggggccucgcugccugg

SEQ ID NO: 3388587 - RNA, 17 nt, Pseudomonas aeruginosa PA01
cggguagagcgcggcgc

SEQ ID NO: 3388588 - RNA, 18 nt, Pseudomonas aeruginosa PA01
cggguagagcgcggcgca

SEQ ID NO: 3388589 - RNA, 14 nt, Pseudomonas aeruginosa PA01
cggguagagcgggc

SEQ ID NO: 3388590 - RNA, 13 nt, Pseudomonas aeruginosa PA01
cggguagcgccgg

SEQ ID NO: 3388591 - RNA, 14 nt, Pseudomonas aeruginosa PA01
cggguagcgccggu

SEQ ID NO: 3388592 - RNA, 19 nt, Pseudomonas aeruginosa PA01
cggguagcguuaucgccgg

SEQ ID NO: 3388593 - RNA, 22 nt, Pseudomonas aeruginosa PA01
cggguagggcgaauagcgccgc

SEQ ID NO: 3388594 - RNA, 17 nt, Pseudomonas aeruginosa PA01
cggguaguaguggaagc

SEQ ID NO: 3388595 - RNA, 15 nt, Pseudomonas aeruginosa PA01
cggguaguccagcga

SEQ ID NO: 3388596 - RNA, 16 nt, Pseudomonas aeruginosa PA01
cggguagucgaacugc

SEQ ID NO: 3388597 - RNA, 20 nt, Pseudomonas aeruginosa PA01
cggguagucgaacugcucga

SEQ ID NO: 3388598 - RNA, 19 nt, Pseudomonas aeruginosa PA01
cggguaguguuugcgcagg

SEQ ID NO: 3388599 - RNA, 23 nt, Pseudomonas aeruginosa PA01
cggguaguguuugcgcagggcgu

SEQ ID NO: 3388600 - RNA, 22 nt, Pseudomonas aeruginosa PA01
cggguauagaaaucgaucgagc

SEQ ID NO: 3388601 - RNA, 13 nt, Pseudomonas aeruginosa PA01
cggguauccgccg

SEQ ID NO: 3388602 - RNA, 16 nt, Pseudomonas aeruginosa PA01
cggguaucgauccagc

SEQ ID NO: 3388603 - RNA, 17 nt, Pseudomonas aeruginosa PA01
cggguaucgauccagcc

SEQ ID NO: 3388604 - RNA, 13 nt, Pseudomonas aeruginosa PA01
cgggucaccagcg

SEQ ID NO: 3388605 - RNA, 14 nt, Pseudomonas aeruginosa PA01
cgggucaccagcgc

SEQ ID NO: 3388606 - RNA, 16 nt, Pseudomonas aeruginosa PA01
cgggucaccagcgccg

SEQ ID NO: 3388607 - RNA, 17 nt, Pseudomonas aeruginosa PA01
cgggucaccagcgccgg

SEQ ID NO: 3388608 - RNA, 18 nt, Pseudomonas aeruginosa PA01
cgggucaccagcgccggg

SEQ ID NO: 3388609 - RNA, 16 nt, Pseudomonas aeruginosa PA01
cgggucaccagcgggu

SEQ ID NO: 3388610 - RNA, 19 nt, Pseudomonas aeruginosa PA01
cgggucacgccgagggcgc

SEQ ID NO: 3388611 - RNA, 22 nt, Pseudomonas aeruginosa PA01
cgggucacgccgagggcgcggc

SEQ ID NO: 3388612 - RNA, 15 nt, Pseudomonas aeruginosa PA01
cgggucagaccacga

SEQ ID NO: 3388613 - RNA, 22 nt, Pseudomonas aeruginosa PA01
cgggucagaccacgaagcgacc

SEQ ID NO: 3388614 - RNA, 16 nt, Pseudomonas aeruginosa PA01
cgggucagcagcaccg

SEQ ID NO: 3388615 - RNA, 17 nt, Pseudomonas aeruginosa PA01
cgggucagcagcaccgc

SEQ ID NO: 3388616 - RNA, 14 nt, Pseudomonas aeruginosa PA01
cgggucagcagugc

SEQ ID NO: 3388617 - RNA, 19 nt, Pseudomonas aeruginosa PA01
cgggucagcagugcggggc

SEQ ID NO: 3388618 - RNA, 13 nt, Pseudomonas aeruginosa PA01
cgggucaggccga

SEQ ID NO: 3388619 - RNA, 14 nt, Pseudomonas aeruginosa PA01
cgggucaggccgag

SEQ ID NO: 3388620 - RNA, 15 nt, Pseudomonas aeruginosa PA01
cgggucaggccgaga

SEQ ID NO: 3388621 - RNA, 22 nt, Pseudomonas aeruginosa PA01
cgggucauagucggugaccucc

SEQ ID NO: 3388622 - RNA, 19 nt, Pseudomonas aeruginosa PA01
cgggucaucaccggcagga

SEQ ID NO: 3388623 - RNA, 14 nt, Pseudomonas aeruginosa PA01
cgggucaucggccc

SEQ ID NO: 3388624 - RNA, 16 nt, Pseudomonas aeruginosa PA01
cgggucaucggcccga

SEQ ID NO: 3388625 - RNA, 17 nt, Pseudomonas aeruginosa PA01
cgggucaucggcccgac

SEQ ID NO: 3388626 - RNA, 14 nt, Pseudomonas aeruginosa PA01
cgggucaugagguu

SEQ ID NO: 3388627 - RNA, 14 nt, Pseudomonas aeruginosa PA01
cgggucaugccgcc

SEQ ID NO: 3388628 - RNA, 15 nt, Pseudomonas aeruginosa PA01
cgggucaugccgcca

SEQ ID NO: 3388629 - RNA, 16 nt, Pseudomonas aeruginosa PA01
cgggucauuggcgaaa

SEQ ID NO: 3388630 - RNA, 16 nt, Pseudomonas aeruginosa PA01
cgggucauuggcgaag

SEQ ID NO: 3388631 - RNA, 17 nt, Pseudomonas aeruginosa PA01
cgggucauuggcgaagu

SEQ ID NO: 3388632 - RNA, 17 nt, Pseudomonas aeruginosa PA01
cggguccagcggccgcg

SEQ ID NO: 3388633 - RNA, 19 nt, Pseudomonas aeruginosa PA01
cggguccagcggccgcgcc

SEQ ID NO: 3388634 - RNA, 14 nt, Pseudomonas aeruginosa PA01
cggguccaggcgcc

SEQ ID NO: 3388635 - RNA, 15 nt, Pseudomonas aeruginosa PA01
cggguccaggcgcca

SEQ ID NO: 3388636 - RNA, 17 nt, Pseudomonas aeruginosa PA01
cggguccaggcgccaga

SEQ ID NO: 3388637 - RNA, 22 nt, Pseudomonas aeruginosa PA01
cggguccaucugcaacgcggcg

SEQ ID NO: 3388638 - RNA, 22 nt, Pseudomonas aeruginosa PA01
cggguccugcagauaaagcugg

SEQ ID NO: 3388639 - RNA, 16 nt, Pseudomonas aeruginosa PA01
cggguccuggaucacg

SEQ ID NO: 3388640 - RNA, 17 nt, Pseudomonas aeruginosa PA01
cggguccuggaucacgc

SEQ ID NO: 3388641 - RNA, 20 nt, Pseudomonas aeruginosa PA01
cgggucgacaugcaggccgg

SEQ ID NO: 3388642 - RNA, 21 nt, Pseudomonas aeruginosa PA01
cgggucgacaugcaggccggc

SEQ ID NO: 3388643 - RNA, 23 nt, Pseudomonas aeruginosa PA01
cgggucgacaugcaggccggccu

SEQ ID NO: 3388644 - RNA, 20 nt, Pseudomonas aeruginosa PA01
cgggucgacuucgcaccagc

SEQ ID NO: 3388645 - RNA, 21 nt, Pseudomonas aeruginosa PA01
cgggucgacuucgcaccagcc

SEQ ID NO: 3388646 - RNA, 18 nt, Pseudomonas aeruginosa PA01
cgggucgagccaggcgua

SEQ ID NO: 3388647 - RNA, 17 nt, Pseudomonas aeruginosa PA01
cgggucgagcuugccga

SEQ ID NO: 3388648 - RNA, 13 nt, Pseudomonas aeruginosa PA01
cgggucgaggccg

SEQ ID NO: 3388649 - RNA, 17 nt, Pseudomonas aeruginosa PA01
cgggucgaucaggcgca

SEQ ID NO: 3388650 - RNA, 15 nt, Pseudomonas aeruginosa PA01
cgggucgcagccgag

SEQ ID NO: 3388651 - RNA, 14 nt, Pseudomonas aeruginosa PA01
cgggucgccauggu

SEQ ID NO: 3388652 - RNA, 15 nt, Pseudomonas aeruginosa PA01
cgggucgccgcagcc

SEQ ID NO: 3388653 - RNA, 22 nt, Pseudomonas aeruginosa PA01
cgggucgccgcagcccuaggcg

SEQ ID NO: 3388654 - RNA, 13 nt, Pseudomonas aeruginosa PA01
cgggucgcgcagc

SEQ ID NO: 3388655 - RNA, 14 nt, Pseudomonas aeruginosa PA01
cgggucgcgcagcg

SEQ ID NO: 3388656 - RNA, 15 nt, Pseudomonas aeruginosa PA01
cgggucgcgcagcgg

SEQ ID NO: 3388657 - RNA, 16 nt, Pseudomonas aeruginosa PA01
cgggucgcgcagcggc

SEQ ID NO: 3388658 - RNA, 13 nt, Pseudomonas aeruginosa PA01
cgggucgcggcug

SEQ ID NO: 3388659 - RNA, 14 nt, Pseudomonas aeruginosa PA01
cgggucgcggcuga

SEQ ID NO: 3388660 - RNA, 16 nt, Pseudomonas aeruginosa PA01
cgggucgcggcuggcc

SEQ ID NO: 3388661 - RNA, 22 nt, Pseudomonas aeruginosa PA01
cgggucgcggcuggccgccugg

SEQ ID NO: 3388662 - RNA, 13 nt, Pseudomonas aeruginosa PA01
cgggucgcugccc

SEQ ID NO: 3388663 - RNA, 17 nt, Pseudomonas aeruginosa PA01
cgggucgcugcucaggg

SEQ ID NO: 3388664 - RNA, 22 nt, Pseudomonas aeruginosa PA01
cgggucggaugccacucguccc

SEQ ID NO: 3388665 - RNA, 15 nt, Pseudomonas aeruginosa PA01
cgggucggcacggcc

SEQ ID NO: 3388666 - RNA, 11 nt, Pseudomonas aeruginosa PA01
cgggucggcga

SEQ ID NO: 3388667 - RNA, 14 nt, Pseudomonas aeruginosa PA01
cgggucggcgaagu

SEQ ID NO: 3388668 - RNA, 22 nt, Pseudomonas aeruginosa PA01
cgggucggcgaaguccaccagg

SEQ ID NO: 3388669 - RNA, 21 nt, Pseudomonas aeruginosa PA01
cgggucgggcucaugggcgau

SEQ ID NO: 3388670 - RNA, 17 nt, Pseudomonas aeruginosa PA01
cgggucguacaccgcgc

SEQ ID NO: 3388671 - RNA, 18 nt, Pseudomonas aeruginosa PA01
cgggucguacaccgcgcg

SEQ ID NO: 3388672 - RNA, 12 nt, Pseudomonas aeruginosa PA01
cgggucgucagc

SEQ ID NO: 3388673 - RNA, 22 nt, Pseudomonas aeruginosa PA01
cgggucgucgaagcgcagcagg

SEQ ID NO: 3388674 - RNA, 16 nt, Pseudomonas aeruginosa PA01
cgggucgucggucggc

SEQ ID NO: 3388675 - RNA, 22 nt, Pseudomonas aeruginosa PA01
cgggucgucggucggccaggac

SEQ ID NO: 3388676 - RNA, 12 nt, Pseudomonas aeruginosa PA01
cgggucucgauc

SEQ ID NO: 3388677 - RNA, 21 nt, Pseudomonas aeruginosa PA01
cgggucucgaucagcgccggg

SEQ ID NO: 3388678 - RNA, 22 nt, Pseudomonas aeruginosa PA01
cgggucucgaucagcgccgggu

SEQ ID NO: 3388679 - RNA, 16 nt, Pseudomonas aeruginosa PA01
cgggucugcucgcgcu

SEQ ID NO: 3388680 - RNA, 18 nt, Pseudomonas aeruginosa PA01
cgggucuggcggaacagc

SEQ ID NO: 3388681 - RNA, 16 nt, Pseudomonas aeruginosa PA01
cgggucuugcgcaggg

SEQ ID NO: 3388682 - RNA, 17 nt, Pseudomonas aeruginosa PA01
cgggucuugcgcagggc

SEQ ID NO: 3388683 - RNA, 18 nt, Pseudomonas aeruginosa PA01
cgggugaccuggccgccg

SEQ ID NO: 3388684 - RNA, 20 nt, Pseudomonas aeruginosa PA01
cgggugacggcguucggggc

SEQ ID NO: 3388685 - RNA, 18 nt, Pseudomonas aeruginosa PA01
cgggugcagguucaccgc

SEQ ID NO: 3388686 - RNA, 16 nt, Pseudomonas aeruginosa PA01
cgggugccccaggcga

SEQ ID NO: 3388687 - RNA, 17 nt, Pseudomonas aeruginosa PA01
cgggugccccaggcgag

SEQ ID NO: 3388688 - RNA, 15 nt, Pseudomonas aeruginosa PA01
cgggugccggagaac

SEQ ID NO: 3388689 - RNA, 22 nt, Pseudomonas aeruginosa PA01
cgggugccggagaacgccgcca

SEQ ID NO: 3388690 - RNA, 20 nt, Pseudomonas aeruginosa PA01
cgguacggucgaggcggaga

SEQ ID NO: 3388691 - RNA, 23 nt, Pseudomonas aeruginosa PA01
cgguacggucgaggcggagaagc

SEQ ID NO: 3388692 - RNA, 20 nt, Pseudomonas aeruginosa PA01
cgguacuaucccggucgggu

SEQ ID NO: 3388693 - RNA, 23 nt, Pseudomonas aeruginosa PA01
cgguacugcugggccuugaucac

SEQ ID NO: 3388694 - RNA, 16 nt, Pseudomonas aeruginosa PA01
cgguacugggucuugu

SEQ ID NO: 3388695 - RNA, 17 nt, Pseudomonas aeruginosa PA01
cgguagacauucagcag

SEQ ID NO: 3388696 - RNA, 20 nt, Pseudomonas aeruginosa PA01
cgguagaccccggugugcgc

SEQ ID NO: 3388697 - RNA, 24 nt, Pseudomonas aeruginosa PA01
cgguagaccccggugugcgcugca

SEQ ID NO: 3388698 - RNA, 19 nt, Pseudomonas aeruginosa PA01
cgguagacgccucccaccg

SEQ ID NO: 3388699 - RNA, 18 nt, Pseudomonas aeruginosa PA01
cgguagcccgcggcgagc

SEQ ID NO: 3388700 - RNA, 21 nt, Pseudomonas aeruginosa PA01
cgguagcccgcggcgagcagc

SEQ ID NO: 3388701 - RNA, 13 nt, Pseudomonas aeruginosa PA01
cgguagcccggca

SEQ ID NO: 3388702 - RNA, 15 nt, Pseudomonas aeruginosa PA01
cgguagcccggcagc

SEQ ID NO: 3388703 - RNA, 18 nt, Pseudomonas aeruginosa PA01
cgguagccgaggcggccg

SEQ ID NO: 3388704 - RNA, 19 nt, Pseudomonas aeruginosa PA01
cgguagccgaggcggccga

SEQ ID NO: 3388705 - RNA, 13 nt, Pseudomonas aeruginosa PA01
cgguagccggcga

SEQ ID NO: 3388706 - RNA, 20 nt, Pseudomonas aeruginosa PA01
cgguagccggcgaucagcgc

SEQ ID NO: 3388707 - RNA, 23 nt, Pseudomonas aeruginosa PA01
cgguagccggcgaucagcgcuuc

SEQ ID NO: 3388708 - RNA, 21 nt, Pseudomonas aeruginosa PA01
cgguagccguucgacgcugcu

SEQ ID NO: 3388709 - RNA, 14 nt, Pseudomonas aeruginosa PA01
cgguagcgccgcgc

SEQ ID NO: 3388710 - RNA, 15 nt, Pseudomonas aeruginosa PA01
cgguagcggaucagc

SEQ ID NO: 3388711 - RNA, 17 nt, Pseudomonas aeruginosa PA01
cgguagcggaucagccg

SEQ ID NO: 3388712 - RNA, 19 nt, Pseudomonas aeruginosa PA01
cgguagcggaucagccggc

SEQ ID NO: 3388713 - RNA, 13 nt, Pseudomonas aeruginosa PA01
cgguagcggcagg

SEQ ID NO: 3388714 - RNA, 16 nt, Pseudomonas aeruginosa PA01
cgguagcggcaggagc

SEQ ID NO: 3388715 - RNA, 13 nt, Pseudomonas aeruginosa PA01
cgguagcggcgca

SEQ ID NO: 3388716 - RNA, 21 nt, Pseudomonas aeruginosa PA01
cgguagcggcgcaccgacgcc

SEQ ID NO: 3388717 - RNA, 22 nt, Pseudomonas aeruginosa PA01
cgguagcggcgcaccgacgccg

SEQ ID NO: 3388718 - RNA, 16 nt, Pseudomonas aeruginosa PA01
cgguagcgggccagca

SEQ ID NO: 3388719 - RNA, 17 nt, Pseudomonas aeruginosa PA01
cgguagcgggccagcag

SEQ ID NO: 3388720 - RNA, 16 nt, Pseudomonas aeruginosa PA01
cgguagcuccaggccg

SEQ ID NO: 3388721 - RNA, 18 nt, Pseudomonas aeruginosa PA01
cgguagcuccaggccgaa

SEQ ID NO: 3388722 - RNA, 15 nt, Pseudomonas aeruginosa PA01
cgguagcugcgcagg

SEQ ID NO: 3388723 - RNA, 18 nt, Pseudomonas aeruginosa PA01
cgguagcugcgcagggcg

SEQ ID NO: 3388724 - RNA, 21 nt, Pseudomonas aeruginosa PA01
cgguagcugcgcagggcgccg

SEQ ID NO: 3388725 - RNA, 12 nt, Pseudomonas aeruginosa PA01
cgguaggcgcgu

SEQ ID NO: 3388726 - RNA, 18 nt, Pseudomonas aeruginosa PA01
cgguaggcucugcuccag

SEQ ID NO: 3388727 - RNA, 18 nt, Pseudomonas aeruginosa PA01
cgguagggaucgucgcca

SEQ ID NO: 3388728 - RNA, 14 nt, Pseudomonas aeruginosa PA01
cgguagggccgagg

SEQ ID NO: 3388729 - RNA, 17 nt, Pseudomonas aeruginosa PA01
cgguagggccgaggucg

SEQ ID NO: 3388730 - RNA, 23 nt, Pseudomonas aeruginosa PA01
cgguagggcgaauagcgccgcag

SEQ ID NO: 3388731 - RNA, 16 nt, Pseudomonas aeruginosa PA01
cgguaggggccgacga

SEQ ID NO: 3388732 - RNA, 18 nt, Pseudomonas aeruginosa PA01
cgguagguagcguugcgc

SEQ ID NO: 3388733 - RNA, 16 nt, Pseudomonas aeruginosa PA01
cgguaggucagcggua

SEQ ID NO: 3388734 - RNA, 19 nt, Pseudomonas aeruginosa PA01
cgguaggugagcgacccgc

SEQ ID NO: 3388735 - RNA, 21 nt, Pseudomonas aeruginosa PA01
cgguaggugagcgacccgcug

SEQ ID NO: 3388736 - RNA, 18 nt, Pseudomonas aeruginosa PA01
cgguaggugauguugcgc

SEQ ID NO: 3388737 - RNA, 21 nt, Pseudomonas aeruginosa PA01
cgguaguaccucgaagcccag

SEQ ID NO: 3388738 - RNA, 23 nt, Pseudomonas aeruginosa PA01
cgguaguaccucgaagcccagcg

SEQ ID NO: 3388739 - RNA, 16 nt, Pseudomonas aeruginosa PA01
cgguaguaggguucgc

SEQ ID NO: 3388740 - RNA, 20 nt, Pseudomonas aeruginosa PA01
cgguaguaggguucgccgac

SEQ ID NO: 3388741 - RNA, 13 nt, Pseudomonas aeruginosa PA01
cgguagucgcugc

SEQ ID NO: 3388742 - RNA, 21 nt, Pseudomonas aeruginosa PA01
cgguagucgcugcuggcgccg

SEQ ID NO: 3388743 - RNA, 14 nt, Pseudomonas aeruginosa PA01
cgguagugcccggu

SEQ ID NO: 3388744 - RNA, 15 nt, Pseudomonas aeruginosa PA01
cgguagugcccggua

SEQ ID NO: 3388745 - RNA, 18 nt, Pseudomonas aeruginosa PA01
cgguagugcuucagguag

SEQ ID NO: 3388746 - RNA, 20 nt, Pseudomonas aeruginosa PA01
cgguagugcuucagguagcu

SEQ ID NO: 3388747 - RNA, 16 nt, Pseudomonas aeruginosa PA01
cgguaguucgcugacc

SEQ ID NO: 3388748 - RNA, 18 nt, Pseudomonas aeruginosa PA01
cgguaucggcuugccggc

SEQ ID NO: 3388749 - RNA, 16 nt, Pseudomonas aeruginosa PA01
cgguauggcugcugug

SEQ ID NO: 3388750 - RNA, 18 nt, Pseudomonas aeruginosa PA01
cgguauggcugcugugcg

SEQ ID NO: 3388751 - RNA, 17 nt, Pseudomonas aeruginosa PA01
cgguauucuccagcagg

SEQ ID NO: 3388752 - RNA, 19 nt, Pseudomonas aeruginosa PA01
cgguauucuccagcaggcu

SEQ ID NO: 3388753 - RNA, 18 nt, Pseudomonas aeruginosa PA01
cgguauuguggccccagc

SEQ ID NO: 3388754 - RNA, 16 nt, Pseudomonas aeruginosa PA01
cggucaaaccauggcg

SEQ ID NO: 3388755 - RNA, 18 nt, Pseudomonas aeruginosa PA01
cggucaaaccauggcgua

SEQ ID NO: 3388756 - RNA, 17 nt, Pseudomonas aeruginosa PA01
cggucaaccgcgggcga

SEQ ID NO: 3388757 - RNA, 22 nt, Pseudomonas aeruginosa PA01
cggucaaccgcgggcgaggucg

SEQ ID NO: 3388758 - RNA, 15 nt, Pseudomonas aeruginosa PA01
cggucaccacccagc

SEQ ID NO: 3388759 - RNA, 19 nt, Pseudomonas aeruginosa PA01
cggucaccacccagccgcg

SEQ ID NO: 3388760 - RNA, 16 nt, Pseudomonas aeruginosa PA01
cggucaccacuggaaa

SEQ ID NO: 3388761 - RNA, 20 nt, Pseudomonas aeruginosa PA01
cggucacccauucgaugccg

SEQ ID NO: 3388762 - RNA, 15 nt, Pseudomonas aeruginosa PA01
cggucaccguggaga

SEQ ID NO: 3388763 - RNA, 15 nt, Pseudomonas aeruginosa PA01
cggucacgaaggcga

SEQ ID NO: 3388764 - RNA, 16 nt, Pseudomonas aeruginosa PA01
cggucacucggccucg

SEQ ID NO: 3388765 - RNA, 20 nt, Pseudomonas aeruginosa PA01
cggucacucggccucggcgu

SEQ ID NO: 3388766 - RNA, 21 nt, Pseudomonas aeruginosa PA01
cggucacucggccucggcguc

SEQ ID NO: 3388767 - RNA, 15 nt, Pseudomonas aeruginosa PA01
cggucagaucagcgg

SEQ ID NO: 3388768 - RNA, 18 nt, Pseudomonas aeruginosa PA01
cggucagcgacuggcccu

SEQ ID NO: 3388769 - RNA, 21 nt, Pseudomonas aeruginosa PA01
cggucagcgcguucaccccgc

SEQ ID NO: 3388770 - RNA, 22 nt, Pseudomonas aeruginosa PA01
cggucagcgcguucaccccgcc

SEQ ID NO: 3388771 - RNA, 19 nt, Pseudomonas aeruginosa PA01
cggucagcggacaaccgcc

SEQ ID NO: 3388772 - RNA, 13 nt, Pseudomonas aeruginosa PA01
cggucagcggcgc

SEQ ID NO: 3388773 - RNA, 18 nt, Pseudomonas aeruginosa PA01
cggucagcggcgcagccu

SEQ ID NO: 3388774 - RNA, 14 nt, Pseudomonas aeruginosa PA01
cggucagcucccug

SEQ ID NO: 3388775 - RNA, 14 nt, Pseudomonas aeruginosa PA01
cggucagcucggca

SEQ ID NO: 3388776 - RNA, 15 nt, Pseudomonas aeruginosa PA01
cggucagcuucgccg

SEQ ID NO: 3388777 - RNA, 18 nt, Pseudomonas aeruginosa PA01
cggucagcuucgccgccc

SEQ ID NO: 3388778 - RNA, 20 nt, Pseudomonas aeruginosa PA01
cggucagcuucgccgcccug

SEQ ID NO: 3388779 - RNA, 22 nt, Pseudomonas aeruginosa PA01
cggucagcuucgccgcccugga

SEQ ID NO: 3388780 - RNA, 15 nt, Pseudomonas aeruginosa PA01
cggucagcuugcccu

SEQ ID NO: 3388781 - RNA, 16 nt, Pseudomonas aeruginosa PA01
cggucaggacagcgug

SEQ ID NO: 3388782 - RNA, 21 nt, Pseudomonas aeruginosa PA01
cggucaggacgagcguccgcc

SEQ ID NO: 3388783 - RNA, 20 nt, Pseudomonas aeruginosa PA01
cggucaggccgagcagcgcc

SEQ ID NO: 3388784 - RNA, 22 nt, Pseudomonas aeruginosa PA01
cggucaggccgagcagcgccag

SEQ ID NO: 3388785 - RNA, 13 nt, Pseudomonas aeruginosa PA01
cggucaggccgau

SEQ ID NO: 3388786 - RNA, 18 nt, Pseudomonas aeruginosa PA01
cggucaggccgaucacca

SEQ ID NO: 3388787 - RNA, 22 nt, Pseudomonas aeruginosa PA01
cggucaggccgaucaccaccag

SEQ ID NO: 3388788 - RNA, 23 nt, Pseudomonas aeruginosa PA01
cggucaggccgaucaccaccagc

SEQ ID NO: 3388789 - RNA, 16 nt, Pseudomonas aeruginosa PA01
cggucaggcgcuggug

SEQ ID NO: 3388790 - RNA, 12 nt, Pseudomonas aeruginosa PA01
cggucaggcugc

SEQ ID NO: 3388791 - RNA, 12 nt, Pseudomonas aeruginosa PA01
cggucaggcugg

SEQ ID NO: 3388792 - RNA, 14 nt, Pseudomonas aeruginosa PA01
cggucggccaggcg

SEQ ID NO: 3388793 - RNA, 15 nt, Pseudomonas aeruginosa PA01
cggucggccaggcgg

SEQ ID NO: 3388794 - RNA, 16 nt, Pseudomonas aeruginosa PA01
cggucggccaggcggc

SEQ ID NO: 3388795 - RNA, 22 nt, Pseudomonas aeruginosa PA01
cggucggccaggcggccgacga

SEQ ID NO: 3388796 - RNA, 21 nt, Pseudomonas aeruginosa PA01
cggucggccaggggagcgccg

SEQ ID NO: 3388797 - RNA, 22 nt, Pseudomonas aeruginosa PA01
cggucggccaucuggcugccga

SEQ ID NO: 3388798 - RNA, 21 nt, Pseudomonas aeruginosa PA01
cggucggccuguucgcccaag

SEQ ID NO: 3388799 - RNA, 23 nt, Pseudomonas aeruginosa PA01
cggucggccuguucgcccaaggc

SEQ ID NO: 3388800 - RNA, 13 nt, Pseudomonas aeruginosa PA01
cggucggcgaggg

SEQ ID NO: 3388801 - RNA, 14 nt, Pseudomonas aeruginosa PA01
cggucggcgagggc

SEQ ID NO: 3388802 - RNA, 13 nt, Pseudomonas aeruginosa PA01
cggucggcgccuu

SEQ ID NO: 3388803 - RNA, 13 nt, Pseudomonas aeruginosa PA01
cggucggcucagc

SEQ ID NO: 3388804 - RNA, 16 nt, Pseudomonas aeruginosa PA01
cggucggcucagccga

SEQ ID NO: 3388805 - RNA, 17 nt, Pseudomonas aeruginosa PA01
cggucggcucagccgac

SEQ ID NO: 3388806 - RNA, 21 nt, Pseudomonas aeruginosa PA01
cggucgggaugccgugccgug

SEQ ID NO: 3388807 - RNA, 15 nt, Pseudomonas aeruginosa PA01
cggucgggcacuugu

SEQ ID NO: 3388808 - RNA, 13 nt, Pseudomonas aeruginosa PA01
cggucgggcagau

SEQ ID NO: 3388809 - RNA, 14 nt, Pseudomonas aeruginosa PA01
cggucgggcgggcg

SEQ ID NO: 3388810 - RNA, 18 nt, Pseudomonas aeruginosa PA01
cggucggugagcacgccg

SEQ ID NO: 3388811 - RNA, 13 nt, Pseudomonas aeruginosa PA01
cggucgguugcgg

SEQ ID NO: 3388812 - RNA, 15 nt, Pseudomonas aeruginosa PA01
cggucgguugcggcc

SEQ ID NO: 3388813 - RNA, 14 nt, Pseudomonas aeruginosa PA01
cggucguagcccau

SEQ ID NO: 3388814 - RNA, 17 nt, Pseudomonas aeruginosa PA01
cggucguagcccauggu

SEQ ID NO: 3388815 - RNA, 21 nt, Pseudomonas aeruginosa PA01
cggucguaggaacgugcggcc

SEQ ID NO: 3388816 - RNA, 13 nt, Pseudomonas aeruginosa PA01
cggucgugcagca

SEQ ID NO: 3388817 - RNA, 15 nt, Pseudomonas aeruginosa PA01
cggucgugcagcagc

SEQ ID NO: 3388818 - RNA, 18 nt, Pseudomonas aeruginosa PA01
cggucgugcagcagcgcc

SEQ ID NO: 3388819 - RNA, 19 nt, Pseudomonas aeruginosa PA01
cggucgugcagcagcgccu

SEQ ID NO: 3388820 - RNA, 13 nt, Pseudomonas aeruginosa PA01
cggucuagccggg

SEQ ID NO: 3388821 - RNA, 14 nt, Pseudomonas aeruginosa PA01
cggucuagccgggc

SEQ ID NO: 3388822 - RNA, 15 nt, Pseudomonas aeruginosa PA01
cggucuagccgggcc

SEQ ID NO: 3388823 - RNA, 13 nt, Pseudomonas aeruginosa PA01
cggucuagcgccc

SEQ ID NO: 3388824 - RNA, 20 nt, Pseudomonas aeruginosa PA01
cggucuagcgccccggccgc

SEQ ID NO: 3388825 - RNA, 21 nt, Pseudomonas aeruginosa PA01
cggucuagcgccccggccgcg

SEQ ID NO: 3388826 - RNA, 23 nt, Pseudomonas aeruginosa PA01
cggucuagcgccccggccgcgcc

SEQ ID NO: 3388827 - RNA, 15 nt, Pseudomonas aeruginosa PA01
cggucucgaacgcca

SEQ ID NO: 3388828 - RNA, 20 nt, Pseudomonas aeruginosa PA01
cggucucgaacgccaggcag

SEQ ID NO: 3388829 - RNA, 14 nt, Pseudomonas aeruginosa PA01
cggucucgaucggc

SEQ ID NO: 3388830 - RNA, 20 nt, Pseudomonas aeruginosa PA01
cggucucgaucggcccgggc

SEQ ID NO: 3388831 - RNA, 17 nt, Pseudomonas aeruginosa PA01
cggucucgccaccccgc

SEQ ID NO: 3388832 - RNA, 22 nt, Pseudomonas aeruginosa PA01
cggucucgccaccccgcuccgc

SEQ ID NO: 3388833 - RNA, 14 nt, Pseudomonas aeruginosa PA01
cggucucgccgccg

SEQ ID NO: 3388834 - RNA, 15 nt, Pseudomonas aeruginosa PA01
cggucucgccgccga

SEQ ID NO: 3388835 - RNA, 20 nt, Pseudomonas aeruginosa PA01
cggucucgcgcagcggcgga

SEQ ID NO: 3388836 - RNA, 20 nt, Pseudomonas aeruginosa PA01
cggucucggcgauguugcgc

SEQ ID NO: 3388837 - RNA, 13 nt, Pseudomonas aeruginosa PA01
cggucucggcggg

SEQ ID NO: 3388838 - RNA, 20 nt, Pseudomonas aeruginosa PA01
cggucuucccguaaggccag

SEQ ID NO: 3388839 - RNA, 21 nt, Pseudomonas aeruginosa PA01
cggucuucccguaaggccagg

SEQ ID NO: 3388840 - RNA, 22 nt, Pseudomonas aeruginosa PA01
cggucuucccguaaggccaggc

SEQ ID NO: 3388841 - RNA, 23 nt, Pseudomonas aeruginosa PA01
cggucuucccguaaggccaggcu

SEQ ID NO: 3388842 - RNA, 21 nt, Pseudomonas aeruginosa PA01
cggucuugccggcugcgccgc

SEQ ID NO: 3388843 - RNA, 14 nt, Pseudomonas aeruginosa PA01
cggucuugcgcuug

SEQ ID NO: 3388844 - RNA, 17 nt, Pseudomonas aeruginosa PA01
cggucuugcgcuugccg

SEQ ID NO: 3388845 - RNA, 19 nt, Pseudomonas aeruginosa PA01
cggucuugcgcuugccggc

SEQ ID NO: 3388846 - RNA, 20 nt, Pseudomonas aeruginosa PA01
cggucuugcgcuugccggcc

SEQ ID NO: 3388847 - RNA, 16 nt, Pseudomonas aeruginosa PA01
cggucuuggcggcgau

SEQ ID NO: 3388848 - RNA, 12 nt, Pseudomonas aeruginosa PA01
cggucuuuuucg

SEQ ID NO: 3388849 - RNA, 16 nt, Pseudomonas aeruginosa PA01
cggucuuuuucgcgug

SEQ ID NO: 3388850 - RNA, 14 nt, Pseudomonas aeruginosa PA01
cggugaaaccggca

SEQ ID NO: 3388851 - RNA, 11 nt, Pseudomonas aeruginosa PA01
cggugaacagg

SEQ ID NO: 3388852 - RNA, 17 nt, Pseudomonas aeruginosa PA01
cggugaacagguagcug

SEQ ID NO: 3388853 - RNA, 13 nt, Pseudomonas aeruginosa PA01
cggugaaccaggc

SEQ ID NO: 3388854 - RNA, 16 nt, Pseudomonas aeruginosa PA01
cggugaaccaggcgcc

SEQ ID NO: 3388855 - RNA, 15 nt, Pseudomonas aeruginosa PA01
cggugaagcgcggcg

SEQ ID NO: 3388856 - RNA, 20 nt, Pseudomonas aeruginosa PA01
cggugaagguccgcgccaug

SEQ ID NO: 3388857 - RNA, 22 nt, Pseudomonas aeruginosa PA01
cggugaagguccgcgccaugcc

SEQ ID NO: 3388858 - RNA, 17 nt, Pseudomonas aeruginosa PA01
cggugaaguagaucgcc

SEQ ID NO: 3388859 - RNA, 20 nt, Pseudomonas aeruginosa PA01
cggugacauucgacagcagg

SEQ ID NO: 3388860 - RNA, 11 nt, Pseudomonas aeruginosa PA01
cggugaccacc

SEQ ID NO: 3388861 - RNA, 18 nt, Pseudomonas aeruginosa PA01
cggugaccaccaggcggu

SEQ ID NO: 3388862 - RNA, 12 nt, Pseudomonas aeruginosa PA01
cggugaccagcg

SEQ ID NO: 3388863 - RNA, 18 nt, Pseudomonas aeruginosa PA01
cggugacccacuccggca

SEQ ID NO: 3388864 - RNA, 20 nt, Pseudomonas aeruginosa PA01
cggugacccacuccggcagg

SEQ ID NO: 3388865 - RNA, 22 nt, Pseudomonas aeruginosa PA01
cggugacccacuccggcaggcg

SEQ ID NO: 3388866 - RNA, 18 nt, Pseudomonas aeruginosa PA01
cggugacccgcacggcga

SEQ ID NO: 3388867 - RNA, 20 nt, Pseudomonas aeruginosa PA01
cggugacccgcacggcgacg

SEQ ID NO: 3388868 - RNA, 21 nt, Pseudomonas aeruginosa PA01
cggugaccguuucgccgccgg

SEQ ID NO: 3388869 - RNA, 23 nt, Pseudomonas aeruginosa PA01
cggugaccguuucgccgccggcc

SEQ ID NO: 3388870 - RNA, 16 nt, Pseudomonas aeruginosa PA01
cggugacgcugcucac

SEQ ID NO: 3388871 - RNA, 15 nt, Pseudomonas aeruginosa PA01
cggugacgucgagga

SEQ ID NO: 3388872 - RNA, 17 nt, Pseudomonas aeruginosa PA01
cggugagauggcacagu

SEQ ID NO: 3388873 - RNA, 14 nt, Pseudomonas aeruginosa PA01
cggugagcacgccg

SEQ ID NO: 3388874 - RNA, 17 nt, Pseudomonas aeruginosa PA01
cggugagcacgccgcga

SEQ ID NO: 3388875 - RNA, 19 nt, Pseudomonas aeruginosa PA01
cggugagcacgccgcgacc

SEQ ID NO: 3388876 - RNA, 16 nt, Pseudomonas aeruginosa PA01
cggugagcaggcgccg

SEQ ID NO: 3388877 - RNA, 18 nt, Pseudomonas aeruginosa PA01
cggugagcugaucgcgaa

SEQ ID NO: 3388878 - RNA, 16 nt, Pseudomonas aeruginosa PA01
cggugaggaccuggcc

SEQ ID NO: 3388879 - RNA, 18 nt, Pseudomonas aeruginosa PA01
cggugaggaccuggccgc

SEQ ID NO: 3388880 - RNA, 14 nt, Pseudomonas aeruginosa PA01
cggugagggcgacg

SEQ ID NO: 3388881 - RNA, 17 nt, Pseudomonas aeruginosa PA01
cggugagggcgacggcg

SEQ ID NO: 3388882 - RNA, 16 nt, Pseudomonas aeruginosa PA01
cggugagguugccgcc

SEQ ID NO: 3388883 - RNA, 18 nt, Pseudomonas aeruginosa PA01
cggugagguugccgccga

SEQ ID NO: 3388884 - RNA, 20 nt, Pseudomonas aeruginosa PA01
cggugagguugccgccgauc

SEQ ID NO: 3388885 - RNA, 23 nt, Pseudomonas aeruginosa PA01
cggugagguugccgccgaucagc

SEQ ID NO: 3388886 - RNA, 16 nt, Pseudomonas aeruginosa PA01
cggugauaccgccggc

SEQ ID NO: 3388887 - RNA, 18 nt, Pseudomonas aeruginosa PA01
cggugauaccgccggcgg

SEQ ID NO: 3388888 - RNA, 19 nt, Pseudomonas aeruginosa PA01
cggugauaccgccggcggc

SEQ ID NO: 3388889 - RNA, 20 nt, Pseudomonas aeruginosa PA01
cggugauaccgccggcggcg

SEQ ID NO: 3388890 - RNA, 22 nt, Pseudomonas aeruginosa PA01
cggugauaccgccggcggcgau

SEQ ID NO: 3388891 - RNA, 21 nt, Pseudomonas aeruginosa PA01
cggugaucgaaaaaaggcgcc

SEQ ID NO: 3388892 - RNA, 16 nt, Pseudomonas aeruginosa PA01
cggugaucgagccgcc

SEQ ID NO: 3388893 - RNA, 17 nt, Pseudomonas aeruginosa PA01
cggugaucgagccgccg

SEQ ID NO: 3388894 - RNA, 22 nt, Pseudomonas aeruginosa PA01
cggugaucgagccgccggggaa

SEQ ID NO: 3388895 - RNA, 16 nt, Pseudomonas aeruginosa PA01
cggugggccuugagca

SEQ ID NO: 3388896 - RNA, 16 nt, Pseudomonas aeruginosa PA01
cggugggcgagggcgc

SEQ ID NO: 3388897 - RNA, 18 nt, Pseudomonas aeruginosa PA01
cggugggcgagggcgcgc

SEQ ID NO: 3388898 - RNA, 14 nt, Pseudomonas aeruginosa PA01
cgguggggccgccg

SEQ ID NO: 3388899 - RNA, 18 nt, Pseudomonas aeruginosa PA01
cgguggggccgccgaugc

SEQ ID NO: 3388900 - RNA, 16 nt, Pseudomonas aeruginosa PA01
cgguggucuucagcac

SEQ ID NO: 3388901 - RNA, 17 nt, Pseudomonas aeruginosa PA01
cgguggugucugguucc

SEQ ID NO: 3388902 - RNA, 21 nt, Pseudomonas aeruginosa PA01
cgguggugugauccugcuggu

SEQ ID NO: 3388903 - RNA, 16 nt, Pseudomonas aeruginosa PA01
cgguguagaccaccag

SEQ ID NO: 3388904 - RNA, 20 nt, Pseudomonas aeruginosa PA01
cgguguagaccaccagcagg

SEQ ID NO: 3388905 - RNA, 21 nt, Pseudomonas aeruginosa PA01
cgguguagaccaccagcagga

SEQ ID NO: 3388906 - RNA, 16 nt, Pseudomonas aeruginosa PA01
cgguguagcugaggcc

SEQ ID NO: 3388907 - RNA, 15 nt, Pseudomonas aeruginosa PA01
cgguguaucggcgga

SEQ ID NO: 3388908 - RNA, 16 nt, Pseudomonas aeruginosa PA01
cgguguaucggcggau

SEQ ID NO: 3388909 - RNA, 14 nt, Pseudomonas aeruginosa PA01
cggugucaggccga

SEQ ID NO: 3388910 - RNA, 17 nt, Pseudomonas aeruginosa PA01
cggugucaggccgaggu

SEQ ID NO: 3388911 - RNA, 19 nt, Pseudomonas aeruginosa PA01
cgguguccaccaccagcag

SEQ ID NO: 3388912 - RNA, 16 nt, Pseudomonas aeruginosa PA01
cgguguccauguugcc

SEQ ID NO: 3388913 - RNA, 19 nt, Pseudomonas aeruginosa PA01
cgguguccgcggugccgcc

SEQ ID NO: 3388914 - RNA, 17 nt, Pseudomonas aeruginosa PA01
cggugucgcgguugcgc

SEQ ID NO: 3388915 - RNA, 20 nt, Pseudomonas aeruginosa PA01
cggugucgcgguugcgcugc

SEQ ID NO: 3388916 - RNA, 21 nt, Pseudomonas aeruginosa PA01
cggugucggccaacugggccu

SEQ ID NO: 3388917 - RNA, 12 nt, Pseudomonas aeruginosa PA01
cggugucggcga

SEQ ID NO: 3388918 - RNA, 13 nt, Pseudomonas aeruginosa PA01
cggugugacggcc

SEQ ID NO: 3388919 - RNA, 14 nt, Pseudomonas aeruginosa PA01
cggugugacggccg

SEQ ID NO: 3388920 - RNA, 21 nt, Pseudomonas aeruginosa PA01
cggugugccgucaggcaccuc

SEQ ID NO: 3388921 - RNA, 20 nt, Pseudomonas aeruginosa PA01
cggugugcgcugcaucggcg

SEQ ID NO: 3388922 - RNA, 16 nt, Pseudomonas aeruginosa PA01
cggugugcucaggcga

SEQ ID NO: 3388923 - RNA, 20 nt, Pseudomonas aeruginosa PA01
cgguguugccguggucgcgc

SEQ ID NO: 3388924 - RNA, 17 nt, Pseudomonas aeruginosa PA01
cgguuaccaggucugug

SEQ ID NO: 3388925 - RNA, 18 nt, Pseudomonas aeruginosa PA01
cgguuaccggcgaccacc

SEQ ID NO: 3388926 - RNA, 19 nt, Pseudomonas aeruginosa PA01
cgguuaccggcgaccaccg

SEQ ID NO: 3388927 - RNA, 20 nt, Pseudomonas aeruginosa PA01
cgguuaccggcgaccaccgc

SEQ ID NO: 3388928 - RNA, 22 nt, Pseudomonas aeruginosa PA01
cgguuaccggcgaccaccgccg

SEQ ID NO: 3388929 - RNA, 17 nt, Pseudomonas aeruginosa PA01
cgguuagaauaccggcc

SEQ ID NO: 3388930 - RNA, 19 nt, Pseudomonas aeruginosa PA01
cgguuagaauaccggccug

SEQ ID NO: 3388931 - RNA, 20 nt, Pseudomonas aeruginosa PA01
cgguuagaauaccggccugu

SEQ ID NO: 3388932 - RNA, 14 nt, Pseudomonas aeruginosa PA01
cgguuagccggcga

SEQ ID NO: 3388933 - RNA, 13 nt, Pseudomonas aeruginosa PA01
cgguuauccgccg

SEQ ID NO: 3388934 - RNA, 15 nt, Pseudomonas aeruginosa PA01
cgguuauccgccgcc

SEQ ID NO: 3388935 - RNA, 16 nt, Pseudomonas aeruginosa PA01
cgguuauccgccgccu

SEQ ID NO: 3388936 - RNA, 15 nt, Pseudomonas aeruginosa PA01
cgguuauccgccgcu

SEQ ID NO: 3388937 - RNA, 16 nt, Pseudomonas aeruginosa PA01
cgguuauccgccgcug

SEQ ID NO: 3388938 - RNA, 17 nt, Pseudomonas aeruginosa PA01
cgguuauccgccgugga

SEQ ID NO: 3388939 - RNA, 19 nt, Pseudomonas aeruginosa PA01
cgguuaucgaggcgucggc

SEQ ID NO: 3388940 - RNA, 20 nt, Pseudomonas aeruginosa PA01
cgguuaucgaggcgucggcg

SEQ ID NO: 3388941 - RNA, 22 nt, Pseudomonas aeruginosa PA01
cgguuaucgaggcgucggcggg

SEQ ID NO: 3388942 - RNA, 20 nt, Pseudomonas aeruginosa PA01
cgguuauucgcccuaccccc

SEQ ID NO: 3388943 - RNA, 17 nt, Pseudomonas aeruginosa PA01
cgguuauucgcccuacg

SEQ ID NO: 3388944 - RNA, 16 nt, Pseudomonas aeruginosa PA01
cgguucacaaagccuu

SEQ ID NO: 3388945 - RNA, 20 nt, Pseudomonas aeruginosa PA01
cgguucacaaagccuugacc

SEQ ID NO: 3388946 - RNA, 22 nt, Pseudomonas aeruginosa PA01
cgguucagcgggacagcuugcc

SEQ ID NO: 3388947 - RNA, 16 nt, Pseudomonas aeruginosa PA01
cgguuccagcggccgc

SEQ ID NO: 3388948 - RNA, 17 nt, Pseudomonas aeruginosa PA01
cgguuccagcggccgcg

SEQ ID NO: 3388949 - RNA, 18 nt, Pseudomonas aeruginosa PA01
cgguuccagcggccgcga

SEQ ID NO: 3388950 - RNA, 19 nt, Pseudomonas aeruginosa PA01
cgguuccagcggccgcgag

SEQ ID NO: 3388951 - RNA, 20 nt, Pseudomonas aeruginosa PA01
cgguuccagcggccgcgagc

SEQ ID NO: 3388952 - RNA, 14 nt, Pseudomonas aeruginosa PA01
cgguucccgcagcg

SEQ ID NO: 3388953 - RNA, 14 nt, Pseudomonas aeruginosa PA01
cgguucccgcccgc

SEQ ID NO: 3388954 - RNA, 14 nt, Pseudomonas aeruginosa PA01
cgguuccuggcugg

SEQ ID NO: 3388955 - RNA, 16 nt, Pseudomonas aeruginosa PA01
cgguuccuggcuggag

SEQ ID NO: 3388956 - RNA, 16 nt, Pseudomonas aeruginosa PA01
cgguucgacacgcuca

SEQ ID NO: 3388957 - RNA, 18 nt, Pseudomonas aeruginosa PA01
cgguucgcaggccaggcg

SEQ ID NO: 3388958 - RNA, 19 nt, Pseudomonas aeruginosa PA01
cgguucgcaggccaggcgc

SEQ ID NO: 3388959 - RNA, 20 nt, Pseudomonas aeruginosa PA01
cgguucgcaggccaggcgca

SEQ ID NO: 3388960 - RNA, 21 nt, Pseudomonas aeruginosa PA01
cgguucgcaggccaggcgcag

SEQ ID NO: 3388961 - RNA, 23 nt, Pseudomonas aeruginosa PA01
cgguucgcccaguaccacgcagc

SEQ ID NO: 3388962 - RNA, 17 nt, Pseudomonas aeruginosa PA01
cgguucgccgagcgccg

SEQ ID NO: 3388963 - RNA, 18 nt, Pseudomonas aeruginosa PA01
cgguucgccgagcgccgc

SEQ ID NO: 3388964 - RNA, 14 nt, Pseudomonas aeruginosa PA01
cgguucgccuuccc

SEQ ID NO: 3388965 - RNA, 16 nt, Pseudomonas aeruginosa PA01
cgguucgcggcgcagc

SEQ ID NO: 3388966 - RNA, 18 nt, Pseudomonas aeruginosa PA01
cgguucggcaaggcgcag

SEQ ID NO: 3388967 - RNA, 13 nt, Pseudomonas aeruginosa PA01
cgguucggcgucu

SEQ ID NO: 3388968 - RNA, 23 nt, Pseudomonas aeruginosa PA01
cgguucguugaccguccacaccg

SEQ ID NO: 3388969 - RNA, 16 nt, Pseudomonas aeruginosa PA01
cgguucucgccccagc

SEQ ID NO: 3388970 - RNA, 21 nt, Pseudomonas aeruginosa PA01
cgguucucguccagguccgca

SEQ ID NO: 3388971 - RNA, 13 nt, Pseudomonas aeruginosa PA01
cgguucucgucga

SEQ ID NO: 3388972 - RNA, 14 nt, Pseudomonas aeruginosa PA01
cgguucugcuccug

SEQ ID NO: 3388973 - RNA, 16 nt, Pseudomonas aeruginosa PA01
cgguucugcuccuggg

SEQ ID NO: 3388974 - RNA, 19 nt, Pseudomonas aeruginosa PA01
cgguugaaacugcgcaggc

SEQ ID NO: 3388975 - RNA, 21 nt, Pseudomonas aeruginosa PA01
cgguugaaacugcgcaggcug

SEQ ID NO: 3388976 - RNA, 22 nt, Pseudomonas aeruginosa PA01
cgguugaagauauaacgcgagc

SEQ ID NO: 3388977 - RNA, 21 nt, Pseudomonas aeruginosa PA01
cgguugagauccuggccggcg

SEQ ID NO: 3388978 - RNA, 16 nt, Pseudomonas aeruginosa PA01
cgguugagcagggcgu

SEQ ID NO: 3388979 - RNA, 13 nt, Pseudomonas aeruginosa PA01
cgguugccaggcc

SEQ ID NO: 3388980 - RNA, 15 nt, Pseudomonas aeruginosa PA01
cgguugccaggccgg

SEQ ID NO: 3388981 - RNA, 20 nt, Pseudomonas aeruginosa PA01
cgguugccaggccggcgcau

SEQ ID NO: 3388982 - RNA, 14 nt, Pseudomonas aeruginosa PA01
cgguugccgaagcg

SEQ ID NO: 3388983 - RNA, 13 nt, Pseudomonas aeruginosa PA01
cgguugccgcgcc

SEQ ID NO: 3388984 - RNA, 16 nt, Pseudomonas aeruginosa PA01
cgguugccgcugcggc

SEQ ID NO: 3388985 - RNA, 15 nt, Pseudomonas aeruginosa PA01
cgguugccggagacg

SEQ ID NO: 3388986 - RNA, 18 nt, Pseudomonas aeruginosa PA01
cgguugccuucgucgcug

SEQ ID NO: 3388987 - RNA, 12 nt, Pseudomonas aeruginosa PA01
cgguugcgaccg

SEQ ID NO: 3388988 - RNA, 13 nt, Pseudomonas aeruginosa PA01
cgguugcggccug

SEQ ID NO: 3388989 - RNA, 15 nt, Pseudomonas aeruginosa PA01
cgguugcggcgccgg

SEQ ID NO: 3388990 - RNA, 18 nt, Pseudomonas aeruginosa PA01
cgguugcugcugcggggc

SEQ ID NO: 3388991 - RNA, 16 nt, Pseudomonas aeruginosa PA01
cgguugcugugcaccc

SEQ ID NO: 3388992 - RNA, 19 nt, Pseudomonas aeruginosa PA01
cgguugcugugcacccaga

SEQ ID NO: 3388993 - RNA, 14 nt, Pseudomonas aeruginosa PA01
cgguuggagcggau

SEQ ID NO: 3388994 - RNA, 17 nt, Pseudomonas aeruginosa PA01
cgguuggagcggaucac

SEQ ID NO: 3388995 - RNA, 16 nt, Pseudomonas aeruginosa PA01
cgguuggccaggacca

SEQ ID NO: 3388996 - RNA, 14 nt, Pseudomonas aeruginosa PA01
cgguuggcccgcgc

SEQ ID NO: 3388997 - RNA, 16 nt, Pseudomonas aeruginosa PA01
cgguuggcccgcgccg

SEQ ID NO: 3388998 - RNA, 12 nt, Pseudomonas aeruginosa PA01
cguagcgcagcg

SEQ ID NO: 3388999 - RNA, 15 nt, Pseudomonas aeruginosa PA01
cguagcgcagggucg

SEQ ID NO: 3389000 - RNA, 12 nt, Pseudomonas aeruginosa PA01
cguagcgcaggu

SEQ ID NO: 3389001 - RNA, 19 nt, Pseudomonas aeruginosa PA01
cguagcgcaguucgccgcc

SEQ ID NO: 3389002 - RNA, 20 nt, Pseudomonas aeruginosa PA01
cguagcgccccuuggccagc

SEQ ID NO: 3389003 - RNA, 14 nt, Pseudomonas aeruginosa PA01
cguagcgcggcagc

SEQ ID NO: 3389004 - RNA, 17 nt, Pseudomonas aeruginosa PA01
cguagcgcucgguggca

SEQ ID NO: 3389005 - RNA, 23 nt, Pseudomonas aeruginosa PA01
cguagcggaagccgucggcgauc

SEQ ID NO: 3389006 - RNA, 20 nt, Pseudomonas aeruginosa PA01
cguagcggucgugcagcagc

SEQ ID NO: 3389007 - RNA, 23 nt, Pseudomonas aeruginosa PA01
cguagcggucgugcagcagcgcc

SEQ ID NO: 3389008 - RNA, 14 nt, Pseudomonas aeruginosa PA01
cguagcgugccgcc

SEQ ID NO: 3389009 - RNA, 21 nt, Pseudomonas aeruginosa PA01
cguagcguugcgcgagcaccg

SEQ ID NO: 3389010 - RNA, 17 nt, Pseudomonas aeruginosa PA01
cguagcugggcgaucac

SEQ ID NO: 3389011 - RNA, 18 nt, Pseudomonas aeruginosa PA01
cguagcugggcgaucacg

SEQ ID NO: 3389012 - RNA, 18 nt, Pseudomonas aeruginosa PA01
cguagcuuuccgcggcgu

SEQ ID NO: 3389013 - RNA, 20 nt, Pseudomonas aeruginosa PA01
cguaggaacgugcggccugc

SEQ ID NO: 3389014 - RNA, 21 nt, Pseudomonas aeruginosa PA01
cguaggaacgugcggccugca

SEQ ID NO: 3389015 - RNA, 13 nt, Pseudomonas aeruginosa PA01
cguaggagccggc

SEQ ID NO: 3389016 - RNA, 23 nt, Pseudomonas aeruginosa PA01
cguaggauacgucuucgauggcg

SEQ ID NO: 3389017 - RNA, 14 nt, Pseudomonas aeruginosa PA01
cguaggcaggcgcg

SEQ ID NO: 3389018 - RNA, 16 nt, Pseudomonas aeruginosa PA01
cguaggcaggcgcggc

SEQ ID NO: 3389019 - RNA, 17 nt, Pseudomonas aeruginosa PA01
cguaggcaggcgcggca

SEQ ID NO: 3389020 - RNA, 18 nt, Pseudomonas aeruginosa PA01
cguaggccacuucccggc

SEQ ID NO: 3389021 - RNA, 23 nt, Pseudomonas aeruginosa PA01
cguaggccacuucccggcgcaga

SEQ ID NO: 3389022 - RNA, 21 nt, Pseudomonas aeruginosa PA01
cguaggccaggcagaccagcg

SEQ ID NO: 3389023 - RNA, 15 nt, Pseudomonas aeruginosa PA01
cguaggccgucgcug

SEQ ID NO: 3389024 - RNA, 19 nt, Pseudomonas aeruginosa PA01
cguaggcgaacacgucggc

SEQ ID NO: 3389025 - RNA, 21 nt, Pseudomonas aeruginosa PA01
cguaggcgaacacgucggcgc

SEQ ID NO: 3389026 - RNA, 22 nt, Pseudomonas aeruginosa PA01
cguaggcgaacacgucggcgcg

SEQ ID NO: 3389027 - RNA, 18 nt, Pseudomonas aeruginosa PA01
cguaggcgcgcaccugcg

SEQ ID NO: 3389028 - RNA, 16 nt, Pseudomonas aeruginosa PA01
cguaggcgcgccaagg

SEQ ID NO: 3389029 - RNA, 18 nt, Pseudomonas aeruginosa PA01
cguaggcgcgccaaggcc

SEQ ID NO: 3389030 - RNA, 15 nt, Pseudomonas aeruginosa PA01
cguaggcggcgaagg

SEQ ID NO: 3389031 - RNA, 14 nt, Pseudomonas aeruginosa PA01
cguaggcgucgcga

SEQ ID NO: 3389032 - RNA, 22 nt, Pseudomonas aeruginosa PA01
cguagggcgaacaaccgcucgc

SEQ ID NO: 3389033 - RNA, 18 nt, Pseudomonas aeruginosa PA01
cguagggcgaacaacgcc

SEQ ID NO: 3389034 - RNA, 22 nt, Pseudomonas aeruginosa PA01
cguagggcgaauaaccgcaucg

SEQ ID NO: 3389035 - RNA, 22 nt, Pseudomonas aeruginosa PA01
cguagggcgaauaaccgcucgc

SEQ ID NO: 3389036 - RNA, 21 nt, Pseudomonas aeruginosa PA01
cguagggcgaauaaccgcugc

SEQ ID NO: 3389037 - RNA, 19 nt, Pseudomonas aeruginosa PA01
cguagggcgaauaacgcca

SEQ ID NO: 3389038 - RNA, 15 nt, Pseudomonas aeruginosa PA01
cguagggcgacgccc

SEQ ID NO: 3389039 - RNA, 22 nt, Pseudomonas aeruginosa PA01
cguagggcgcauaaccgcuugc

SEQ ID NO: 3389040 - RNA, 19 nt, Pseudomonas aeruginosa PA01
cguagggcgcauaacgcca

SEQ ID NO: 3389041 - RNA, 22 nt, Pseudomonas aeruginosa PA01
cguagggcguauaaccgcucgc

SEQ ID NO: 3389042 - RNA, 15 nt, Pseudomonas aeruginosa PA01
cguagggcuggacgu

SEQ ID NO: 3389043 - RNA, 15 nt, Pseudomonas aeruginosa PA01
cguaggggaccaccc

SEQ ID NO: 3389044 - RNA, 19 nt, Pseudomonas aeruginosa PA01
cguaggucaugcgugcggg

SEQ ID NO: 3389045 - RNA, 15 nt, Pseudomonas aeruginosa PA01
cguagguggauugca

SEQ ID NO: 3389046 - RNA, 20 nt, Pseudomonas aeruginosa PA01
cguagguggauugcagcguc

SEQ ID NO: 3389047 - RNA, 14 nt, Pseudomonas aeruginosa PA01
cguagguggcgccg

SEQ ID NO: 3389048 - RNA, 17 nt, Pseudomonas aeruginosa PA01
cguagguggcgccgccg

SEQ ID NO: 3389049 - RNA, 21 nt, Pseudomonas aeruginosa PA01
cguagguuuccggguccugga

SEQ ID NO: 3389050 - RNA, 14 nt, Pseudomonas aeruginosa PA01
cguaguaggcgcgg

SEQ ID NO: 3389051 - RNA, 15 nt, Pseudomonas aeruginosa PA01
cguaguccugggccg

SEQ ID NO: 3389052 - RNA, 17 nt, Pseudomonas aeruginosa PA01
cguagucguucagcgcc

SEQ ID NO: 3389053 - RNA, 14 nt, Pseudomonas aeruginosa PA01
cguagugcaucagc

SEQ ID NO: 3389054 - RNA, 23 nt, Pseudomonas aeruginosa PA01
cguagugcaucagccuggccagc

SEQ ID NO: 3389055 - RNA, 21 nt, Pseudomonas aeruginosa PA01
cguagugcuggguggaggccc

SEQ ID NO: 3389056 - RNA, 23 nt, Pseudomonas aeruginosa PA01
cguagugcuggguggaggcccag

SEQ ID NO: 3389057 - RNA, 20 nt, Pseudomonas aeruginosa PA01
cguaguggcguuccaggcgg

SEQ ID NO: 3389058 - RNA, 18 nt, Pseudomonas aeruginosa PA01
cguagugguugcgcacgc

SEQ ID NO: 3389059 - RNA, 17 nt, Pseudomonas aeruginosa PA01
cguaguugacccgcccc

SEQ ID NO: 3389060 - RNA, 19 nt, Pseudomonas aeruginosa PA01
cguaguugacccgccccug

SEQ ID NO: 3389061 - RNA, 22 nt, Pseudomonas aeruginosa PA01
cguaguugaugaagccgcgacc

SEQ ID NO: 3389062 - RNA, 13 nt, Pseudomonas aeruginosa PA01
cguauaggcgcug

SEQ ID NO: 3389063 - RNA, 14 nt, Pseudomonas aeruginosa PA01
cguauaggcgcugg

SEQ ID NO: 3389064 - RNA, 14 nt, Pseudomonas aeruginosa PA01
cguaucccagcgcg

SEQ ID NO: 3389065 - RNA, 14 nt, Pseudomonas aeruginosa PA01
cguauccgcggggu

SEQ ID NO: 3389066 - RNA, 19 nt, Pseudomonas aeruginosa PA01
cguaucgaugcgcgcggcg

SEQ ID NO: 3389067 - RNA, 20 nt, Pseudomonas aeruginosa PA01
cguaucgaugcgcgcggcga

SEQ ID NO: 3389068 - RNA, 23 nt, Pseudomonas aeruginosa PA01
cguauggccccuccaccucgacc

SEQ ID NO: 3389069 - RNA, 15 nt, Pseudomonas aeruginosa PA01
cguauuccaggggca

SEQ ID NO: 3389070 - RNA, 17 nt, Pseudomonas aeruginosa PA01
cguauucggcgaccagc

SEQ ID NO: 3389071 - RNA, 21 nt, Pseudomonas aeruginosa PA01
cgucaacccuugcucccgccg

SEQ ID NO: 3389072 - RNA, 15 nt, Pseudomonas aeruginosa PA01
cgucaagcaacggcg

SEQ ID NO: 3389073 - RNA, 15 nt, Pseudomonas aeruginosa PA01
cgucaagggccagga

SEQ ID NO: 3389074 - RNA, 22 nt, Pseudomonas aeruginosa PA01
cgucaagggccaggaaaucgag

SEQ ID NO: 3389075 - RNA, 13 nt, Pseudomonas aeruginosa PA01
cgucaaugcggcc

SEQ ID NO: 3389076 - RNA, 14 nt, Pseudomonas aeruginosa PA01
cgucaaugcggccu

SEQ ID NO: 3389077 - RNA, 12 nt, Pseudomonas aeruginosa PA01
cgucaccagcag

SEQ ID NO: 3389078 - RNA, 19 nt, Pseudomonas aeruginosa PA01
cgucaccagcagccccgag

SEQ ID NO: 3389079 - RNA, 19 nt, Pseudomonas aeruginosa PA01
cgucacccgcgccugcagg

SEQ ID NO: 3389080 - RNA, 22 nt, Pseudomonas aeruginosa PA01
cgucacccgcgccugcaggucg

SEQ ID NO: 3389081 - RNA, 12 nt, Pseudomonas aeruginosa PA01
cgucaccgcgcc

SEQ ID NO: 3389082 - RNA, 13 nt, Pseudomonas aeruginosa PA01
cgucaccgcgccg

SEQ ID NO: 3389083 - RNA, 20 nt, Pseudomonas aeruginosa PA01
cgucaccgcgccgaagguca

SEQ ID NO: 3389084 - RNA, 14 nt, Pseudomonas aeruginosa PA01
cgucaccggcgcca

SEQ ID NO: 3389085 - RNA, 16 nt, Pseudomonas aeruginosa PA01
cgucaccggcgccacc

SEQ ID NO: 3389086 - RNA, 16 nt, Pseudomonas aeruginosa PA01
cgucaccucggcgcca

SEQ ID NO: 3389087 - RNA, 21 nt, Pseudomonas aeruginosa PA01
cgucacgaacggacaccuugg

SEQ ID NO: 3389088 - RNA, 14 nt, Pseudomonas aeruginosa PA01
cgucacgaacggcg

SEQ ID NO: 3389089 - RNA, 15 nt, Pseudomonas aeruginosa PA01
cgucacgcccugccc

SEQ ID NO: 3389090 - RNA, 16 nt, Pseudomonas aeruginosa PA01
cgucacgcccugcccc

SEQ ID NO: 3389091 - RNA, 19 nt, Pseudomonas aeruginosa PA01
cgucacgccgaucccggcg

SEQ ID NO: 3389092 - RNA, 22 nt, Pseudomonas aeruginosa PA01
cgucacgccgaucccggcggcg

SEQ ID NO: 3389093 - RNA, 23 nt, Pseudomonas aeruginosa PA01
cgucacgccgaucccggcggcga

SEQ ID NO: 3389094 - RNA, 17 nt, Pseudomonas aeruginosa PA01
cgucacggauaggcggc

SEQ ID NO: 3389095 - RNA, 22 nt, Pseudomonas aeruginosa PA01
cgucacggcgaaaccggccagc

SEQ ID NO: 3389096 - RNA, 21 nt, Pseudomonas aeruginosa PA01
cgucacggcgugccgcaggcc

SEQ ID NO: 3389097 - RNA, 22 nt, Pseudomonas aeruginosa PA01
cgucacggcgugccgcaggccg

SEQ ID NO: 3389098 - RNA, 15 nt, Pseudomonas aeruginosa PA01
cgucacuggaacagc

SEQ ID NO: 3389099 - RNA, 18 nt, Pseudomonas aeruginosa PA01
cgucacuggaacagcgcg

SEQ ID NO: 3389100 - RNA, 18 nt, Pseudomonas aeruginosa PA01
cguccccuuccuccucgc

SEQ ID NO: 3389101 - RNA, 19 nt, Pseudomonas aeruginosa PA01
cguccccuuccuccucgcc

SEQ ID NO: 3389102 - RNA, 20 nt, Pseudomonas aeruginosa PA01
cguccccuuccuccucgccg

SEQ ID NO: 3389103 - RNA, 19 nt, Pseudomonas aeruginosa PA01
cgucccgagcaccggccuc

SEQ ID NO: 3389104 - RNA, 20 nt, Pseudomonas aeruginosa PA01
cgucccgagcaccggccuca

SEQ ID NO: 3389105 - RNA, 18 nt, Pseudomonas aeruginosa PA01
cgucccgcgcgccgagcc

SEQ ID NO: 3389106 - RNA, 17 nt, Pseudomonas aeruginosa PA01
cgucccggaguuccagc

SEQ ID NO: 3389107 - RNA, 16 nt, Pseudomonas aeruginosa PA01
cgucccguuccgcuca

SEQ ID NO: 3389108 - RNA, 19 nt, Pseudomonas aeruginosa PA01
cgucccguuccggcgcagc

SEQ ID NO: 3389109 - RNA, 15 nt, Pseudomonas aeruginosa PA01
cgucccuaccagcgc

SEQ ID NO: 3389110 - RNA, 17 nt, Pseudomonas aeruginosa PA01
cgucccugcccgcgccu

SEQ ID NO: 3389111 - RNA, 15 nt, Pseudomonas aeruginosa PA01
cgucccuggagcagg

SEQ ID NO: 3389112 - RNA, 17 nt, Pseudomonas aeruginosa PA01
cgucccugggccugcag

SEQ ID NO: 3389113 - RNA, 23 nt, Pseudomonas aeruginosa PA01
cgucccugggcgcaggggcgcgc

SEQ ID NO: 3389114 - RNA, 15 nt, Pseudomonas aeruginosa PA01
cgucccuugcgggua

SEQ ID NO: 3389115 - RNA, 17 nt, Pseudomonas aeruginosa PA01
cgucccuuggcgucgcg

SEQ ID NO: 3389116 - RNA, 18 nt, Pseudomonas aeruginosa PA01
cgucccuuggcgucgcgg

SEQ ID NO: 3389117 - RNA, 21 nt, Pseudomonas aeruginosa PA01
cgucccuuguuuuccuggccc

SEQ ID NO: 3389118 - RNA, 23 nt, Pseudomonas aeruginosa PA01
cgucccuuguuuuccuggcccug

SEQ ID NO: 3389119 - RNA, 12 nt, Pseudomonas aeruginosa PA01
cguccgaacgcg

SEQ ID NO: 3389120 - RNA, 15 nt, Pseudomonas aeruginosa PA01
cguccgaacgcgcug

SEQ ID NO: 3389121 - RNA, 22 nt, Pseudomonas aeruginosa PA01
cguccgaacgcgcugacggcaa

SEQ ID NO: 3389122 - RNA, 14 nt, Pseudomonas aeruginosa PA01
cguccgacagcagg

SEQ ID NO: 3389123 - RNA, 21 nt, Pseudomonas aeruginosa PA01
cguccgagagcagggccuggc

SEQ ID NO: 3389124 - RNA, 23 nt, Pseudomonas aeruginosa PA01
cguccgagagcagggccuggccc

SEQ ID NO: 3389125 - RNA, 18 nt, Pseudomonas aeruginosa PA01
cguccgaugucguugcgc

SEQ ID NO: 3389126 - RNA, 21 nt, Pseudomonas aeruginosa PA01
cguccgcagcacagccccagc

SEQ ID NO: 3389127 - RNA, 22 nt, Pseudomonas aeruginosa PA01
cguccgcaguucgccccgccgc

SEQ ID NO: 3389128 - RNA, 15 nt, Pseudomonas aeruginosa PA01
cguccgccaccacgg

SEQ ID NO: 3389129 - RNA, 16 nt, Pseudomonas aeruginosa PA01
cguccgccaccacggc

SEQ ID NO: 3389130 - RNA, 17 nt, Pseudomonas aeruginosa PA01
cguccgccaccacggcg

SEQ ID NO: 3389131 - RNA, 18 nt, Pseudomonas aeruginosa PA01
cguccgccagguccaggc

SEQ ID NO: 3389132 - RNA, 19 nt, Pseudomonas aeruginosa PA01
cguccgcccaguucgccgg

SEQ ID NO: 3389133 - RNA, 15 nt, Pseudomonas aeruginosa PA01
cguccgccucgcuga

SEQ ID NO: 3389134 - RNA, 12 nt, Pseudomonas aeruginosa PA01
cguccgccugcg

SEQ ID NO: 3389135 - RNA, 21 nt, Pseudomonas aeruginosa PA01
cguccgcgaugcguuccaggg

SEQ ID NO: 3389136 - RNA, 23 nt, Pseudomonas aeruginosa PA01
cguccgcgaugcguuccagggcg

SEQ ID NO: 3389137 - RNA, 13 nt, Pseudomonas aeruginosa PA01
cguccgcgccgcg

SEQ ID NO: 3389138 - RNA, 15 nt, Pseudomonas aeruginosa PA01
cguccgcgccgcgcg

SEQ ID NO: 3389139 - RNA, 18 nt, Pseudomonas aeruginosa PA01
cguccgcggccugcucgg

SEQ ID NO: 3389140 - RNA, 13 nt, Pseudomonas aeruginosa PA01
cguccgcuggccu

SEQ ID NO: 3389141 - RNA, 20 nt, Pseudomonas aeruginosa PA01
cguccgcuggccugcagcag

SEQ ID NO: 3389142 - RNA, 18 nt, Pseudomonas aeruginosa PA01
cguccggaccgggcggca

SEQ ID NO: 3389143 - RNA, 15 nt, Pseudomonas aeruginosa PA01
cguccggagccgggc

SEQ ID NO: 3389144 - RNA, 16 nt, Pseudomonas aeruginosa PA01
cguccggagccgggca

SEQ ID NO: 3389145 - RNA, 17 nt, Pseudomonas aeruginosa PA01
cguccggagugaugccg

SEQ ID NO: 3389146 - RNA, 14 nt, Pseudomonas aeruginosa PA01
cguccggcagggcc

SEQ ID NO: 3389147 - RNA, 15 nt, Pseudomonas aeruginosa PA01
cguccggccgcccga

SEQ ID NO: 3389148 - RNA, 12 nt, Pseudomonas aeruginosa PA01
cguccggcgaga

SEQ ID NO: 3389149 - RNA, 13 nt, Pseudomonas aeruginosa PA01
cguccggcgagca

SEQ ID NO: 3389150 - RNA, 17 nt, Pseudomonas aeruginosa PA01
cguccggcgucccgcag

SEQ ID NO: 3389151 - RNA, 16 nt, Pseudomonas aeruginosa PA01
cguccggcgugguggc

SEQ ID NO: 3389152 - RNA, 21 nt, Pseudomonas aeruginosa PA01
cguccgggcgguacaggcgca

SEQ ID NO: 3389153 - RNA, 21 nt, Pseudomonas aeruginosa PA01
cguccgggugccccaggcgag

SEQ ID NO: 3389154 - RNA, 22 nt, Pseudomonas aeruginosa PA01
cguccgggugccccaggcgagu

SEQ ID NO: 3389155 - RNA, 20 nt, Pseudomonas aeruginosa PA01
cguccgggugggucauggcg

SEQ ID NO: 3389156 - RNA, 22 nt, Pseudomonas aeruginosa PA01
cguccggguucaugucgguauc

SEQ ID NO: 3389157 - RNA, 22 nt, Pseudomonas aeruginosa PA01
cguccgguaggagcgagagcgc

SEQ ID NO: 3389158 - RNA, 21 nt, Pseudomonas aeruginosa PA01
cguccgguaugccgaucaugc

SEQ ID NO: 3389159 - RNA, 17 nt, Pseudomonas aeruginosa PA01
cguccggucgcaccgcc

SEQ ID NO: 3389160 - RNA, 20 nt, Pseudomonas aeruginosa PA01
cguccggucgcaccgccagc

SEQ ID NO: 3389161 - RNA, 21 nt, Pseudomonas aeruginosa PA01
cguccggucgcaccgccagca

SEQ ID NO: 3389162 - RNA, 20 nt, Pseudomonas aeruginosa PA01
cguccgguugcuggcacagg

SEQ ID NO: 3389163 - RNA, 19 nt, Pseudomonas aeruginosa PA01
cguccguaaugcaacccgc

SEQ ID NO: 3389164 - RNA, 21 nt, Pseudomonas aeruginosa PA01
cguccgucccacaggccggcu

SEQ ID NO: 3389165 - RNA, 13 nt, Pseudomonas aeruginosa PA01
cguccguucaggc

SEQ ID NO: 3389166 - RNA, 15 nt, Pseudomonas aeruginosa PA01
cguccuacgaaggca

SEQ ID NO: 3389167 - RNA, 20 nt, Pseudomonas aeruginosa PA01
cguccucagccucacccugc

SEQ ID NO: 3389168 - RNA, 15 nt, Pseudomonas aeruginosa PA01
cguccuccaaagccu

SEQ ID NO: 3389169 - RNA, 21 nt, Pseudomonas aeruginosa PA01
cguccuccaaagccuggagca

SEQ ID NO: 3389170 - RNA, 19 nt, Pseudomonas aeruginosa PA01
cguccuccaccgcuccggc

SEQ ID NO: 3389171 - RNA, 13 nt, Pseudomonas aeruginosa PA01
cguccuccagcaa

SEQ ID NO: 3389172 - RNA, 15 nt, Pseudomonas aeruginosa PA01
cguccuccagcaagg

SEQ ID NO: 3389173 - RNA, 15 nt, Pseudomonas aeruginosa PA01
cguccuccaggacca

SEQ ID NO: 3389174 - RNA, 23 nt, Pseudomonas aeruginosa PA01
cguccuccuccaguuccucgcga

SEQ ID NO: 3389175 - RNA, 20 nt, Pseudomonas aeruginosa PA01
cguccuccucgaucacccgc

SEQ ID NO: 3389176 - RNA, 22 nt, Pseudomonas aeruginosa PA01
cguccuccuggaggacgcgggc

SEQ ID NO: 3389177 - RNA, 23 nt, Pseudomonas aeruginosa PA01
cguccuccuggaggacgcgggcu

SEQ ID NO: 3389178 - RNA, 17 nt, Pseudomonas aeruginosa PA01
cguccucgaaagccgcc

SEQ ID NO: 3389179 - RNA, 18 nt, Pseudomonas aeruginosa PA01
cguccucgaaagccgccg

SEQ ID NO: 3389180 - RNA, 19 nt, Pseudomonas aeruginosa PA01
cguccucgaugcccgccuc

SEQ ID NO: 3389181 - RNA, 24 nt, Pseudomonas aeruginosa PA01
cguccucgaugcccgccucgcgca

SEQ ID NO: 3389182 - RNA, 20 nt, Pseudomonas aeruginosa PA01
cguccucgcccugcuuggcc

SEQ ID NO: 3389183 - RNA, 17 nt, Pseudomonas aeruginosa PA01
cguccucgggaugcagu

SEQ ID NO: 3389184 - RNA, 16 nt, Pseudomonas aeruginosa PA01
cguccucguggcgcgc

SEQ ID NO: 3389185 - RNA, 17 nt, Pseudomonas aeruginosa PA01
cguccucguggcgcgcc

SEQ ID NO: 3389186 - RNA, 20 nt, Pseudomonas aeruginosa PA01
cguccugcaacugcucgauc

SEQ ID NO: 3389187 - RNA, 14 nt, Pseudomonas aeruginosa PA01
cguccugcccuccu

SEQ ID NO: 3389188 - RNA, 17 nt, Pseudomonas aeruginosa PA01
cguccugccggugcucg

SEQ ID NO: 3389189 - RNA, 20 nt, Pseudomonas aeruginosa PA01
cguccugccggugcucggcc

SEQ ID NO: 3389190 - RNA, 21 nt, Pseudomonas aeruginosa PA01
cguccugccggugcucggccu

SEQ ID NO: 3389191 - RNA, 14 nt, Pseudomonas aeruginosa PA01
cguccugccucgga

SEQ ID NO: 3389192 - RNA, 17 nt, Pseudomonas aeruginosa PA01
cguccugccucggaggc

SEQ ID NO: 3389193 - RNA, 14 nt, Pseudomonas aeruginosa PA01
cguccugcgcggcg

SEQ ID NO: 3389194 - RNA, 15 nt, Pseudomonas aeruginosa PA01
cguccugcgcggcga

SEQ ID NO: 3389195 - RNA, 16 nt, Pseudomonas aeruginosa PA01
cguccugcucccuggc

SEQ ID NO: 3389196 - RNA, 17 nt, Pseudomonas aeruginosa PA01
cguccugcucccuggcg

SEQ ID NO: 3389197 - RNA, 19 nt, Pseudomonas aeruginosa PA01
cguccugcucccuggcgga

SEQ ID NO: 3389198 - RNA, 13 nt, Pseudomonas aeruginosa PA01
cguccugcugcug

SEQ ID NO: 3389199 - RNA, 15 nt, Pseudomonas aeruginosa PA01
cguccugcugcuggc

SEQ ID NO: 3389200 - RNA, 19 nt, Pseudomonas aeruginosa PA01
cguccugcuuccagaccuc

SEQ ID NO: 3389201 - RNA, 18 nt, Pseudomonas aeruginosa PA01
cguccuggucgcugaggc

SEQ ID NO: 3389202 - RNA, 18 nt, Pseudomonas aeruginosa PA01
cgucgaugaggucgcagc

SEQ ID NO: 3389203 - RNA, 19 nt, Pseudomonas aeruginosa PA01
cgucgaugaggucgcagcg

SEQ ID NO: 3389204 - RNA, 21 nt, Pseudomonas aeruginosa PA01
cgucgaugaggucgcagcguu

SEQ ID NO: 3389205 - RNA, 15 nt, Pseudomonas aeruginosa PA01
cgucgaugaucccga

SEQ ID NO: 3389206 - RNA, 21 nt, Pseudomonas aeruginosa PA01
cgucgaugaucugcauggcgc

SEQ ID NO: 3389207 - RNA, 19 nt, Pseudomonas aeruginosa PA01
cgucgaugccuucggcggc

SEQ ID NO: 3389208 - RNA, 20 nt, Pseudomonas aeruginosa PA01
cgucgaugccuucggcggcc

SEQ ID NO: 3389209 - RNA, 18 nt, Pseudomonas aeruginosa PA01
cgucgaugcgccucagcg

SEQ ID NO: 3389210 - RNA, 14 nt, Pseudomonas aeruginosa PA01
cgucgaugcguccg

SEQ ID NO: 3389211 - RNA, 17 nt, Pseudomonas aeruginosa PA01
cgucgaugcguccgcgc

SEQ ID NO: 3389212 - RNA, 13 nt, Pseudomonas aeruginosa PA01
cgucgaugucgcg

SEQ ID NO: 3389213 - RNA, 15 nt, Pseudomonas aeruginosa PA01
cgucgaugucgcggc

SEQ ID NO: 3389214 - RNA, 14 nt, Pseudomonas aeruginosa PA01
cgucgcacccggcc

SEQ ID NO: 3389215 - RNA, 22 nt, Pseudomonas aeruginosa PA01
cgucgcacccggcccauggcga

SEQ ID NO: 3389216 - RNA, 19 nt, Pseudomonas aeruginosa PA01
cgucgcaccugggacuccc

SEQ ID NO: 3389217 - RNA, 23 nt, Pseudomonas aeruginosa PA01
cgucgcaccugggacucccgcag

SEQ ID NO: 3389218 - RNA, 20 nt, Pseudomonas aeruginosa PA01
cgucgcaccuguuccagcaa

SEQ ID NO: 3389219 - RNA, 20 nt, Pseudomonas aeruginosa PA01
cgucgcacugcugcuugcuc

SEQ ID NO: 3389220 - RNA, 19 nt, Pseudomonas aeruginosa PA01
cgucgcagagacgcagcgc

SEQ ID NO: 3389221 - RNA, 20 nt, Pseudomonas aeruginosa PA01
cgucgcagagacgcagcgcu

SEQ ID NO: 3389222 - RNA, 13 nt, Pseudomonas aeruginosa PA01
cgucgcaggccug

SEQ ID NO: 3389223 - RNA, 14 nt, Pseudomonas aeruginosa PA01
cgucgcaggcgaug

SEQ ID NO: 3389224 - RNA, 21 nt, Pseudomonas aeruginosa PA01
cgucgcaggcgaugccgacgc

SEQ ID NO: 3389225 - RNA, 14 nt, Pseudomonas aeruginosa PA01
cgucgccaacgcgc

SEQ ID NO: 3389226 - RNA, 19 nt, Pseudomonas aeruginosa PA01
cgucgccaacgcgccgucg

SEQ ID NO: 3389227 - RNA, 20 nt, Pseudomonas aeruginosa PA01
cgucgccaacgcgccgucgc

SEQ ID NO: 3389228 - RNA, 14 nt, Pseudomonas aeruginosa PA01
cgucgccaagcccg

SEQ ID NO: 3389229 - RNA, 20 nt, Pseudomonas aeruginosa PA01
cgucgccaagcccggcgaga

SEQ ID NO: 3389230 - RNA, 14 nt, Pseudomonas aeruginosa PA01
cgucgccacgcccg

SEQ ID NO: 3389231 - RNA, 17 nt, Pseudomonas aeruginosa PA01
cgucgccacgcccgccg

SEQ ID NO: 3389232 - RNA, 12 nt, Pseudomonas aeruginosa PA01
cgucgccagccc

SEQ ID NO: 3389233 - RNA, 13 nt, Pseudomonas aeruginosa PA01
cgucgccagcccg

SEQ ID NO: 3389234 - RNA, 22 nt, Pseudomonas aeruginosa PA01
cgucgccaggccguagaccacc

SEQ ID NO: 3389235 - RNA, 23 nt, Pseudomonas aeruginosa PA01
cgucgccaggccguagaccacca

SEQ ID NO: 3389236 - RNA, 19 nt, Pseudomonas aeruginosa PA01
cgucgccaugcggcaggcc

SEQ ID NO: 3389237 - RNA, 17 nt, Pseudomonas aeruginosa PA01
cgucgccauucggcgac

SEQ ID NO: 3389238 - RNA, 20 nt, Pseudomonas aeruginosa PA01
cgucgccauucggcgacggg

SEQ ID NO: 3389239 - RNA, 23 nt, Pseudomonas aeruginosa PA01
cgucgcccaugugcuugaccgcc

SEQ ID NO: 3389240 - RNA, 21 nt, Pseudomonas aeruginosa PA01
cgucgccccacagcgguggga

SEQ ID NO: 3389241 - RNA, 14 nt, Pseudomonas aeruginosa PA01
cgucgccccagccu

SEQ ID NO: 3389242 - RNA, 19 nt, Pseudomonas aeruginosa PA01
cgucgcccucggcgcuggc

SEQ ID NO: 3389243 - RNA, 20 nt, Pseudomonas aeruginosa PA01
cgucgcccucggcgcuggcc

SEQ ID NO: 3389244 - RNA, 14 nt, Pseudomonas aeruginosa PA01
cgucgcccuggccg

SEQ ID NO: 3389245 - RNA, 15 nt, Pseudomonas aeruginosa PA01
cgucgcccuggugca

SEQ ID NO: 3389246 - RNA, 23 nt, Pseudomonas aeruginosa PA01
cgucgcccuucaggucgacaugc

SEQ ID NO: 3389247 - RNA, 21 nt, Pseudomonas aeruginosa PA01
cgucgccgaacuccgagcagg

SEQ ID NO: 3389248 - RNA, 13 nt, Pseudomonas aeruginosa PA01
cgucgccgaccag

SEQ ID NO: 3389249 - RNA, 16 nt, Pseudomonas aeruginosa PA01
cgucgccgacccugca

SEQ ID NO: 3389250 - RNA, 13 nt, Pseudomonas aeruginosa PA01
cgucgccgacugc

SEQ ID NO: 3389251 - RNA, 21 nt, Pseudomonas aeruginosa PA01
cgucgccgacuucggcaagca

SEQ ID NO: 3389252 - RNA, 13 nt, Pseudomonas aeruginosa PA01
cgucgccgaugcg

SEQ ID NO: 3389253 - RNA, 13 nt, Pseudomonas aeruginosa PA01
cgucgccgcccgg

SEQ ID NO: 3389254 - RNA, 14 nt, Pseudomonas aeruginosa PA01
cgucgccgcccggc

SEQ ID NO: 3389255 - RNA, 16 nt, Pseudomonas aeruginosa PA01
cgucgccgcccggcag

SEQ ID NO: 3389256 - RNA, 17 nt, Pseudomonas aeruginosa PA01
cgucgccgcccggcagc

SEQ ID NO: 3389257 - RNA, 18 nt, Pseudomonas aeruginosa PA01
cgucgccgcccggcagcg

SEQ ID NO: 3389258 - RNA, 17 nt, Pseudomonas aeruginosa PA01
cgucgccgccgaggcgc

SEQ ID NO: 3389259 - RNA, 20 nt, Pseudomonas aeruginosa PA01
cgucgccgccgaggcgcgcc

SEQ ID NO: 3389260 - RNA, 14 nt, Pseudomonas aeruginosa PA01
cgucgccgccgcgg

SEQ ID NO: 3389261 - RNA, 14 nt, Pseudomonas aeruginosa PA01
cgucgccgcugaug

SEQ ID NO: 3389262 - RNA, 14 nt, Pseudomonas aeruginosa PA01
cgucgccggccgcu

SEQ ID NO: 3389263 - RNA, 21 nt, Pseudomonas aeruginosa PA01
cgucgccguggaugucgagga

SEQ ID NO: 3389264 - RNA, 23 nt, Pseudomonas aeruginosa PA01
cgucgccguggaugucgaggaac

SEQ ID NO: 3389265 - RNA, 17 nt, Pseudomonas aeruginosa PA01
cgucgccugccaggcgg

SEQ ID NO: 3389266 - RNA, 13 nt, Pseudomonas aeruginosa PA01
cgucgccuuccac

SEQ ID NO: 3389267 - RNA, 17 nt, Pseudomonas aeruginosa PA01
cgucgccuuccaccacc

SEQ ID NO: 3389268 - RNA, 16 nt, Pseudomonas aeruginosa PA01
cgucgccuucgcugag

SEQ ID NO: 3389269 - RNA, 17 nt, Pseudomonas aeruginosa PA01
cgucgcgauagacgccg

SEQ ID NO: 3389270 - RNA, 18 nt, Pseudomonas aeruginosa PA01
cgucgcgauagacgccgg

SEQ ID NO: 3389271 - RNA, 20 nt, Pseudomonas aeruginosa PA01
cgucgcgauagacgccggcg

SEQ ID NO: 3389272 - RNA, 21 nt, Pseudomonas aeruginosa PA01
cgucgcgauagacgccggcga

SEQ ID NO: 3389273 - RNA, 22 nt, Pseudomonas aeruginosa PA01
cgucgcgauagacgccggcgac

SEQ ID NO: 3389274 - RNA, 15 nt, Pseudomonas aeruginosa PA01
cgucgcgcaccuggc

SEQ ID NO: 3389275 - RNA, 19 nt, Pseudomonas aeruginosa PA01
cgucgcgcagcuccucggc

SEQ ID NO: 3389276 - RNA, 15 nt, Pseudomonas aeruginosa PA01
cgucgcgcaggcggg

SEQ ID NO: 3389277 - RNA, 23 nt, Pseudomonas aeruginosa PA01
cgucgcgcaggcgggcggcgucg

SEQ ID NO: 3389278 - RNA, 13 nt, Pseudomonas aeruginosa PA01
cgucgcgccagca

SEQ ID NO: 3389279 - RNA, 18 nt, Pseudomonas aeruginosa PA01
cgucgcgccagcaccgug

SEQ ID NO: 3389280 - RNA, 15 nt, Pseudomonas aeruginosa PA01
cgucgcgccaggcga

SEQ ID NO: 3389281 - RNA, 21 nt, Pseudomonas aeruginosa PA01
cgucgcgccgcccggcucgcc

SEQ ID NO: 3389282 - RNA, 14 nt, Pseudomonas aeruginosa PA01
cgucgcgccgcgga

SEQ ID NO: 3389283 - RNA, 12 nt, Pseudomonas aeruginosa PA01
cgucgcgccggc

SEQ ID NO: 3389284 - RNA, 16 nt, Pseudomonas aeruginosa PA01
cgucgcgccggccauu

SEQ ID NO: 3389285 - RNA, 12 nt, Pseudomonas aeruginosa PA01
cgucgcgcgccc

SEQ ID NO: 3389286 - RNA, 15 nt, Pseudomonas aeruginosa PA01
cgucgcgcgccggag

SEQ ID NO: 3389287 - RNA, 16 nt, Pseudomonas aeruginosa PA01
cgucgcgcggccagcg

SEQ ID NO: 3389288 - RNA, 18 nt, Pseudomonas aeruginosa PA01
cgucgcgcguccagccgg

SEQ ID NO: 3389289 - RNA, 19 nt, Pseudomonas aeruginosa PA01
cgucgcgcguccagccggu

SEQ ID NO: 3389290 - RNA, 21 nt, Pseudomonas aeruginosa PA01
cgucgcgcgugccccguggcg

SEQ ID NO: 3389291 - RNA, 21 nt, Pseudomonas aeruginosa PA01
cgucgcgcuugagcagggugu

SEQ ID NO: 3389292 - RNA, 16 nt, Pseudomonas aeruginosa PA01
cgucgcggaucaacgg

SEQ ID NO: 3389293 - RNA, 18 nt, Pseudomonas aeruginosa PA01
cgucgcggauguucacca

SEQ ID NO: 3389294 - RNA, 20 nt, Pseudomonas aeruginosa PA01
cgucgcggauguucaccagg

SEQ ID NO: 3389295 - RNA, 13 nt, Pseudomonas aeruginosa PA01
cgucgcggcgcga

SEQ ID NO: 3389296 - RNA, 17 nt, Pseudomonas aeruginosa PA01
cgucgcgguacagccgg

SEQ ID NO: 3389297 - RNA, 18 nt, Pseudomonas aeruginosa PA01
cgucgcgguacagccggu

SEQ ID NO: 3389298 - RNA, 20 nt, Pseudomonas aeruginosa PA01
cgucgcgguacagccgguug

SEQ ID NO: 3389299 - RNA, 19 nt, Pseudomonas aeruginosa PA01
cgucgcggucuuccgccga

SEQ ID NO: 3389300 - RNA, 22 nt, Pseudomonas aeruginosa PA01
cgucgcggucuuccgccgacug

SEQ ID NO: 3389301 - RNA, 16 nt, Pseudomonas aeruginosa PA01
cgucgcgucgcacccg

SEQ ID NO: 3389302 - RNA, 18 nt, Pseudomonas aeruginosa PA01
cgucgcgucggccuggcg

SEQ ID NO: 3389303 - RNA, 20 nt, Pseudomonas aeruginosa PA01
cgucgcuauggugagguugu

SEQ ID NO: 3389304 - RNA, 14 nt, Pseudomonas aeruginosa PA01
cgucguaggccgag

SEQ ID NO: 3389305 - RNA, 21 nt, Pseudomonas aeruginosa PA01
cgucguaggccgagcccaccg

SEQ ID NO: 3389306 - RNA, 17 nt, Pseudomonas aeruginosa PA01
cgucguaguggccgucg

SEQ ID NO: 3389307 - RNA, 18 nt, Pseudomonas aeruginosa PA01
cgucguaguggccgucga

SEQ ID NO: 3389308 - RNA, 23 nt, Pseudomonas aeruginosa PA01
cgucguaguggccgucgaagggc

SEQ ID NO: 3389309 - RNA, 17 nt, Pseudomonas aeruginosa PA01
cgucgucaccucggcgc

SEQ ID NO: 3389310 - RNA, 19 nt, Pseudomonas aeruginosa PA01
cgucgucaccucggcgcca

SEQ ID NO: 3389311 - RNA, 20 nt, Pseudomonas aeruginosa PA01
cgucgucaccucggcgccau

SEQ ID NO: 3389312 - RNA, 12 nt, Pseudomonas aeruginosa PA01
cgucguccaccg

SEQ ID NO: 3389313 - RNA, 14 nt, Pseudomonas aeruginosa PA01
cgucguccagcggc

SEQ ID NO: 3389314 - RNA, 15 nt, Pseudomonas aeruginosa PA01
cgucguccagcgggc

SEQ ID NO: 3389315 - RNA, 16 nt, Pseudomonas aeruginosa PA01
cgucguccagcgggcc

SEQ ID NO: 3389316 - RNA, 19 nt, Pseudomonas aeruginosa PA01
cgucguccaucgccgcggc

SEQ ID NO: 3389317 - RNA, 23 nt, Pseudomonas aeruginosa PA01
cgucguccaucgccgcggcgaag

SEQ ID NO: 3389318 - RNA, 22 nt, Pseudomonas aeruginosa PA01
cgucguccggguucaugucggu

SEQ ID NO: 3389319 - RNA, 14 nt, Pseudomonas aeruginosa PA01
cgucguccugcgcg

SEQ ID NO: 3389320 - RNA, 15 nt, Pseudomonas aeruginosa PA01
cgucguccugcgcgg

SEQ ID NO: 3389321 - RNA, 16 nt, Pseudomonas aeruginosa PA01
cgucguccugcgcggc

SEQ ID NO: 3389322 - RNA, 21 nt, Pseudomonas aeruginosa PA01
cgucguccugcgcggcgacga

SEQ ID NO: 3389323 - RNA, 14 nt, Pseudomonas aeruginosa PA01
cgucgucgaccucg

SEQ ID NO: 3389324 - RNA, 14 nt, Pseudomonas aeruginosa PA01
cgucgucgaggcug

SEQ ID NO: 3389325 - RNA, 19 nt, Pseudomonas aeruginosa PA01
cgucgucgcggcgccuggc

SEQ ID NO: 3389326 - RNA, 16 nt, Pseudomonas aeruginosa PA01
cgucgucgcugcgcgg

SEQ ID NO: 3389327 - RNA, 11 nt, Pseudomonas aeruginosa PA01
cgucgucggcg

SEQ ID NO: 3389328 - RNA, 14 nt, Pseudomonas aeruginosa PA01
cgucgucggcgacc

SEQ ID NO: 3389329 - RNA, 16 nt, Pseudomonas aeruginosa PA01
cgucgucggggugccg

SEQ ID NO: 3389330 - RNA, 15 nt, Pseudomonas aeruginosa PA01
cgucgugcgccggcc

SEQ ID NO: 3389331 - RNA, 21 nt, Pseudomonas aeruginosa PA01
cgucguggaaguauugcucca

SEQ ID NO: 3389332 - RNA, 19 nt, Pseudomonas aeruginosa PA01
cgucguggauaggcggcgg

SEQ ID NO: 3389333 - RNA, 20 nt, Pseudomonas aeruginosa PA01
cgucguggauaggcggcgga

SEQ ID NO: 3389334 - RNA, 20 nt, Pseudomonas aeruginosa PA01
cgucguggccauagagccgc

SEQ ID NO: 3389335 - RNA, 12 nt, Pseudomonas aeruginosa PA01
cgucguggcgaa

SEQ ID NO: 3389336 - RNA, 19 nt, Pseudomonas aeruginosa PA01
cgucgugguccuugaacgg

SEQ ID NO: 3389337 - RNA, 13 nt, Pseudomonas aeruginosa PA01
cgucguucagccc

SEQ ID NO: 3389338 - RNA, 14 nt, Pseudomonas aeruginosa PA01
cgucguucagccca

SEQ ID NO: 3389339 - RNA, 22 nt, Pseudomonas aeruginosa PA01
cgucguucagcccacccccggc

SEQ ID NO: 3389340 - RNA, 14 nt, Pseudomonas aeruginosa PA01
cgucguucagcggc

SEQ ID NO: 3389341 - RNA, 16 nt, Pseudomonas aeruginosa PA01
cgucguuggccggcug

SEQ ID NO: 3389342 - RNA, 16 nt, Pseudomonas aeruginosa PA01
cgucguuucucggcga

SEQ ID NO: 3389343 - RNA, 17 nt, Pseudomonas aeruginosa PA01
cgucguuucucggcgau

SEQ ID NO: 3389344 - RNA, 18 nt, Pseudomonas aeruginosa PA01
cgucguuucucggcgaug

SEQ ID NO: 3389345 - RNA, 16 nt, Pseudomonas aeruginosa PA01
cgucguuuuguccggc

SEQ ID NO: 3389346 - RNA, 22 nt, Pseudomonas aeruginosa PA01
cgucguuuuguccggcggcugc

SEQ ID NO: 3389347 - RNA, 20 nt, Pseudomonas aeruginosa PA01
cgucucagaccuuccugacg

SEQ ID NO: 3389348 - RNA, 22 nt, Pseudomonas aeruginosa PA01
cgucucagcgguagaacaggcg

SEQ ID NO: 3389349 - RNA, 21 nt, Pseudomonas aeruginosa PA01
cgucucauggaacagcagcca

SEQ ID NO: 3389350 - RNA, 14 nt, Pseudomonas aeruginosa PA01
cgucuccaggcgcg

SEQ ID NO: 3389351 - RNA, 22 nt, Pseudomonas aeruginosa PA01
cgucuccaugcgggagagcgcc

SEQ ID NO: 3389352 - RNA, 13 nt, Pseudomonas aeruginosa PA01
cgucuccgccgcu

SEQ ID NO: 3389353 - RNA, 17 nt, Pseudomonas aeruginosa PA01
cgucuccgccgcuaucg

SEQ ID NO: 3389354 - RNA, 12 nt, Pseudomonas aeruginosa PA01
cgucuccugccg

SEQ ID NO: 3389355 - RNA, 15 nt, Pseudomonas aeruginosa PA01
cgucuccugccgccg

SEQ ID NO: 3389356 - RNA, 16 nt, Pseudomonas aeruginosa PA01
cgucuccugccgccga

SEQ ID NO: 3389357 - RNA, 16 nt, Pseudomonas aeruginosa PA01
cgucucgcgacacgug

SEQ ID NO: 3389358 - RNA, 18 nt, Pseudomonas aeruginosa PA01
cgucucggagugaggccg

SEQ ID NO: 3389359 - RNA, 20 nt, Pseudomonas aeruginosa PA01
cgucucggagugaggccgag

SEQ ID NO: 3389360 - RNA, 21 nt, Pseudomonas aeruginosa PA01
cgucucggagugaggccgagc

SEQ ID NO: 3389361 - RNA, 14 nt, Pseudomonas aeruginosa PA01
cgucucggcgaacg

SEQ ID NO: 3389362 - RNA, 19 nt, Pseudomonas aeruginosa PA01
cgucucggcugccgccagc

SEQ ID NO: 3389363 - RNA, 22 nt, Pseudomonas aeruginosa PA01
cgucugaacgaagaagccggcc

SEQ ID NO: 3389364 - RNA, 16 nt, Pseudomonas aeruginosa PA01
cgucugcagcuugcgc

SEQ ID NO: 3389365 - RNA, 21 nt, Pseudomonas aeruginosa PA01
cgucugcagcuugcgcgccag

SEQ ID NO: 3389366 - RNA, 13 nt, Pseudomonas aeruginosa PA01
cgucugccgcugg

SEQ ID NO: 3389367 - RNA, 20 nt, Pseudomonas aeruginosa PA01
cgucugcucauucggccagc

SEQ ID NO: 3389368 - RNA, 16 nt, Pseudomonas aeruginosa PA01
cgucuggcgcauccgc

SEQ ID NO: 3389369 - RNA, 14 nt, Pseudomonas aeruginosa PA01
cgucugggacggca

SEQ ID NO: 3389370 - RNA, 15 nt, Pseudomonas aeruginosa PA01
cgucugggacggcag

SEQ ID NO: 3389371 - RNA, 21 nt, Pseudomonas aeruginosa PA01
cgucugggacggcagccuggg

SEQ ID NO: 3389372 - RNA, 17 nt, Pseudomonas aeruginosa PA01
cgucuggggugaggccg

SEQ ID NO: 3389373 - RNA, 19 nt, Pseudomonas aeruginosa PA01
cgucuggggugaggccgag

SEQ ID NO: 3389374 - RNA, 20 nt, Pseudomonas aeruginosa PA01
cgucuggggugaggccgagc

SEQ ID NO: 3389375 - RNA, 19 nt, Pseudomonas aeruginosa PA01
cgucugggugaccagcagg

SEQ ID NO: 3389376 - RNA, 20 nt, Pseudomonas aeruginosa PA01
cgucugugccgaggccgccg

SEQ ID NO: 3389377 - RNA, 21 nt, Pseudomonas aeruginosa PA01
cgucugugccgaggccgccgc

SEQ ID NO: 3389378 - RNA, 13 nt, Pseudomonas aeruginosa PA01
cgucuguucggcc

SEQ ID NO: 3389379 - RNA, 16 nt, Pseudomonas aeruginosa PA01
cgucuguucggccagg

SEQ ID NO: 3389380 - RNA, 23 nt, Pseudomonas aeruginosa PA01
cgucuguugcgguggugucuggu

SEQ ID NO: 3389381 - RNA, 18 nt, Pseudomonas aeruginosa PA01
cgucuuauucgacgcucu

SEQ ID NO: 3389382 - RNA, 22 nt, Pseudomonas aeruginosa PA01
cgucuucaggcgcuccuggagg

SEQ ID NO: 3389383 - RNA, 14 nt, Pseudomonas aeruginosa PA01
cgucuuccaccaga

SEQ ID NO: 3389384 - RNA, 16 nt, Pseudomonas aeruginosa PA01
cgucuuccagcggcca

SEQ ID NO: 3389385 - RNA, 21 nt, Pseudomonas aeruginosa PA01
cgucuuccagcggccacggcg

SEQ ID NO: 3389386 - RNA, 19 nt, Pseudomonas aeruginosa PA01
cgucuuccagggcggcgcg

SEQ ID NO: 3389387 - RNA, 17 nt, Pseudomonas aeruginosa PA01
cgucuuccggcucgccg

SEQ ID NO: 3389388 - RNA, 18 nt, Pseudomonas aeruginosa PA01
cgucuuccuugcugaagc

SEQ ID NO: 3389389 - RNA, 19 nt, Pseudomonas aeruginosa PA01
cgucuucgaugaaggucag

SEQ ID NO: 3389390 - RNA, 17 nt, Pseudomonas aeruginosa PA01
cgucuucgauggcggcc

SEQ ID NO: 3389391 - RNA, 13 nt, Pseudomonas aeruginosa PA01
cgucuucgccgau

SEQ ID NO: 3389392 - RNA, 16 nt, Pseudomonas aeruginosa PA01
cgucuucgccgaugcg

SEQ ID NO: 3389393 - RNA, 14 nt, Pseudomonas aeruginosa PA01
cgucuucggcggcg

SEQ ID NO: 3389394 - RNA, 15 nt, Pseudomonas aeruginosa PA01
cgucuugcaggcuca

SEQ ID NO: 3389395 - RNA, 16 nt, Pseudomonas aeruginosa PA01
cgucuugcaggcucac

SEQ ID NO: 3389396 - RNA, 16 nt, Pseudomonas aeruginosa PA01
cgucuugccgcugcgc

SEQ ID NO: 3389397 - RNA, 16 nt, Pseudomonas aeruginosa PA01
cgucuugucgaagccc

SEQ ID NO: 3389398 - RNA, 18 nt, Pseudomonas aeruginosa PA01
cgugaaacgccagaagcg

SEQ ID NO: 3389399 - RNA, 14 nt, Pseudomonas aeruginosa PA01
cgugaacgcggcga

SEQ ID NO: 3389400 - RNA, 13 nt, Pseudomonas aeruginosa PA01
cgugaagccccug

SEQ ID NO: 3389401 - RNA, 20 nt, Pseudomonas aeruginosa PA01
cgugaagccccuggcgcugg

SEQ ID NO: 3389402 - RNA, 14 nt, Pseudomonas aeruginosa PA01
cgugaagccgccgc

SEQ ID NO: 3389403 - RNA, 17 nt, Pseudomonas aeruginosa PA01
cgugaagccgccgccca

SEQ ID NO: 3389404 - RNA, 21 nt, Pseudomonas aeruginosa PA01
cgugaagccgccgcccagcag

SEQ ID NO: 3389405 - RNA, 20 nt, Pseudomonas aeruginosa PA01
cgugaagcuggagcagcagc

SEQ ID NO: 3389406 - RNA, 21 nt, Pseudomonas aeruginosa PA01
cgugaccauaggcuugcgccg

SEQ ID NO: 3389407 - RNA, 19 nt, Pseudomonas aeruginosa PA01
cgugcgauucagaugcggu

SEQ ID NO: 3389408 - RNA, 16 nt, Pseudomonas aeruginosa PA01
cgugcgcaugcccgcg

SEQ ID NO: 3389409 - RNA, 13 nt, Pseudomonas aeruginosa PA01
cgugcgccccagc

SEQ ID NO: 3389410 - RNA, 21 nt, Pseudomonas aeruginosa PA01
cgugcgccccagcucagcagg

SEQ ID NO: 3389411 - RNA, 22 nt, Pseudomonas aeruginosa PA01
cgugcgccgcgggucaccagcg

SEQ ID NO: 3389412 - RNA, 23 nt, Pseudomonas aeruginosa PA01
cgugcgccgcgggucaccagcgc

SEQ ID NO: 3389413 - RNA, 16 nt, Pseudomonas aeruginosa PA01
cgugcgccgcucgcgc

SEQ ID NO: 3389414 - RNA, 18 nt, Pseudomonas aeruginosa PA01
cgugcgccgcucgcgcac

SEQ ID NO: 3389415 - RNA, 15 nt, Pseudomonas aeruginosa PA01
cgugcgccggccucu

SEQ ID NO: 3389416 - RNA, 13 nt, Pseudomonas aeruginosa PA01
cgugcgcgccgcc

SEQ ID NO: 3389417 - RNA, 15 nt, Pseudomonas aeruginosa PA01
cgugcgcgccgccgg

SEQ ID NO: 3389418 - RNA, 16 nt, Pseudomonas aeruginosa PA01
cgugcgcgccgccggg

SEQ ID NO: 3389419 - RNA, 16 nt, Pseudomonas aeruginosa PA01
cgugcgcuccgccagg

SEQ ID NO: 3389420 - RNA, 20 nt, Pseudomonas aeruginosa PA01
cgugcgcuccgccaggccgc

SEQ ID NO: 3389421 - RNA, 22 nt, Pseudomonas aeruginosa PA01
cgugcgcuccgccaggccgcgc

SEQ ID NO: 3389422 - RNA, 13 nt, Pseudomonas aeruginosa PA01
cgugcgcugcgcg

SEQ ID NO: 3389423 - RNA, 21 nt, Pseudomonas aeruginosa PA01
cgugcgcugguaccugccggc

SEQ ID NO: 3389424 - RNA, 17 nt, Pseudomonas aeruginosa PA01
cgugcggaaaccgcggc

SEQ ID NO: 3389425 - RNA, 19 nt, Pseudomonas aeruginosa PA01
cgugcggaaaccgcggccg

SEQ ID NO: 3389426 - RNA, 22 nt, Pseudomonas aeruginosa PA01
cgugcggaaaccgcggccggcu

SEQ ID NO: 3389427 - RNA, 20 nt, Pseudomonas aeruginosa PA01
cgugcggcacgcugcuugcg

SEQ ID NO: 3389428 - RNA, 22 nt, Pseudomonas aeruginosa PA01
cgugcggcacgcugcuugcgca

SEQ ID NO: 3389429 - RNA, 15 nt, Pseudomonas aeruginosa PA01
cgugcggccgaucau

SEQ ID NO: 3389430 - RNA, 15 nt, Pseudomonas aeruginosa PA01
cgugcggccugcaac

SEQ ID NO: 3389431 - RNA, 19 nt, Pseudomonas aeruginosa PA01
cgugcggcguucgccgcgg

SEQ ID NO: 3389432 - RNA, 19 nt, Pseudomonas aeruginosa PA01
cgugcggggugcgcuggaa

SEQ ID NO: 3389433 - RNA, 13 nt, Pseudomonas aeruginosa PA01
cgugcgggucgag

SEQ ID NO: 3389434 - RNA, 17 nt, Pseudomonas aeruginosa PA01
cgugcguugcgcggcag

SEQ ID NO: 3389435 - RNA, 12 nt, Pseudomonas aeruginosa PA01
cgugcuccaccu

SEQ ID NO: 3389436 - RNA, 12 nt, Pseudomonas aeruginosa PA01
cgugcuccagca

SEQ ID NO: 3389437 - RNA, 18 nt, Pseudomonas aeruginosa PA01
cgugcuccgugucggcgg

SEQ ID NO: 3389438 - RNA, 16 nt, Pseudomonas aeruginosa PA01
cgugcuccucauggaa

SEQ ID NO: 3389439 - RNA, 22 nt, Pseudomonas aeruginosa PA01
cgugcuccucauggaacugcag

SEQ ID NO: 3389440 - RNA, 19 nt, Pseudomonas aeruginosa PA01
cgugcucgaugaucgacug

SEQ ID NO: 3389441 - RNA, 14 nt, Pseudomonas aeruginosa PA01
cgugcucgcggacc

SEQ ID NO: 3389442 - RNA, 19 nt, Pseudomonas aeruginosa PA01
cgugcucgcggaccagcuc

SEQ ID NO: 3389443 - RNA, 20 nt, Pseudomonas aeruginosa PA01
cgugcucgcggaccagcucc

SEQ ID NO: 3389444 - RNA, 17 nt, Pseudomonas aeruginosa PA01
cgugcucggcgaucucg

SEQ ID NO: 3389445 - RNA, 19 nt, Pseudomonas aeruginosa PA01
cgugcucggcgaucucgcc

SEQ ID NO: 3389446 - RNA, 19 nt, Pseudomonas aeruginosa PA01
cgugcucuuuucccgcacc

SEQ ID NO: 3389447 - RNA, 22 nt, Pseudomonas aeruginosa PA01
cgugcucuuuucccgcaccggc

SEQ ID NO: 3389448 - RNA, 13 nt, Pseudomonas aeruginosa PA01
cgugcuggacuuc

SEQ ID NO: 3389449 - RNA, 14 nt, Pseudomonas aeruginosa PA01
cgugcuggccggca

SEQ ID NO: 3389450 - RNA, 12 nt, Pseudomonas aeruginosa PA01
cgugcuucucac

SEQ ID NO: 3389451 - RNA, 18 nt, Pseudomonas aeruginosa PA01
cgugcuugcagucgcgga

SEQ ID NO: 3389452 - RNA, 20 nt, Pseudomonas aeruginosa PA01
cgugcuugcagucgcggaag

SEQ ID NO: 3389453 - RNA, 18 nt, Pseudomonas aeruginosa PA01
cgugcuuggugucggccg

SEQ ID NO: 3389454 - RNA, 20 nt, Pseudomonas aeruginosa PA01
cgugcuuggugucggccgcc

SEQ ID NO: 3389455 - RNA, 21 nt, Pseudomonas aeruginosa PA01
cgugcuuggugucggccgcca

SEQ ID NO: 3389456 - RNA, 23 nt, Pseudomonas aeruginosa PA01
cgugcuuggugucggccgccagg

SEQ ID NO: 3389457 - RNA, 16 nt, Pseudomonas aeruginosa PA01
cguggaacagcgcguc

SEQ ID NO: 3389458 - RNA, 16 nt, Pseudomonas aeruginosa PA01
cguggaaccgauggcc

SEQ ID NO: 3389459 - RNA, 19 nt, Pseudomonas aeruginosa PA01
cguggaaccgauggccagg

SEQ ID NO: 3389460 - RNA, 21 nt, Pseudomonas aeruginosa PA01
cguggaaccgauggccagggg

SEQ ID NO: 3389461 - RNA, 16 nt, Pseudomonas aeruginosa PA01
cguggaaccgcggcgc

SEQ ID NO: 3389462 - RNA, 20 nt, Pseudomonas aeruginosa PA01
cguggaaguauugcuccacc

SEQ ID NO: 3389463 - RNA, 21 nt, Pseudomonas aeruginosa PA01
cguggaaguauugcuccaccc

SEQ ID NO: 3389464 - RNA, 17 nt, Pseudomonas aeruginosa PA01
cguggacauacaggcgc

SEQ ID NO: 3389465 - RNA, 19 nt, Pseudomonas aeruginosa PA01
cguggacauacaggcgcgc

SEQ ID NO: 3389466 - RNA, 22 nt, Pseudomonas aeruginosa PA01
cguggacauacaggcgcgccug

SEQ ID NO: 3389467 - RNA, 13 nt, Pseudomonas aeruginosa PA01
cguggaccaacag

SEQ ID NO: 3389468 - RNA, 18 nt, Pseudomonas aeruginosa PA01
cguggaccaacagccggc

SEQ ID NO: 3389469 - RNA, 20 nt, Pseudomonas aeruginosa PA01
cguggaccaacagccggcgg

SEQ ID NO: 3389470 - RNA, 21 nt, Pseudomonas aeruginosa PA01
cguggacccgugcgccccagc

SEQ ID NO: 3389471 - RNA, 14 nt, Pseudomonas aeruginosa PA01
cguggacgccggug

SEQ ID NO: 3389472 - RNA, 14 nt, Pseudomonas aeruginosa PA01
cguggagaggucgc

SEQ ID NO: 3389473 - RNA, 18 nt, Pseudomonas aeruginosa PA01
cguggauauugugcgaga

SEQ ID NO: 3389474 - RNA, 12 nt, Pseudomonas aeruginosa PA01
cguggaucgcca

SEQ ID NO: 3389475 - RNA, 23 nt, Pseudomonas aeruginosa PA01
cguggaucgcccggcugcacagg

SEQ ID NO: 3389476 - RNA, 16 nt, Pseudomonas aeruginosa PA01
cguggcacccaggcca

SEQ ID NO: 3389477 - RNA, 21 nt, Pseudomonas aeruginosa PA01
cguggcacguacguccagggc

SEQ ID NO: 3389478 - RNA, 23 nt, Pseudomonas aeruginosa PA01
cguggcacguacguccagggcac

SEQ ID NO: 3389479 - RNA, 13 nt, Pseudomonas aeruginosa PA01
cguggcaggcgcc

SEQ ID NO: 3389480 - RNA, 16 nt, Pseudomonas aeruginosa PA01
cguggcaggcgcccgg

SEQ ID NO: 3389481 - RNA, 20 nt, Pseudomonas aeruginosa PA01
cguggcaggcgcccggucag

SEQ ID NO: 3389482 - RNA, 22 nt, Pseudomonas aeruginosa PA01
cguggcaggugacgcagggcgg

SEQ ID NO: 3389483 - RNA, 20 nt, Pseudomonas aeruginosa PA01
cguggccagcgaacccaggc

SEQ ID NO: 3389484 - RNA, 22 nt, Pseudomonas aeruginosa PA01
cguggccagcgaacccaggccg

SEQ ID NO: 3389485 - RNA, 24 nt, Pseudomonas aeruginosa PA01
cguggccagcgaacccaggccgcg

SEQ ID NO: 3389486 - RNA, 19 nt, Pseudomonas aeruginosa PA01
cguggccagcgcccaggcc

SEQ ID NO: 3389487 - RNA, 21 nt, Pseudomonas aeruginosa PA01
cguggccagcgcccaggccgg

SEQ ID NO: 3389488 - RNA, 19 nt, Pseudomonas aeruginosa PA01
cguggccauagagccgcug

SEQ ID NO: 3389489 - RNA, 21 nt, Pseudomonas aeruginosa PA01
cguggccauggguaucguuga

SEQ ID NO: 3389490 - RNA, 13 nt, Pseudomonas aeruginosa PA01
cguggcccggcgc

SEQ ID NO: 3389491 - RNA, 14 nt, Pseudomonas aeruginosa PA01
cguggcccggcgcg

SEQ ID NO: 3389492 - RNA, 19 nt, Pseudomonas aeruginosa PA01
cguggcccggcgcggcggc

SEQ ID NO: 3389493 - RNA, 14 nt, Pseudomonas aeruginosa PA01
cguggccgccaggg

SEQ ID NO: 3389494 - RNA, 18 nt, Pseudomonas aeruginosa PA01
cguggccgcgaaccgggu

SEQ ID NO: 3389495 - RNA, 17 nt, Pseudomonas aeruginosa PA01
cguggccggcgaccagc

SEQ ID NO: 3389496 - RNA, 18 nt, Pseudomonas aeruginosa PA01
cguggcgaacgcccggcu

SEQ ID NO: 3389497 - RNA, 22 nt, Pseudomonas aeruginosa PA01
cguggcgacgaugcgccccagc

SEQ ID NO: 3389498 - RNA, 21 nt, Pseudomonas aeruginosa PA01
cguggcgaucaggcagcgcgc

SEQ ID NO: 3389499 - RNA, 19 nt, Pseudomonas aeruginosa PA01
cguggcgaugcccuggcuu

SEQ ID NO: 3389500 - RNA, 22 nt, Pseudomonas aeruginosa PA01
cguggcgaugcccuggcuuucc

SEQ ID NO: 3389501 - RNA, 19 nt, Pseudomonas aeruginosa PA01
cguggcgccauccuccagc

SEQ ID NO: 3389502 - RNA, 17 nt, Pseudomonas aeruginosa PA01
cguggcgccccaggcgg

SEQ ID NO: 3389503 - RNA, 20 nt, Pseudomonas aeruginosa PA01
cguggcgccccaggcgggca

SEQ ID NO: 3389504 - RNA, 21 nt, Pseudomonas aeruginosa PA01
cguggcgccccaggcgggcac

SEQ ID NO: 3389505 - RNA, 12 nt, Pseudomonas aeruginosa PA01
cguggcgccgca

SEQ ID NO: 3389506 - RNA, 13 nt, Pseudomonas aeruginosa PA01
cguggcgccgcag

SEQ ID NO: 3389507 - RNA, 14 nt, Pseudomonas aeruginosa PA01
cguggcgccgcagg

SEQ ID NO: 3389508 - RNA, 14 nt, Pseudomonas aeruginosa PA01
cguggcgccggcgc

SEQ ID NO: 3389509 - RNA, 15 nt, Pseudomonas aeruginosa PA01
cguuaaccugccugc

SEQ ID NO: 3389510 - RNA, 20 nt, Pseudomonas aeruginosa PA01
cguuaccgcgggcucaggcu

SEQ ID NO: 3389511 - RNA, 23 nt, Pseudomonas aeruginosa PA01
cguuacggguggcaugggccagu

SEQ ID NO: 3389512 - RNA, 15 nt, Pseudomonas aeruginosa PA01
cguuagcucagucgg

SEQ ID NO: 3389513 - RNA, 16 nt, Pseudomonas aeruginosa PA01
cguuauccgccgauac

SEQ ID NO: 3389514 - RNA, 23 nt, Pseudomonas aeruginosa PA01
cguuauccgccgauacagcgcgc

SEQ ID NO: 3389515 - RNA, 15 nt, Pseudomonas aeruginosa PA01
cguuauccgccgccg

SEQ ID NO: 3389516 - RNA, 16 nt, Pseudomonas aeruginosa PA01
cguuauccguccuacg

SEQ ID NO: 3389517 - RNA, 13 nt, Pseudomonas aeruginosa PA01
cguuaucgccggu

SEQ ID NO: 3389518 - RNA, 20 nt, Pseudomonas aeruginosa PA01
cguuaugcacguucuugacc

SEQ ID NO: 3389519 - RNA, 19 nt, Pseudomonas aeruginosa PA01
cguucaccccgcccuuggc

SEQ ID NO: 3389520 - RNA, 20 nt, Pseudomonas aeruginosa PA01
cguucaccccgcccuuggcg

SEQ ID NO: 3389521 - RNA, 15 nt, Pseudomonas aeruginosa PA01
cguucacgccuggcg

SEQ ID NO: 3389522 - RNA, 20 nt, Pseudomonas aeruginosa PA01
cguucacgcgaccaccuucu

SEQ ID NO: 3389523 - RNA, 18 nt, Pseudomonas aeruginosa PA01
cguucacguugaccugcg

SEQ ID NO: 3389524 - RNA, 16 nt, Pseudomonas aeruginosa PA01
cguucacuccacgagg

SEQ ID NO: 3389525 - RNA, 17 nt, Pseudomonas aeruginosa PA01
cguucagcagcaugccg

SEQ ID NO: 3389526 - RNA, 23 nt, Pseudomonas aeruginosa PA01
cguucagccacggacgcgcaggg

SEQ ID NO: 3389527 - RNA, 13 nt, Pseudomonas aeruginosa PA01
cguucagcccacc

SEQ ID NO: 3389528 - RNA, 13 nt, Pseudomonas aeruginosa PA01
cguucagcgccuc

SEQ ID NO: 3389529 - RNA, 14 nt, Pseudomonas aeruginosa PA01
cguucagcggcacg

SEQ ID NO: 3389530 - RNA, 12 nt, Pseudomonas aeruginosa PA01
cguucaggccgg

SEQ ID NO: 3389531 - RNA, 20 nt, Pseudomonas aeruginosa PA01
cguucaggccggcgccgccg

SEQ ID NO: 3389532 - RNA, 21 nt, Pseudomonas aeruginosa PA01
cguucaggccggcgccgccga

SEQ ID NO: 3389533 - RNA, 23 nt, Pseudomonas aeruginosa PA01
cguucaggccggcgccgccgaac

SEQ ID NO: 3389534 - RNA, 13 nt, Pseudomonas aeruginosa PA01
cguucaggcgcgg

SEQ ID NO: 3389535 - RNA, 21 nt, Pseudomonas aeruginosa PA01
cguucaggcuguugcccuggg

SEQ ID NO: 3389536 - RNA, 15 nt, Pseudomonas aeruginosa PA01
cguucagggucaggu

SEQ ID NO: 3389537 - RNA, 19 nt, Pseudomonas aeruginosa PA01
cguucagucccgcggcgcg

SEQ ID NO: 3389538 - RNA, 18 nt, Pseudomonas aeruginosa PA01
cguucaguucugggcggc

SEQ ID NO: 3389539 - RNA, 21 nt, Pseudomonas aeruginosa PA01
cguucaguucugggcggccag

SEQ ID NO: 3389540 - RNA, 13 nt, Pseudomonas aeruginosa PA01
cguucaguugccu

SEQ ID NO: 3389541 - RNA, 16 nt, Pseudomonas aeruginosa PA01
cguucauguagcgcuc

SEQ ID NO: 3389542 - RNA, 16 nt, Pseudomonas aeruginosa PA01
cguucaugucggcucc

SEQ ID NO: 3389543 - RNA, 17 nt, Pseudomonas aeruginosa PA01
cguucaugucggcuccu

SEQ ID NO: 3389544 - RNA, 15 nt, Pseudomonas aeruginosa PA01
cguuccaccgccugg

SEQ ID NO: 3389545 - RNA, 16 nt, Pseudomonas aeruginosa PA01
cguuccaccgccugga

SEQ ID NO: 3389546 - RNA, 18 nt, Pseudomonas aeruginosa PA01
cguuccaccuggcgcagg

SEQ ID NO: 3389547 - RNA, 19 nt, Pseudomonas aeruginosa PA01
cguuccaccuggcgcaggu

SEQ ID NO: 3389548 - RNA, 21 nt, Pseudomonas aeruginosa PA01
cguuccacgaaaaagcccggc

SEQ ID NO: 3389549 - RNA, 20 nt, Pseudomonas aeruginosa PA01
cguuccacgggucgcagccg

SEQ ID NO: 3389550 - RNA, 21 nt, Pseudomonas aeruginosa PA01
cguuccacgggucgcagccga

SEQ ID NO: 3389551 - RNA, 19 nt, Pseudomonas aeruginosa PA01
cguuccacguccuccaggc

SEQ ID NO: 3389552 - RNA, 14 nt, Pseudomonas aeruginosa PA01
cguuccagcaccuc

SEQ ID NO: 3389553 - RNA, 19 nt, Pseudomonas aeruginosa PA01
cguuccagcaccucgcggg

SEQ ID NO: 3389554 - RNA, 14 nt, Pseudomonas aeruginosa PA01
cguuccagcgccuc

SEQ ID NO: 3389555 - RNA, 19 nt, Pseudomonas aeruginosa PA01
cguuccagcgccucgggcc

SEQ ID NO: 3389556 - RNA, 15 nt, Pseudomonas aeruginosa PA01
cguuccagcgcuggc

SEQ ID NO: 3389557 - RNA, 15 nt, Pseudomonas aeruginosa PA01
cguuccagcggcacu

SEQ ID NO: 3389558 - RNA, 23 nt, Pseudomonas aeruginosa PA01
cguuccagcggcacuucccgccc

SEQ ID NO: 3389559 - RNA, 12 nt, Pseudomonas aeruginosa PA01
cguuccagcucc

SEQ ID NO: 3389560 - RNA, 17 nt, Pseudomonas aeruginosa PA01
cguuccagcucggcgag

SEQ ID NO: 3389561 - RNA, 15 nt, Pseudomonas aeruginosa PA01
cguuccagggccugg

SEQ ID NO: 3389562 - RNA, 16 nt, Pseudomonas aeruginosa PA01
cguuccagggccuggu

SEQ ID NO: 3389563 - RNA, 18 nt, Pseudomonas aeruginosa PA01
cguuccagggcgaagucg

SEQ ID NO: 3389564 - RNA, 18 nt, Pseudomonas aeruginosa PA01
cguuccaguacacccagg

SEQ ID NO: 3389565 - RNA, 13 nt, Pseudomonas aeruginosa PA01
cguuccaguucgg

SEQ ID NO: 3389566 - RNA, 16 nt, Pseudomonas aeruginosa PA01
cguuccaguucggccg

SEQ ID NO: 3389567 - RNA, 18 nt, Pseudomonas aeruginosa PA01
cguuccaguucggccgcg

SEQ ID NO: 3389568 - RNA, 22 nt, Pseudomonas aeruginosa PA01
cguuccaucgcaggcagcgcgc

SEQ ID NO: 3389569 - RNA, 13 nt, Pseudomonas aeruginosa PA01
cguucccagcagc

SEQ ID NO: 3389570 - RNA, 14 nt, Pseudomonas aeruginosa PA01
cguucccagcagcg

SEQ ID NO: 3389571 - RNA, 16 nt, Pseudomonas aeruginosa PA01
cguucccagcagcgcc

SEQ ID NO: 3389572 - RNA, 22 nt, Pseudomonas aeruginosa PA01
cguucccagcagcgccucggca

SEQ ID NO: 3389573 - RNA, 20 nt, Pseudomonas aeruginosa PA01
cguucccccuuuuucggcgc

SEQ ID NO: 3389574 - RNA, 21 nt, Pseudomonas aeruginosa PA01
cguucccccuuuuucggcgcg

SEQ ID NO: 3389575 - RNA, 22 nt, Pseudomonas aeruginosa PA01
cguucccccuuuuucggcgcgg

SEQ ID NO: 3389576 - RNA, 16 nt, Pseudomonas aeruginosa PA01
cguucccggccuggcg

SEQ ID NO: 3389577 - RNA, 21 nt, Pseudomonas aeruginosa PA01
cguucccggucgagguugcgc

SEQ ID NO: 3389578 - RNA, 14 nt, Pseudomonas aeruginosa PA01
cguuccgacccggc

SEQ ID NO: 3389579 - RNA, 16 nt, Pseudomonas aeruginosa PA01
cguuccgacccggccg

SEQ ID NO: 3389580 - RNA, 21 nt, Pseudomonas aeruginosa PA01
cguuccgcucaccaggcccgc

SEQ ID NO: 3389581 - RNA, 14 nt, Pseudomonas aeruginosa PA01
cguuccggcgcagc

SEQ ID NO: 3389582 - RNA, 18 nt, Pseudomonas aeruginosa PA01
cguuccggcucagccgcu

SEQ ID NO: 3389583 - RNA, 20 nt, Pseudomonas aeruginosa PA01
cguuccggcucagccgcugg

SEQ ID NO: 3389584 - RNA, 15 nt, Pseudomonas aeruginosa PA01
cguuccuccucgccg

SEQ ID NO: 3389585 - RNA, 16 nt, Pseudomonas aeruginosa PA01
cguuccuccucgccgc

SEQ ID NO: 3389586 - RNA, 13 nt, Pseudomonas aeruginosa PA01
cguuccuggaagc

SEQ ID NO: 3389587 - RNA, 20 nt, Pseudomonas aeruginosa PA01
cguuccuucaacagcgaagc

SEQ ID NO: 3389588 - RNA, 24 nt, Pseudomonas aeruginosa PA01
cguucgaaucuucguaggucaugc

SEQ ID NO: 3389589 - RNA, 21 nt, Pseudomonas aeruginosa PA01
cguucgacgccuugcccggcg

SEQ ID NO: 3389590 - RNA, 19 nt, Pseudomonas aeruginosa PA01
cguucgacgcugcuaggcu

SEQ ID NO: 3389591 - RNA, 20 nt, Pseudomonas aeruginosa PA01
cguucgaggguacuccuggc

SEQ ID NO: 3389592 - RNA, 18 nt, Pseudomonas aeruginosa PA01
cguucgaucuccucgcgc

SEQ ID NO: 3389593 - RNA, 14 nt, Pseudomonas aeruginosa PA01
cguucgcccagacc

SEQ ID NO: 3389594 - RNA, 18 nt, Pseudomonas aeruginosa PA01
cguucgcccagaccugca

SEQ ID NO: 3389595 - RNA, 16 nt, Pseudomonas aeruginosa PA01
cguucgcccgcggcgg

SEQ ID NO: 3389596 - RNA, 17 nt, Pseudomonas aeruginosa PA01
cguucgcccgcggcggc

SEQ ID NO: 3389597 - RNA, 22 nt, Pseudomonas aeruginosa PA01
cguucgcccgcggcggcgacgc

SEQ ID NO: 3389598 - RNA, 14 nt, Pseudomonas aeruginosa PA01
cguucgccgaggcg

SEQ ID NO: 3389599 - RNA, 20 nt, Pseudomonas aeruginosa PA01
cguucgccgaggcggcgcag

SEQ ID NO: 3389600 - RNA, 14 nt, Pseudomonas aeruginosa PA01
cguucgccgagggc

SEQ ID NO: 3389601 - RNA, 18 nt, Pseudomonas aeruginosa PA01
cguucgccggccuccagc

SEQ ID NO: 3389602 - RNA, 23 nt, Pseudomonas aeruginosa PA01
cguucgccggccuccagcacucg

SEQ ID NO: 3389603 - RNA, 15 nt, Pseudomonas aeruginosa PA01
cguucgcgcgaggcg

SEQ ID NO: 3389604 - RNA, 14 nt, Pseudomonas aeruginosa PA01
cguucgcgggcgcc

SEQ ID NO: 3389605 - RNA, 16 nt, Pseudomonas aeruginosa PA01
cguucgcgggcgccgu

SEQ ID NO: 3389606 - RNA, 15 nt, Pseudomonas aeruginosa PA01
cguucgcuccagucg

SEQ ID NO: 3389607 - RNA, 23 nt, Pseudomonas aeruginosa PA01
cguucgcuccagucggggcaggc

SEQ ID NO: 3389608 - RNA, 14 nt, Pseudomonas aeruginosa PA01
cguucgcuguucuu

SEQ ID NO: 3389609 - RNA, 15 nt, Pseudomonas aeruginosa PA01
cguucggcgaugccg

SEQ ID NO: 3389610 - RNA, 19 nt, Pseudomonas aeruginosa PA01
cguucggcgaugccgcgcc

SEQ ID NO: 3389611 - RNA, 22 nt, Pseudomonas aeruginosa PA01
cguugcucgagccguuccaggc

SEQ ID NO: 3389612 - RNA, 19 nt, Pseudomonas aeruginosa PA01
cguugcucgcaccaggcca

SEQ ID NO: 3389613 - RNA, 20 nt, Pseudomonas aeruginosa PA01
cguugcucgcaccaggccag

SEQ ID NO: 3389614 - RNA, 22 nt, Pseudomonas aeruginosa PA01
cguugcugcccuggcgcgcgcc

SEQ ID NO: 3389615 - RNA, 18 nt, Pseudomonas aeruginosa PA01
cguugcugugcugcacca

SEQ ID NO: 3389616 - RNA, 23 nt, Pseudomonas aeruginosa PA01
cguugcugugcugcaccagcagg

SEQ ID NO: 3389617 - RNA, 17 nt, Pseudomonas aeruginosa PA01
cguuggaucaccggggu

SEQ ID NO: 3389618 - RNA, 15 nt, Pseudomonas aeruginosa PA01
cguuggccagcaggc

SEQ ID NO: 3389619 - RNA, 17 nt, Pseudomonas aeruginosa PA01
cguuggccagcaggcgc

SEQ ID NO: 3389620 - RNA, 16 nt, Pseudomonas aeruginosa PA01
cguuggccagcgccac

SEQ ID NO: 3389621 - RNA, 12 nt, Pseudomonas aeruginosa PA01
cguuggccaggc

SEQ ID NO: 3389622 - RNA, 16 nt, Pseudomonas aeruginosa PA01
cguuggccaggcgcga

SEQ ID NO: 3389623 - RNA, 20 nt, Pseudomonas aeruginosa PA01
cguuggccaggcgcgacagc

SEQ ID NO: 3389624 - RNA, 21 nt, Pseudomonas aeruginosa PA01
cguuggcccagaccuuggagc

SEQ ID NO: 3389625 - RNA, 17 nt, Pseudomonas aeruginosa PA01
cguuggccgagcgcgag

SEQ ID NO: 3389626 - RNA, 20 nt, Pseudomonas aeruginosa PA01
cguuggccgaggaggccagc

SEQ ID NO: 3389627 - RNA, 23 nt, Pseudomonas aeruginosa PA01
cguuggccgaggaggccagcagc

SEQ ID NO: 3389628 - RNA, 12 nt, Pseudomonas aeruginosa PA01
cguuggccggcu

SEQ ID NO: 3389629 - RNA, 16 nt, Pseudomonas aeruginosa PA01
cguuggccggcugcuc

SEQ ID NO: 3389630 - RNA, 19 nt, Pseudomonas aeruginosa PA01
cguuggccggcugcuccgg

SEQ ID NO: 3389631 - RNA, 21 nt, Pseudomonas aeruginosa PA01
cguuggccuugaugccggcga

SEQ ID NO: 3389632 - RNA, 20 nt, Pseudomonas aeruginosa PA01
cguuggcgaacaaucggucg

SEQ ID NO: 3389633 - RNA, 23 nt, Pseudomonas aeruginosa PA01
cguuggcgaacaaucggucgccc

SEQ ID NO: 3389634 - RNA, 20 nt, Pseudomonas aeruginosa PA01
cguuggcgaacuucaggccg

SEQ ID NO: 3389635 - RNA, 21 nt, Pseudomonas aeruginosa PA01
cguuggcgaacuucaggccgg

SEQ ID NO: 3389636 - RNA, 20 nt, Pseudomonas aeruginosa PA01
cguuggcgaaguucccgccg

SEQ ID NO: 3389637 - RNA, 21 nt, Pseudomonas aeruginosa PA01
cguuggcgaaguucccgccgc

SEQ ID NO: 3389638 - RNA, 22 nt, Pseudomonas aeruginosa PA01
cguuggcgaaguucccgccgcu

SEQ ID NO: 3389639 - RNA, 19 nt, Pseudomonas aeruginosa PA01
cguuggcgacgacgggagc

SEQ ID NO: 3389640 - RNA, 13 nt, Pseudomonas aeruginosa PA01
cguuggcgcgggc

SEQ ID NO: 3389641 - RNA, 19 nt, Pseudomonas aeruginosa PA01
cguuggcgcgggcgaaggc

SEQ ID NO: 3389642 - RNA, 13 nt, Pseudomonas aeruginosa PA01
cguuggcggccag

SEQ ID NO: 3389643 - RNA, 15 nt, Pseudomonas aeruginosa PA01
cguuggcggugccgc

SEQ ID NO: 3389644 - RNA, 21 nt, Pseudomonas aeruginosa PA01
cguuggcggugccgcagacau

SEQ ID NO: 3389645 - RNA, 16 nt, Pseudomonas aeruginosa PA01
cguuggcgucaacggu

SEQ ID NO: 3389646 - RNA, 16 nt, Pseudomonas aeruginosa PA01
cguuggcgucgcgcac

SEQ ID NO: 3389647 - RNA, 15 nt, Pseudomonas aeruginosa PA01
cguuggcgugcucgc

SEQ ID NO: 3389648 - RNA, 17 nt, Pseudomonas aeruginosa PA01
cguuggcgugcucgcgc

SEQ ID NO: 3389649 - RNA, 17 nt, Pseudomonas aeruginosa PA01
cguuggcuccgggccga

SEQ ID NO: 3389650 - RNA, 19 nt, Pseudomonas aeruginosa PA01
cguugggccucgcugcgca

SEQ ID NO: 3389651 - RNA, 18 nt, Pseudomonas aeruginosa PA01
cguugguacagcucgcgc

SEQ ID NO: 3389652 - RNA, 20 nt, Pseudomonas aeruginosa PA01
cguugguacagcucgcgcaa

SEQ ID NO: 3389653 - RNA, 14 nt, Pseudomonas aeruginosa PA01
cguuggucaacggc

SEQ ID NO: 3389654 - RNA, 18 nt, Pseudomonas aeruginosa PA01
cguuggucaacggcgauu

SEQ ID NO: 3389655 - RNA, 22 nt, Pseudomonas aeruginosa PA01
cguuggugauguugcggucgau

SEQ ID NO: 3389656 - RNA, 14 nt, Pseudomonas aeruginosa PA01
cguuguacccggcg

SEQ ID NO: 3389657 - RNA, 16 nt, Pseudomonas aeruginosa PA01
cguuguagaacacggc

SEQ ID NO: 3389658 - RNA, 15 nt, Pseudomonas aeruginosa PA01
cguuguagagacaga

SEQ ID NO: 3389659 - RNA, 15 nt, Pseudomonas aeruginosa PA01
cguuguagaucggca

SEQ ID NO: 3389660 - RNA, 18 nt, Pseudomonas aeruginosa PA01
cguuguagcugaccacga

SEQ ID NO: 3389661 - RNA, 13 nt, Pseudomonas aeruginosa PA01
cguuguaggaaaa

SEQ ID NO: 3389662 - RNA, 20 nt, Pseudomonas aeruginosa PA01
cguuguaggccaugaucauc

SEQ ID NO: 3389663 - RNA, 17 nt, Pseudomonas aeruginosa PA01
cguuguaguucggcaug

SEQ ID NO: 3389664 - RNA, 23 nt, Pseudomonas aeruginosa PA01
cguuguccaggcuguggcgcggc

SEQ ID NO: 3389665 - RNA, 16 nt, Pseudomonas aeruginosa PA01
cguugucccugucccg

SEQ ID NO: 3389666 - RNA, 20 nt, Pseudomonas aeruginosa PA01
cguugucccugucccgccgc

SEQ ID NO: 3389667 - RNA, 16 nt, Pseudomonas aeruginosa PA01
cguuguccucggcggc

SEQ ID NO: 3389668 - RNA, 17 nt, Pseudomonas aeruginosa PA01
cguuguccucggcggcu

SEQ ID NO: 3389669 - RNA, 16 nt, Pseudomonas aeruginosa PA01
cguugucggccagcag

SEQ ID NO: 3389670 - RNA, 17 nt, Pseudomonas aeruginosa PA01
cguugucggccagcagc

SEQ ID NO: 3389671 - RNA, 18 nt, Pseudomonas aeruginosa PA01
cguugucggccagcagca

SEQ ID NO: 3389672 - RNA, 14 nt, Pseudomonas aeruginosa PA01
cguugugccgccac

SEQ ID NO: 3389673 - RNA, 13 nt, Pseudomonas aeruginosa PA01
cguuguggcaggc

SEQ ID NO: 3389674 - RNA, 14 nt, Pseudomonas aeruginosa PA01
cguuguggcggcgc

SEQ ID NO: 3389675 - RNA, 14 nt, Pseudomonas aeruginosa PA01
cguuguucagcagg

SEQ ID NO: 3389676 - RNA, 14 nt, Pseudomonas aeruginosa PA01
cguuguugaccgca

SEQ ID NO: 3389677 - RNA, 14 nt, Pseudomonas aeruginosa PA01
cguuguugccgcgc

SEQ ID NO: 3389678 - RNA, 15 nt, Pseudomonas aeruginosa PA01
cguuguugccgcgca

SEQ ID NO: 3389679 - RNA, 21 nt, Pseudomonas aeruginosa PA01
cguuguugccgcgcaccaccg

SEQ ID NO: 3389680 - RNA, 20 nt, Pseudomonas aeruginosa PA01
cguuguuggucaggcugcgc

SEQ ID NO: 3389681 - RNA, 16 nt, Pseudomonas aeruginosa PA01
cguuuacgcgccaagg

SEQ ID NO: 3389682 - RNA, 20 nt, Pseudomonas aeruginosa PA01
cguuucagaacgucggcggg

SEQ ID NO: 3389683 - RNA, 15 nt, Pseudomonas aeruginosa PA01
cguuucagcgccagc

SEQ ID NO: 3389684 - RNA, 21 nt, Pseudomonas aeruginosa PA01
cguuucagcgcuugcuggcgc

SEQ ID NO: 3389685 - RNA, 18 nt, Pseudomonas aeruginosa PA01
cguuucauucgucgcugc

SEQ ID NO: 3389686 - RNA, 14 nt, Pseudomonas aeruginosa PA01
cguuuccaugcggu

SEQ ID NO: 3389687 - RNA, 17 nt, Pseudomonas aeruginosa PA01
cguuucccggcgcggcu

SEQ ID NO: 3389688 - RNA, 14 nt, Pseudomonas aeruginosa PA01
cguuuccgcugucc

SEQ ID NO: 3389689 - RNA, 21 nt, Pseudomonas aeruginosa PA01
cguuuccgcuguccgccgccg

SEQ ID NO: 3389690 - RNA, 16 nt, Pseudomonas aeruginosa PA01
cguuuccggucacgca

SEQ ID NO: 3389691 - RNA, 16 nt, Pseudomonas aeruginosa PA01
cguuucgaagccgccg

SEQ ID NO: 3389692 - RNA, 17 nt, Pseudomonas aeruginosa PA01
cguuucgaagccgccgc

SEQ ID NO: 3389693 - RNA, 12 nt, Pseudomonas aeruginosa PA01
cguuucgacgau

SEQ ID NO: 3389694 - RNA, 19 nt, Pseudomonas aeruginosa PA01
cguuucgccgccggccagc

SEQ ID NO: 3389695 - RNA, 12 nt, Pseudomonas aeruginosa PA01
cguuucgccggg

SEQ ID NO: 3389696 - RNA, 14 nt, Pseudomonas aeruginosa PA01
cguuucgccgggcc

SEQ ID NO: 3389697 - RNA, 19 nt, Pseudomonas aeruginosa PA01
cguuucggcgagauugcgc

SEQ ID NO: 3389698 - RNA, 18 nt, Pseudomonas aeruginosa PA01
cguuucuuuuugccgguc

SEQ ID NO: 3389699 - RNA, 18 nt, Pseudomonas aeruginosa PA01
cguuugcgucauccgccu

SEQ ID NO: 3389700 - RNA, 21 nt, Pseudomonas aeruginosa PA01
cguuugcucucaucccugugc

SEQ ID NO: 3389701 - RNA, 16 nt, Pseudomonas aeruginosa PA01
cguuugucgaccugcc

SEQ ID NO: 3389702 - RNA, 13 nt, Pseudomonas aeruginosa PA01
cguuuucaggcga

SEQ ID NO: 3389703 - RNA, 18 nt, Pseudomonas aeruginosa PA01
cguuuucaggcgacgccg

SEQ ID NO: 3389704 - RNA, 17 nt, Pseudomonas aeruginosa PA01
cuaacaggucaacaaga

SEQ ID NO: 3389705 - RNA, 15 nt, Pseudomonas aeruginosa PA01
cuaaccggcguccgg

SEQ ID NO: 3389706 - RNA, 16 nt, Pseudomonas aeruginosa PA01
cuaaccggcguccggg

SEQ ID NO: 3389707 - RNA, 12 nt, Pseudomonas aeruginosa PA01
cuaacgccgagg

SEQ ID NO: 3389708 - RNA, 18 nt, Pseudomonas aeruginosa PA01
cuaaggaaaaacccggcc

SEQ ID NO: 3389709 - RNA, 20 nt, Pseudomonas aeruginosa PA01
cuaaggaaaaacccggccca

SEQ ID NO: 3389710 - RNA, 23 nt, Pseudomonas aeruginosa PA01
cuaaggaaaaacccggcccaggc

SEQ ID NO: 3389711 - RNA, 22 nt, Pseudomonas aeruginosa PA01
cuacaaugauggcccuucgccc

SEQ ID NO: 3389712 - RNA, 16 nt, Pseudomonas aeruginosa PA01
cuacagcccccccagc

SEQ ID NO: 3389713 - RNA, 12 nt, Pseudomonas aeruginosa PA01
cucacaccacca

SEQ ID NO: 3389714 - RNA, 16 nt, Pseudomonas aeruginosa PA01
cucaccaaugccagug

SEQ ID NO: 3389715 - RNA, 14 nt, Pseudomonas aeruginosa PA01
cucaccaccaccgc

SEQ ID NO: 3389716 - RNA, 22 nt, Pseudomonas aeruginosa PA01
cucaccaccaccgcgccgaugu

SEQ ID NO: 3389717 - RNA, 13 nt, Pseudomonas aeruginosa PA01
cucaccaggcccg

SEQ ID NO: 3389718 - RNA, 14 nt, Pseudomonas aeruginosa PA01
cucaccaggcccgc

SEQ ID NO: 3389719 - RNA, 15 nt, Pseudomonas aeruginosa PA01
cucaccaggcccgcc

SEQ ID NO: 3389720 - RNA, 17 nt, Pseudomonas aeruginosa PA01
cucaccaggcccgccgg

SEQ ID NO: 3389721 - RNA, 16 nt, Pseudomonas aeruginosa PA01
cucaccccacgggcga

SEQ ID NO: 3389722 - RNA, 13 nt, Pseudomonas aeruginosa PA01
cucacccugcugg

SEQ ID NO: 3389723 - RNA, 16 nt, Pseudomonas aeruginosa PA01
cucacccugcugggcg

SEQ ID NO: 3389724 - RNA, 17 nt, Pseudomonas aeruginosa PA01
cucacccugcugggcgg

SEQ ID NO: 3389725 - RNA, 17 nt, Pseudomonas aeruginosa PA01
cucaccgaggaucggca

SEQ ID NO: 3389726 - RNA, 20 nt, Pseudomonas aeruginosa PA01
cucaccgaggaucggcacga

SEQ ID NO: 3389727 - RNA, 21 nt, Pseudomonas aeruginosa PA01
cucaccgaggcgaacggcagg

SEQ ID NO: 3389728 - RNA, 13 nt, Pseudomonas aeruginosa PA01
cucaccgccaccc

SEQ ID NO: 3389729 - RNA, 14 nt, Pseudomonas aeruginosa PA01
cucaccgccacccc

SEQ ID NO: 3389730 - RNA, 15 nt, Pseudomonas aeruginosa PA01
cucacgcaccucguc

SEQ ID NO: 3389731 - RNA, 13 nt, Pseudomonas aeruginosa PA01
cucacgccccagc

SEQ ID NO: 3389732 - RNA, 19 nt, Pseudomonas aeruginosa PA01
cucacgccccagcgcaucg

SEQ ID NO: 3389733 - RNA, 15 nt, Pseudomonas aeruginosa PA01
cucacgcucgacauu

SEQ ID NO: 3389734 - RNA, 17 nt, Pseudomonas aeruginosa PA01
cucacgcucgacauugc

SEQ ID NO: 3389735 - RNA, 20 nt, Pseudomonas aeruginosa PA01
cucacggcauucucucuuca

SEQ ID NO: 3389736 - RNA, 15 nt, Pseudomonas aeruginosa PA01
cucacggcgcagccg

SEQ ID NO: 3389737 - RNA, 17 nt, Pseudomonas aeruginosa PA01
cucacggcgcagccgca

SEQ ID NO: 3389738 - RNA, 20 nt, Pseudomonas aeruginosa PA01
cucacggguguuucggccgc

SEQ ID NO: 3389739 - RNA, 23 nt, Pseudomonas aeruginosa PA01
cucacggguguuucggccgcugc

SEQ ID NO: 3389740 - RNA, 20 nt, Pseudomonas aeruginosa PA01
cucacgugaccguccagcgc

SEQ ID NO: 3389741 - RNA, 21 nt, Pseudomonas aeruginosa PA01
cucacgugaccguccagcgcg

SEQ ID NO: 3389742 - RNA, 16 nt, Pseudomonas aeruginosa PA01
cucacucccguccagc

SEQ ID NO: 3389743 - RNA, 18 nt, Pseudomonas aeruginosa PA01
cucacuccgucuccagca

SEQ ID NO: 3389744 - RNA, 20 nt, Pseudomonas aeruginosa PA01
cucacugcgagcaccaugcc

SEQ ID NO: 3389745 - RNA, 18 nt, Pseudomonas aeruginosa PA01
cucagaacagcggcagcu

SEQ ID NO: 3389746 - RNA, 20 nt, Pseudomonas aeruginosa PA01
cucagaacagcggcagcuca

SEQ ID NO: 3389747 - RNA, 22 nt, Pseudomonas aeruginosa PA01
cucagaagaacggacgcgacgc

SEQ ID NO: 3389748 - RNA, 23 nt, Pseudomonas aeruginosa PA01
cucagaaguauuucaaccaggcg

SEQ ID NO: 3389749 - RNA, 15 nt, Pseudomonas aeruginosa PA01
cucagaagucccagc

SEQ ID NO: 3389750 - RNA, 16 nt, Pseudomonas aeruginosa PA01
cucagaagucccagcg

SEQ ID NO: 3389751 - RNA, 17 nt, Pseudomonas aeruginosa PA01
cucagaccacgcccugc

SEQ ID NO: 3389752 - RNA, 19 nt, Pseudomonas aeruginosa PA01
cucagaggcgaccagccgg

SEQ ID NO: 3389753 - RNA, 16 nt, Pseudomonas aeruginosa PA01
cucagcacccuggcca

SEQ ID NO: 3389754 - RNA, 13 nt, Pseudomonas aeruginosa PA01
cucagcaccuugu

SEQ ID NO: 3389755 - RNA, 19 nt, Pseudomonas aeruginosa PA01
cucagcaccuugugcugcc

SEQ ID NO: 3389756 - RNA, 21 nt, Pseudomonas aeruginosa PA01
cucagcaccuugugcugccug

SEQ ID NO: 3389757 - RNA, 15 nt, Pseudomonas aeruginosa PA01
cucagcagcgccgcc

SEQ ID NO: 3389758 - RNA, 13 nt, Pseudomonas aeruginosa PA01
cucagccagcggc

SEQ ID NO: 3389759 - RNA, 16 nt, Pseudomonas aeruginosa PA01
cucagcccaggcgccg

SEQ ID NO: 3389760 - RNA, 18 nt, Pseudomonas aeruginosa PA01
cucagcccaggcgccgcu

SEQ ID NO: 3389761 - RNA, 13 nt, Pseudomonas aeruginosa PA01
cucagccccgauc

SEQ ID NO: 3389762 - RNA, 18 nt, Pseudomonas aeruginosa PA01
cucagccccgaucgccuc

SEQ ID NO: 3389763 - RNA, 22 nt, Pseudomonas aeruginosa PA01
cucagccccgaucgccucggcc

SEQ ID NO: 3389764 - RNA, 15 nt, Pseudomonas aeruginosa PA01
cucagccgaccaccu

SEQ ID NO: 3389765 - RNA, 19 nt, Pseudomonas aeruginosa PA01
cucagccgaggucgccgcc

SEQ ID NO: 3389766 - RNA, 21 nt, Pseudomonas aeruginosa PA01
cucagccgaggucgccgccag

SEQ ID NO: 3389767 - RNA, 22 nt, Pseudomonas aeruginosa PA01
cucagccgaggucgccgccagc

SEQ ID NO: 3389768 - RNA, 12 nt, Pseudomonas aeruginosa PA01
cucagccgcgcc

SEQ ID NO: 3389769 - RNA, 13 nt, Pseudomonas aeruginosa PA01
cucagccggcgcu

SEQ ID NO: 3389770 - RNA, 23 nt, Pseudomonas aeruginosa PA01
cucagccguggcacccaggccac

SEQ ID NO: 3389771 - RNA, 15 nt, Pseudomonas aeruginosa PA01
cucagccucacccug

SEQ ID NO: 3389772 - RNA, 16 nt, Pseudomonas aeruginosa PA01
cucagccucacccugc

SEQ ID NO: 3389773 - RNA, 19 nt, Pseudomonas aeruginosa PA01
cucagccucacccugcugg

SEQ ID NO: 3389774 - RNA, 13 nt, Pseudomonas aeruginosa PA01
cucagcgccgcuu

SEQ ID NO: 3389775 - RNA, 16 nt, Pseudomonas aeruginosa PA01
cucagcgccggccagg

SEQ ID NO: 3389776 - RNA, 12 nt, Pseudomonas aeruginosa PA01
cucagcgccggu

SEQ ID NO: 3389777 - RNA, 21 nt, Pseudomonas aeruginosa PA01
cucagcgccguugcggcagca

SEQ ID NO: 3389778 - RNA, 11 nt, Pseudomonas aeruginosa PA01
cucagcgcgac

SEQ ID NO: 3389779 - RNA, 23 nt, Pseudomonas aeruginosa PA01
cucagcgcgccgaguucgccgcg

SEQ ID NO: 3389780 - RNA, 19 nt, Pseudomonas aeruginosa PA01
cucagcgcgcucggccugg

SEQ ID NO: 3389781 - RNA, 20 nt, Pseudomonas aeruginosa PA01
cucagcggaacauuuccuug

SEQ ID NO: 3389782 - RNA, 22 nt, Pseudomonas aeruginosa PA01
cucagcggaacuugcgccgacc

SEQ ID NO: 3389783 - RNA, 13 nt, Pseudomonas aeruginosa PA01
cucagcggcccag

SEQ ID NO: 3389784 - RNA, 21 nt, Pseudomonas aeruginosa PA01
cucagcggcccagcgccccgc

SEQ ID NO: 3389785 - RNA, 21 nt, Pseudomonas aeruginosa PA01
cucagcggccuucgacgaugc

SEQ ID NO: 3389786 - RNA, 15 nt, Pseudomonas aeruginosa PA01
cucagcggcuggcga

SEQ ID NO: 3389787 - RNA, 15 nt, Pseudomonas aeruginosa PA01
cucagcgggccgauc

SEQ ID NO: 3389788 - RNA, 21 nt, Pseudomonas aeruginosa PA01
cucagcgggccgauccgcgaa

SEQ ID NO: 3389789 - RNA, 15 nt, Pseudomonas aeruginosa PA01
cucagcgggcgcggu

SEQ ID NO: 3389790 - RNA, 17 nt, Pseudomonas aeruginosa PA01
cucagcuccaggccgcg

SEQ ID NO: 3389791 - RNA, 21 nt, Pseudomonas aeruginosa PA01
cucagcucggcgaugccgccg

SEQ ID NO: 3389792 - RNA, 20 nt, Pseudomonas aeruginosa PA01
cucagcucucccgaggcgau

SEQ ID NO: 3389793 - RNA, 21 nt, Pseudomonas aeruginosa PA01
cucagcuggauagaguacucg

SEQ ID NO: 3389794 - RNA, 19 nt, Pseudomonas aeruginosa PA01
cucaggaaaaaacgccggu

SEQ ID NO: 3389795 - RNA, 13 nt, Pseudomonas aeruginosa PA01
cucaggaccuucc

SEQ ID NO: 3389796 - RNA, 19 nt, Pseudomonas aeruginosa PA01
cucaggaccuuccgccagc

SEQ ID NO: 3389797 - RNA, 21 nt, Pseudomonas aeruginosa PA01
cucaggaccuuccgccagcag

SEQ ID NO: 3389798 - RNA, 18 nt, Pseudomonas aeruginosa PA01
cucaggacguccuggccg

SEQ ID NO: 3389799 - RNA, 14 nt, Pseudomonas aeruginosa PA01
cucaggagcgccgc

SEQ ID NO: 3389800 - RNA, 15 nt, Pseudomonas aeruginosa PA01
cucaggagcgccgcg

SEQ ID NO: 3389801 - RNA, 22 nt, Pseudomonas aeruginosa PA01
cucaggaugcgaugcugucagc

SEQ ID NO: 3389802 - RNA, 20 nt, Pseudomonas aeruginosa PA01
cucaggcagcgaucgccgcc

SEQ ID NO: 3389803 - RNA, 15 nt, Pseudomonas aeruginosa PA01
cucaggccuggcgca

SEQ ID NO: 3389804 - RNA, 16 nt, Pseudomonas aeruginosa PA01
cucaggccuuggcuuc

SEQ ID NO: 3389805 - RNA, 20 nt, Pseudomonas aeruginosa PA01
cucaggccuuggcuucgaag

SEQ ID NO: 3389806 - RNA, 21 nt, Pseudomonas aeruginosa PA01
cucaggcgcagcguccugccc

SEQ ID NO: 3389807 - RNA, 21 nt, Pseudomonas aeruginosa PA01
cucaggcgccgcugucuaucu

SEQ ID NO: 3389808 - RNA, 22 nt, Pseudomonas aeruginosa PA01
cucaggcgccgcugucuaucug

SEQ ID NO: 3389809 - RNA, 21 nt, Pseudomonas aeruginosa PA01
cucaggcgcugcgcggccugc

SEQ ID NO: 3389810 - RNA, 18 nt, Pseudomonas aeruginosa PA01
cucaggcgcugcuggugg

SEQ ID NO: 3389811 - RNA, 21 nt, Pseudomonas aeruginosa PA01
cucaggcggccgaacuggaug

SEQ ID NO: 3389812 - RNA, 22 nt, Pseudomonas aeruginosa PA01
cucaggcggccgaacuggauga

SEQ ID NO: 3389813 - RNA, 23 nt, Pseudomonas aeruginosa PA01
cucaggcgucccgcuccagccgg

SEQ ID NO: 3389814 - RNA, 23 nt, Pseudomonas aeruginosa PA01
cucaggcugugcaggaaggcgac

SEQ ID NO: 3389815 - RNA, 16 nt, Pseudomonas aeruginosa PA01
cuccagcagggucgcc

SEQ ID NO: 3389816 - RNA, 20 nt, Pseudomonas aeruginosa PA01
cuccagcagggucgccuggg

SEQ ID NO: 3389817 - RNA, 21 nt, Pseudomonas aeruginosa PA01
cuccagcagggucgccugggu

SEQ ID NO: 3389818 - RNA, 17 nt, Pseudomonas aeruginosa PA01
cuccagcagucgcacag

SEQ ID NO: 3389819 - RNA, 19 nt, Pseudomonas aeruginosa PA01
cuccagcagucgcacagcc

SEQ ID NO: 3389820 - RNA, 22 nt, Pseudomonas aeruginosa PA01
cuccagcagucgcacagccagg

SEQ ID NO: 3389821 - RNA, 18 nt, Pseudomonas aeruginosa PA01
cuccagcaguucgucgcc

SEQ ID NO: 3389822 - RNA, 20 nt, Pseudomonas aeruginosa PA01
cuccagcaguucgucgccac

SEQ ID NO: 3389823 - RNA, 21 nt, Pseudomonas aeruginosa PA01
cuccagcaguucgucgccacg

SEQ ID NO: 3389824 - RNA, 12 nt, Pseudomonas aeruginosa PA01
cuccagccagca

SEQ ID NO: 3389825 - RNA, 19 nt, Pseudomonas aeruginosa PA01
cuccagccccgcgauugca

SEQ ID NO: 3389826 - RNA, 15 nt, Pseudomonas aeruginosa PA01
cuccagccgcacccu

SEQ ID NO: 3389827 - RNA, 16 nt, Pseudomonas aeruginosa PA01
cuccagccgcacccuc

SEQ ID NO: 3389828 - RNA, 13 nt, Pseudomonas aeruginosa PA01
cuccagccgcugc

SEQ ID NO: 3389829 - RNA, 14 nt, Pseudomonas aeruginosa PA01
cuccagccgcugca

SEQ ID NO: 3389830 - RNA, 13 nt, Pseudomonas aeruginosa PA01
cuccagccggcaa

SEQ ID NO: 3389831 - RNA, 15 nt, Pseudomonas aeruginosa PA01
cuccagccggcgacg

SEQ ID NO: 3389832 - RNA, 13 nt, Pseudomonas aeruginosa PA01
cuccagccgggcu

SEQ ID NO: 3389833 - RNA, 21 nt, Pseudomonas aeruginosa PA01
cuccagccgggcuccgccgcg

SEQ ID NO: 3389834 - RNA, 21 nt, Pseudomonas aeruginosa PA01
cuccagcgaauggacaggcgc

SEQ ID NO: 3389835 - RNA, 20 nt, Pseudomonas aeruginosa PA01
cuccagcgccgcauuggcca

SEQ ID NO: 3389836 - RNA, 14 nt, Pseudomonas aeruginosa PA01
cuccagcgccgcca

SEQ ID NO: 3389837 - RNA, 15 nt, Pseudomonas aeruginosa PA01
cuccagcgccgccag

SEQ ID NO: 3389838 - RNA, 20 nt, Pseudomonas aeruginosa PA01
cuccagcgccgccucgaagg

SEQ ID NO: 3389839 - RNA, 18 nt, Pseudomonas aeruginosa PA01
cuccagcgccucgaccag

SEQ ID NO: 3389840 - RNA, 14 nt, Pseudomonas aeruginosa PA01
cuccagcgccucgc

SEQ ID NO: 3389841 - RNA, 19 nt, Pseudomonas aeruginosa PA01
cuccagcgccucgccgagc

SEQ ID NO: 3389842 - RNA, 20 nt, Pseudomonas aeruginosa PA01
cuccagcgccucgccgagca

SEQ ID NO: 3389843 - RNA, 14 nt, Pseudomonas aeruginosa PA01
cuccagcggaaucg

SEQ ID NO: 3389844 - RNA, 14 nt, Pseudomonas aeruginosa PA01
cuccagcggcagcu

SEQ ID NO: 3389845 - RNA, 20 nt, Pseudomonas aeruginosa PA01
cuccagcggcagcucggcga

SEQ ID NO: 3389846 - RNA, 21 nt, Pseudomonas aeruginosa PA01
cuccagcggcagcucggcgac

SEQ ID NO: 3389847 - RNA, 13 nt, Pseudomonas aeruginosa PA01
cuccagcggcggg

SEQ ID NO: 3389848 - RNA, 12 nt, Pseudomonas aeruginosa PA01
cuccagcggcuu

SEQ ID NO: 3389849 - RNA, 23 nt, Pseudomonas aeruginosa PA01
cuccagcggcuuguccuggcgca

SEQ ID NO: 3389850 - RNA, 18 nt, Pseudomonas aeruginosa PA01
cuccagcgggaaggucgg

SEQ ID NO: 3389851 - RNA, 21 nt, Pseudomonas aeruginosa PA01
cuccagcgggaaggucggcag

SEQ ID NO: 3389852 - RNA, 23 nt, Pseudomonas aeruginosa PA01
cuccagcgggaaggucggcagca

SEQ ID NO: 3389853 - RNA, 15 nt, Pseudomonas aeruginosa PA01
cuccagcuccuccag

SEQ ID NO: 3389854 - RNA, 16 nt, Pseudomonas aeruginosa PA01
cuccagcucgacccgc

SEQ ID NO: 3389855 - RNA, 19 nt, Pseudomonas aeruginosa PA01
cuccagcucgacccgcccg

SEQ ID NO: 3389856 - RNA, 13 nt, Pseudomonas aeruginosa PA01
cuccagcucggcg

SEQ ID NO: 3389857 - RNA, 19 nt, Pseudomonas aeruginosa PA01
cuccagcucggcgauccgc

SEQ ID NO: 3389858 - RNA, 23 nt, Pseudomonas aeruginosa PA01
cuccagcugcgccugcagcucgg

SEQ ID NO: 3389859 - RNA, 17 nt, Pseudomonas aeruginosa PA01
cuccagcuucuucugca

SEQ ID NO: 3389860 - RNA, 23 nt, Pseudomonas aeruginosa PA01
cuccagcuucuucugcagcucgg

SEQ ID NO: 3389861 - RNA, 18 nt, Pseudomonas aeruginosa PA01
cuccagcuugucgucggc

SEQ ID NO: 3389862 - RNA, 19 nt, Pseudomonas aeruginosa PA01
cuccaggaucgccuccacc

SEQ ID NO: 3389863 - RNA, 21 nt, Pseudomonas aeruginosa PA01
cuccaggaucgccuccaccag

SEQ ID NO: 3389864 - RNA, 17 nt, Pseudomonas aeruginosa PA01
cuccaggcccauccugg

SEQ ID NO: 3389865 - RNA, 15 nt, Pseudomonas aeruginosa PA01
cuccaggcccggcag

SEQ ID NO: 3389866 - RNA, 12 nt, Pseudomonas aeruginosa PA01
cuccaggccgaa

SEQ ID NO: 3389867 - RNA, 14 nt, Pseudomonas aeruginosa PA01
cuccaggccgccgg

SEQ ID NO: 3389868 - RNA, 16 nt, Pseudomonas aeruginosa PA01
cuccaggccgccggcg

SEQ ID NO: 3389869 - RNA, 17 nt, Pseudomonas aeruginosa PA01
cuccaggccgccggcga

SEQ ID NO: 3389870 - RNA, 17 nt, Pseudomonas aeruginosa PA01
cuccaggcgcgccgugc

SEQ ID NO: 3389871 - RNA, 19 nt, Pseudomonas aeruginosa PA01
cuccaggcgcgccuggauc

SEQ ID NO: 3389872 - RNA, 14 nt, Pseudomonas aeruginosa PA01
cuccaggcggcggu

SEQ ID NO: 3389873 - RNA, 17 nt, Pseudomonas aeruginosa PA01
cuccaggcucuucagca

SEQ ID NO: 3389874 - RNA, 13 nt, Pseudomonas aeruginosa PA01
cuccaggcugugg

SEQ ID NO: 3389875 - RNA, 21 nt, Pseudomonas aeruginosa PA01
cuccaggcugugggcgacuuc

SEQ ID NO: 3389876 - RNA, 16 nt, Pseudomonas aeruginosa PA01
cuccaggcuuugcggc

SEQ ID NO: 3389877 - RNA, 22 nt, Pseudomonas aeruginosa PA01
cuccaggcuuugcggcaaggcg

SEQ ID NO: 3389878 - RNA, 20 nt, Pseudomonas aeruginosa PA01
cuccagggaaaccaccugga

SEQ ID NO: 3389879 - RNA, 23 nt, Pseudomonas aeruginosa PA01
cuccagggaaaccaccuggaacu

SEQ ID NO: 3389880 - RNA, 19 nt, Pseudomonas aeruginosa PA01
cuccagggagcgcucgcgc

SEQ ID NO: 3389881 - RNA, 20 nt, Pseudomonas aeruginosa PA01
cuccagggcauccucgcggu

SEQ ID NO: 3389882 - RNA, 14 nt, Pseudomonas aeruginosa PA01
cuccagggcugcca

SEQ ID NO: 3389883 - RNA, 22 nt, Pseudomonas aeruginosa PA01
cuccagggcugccaccgagggc

SEQ ID NO: 3389884 - RNA, 12 nt, Pseudomonas aeruginosa PA01
cuccaggggucg

SEQ ID NO: 3389885 - RNA, 20 nt, Pseudomonas aeruginosa PA01
cuccaggggucggcaucgcg

SEQ ID NO: 3389886 - RNA, 15 nt, Pseudomonas aeruginosa PA01
cuccagggucgcccg

SEQ ID NO: 3389887 - RNA, 19 nt, Pseudomonas aeruginosa PA01
cuccagggugccgaccaac

SEQ ID NO: 3389888 - RNA, 19 nt, Pseudomonas aeruginosa PA01
cuccaggucgaacagcggc

SEQ ID NO: 3389889 - RNA, 21 nt, Pseudomonas aeruginosa PA01
cuccaggucgaacagcggcug

SEQ ID NO: 3389890 - RNA, 21 nt, Pseudomonas aeruginosa PA01
cuccaggucgcccugcagcgc

SEQ ID NO: 3389891 - RNA, 17 nt, Pseudomonas aeruginosa PA01
cuccaggucggucggcg

SEQ ID NO: 3389892 - RNA, 18 nt, Pseudomonas aeruginosa PA01
cuccaggucggucggcgg

SEQ ID NO: 3389893 - RNA, 19 nt, Pseudomonas aeruginosa PA01
cuccaggucggucggcggc

SEQ ID NO: 3389894 - RNA, 20 nt, Pseudomonas aeruginosa PA01
cuccaggugcacggccaggc

SEQ ID NO: 3389895 - RNA, 15 nt, Pseudomonas aeruginosa PA01
cuccagguucggcgc

SEQ ID NO: 3389896 - RNA, 17 nt, Pseudomonas aeruginosa PA01
cuccagguucggcgcca

SEQ ID NO: 3389897 - RNA, 20 nt, Pseudomonas aeruginosa PA01
cuccagguucggcgccagcu

SEQ ID NO: 3389898 - RNA, 17 nt, Pseudomonas aeruginosa PA01
cuccaguagcggaagca

SEQ ID NO: 3389899 - RNA, 19 nt, Pseudomonas aeruginosa PA01
cuccagucggggcaggcgc

SEQ ID NO: 3389900 - RNA, 22 nt, Pseudomonas aeruginosa PA01
cuccagucggggcaggcgcagg

SEQ ID NO: 3389901 - RNA, 12 nt, Pseudomonas aeruginosa PA01
cuccaguuccug

SEQ ID NO: 3389902 - RNA, 16 nt, Pseudomonas aeruginosa PA01
cuccaguucguugacc

SEQ ID NO: 3389903 - RNA, 21 nt, Pseudomonas aeruginosa PA01
cuccaguucguugaccacgcu

SEQ ID NO: 3389904 - RNA, 15 nt, Pseudomonas aeruginosa PA01
cuccaguugcagcac

SEQ ID NO: 3389905 - RNA, 17 nt, Pseudomonas aeruginosa PA01
cuccaguugcagcaccc

SEQ ID NO: 3389906 - RNA, 23 nt, Pseudomonas aeruginosa PA01
cuccaguugcagcacccccagca

SEQ ID NO: 3389907 - RNA, 19 nt, Pseudomonas aeruginosa PA01
cuccaucaguugcgcgcgg

SEQ ID NO: 3389908 - RNA, 14 nt, Pseudomonas aeruginosa PA01
cuccaucucgcggc

SEQ ID NO: 3389909 - RNA, 17 nt, Pseudomonas aeruginosa PA01
cuccaucucgcggcgga

SEQ ID NO: 3389910 - RNA, 18 nt, Pseudomonas aeruginosa PA01
cuccaugcgggagagcgc

SEQ ID NO: 3389911 - RNA, 19 nt, Pseudomonas aeruginosa PA01
cucccacagucgaugacga

SEQ ID NO: 3389912 - RNA, 16 nt, Pseudomonas aeruginosa PA01
cucccaccgcgcggca

SEQ ID NO: 3389913 - RNA, 17 nt, Pseudomonas aeruginosa PA01
cucccaccgcgcggcac

SEQ ID NO: 3389914 - RNA, 12 nt, Pseudomonas aeruginosa PA01
cucccaccgcuu

SEQ ID NO: 3389915 - RNA, 17 nt, Pseudomonas aeruginosa PA01
cucccaccgcuuucagc

SEQ ID NO: 3389916 - RNA, 20 nt, Pseudomonas aeruginosa PA01
cucccagaagucgcuggccu

SEQ ID NO: 3389917 - RNA, 22 nt, Pseudomonas aeruginosa PA01
cuccgccgcgugcgcgcccucg

SEQ ID NO: 3389918 - RNA, 21 nt, Pseudomonas aeruginosa PA01
cuccgccgcuaucgccgccgc

SEQ ID NO: 3389919 - RNA, 22 nt, Pseudomonas aeruginosa PA01
cuccgccgcuaucgccgccgca

SEQ ID NO: 3389920 - RNA, 18 nt, Pseudomonas aeruginosa PA01
cuccgccgcuuccgccgg

SEQ ID NO: 3389921 - RNA, 19 nt, Pseudomonas aeruginosa PA01
cuccgccgcuuccgccggc

SEQ ID NO: 3389922 - RNA, 20 nt, Pseudomonas aeruginosa PA01
cuccgccgcuuccgccggcg

SEQ ID NO: 3389923 - RNA, 24 nt, Pseudomonas aeruginosa PA01
cuccgccgcuuccgccggcgccgc

SEQ ID NO: 3389924 - RNA, 12 nt, Pseudomonas aeruginosa PA01
cuccgccggcgu

SEQ ID NO: 3389925 - RNA, 21 nt, Pseudomonas aeruginosa PA01
cuccgccggcguugcgcgccc

SEQ ID NO: 3389926 - RNA, 17 nt, Pseudomonas aeruginosa PA01
cuccgccugaccgcuga

SEQ ID NO: 3389927 - RNA, 16 nt, Pseudomonas aeruginosa PA01
cuccgccugcacgucg

SEQ ID NO: 3389928 - RNA, 13 nt, Pseudomonas aeruginosa PA01
cuccgccuggcgg

SEQ ID NO: 3389929 - RNA, 24 nt, Pseudomonas aeruginosa PA01
cuccgccuggcggauaucgcgugg

SEQ ID NO: 3389930 - RNA, 20 nt, Pseudomonas aeruginosa PA01
cuccgcgauguccccggcca

SEQ ID NO: 3389931 - RNA, 16 nt, Pseudomonas aeruginosa PA01
cuccgcgccacgcgca

SEQ ID NO: 3389932 - RNA, 18 nt, Pseudomonas aeruginosa PA01
cuccgcgccacgcgcauc

SEQ ID NO: 3389933 - RNA, 16 nt, Pseudomonas aeruginosa PA01
cuccgcgccacgcucu

SEQ ID NO: 3389934 - RNA, 19 nt, Pseudomonas aeruginosa PA01
cuccgcgccgggcuggccg

SEQ ID NO: 3389935 - RNA, 15 nt, Pseudomonas aeruginosa PA01
cuccgcggagaggau

SEQ ID NO: 3389936 - RNA, 22 nt, Pseudomonas aeruginosa PA01
cuccgcggagaggaucagcgaa

SEQ ID NO: 3389937 - RNA, 14 nt, Pseudomonas aeruginosa PA01
cuccgcggccggcu

SEQ ID NO: 3389938 - RNA, 20 nt, Pseudomonas aeruginosa PA01
cuccgcggccggcuucagca

SEQ ID NO: 3389939 - RNA, 17 nt, Pseudomonas aeruginosa PA01
cuccgcguguucgcggc

SEQ ID NO: 3389940 - RNA, 21 nt, Pseudomonas aeruginosa PA01
cuccgcuaagcgucacuccca

SEQ ID NO: 3389941 - RNA, 22 nt, Pseudomonas aeruginosa PA01
cuccgcuaagcgucacucccag

SEQ ID NO: 3389942 - RNA, 14 nt, Pseudomonas aeruginosa PA01
cuccgcucugcugg

SEQ ID NO: 3389943 - RNA, 17 nt, Pseudomonas aeruginosa PA01
cuccgcucugcuggcca

SEQ ID NO: 3389944 - RNA, 19 nt, Pseudomonas aeruginosa PA01
cuccgcucugcuggccacc

SEQ ID NO: 3389945 - RNA, 23 nt, Pseudomonas aeruginosa PA01
cuccgcuggauggcauuggugcu

SEQ ID NO: 3389946 - RNA, 15 nt, Pseudomonas aeruginosa PA01
cuccggaacgccugc

SEQ ID NO: 3389947 - RNA, 23 nt, Pseudomonas aeruginosa PA01
cuccggacucgcuaucaggcauc

SEQ ID NO: 3389948 - RNA, 15 nt, Pseudomonas aeruginosa PA01
cuccggacugccgau

SEQ ID NO: 3389949 - RNA, 18 nt, Pseudomonas aeruginosa PA01
cuccggagaaccggcgga

SEQ ID NO: 3389950 - RNA, 19 nt, Pseudomonas aeruginosa PA01
cuccggagaaccggcggau

SEQ ID NO: 3389951 - RNA, 13 nt, Pseudomonas aeruginosa PA01
cuccggaggcgca

SEQ ID NO: 3389952 - RNA, 18 nt, Pseudomonas aeruginosa PA01
cuccggaggcgcacaggc

SEQ ID NO: 3389953 - RNA, 15 nt, Pseudomonas aeruginosa PA01
cuccggaucgcgcaa

SEQ ID NO: 3389954 - RNA, 22 nt, Pseudomonas aeruginosa PA01
cuccggaucgcgcaaugccgcg

SEQ ID NO: 3389955 - RNA, 19 nt, Pseudomonas aeruginosa PA01
cuccggaugcagauccagc

SEQ ID NO: 3389956 - RNA, 23 nt, Pseudomonas aeruginosa PA01
cuccggaugcagauccagcggca

SEQ ID NO: 3389957 - RNA, 15 nt, Pseudomonas aeruginosa PA01
cuccggcaccguggu

SEQ ID NO: 3389958 - RNA, 13 nt, Pseudomonas aeruginosa PA01
cuccggcacgcug

SEQ ID NO: 3389959 - RNA, 17 nt, Pseudomonas aeruginosa PA01
cuccggcacgcugccgc

SEQ ID NO: 3389960 - RNA, 20 nt, Pseudomonas aeruginosa PA01
cuccggcacgcugccgccga

SEQ ID NO: 3389961 - RNA, 21 nt, Pseudomonas aeruginosa PA01
cuccggcacgcugccgccgau

SEQ ID NO: 3389962 - RNA, 15 nt, Pseudomonas aeruginosa PA01
cuccggcagcacccg

SEQ ID NO: 3389963 - RNA, 18 nt, Pseudomonas aeruginosa PA01
cuccggcagcacccgcac

SEQ ID NO: 3389964 - RNA, 22 nt, Pseudomonas aeruginosa PA01
cuccggcagcacccgcaccagc

SEQ ID NO: 3389965 - RNA, 13 nt, Pseudomonas aeruginosa PA01
cuccggcaggcgc

SEQ ID NO: 3389966 - RNA, 22 nt, Pseudomonas aeruginosa PA01
cuccggcaguuuguucugugug

SEQ ID NO: 3389967 - RNA, 16 nt, Pseudomonas aeruginosa PA01
cuccggcgccaggccg

SEQ ID NO: 3389968 - RNA, 19 nt, Pseudomonas aeruginosa PA01
cuccggcgccaggccggag

SEQ ID NO: 3389969 - RNA, 14 nt, Pseudomonas aeruginosa PA01
cuccggcgccgagg

SEQ ID NO: 3389970 - RNA, 13 nt, Pseudomonas aeruginosa PA01
cuccggcgccggg

SEQ ID NO: 3389971 - RNA, 21 nt, Pseudomonas aeruginosa PA01
cuccggcgcguuggcuggcgg

SEQ ID NO: 3389972 - RNA, 23 nt, Pseudomonas aeruginosa PA01
cuccggcgggcgguagcgggcca

SEQ ID NO: 3389973 - RNA, 24 nt, Pseudomonas aeruginosa PA01
cuccggcguaccguuggcgaugau

SEQ ID NO: 3389974 - RNA, 15 nt, Pseudomonas aeruginosa PA01
cuccggcuccgcgca

SEQ ID NO: 3389975 - RNA, 20 nt, Pseudomonas aeruginosa PA01
cuccggcucgcugacgccau

SEQ ID NO: 3389976 - RNA, 18 nt, Pseudomonas aeruginosa PA01
cuccggcugcgugaggau

SEQ ID NO: 3389977 - RNA, 14 nt, Pseudomonas aeruginosa PA01
cuccgggaacagcc

SEQ ID NO: 3389978 - RNA, 16 nt, Pseudomonas aeruginosa PA01
cuccgggagcaucugg

SEQ ID NO: 3389979 - RNA, 20 nt, Pseudomonas aeruginosa PA01
cuccgggagcaucuggcccg

SEQ ID NO: 3389980 - RNA, 21 nt, Pseudomonas aeruginosa PA01
cuccgggagcaucuggcccgg

SEQ ID NO: 3389981 - RNA, 20 nt, Pseudomonas aeruginosa PA01
cuccgggcagaccagcagcg

SEQ ID NO: 3389982 - RNA, 15 nt, Pseudomonas aeruginosa PA01
cuccgggccgagggc

SEQ ID NO: 3389983 - RNA, 16 nt, Pseudomonas aeruginosa PA01
cuccgggcggcuguag

SEQ ID NO: 3389984 - RNA, 20 nt, Pseudomonas aeruginosa PA01
cuccgggcuggccaccagca

SEQ ID NO: 3389985 - RNA, 16 nt, Pseudomonas aeruginosa PA01
cuccggggcccggcag

SEQ ID NO: 3389986 - RNA, 16 nt, Pseudomonas aeruginosa PA01
cuccggggcgcuguug

SEQ ID NO: 3389987 - RNA, 19 nt, Pseudomonas aeruginosa PA01
cuccggggugaagcucuuc

SEQ ID NO: 3389988 - RNA, 17 nt, Pseudomonas aeruginosa PA01
cuccggguacuggcgcu

SEQ ID NO: 3389989 - RNA, 19 nt, Pseudomonas aeruginosa PA01
cuccgggucgggcuucagc

SEQ ID NO: 3389990 - RNA, 18 nt, Pseudomonas aeruginosa PA01
cuccgggucgugcccgag

SEQ ID NO: 3389991 - RNA, 19 nt, Pseudomonas aeruginosa PA01
cuccggguugaccgccaga

SEQ ID NO: 3389992 - RNA, 19 nt, Pseudomonas aeruginosa PA01
cuccgguacccguacgcug

SEQ ID NO: 3389993 - RNA, 22 nt, Pseudomonas aeruginosa PA01
cuccgguacccguacgcugcca

SEQ ID NO: 3389994 - RNA, 13 nt, Pseudomonas aeruginosa PA01
cuccggucaaggc

SEQ ID NO: 3389995 - RNA, 13 nt, Pseudomonas aeruginosa PA01
cuccggugccagg

SEQ ID NO: 3389996 - RNA, 17 nt, Pseudomonas aeruginosa PA01
cuccggugccagggcgg

SEQ ID NO: 3389997 - RNA, 23 nt, Pseudomonas aeruginosa PA01
cuccggugccagggcggucggcc

SEQ ID NO: 3389998 - RNA, 16 nt, Pseudomonas aeruginosa PA01
cuccggugucaggccg

SEQ ID NO: 3389999 - RNA, 17 nt, Pseudomonas aeruginosa PA01
cuccggugucaggccga

SEQ ID NO: 3390000 - RNA, 19 nt, Pseudomonas aeruginosa PA01
cuccggugucaggccgagg

SEQ ID NO: 3390001 - RNA, 21 nt, Pseudomonas aeruginosa PA01
cuccgucaaugcggccugcaa

SEQ ID NO: 3390002 - RNA, 14 nt, Pseudomonas aeruginosa PA01
cuccgucuccagca

SEQ ID NO: 3390003 - RNA, 15 nt, Pseudomonas aeruginosa PA01
cuccgucuguucggc

SEQ ID NO: 3390004 - RNA, 17 nt, Pseudomonas aeruginosa PA01
cuccgucuguucggcca

SEQ ID NO: 3390005 - RNA, 19 nt, Pseudomonas aeruginosa PA01
cuccgucuguucggccagg

SEQ ID NO: 3390006 - RNA, 21 nt, Pseudomonas aeruginosa PA01
cuccgugcuggccggcagcag

SEQ ID NO: 3390007 - RNA, 17 nt, Pseudomonas aeruginosa PA01
cuccgugucggcggcgc

SEQ ID NO: 3390008 - RNA, 20 nt, Pseudomonas aeruginosa PA01
cuccguugaacucggcgccc

SEQ ID NO: 3390009 - RNA, 23 nt, Pseudomonas aeruginosa PA01
cuccguugaacucggcgcccagg

SEQ ID NO: 3390010 - RNA, 20 nt, Pseudomonas aeruginosa PA01
cuccucauggcgucaacgaa

SEQ ID NO: 3390011 - RNA, 16 nt, Pseudomonas aeruginosa PA01
cuccuccagcgccgcc

SEQ ID NO: 3390012 - RNA, 16 nt, Pseudomonas aeruginosa PA01
cuccuccaucucgugg

SEQ ID NO: 3390013 - RNA, 17 nt, Pseudomonas aeruginosa PA01
cuccuccaucucguggu

SEQ ID NO: 3390014 - RNA, 14 nt, Pseudomonas aeruginosa PA01
cuccuccgacgccc

SEQ ID NO: 3390015 - RNA, 16 nt, Pseudomonas aeruginosa PA01
cuccuccgacgccccc

SEQ ID NO: 3390016 - RNA, 22 nt, Pseudomonas aeruginosa PA01
cuccuccgggcgugccaggagc

SEQ ID NO: 3390017 - RNA, 16 nt, Pseudomonas aeruginosa PA01
cuccuccucgcuccag

SEQ ID NO: 3390018 - RNA, 21 nt, Pseudomonas aeruginosa PA01
cuccuccucgcucugcgccgc

SEQ ID NO: 3390019 - RNA, 17 nt, Pseudomonas aeruginosa PA01
cucgaccagcgccgcgg

SEQ ID NO: 3390020 - RNA, 17 nt, Pseudomonas aeruginosa PA01
cucgaccagguccggca

SEQ ID NO: 3390021 - RNA, 18 nt, Pseudomonas aeruginosa PA01
cucgaccagguccggcag

SEQ ID NO: 3390022 - RNA, 20 nt, Pseudomonas aeruginosa PA01
cucgaccagguccggcagcg

SEQ ID NO: 3390023 - RNA, 15 nt, Pseudomonas aeruginosa PA01
cucgaccaucggcgg

SEQ ID NO: 3390024 - RNA, 18 nt, Pseudomonas aeruginosa PA01
cucgaccaucggcggcgg

SEQ ID NO: 3390025 - RNA, 20 nt, Pseudomonas aeruginosa PA01
cucgaccaucggcggcggcc

SEQ ID NO: 3390026 - RNA, 16 nt, Pseudomonas aeruginosa PA01
cucgacccacuggcgg

SEQ ID NO: 3390027 - RNA, 17 nt, Pseudomonas aeruginosa PA01
cucgacccacuggcgga

SEQ ID NO: 3390028 - RNA, 15 nt, Pseudomonas aeruginosa PA01
cucgacccgcccgcc

SEQ ID NO: 3390029 - RNA, 18 nt, Pseudomonas aeruginosa PA01
cucgacccgcccgccguc

SEQ ID NO: 3390030 - RNA, 14 nt, Pseudomonas aeruginosa PA01
cucgacccgcucga

SEQ ID NO: 3390031 - RNA, 19 nt, Pseudomonas aeruginosa PA01
cucgacccuggcgccgacc

SEQ ID NO: 3390032 - RNA, 18 nt, Pseudomonas aeruginosa PA01
cucgaccgccugcucgcg

SEQ ID NO: 3390033 - RNA, 21 nt, Pseudomonas aeruginosa PA01
cucgaccgccugcucgcggcu

SEQ ID NO: 3390034 - RNA, 14 nt, Pseudomonas aeruginosa PA01
cucgaccgcgccgg

SEQ ID NO: 3390035 - RNA, 15 nt, Pseudomonas aeruginosa PA01
cucgaccucggccgc

SEQ ID NO: 3390036 - RNA, 16 nt, Pseudomonas aeruginosa PA01
cucgaccucggccgca

SEQ ID NO: 3390037 - RNA, 13 nt, Pseudomonas aeruginosa PA01
cucgaccuggcca

SEQ ID NO: 3390038 - RNA, 13 nt, Pseudomonas aeruginosa PA01
cucgaccuugccg

SEQ ID NO: 3390039 - RNA, 14 nt, Pseudomonas aeruginosa PA01
cucgaccuugccga

SEQ ID NO: 3390040 - RNA, 18 nt, Pseudomonas aeruginosa PA01
cucgaccuugcuggugcc

SEQ ID NO: 3390041 - RNA, 22 nt, Pseudomonas aeruginosa PA01
cucgacgaaauaaugcggcgcg

SEQ ID NO: 3390042 - RNA, 16 nt, Pseudomonas aeruginosa PA01
cucgacgaaggcgcgc

SEQ ID NO: 3390043 - RNA, 17 nt, Pseudomonas aeruginosa PA01
cucgacgaaggcgcgcu

SEQ ID NO: 3390044 - RNA, 13 nt, Pseudomonas aeruginosa PA01
cucgacgagccgc

SEQ ID NO: 3390045 - RNA, 16 nt, Pseudomonas aeruginosa PA01
cucgacgagccgcgac

SEQ ID NO: 3390046 - RNA, 18 nt, Pseudomonas aeruginosa PA01
cucgacgagccgcgacgc

SEQ ID NO: 3390047 - RNA, 22 nt, Pseudomonas aeruginosa PA01
cucgacgagguugcucugggca

SEQ ID NO: 3390048 - RNA, 19 nt, Pseudomonas aeruginosa PA01
cucgacgauauccacgccg

SEQ ID NO: 3390049 - RNA, 18 nt, Pseudomonas aeruginosa PA01
cucgacgaucugucgaua

SEQ ID NO: 3390050 - RNA, 14 nt, Pseudomonas aeruginosa PA01
cucgacgcagagcg

SEQ ID NO: 3390051 - RNA, 21 nt, Pseudomonas aeruginosa PA01
cucgacgcccgcuugcgccgc

SEQ ID NO: 3390052 - RNA, 22 nt, Pseudomonas aeruginosa PA01
cucgacgccgagccagccgcgg

SEQ ID NO: 3390053 - RNA, 13 nt, Pseudomonas aeruginosa PA01
cucgacgcugccc

SEQ ID NO: 3390054 - RNA, 16 nt, Pseudomonas aeruginosa PA01
cucgacggcaccagcg

SEQ ID NO: 3390055 - RNA, 15 nt, Pseudomonas aeruginosa PA01
cucgacggcgggagc

SEQ ID NO: 3390056 - RNA, 13 nt, Pseudomonas aeruginosa PA01
cucgacggucagc

SEQ ID NO: 3390057 - RNA, 17 nt, Pseudomonas aeruginosa PA01
cucgacguaggcggcga

SEQ ID NO: 3390058 - RNA, 15 nt, Pseudomonas aeruginosa PA01
cucgacuuccgccuu

SEQ ID NO: 3390059 - RNA, 19 nt, Pseudomonas aeruginosa PA01
cucgacuucuucgcuggac

SEQ ID NO: 3390060 - RNA, 23 nt, Pseudomonas aeruginosa PA01
cucgagcaccaccacucgcgagc

SEQ ID NO: 3390061 - RNA, 14 nt, Pseudomonas aeruginosa PA01
cucgagcaggccga

SEQ ID NO: 3390062 - RNA, 16 nt, Pseudomonas aeruginosa PA01
cucgagcaucuccggc

SEQ ID NO: 3390063 - RNA, 16 nt, Pseudomonas aeruginosa PA01
cucgagcaugucggcg

SEQ ID NO: 3390064 - RNA, 12 nt, Pseudomonas aeruginosa PA01
cucgagccguuc

SEQ ID NO: 3390065 - RNA, 18 nt, Pseudomonas aeruginosa PA01
cucgagccguuccaggcg

SEQ ID NO: 3390066 - RNA, 19 nt, Pseudomonas aeruginosa PA01
cucgagccguuccaggcgg

SEQ ID NO: 3390067 - RNA, 21 nt, Pseudomonas aeruginosa PA01
cucgaggaacaggucgacggc

SEQ ID NO: 3390068 - RNA, 22 nt, Pseudomonas aeruginosa PA01
cucgaggaacaggucgacggcu

SEQ ID NO: 3390069 - RNA, 13 nt, Pseudomonas aeruginosa PA01
cucgaggccgagc

SEQ ID NO: 3390070 - RNA, 18 nt, Pseudomonas aeruginosa PA01
cucgaggccgagccggca

SEQ ID NO: 3390071 - RNA, 19 nt, Pseudomonas aeruginosa PA01
cucgaggccgagccggcau

SEQ ID NO: 3390072 - RNA, 14 nt, Pseudomonas aeruginosa PA01
cucgagggcgaccg

SEQ ID NO: 3390073 - RNA, 16 nt, Pseudomonas aeruginosa PA01
cucgagggcgaccgcc

SEQ ID NO: 3390074 - RNA, 18 nt, Pseudomonas aeruginosa PA01
cucgagggcgaccgccag

SEQ ID NO: 3390075 - RNA, 19 nt, Pseudomonas aeruginosa PA01
cucgagggcgaccgccagg

SEQ ID NO: 3390076 - RNA, 18 nt, Pseudomonas aeruginosa PA01
cucgaggucggccuggcu

SEQ ID NO: 3390077 - RNA, 19 nt, Pseudomonas aeruginosa PA01
cucgagguucucgacccgc

SEQ ID NO: 3390078 - RNA, 23 nt, Pseudomonas aeruginosa PA01
cucgaguucgcgcgggucgucga

SEQ ID NO: 3390079 - RNA, 13 nt, Pseudomonas aeruginosa PA01
cucgaucacccgc

SEQ ID NO: 3390080 - RNA, 17 nt, Pseudomonas aeruginosa PA01
cucgaucacccgcgagg

SEQ ID NO: 3390081 - RNA, 23 nt, Pseudomonas aeruginosa PA01
cucgaucacccgcgaggccggcc

SEQ ID NO: 3390082 - RNA, 14 nt, Pseudomonas aeruginosa PA01
cucgaucagcccgc

SEQ ID NO: 3390083 - RNA, 18 nt, Pseudomonas aeruginosa PA01
cucgaucagcccgccaac

SEQ ID NO: 3390084 - RNA, 15 nt, Pseudomonas aeruginosa PA01
cucgaucagccggcg

SEQ ID NO: 3390085 - RNA, 15 nt, Pseudomonas aeruginosa PA01
cucgaucagcgaguc

SEQ ID NO: 3390086 - RNA, 17 nt, Pseudomonas aeruginosa PA01
cucgaucagcgccgggu

SEQ ID NO: 3390087 - RNA, 18 nt, Pseudomonas aeruginosa PA01
cucgaucagcgccgggug

SEQ ID NO: 3390088 - RNA, 13 nt, Pseudomonas aeruginosa PA01
cucgaucagcgcg

SEQ ID NO: 3390089 - RNA, 13 nt, Pseudomonas aeruginosa PA01
cucgaucaggccu

SEQ ID NO: 3390090 - RNA, 15 nt, Pseudomonas aeruginosa PA01
cucgaucaggccuuc

SEQ ID NO: 3390091 - RNA, 20 nt, Pseudomonas aeruginosa PA01
cucgaucaggccuuccggga

SEQ ID NO: 3390092 - RNA, 17 nt, Pseudomonas aeruginosa PA01
cucgaucaggcugugca

SEQ ID NO: 3390093 - RNA, 12 nt, Pseudomonas aeruginosa PA01
cucgaucaggua

SEQ ID NO: 3390094 - RNA, 20 nt, Pseudomonas aeruginosa PA01
cucgaucagugcaucggccg

SEQ ID NO: 3390095 - RNA, 23 nt, Pseudomonas aeruginosa PA01
cucgaucagugcaucggccgcca

SEQ ID NO: 3390096 - RNA, 14 nt, Pseudomonas aeruginosa PA01
cucgaucaucgcca

SEQ ID NO: 3390097 - RNA, 16 nt, Pseudomonas aeruginosa PA01
cucgaucaucugcggg

SEQ ID NO: 3390098 - RNA, 16 nt, Pseudomonas aeruginosa PA01
cucgauccagccggca

SEQ ID NO: 3390099 - RNA, 18 nt, Pseudomonas aeruginosa PA01
cucgaucgagucgccgau

SEQ ID NO: 3390100 - RNA, 12 nt, Pseudomonas aeruginosa PA01
cucgaucgccuc

SEQ ID NO: 3390101 - RNA, 21 nt, Pseudomonas aeruginosa PA01
cucgaucgccucgggcgagcg

SEQ ID NO: 3390102 - RNA, 15 nt, Pseudomonas aeruginosa PA01
cucgaucggcccggg

SEQ ID NO: 3390103 - RNA, 23 nt, Pseudomonas aeruginosa PA01
cucgaucucauggucgggcaggu

SEQ ID NO: 3390104 - RNA, 18 nt, Pseudomonas aeruginosa PA01
cucgaucugucgcagcgg

SEQ ID NO: 3390105 - RNA, 20 nt, Pseudomonas aeruginosa PA01
cucgaugaaaccggccucga

SEQ ID NO: 3390106 - RNA, 16 nt, Pseudomonas aeruginosa PA01
cucgaugaacgcccug

SEQ ID NO: 3390107 - RNA, 17 nt, Pseudomonas aeruginosa PA01
cucgaugaaugcgcagg

SEQ ID NO: 3390108 - RNA, 19 nt, Pseudomonas aeruginosa PA01
cucgaugaccuugccgcga

SEQ ID NO: 3390109 - RNA, 14 nt, Pseudomonas aeruginosa PA01
cucgaugagcaugc

SEQ ID NO: 3390110 - RNA, 17 nt, Pseudomonas aeruginosa PA01
cucgaugagcaugccgc

SEQ ID NO: 3390111 - RNA, 19 nt, Pseudomonas aeruginosa PA01
cucgaugagcaugccgcag

SEQ ID NO: 3390112 - RNA, 15 nt, Pseudomonas aeruginosa PA01
cucgaugauccacuu

SEQ ID NO: 3390113 - RNA, 15 nt, Pseudomonas aeruginosa PA01
cucgaugaucgccgg

SEQ ID NO: 3390114 - RNA, 17 nt, Pseudomonas aeruginosa PA01
cucgaugaucgccgggu

SEQ ID NO: 3390115 - RNA, 13 nt, Pseudomonas aeruginosa PA01
cucgaugcccgcc

SEQ ID NO: 3390116 - RNA, 16 nt, Pseudomonas aeruginosa PA01
cucgaugcccgccagc

SEQ ID NO: 3390117 - RNA, 20 nt, Pseudomonas aeruginosa PA01
cucgaugcccgccagcaggc

SEQ ID NO: 3390118 - RNA, 21 nt, Pseudomonas aeruginosa PA01
cucgaugcccgccagcaggcg

SEQ ID NO: 3390119 - RNA, 23 nt, Pseudomonas aeruginosa PA01
cucgaugcccgccagcaggcgcc

SEQ ID NO: 3390120 - RNA, 15 nt, Pseudomonas aeruginosa PA01
cucgaugcccgccuc

SEQ ID NO: 3390121 - RNA, 20 nt, Pseudomonas aeruginosa PA01
cucgauggcagccuuggcca

SEQ ID NO: 3390122 - RNA, 22 nt, Pseudomonas aeruginosa PA01
cucgccgggaaucgccagcagg

SEQ ID NO: 3390123 - RNA, 18 nt, Pseudomonas aeruginosa PA01
cucgccgggucgccgcag

SEQ ID NO: 3390124 - RNA, 22 nt, Pseudomonas aeruginosa PA01
cucgccgggucgccgcagcccu

SEQ ID NO: 3390125 - RNA, 23 nt, Pseudomonas aeruginosa PA01
cucgccggguuguccaggcgaug

SEQ ID NO: 3390126 - RNA, 23 nt, Pseudomonas aeruginosa PA01
cucgccggugcggguaucgaucu

SEQ ID NO: 3390127 - RNA, 14 nt, Pseudomonas aeruginosa PA01
cucgccguacagca

SEQ ID NO: 3390128 - RNA, 17 nt, Pseudomonas aeruginosa PA01
cucgccguacagcaggc

SEQ ID NO: 3390129 - RNA, 19 nt, Pseudomonas aeruginosa PA01
cucgccguacagcaggcag

SEQ ID NO: 3390130 - RNA, 22 nt, Pseudomonas aeruginosa PA01
cucgccguacagcaggcaggca

SEQ ID NO: 3390131 - RNA, 15 nt, Pseudomonas aeruginosa PA01
cucgccgucaucgag

SEQ ID NO: 3390132 - RNA, 19 nt, Pseudomonas aeruginosa PA01
cucgccgucaucgagcagu

SEQ ID NO: 3390133 - RNA, 16 nt, Pseudomonas aeruginosa PA01
cucgccguccgcgaug

SEQ ID NO: 3390134 - RNA, 17 nt, Pseudomonas aeruginosa PA01
cucgccguccgcgaugc

SEQ ID NO: 3390135 - RNA, 14 nt, Pseudomonas aeruginosa PA01
cucgccgucggcgg

SEQ ID NO: 3390136 - RNA, 17 nt, Pseudomonas aeruginosa PA01
cucgccguuggcgagga

SEQ ID NO: 3390137 - RNA, 18 nt, Pseudomonas aeruginosa PA01
cucgccguuggcgaggac

SEQ ID NO: 3390138 - RNA, 16 nt, Pseudomonas aeruginosa PA01
cucgccuaccggcgcc

SEQ ID NO: 3390139 - RNA, 19 nt, Pseudomonas aeruginosa PA01
cucgccuaccggcgccgcc

SEQ ID NO: 3390140 - RNA, 13 nt, Pseudomonas aeruginosa PA01
cucgccucccggc

SEQ ID NO: 3390141 - RNA, 14 nt, Pseudomonas aeruginosa PA01
cucgccucccggcu

SEQ ID NO: 3390142 - RNA, 20 nt, Pseudomonas aeruginosa PA01
cucgccucgcgccagagauc

SEQ ID NO: 3390143 - RNA, 20 nt, Pseudomonas aeruginosa PA01
cucgccucgggccaugagca

SEQ ID NO: 3390144 - RNA, 22 nt, Pseudomonas aeruginosa PA01
cucgccugguaggcggcgacga

SEQ ID NO: 3390145 - RNA, 16 nt, Pseudomonas aeruginosa PA01
cucgccuucguccaug

SEQ ID NO: 3390146 - RNA, 15 nt, Pseudomonas aeruginosa PA01
cucgcgacaccgggc

SEQ ID NO: 3390147 - RNA, 16 nt, Pseudomonas aeruginosa PA01
cucgcgacccuggccg

SEQ ID NO: 3390148 - RNA, 17 nt, Pseudomonas aeruginosa PA01
cucgcgacccuggccgc

SEQ ID NO: 3390149 - RNA, 18 nt, Pseudomonas aeruginosa PA01
cucgcgacccuggccgcg

SEQ ID NO: 3390150 - RNA, 22 nt, Pseudomonas aeruginosa PA01
cucgcgacccuggccgcgcggc

SEQ ID NO: 3390151 - RNA, 15 nt, Pseudomonas aeruginosa PA01
cucgcgacggcauuc

SEQ ID NO: 3390152 - RNA, 23 nt, Pseudomonas aeruginosa PA01
cucgcgacggcauuccuggucca

SEQ ID NO: 3390153 - RNA, 17 nt, Pseudomonas aeruginosa PA01
cucgcgacugccgucgg

SEQ ID NO: 3390154 - RNA, 21 nt, Pseudomonas aeruginosa PA01
cucgcgacugccgucggcgcc

SEQ ID NO: 3390155 - RNA, 15 nt, Pseudomonas aeruginosa PA01
cucgcgacugcugau

SEQ ID NO: 3390156 - RNA, 22 nt, Pseudomonas aeruginosa PA01
cucgcgaucgaucggcuggucg

SEQ ID NO: 3390157 - RNA, 19 nt, Pseudomonas aeruginosa PA01
cucgcgcaaccagccggag

SEQ ID NO: 3390158 - RNA, 21 nt, Pseudomonas aeruginosa PA01
cucgcgcaacugcggggcgcu

SEQ ID NO: 3390159 - RNA, 19 nt, Pseudomonas aeruginosa PA01
cucgcgcaagcgcccggcg

SEQ ID NO: 3390160 - RNA, 20 nt, Pseudomonas aeruginosa PA01
cucgcgcaagcgcccggcga

SEQ ID NO: 3390161 - RNA, 20 nt, Pseudomonas aeruginosa PA01
cucgcgcaccgccucgugca

SEQ ID NO: 3390162 - RNA, 13 nt, Pseudomonas aeruginosa PA01
cucgcgcaccgcg

SEQ ID NO: 3390163 - RNA, 20 nt, Pseudomonas aeruginosa PA01
cucgcgcaccgcggccaguu

SEQ ID NO: 3390164 - RNA, 21 nt, Pseudomonas aeruginosa PA01
cucgcgcacggcgaagaacag

SEQ ID NO: 3390165 - RNA, 13 nt, Pseudomonas aeruginosa PA01
cucgcgcagcagg

SEQ ID NO: 3390166 - RNA, 14 nt, Pseudomonas aeruginosa PA01
cucgcgcagcagga

SEQ ID NO: 3390167 - RNA, 14 nt, Pseudomonas aeruginosa PA01
cucgcgcagccacu

SEQ ID NO: 3390168 - RNA, 13 nt, Pseudomonas aeruginosa PA01
cucgcgcagccag

SEQ ID NO: 3390169 - RNA, 17 nt, Pseudomonas aeruginosa PA01
cucgcgcagccaggcga

SEQ ID NO: 3390170 - RNA, 18 nt, Pseudomonas aeruginosa PA01
cucgcgcagggucgaggc

SEQ ID NO: 3390171 - RNA, 17 nt, Pseudomonas aeruginosa PA01
cucgcgcaugaccuuca

SEQ ID NO: 3390172 - RNA, 18 nt, Pseudomonas aeruginosa PA01
cucgcgcaugaucgccuc

SEQ ID NO: 3390173 - RNA, 22 nt, Pseudomonas aeruginosa PA01
cucgcgcaugaucgccucggcg

SEQ ID NO: 3390174 - RNA, 13 nt, Pseudomonas aeruginosa PA01
cucgcgccagaga

SEQ ID NO: 3390175 - RNA, 21 nt, Pseudomonas aeruginosa PA01
cucgcgccagccccaggcgcg

SEQ ID NO: 3390176 - RNA, 20 nt, Pseudomonas aeruginosa PA01
cucgcgccgcgccagcaggc

SEQ ID NO: 3390177 - RNA, 14 nt, Pseudomonas aeruginosa PA01
cucgcgcggggcgc

SEQ ID NO: 3390178 - RNA, 19 nt, Pseudomonas aeruginosa PA01
cucgcgcggggcgcgcugc

SEQ ID NO: 3390179 - RNA, 14 nt, Pseudomonas aeruginosa PA01
cucgcgcguggccg

SEQ ID NO: 3390180 - RNA, 18 nt, Pseudomonas aeruginosa PA01
cucgcgcguggccgccag

SEQ ID NO: 3390181 - RNA, 21 nt, Pseudomonas aeruginosa PA01
cucgcgcguggccgccagggu

SEQ ID NO: 3390182 - RNA, 19 nt, Pseudomonas aeruginosa PA01
cucgcgcugcccggcgcga

SEQ ID NO: 3390183 - RNA, 20 nt, Pseudomonas aeruginosa PA01
cucgcgcugcccggcgcgac

SEQ ID NO: 3390184 - RNA, 21 nt, Pseudomonas aeruginosa PA01
cucgcggaagcguugcucgag

SEQ ID NO: 3390185 - RNA, 21 nt, Pseudomonas aeruginosa PA01
cucgcggaagucggcgggucc

SEQ ID NO: 3390186 - RNA, 17 nt, Pseudomonas aeruginosa PA01
cucgcggaccagcuccg

SEQ ID NO: 3390187 - RNA, 23 nt, Pseudomonas aeruginosa PA01
cucgcggaccagcuccgaaggga

SEQ ID NO: 3390188 - RNA, 13 nt, Pseudomonas aeruginosa PA01
cucgcggaccucg

SEQ ID NO: 3390189 - RNA, 19 nt, Pseudomonas aeruginosa PA01
cucgcggaucugcuccugc

SEQ ID NO: 3390190 - RNA, 20 nt, Pseudomonas aeruginosa PA01
cucgcggaucugcuccugca

SEQ ID NO: 3390191 - RNA, 16 nt, Pseudomonas aeruginosa PA01
cucgcggcaucccgcc

SEQ ID NO: 3390192 - RNA, 21 nt, Pseudomonas aeruginosa PA01
cucgcggcaucccgcccgguc

SEQ ID NO: 3390193 - RNA, 18 nt, Pseudomonas aeruginosa PA01
cucgcggccgaauuccag

SEQ ID NO: 3390194 - RNA, 13 nt, Pseudomonas aeruginosa PA01
cucgcggcgcggc

SEQ ID NO: 3390195 - RNA, 14 nt, Pseudomonas aeruginosa PA01
cucgcggcuggccg

SEQ ID NO: 3390196 - RNA, 15 nt, Pseudomonas aeruginosa PA01
cucgcggcuggccgc

SEQ ID NO: 3390197 - RNA, 16 nt, Pseudomonas aeruginosa PA01
cucgcggcuggccgcc

SEQ ID NO: 3390198 - RNA, 16 nt, Pseudomonas aeruginosa PA01
cucgcgggacagcuug

SEQ ID NO: 3390199 - RNA, 20 nt, Pseudomonas aeruginosa PA01
cucgcgggccgccuggucgg

SEQ ID NO: 3390200 - RNA, 17 nt, Pseudomonas aeruginosa PA01
cucgcgggcgacgaagc

SEQ ID NO: 3390201 - RNA, 16 nt, Pseudomonas aeruginosa PA01
cucgcgggcgcgcagc

SEQ ID NO: 3390202 - RNA, 18 nt, Pseudomonas aeruginosa PA01
cucgcgggcuaccaggaa

SEQ ID NO: 3390203 - RNA, 16 nt, Pseudomonas aeruginosa PA01
cucgcgguaggccagc

SEQ ID NO: 3390204 - RNA, 20 nt, Pseudomonas aeruginosa PA01
cucgcgguaggccagcuccu

SEQ ID NO: 3390205 - RNA, 16 nt, Pseudomonas aeruginosa PA01
cucgcgguuauccgcc

SEQ ID NO: 3390206 - RNA, 17 nt, Pseudomonas aeruginosa PA01
cucgcgguuauccgccg

SEQ ID NO: 3390207 - RNA, 19 nt, Pseudomonas aeruginosa PA01
cucgcgguuauccgccgcc

SEQ ID NO: 3390208 - RNA, 21 nt, Pseudomonas aeruginosa PA01
cucgcgguuauccgccgccgg

SEQ ID NO: 3390209 - RNA, 18 nt, Pseudomonas aeruginosa PA01
cucgcgguuauccgccgg

SEQ ID NO: 3390210 - RNA, 14 nt, Pseudomonas aeruginosa PA01
cucgcguccgcagu

SEQ ID NO: 3390211 - RNA, 19 nt, Pseudomonas aeruginosa PA01
cucgcguccgcaguucgcc

SEQ ID NO: 3390212 - RNA, 20 nt, Pseudomonas aeruginosa PA01
cucgcguucaucgucggcag

SEQ ID NO: 3390213 - RNA, 20 nt, Pseudomonas aeruginosa PA01
cucgcguucgcggucgguga

SEQ ID NO: 3390214 - RNA, 21 nt, Pseudomonas aeruginosa PA01
cucgcuacggaaggucgccgg

SEQ ID NO: 3390215 - RNA, 23 nt, Pseudomonas aeruginosa PA01
cucgcuacggaaggucgccgggc

SEQ ID NO: 3390216 - RNA, 20 nt, Pseudomonas aeruginosa PA01
cucgcuagucuuccugcacg

SEQ ID NO: 3390217 - RNA, 19 nt, Pseudomonas aeruginosa PA01
cucgcuccaacgcaggcgc

SEQ ID NO: 3390218 - RNA, 13 nt, Pseudomonas aeruginosa PA01
cucgcuccagagg

SEQ ID NO: 3390219 - RNA, 16 nt, Pseudomonas aeruginosa PA01
cucgcuccagaggaac

SEQ ID NO: 3390220 - RNA, 17 nt, Pseudomonas aeruginosa PA01
cucgcuccagaggaaca

SEQ ID NO: 3390221 - RNA, 15 nt, Pseudomonas aeruginosa PA01
cucgcuccgagcagg

SEQ ID NO: 3390222 - RNA, 16 nt, Pseudomonas aeruginosa PA01
cucgcuccuccgggcg

SEQ ID NO: 3390223 - RNA, 15 nt, Pseudomonas aeruginosa PA01
cucgcucugcgccgc

SEQ ID NO: 3390224 - RNA, 22 nt, Pseudomonas aeruginosa PA01
cucgcugaaauccaccagcacg

SEQ ID NO: 3390225 - RNA, 15 nt, Pseudomonas aeruginosa PA01
cucgcugacccaggc

SEQ ID NO: 3390226 - RNA, 23 nt, Pseudomonas aeruginosa PA01
cucgcugacuuccaucagcucca

SEQ ID NO: 3390227 - RNA, 15 nt, Pseudomonas aeruginosa PA01
cucgcugagcaccgg

SEQ ID NO: 3390228 - RNA, 12 nt, Pseudomonas aeruginosa PA01
cucgcugccgaa

SEQ ID NO: 3390229 - RNA, 12 nt, Pseudomonas aeruginosa PA01
cucgcugccgcc

SEQ ID NO: 3390230 - RNA, 14 nt, Pseudomonas aeruginosa PA01
cucgcugccgccgc

SEQ ID NO: 3390231 - RNA, 15 nt, Pseudomonas aeruginosa PA01
cucgcugccggcgcg

SEQ ID NO: 3390232 - RNA, 16 nt, Pseudomonas aeruginosa PA01
cucgcugccggcgcgc

SEQ ID NO: 3390233 - RNA, 17 nt, Pseudomonas aeruginosa PA01
cucgcugccggcgcgca

SEQ ID NO: 3390234 - RNA, 13 nt, Pseudomonas aeruginosa PA01
cucgcugcgcaga

SEQ ID NO: 3390235 - RNA, 15 nt, Pseudomonas aeruginosa PA01
cucgcugcgcggguc

SEQ ID NO: 3390236 - RNA, 22 nt, Pseudomonas aeruginosa PA01
cucgcugcgugcguugcgcggc

SEQ ID NO: 3390237 - RNA, 16 nt, Pseudomonas aeruginosa PA01
cucgcugggcgccggc

SEQ ID NO: 3390238 - RNA, 18 nt, Pseudomonas aeruginosa PA01
cucgcugggcgccggcag

SEQ ID NO: 3390239 - RNA, 20 nt, Pseudomonas aeruginosa PA01
cucgcugggcgccggcaggc

SEQ ID NO: 3390240 - RNA, 13 nt, Pseudomonas aeruginosa PA01
cucgcugucgccg

SEQ ID NO: 3390241 - RNA, 18 nt, Pseudomonas aeruginosa PA01
cucgcugucgccgagcac

SEQ ID NO: 3390242 - RNA, 16 nt, Pseudomonas aeruginosa PA01
cucgcugucgcucagc

SEQ ID NO: 3390243 - RNA, 19 nt, Pseudomonas aeruginosa PA01
cucgcugucgcucagcggg

SEQ ID NO: 3390244 - RNA, 20 nt, Pseudomonas aeruginosa PA01
cucgcuucagcgagcggucg

SEQ ID NO: 3390245 - RNA, 19 nt, Pseudomonas aeruginosa PA01
cucggaaaccucgccgguc

SEQ ID NO: 3390246 - RNA, 22 nt, Pseudomonas aeruginosa PA01
cucggacaagggccagagcacg

SEQ ID NO: 3390247 - RNA, 15 nt, Pseudomonas aeruginosa PA01
cucggacggcucgcg

SEQ ID NO: 3390248 - RNA, 19 nt, Pseudomonas aeruginosa PA01
cucggacggcucgcgcagc

SEQ ID NO: 3390249 - RNA, 22 nt, Pseudomonas aeruginosa PA01
cucggacggcucgcgcagcggc

SEQ ID NO: 3390250 - RNA, 19 nt, Pseudomonas aeruginosa PA01
cucggacugaaaccccacc

SEQ ID NO: 3390251 - RNA, 15 nt, Pseudomonas aeruginosa PA01
cucggagaacagcag

SEQ ID NO: 3390252 - RNA, 16 nt, Pseudomonas aeruginosa PA01
cucggagaacagcagc

SEQ ID NO: 3390253 - RNA, 17 nt, Pseudomonas aeruginosa PA01
cucggagaacagcagcg

SEQ ID NO: 3390254 - RNA, 17 nt, Pseudomonas aeruginosa PA01
cucggagugaggccgag

SEQ ID NO: 3390255 - RNA, 23 nt, Pseudomonas aeruginosa PA01
cucggcagcgcuacgcaggcccu

SEQ ID NO: 3390256 - RNA, 17 nt, Pseudomonas aeruginosa PA01
cucggcagcgcuggcga

SEQ ID NO: 3390257 - RNA, 12 nt, Pseudomonas aeruginosa PA01
cucggcagggcg

SEQ ID NO: 3390258 - RNA, 18 nt, Pseudomonas aeruginosa PA01
cucggcagggcgcccgcc

SEQ ID NO: 3390259 - RNA, 19 nt, Pseudomonas aeruginosa PA01
cucggcagggcgcccgccc

SEQ ID NO: 3390260 - RNA, 16 nt, Pseudomonas aeruginosa PA01
cucggcauccucgccc

SEQ ID NO: 3390261 - RNA, 19 nt, Pseudomonas aeruginosa PA01
cucggcauccucgccccgc

SEQ ID NO: 3390262 - RNA, 20 nt, Pseudomonas aeruginosa PA01
cucggcauccucgccccgcc

SEQ ID NO: 3390263 - RNA, 20 nt, Pseudomonas aeruginosa PA01
cucggcaucgaccagggccg

SEQ ID NO: 3390264 - RNA, 19 nt, Pseudomonas aeruginosa PA01
cucggcaucgaccaugccg

SEQ ID NO: 3390265 - RNA, 17 nt, Pseudomonas aeruginosa PA01
cucggcaucgucgaagc

SEQ ID NO: 3390266 - RNA, 16 nt, Pseudomonas aeruginosa PA01
cucggccaacggccgc

SEQ ID NO: 3390267 - RNA, 17 nt, Pseudomonas aeruginosa PA01
cucggccaacggccgcu

SEQ ID NO: 3390268 - RNA, 14 nt, Pseudomonas aeruginosa PA01
cucggccaccacca

SEQ ID NO: 3390269 - RNA, 18 nt, Pseudomonas aeruginosa PA01
cucggccagcaaugcccg

SEQ ID NO: 3390270 - RNA, 19 nt, Pseudomonas aeruginosa PA01
cucggccagcaaugcccgc

SEQ ID NO: 3390271 - RNA, 13 nt, Pseudomonas aeruginosa PA01
cucggccagccag

SEQ ID NO: 3390272 - RNA, 15 nt, Pseudomonas aeruginosa PA01
cucggccagccaggg

SEQ ID NO: 3390273 - RNA, 20 nt, Pseudomonas aeruginosa PA01
cucggccagccagggcagca

SEQ ID NO: 3390274 - RNA, 13 nt, Pseudomonas aeruginosa PA01
cucggccagcgcc

SEQ ID NO: 3390275 - RNA, 18 nt, Pseudomonas aeruginosa PA01
cucggccagcgccacggc

SEQ ID NO: 3390276 - RNA, 14 nt, Pseudomonas aeruginosa PA01
cucggccagcgccg

SEQ ID NO: 3390277 - RNA, 16 nt, Pseudomonas aeruginosa PA01
cucggccagcgccgcc

SEQ ID NO: 3390278 - RNA, 13 nt, Pseudomonas aeruginosa PA01
cucggccagcguc

SEQ ID NO: 3390279 - RNA, 13 nt, Pseudomonas aeruginosa PA01
cucggccagcucg

SEQ ID NO: 3390280 - RNA, 14 nt, Pseudomonas aeruginosa PA01
cucggccagcucgc

SEQ ID NO: 3390281 - RNA, 15 nt, Pseudomonas aeruginosa PA01
cucggccagcucgcc

SEQ ID NO: 3390282 - RNA, 13 nt, Pseudomonas aeruginosa PA01
cucggccaggcac

SEQ ID NO: 3390283 - RNA, 14 nt, Pseudomonas aeruginosa PA01
cucggccaggcaca

SEQ ID NO: 3390284 - RNA, 14 nt, Pseudomonas aeruginosa PA01
cucggccaggcauu

SEQ ID NO: 3390285 - RNA, 22 nt, Pseudomonas aeruginosa PA01
cucggccaggcauuccuccagg

SEQ ID NO: 3390286 - RNA, 14 nt, Pseudomonas aeruginosa PA01
cucggccaggcccu

SEQ ID NO: 3390287 - RNA, 19 nt, Pseudomonas aeruginosa PA01
cucggccaggcccuugagg

SEQ ID NO: 3390288 - RNA, 15 nt, Pseudomonas aeruginosa PA01
cucggccaggcgcca

SEQ ID NO: 3390289 - RNA, 16 nt, Pseudomonas aeruginosa PA01
cucggccaggcgccag

SEQ ID NO: 3390290 - RNA, 20 nt, Pseudomonas aeruginosa PA01
cucggccagguauucgcgcu

SEQ ID NO: 3390291 - RNA, 18 nt, Pseudomonas aeruginosa PA01
cucggccaggucgcgacu

SEQ ID NO: 3390292 - RNA, 18 nt, Pseudomonas aeruginosa PA01
cucggccauaccuccagc

SEQ ID NO: 3390293 - RNA, 20 nt, Pseudomonas aeruginosa PA01
cucggccauaccuccagcca

SEQ ID NO: 3390294 - RNA, 23 nt, Pseudomonas aeruginosa PA01
cucggccauaccuccagccagca

SEQ ID NO: 3390295 - RNA, 16 nt, Pseudomonas aeruginosa PA01
cucggccaugccggcc

SEQ ID NO: 3390296 - RNA, 19 nt, Pseudomonas aeruginosa PA01
cucggccaugccggccagg

SEQ ID NO: 3390297 - RNA, 20 nt, Pseudomonas aeruginosa PA01
cucggccauggucucgcuga

SEQ ID NO: 3390298 - RNA, 14 nt, Pseudomonas aeruginosa PA01
cucggcccggagcc

SEQ ID NO: 3390299 - RNA, 14 nt, Pseudomonas aeruginosa PA01
cucggcccgggccu

SEQ ID NO: 3390300 - RNA, 19 nt, Pseudomonas aeruginosa PA01
cucggccgagggcagccuc

SEQ ID NO: 3390301 - RNA, 23 nt, Pseudomonas aeruginosa PA01
cucggccgagggcagccucagcg

SEQ ID NO: 3390302 - RNA, 15 nt, Pseudomonas aeruginosa PA01
cucggccgccaggcg

SEQ ID NO: 3390303 - RNA, 18 nt, Pseudomonas aeruginosa PA01
cucggccgccaggcgcgu

SEQ ID NO: 3390304 - RNA, 16 nt, Pseudomonas aeruginosa PA01
cucggccgccuggcgu

SEQ ID NO: 3390305 - RNA, 17 nt, Pseudomonas aeruginosa PA01
cucggccgugugccuga

SEQ ID NO: 3390306 - RNA, 14 nt, Pseudomonas aeruginosa PA01
cucggccucgaucu

SEQ ID NO: 3390307 - RNA, 17 nt, Pseudomonas aeruginosa PA01
cucggccucgucgagca

SEQ ID NO: 3390308 - RNA, 14 nt, Pseudomonas aeruginosa PA01
cucggccugcgucg

SEQ ID NO: 3390309 - RNA, 20 nt, Pseudomonas aeruginosa PA01
cucggccugcgucgcaucca

SEQ ID NO: 3390310 - RNA, 14 nt, Pseudomonas aeruginosa PA01
cucggccugcugcg

SEQ ID NO: 3390311 - RNA, 20 nt, Pseudomonas aeruginosa PA01
cucggccugcugcgccggca

SEQ ID NO: 3390312 - RNA, 14 nt, Pseudomonas aeruginosa PA01
cucggccuggaacc

SEQ ID NO: 3390313 - RNA, 17 nt, Pseudomonas aeruginosa PA01
cucggccugggcgcagg

SEQ ID NO: 3390314 - RNA, 22 nt, Pseudomonas aeruginosa PA01
cucggccugggcgcaggccgag

SEQ ID NO: 3390315 - RNA, 14 nt, Pseudomonas aeruginosa PA01
cucggccuggugca

SEQ ID NO: 3390316 - RNA, 18 nt, Pseudomonas aeruginosa PA01
cucggccuugagcgccga

SEQ ID NO: 3390317 - RNA, 13 nt, Pseudomonas aeruginosa PA01
cucggccuugcug

SEQ ID NO: 3390318 - RNA, 15 nt, Pseudomonas aeruginosa PA01
cucggccuugcuggc

SEQ ID NO: 3390319 - RNA, 19 nt, Pseudomonas aeruginosa PA01
cucggccuuguccgcgcgc

SEQ ID NO: 3390320 - RNA, 20 nt, Pseudomonas aeruginosa PA01
cucggccuuguccgcgcgcu

SEQ ID NO: 3390321 - RNA, 17 nt, Pseudomonas aeruginosa PA01
cucggcgaacgacagca

SEQ ID NO: 3390322 - RNA, 20 nt, Pseudomonas aeruginosa PA01
cucggcgaacgacagcacca

SEQ ID NO: 3390323 - RNA, 19 nt, Pseudomonas aeruginosa PA01
cucggcgaacuccgccagc

SEQ ID NO: 3390324 - RNA, 14 nt, Pseudomonas aeruginosa PA01
cucggcgaccaccc

SEQ ID NO: 3390325 - RNA, 17 nt, Pseudomonas aeruginosa PA01
cucggcgaccacccggc

SEQ ID NO: 3390326 - RNA, 18 nt, Pseudomonas aeruginosa PA01
cucggcgaccacccggcg

SEQ ID NO: 3390327 - RNA, 20 nt, Pseudomonas aeruginosa PA01
cucggggcgccuccagcggg

SEQ ID NO: 3390328 - RNA, 15 nt, Pseudomonas aeruginosa PA01
cucggggugcgcggc

SEQ ID NO: 3390329 - RNA, 17 nt, Pseudomonas aeruginosa PA01
cucggggugcgcggcga

SEQ ID NO: 3390330 - RNA, 15 nt, Pseudomonas aeruginosa PA01
cucggguuuggcgcc

SEQ ID NO: 3390331 - RNA, 21 nt, Pseudomonas aeruginosa PA01
cucggguuuggcgcccgccuu

SEQ ID NO: 3390332 - RNA, 15 nt, Pseudomonas aeruginosa PA01
cucgguaaagcccag

SEQ ID NO: 3390333 - RNA, 23 nt, Pseudomonas aeruginosa PA01
cucgguagaccccggugugcgcu

SEQ ID NO: 3390334 - RNA, 14 nt, Pseudomonas aeruginosa PA01
cucgguagccggcc

SEQ ID NO: 3390335 - RNA, 16 nt, Pseudomonas aeruginosa PA01
cucgguagggccgagg

SEQ ID NO: 3390336 - RNA, 17 nt, Pseudomonas aeruginosa PA01
cucgguagggccgaggu

SEQ ID NO: 3390337 - RNA, 19 nt, Pseudomonas aeruginosa PA01
cucgguagggccgaggucg

SEQ ID NO: 3390338 - RNA, 21 nt, Pseudomonas aeruginosa PA01
cucgguagggccgaggucgag

SEQ ID NO: 3390339 - RNA, 18 nt, Pseudomonas aeruginosa PA01
cucgguauggcugcugug

SEQ ID NO: 3390340 - RNA, 14 nt, Pseudomonas aeruginosa PA01
cucggucagcggcg

SEQ ID NO: 3390341 - RNA, 18 nt, Pseudomonas aeruginosa PA01
cucggucagcggcgcagc

SEQ ID NO: 3390342 - RNA, 21 nt, Pseudomonas aeruginosa PA01
cucggucagcggcgcagccuc

SEQ ID NO: 3390343 - RNA, 22 nt, Pseudomonas aeruginosa PA01
cucggucagcggcgcagccucg

SEQ ID NO: 3390344 - RNA, 19 nt, Pseudomonas aeruginosa PA01
cucggucaggcgcugguga

SEQ ID NO: 3390345 - RNA, 22 nt, Pseudomonas aeruginosa PA01
cucggucagguauucgccggcc

SEQ ID NO: 3390346 - RNA, 13 nt, Pseudomonas aeruginosa PA01
cucggucgccgcc

SEQ ID NO: 3390347 - RNA, 16 nt, Pseudomonas aeruginosa PA01
cucggucgccgccagc

SEQ ID NO: 3390348 - RNA, 16 nt, Pseudomonas aeruginosa PA01
cucggucucgaucggc

SEQ ID NO: 3390349 - RNA, 19 nt, Pseudomonas aeruginosa PA01
cucggucucgaucggcccg

SEQ ID NO: 3390350 - RNA, 12 nt, Pseudomonas aeruginosa PA01
cucggugaccac

SEQ ID NO: 3390351 - RNA, 13 nt, Pseudomonas aeruginosa PA01
cucggugaccacc

SEQ ID NO: 3390352 - RNA, 14 nt, Pseudomonas aeruginosa PA01
cucggugaccacca

SEQ ID NO: 3390353 - RNA, 18 nt, Pseudomonas aeruginosa PA01
cucggugaccaccaggcg

SEQ ID NO: 3390354 - RNA, 18 nt, Pseudomonas aeruginosa PA01
cucggugagcaggcgccg

SEQ ID NO: 3390355 - RNA, 16 nt, Pseudomonas aeruginosa PA01
cucggugaugcguucg

SEQ ID NO: 3390356 - RNA, 14 nt, Pseudomonas aeruginosa PA01
cucggugcgcccca

SEQ ID NO: 3390357 - RNA, 17 nt, Pseudomonas aeruginosa PA01
cucggugcgccccaggu

SEQ ID NO: 3390358 - RNA, 17 nt, Pseudomonas aeruginosa PA01
cucggugcggccgagga

SEQ ID NO: 3390359 - RNA, 20 nt, Pseudomonas aeruginosa PA01
cucggugcggccgaggaacu

SEQ ID NO: 3390360 - RNA, 13 nt, Pseudomonas aeruginosa PA01
cucggugcguagc

SEQ ID NO: 3390361 - RNA, 15 nt, Pseudomonas aeruginosa PA01
cucggugcucaggcg

SEQ ID NO: 3390362 - RNA, 16 nt, Pseudomonas aeruginosa PA01
cucggugcucaggcgg

SEQ ID NO: 3390363 - RNA, 18 nt, Pseudomonas aeruginosa PA01
cucggugggcuugccggg

SEQ ID NO: 3390364 - RNA, 17 nt, Pseudomonas aeruginosa PA01
cucgguguagcugaggc

SEQ ID NO: 3390365 - RNA, 17 nt, Pseudomonas aeruginosa PA01
cucgguguaggcgaucu

SEQ ID NO: 3390366 - RNA, 16 nt, Pseudomonas aeruginosa PA01
cucgguguccaccacc

SEQ ID NO: 3390367 - RNA, 19 nt, Pseudomonas aeruginosa PA01
cucgguguccaccaccagc

SEQ ID NO: 3390368 - RNA, 22 nt, Pseudomonas aeruginosa PA01
cucgguguccaccaccagcagg

SEQ ID NO: 3390369 - RNA, 23 nt, Pseudomonas aeruginosa PA01
cucgguguccaccaccagcaggc

SEQ ID NO: 3390370 - RNA, 22 nt, Pseudomonas aeruginosa PA01
cucggugugaucaccagccacu

SEQ ID NO: 3390371 - RNA, 14 nt, Pseudomonas aeruginosa PA01
cucgguucauggac

SEQ ID NO: 3390372 - RNA, 16 nt, Pseudomonas aeruginosa PA01
cucgguucugcgcacc

SEQ ID NO: 3390373 - RNA, 16 nt, Pseudomonas aeruginosa PA01
cucgguugccaggccg

SEQ ID NO: 3390374 - RNA, 18 nt, Pseudomonas aeruginosa PA01
cucgguuuccggccaggc

SEQ ID NO: 3390375 - RNA, 17 nt, Pseudomonas aeruginosa PA01
cucguacaugcgcgagu

SEQ ID NO: 3390376 - RNA, 17 nt, Pseudomonas aeruginosa PA01
cucguagaacucgcccu

SEQ ID NO: 3390377 - RNA, 18 nt, Pseudomonas aeruginosa PA01
cucguagacuguggugua

SEQ ID NO: 3390378 - RNA, 20 nt, Pseudomonas aeruginosa PA01
cucguagagauauucccgcg

SEQ ID NO: 3390379 - RNA, 21 nt, Pseudomonas aeruginosa PA01
cucguagagauauucccgcga

SEQ ID NO: 3390380 - RNA, 13 nt, Pseudomonas aeruginosa PA01
cucguagccggcg

SEQ ID NO: 3390381 - RNA, 20 nt, Pseudomonas aeruginosa PA01
cucguaggcguccuggcgag

SEQ ID NO: 3390382 - RNA, 14 nt, Pseudomonas aeruginosa PA01
cucguagucgauca

SEQ ID NO: 3390383 - RNA, 16 nt, Pseudomonas aeruginosa PA01
cucguauuccacgucg

SEQ ID NO: 3390384 - RNA, 22 nt, Pseudomonas aeruginosa PA01
cucguauuccacgucgccgacc

SEQ ID NO: 3390385 - RNA, 14 nt, Pseudomonas aeruginosa PA01
cucgucacccgcgc

SEQ ID NO: 3390386 - RNA, 22 nt, Pseudomonas aeruginosa PA01
cucgucaucguccagcucggcc

SEQ ID NO: 3390387 - RNA, 21 nt, Pseudomonas aeruginosa PA01
cucgucauggcgcacgccgcg

SEQ ID NO: 3390388 - RNA, 22 nt, Pseudomonas aeruginosa PA01
cucgucauggcgcacgccgcgg

SEQ ID NO: 3390389 - RNA, 16 nt, Pseudomonas aeruginosa PA01
cucguccagcaggacg

SEQ ID NO: 3390390 - RNA, 20 nt, Pseudomonas aeruginosa PA01
cucguccagcaggcccagcc

SEQ ID NO: 3390391 - RNA, 21 nt, Pseudomonas aeruginosa PA01
cucguccagcaggcccagcca

SEQ ID NO: 3390392 - RNA, 14 nt, Pseudomonas aeruginosa PA01
cucguccaggcaag

SEQ ID NO: 3390393 - RNA, 19 nt, Pseudomonas aeruginosa PA01
cucguccaggcaagcgcau

SEQ ID NO: 3390394 - RNA, 14 nt, Pseudomonas aeruginosa PA01
cucguccaggccgc

SEQ ID NO: 3390395 - RNA, 20 nt, Pseudomonas aeruginosa PA01
cucguccaggccgcagguga

SEQ ID NO: 3390396 - RNA, 19 nt, Pseudomonas aeruginosa PA01
cucguccaguucagggcca

SEQ ID NO: 3390397 - RNA, 21 nt, Pseudomonas aeruginosa PA01
cucguccauguugcggcccag

SEQ ID NO: 3390398 - RNA, 22 nt, Pseudomonas aeruginosa PA01
cucguccauguugcggcccagc

SEQ ID NO: 3390399 - RNA, 16 nt, Pseudomonas aeruginosa PA01
cucguccgacagcagg

SEQ ID NO: 3390400 - RNA, 21 nt, Pseudomonas aeruginosa PA01
cucguccggucgcaccgccag

SEQ ID NO: 3390401 - RNA, 17 nt, Pseudomonas aeruginosa PA01
cucguccucccagugcg

SEQ ID NO: 3390402 - RNA, 22 nt, Pseudomonas aeruginosa PA01
cucguccuccucgaucacccgc

SEQ ID NO: 3390403 - RNA, 16 nt, Pseudomonas aeruginosa PA01
cucguccucggggaag

SEQ ID NO: 3390404 - RNA, 16 nt, Pseudomonas aeruginosa PA01
cucgucgaagcgcagu

SEQ ID NO: 3390405 - RNA, 20 nt, Pseudomonas aeruginosa PA01
cucgucgagcagcgcgcggc

SEQ ID NO: 3390406 - RNA, 18 nt, Pseudomonas aeruginosa PA01
cucgucgagcgcagcgac

SEQ ID NO: 3390407 - RNA, 22 nt, Pseudomonas aeruginosa PA01
cucgucgagcugcucggcggug

SEQ ID NO: 3390408 - RNA, 16 nt, Pseudomonas aeruginosa PA01
cucgucgaggucgagg

SEQ ID NO: 3390409 - RNA, 17 nt, Pseudomonas aeruginosa PA01
cucgucgaggucgaggu

SEQ ID NO: 3390410 - RNA, 22 nt, Pseudomonas aeruginosa PA01
cucgucgaggucgagguccacg

SEQ ID NO: 3390411 - RNA, 17 nt, Pseudomonas aeruginosa PA01
cucgucgaucucgccga

SEQ ID NO: 3390412 - RNA, 21 nt, Pseudomonas aeruginosa PA01
cucgucgaugaucugcauggc

SEQ ID NO: 3390413 - RNA, 16 nt, Pseudomonas aeruginosa PA01
cucgucgcaccuguuc

SEQ ID NO: 3390414 - RNA, 18 nt, Pseudomonas aeruginosa PA01
cucgucgcaccuguucca

SEQ ID NO: 3390415 - RNA, 14 nt, Pseudomonas aeruginosa PA01
cucgucgccaugcg

SEQ ID NO: 3390416 - RNA, 15 nt, Pseudomonas aeruginosa PA01
cucgucgccaugcgg

SEQ ID NO: 3390417 - RNA, 19 nt, Pseudomonas aeruginosa PA01
cucgucgccaugcggcagg

SEQ ID NO: 3390418 - RNA, 22 nt, Pseudomonas aeruginosa PA01
cucgucgcccuucaggucgaca

SEQ ID NO: 3390419 - RNA, 13 nt, Pseudomonas aeruginosa PA01
cucgucgccgacc

SEQ ID NO: 3390420 - RNA, 13 nt, Pseudomonas aeruginosa PA01
cucgucgccgccc

SEQ ID NO: 3390421 - RNA, 16 nt, Pseudomonas aeruginosa PA01
cucgucgccgcccggc

SEQ ID NO: 3390422 - RNA, 17 nt, Pseudomonas aeruginosa PA01
cucgucgccgcccggca

SEQ ID NO: 3390423 - RNA, 13 nt, Pseudomonas aeruginosa PA01
cucgucgccgccg

SEQ ID NO: 3390424 - RNA, 14 nt, Pseudomonas aeruginosa PA01
cucgucgccgccgu

SEQ ID NO: 3390425 - RNA, 20 nt, Pseudomonas aeruginosa PA01
cucgucgcuauagcggaugu

SEQ ID NO: 3390426 - RNA, 17 nt, Pseudomonas aeruginosa PA01
cucgucggaggcgagga

SEQ ID NO: 3390427 - RNA, 13 nt, Pseudomonas aeruginosa PA01
cucgucggcgggg

SEQ ID NO: 3390428 - RNA, 21 nt, Pseudomonas aeruginosa PA01
cucgucggcggggcgcaccgc

SEQ ID NO: 3390429 - RNA, 12 nt, Pseudomonas aeruginosa PA01
cucuucuugauc

SEQ ID NO: 3390430 - RNA, 20 nt, Pseudomonas aeruginosa PA01
cucuugaaaacugucggcgg

SEQ ID NO: 3390431 - RNA, 19 nt, Pseudomonas aeruginosa PA01
cucuugaucccggaggcgg

SEQ ID NO: 3390432 - RNA, 23 nt, Pseudomonas aeruginosa PA01
cucuugaucccggaggcggcgag

SEQ ID NO: 3390433 - RNA, 14 nt, Pseudomonas aeruginosa PA01
cucuugcccugcca

SEQ ID NO: 3390434 - RNA, 21 nt, Pseudomonas aeruginosa PA01
cucuugccgcgagcuuggccc

SEQ ID NO: 3390435 - RNA, 16 nt, Pseudomonas aeruginosa PA01
cucuugggcucugccu

SEQ ID NO: 3390436 - RNA, 19 nt, Pseudomonas aeruginosa PA01
cucuuuccgggucauuggc

SEQ ID NO: 3390437 - RNA, 19 nt, Pseudomonas aeruginosa PA01
cucuuucguuucagcgcca

SEQ ID NO: 3390438 - RNA, 16 nt, Pseudomonas aeruginosa PA01
cucuuuuuaagagaau

SEQ ID NO: 3390439 - RNA, 13 nt, Pseudomonas aeruginosa PA01
cugaaaaaagggg

SEQ ID NO: 3390440 - RNA, 18 nt, Pseudomonas aeruginosa PA01
cugaaaaaaggggaugcc

SEQ ID NO: 3390441 - RNA, 23 nt, Pseudomonas aeruginosa PA01
cugaaaaaaggggaugccauggc

SEQ ID NO: 3390442 - RNA, 14 nt, Pseudomonas aeruginosa PA01
cugaaaccccacca

SEQ ID NO: 3390443 - RNA, 15 nt, Pseudomonas aeruginosa PA01
cugaaauccaccagc

SEQ ID NO: 3390444 - RNA, 13 nt, Pseudomonas aeruginosa PA01
cugaacgcgcccg

SEQ ID NO: 3390445 - RNA, 14 nt, Pseudomonas aeruginosa PA01
cugaacgcgcccgg

SEQ ID NO: 3390446 - RNA, 15 nt, Pseudomonas aeruginosa PA01
cugaacgcgcccggc

SEQ ID NO: 3390447 - RNA, 19 nt, Pseudomonas aeruginosa PA01
cugaacgcgcccggccagg

SEQ ID NO: 3390448 - RNA, 13 nt, Pseudomonas aeruginosa PA01
cugaagaagcugc

SEQ ID NO: 3390449 - RNA, 14 nt, Pseudomonas aeruginosa PA01
cugaagaagcugcc

SEQ ID NO: 3390450 - RNA, 15 nt, Pseudomonas aeruginosa PA01
cugaagacccggcgu

SEQ ID NO: 3390451 - RNA, 21 nt, Pseudomonas aeruginosa PA01
cugaagacccggcguucgccg

SEQ ID NO: 3390452 - RNA, 23 nt, Pseudomonas aeruginosa PA01
cugaagacccggcguucgccggg

SEQ ID NO: 3390453 - RNA, 13 nt, Pseudomonas aeruginosa PA01
cugaagaucgcca

SEQ ID NO: 3390454 - RNA, 18 nt, Pseudomonas aeruginosa PA01
cugaagcgccgcggcccg

SEQ ID NO: 3390455 - RNA, 19 nt, Pseudomonas aeruginosa PA01
cugaagcgccgcggcccgg

SEQ ID NO: 3390456 - RNA, 19 nt, Pseudomonas aeruginosa PA01
cugaagcggccgccgaaau

SEQ ID NO: 3390457 - RNA, 12 nt, Pseudomonas aeruginosa PA01
cugaaggccgaa

SEQ ID NO: 3390458 - RNA, 21 nt, Pseudomonas aeruginosa PA01
cugaaggcgguguagaccacc

SEQ ID NO: 3390459 - RNA, 16 nt, Pseudomonas aeruginosa PA01
cugaaggugagauggu

SEQ ID NO: 3390460 - RNA, 18 nt, Pseudomonas aeruginosa PA01
cugaaggugagauggucg

SEQ ID NO: 3390461 - RNA, 19 nt, Pseudomonas aeruginosa PA01
cugaaguccuggccgagca

SEQ ID NO: 3390462 - RNA, 16 nt, Pseudomonas aeruginosa PA01
cugaauaccaccgggc

SEQ ID NO: 3390463 - RNA, 21 nt, Pseudomonas aeruginosa PA01
cugaauaccacguggccggcg

SEQ ID NO: 3390464 - RNA, 18 nt, Pseudomonas aeruginosa PA01
cugacagcuugucgguga

SEQ ID NO: 3390465 - RNA, 15 nt, Pseudomonas aeruginosa PA01
cugacauccaccagg

SEQ ID NO: 3390466 - RNA, 20 nt, Pseudomonas aeruginosa PA01
cugacauccaccagggucgg

SEQ ID NO: 3390467 - RNA, 13 nt, Pseudomonas aeruginosa PA01
cugaccaccagga

SEQ ID NO: 3390468 - RNA, 17 nt, Pseudomonas aeruginosa PA01
cugaccaccagggcgau

SEQ ID NO: 3390469 - RNA, 21 nt, Pseudomonas aeruginosa PA01
cugaccacgcagagcggcagg

SEQ ID NO: 3390470 - RNA, 12 nt, Pseudomonas aeruginosa PA01
cugaccagcagg

SEQ ID NO: 3390471 - RNA, 13 nt, Pseudomonas aeruginosa PA01
cugaccagcaggg

SEQ ID NO: 3390472 - RNA, 13 nt, Pseudomonas aeruginosa PA01
cugaccagcccgg

SEQ ID NO: 3390473 - RNA, 13 nt, Pseudomonas aeruginosa PA01
cugacccaggcuu

SEQ ID NO: 3390474 - RNA, 18 nt, Pseudomonas aeruginosa PA01
cugacccaggcuucggcg

SEQ ID NO: 3390475 - RNA, 22 nt, Pseudomonas aeruginosa PA01
cugacccaggcuucggcgcgcu

SEQ ID NO: 3390476 - RNA, 15 nt, Pseudomonas aeruginosa PA01
cugaccccggccugg

SEQ ID NO: 3390477 - RNA, 17 nt, Pseudomonas aeruginosa PA01
cugaccccggccuggcu

SEQ ID NO: 3390478 - RNA, 16 nt, Pseudomonas aeruginosa PA01
cugacccgcaccggca

SEQ ID NO: 3390479 - RNA, 19 nt, Pseudomonas aeruginosa PA01
cugacccgcugcuggaugg

SEQ ID NO: 3390480 - RNA, 14 nt, Pseudomonas aeruginosa PA01
cugacccgcugucc

SEQ ID NO: 3390481 - RNA, 16 nt, Pseudomonas aeruginosa PA01
cugacccgcuguccgc

SEQ ID NO: 3390482 - RNA, 21 nt, Pseudomonas aeruginosa PA01
cugacccgcuguccgccggcc

SEQ ID NO: 3390483 - RNA, 22 nt, Pseudomonas aeruginosa PA01
cugaccgcgaauggcagcaggc

SEQ ID NO: 3390484 - RNA, 18 nt, Pseudomonas aeruginosa PA01
cugaccgcgagcgccgcc

SEQ ID NO: 3390485 - RNA, 15 nt, Pseudomonas aeruginosa PA01
cugaccgcgugggcc

SEQ ID NO: 3390486 - RNA, 16 nt, Pseudomonas aeruginosa PA01
cugaccgcucccaggc

SEQ ID NO: 3390487 - RNA, 17 nt, Pseudomonas aeruginosa PA01
cugaccggcaucgacca

SEQ ID NO: 3390488 - RNA, 22 nt, Pseudomonas aeruginosa PA01
cugaccggcaucgaccagcagc

SEQ ID NO: 3390489 - RNA, 14 nt, Pseudomonas aeruginosa PA01
cugaccgggcggau

SEQ ID NO: 3390490 - RNA, 13 nt, Pseudomonas aeruginosa PA01
cugaccguccugg

SEQ ID NO: 3390491 - RNA, 18 nt, Pseudomonas aeruginosa PA01
cugaccgucgggucgacc

SEQ ID NO: 3390492 - RNA, 17 nt, Pseudomonas aeruginosa PA01
cugaccucgagcuggac

SEQ ID NO: 3390493 - RNA, 16 nt, Pseudomonas aeruginosa PA01
cugaccucgauggcgu

SEQ ID NO: 3390494 - RNA, 15 nt, Pseudomonas aeruginosa PA01
cugaccucggugagg

SEQ ID NO: 3390495 - RNA, 20 nt, Pseudomonas aeruginosa PA01
cugaccuggucguugcgcgc

SEQ ID NO: 3390496 - RNA, 20 nt, Pseudomonas aeruginosa PA01
cugaccuucacuucgcgcgg

SEQ ID NO: 3390497 - RNA, 15 nt, Pseudomonas aeruginosa PA01
cugacgaacaucgcc

SEQ ID NO: 3390498 - RNA, 20 nt, Pseudomonas aeruginosa PA01
cugacgaacaucgccagcgc

SEQ ID NO: 3390499 - RNA, 17 nt, Pseudomonas aeruginosa PA01
cugacgaaggcuggagc

SEQ ID NO: 3390500 - RNA, 18 nt, Pseudomonas aeruginosa PA01
cugacgaaggcuggagcg

SEQ ID NO: 3390501 - RNA, 16 nt, Pseudomonas aeruginosa PA01
cugacgaaguccuugu

SEQ ID NO: 3390502 - RNA, 24 nt, Pseudomonas aeruginosa PA01
cugacgaagugauggaagagcgcc

SEQ ID NO: 3390503 - RNA, 18 nt, Pseudomonas aeruginosa PA01
cugacgaggacgccgccg

SEQ ID NO: 3390504 - RNA, 17 nt, Pseudomonas aeruginosa PA01
cugacgaugaagcccca

SEQ ID NO: 3390505 - RNA, 19 nt, Pseudomonas aeruginosa PA01
cugacgaugaagccccagc

SEQ ID NO: 3390506 - RNA, 17 nt, Pseudomonas aeruginosa PA01
cugacgaugcagggcug

SEQ ID NO: 3390507 - RNA, 19 nt, Pseudomonas aeruginosa PA01
cugacgcgcagcgccgccg

SEQ ID NO: 3390508 - RNA, 20 nt, Pseudomonas aeruginosa PA01
cugacgcgcagcgccgccgc

SEQ ID NO: 3390509 - RNA, 17 nt, Pseudomonas aeruginosa PA01
cugacgcucauaccggu

SEQ ID NO: 3390510 - RNA, 17 nt, Pseudomonas aeruginosa PA01
cugacggcaaggaccug

SEQ ID NO: 3390511 - RNA, 18 nt, Pseudomonas aeruginosa PA01
cugacggcaaggaccugc

SEQ ID NO: 3390512 - RNA, 21 nt, Pseudomonas aeruginosa PA01
cugacggcaaggaccugcugc

SEQ ID NO: 3390513 - RNA, 14 nt, Pseudomonas aeruginosa PA01
cugacggcggaagg

SEQ ID NO: 3390514 - RNA, 18 nt, Pseudomonas aeruginosa PA01
cugacggcggaaggcggc

SEQ ID NO: 3390515 - RNA, 15 nt, Pseudomonas aeruginosa PA01
cugacggcguggcgg

SEQ ID NO: 3390516 - RNA, 16 nt, Pseudomonas aeruginosa PA01
cugacggcguggcgga

SEQ ID NO: 3390517 - RNA, 20 nt, Pseudomonas aeruginosa PA01
cugacuuccaucagcuccac

SEQ ID NO: 3390518 - RNA, 18 nt, Pseudomonas aeruginosa PA01
cugagaccgauccagcag

SEQ ID NO: 3390519 - RNA, 19 nt, Pseudomonas aeruginosa PA01
cugagaccuuccugccagc

SEQ ID NO: 3390520 - RNA, 20 nt, Pseudomonas aeruginosa PA01
cugagaccuuccugccagcg

SEQ ID NO: 3390521 - RNA, 19 nt, Pseudomonas aeruginosa PA01
cugagacgcgaauccagca

SEQ ID NO: 3390522 - RNA, 15 nt, Pseudomonas aeruginosa PA01
cugagaucagcgccc

SEQ ID NO: 3390523 - RNA, 13 nt, Pseudomonas aeruginosa PA01
cugagcagcaggu

SEQ ID NO: 3390524 - RNA, 15 nt, Pseudomonas aeruginosa PA01
cugagcagcaggugg

SEQ ID NO: 3390525 - RNA, 20 nt, Pseudomonas aeruginosa PA01
cugagcaggacccaucgaug

SEQ ID NO: 3390526 - RNA, 14 nt, Pseudomonas aeruginosa PA01
cugagcaggccgac

SEQ ID NO: 3390527 - RNA, 17 nt, Pseudomonas aeruginosa PA01
cugagcaggccgacggc

SEQ ID NO: 3390528 - RNA, 18 nt, Pseudomonas aeruginosa PA01
cugagcaggccgacggcg

SEQ ID NO: 3390529 - RNA, 19 nt, Pseudomonas aeruginosa PA01
cugagcaggccgacggcgc

SEQ ID NO: 3390530 - RNA, 20 nt, Pseudomonas aeruginosa PA01
cugagcaggccgacggcgcg

SEQ ID NO: 3390531 - RNA, 18 nt, Pseudomonas aeruginosa PA01
cugagcagucgccuggcc

SEQ ID NO: 3390532 - RNA, 20 nt, Pseudomonas aeruginosa PA01
cugcacaucaccuucgcccu

SEQ ID NO: 3390533 - RNA, 21 nt, Pseudomonas aeruginosa PA01
cugcacaucaccuucgcccuc

SEQ ID NO: 3390534 - RNA, 17 nt, Pseudomonas aeruginosa PA01
cugcacaugcaccaccu

SEQ ID NO: 3390535 - RNA, 21 nt, Pseudomonas aeruginosa PA01
cugcaccacguucggcgcggg

SEQ ID NO: 3390536 - RNA, 20 nt, Pseudomonas aeruginosa PA01
cugcaccagccaguccggca

SEQ ID NO: 3390537 - RNA, 13 nt, Pseudomonas aeruginosa PA01
cugcaccagcuuc

SEQ ID NO: 3390538 - RNA, 21 nt, Pseudomonas aeruginosa PA01
cugcaccaggcucgccccggc

SEQ ID NO: 3390539 - RNA, 23 nt, Pseudomonas aeruginosa PA01
cugcaccaggcucgccccggcgg

SEQ ID NO: 3390540 - RNA, 15 nt, Pseudomonas aeruginosa PA01
cugcacccgccgacc

SEQ ID NO: 3390541 - RNA, 14 nt, Pseudomonas aeruginosa PA01
cugcaccgcccagc

SEQ ID NO: 3390542 - RNA, 16 nt, Pseudomonas aeruginosa PA01
cugcaccgcccagccg

SEQ ID NO: 3390543 - RNA, 21 nt, Pseudomonas aeruginosa PA01
cugcaccgcgcggauccccuc

SEQ ID NO: 3390544 - RNA, 18 nt, Pseudomonas aeruginosa PA01
cugcaccgucauggugcg

SEQ ID NO: 3390545 - RNA, 19 nt, Pseudomonas aeruginosa PA01
cugcaccuuggccacgcug

SEQ ID NO: 3390546 - RNA, 16 nt, Pseudomonas aeruginosa PA01
cugcacgcacgcgccu

SEQ ID NO: 3390547 - RNA, 19 nt, Pseudomonas aeruginosa PA01
cugcacgcacgcgccugcu

SEQ ID NO: 3390548 - RNA, 23 nt, Pseudomonas aeruginosa PA01
cugcacgcagacgucgagguagu

SEQ ID NO: 3390549 - RNA, 15 nt, Pseudomonas aeruginosa PA01
cugcacgcccaggcg

SEQ ID NO: 3390550 - RNA, 12 nt, Pseudomonas aeruginosa PA01
cugcacgcccau

SEQ ID NO: 3390551 - RNA, 22 nt, Pseudomonas aeruginosa PA01
cugcacgcccaucgccaccagc

SEQ ID NO: 3390552 - RNA, 15 nt, Pseudomonas aeruginosa PA01
cugcacgcugcgccg

SEQ ID NO: 3390553 - RNA, 17 nt, Pseudomonas aeruginosa PA01
cugcacgcugcgccggc

SEQ ID NO: 3390554 - RNA, 18 nt, Pseudomonas aeruginosa PA01
cugcacggagugggccgc

SEQ ID NO: 3390555 - RNA, 17 nt, Pseudomonas aeruginosa PA01
cugcacggauaccaccc

SEQ ID NO: 3390556 - RNA, 18 nt, Pseudomonas aeruginosa PA01
cugcacggauaccacccg

SEQ ID NO: 3390557 - RNA, 19 nt, Pseudomonas aeruginosa PA01
cugcacggauaccacccgc

SEQ ID NO: 3390558 - RNA, 23 nt, Pseudomonas aeruginosa PA01
cugcacguugcugugcugcacca

SEQ ID NO: 3390559 - RNA, 18 nt, Pseudomonas aeruginosa PA01
cugcagacgguucagcag

SEQ ID NO: 3390560 - RNA, 23 nt, Pseudomonas aeruginosa PA01
cugcagacgguucagcagcggca

SEQ ID NO: 3390561 - RNA, 17 nt, Pseudomonas aeruginosa PA01
cugcagauaaagcugga

SEQ ID NO: 3390562 - RNA, 19 nt, Pseudomonas aeruginosa PA01
cugcagauaaagcuggacc

SEQ ID NO: 3390563 - RNA, 20 nt, Pseudomonas aeruginosa PA01
cugcagauaaagcuggacca

SEQ ID NO: 3390564 - RNA, 22 nt, Pseudomonas aeruginosa PA01
cugcagcaccaccucgccaagc

SEQ ID NO: 3390565 - RNA, 23 nt, Pseudomonas aeruginosa PA01
cugcagcaccaccucgccaagcu

SEQ ID NO: 3390566 - RNA, 16 nt, Pseudomonas aeruginosa PA01
cugcagccagcuucag

SEQ ID NO: 3390567 - RNA, 18 nt, Pseudomonas aeruginosa PA01
cugcagccagcuucagcc

SEQ ID NO: 3390568 - RNA, 20 nt, Pseudomonas aeruginosa PA01
cugcagccagcuucagccga

SEQ ID NO: 3390569 - RNA, 21 nt, Pseudomonas aeruginosa PA01
cugcagccagcuucagccgac

SEQ ID NO: 3390570 - RNA, 17 nt, Pseudomonas aeruginosa PA01
cugcagccuggcgucgc

SEQ ID NO: 3390571 - RNA, 16 nt, Pseudomonas aeruginosa PA01
cugcagcgacuccagc

SEQ ID NO: 3390572 - RNA, 18 nt, Pseudomonas aeruginosa PA01
cugcagcgacuccagcca

SEQ ID NO: 3390573 - RNA, 19 nt, Pseudomonas aeruginosa PA01
cugcagcgacuccagccag

SEQ ID NO: 3390574 - RNA, 21 nt, Pseudomonas aeruginosa PA01
cugcagcgacuccagccaggc

SEQ ID NO: 3390575 - RNA, 22 nt, Pseudomonas aeruginosa PA01
cugcagcgacuccagccaggcg

SEQ ID NO: 3390576 - RNA, 23 nt, Pseudomonas aeruginosa PA01
cugcagcgacuccagccaggcga

SEQ ID NO: 3390577 - RNA, 11 nt, Pseudomonas aeruginosa PA01
cugcagcgccc

SEQ ID NO: 3390578 - RNA, 18 nt, Pseudomonas aeruginosa PA01
cugcagcgccccagcacc

SEQ ID NO: 3390579 - RNA, 19 nt, Pseudomonas aeruginosa PA01
cugcagcgccccagcaccu

SEQ ID NO: 3390580 - RNA, 11 nt, Pseudomonas aeruginosa PA01
cugcagcgccu

SEQ ID NO: 3390581 - RNA, 21 nt, Pseudomonas aeruginosa PA01
cugcagcgccucguggaacag

SEQ ID NO: 3390582 - RNA, 14 nt, Pseudomonas aeruginosa PA01
cugcagcgcgcgcu

SEQ ID NO: 3390583 - RNA, 16 nt, Pseudomonas aeruginosa PA01
cugcagcucggccugg

SEQ ID NO: 3390584 - RNA, 14 nt, Pseudomonas aeruginosa PA01
cugcagcuugcgcg

SEQ ID NO: 3390585 - RNA, 16 nt, Pseudomonas aeruginosa PA01
cugcagcuugcgcgcc

SEQ ID NO: 3390586 - RNA, 23 nt, Pseudomonas aeruginosa PA01
cugcagcuugcgcgccagggcgg

SEQ ID NO: 3390587 - RNA, 18 nt, Pseudomonas aeruginosa PA01
cugcagcuugugggcaug

SEQ ID NO: 3390588 - RNA, 23 nt, Pseudomonas aeruginosa PA01
cugcagcuugugggcaugcucgg

SEQ ID NO: 3390589 - RNA, 16 nt, Pseudomonas aeruginosa PA01
cugcaggacgaagucg

SEQ ID NO: 3390590 - RNA, 20 nt, Pseudomonas aeruginosa PA01
cugcaggacgaagucgccgg

SEQ ID NO: 3390591 - RNA, 21 nt, Pseudomonas aeruginosa PA01
cugcaggacgaagucgccggc

SEQ ID NO: 3390592 - RNA, 23 nt, Pseudomonas aeruginosa PA01
cugcaggacgaagucgccggcau

SEQ ID NO: 3390593 - RNA, 15 nt, Pseudomonas aeruginosa PA01
cugcaggccaccgga

SEQ ID NO: 3390594 - RNA, 13 nt, Pseudomonas aeruginosa PA01
cugcaggcccugc

SEQ ID NO: 3390595 - RNA, 16 nt, Pseudomonas aeruginosa PA01
cugcaggcccugccag

SEQ ID NO: 3390596 - RNA, 12 nt, Pseudomonas aeruginosa PA01
cugcaggccgaa

SEQ ID NO: 3390597 - RNA, 14 nt, Pseudomonas aeruginosa PA01
cugcaggcgcucca

SEQ ID NO: 3390598 - RNA, 19 nt, Pseudomonas aeruginosa PA01
cugcaggcgguagcgccgc

SEQ ID NO: 3390599 - RNA, 20 nt, Pseudomonas aeruginosa PA01
cugcagggcaucgaccagac

SEQ ID NO: 3390600 - RNA, 14 nt, Pseudomonas aeruginosa PA01
cugcagggccaggg

SEQ ID NO: 3390601 - RNA, 16 nt, Pseudomonas aeruginosa PA01
cugcagggccucgcug

SEQ ID NO: 3390602 - RNA, 14 nt, Pseudomonas aeruginosa PA01
cugcagggcggcgc

SEQ ID NO: 3390603 - RNA, 16 nt, Pseudomonas aeruginosa PA01
cugcagggcggcgcug

SEQ ID NO: 3390604 - RNA, 22 nt, Pseudomonas aeruginosa PA01
cugcagggcguagugcuccucg

SEQ ID NO: 3390605 - RNA, 17 nt, Pseudomonas aeruginosa PA01
cugcagggcgucgccgg

SEQ ID NO: 3390606 - RNA, 17 nt, Pseudomonas aeruginosa PA01
cugcagguaggcggugg

SEQ ID NO: 3390607 - RNA, 19 nt, Pseudomonas aeruginosa PA01
cugcagguaggcgguggcg

SEQ ID NO: 3390608 - RNA, 21 nt, Pseudomonas aeruginosa PA01
cugcagguaggcgguggcgau

SEQ ID NO: 3390609 - RNA, 17 nt, Pseudomonas aeruginosa PA01
cugcaggucgaggcgcu

SEQ ID NO: 3390610 - RNA, 17 nt, Pseudomonas aeruginosa PA01
cugcagguuggcgugca

SEQ ID NO: 3390611 - RNA, 22 nt, Pseudomonas aeruginosa PA01
cugcaucaccaggcugccgccg

SEQ ID NO: 3390612 - RNA, 13 nt, Pseudomonas aeruginosa PA01
cugcaucggcgcg

SEQ ID NO: 3390613 - RNA, 14 nt, Pseudomonas aeruginosa PA01
cugcaucggcgcgc

SEQ ID NO: 3390614 - RNA, 16 nt, Pseudomonas aeruginosa PA01
cugcaucggcgcgccg

SEQ ID NO: 3390615 - RNA, 17 nt, Pseudomonas aeruginosa PA01
cugcaucggcgcgccga

SEQ ID NO: 3390616 - RNA, 20 nt, Pseudomonas aeruginosa PA01
cugcaucggcucggcaagcg

SEQ ID NO: 3390617 - RNA, 18 nt, Pseudomonas aeruginosa PA01
cugcaucucuuccucgcu

SEQ ID NO: 3390618 - RNA, 19 nt, Pseudomonas aeruginosa PA01
cugcaucucuuccucgcug

SEQ ID NO: 3390619 - RNA, 21 nt, Pseudomonas aeruginosa PA01
cugcaugaaaaagcccggccg

SEQ ID NO: 3390620 - RNA, 14 nt, Pseudomonas aeruginosa PA01
cugcaugaccucca

SEQ ID NO: 3390621 - RNA, 16 nt, Pseudomonas aeruginosa PA01
cugcaugaccuccagg

SEQ ID NO: 3390622 - RNA, 16 nt, Pseudomonas aeruginosa PA01
cugcaugccggccguc

SEQ ID NO: 3390623 - RNA, 17 nt, Pseudomonas aeruginosa PA01
cugcaugccggccgucg

SEQ ID NO: 3390624 - RNA, 20 nt, Pseudomonas aeruginosa PA01
cugcaugccggccgucgcgc

SEQ ID NO: 3390625 - RNA, 24 nt, Pseudomonas aeruginosa PA01
cugcaugccggccgucgcgcacca

SEQ ID NO: 3390626 - RNA, 23 nt, Pseudomonas aeruginosa PA01
cugcaugccgggguccgccgguc

SEQ ID NO: 3390627 - RNA, 21 nt, Pseudomonas aeruginosa PA01
cugcaugcuuuugaacaccag

SEQ ID NO: 3390628 - RNA, 14 nt, Pseudomonas aeruginosa PA01
cugcauggccuugu

SEQ ID NO: 3390629 - RNA, 17 nt, Pseudomonas aeruginosa PA01
cugcaugggcucgcgcg

SEQ ID NO: 3390630 - RNA, 19 nt, Pseudomonas aeruginosa PA01
cugcaugggcucgcgcggg

SEQ ID NO: 3390631 - RNA, 16 nt, Pseudomonas aeruginosa PA01
cugcauguccgccagu

SEQ ID NO: 3390632 - RNA, 17 nt, Pseudomonas aeruginosa PA01
cugcaugugccaggccu

SEQ ID NO: 3390633 - RNA, 19 nt, Pseudomonas aeruginosa PA01
cugcaugugccaggccugg

SEQ ID NO: 3390634 - RNA, 24 nt, Pseudomonas aeruginosa PA01
cugcccgcucggggcaucggccau

SEQ ID NO: 3390635 - RNA, 15 nt, Pseudomonas aeruginosa PA01
cugcccggagcggcu

SEQ ID NO: 3390636 - RNA, 19 nt, Pseudomonas aeruginosa PA01
cugcccggagcggcugccg

SEQ ID NO: 3390637 - RNA, 20 nt, Pseudomonas aeruginosa PA01
cugcccggcauaggcgccag

SEQ ID NO: 3390638 - RNA, 21 nt, Pseudomonas aeruginosa PA01
cugcccggcauaggcgccagc

SEQ ID NO: 3390639 - RNA, 19 nt, Pseudomonas aeruginosa PA01
cugcccggcaucgugccgc

SEQ ID NO: 3390640 - RNA, 17 nt, Pseudomonas aeruginosa PA01
cugcccggcgcgacgcu

SEQ ID NO: 3390641 - RNA, 19 nt, Pseudomonas aeruginosa PA01
cugcccggcgcgacgcucc

SEQ ID NO: 3390642 - RNA, 23 nt, Pseudomonas aeruginosa PA01
cugcccgggguuggcgcugacca

SEQ ID NO: 3390643 - RNA, 20 nt, Pseudomonas aeruginosa PA01
cugcccgguggggcgggcga

SEQ ID NO: 3390644 - RNA, 22 nt, Pseudomonas aeruginosa PA01
cugcccgguggggcgggcgaag

SEQ ID NO: 3390645 - RNA, 14 nt, Pseudomonas aeruginosa PA01
cugcccguggcgcg

SEQ ID NO: 3390646 - RNA, 15 nt, Pseudomonas aeruginosa PA01
cugcccguggcgcgg

SEQ ID NO: 3390647 - RNA, 20 nt, Pseudomonas aeruginosa PA01
cugcccguggcgcggacggg

SEQ ID NO: 3390648 - RNA, 15 nt, Pseudomonas aeruginosa PA01
cugcccuccugcucg

SEQ ID NO: 3390649 - RNA, 18 nt, Pseudomonas aeruginosa PA01
cugcccuggcgcgcgccc

SEQ ID NO: 3390650 - RNA, 13 nt, Pseudomonas aeruginosa PA01
cugccgaacagca

SEQ ID NO: 3390651 - RNA, 15 nt, Pseudomonas aeruginosa PA01
cugccgaacagcagg

SEQ ID NO: 3390652 - RNA, 17 nt, Pseudomonas aeruginosa PA01
cugccgaacaggcgucc

SEQ ID NO: 3390653 - RNA, 22 nt, Pseudomonas aeruginosa PA01
cugccgaacaggcgucccaugg

SEQ ID NO: 3390654 - RNA, 18 nt, Pseudomonas aeruginosa PA01
cugccgaagaucgacagg

SEQ ID NO: 3390655 - RNA, 19 nt, Pseudomonas aeruginosa PA01
cugccgaagcccgauccgu

SEQ ID NO: 3390656 - RNA, 22 nt, Pseudomonas aeruginosa PA01
cugccgaagccuucgucgauga

SEQ ID NO: 3390657 - RNA, 23 nt, Pseudomonas aeruginosa PA01
cugccgaagggaaacaccaggcc

SEQ ID NO: 3390658 - RNA, 21 nt, Pseudomonas aeruginosa PA01
cugccgaauugggucugcugg

SEQ ID NO: 3390659 - RNA, 15 nt, Pseudomonas aeruginosa PA01
cugccgacggcggcg

SEQ ID NO: 3390660 - RNA, 23 nt, Pseudomonas aeruginosa PA01
cugccgacggcggcggcggaccu

SEQ ID NO: 3390661 - RNA, 20 nt, Pseudomonas aeruginosa PA01
cugccgagaaucugcccggc

SEQ ID NO: 3390662 - RNA, 22 nt, Pseudomonas aeruginosa PA01
cugccgagcagggucacgccga

SEQ ID NO: 3390663 - RNA, 13 nt, Pseudomonas aeruginosa PA01
cugccgagcuucc

SEQ ID NO: 3390664 - RNA, 14 nt, Pseudomonas aeruginosa PA01
cugccgagcuucca

SEQ ID NO: 3390665 - RNA, 16 nt, Pseudomonas aeruginosa PA01
cugccgaggaacucgc

SEQ ID NO: 3390666 - RNA, 14 nt, Pseudomonas aeruginosa PA01
cugccgaggccgag

SEQ ID NO: 3390667 - RNA, 13 nt, Pseudomonas aeruginosa PA01
cugccgaucagcc

SEQ ID NO: 3390668 - RNA, 16 nt, Pseudomonas aeruginosa PA01
cugccgauccuugucg

SEQ ID NO: 3390669 - RNA, 14 nt, Pseudomonas aeruginosa PA01
cugccgaucgccgc

SEQ ID NO: 3390670 - RNA, 15 nt, Pseudomonas aeruginosa PA01
cugccgaucgccgcg

SEQ ID NO: 3390671 - RNA, 16 nt, Pseudomonas aeruginosa PA01
cugccgaucgccgcgc

SEQ ID NO: 3390672 - RNA, 19 nt, Pseudomonas aeruginosa PA01
cugccgaucgccgcgcggu

SEQ ID NO: 3390673 - RNA, 16 nt, Pseudomonas aeruginosa PA01
cugccgaugggccuuc

SEQ ID NO: 3390674 - RNA, 20 nt, Pseudomonas aeruginosa PA01
cugccgauggucucucucug

SEQ ID NO: 3390675 - RNA, 21 nt, Pseudomonas aeruginosa PA01
cugccgauggugauacgcagg

SEQ ID NO: 3390676 - RNA, 16 nt, Pseudomonas aeruginosa PA01
cugccgcaccgccucg

SEQ ID NO: 3390677 - RNA, 17 nt, Pseudomonas aeruginosa PA01
cugccgcagaucaucgc

SEQ ID NO: 3390678 - RNA, 14 nt, Pseudomonas aeruginosa PA01
cugccgcagcgccu

SEQ ID NO: 3390679 - RNA, 16 nt, Pseudomonas aeruginosa PA01
cugccgcagcgccucc

SEQ ID NO: 3390680 - RNA, 23 nt, Pseudomonas aeruginosa PA01
cugccgcagcgccucccgggccu

SEQ ID NO: 3390681 - RNA, 19 nt, Pseudomonas aeruginosa PA01
cugccgcaggcgggcgcca

SEQ ID NO: 3390682 - RNA, 19 nt, Pseudomonas aeruginosa PA01
cugccgcaguagaugccgc

SEQ ID NO: 3390683 - RNA, 22 nt, Pseudomonas aeruginosa PA01
cugccgccagcucauggagcaa

SEQ ID NO: 3390684 - RNA, 19 nt, Pseudomonas aeruginosa PA01
cugccgcccggccaggcca

SEQ ID NO: 3390685 - RNA, 14 nt, Pseudomonas aeruginosa PA01
cugccgcccggucu

SEQ ID NO: 3390686 - RNA, 18 nt, Pseudomonas aeruginosa PA01
cugccgcccucgggccgc

SEQ ID NO: 3390687 - RNA, 14 nt, Pseudomonas aeruginosa PA01
cugccgccgcagag

SEQ ID NO: 3390688 - RNA, 16 nt, Pseudomonas aeruginosa PA01
cugccgccgcagagcc

SEQ ID NO: 3390689 - RNA, 20 nt, Pseudomonas aeruginosa PA01
cugccgccgcagagccagcc

SEQ ID NO: 3390690 - RNA, 23 nt, Pseudomonas aeruginosa PA01
cugccgccgcagagccagccgca

SEQ ID NO: 3390691 - RNA, 20 nt, Pseudomonas aeruginosa PA01
cugccgccgccgucgacacc

SEQ ID NO: 3390692 - RNA, 15 nt, Pseudomonas aeruginosa PA01
cugccgccgcgcagg

SEQ ID NO: 3390693 - RNA, 18 nt, Pseudomonas aeruginosa PA01
cugccgccgcgcaggcgg

SEQ ID NO: 3390694 - RNA, 13 nt, Pseudomonas aeruginosa PA01
cugccgccgcgcc

SEQ ID NO: 3390695 - RNA, 14 nt, Pseudomonas aeruginosa PA01
cugccgccgcgccc

SEQ ID NO: 3390696 - RNA, 22 nt, Pseudomonas aeruginosa PA01
cugccgccgcgcccggcgccag

SEQ ID NO: 3390697 - RNA, 13 nt, Pseudomonas aeruginosa PA01
cugccgccgcgcu

SEQ ID NO: 3390698 - RNA, 21 nt, Pseudomonas aeruginosa PA01
cugccgccgcgcugcaggcgg

SEQ ID NO: 3390699 - RNA, 20 nt, Pseudomonas aeruginosa PA01
cugccgccgucuccgccgcu

SEQ ID NO: 3390700 - RNA, 14 nt, Pseudomonas aeruginosa PA01
cugccgccuguucg

SEQ ID NO: 3390701 - RNA, 14 nt, Pseudomonas aeruginosa PA01
cugccgccuucgcg

SEQ ID NO: 3390702 - RNA, 18 nt, Pseudomonas aeruginosa PA01
cugccgccuucgcgggcc

SEQ ID NO: 3390703 - RNA, 14 nt, Pseudomonas aeruginosa PA01
cugccgcgacagga

SEQ ID NO: 3390704 - RNA, 20 nt, Pseudomonas aeruginosa PA01
cugccgcgacaggauggaca

SEQ ID NO: 3390705 - RNA, 13 nt, Pseudomonas aeruginosa PA01
cugccgcgccgga

SEQ ID NO: 3390706 - RNA, 21 nt, Pseudomonas aeruginosa PA01
cugccgcggaagugcgccggu

SEQ ID NO: 3390707 - RNA, 22 nt, Pseudomonas aeruginosa PA01
cugccgcguuccuugugcacga

SEQ ID NO: 3390708 - RNA, 22 nt, Pseudomonas aeruginosa PA01
cugccgcuaucgcuggcgcagc

SEQ ID NO: 3390709 - RNA, 16 nt, Pseudomonas aeruginosa PA01
cugccgcucguuggcg

SEQ ID NO: 3390710 - RNA, 18 nt, Pseudomonas aeruginosa PA01
cugccgcucguuggcggc

SEQ ID NO: 3390711 - RNA, 13 nt, Pseudomonas aeruginosa PA01
cugccgcucuggc

SEQ ID NO: 3390712 - RNA, 16 nt, Pseudomonas aeruginosa PA01
cugccgcucuggcugc

SEQ ID NO: 3390713 - RNA, 22 nt, Pseudomonas aeruginosa PA01
cugccgcucuggcugcuggcga

SEQ ID NO: 3390714 - RNA, 14 nt, Pseudomonas aeruginosa PA01
cugccggcacgcuc

SEQ ID NO: 3390715 - RNA, 18 nt, Pseudomonas aeruginosa PA01
cugccggcacgcucaggc

SEQ ID NO: 3390716 - RNA, 21 nt, Pseudomonas aeruginosa PA01
cugccggcacgcucaggcgca

SEQ ID NO: 3390717 - RNA, 23 nt, Pseudomonas aeruginosa PA01
cugccggccaccaucacgucgcg

SEQ ID NO: 3390718 - RNA, 20 nt, Pseudomonas aeruginosa PA01
cugccggccagggucgccag

SEQ ID NO: 3390719 - RNA, 18 nt, Pseudomonas aeruginosa PA01
cugccggccagguagcgg

SEQ ID NO: 3390720 - RNA, 13 nt, Pseudomonas aeruginosa PA01
cugccggcgcaga

SEQ ID NO: 3390721 - RNA, 22 nt, Pseudomonas aeruginosa PA01
cugccggcgcagaucgcggcgc

SEQ ID NO: 3390722 - RNA, 23 nt, Pseudomonas aeruginosa PA01
cugccggcgcagaucgcggcgca

SEQ ID NO: 3390723 - RNA, 12 nt, Pseudomonas aeruginosa PA01
cugccggcgcgc

SEQ ID NO: 3390724 - RNA, 18 nt, Pseudomonas aeruginosa PA01
cugccggcgucguccugc

SEQ ID NO: 3390725 - RNA, 22 nt, Pseudomonas aeruginosa PA01
cugccgggcaagcucgacgagc

SEQ ID NO: 3390726 - RNA, 15 nt, Pseudomonas aeruginosa PA01
cugccgggccagcuc

SEQ ID NO: 3390727 - RNA, 23 nt, Pseudomonas aeruginosa PA01
cugccgggcguuuucguugccgc

SEQ ID NO: 3390728 - RNA, 13 nt, Pseudomonas aeruginosa PA01
cugccgggcucug

SEQ ID NO: 3390729 - RNA, 20 nt, Pseudomonas aeruginosa PA01
cugccgggcucugguagccg

SEQ ID NO: 3390730 - RNA, 20 nt, Pseudomonas aeruginosa PA01
cugccgggcucuucggaggu

SEQ ID NO: 3390731 - RNA, 22 nt, Pseudomonas aeruginosa PA01
cugccgggcuuuuucaugggcg

SEQ ID NO: 3390732 - RNA, 20 nt, Pseudomonas aeruginosa PA01
cugccgguaauuggccaggc

SEQ ID NO: 3390733 - RNA, 23 nt, Pseudomonas aeruginosa PA01
cugccgguaauuggccaggcucg

SEQ ID NO: 3390734 - RNA, 18 nt, Pseudomonas aeruginosa PA01
cugccgguacgcaccagc

SEQ ID NO: 3390735 - RNA, 19 nt, Pseudomonas aeruginosa PA01
cugccgguacgcaccagcg

SEQ ID NO: 3390736 - RNA, 21 nt, Pseudomonas aeruginosa PA01
cugcgccgccgucuugccgcu

SEQ ID NO: 3390737 - RNA, 23 nt, Pseudomonas aeruginosa PA01
cugcgccgccgucuugccgcugc

SEQ ID NO: 3390738 - RNA, 12 nt, Pseudomonas aeruginosa PA01
cugcgccgccuu

SEQ ID NO: 3390739 - RNA, 23 nt, Pseudomonas aeruginosa PA01
cugcgccgccuuucugcccggcu

SEQ ID NO: 3390740 - RNA, 15 nt, Pseudomonas aeruginosa PA01
cugcgccgcugcggc

SEQ ID NO: 3390741 - RNA, 16 nt, Pseudomonas aeruginosa PA01
cugcgccggaccagau

SEQ ID NO: 3390742 - RNA, 13 nt, Pseudomonas aeruginosa PA01
cugcgccggcgcu

SEQ ID NO: 3390743 - RNA, 14 nt, Pseudomonas aeruginosa PA01
cugcgccggcgcug

SEQ ID NO: 3390744 - RNA, 13 nt, Pseudomonas aeruginosa PA01
cugcgccggcucg

SEQ ID NO: 3390745 - RNA, 17 nt, Pseudomonas aeruginosa PA01
cugcgccggcucgugcg

SEQ ID NO: 3390746 - RNA, 19 nt, Pseudomonas aeruginosa PA01
cugcgccguuucgacgaug

SEQ ID NO: 3390747 - RNA, 20 nt, Pseudomonas aeruginosa PA01
cugcgccguuucgacgaugc

SEQ ID NO: 3390748 - RNA, 12 nt, Pseudomonas aeruginosa PA01
cugcgccuccuc

SEQ ID NO: 3390749 - RNA, 14 nt, Pseudomonas aeruginosa PA01
cugcgccuccucgg

SEQ ID NO: 3390750 - RNA, 21 nt, Pseudomonas aeruginosa PA01
cugcgccuccucggcggccuu

SEQ ID NO: 3390751 - RNA, 22 nt, Pseudomonas aeruginosa PA01
cugcgccuccucggcggccuuu

SEQ ID NO: 3390752 - RNA, 13 nt, Pseudomonas aeruginosa PA01
cugcgccucgacc

SEQ ID NO: 3390753 - RNA, 16 nt, Pseudomonas aeruginosa PA01
cugcgccucgaccugg

SEQ ID NO: 3390754 - RNA, 19 nt, Pseudomonas aeruginosa PA01
cugcgccucgaccuggcca

SEQ ID NO: 3390755 - RNA, 23 nt, Pseudomonas aeruginosa PA01
cugcgccucgaccuggccacgcc

SEQ ID NO: 3390756 - RNA, 13 nt, Pseudomonas aeruginosa PA01
cugcgccucgcug

SEQ ID NO: 3390757 - RNA, 23 nt, Pseudomonas aeruginosa PA01
cugcgccucgcuggcguucucca

SEQ ID NO: 3390758 - RNA, 20 nt, Pseudomonas aeruginosa PA01
cugcgccucggcccuggcgg

SEQ ID NO: 3390759 - RNA, 17 nt, Pseudomonas aeruginosa PA01
cugcgccugcagcucgg

SEQ ID NO: 3390760 - RNA, 13 nt, Pseudomonas aeruginosa PA01
cugcgccuggccg

SEQ ID NO: 3390761 - RNA, 14 nt, Pseudomonas aeruginosa PA01
cugcgccuggccgc

SEQ ID NO: 3390762 - RNA, 16 nt, Pseudomonas aeruginosa PA01
cugcgccuggccgcgc

SEQ ID NO: 3390763 - RNA, 17 nt, Pseudomonas aeruginosa PA01
cugcgccuggccgcgca

SEQ ID NO: 3390764 - RNA, 19 nt, Pseudomonas aeruginosa PA01
cugcgccuggccgcgcagg

SEQ ID NO: 3390765 - RNA, 16 nt, Pseudomonas aeruginosa PA01
cugcgcgaagccagga

SEQ ID NO: 3390766 - RNA, 16 nt, Pseudomonas aeruginosa PA01
cugcgcgaucccccgc

SEQ ID NO: 3390767 - RNA, 17 nt, Pseudomonas aeruginosa PA01
cugcgcgcaccaggccu

SEQ ID NO: 3390768 - RNA, 19 nt, Pseudomonas aeruginosa PA01
cugcgcgcaccaggccucc

SEQ ID NO: 3390769 - RNA, 21 nt, Pseudomonas aeruginosa PA01
cugcgcgccaccaccgucacg

SEQ ID NO: 3390770 - RNA, 19 nt, Pseudomonas aeruginosa PA01
cugcgcgccaucuccucgc

SEQ ID NO: 3390771 - RNA, 20 nt, Pseudomonas aeruginosa PA01
cugcgcgccaucuccucgcu

SEQ ID NO: 3390772 - RNA, 21 nt, Pseudomonas aeruginosa PA01
cugcgcgccaucuccucgcug

SEQ ID NO: 3390773 - RNA, 13 nt, Pseudomonas aeruginosa PA01
cugcgcgccgggu

SEQ ID NO: 3390774 - RNA, 15 nt, Pseudomonas aeruginosa PA01
cugcgcgccucuucc

SEQ ID NO: 3390775 - RNA, 16 nt, Pseudomonas aeruginosa PA01
cugcgcgccucuuccu

SEQ ID NO: 3390776 - RNA, 22 nt, Pseudomonas aeruginosa PA01
cugcgcgccucuuccuggaccu

SEQ ID NO: 3390777 - RNA, 22 nt, Pseudomonas aeruginosa PA01
cugcgcggacguaacggcuuga

SEQ ID NO: 3390778 - RNA, 16 nt, Pseudomonas aeruginosa PA01
cugcgcggcgacgauc

SEQ ID NO: 3390779 - RNA, 20 nt, Pseudomonas aeruginosa PA01
cugcgcggcguucgcccugc

SEQ ID NO: 3390780 - RNA, 13 nt, Pseudomonas aeruginosa PA01
cugcgcgggacgc

SEQ ID NO: 3390781 - RNA, 13 nt, Pseudomonas aeruginosa PA01
cugcgcgggcaug

SEQ ID NO: 3390782 - RNA, 20 nt, Pseudomonas aeruginosa PA01
cugcgcgggucguccuccac

SEQ ID NO: 3390783 - RNA, 17 nt, Pseudomonas aeruginosa PA01
cugcgcgggugucgcga

SEQ ID NO: 3390784 - RNA, 16 nt, Pseudomonas aeruginosa PA01
cugcgcguguaccccc

SEQ ID NO: 3390785 - RNA, 19 nt, Pseudomonas aeruginosa PA01
cugcgcguguacccccacc

SEQ ID NO: 3390786 - RNA, 14 nt, Pseudomonas aeruginosa PA01
cugcgcguugcagc

SEQ ID NO: 3390787 - RNA, 20 nt, Pseudomonas aeruginosa PA01
cugcgcguugcagcgccugu

SEQ ID NO: 3390788 - RNA, 22 nt, Pseudomonas aeruginosa PA01
cugcgcguugcagcgccuguuc

SEQ ID NO: 3390789 - RNA, 23 nt, Pseudomonas aeruginosa PA01
cugcgcguugcagcgccuguucc

SEQ ID NO: 3390790 - RNA, 12 nt, Pseudomonas aeruginosa PA01
cugcgcucaccu

SEQ ID NO: 3390791 - RNA, 13 nt, Pseudomonas aeruginosa PA01
cugcgcuccaggc

SEQ ID NO: 3390792 - RNA, 12 nt, Pseudomonas aeruginosa PA01
cugcgcucggcg

SEQ ID NO: 3390793 - RNA, 14 nt, Pseudomonas aeruginosa PA01
cugcgcucggcgcu

SEQ ID NO: 3390794 - RNA, 16 nt, Pseudomonas aeruginosa PA01
cugcgcucggcgcucg

SEQ ID NO: 3390795 - RNA, 21 nt, Pseudomonas aeruginosa PA01
cugcgcucggcgcucggcucc

SEQ ID NO: 3390796 - RNA, 15 nt, Pseudomonas aeruginosa PA01
cugcgcugccagcgc

SEQ ID NO: 3390797 - RNA, 15 nt, Pseudomonas aeruginosa PA01
cugcgcuggccgagc

SEQ ID NO: 3390798 - RNA, 12 nt, Pseudomonas aeruginosa PA01
cugcgcugggcg

SEQ ID NO: 3390799 - RNA, 16 nt, Pseudomonas aeruginosa PA01
cugcgcugggcgccga

SEQ ID NO: 3390800 - RNA, 13 nt, Pseudomonas aeruginosa PA01
cugcgcuguucgg

SEQ ID NO: 3390801 - RNA, 16 nt, Pseudomonas aeruginosa PA01
cugcgcuuccggcagc

SEQ ID NO: 3390802 - RNA, 17 nt, Pseudomonas aeruginosa PA01
cugcgcuuccggcagcc

SEQ ID NO: 3390803 - RNA, 18 nt, Pseudomonas aeruginosa PA01
cugcgcuuccggcagcca

SEQ ID NO: 3390804 - RNA, 19 nt, Pseudomonas aeruginosa PA01
cugcgcuucguuggcgacg

SEQ ID NO: 3390805 - RNA, 20 nt, Pseudomonas aeruginosa PA01
cugcgcuucguuggcgacga

SEQ ID NO: 3390806 - RNA, 23 nt, Pseudomonas aeruginosa PA01
cugcggaagagguacggccuuca

SEQ ID NO: 3390807 - RNA, 19 nt, Pseudomonas aeruginosa PA01
cugcggacuaccuucgauc

SEQ ID NO: 3390808 - RNA, 18 nt, Pseudomonas aeruginosa PA01
cugcggaucaacuccgcc

SEQ ID NO: 3390809 - RNA, 13 nt, Pseudomonas aeruginosa PA01
cugcggaucgagg

SEQ ID NO: 3390810 - RNA, 15 nt, Pseudomonas aeruginosa PA01
cugcggaucgaucag

SEQ ID NO: 3390811 - RNA, 14 nt, Pseudomonas aeruginosa PA01
cugcggauggcgcg

SEQ ID NO: 3390812 - RNA, 15 nt, Pseudomonas aeruginosa PA01
cugcggauggcgcgg

SEQ ID NO: 3390813 - RNA, 14 nt, Pseudomonas aeruginosa PA01
cugcggaugucacg

SEQ ID NO: 3390814 - RNA, 19 nt, Pseudomonas aeruginosa PA01
cugcggauucaucggcggc

SEQ ID NO: 3390815 - RNA, 14 nt, Pseudomonas aeruginosa PA01
cugcggcaggcgcc

SEQ ID NO: 3390816 - RNA, 15 nt, Pseudomonas aeruginosa PA01
cugcggcaggcgcca

SEQ ID NO: 3390817 - RNA, 15 nt, Pseudomonas aeruginosa PA01
cugcggccagcgcca

SEQ ID NO: 3390818 - RNA, 16 nt, Pseudomonas aeruginosa PA01
cugcggccagcgccag

SEQ ID NO: 3390819 - RNA, 17 nt, Pseudomonas aeruginosa PA01
cugcggccagcgccagg

SEQ ID NO: 3390820 - RNA, 18 nt, Pseudomonas aeruginosa PA01
cugcggccagcgccagga

SEQ ID NO: 3390821 - RNA, 20 nt, Pseudomonas aeruginosa PA01
cugcggccccaaggggccgc

SEQ ID NO: 3390822 - RNA, 23 nt, Pseudomonas aeruginosa PA01
cugcggccccaaggggccgcgcu

SEQ ID NO: 3390823 - RNA, 17 nt, Pseudomonas aeruginosa PA01
cugcggcccgagggcgg

SEQ ID NO: 3390824 - RNA, 18 nt, Pseudomonas aeruginosa PA01
cugcggcccgagggcggc

SEQ ID NO: 3390825 - RNA, 19 nt, Pseudomonas aeruginosa PA01
cugcggcccgagggcggca

SEQ ID NO: 3390826 - RNA, 21 nt, Pseudomonas aeruginosa PA01
cugcggcccgagggcggcagg

SEQ ID NO: 3390827 - RNA, 23 nt, Pseudomonas aeruginosa PA01
cugcggccgagcauguaggcgca

SEQ ID NO: 3390828 - RNA, 13 nt, Pseudomonas aeruginosa PA01
cugcggccggcgc

SEQ ID NO: 3390829 - RNA, 14 nt, Pseudomonas aeruginosa PA01
cugcggccggcgcg

SEQ ID NO: 3390830 - RNA, 12 nt, Pseudomonas aeruginosa PA01
cugcggcgccgg

SEQ ID NO: 3390831 - RNA, 21 nt, Pseudomonas aeruginosa PA01
cugcggcgccuagacccuggg

SEQ ID NO: 3390832 - RNA, 19 nt, Pseudomonas aeruginosa PA01
cugcggcggaaggcggcgu

SEQ ID NO: 3390833 - RNA, 22 nt, Pseudomonas aeruginosa PA01
cugcggcggaaggcggcgucgu

SEQ ID NO: 3390834 - RNA, 22 nt, Pseudomonas aeruginosa PA01
cugcggcggcaccacgugcagc

SEQ ID NO: 3390835 - RNA, 13 nt, Pseudomonas aeruginosa PA01
cugcggcggcagg

SEQ ID NO: 3390836 - RNA, 14 nt, Pseudomonas aeruginosa PA01
cugcggcggcaggu

SEQ ID NO: 3390837 - RNA, 22 nt, Pseudomonas aeruginosa PA01
cugcggcggucccagaccagca

SEQ ID NO: 3390838 - RNA, 22 nt, Pseudomonas aeruginosa PA01
cugcggcggucccuucgugggc

SEQ ID NO: 3390839 - RNA, 23 nt, Pseudomonas aeruginosa PA01
cugcucgauggcggccugguagu

SEQ ID NO: 3390840 - RNA, 14 nt, Pseudomonas aeruginosa PA01
cugcucgcagccgg

SEQ ID NO: 3390841 - RNA, 13 nt, Pseudomonas aeruginosa PA01
cugcucgccgccg

SEQ ID NO: 3390842 - RNA, 16 nt, Pseudomonas aeruginosa PA01
cugcucgccgccggcg

SEQ ID NO: 3390843 - RNA, 12 nt, Pseudomonas aeruginosa PA01
cugcucgccgcu

SEQ ID NO: 3390844 - RNA, 16 nt, Pseudomonas aeruginosa PA01
cugcucgccggcgcgg

SEQ ID NO: 3390845 - RNA, 18 nt, Pseudomonas aeruginosa PA01
cugcucgccggcgcgggc

SEQ ID NO: 3390846 - RNA, 20 nt, Pseudomonas aeruginosa PA01
cugcucgccucgggccauga

SEQ ID NO: 3390847 - RNA, 17 nt, Pseudomonas aeruginosa PA01
cugcucgcgcagccagg

SEQ ID NO: 3390848 - RNA, 18 nt, Pseudomonas aeruginosa PA01
cugcucgcgcagccaggc

SEQ ID NO: 3390849 - RNA, 19 nt, Pseudomonas aeruginosa PA01
cugcucgcgcagccaggcg

SEQ ID NO: 3390850 - RNA, 11 nt, Pseudomonas aeruginosa PA01
cugcucgcgcu

SEQ ID NO: 3390851 - RNA, 13 nt, Pseudomonas aeruginosa PA01
cugcucgcggcug

SEQ ID NO: 3390852 - RNA, 14 nt, Pseudomonas aeruginosa PA01
cugcucgcggcugg

SEQ ID NO: 3390853 - RNA, 17 nt, Pseudomonas aeruginosa PA01
cugcucgcugcccgacg

SEQ ID NO: 3390854 - RNA, 22 nt, Pseudomonas aeruginosa PA01
cugcucggcauucgacccgccg

SEQ ID NO: 3390855 - RNA, 24 nt, Pseudomonas aeruginosa PA01
cugcucggcauucgacccgccgac

SEQ ID NO: 3390856 - RNA, 13 nt, Pseudomonas aeruginosa PA01
cugcucggccugc

SEQ ID NO: 3390857 - RNA, 18 nt, Pseudomonas aeruginosa PA01
cugcucggccugcugcgc

SEQ ID NO: 3390858 - RNA, 22 nt, Pseudomonas aeruginosa PA01
cugcucggccugcugcgccggc

SEQ ID NO: 3390859 - RNA, 23 nt, Pseudomonas aeruginosa PA01
cugcucggcgguggggaagcgau

SEQ ID NO: 3390860 - RNA, 17 nt, Pseudomonas aeruginosa PA01
cugcucggcguccagca

SEQ ID NO: 3390861 - RNA, 16 nt, Pseudomonas aeruginosa PA01
cugcucggcucgcggu

SEQ ID NO: 3390862 - RNA, 22 nt, Pseudomonas aeruginosa PA01
cugcucgggcgucuccugccgc

SEQ ID NO: 3390863 - RNA, 22 nt, Pseudomonas aeruginosa PA01
cugcucgguauggcugcugugc

SEQ ID NO: 3390864 - RNA, 16 nt, Pseudomonas aeruginosa PA01
cugcucguccaggccg

SEQ ID NO: 3390865 - RNA, 18 nt, Pseudomonas aeruginosa PA01
cugcucguccaggccgca

SEQ ID NO: 3390866 - RNA, 20 nt, Pseudomonas aeruginosa PA01
cugcucguccaggccgcagg

SEQ ID NO: 3390867 - RNA, 15 nt, Pseudomonas aeruginosa PA01
cugcucuuccagcgg

SEQ ID NO: 3390868 - RNA, 17 nt, Pseudomonas aeruginosa PA01
cugcucuuccagcgggc

SEQ ID NO: 3390869 - RNA, 22 nt, Pseudomonas aeruginosa PA01
cugcucuucggcggccagcgga

SEQ ID NO: 3390870 - RNA, 20 nt, Pseudomonas aeruginosa PA01
cugcugaaaaacgccugggc

SEQ ID NO: 3390871 - RNA, 21 nt, Pseudomonas aeruginosa PA01
cugcugaaaaacgccugggcg

SEQ ID NO: 3390872 - RNA, 22 nt, Pseudomonas aeruginosa PA01
cugcugaaaaacgccugggcgu

SEQ ID NO: 3390873 - RNA, 13 nt, Pseudomonas aeruginosa PA01
cugcugaucagga

SEQ ID NO: 3390874 - RNA, 16 nt, Pseudomonas aeruginosa PA01
cugcugaucaggagga

SEQ ID NO: 3390875 - RNA, 21 nt, Pseudomonas aeruginosa PA01
cugcugaucaggaggaucgcc

SEQ ID NO: 3390876 - RNA, 23 nt, Pseudomonas aeruginosa PA01
cugcugaucaggaggaucgccag

SEQ ID NO: 3390877 - RNA, 17 nt, Pseudomonas aeruginosa PA01
cugcugcaacauggcgu

SEQ ID NO: 3390878 - RNA, 23 nt, Pseudomonas aeruginosa PA01
cugcugcaacauggcgucggcga

SEQ ID NO: 3390879 - RNA, 16 nt, Pseudomonas aeruginosa PA01
cugcugccauccgcgc

SEQ ID NO: 3390880 - RNA, 19 nt, Pseudomonas aeruginosa PA01
cugcugccauccgcgccga

SEQ ID NO: 3390881 - RNA, 21 nt, Pseudomonas aeruginosa PA01
cugcugccauccgcgccgacc

SEQ ID NO: 3390882 - RNA, 22 nt, Pseudomonas aeruginosa PA01
cugcugccauccgcgccgacca

SEQ ID NO: 3390883 - RNA, 15 nt, Pseudomonas aeruginosa PA01
cugcugcccggcaua

SEQ ID NO: 3390884 - RNA, 13 nt, Pseudomonas aeruginosa PA01
cugcugccggcuu

SEQ ID NO: 3390885 - RNA, 16 nt, Pseudomonas aeruginosa PA01
cugcugcgccuggccg

SEQ ID NO: 3390886 - RNA, 17 nt, Pseudomonas aeruginosa PA01
cugcugcgccuggccgc

SEQ ID NO: 3390887 - RNA, 15 nt, Pseudomonas aeruginosa PA01
cugcugcgcgcacca

SEQ ID NO: 3390888 - RNA, 13 nt, Pseudomonas aeruginosa PA01
cugcugcgcgggu

SEQ ID NO: 3390889 - RNA, 13 nt, Pseudomonas aeruginosa PA01
cugcugcgggcgc

SEQ ID NO: 3390890 - RNA, 14 nt, Pseudomonas aeruginosa PA01
cugcugcgggcgcu

SEQ ID NO: 3390891 - RNA, 18 nt, Pseudomonas aeruginosa PA01
cugcugcgggcgcugcau

SEQ ID NO: 3390892 - RNA, 16 nt, Pseudomonas aeruginosa PA01
cugcugcggggccgga

SEQ ID NO: 3390893 - RNA, 14 nt, Pseudomonas aeruginosa PA01
cugcugcggggccu

SEQ ID NO: 3390894 - RNA, 13 nt, Pseudomonas aeruginosa PA01
cugcugcucagcg

SEQ ID NO: 3390895 - RNA, 17 nt, Pseudomonas aeruginosa PA01
cugcugcucagcgcgcu

SEQ ID NO: 3390896 - RNA, 23 nt, Pseudomonas aeruginosa PA01
cugcugcucagcgcgcucggccu

SEQ ID NO: 3390897 - RNA, 22 nt, Pseudomonas aeruginosa PA01
cugcugcucgaccgccugcucg

SEQ ID NO: 3390898 - RNA, 16 nt, Pseudomonas aeruginosa PA01
cugcugcucgccaugg

SEQ ID NO: 3390899 - RNA, 17 nt, Pseudomonas aeruginosa PA01
cugcugcugcggcuucg

SEQ ID NO: 3390900 - RNA, 23 nt, Pseudomonas aeruginosa PA01
cugcugcuugcgccguggcacca

SEQ ID NO: 3390901 - RNA, 19 nt, Pseudomonas aeruginosa PA01
cugcuggauccucgccucg

SEQ ID NO: 3390902 - RNA, 21 nt, Pseudomonas aeruginosa PA01
cugcuggauggggcugaucuc

SEQ ID NO: 3390903 - RNA, 13 nt, Pseudomonas aeruginosa PA01
cugcuggccaccc

SEQ ID NO: 3390904 - RNA, 18 nt, Pseudomonas aeruginosa PA01
cugcuggccaccgcggcg

SEQ ID NO: 3390905 - RNA, 23 nt, Pseudomonas aeruginosa PA01
cugcuggccgcccuugcggcccg

SEQ ID NO: 3390906 - RNA, 16 nt, Pseudomonas aeruginosa PA01
cugcuggccgcgcagg

SEQ ID NO: 3390907 - RNA, 14 nt, Pseudomonas aeruginosa PA01
cugcuggccggugc

SEQ ID NO: 3390908 - RNA, 20 nt, Pseudomonas aeruginosa PA01
cugcuggccggugccgcccu

SEQ ID NO: 3390909 - RNA, 17 nt, Pseudomonas aeruginosa PA01
cugcuggccugggacgg

SEQ ID NO: 3390910 - RNA, 19 nt, Pseudomonas aeruginosa PA01
cugcuggccugggacggcg

SEQ ID NO: 3390911 - RNA, 22 nt, Pseudomonas aeruginosa PA01
cugcuggcgaauuuccugcugg

SEQ ID NO: 3390912 - RNA, 24 nt, Pseudomonas aeruginosa PA01
cugcuggcgaauuuccugcuggcg

SEQ ID NO: 3390913 - RNA, 16 nt, Pseudomonas aeruginosa PA01
cugcuggcgcagccag

SEQ ID NO: 3390914 - RNA, 18 nt, Pseudomonas aeruginosa PA01
cugcuggcgcagccaggc

SEQ ID NO: 3390915 - RNA, 20 nt, Pseudomonas aeruginosa PA01
cugcuggcgcagccaggcga

SEQ ID NO: 3390916 - RNA, 14 nt, Pseudomonas aeruginosa PA01
cugcuggcgccgcu

SEQ ID NO: 3390917 - RNA, 23 nt, Pseudomonas aeruginosa PA01
cugcuggcugcccaguugcgcgg

SEQ ID NO: 3390918 - RNA, 16 nt, Pseudomonas aeruginosa PA01
cugcuggcuggcaggu

SEQ ID NO: 3390919 - RNA, 13 nt, Pseudomonas aeruginosa PA01
cugcugggccagc

SEQ ID NO: 3390920 - RNA, 16 nt, Pseudomonas aeruginosa PA01
cugcugggccagcgcc

SEQ ID NO: 3390921 - RNA, 14 nt, Pseudomonas aeruginosa PA01
cugcugggcggcga

SEQ ID NO: 3390922 - RNA, 14 nt, Pseudomonas aeruginosa PA01
cugcugggcgucga

SEQ ID NO: 3390923 - RNA, 22 nt, Pseudomonas aeruginosa PA01
cugcugggcgucgaacaccggc

SEQ ID NO: 3390924 - RNA, 23 nt, Pseudomonas aeruginosa PA01
cugcuggggaacugggcgagcau

SEQ ID NO: 3390925 - RNA, 19 nt, Pseudomonas aeruginosa PA01
cugcuggguacgguuggcc

SEQ ID NO: 3390926 - RNA, 21 nt, Pseudomonas aeruginosa PA01
cugcuggguacgguuggccag

SEQ ID NO: 3390927 - RNA, 20 nt, Pseudomonas aeruginosa PA01
cugcugggucaucgaggcca

SEQ ID NO: 3390928 - RNA, 23 nt, Pseudomonas aeruginosa PA01
cugcugggucaucgaggccaucc

SEQ ID NO: 3390929 - RNA, 16 nt, Pseudomonas aeruginosa PA01
cugcugguagcugcug

SEQ ID NO: 3390930 - RNA, 21 nt, Pseudomonas aeruginosa PA01
cugcugguagcugcugccggc

SEQ ID NO: 3390931 - RNA, 18 nt, Pseudomonas aeruginosa PA01
cugcugguccuggcgcga

SEQ ID NO: 3390932 - RNA, 23 nt, Pseudomonas aeruginosa PA01
cugcuggugggugaucucgcuga

SEQ ID NO: 3390933 - RNA, 11 nt, Pseudomonas aeruginosa PA01
cugcugguuga

SEQ ID NO: 3390934 - RNA, 14 nt, Pseudomonas aeruginosa PA01
cugcugguugacca

SEQ ID NO: 3390935 - RNA, 15 nt, Pseudomonas aeruginosa PA01
cugcugguugaggcc

SEQ ID NO: 3390936 - RNA, 14 nt, Pseudomonas aeruginosa PA01
cugcuguccagcgc

SEQ ID NO: 3390937 - RNA, 13 nt, Pseudomonas aeruginosa PA01
cugcugucgaggg

SEQ ID NO: 3390938 - RNA, 22 nt, Pseudomonas aeruginosa PA01
cugcugucgagggucugcucga

SEQ ID NO: 3390939 - RNA, 14 nt, Pseudomonas aeruginosa PA01
cugcugugcgucga

SEQ ID NO: 3390940 - RNA, 15 nt, Pseudomonas aeruginosa PA01
cugcugugcguuucg

SEQ ID NO: 3390941 - RNA, 18 nt, Pseudomonas aeruginosa PA01
cuggauaucugggccauc

SEQ ID NO: 3390942 - RNA, 16 nt, Pseudomonas aeruginosa PA01
cuggaucaccgcggcg

SEQ ID NO: 3390943 - RNA, 14 nt, Pseudomonas aeruginosa PA01
cuggaucagcgccu

SEQ ID NO: 3390944 - RNA, 15 nt, Pseudomonas aeruginosa PA01
cuggaucagcgccuc

SEQ ID NO: 3390945 - RNA, 17 nt, Pseudomonas aeruginosa PA01
cuggaucagcgccucga

SEQ ID NO: 3390946 - RNA, 20 nt, Pseudomonas aeruginosa PA01
cuggaucagcgccucgaccu

SEQ ID NO: 3390947 - RNA, 21 nt, Pseudomonas aeruginosa PA01
cuggaucaggaagguccaggc

SEQ ID NO: 3390948 - RNA, 18 nt, Pseudomonas aeruginosa PA01
cuggauccgugccaggcg

SEQ ID NO: 3390949 - RNA, 21 nt, Pseudomonas aeruginosa PA01
cuggauccgugccaggcgcuc

SEQ ID NO: 3390950 - RNA, 14 nt, Pseudomonas aeruginosa PA01
cuggauccucgccu

SEQ ID NO: 3390951 - RNA, 21 nt, Pseudomonas aeruginosa PA01
cuggauccucgccucgcgcca

SEQ ID NO: 3390952 - RNA, 19 nt, Pseudomonas aeruginosa PA01
cuggaucgaucucgucggc

SEQ ID NO: 3390953 - RNA, 14 nt, Pseudomonas aeruginosa PA01
cuggaucgccaggc

SEQ ID NO: 3390954 - RNA, 15 nt, Pseudomonas aeruginosa PA01
cuggaucgccaggcu

SEQ ID NO: 3390955 - RNA, 23 nt, Pseudomonas aeruginosa PA01
cuggaucgccuugcgcgugcugg

SEQ ID NO: 3390956 - RNA, 13 nt, Pseudomonas aeruginosa PA01
cuggaucggcagc

SEQ ID NO: 3390957 - RNA, 14 nt, Pseudomonas aeruginosa PA01
cuggaucggcaggc

SEQ ID NO: 3390958 - RNA, 18 nt, Pseudomonas aeruginosa PA01
cuggaucggcaggcuggc

SEQ ID NO: 3390959 - RNA, 19 nt, Pseudomonas aeruginosa PA01
cuggaucggcaggcuggcg

SEQ ID NO: 3390960 - RNA, 12 nt, Pseudomonas aeruginosa PA01
cuggaucggccc

SEQ ID NO: 3390961 - RNA, 14 nt, Pseudomonas aeruginosa PA01
cuggaucuccuggg

SEQ ID NO: 3390962 - RNA, 17 nt, Pseudomonas aeruginosa PA01
cuggaucuccugggucg

SEQ ID NO: 3390963 - RNA, 19 nt, Pseudomonas aeruginosa PA01
cuggaucucggcggccagg

SEQ ID NO: 3390964 - RNA, 15 nt, Pseudomonas aeruginosa PA01
cuggaucugguggaa

SEQ ID NO: 3390965 - RNA, 17 nt, Pseudomonas aeruginosa PA01
cuggaugaaacgggcga

SEQ ID NO: 3390966 - RNA, 20 nt, Pseudomonas aeruginosa PA01
cuggaugaucgcgugggcca

SEQ ID NO: 3390967 - RNA, 23 nt, Pseudomonas aeruginosa PA01
cuggaugaucgcgugggccacca

SEQ ID NO: 3390968 - RNA, 20 nt, Pseudomonas aeruginosa PA01
cuggaugaucucgcaguacu

SEQ ID NO: 3390969 - RNA, 22 nt, Pseudomonas aeruginosa PA01
cuggaugaugguauccaggcgg

SEQ ID NO: 3390970 - RNA, 19 nt, Pseudomonas aeruginosa PA01
cuggaugcagccgauggcg

SEQ ID NO: 3390971 - RNA, 21 nt, Pseudomonas aeruginosa PA01
cuggaugcagccgauggcgaa

SEQ ID NO: 3390972 - RNA, 14 nt, Pseudomonas aeruginosa PA01
cuggaugcagccgg

SEQ ID NO: 3390973 - RNA, 15 nt, Pseudomonas aeruginosa PA01
cuggaugcagccggg

SEQ ID NO: 3390974 - RNA, 12 nt, Pseudomonas aeruginosa PA01
cuggaugcccuc

SEQ ID NO: 3390975 - RNA, 14 nt, Pseudomonas aeruginosa PA01
cuggaugcccuccu

SEQ ID NO: 3390976 - RNA, 19 nt, Pseudomonas aeruginosa PA01
cuggaugcccuccugggcc

SEQ ID NO: 3390977 - RNA, 16 nt, Pseudomonas aeruginosa PA01
cuggaugcuccgcgcc

SEQ ID NO: 3390978 - RNA, 18 nt, Pseudomonas aeruginosa PA01
cuggaugcuccgcgccuc

SEQ ID NO: 3390979 - RNA, 20 nt, Pseudomonas aeruginosa PA01
cuggauggucacgccgaggc

SEQ ID NO: 3390980 - RNA, 23 nt, Pseudomonas aeruginosa PA01
cuggauggucacgccgaggcugc

SEQ ID NO: 3390981 - RNA, 16 nt, Pseudomonas aeruginosa PA01
cuggauggugcccggg

SEQ ID NO: 3390982 - RNA, 20 nt, Pseudomonas aeruginosa PA01
cuggaugucgaagcgcaggu

SEQ ID NO: 3390983 - RNA, 14 nt, Pseudomonas aeruginosa PA01
cuggaugucgcugg

SEQ ID NO: 3390984 - RNA, 17 nt, Pseudomonas aeruginosa PA01
cuggaugucgcuggcca

SEQ ID NO: 3390985 - RNA, 23 nt, Pseudomonas aeruginosa PA01
cuggauguggcuauccuccaggc

SEQ ID NO: 3390986 - RNA, 15 nt, Pseudomonas aeruginosa PA01
cuggcaacaaggcau

SEQ ID NO: 3390987 - RNA, 23 nt, Pseudomonas aeruginosa PA01
cuggcaacggcgggccgcucagg

SEQ ID NO: 3390988 - RNA, 15 nt, Pseudomonas aeruginosa PA01
cuggcaccggccagg

SEQ ID NO: 3390989 - RNA, 12 nt, Pseudomonas aeruginosa PA01
cuggcaggcuca

SEQ ID NO: 3390990 - RNA, 20 nt, Pseudomonas aeruginosa PA01
cuggcagguaucgcugggcg

SEQ ID NO: 3390991 - RNA, 15 nt, Pseudomonas aeruginosa PA01
cuggcagguccgacg

SEQ ID NO: 3390992 - RNA, 12 nt, Pseudomonas aeruginosa PA01
cuggcaggucgu

SEQ ID NO: 3390993 - RNA, 23 nt, Pseudomonas aeruginosa PA01
cuggcaggucguuacgugucgua

SEQ ID NO: 3390994 - RNA, 20 nt, Pseudomonas aeruginosa PA01
cuggcaggugccgcucgucc

SEQ ID NO: 3390995 - RNA, 20 nt, Pseudomonas aeruginosa PA01
cuggcagguugcacggccgg

SEQ ID NO: 3390996 - RNA, 22 nt, Pseudomonas aeruginosa PA01
cuggcagguugcacggccggua

SEQ ID NO: 3390997 - RNA, 23 nt, Pseudomonas aeruginosa PA01
cuggcagguugcacggccgguag

SEQ ID NO: 3390998 - RNA, 18 nt, Pseudomonas aeruginosa PA01
cuggcagguugcgggagc

SEQ ID NO: 3390999 - RNA, 22 nt, Pseudomonas aeruginosa PA01
cuggcaguugcaguaccugcuc

SEQ ID NO: 3391000 - RNA, 22 nt, Pseudomonas aeruginosa PA01
cuggcauacacaugcaggcucg

SEQ ID NO: 3391001 - RNA, 13 nt, Pseudomonas aeruginosa PA01
cuggccaccagca

SEQ ID NO: 3391002 - RNA, 16 nt, Pseudomonas aeruginosa PA01
cuggccaccagcaccu

SEQ ID NO: 3391003 - RNA, 13 nt, Pseudomonas aeruginosa PA01
cuggccacccuug

SEQ ID NO: 3391004 - RNA, 22 nt, Pseudomonas aeruginosa PA01
cuggccacccuugcgcccggcu

SEQ ID NO: 3391005 - RNA, 21 nt, Pseudomonas aeruginosa PA01
cuggccacccuugcguccugc

SEQ ID NO: 3391006 - RNA, 23 nt, Pseudomonas aeruginosa PA01
cuggccacccuugcguccugccu

SEQ ID NO: 3391007 - RNA, 17 nt, Pseudomonas aeruginosa PA01
cuggccacccuuggagc

SEQ ID NO: 3391008 - RNA, 15 nt, Pseudomonas aeruginosa PA01
cuggccaccgccagg

SEQ ID NO: 3391009 - RNA, 17 nt, Pseudomonas aeruginosa PA01
cuggccaccgccaggac

SEQ ID NO: 3391010 - RNA, 18 nt, Pseudomonas aeruginosa PA01
cuggccaccgccaggacc

SEQ ID NO: 3391011 - RNA, 21 nt, Pseudomonas aeruginosa PA01
cuggccaccgccaggaccucg

SEQ ID NO: 3391012 - RNA, 21 nt, Pseudomonas aeruginosa PA01
cuggccaccgggaucagcggc

SEQ ID NO: 3391013 - RNA, 22 nt, Pseudomonas aeruginosa PA01
cuggccaccgggaucagcggcg

SEQ ID NO: 3391014 - RNA, 13 nt, Pseudomonas aeruginosa PA01
cuggccacgccau

SEQ ID NO: 3391015 - RNA, 18 nt, Pseudomonas aeruginosa PA01
cuggccagaaggucgggg

SEQ ID NO: 3391016 - RNA, 21 nt, Pseudomonas aeruginosa PA01
cuggccagaaggucggggaga

SEQ ID NO: 3391017 - RNA, 14 nt, Pseudomonas aeruginosa PA01
cuggccagcaauac

SEQ ID NO: 3391018 - RNA, 22 nt, Pseudomonas aeruginosa PA01
cuggccagcaauacccgccgcu

SEQ ID NO: 3391019 - RNA, 15 nt, Pseudomonas aeruginosa PA01
cuggccagcaccagu

SEQ ID NO: 3391020 - RNA, 16 nt, Pseudomonas aeruginosa PA01
cuggccagcaccaguc

SEQ ID NO: 3391021 - RNA, 18 nt, Pseudomonas aeruginosa PA01
cuggccagcaccaguccc

SEQ ID NO: 3391022 - RNA, 21 nt, Pseudomonas aeruginosa PA01
cuggccagcaccagucccugg

SEQ ID NO: 3391023 - RNA, 12 nt, Pseudomonas aeruginosa PA01
cuggccagcagg

SEQ ID NO: 3391024 - RNA, 13 nt, Pseudomonas aeruginosa PA01
cuggccagcaggc

SEQ ID NO: 3391025 - RNA, 15 nt, Pseudomonas aeruginosa PA01
cuggccagcaggcug

SEQ ID NO: 3391026 - RNA, 18 nt, Pseudomonas aeruginosa PA01
cuggccagcaggcuggcg

SEQ ID NO: 3391027 - RNA, 19 nt, Pseudomonas aeruginosa PA01
cuggccagcaggcuggcgg

SEQ ID NO: 3391028 - RNA, 20 nt, Pseudomonas aeruginosa PA01
cuggccagcccugguaggug

SEQ ID NO: 3391029 - RNA, 16 nt, Pseudomonas aeruginosa PA01
cuggccagcgcuucca

SEQ ID NO: 3391030 - RNA, 11 nt, Pseudomonas aeruginosa PA01
cuggccagcgu

SEQ ID NO: 3391031 - RNA, 14 nt, Pseudomonas aeruginosa PA01
cuggccagcgucgc

SEQ ID NO: 3391032 - RNA, 20 nt, Pseudomonas aeruginosa PA01
cuggccagcgucgccugcca

SEQ ID NO: 3391033 - RNA, 19 nt, Pseudomonas aeruginosa PA01
cuggccaggcgcuccucca

SEQ ID NO: 3391034 - RNA, 21 nt, Pseudomonas aeruginosa PA01
cuggccaggcgcuccuccagc

SEQ ID NO: 3391035 - RNA, 21 nt, Pseudomonas aeruginosa PA01
cuggccagggcaugucgaucu

SEQ ID NO: 3391036 - RNA, 22 nt, Pseudomonas aeruginosa PA01
cuggccagguccgaacagagga

SEQ ID NO: 3391037 - RNA, 18 nt, Pseudomonas aeruginosa PA01
cuggccaguugcaccgca

SEQ ID NO: 3391038 - RNA, 17 nt, Pseudomonas aeruginosa PA01
cuggccauagaaaccgu

SEQ ID NO: 3391039 - RNA, 20 nt, Pseudomonas aeruginosa PA01
cuggccauccauaucggcca

SEQ ID NO: 3391040 - RNA, 17 nt, Pseudomonas aeruginosa PA01
cuggccauccgcccugc

SEQ ID NO: 3391041 - RNA, 23 nt, Pseudomonas aeruginosa PA01
cuggccaucuucucgaagcgcgc

SEQ ID NO: 3391042 - RNA, 14 nt, Pseudomonas aeruginosa PA01
cuggcccaacagcg

SEQ ID NO: 3391043 - RNA, 15 nt, Pseudomonas aeruginosa PA01
cuggcgagaauggcg

SEQ ID NO: 3391044 - RNA, 16 nt, Pseudomonas aeruginosa PA01
cuggcgagaauggcga

SEQ ID NO: 3391045 - RNA, 15 nt, Pseudomonas aeruginosa PA01
cuggcgagcgucgag

SEQ ID NO: 3391046 - RNA, 17 nt, Pseudomonas aeruginosa PA01
cuggcgagcgucgaguc

SEQ ID NO: 3391047 - RNA, 21 nt, Pseudomonas aeruginosa PA01
cuggcgagcgucgagucgcgc

SEQ ID NO: 3391048 - RNA, 23 nt, Pseudomonas aeruginosa PA01
cuggcgaggaacacccagaagcc

SEQ ID NO: 3391049 - RNA, 17 nt, Pseudomonas aeruginosa PA01
cuggcgaggacgccggg

SEQ ID NO: 3391050 - RNA, 18 nt, Pseudomonas aeruginosa PA01
cuggcgaggacgccgggc

SEQ ID NO: 3391051 - RNA, 19 nt, Pseudomonas aeruginosa PA01
cuggcgaggacgccgggcu

SEQ ID NO: 3391052 - RNA, 16 nt, Pseudomonas aeruginosa PA01
cuggcgaggcugcgau

SEQ ID NO: 3391053 - RNA, 15 nt, Pseudomonas aeruginosa PA01
cuggcgaguggcgaa

SEQ ID NO: 3391054 - RNA, 22 nt, Pseudomonas aeruginosa PA01
cuggcgaguggcgaagccagca

SEQ ID NO: 3391055 - RNA, 15 nt, Pseudomonas aeruginosa PA01
cuggcgaucaggcca

SEQ ID NO: 3391056 - RNA, 19 nt, Pseudomonas aeruginosa PA01
cuggcgaucaggccaagcu

SEQ ID NO: 3391057 - RNA, 14 nt, Pseudomonas aeruginosa PA01
cuggcgaucaugcc

SEQ ID NO: 3391058 - RNA, 22 nt, Pseudomonas aeruginosa PA01
cuggcgaucaugccuucgaucu

SEQ ID NO: 3391059 - RNA, 16 nt, Pseudomonas aeruginosa PA01
cuggcgaucgaccugc

SEQ ID NO: 3391060 - RNA, 17 nt, Pseudomonas aeruginosa PA01
cuggcgaucgaccugcc

SEQ ID NO: 3391061 - RNA, 20 nt, Pseudomonas aeruginosa PA01
cuggcgaucgaccugccggu

SEQ ID NO: 3391062 - RNA, 17 nt, Pseudomonas aeruginosa PA01
cuggcgaucucggcgcg

SEQ ID NO: 3391063 - RNA, 18 nt, Pseudomonas aeruginosa PA01
cuggcgaucucggcgcgg

SEQ ID NO: 3391064 - RNA, 21 nt, Pseudomonas aeruginosa PA01
cuggcgaugcccuggccgcug

SEQ ID NO: 3391065 - RNA, 17 nt, Pseudomonas aeruginosa PA01
cuggcgauucuccuggg

SEQ ID NO: 3391066 - RNA, 13 nt, Pseudomonas aeruginosa PA01
cuggcgcaacagg

SEQ ID NO: 3391067 - RNA, 14 nt, Pseudomonas aeruginosa PA01
cuggcgcaacgccg

SEQ ID NO: 3391068 - RNA, 17 nt, Pseudomonas aeruginosa PA01
cuggcgcaacgccggca

SEQ ID NO: 3391069 - RNA, 19 nt, Pseudomonas aeruginosa PA01
cuggcgcaacugcgccagc

SEQ ID NO: 3391070 - RNA, 18 nt, Pseudomonas aeruginosa PA01
cuggcgcaauacaccgcu

SEQ ID NO: 3391071 - RNA, 20 nt, Pseudomonas aeruginosa PA01
cuggcgcaauacaccgcugc

SEQ ID NO: 3391072 - RNA, 21 nt, Pseudomonas aeruginosa PA01
cuggcgcaauacaccgcugcg

SEQ ID NO: 3391073 - RNA, 18 nt, Pseudomonas aeruginosa PA01
cuggcgcacacggucgag

SEQ ID NO: 3391074 - RNA, 20 nt, Pseudomonas aeruginosa PA01
cuggcgcacggccugcaccu

SEQ ID NO: 3391075 - RNA, 21 nt, Pseudomonas aeruginosa PA01
cuggcgcacggccugcaccug

SEQ ID NO: 3391076 - RNA, 14 nt, Pseudomonas aeruginosa PA01
cuggcgcagacagg

SEQ ID NO: 3391077 - RNA, 15 nt, Pseudomonas aeruginosa PA01
cuggcgcagacaggc

SEQ ID NO: 3391078 - RNA, 22 nt, Pseudomonas aeruginosa PA01
cuggcgcagacaggccuccagc

SEQ ID NO: 3391079 - RNA, 12 nt, Pseudomonas aeruginosa PA01
cuggcgcagcag

SEQ ID NO: 3391080 - RNA, 13 nt, Pseudomonas aeruginosa PA01
cuggcgcagcagc

SEQ ID NO: 3391081 - RNA, 14 nt, Pseudomonas aeruginosa PA01
cuggcgcagcagca

SEQ ID NO: 3391082 - RNA, 14 nt, Pseudomonas aeruginosa PA01
cuggcgcagccagg

SEQ ID NO: 3391083 - RNA, 17 nt, Pseudomonas aeruginosa PA01
cuggcgcagccaggcga

SEQ ID NO: 3391084 - RNA, 18 nt, Pseudomonas aeruginosa PA01
cuggcgcagccaggcgau

SEQ ID NO: 3391085 - RNA, 20 nt, Pseudomonas aeruginosa PA01
cuggcgcagccaggcgaugg

SEQ ID NO: 3391086 - RNA, 13 nt, Pseudomonas aeruginosa PA01
cuggcgcagccgc

SEQ ID NO: 3391087 - RNA, 18 nt, Pseudomonas aeruginosa PA01
cuggcgcagcggcagcgc

SEQ ID NO: 3391088 - RNA, 20 nt, Pseudomonas aeruginosa PA01
cuggcgcagcggcagcgcca

SEQ ID NO: 3391089 - RNA, 13 nt, Pseudomonas aeruginosa PA01
cuggcgcaggcgg

SEQ ID NO: 3391090 - RNA, 16 nt, Pseudomonas aeruginosa PA01
cuggcgcaggcggcgc

SEQ ID NO: 3391091 - RNA, 13 nt, Pseudomonas aeruginosa PA01
cuggcgcagggcg

SEQ ID NO: 3391092 - RNA, 18 nt, Pseudomonas aeruginosa PA01
cuggcgcauagcggccau

SEQ ID NO: 3391093 - RNA, 17 nt, Pseudomonas aeruginosa PA01
cuggcgcauccgcccga

SEQ ID NO: 3391094 - RNA, 19 nt, Pseudomonas aeruginosa PA01
cuggcgcauccgcccgauc

SEQ ID NO: 3391095 - RNA, 22 nt, Pseudomonas aeruginosa PA01
cuggcgcauccgcccgaucgcc

SEQ ID NO: 3391096 - RNA, 15 nt, Pseudomonas aeruginosa PA01
cuggcgcauggcgcu

SEQ ID NO: 3391097 - RNA, 16 nt, Pseudomonas aeruginosa PA01
cuggcgcaugucgcga

SEQ ID NO: 3391098 - RNA, 17 nt, Pseudomonas aeruginosa PA01
cuggcgcaugucgcgau

SEQ ID NO: 3391099 - RNA, 14 nt, Pseudomonas aeruginosa PA01
cuggcgccaggccg

SEQ ID NO: 3391100 - RNA, 18 nt, Pseudomonas aeruginosa PA01
cuggcgccaggccgcguc

SEQ ID NO: 3391101 - RNA, 20 nt, Pseudomonas aeruginosa PA01
cuggcgccaguaauggggau

SEQ ID NO: 3391102 - RNA, 20 nt, Pseudomonas aeruginosa PA01
cuggcgccgcgggucugcuc

SEQ ID NO: 3391103 - RNA, 15 nt, Pseudomonas aeruginosa PA01
cuggcgccgcuggcg

SEQ ID NO: 3391104 - RNA, 12 nt, Pseudomonas aeruginosa PA01
cuggcgccggua

SEQ ID NO: 3391105 - RNA, 14 nt, Pseudomonas aeruginosa PA01
cuggcgccgguaau

SEQ ID NO: 3391106 - RNA, 17 nt, Pseudomonas aeruginosa PA01
cuggcgccggugcauga

SEQ ID NO: 3391107 - RNA, 16 nt, Pseudomonas aeruginosa PA01
cuggcgccuggccugg

SEQ ID NO: 3391108 - RNA, 20 nt, Pseudomonas aeruginosa PA01
cuggcgccuggccuggaacu

SEQ ID NO: 3391109 - RNA, 21 nt, Pseudomonas aeruginosa PA01
cuggcgcgacgaggcgcggcg

SEQ ID NO: 3391110 - RNA, 23 nt, Pseudomonas aeruginosa PA01
cuggcgcgacgaggcgcggcgga

SEQ ID NO: 3391111 - RNA, 21 nt, Pseudomonas aeruginosa PA01
cuggcgcgagaagccagccag

SEQ ID NO: 3391112 - RNA, 16 nt, Pseudomonas aeruginosa PA01
cuggcgcgauccgcgc

SEQ ID NO: 3391113 - RNA, 19 nt, Pseudomonas aeruginosa PA01
cuggcgcgauccgcgcggc

SEQ ID NO: 3391114 - RNA, 20 nt, Pseudomonas aeruginosa PA01
cuggcgcgaucggggcagaa

SEQ ID NO: 3391115 - RNA, 23 nt, Pseudomonas aeruginosa PA01
cuggcgcgcgcgccaggucgaga

SEQ ID NO: 3391116 - RNA, 16 nt, Pseudomonas aeruginosa PA01
cuggcgcgcggccgcg

SEQ ID NO: 3391117 - RNA, 15 nt, Pseudomonas aeruginosa PA01
cuggcgcgcugcggc

SEQ ID NO: 3391118 - RNA, 13 nt, Pseudomonas aeruginosa PA01
cuggcgcguacgc

SEQ ID NO: 3391119 - RNA, 18 nt, Pseudomonas aeruginosa PA01
cuggcgcguacgcccgca

SEQ ID NO: 3391120 - RNA, 19 nt, Pseudomonas aeruginosa PA01
cuggcgcguacgcccgcag

SEQ ID NO: 3391121 - RNA, 19 nt, Pseudomonas aeruginosa PA01
cuggcgcgucaugccgccg

SEQ ID NO: 3391122 - RNA, 20 nt, Pseudomonas aeruginosa PA01
cuggcgcgucaugccgccgu

SEQ ID NO: 3391123 - RNA, 22 nt, Pseudomonas aeruginosa PA01
cuggcgcgucaugccgccgucg

SEQ ID NO: 3391124 - RNA, 21 nt, Pseudomonas aeruginosa PA01
cuggcgcgucgcugccgccgc

SEQ ID NO: 3391125 - RNA, 22 nt, Pseudomonas aeruginosa PA01
cuggcgcgucgcugccgccgcg

SEQ ID NO: 3391126 - RNA, 17 nt, Pseudomonas aeruginosa PA01
cuggcgcguugugccgc

SEQ ID NO: 3391127 - RNA, 19 nt, Pseudomonas aeruginosa PA01
cuggcgcguugugccgcca

SEQ ID NO: 3391128 - RNA, 20 nt, Pseudomonas aeruginosa PA01
cuggcgcguugugccgccac

SEQ ID NO: 3391129 - RNA, 21 nt, Pseudomonas aeruginosa PA01
cuggcgcguugugccgccacc

SEQ ID NO: 3391130 - RNA, 17 nt, Pseudomonas aeruginosa PA01
cuggcgcuaccgcgcau

SEQ ID NO: 3391131 - RNA, 21 nt, Pseudomonas aeruginosa PA01
cuggcgcuaccgcgcauggcg

SEQ ID NO: 3391132 - RNA, 20 nt, Pseudomonas aeruginosa PA01
cuggcgcucagcgccgcuuc

SEQ ID NO: 3391133 - RNA, 19 nt, Pseudomonas aeruginosa PA01
cuggcgcucucgaacacca

SEQ ID NO: 3391134 - RNA, 22 nt, Pseudomonas aeruginosa PA01
cuggcgcucucgaacaccaggc

SEQ ID NO: 3391135 - RNA, 16 nt, Pseudomonas aeruginosa PA01
cuggcgcugaacaagc

SEQ ID NO: 3391136 - RNA, 18 nt, Pseudomonas aeruginosa PA01
cuggcgcugaacaagccc

SEQ ID NO: 3391137 - RNA, 20 nt, Pseudomonas aeruginosa PA01
cuggcgcugaacaagcccug

SEQ ID NO: 3391138 - RNA, 15 nt, Pseudomonas aeruginosa PA01
cuggcgcugcgcggc

SEQ ID NO: 3391139 - RNA, 23 nt, Pseudomonas aeruginosa PA01
cuggcgcugcgcggcgucggcga

SEQ ID NO: 3391140 - RNA, 17 nt, Pseudomonas aeruginosa PA01
cuggcgcugggccuuga

SEQ ID NO: 3391141 - RNA, 18 nt, Pseudomonas aeruginosa PA01
cuggcgcugggccuugag

SEQ ID NO: 3391142 - RNA, 23 nt, Pseudomonas aeruginosa PA01
cuggcgcugggccuugagcaggc

SEQ ID NO: 3391143 - RNA, 13 nt, Pseudomonas aeruginosa PA01
cuggcgcuggucc

SEQ ID NO: 3391144 - RNA, 18 nt, Pseudomonas aeruginosa PA01
cuggcgcugucgcccggg

SEQ ID NO: 3391145 - RNA, 15 nt, Pseudomonas aeruginosa PA01
cugggccaucgccgg

SEQ ID NO: 3391146 - RNA, 17 nt, Pseudomonas aeruginosa PA01
cugggccaucgccggcc

SEQ ID NO: 3391147 - RNA, 18 nt, Pseudomonas aeruginosa PA01
cugggccaucgccggccc

SEQ ID NO: 3391148 - RNA, 12 nt, Pseudomonas aeruginosa PA01
cugggccaucgu

SEQ ID NO: 3391149 - RNA, 14 nt, Pseudomonas aeruginosa PA01
cugggccaucguca

SEQ ID NO: 3391150 - RNA, 14 nt, Pseudomonas aeruginosa PA01
cugggccaugaccu

SEQ ID NO: 3391151 - RNA, 23 nt, Pseudomonas aeruginosa PA01
cugggccaugaccucggccagcc

SEQ ID NO: 3391152 - RNA, 13 nt, Pseudomonas aeruginosa PA01
cugggccccggcc

SEQ ID NO: 3391153 - RNA, 17 nt, Pseudomonas aeruginosa PA01
cugggccccggccaggu

SEQ ID NO: 3391154 - RNA, 18 nt, Pseudomonas aeruginosa PA01
cugggccgaaggccaggc

SEQ ID NO: 3391155 - RNA, 14 nt, Pseudomonas aeruginosa PA01
cugggccgcgaggu

SEQ ID NO: 3391156 - RNA, 17 nt, Pseudomonas aeruginosa PA01
cugggccggcgccagca

SEQ ID NO: 3391157 - RNA, 23 nt, Pseudomonas aeruginosa PA01
cugggccggcguaugguggagga

SEQ ID NO: 3391158 - RNA, 13 nt, Pseudomonas aeruginosa PA01
cugggccggcuuc

SEQ ID NO: 3391159 - RNA, 13 nt, Pseudomonas aeruginosa PA01
cugggccuugagg

SEQ ID NO: 3391160 - RNA, 20 nt, Pseudomonas aeruginosa PA01
cugggccuugaucaccacca

SEQ ID NO: 3391161 - RNA, 22 nt, Pseudomonas aeruginosa PA01
cugggccuugaucaccaccacg

SEQ ID NO: 3391162 - RNA, 13 nt, Pseudomonas aeruginosa PA01
cugggcgaacagc

SEQ ID NO: 3391163 - RNA, 18 nt, Pseudomonas aeruginosa PA01
cugggcgaacagcaccca

SEQ ID NO: 3391164 - RNA, 21 nt, Pseudomonas aeruginosa PA01
cugggcgaacagcacccagga

SEQ ID NO: 3391165 - RNA, 17 nt, Pseudomonas aeruginosa PA01
cugggcgaacagcgaga

SEQ ID NO: 3391166 - RNA, 19 nt, Pseudomonas aeruginosa PA01
cugggcgaagucgacgauc

SEQ ID NO: 3391167 - RNA, 14 nt, Pseudomonas aeruginosa PA01
cugggcgaccuuca

SEQ ID NO: 3391168 - RNA, 17 nt, Pseudomonas aeruginosa PA01
cugggcgaucacgccgc

SEQ ID NO: 3391169 - RNA, 15 nt, Pseudomonas aeruginosa PA01
cugggcgaugcggcg

SEQ ID NO: 3391170 - RNA, 23 nt, Pseudomonas aeruginosa PA01
cugggcgauguccuggaucggca

SEQ ID NO: 3391171 - RNA, 20 nt, Pseudomonas aeruginosa PA01
cugggcgauuuccaccggca

SEQ ID NO: 3391172 - RNA, 12 nt, Pseudomonas aeruginosa PA01
cugggcgcaggg

SEQ ID NO: 3391173 - RNA, 22 nt, Pseudomonas aeruginosa PA01
cugggcgcaggggcgcgccggc

SEQ ID NO: 3391174 - RNA, 15 nt, Pseudomonas aeruginosa PA01
cugggcgccgccagc

SEQ ID NO: 3391175 - RNA, 16 nt, Pseudomonas aeruginosa PA01
cugggcgccgccagcc

SEQ ID NO: 3391176 - RNA, 17 nt, Pseudomonas aeruginosa PA01
cugggcgccgccagcca

SEQ ID NO: 3391177 - RNA, 22 nt, Pseudomonas aeruginosa PA01
cugggcgccgccagccagagca

SEQ ID NO: 3391178 - RNA, 23 nt, Pseudomonas aeruginosa PA01
cugggcgccgccagccagagcag

SEQ ID NO: 3391179 - RNA, 13 nt, Pseudomonas aeruginosa PA01
cugggcgccggca

SEQ ID NO: 3391180 - RNA, 19 nt, Pseudomonas aeruginosa PA01
cugggcgccggcaggccuu

SEQ ID NO: 3391181 - RNA, 13 nt, Pseudomonas aeruginosa PA01
cugggcggccucg

SEQ ID NO: 3391182 - RNA, 17 nt, Pseudomonas aeruginosa PA01
cugggcggcgaccaucc

SEQ ID NO: 3391183 - RNA, 20 nt, Pseudomonas aeruginosa PA01
cugggcggcgaccauccagc

SEQ ID NO: 3391184 - RNA, 17 nt, Pseudomonas aeruginosa PA01
cugggcggcgaccugcg

SEQ ID NO: 3391185 - RNA, 22 nt, Pseudomonas aeruginosa PA01
cugggcggcgaccugcggcaag

SEQ ID NO: 3391186 - RNA, 17 nt, Pseudomonas aeruginosa PA01
cugggcggcgaggccga

SEQ ID NO: 3391187 - RNA, 22 nt, Pseudomonas aeruginosa PA01
cugggcggcgaggccgaccuug

SEQ ID NO: 3391188 - RNA, 20 nt, Pseudomonas aeruginosa PA01
cugggcggcuggccgaggac

SEQ ID NO: 3391189 - RNA, 15 nt, Pseudomonas aeruginosa PA01
cugggcggcuuccug

SEQ ID NO: 3391190 - RNA, 16 nt, Pseudomonas aeruginosa PA01
cugggcguacaggccc

SEQ ID NO: 3391191 - RNA, 21 nt, Pseudomonas aeruginosa PA01
cugggcguacaggccccaggc

SEQ ID NO: 3391192 - RNA, 22 nt, Pseudomonas aeruginosa PA01
cugggcguacaggccccaggcg

SEQ ID NO: 3391193 - RNA, 19 nt, Pseudomonas aeruginosa PA01
cugggcgucgaacaccggc

SEQ ID NO: 3391194 - RNA, 14 nt, Pseudomonas aeruginosa PA01
cugggcgucgacga

SEQ ID NO: 3391195 - RNA, 17 nt, Pseudomonas aeruginosa PA01
cugggcguggcggccgc

SEQ ID NO: 3391196 - RNA, 19 nt, Pseudomonas aeruginosa PA01
cugggcguggcggccgccg

SEQ ID NO: 3391197 - RNA, 20 nt, Pseudomonas aeruginosa PA01
cugggcguggcggccgccgg

SEQ ID NO: 3391198 - RNA, 21 nt, Pseudomonas aeruginosa PA01
cugggcguggcggccgccggc

SEQ ID NO: 3391199 - RNA, 22 nt, Pseudomonas aeruginosa PA01
cugggcguggcggccgccggcg

SEQ ID NO: 3391200 - RNA, 18 nt, Pseudomonas aeruginosa PA01
cugggcguuggccagcgc

SEQ ID NO: 3391201 - RNA, 19 nt, Pseudomonas aeruginosa PA01
cugggcguuggccagcgcc

SEQ ID NO: 3391202 - RNA, 20 nt, Pseudomonas aeruginosa PA01
cugggcguuggccagcgcca

SEQ ID NO: 3391203 - RNA, 21 nt, Pseudomonas aeruginosa PA01
cugggcguuggccagcgccac

SEQ ID NO: 3391204 - RNA, 21 nt, Pseudomonas aeruginosa PA01
cugggcuacaucgucugcgcg

SEQ ID NO: 3391205 - RNA, 16 nt, Pseudomonas aeruginosa PA01
cugggcugcgggguga

SEQ ID NO: 3391206 - RNA, 17 nt, Pseudomonas aeruginosa PA01
cugggcugcggggugag

SEQ ID NO: 3391207 - RNA, 13 nt, Pseudomonas aeruginosa PA01
cugggcugggucg

SEQ ID NO: 3391208 - RNA, 16 nt, Pseudomonas aeruginosa PA01
cugggcuucguccgcc

SEQ ID NO: 3391209 - RNA, 22 nt, Pseudomonas aeruginosa PA01
cugggcuucguccgccugggac

SEQ ID NO: 3391210 - RNA, 19 nt, Pseudomonas aeruginosa PA01
cuggggaaauucgcgcugg

SEQ ID NO: 3391211 - RNA, 20 nt, Pseudomonas aeruginosa PA01
cuggggaccgcaccuggugg

SEQ ID NO: 3391212 - RNA, 19 nt, Pseudomonas aeruginosa PA01
cuggggcaucucggccacc

SEQ ID NO: 3391213 - RNA, 20 nt, Pseudomonas aeruginosa PA01
cuggggcaucucggccaccu

SEQ ID NO: 3391214 - RNA, 22 nt, Pseudomonas aeruginosa PA01
cuggggcaucucggccaccugc

SEQ ID NO: 3391215 - RNA, 15 nt, Pseudomonas aeruginosa PA01
cuggggccggccugg

SEQ ID NO: 3391216 - RNA, 17 nt, Pseudomonas aeruginosa PA01
cuggggcggccucaggc

SEQ ID NO: 3391217 - RNA, 18 nt, Pseudomonas aeruginosa PA01
cuggggcuguugcugggc

SEQ ID NO: 3391218 - RNA, 15 nt, Pseudomonas aeruginosa PA01
cugggguagccggcc

SEQ ID NO: 3391219 - RNA, 22 nt, Pseudomonas aeruginosa PA01
cugggguugcggcgcccgccaa

SEQ ID NO: 3391220 - RNA, 16 nt, Pseudomonas aeruginosa PA01
cuggguacgcaccggc

SEQ ID NO: 3391221 - RNA, 17 nt, Pseudomonas aeruginosa PA01
cuggguacgguuggcca

SEQ ID NO: 3391222 - RNA, 19 nt, Pseudomonas aeruginosa PA01
cuggguacgguuggccagc

SEQ ID NO: 3391223 - RNA, 20 nt, Pseudomonas aeruginosa PA01
cuggguacgguuggccagcg

SEQ ID NO: 3391224 - RNA, 21 nt, Pseudomonas aeruginosa PA01
cuggguacgguuggccagcga

SEQ ID NO: 3391225 - RNA, 17 nt, Pseudomonas aeruginosa PA01
cuggguaggaucgcuau

SEQ ID NO: 3391226 - RNA, 17 nt, Pseudomonas aeruginosa PA01
cuggguauagaccagca

SEQ ID NO: 3391227 - RNA, 13 nt, Pseudomonas aeruginosa PA01
cugggucaccagc

SEQ ID NO: 3391228 - RNA, 14 nt, Pseudomonas aeruginosa PA01
cugggucaccagca

SEQ ID NO: 3391229 - RNA, 16 nt, Pseudomonas aeruginosa PA01
cugggucaccagcacc

SEQ ID NO: 3391230 - RNA, 18 nt, Pseudomonas aeruginosa PA01
cugggucacguggccgcc

SEQ ID NO: 3391231 - RNA, 17 nt, Pseudomonas aeruginosa PA01
cuggguccuggugauca

SEQ ID NO: 3391232 - RNA, 22 nt, Pseudomonas aeruginosa PA01
cugggucgcguacagcgggccg

SEQ ID NO: 3391233 - RNA, 23 nt, Pseudomonas aeruginosa PA01
cugggucgcguacagcgggccgg

SEQ ID NO: 3391234 - RNA, 13 nt, Pseudomonas aeruginosa PA01
cugggucuggcga

SEQ ID NO: 3391235 - RNA, 14 nt, Pseudomonas aeruginosa PA01
cugggugaccagca

SEQ ID NO: 3391236 - RNA, 21 nt, Pseudomonas aeruginosa PA01
cugggugauuucuucagccug

SEQ ID NO: 3391237 - RNA, 13 nt, Pseudomonas aeruginosa PA01
cugggugcggugg

SEQ ID NO: 3391238 - RNA, 17 nt, Pseudomonas aeruginosa PA01
cugggugcggugggcga

SEQ ID NO: 3391239 - RNA, 14 nt, Pseudomonas aeruginosa PA01
cugggugcuuuccu

SEQ ID NO: 3391240 - RNA, 18 nt, Pseudomonas aeruginosa PA01
cugggugcuuuccugcuc

SEQ ID NO: 3391241 - RNA, 16 nt, Pseudomonas aeruginosa PA01
cuggguggucugcacg

SEQ ID NO: 3391242 - RNA, 21 nt, Pseudomonas aeruginosa PA01
cugggugucgaccuccgccgc

SEQ ID NO: 3391243 - RNA, 23 nt, Pseudomonas aeruginosa PA01
cuggguguugucggucagguacg

SEQ ID NO: 3391244 - RNA, 19 nt, Pseudomonas aeruginosa PA01
cuggguugccgcgccgaug

SEQ ID NO: 3391245 - RNA, 15 nt, Pseudomonas aeruginosa PA01
cuggguuggcgcgag

SEQ ID NO: 3391246 - RNA, 16 nt, Pseudomonas aeruginosa PA01
cugguaacgggcgaac

SEQ ID NO: 3391247 - RNA, 17 nt, Pseudomonas aeruginosa PA01
cuggugcggcaccagcc

SEQ ID NO: 3391248 - RNA, 19 nt, Pseudomonas aeruginosa PA01
cuggugcggcaccagccag

SEQ ID NO: 3391249 - RNA, 20 nt, Pseudomonas aeruginosa PA01
cuggugcggcaccagccagg

SEQ ID NO: 3391250 - RNA, 14 nt, Pseudomonas aeruginosa PA01
cuggugcggccgau

SEQ ID NO: 3391251 - RNA, 16 nt, Pseudomonas aeruginosa PA01
cuggugcggccgauga

SEQ ID NO: 3391252 - RNA, 17 nt, Pseudomonas aeruginosa PA01
cuggugcggccgaugau

SEQ ID NO: 3391253 - RNA, 17 nt, Pseudomonas aeruginosa PA01
cuggugcugcuccauca

SEQ ID NO: 3391254 - RNA, 14 nt, Pseudomonas aeruginosa PA01
cugguggaacagca

SEQ ID NO: 3391255 - RNA, 17 nt, Pseudomonas aeruginosa PA01
cugguggaacagcauca

SEQ ID NO: 3391256 - RNA, 17 nt, Pseudomonas aeruginosa PA01
cugguggacacccugcu

SEQ ID NO: 3391257 - RNA, 20 nt, Pseudomonas aeruginosa PA01
cugguggacggucucgccgc

SEQ ID NO: 3391258 - RNA, 22 nt, Pseudomonas aeruginosa PA01
cugguggacggucucgccgccg

SEQ ID NO: 3391259 - RNA, 13 nt, Pseudomonas aeruginosa PA01
cugguggacgucg

SEQ ID NO: 3391260 - RNA, 20 nt, Pseudomonas aeruginosa PA01
cugguggacgucgucggcga

SEQ ID NO: 3391261 - RNA, 23 nt, Pseudomonas aeruginosa PA01
cugguggauguucgccgccacca

SEQ ID NO: 3391262 - RNA, 19 nt, Pseudomonas aeruginosa PA01
cugguggcccugggcggcg

SEQ ID NO: 3391263 - RNA, 20 nt, Pseudomonas aeruginosa PA01
cugguggcccugggcggcga

SEQ ID NO: 3391264 - RNA, 15 nt, Pseudomonas aeruginosa PA01
cugguggcgaacagc

SEQ ID NO: 3391265 - RNA, 18 nt, Pseudomonas aeruginosa PA01
cugguggcgaacagcacc

SEQ ID NO: 3391266 - RNA, 16 nt, Pseudomonas aeruginosa PA01
cuggugggcggcggcu

SEQ ID NO: 3391267 - RNA, 17 nt, Pseudomonas aeruginosa PA01
cugguggucaccgccag

SEQ ID NO: 3391268 - RNA, 19 nt, Pseudomonas aeruginosa PA01
cugguggugaucagcggcc

SEQ ID NO: 3391269 - RNA, 18 nt, Pseudomonas aeruginosa PA01
cugguuccuggugucggg

SEQ ID NO: 3391270 - RNA, 18 nt, Pseudomonas aeruginosa PA01
cugguucguccgcgcgau

SEQ ID NO: 3391271 - RNA, 21 nt, Pseudomonas aeruginosa PA01
cugguucugguccaccagccc

SEQ ID NO: 3391272 - RNA, 23 nt, Pseudomonas aeruginosa PA01
cugguugaacugcgguccggcga

SEQ ID NO: 3391273 - RNA, 17 nt, Pseudomonas aeruginosa PA01
cugguugaccaggccca

SEQ ID NO: 3391274 - RNA, 19 nt, Pseudomonas aeruginosa PA01
cugguugaccugcagcgcc

SEQ ID NO: 3391275 - RNA, 16 nt, Pseudomonas aeruginosa PA01
cugguugaggccgucc

SEQ ID NO: 3391276 - RNA, 13 nt, Pseudomonas aeruginosa PA01
cugguugaggucg

SEQ ID NO: 3391277 - RNA, 13 nt, Pseudomonas aeruginosa PA01
cugguugccagca

SEQ ID NO: 3391278 - RNA, 16 nt, Pseudomonas aeruginosa PA01
cugguugccagcagcg

SEQ ID NO: 3391279 - RNA, 14 nt, Pseudomonas aeruginosa PA01
cugguugcccaggg

SEQ ID NO: 3391280 - RNA, 15 nt, Pseudomonas aeruginosa PA01
cugguugcccagggu

SEQ ID NO: 3391281 - RNA, 18 nt, Pseudomonas aeruginosa PA01
cugguuggacaccucccg

SEQ ID NO: 3391282 - RNA, 14 nt, Pseudomonas aeruginosa PA01
cugguuggccgccu

SEQ ID NO: 3391283 - RNA, 16 nt, Pseudomonas aeruginosa PA01
cugguuggccgccugg

SEQ ID NO: 3391284 - RNA, 19 nt, Pseudomonas aeruginosa PA01
cugguuggccgccuggcgc

SEQ ID NO: 3391285 - RNA, 21 nt, Pseudomonas aeruginosa PA01
cugguuggccgccuggcgcau

SEQ ID NO: 3391286 - RNA, 16 nt, Pseudomonas aeruginosa PA01
cugguuggcgaggucg

SEQ ID NO: 3391287 - RNA, 12 nt, Pseudomonas aeruginosa PA01
cuguacagaaac

SEQ ID NO: 3391288 - RNA, 15 nt, Pseudomonas aeruginosa PA01
cuguaccgcucccca

SEQ ID NO: 3391289 - RNA, 18 nt, Pseudomonas aeruginosa PA01
cuguaccgcuccccacuc

SEQ ID NO: 3391290 - RNA, 23 nt, Pseudomonas aeruginosa PA01
cuguaccgcuccccacucggcca

SEQ ID NO: 3391291 - RNA, 18 nt, Pseudomonas aeruginosa PA01
cuguaccgcuuccugggc

SEQ ID NO: 3391292 - RNA, 19 nt, Pseudomonas aeruginosa PA01
cuguaccgcuuccugggcu

SEQ ID NO: 3391293 - RNA, 12 nt, Pseudomonas aeruginosa PA01
cuguagaaugcg

SEQ ID NO: 3391294 - RNA, 14 nt, Pseudomonas aeruginosa PA01
cuguagaccagaua

SEQ ID NO: 3391295 - RNA, 20 nt, Pseudomonas aeruginosa PA01
cuguagcagggugcgggcgc

SEQ ID NO: 3391296 - RNA, 24 nt, Pseudomonas aeruginosa PA01
cuguagccacggcgagagcgccga

SEQ ID NO: 3391297 - RNA, 12 nt, Pseudomonas aeruginosa PA01
cuguagccggcg

SEQ ID NO: 3391298 - RNA, 21 nt, Pseudomonas aeruginosa PA01
cuguagccggcgaugugcggc

SEQ ID NO: 3391299 - RNA, 14 nt, Pseudomonas aeruginosa PA01
cuguagccggcgcc

SEQ ID NO: 3391300 - RNA, 19 nt, Pseudomonas aeruginosa PA01
cuguagccggcgccgucga

SEQ ID NO: 3391301 - RNA, 14 nt, Pseudomonas aeruginosa PA01
cuguagccucccgc

SEQ ID NO: 3391302 - RNA, 16 nt, Pseudomonas aeruginosa PA01
cuguagccucccgccg

SEQ ID NO: 3391303 - RNA, 19 nt, Pseudomonas aeruginosa PA01
cuguagcgcuccuguucgu

SEQ ID NO: 3391304 - RNA, 15 nt, Pseudomonas aeruginosa PA01
cuguagcggcuugca

SEQ ID NO: 3391305 - RNA, 22 nt, Pseudomonas aeruginosa PA01
cuguagcguuccgggcagcggc

SEQ ID NO: 3391306 - RNA, 17 nt, Pseudomonas aeruginosa PA01
cuguagcucugcuggcu

SEQ ID NO: 3391307 - RNA, 13 nt, Pseudomonas aeruginosa PA01
cuguaggacaggu

SEQ ID NO: 3391308 - RNA, 22 nt, Pseudomonas aeruginosa PA01
cuguaggacagguucaggucga

SEQ ID NO: 3391309 - RNA, 15 nt, Pseudomonas aeruginosa PA01
cuguaggacucgaua

SEQ ID NO: 3391310 - RNA, 18 nt, Pseudomonas aeruginosa PA01
cuguaggcgagcagcggc

SEQ ID NO: 3391311 - RNA, 22 nt, Pseudomonas aeruginosa PA01
cuguagggucgcagcaggccgc

SEQ ID NO: 3391312 - RNA, 22 nt, Pseudomonas aeruginosa PA01
cuguaguacaugacgaagcgca

SEQ ID NO: 3391313 - RNA, 19 nt, Pseudomonas aeruginosa PA01
cuguagugcuccggggcgc

SEQ ID NO: 3391314 - RNA, 20 nt, Pseudomonas aeruginosa PA01
cuguagugcuccggggcgcu

SEQ ID NO: 3391315 - RNA, 19 nt, Pseudomonas aeruginosa PA01
cuguaguugacgucgccga

SEQ ID NO: 3391316 - RNA, 21 nt, Pseudomonas aeruginosa PA01
cuguaguugacgucgccgaug

SEQ ID NO: 3391317 - RNA, 22 nt, Pseudomonas aeruginosa PA01
cuguaguugacgucgccgaugc

SEQ ID NO: 3391318 - RNA, 22 nt, Pseudomonas aeruginosa PA01
cuguaguuguucggcugggcca

SEQ ID NO: 3391319 - RNA, 18 nt, Pseudomonas aeruginosa PA01
cugucacgccgggggucg

SEQ ID NO: 3391320 - RNA, 20 nt, Pseudomonas aeruginosa PA01
cugucagcgcccggcugugc

SEQ ID NO: 3391321 - RNA, 12 nt, Pseudomonas aeruginosa PA01
cugucagggcuu

SEQ ID NO: 3391322 - RNA, 18 nt, Pseudomonas aeruginosa PA01
cugucagggcuugcgcgc

SEQ ID NO: 3391323 - RNA, 23 nt, Pseudomonas aeruginosa PA01
cugucagggcuugcgcgccacca

SEQ ID NO: 3391324 - RNA, 19 nt, Pseudomonas aeruginosa PA01
cuguccaauauagccauca

SEQ ID NO: 3391325 - RNA, 17 nt, Pseudomonas aeruginosa PA01
cuguccagcucccccac

SEQ ID NO: 3391326 - RNA, 16 nt, Pseudomonas aeruginosa PA01
cuguccagucaccagg

SEQ ID NO: 3391327 - RNA, 17 nt, Pseudomonas aeruginosa PA01
cuguccagucaccaggu

SEQ ID NO: 3391328 - RNA, 17 nt, Pseudomonas aeruginosa PA01
cuguccaucucgccgcg

SEQ ID NO: 3391329 - RNA, 12 nt, Pseudomonas aeruginosa PA01
cugucccagcga

SEQ ID NO: 3391330 - RNA, 14 nt, Pseudomonas aeruginosa PA01
cugucccagcgagu

SEQ ID NO: 3391331 - RNA, 20 nt, Pseudomonas aeruginosa PA01
cuguccccucacggcgcgag

SEQ ID NO: 3391332 - RNA, 16 nt, Pseudomonas aeruginosa PA01
cugucccgccgcgccg

SEQ ID NO: 3391333 - RNA, 17 nt, Pseudomonas aeruginosa PA01
cugucccgccgcgccgc

SEQ ID NO: 3391334 - RNA, 19 nt, Pseudomonas aeruginosa PA01
cugucccgccgcgccgcuc

SEQ ID NO: 3391335 - RNA, 20 nt, Pseudomonas aeruginosa PA01
cugucccggccauuccuucc

SEQ ID NO: 3391336 - RNA, 21 nt, Pseudomonas aeruginosa PA01
cugucccggccauuccuucca

SEQ ID NO: 3391337 - RNA, 14 nt, Pseudomonas aeruginosa PA01
cuguccgaccacuu

SEQ ID NO: 3391338 - RNA, 15 nt, Pseudomonas aeruginosa PA01
cuguccgccgccgcg

SEQ ID NO: 3391339 - RNA, 22 nt, Pseudomonas aeruginosa PA01
cuguccgccggccucgaagaac

SEQ ID NO: 3391340 - RNA, 15 nt, Pseudomonas aeruginosa PA01
cuguccgcugcgcga

SEQ ID NO: 3391341 - RNA, 17 nt, Pseudomonas aeruginosa PA01
cuguccguugcgcagca

SEQ ID NO: 3391342 - RNA, 15 nt, Pseudomonas aeruginosa PA01
cuguccuccagcggc

SEQ ID NO: 3391343 - RNA, 18 nt, Pseudomonas aeruginosa PA01
cuguccuccagcggcggg

SEQ ID NO: 3391344 - RNA, 20 nt, Pseudomonas aeruginosa PA01
cugucgacgcagccgggccg

SEQ ID NO: 3391345 - RNA, 15 nt, Pseudomonas aeruginosa PA01
cugucgagcacggcg

SEQ ID NO: 3391346 - RNA, 15 nt, Pseudomonas aeruginosa PA01
cugucgaggccucgu

SEQ ID NO: 3391347 - RNA, 19 nt, Pseudomonas aeruginosa PA01
cugucgauaccagcgccgc

SEQ ID NO: 3391348 - RNA, 20 nt, Pseudomonas aeruginosa PA01
cugucgccgagcaccccgac

SEQ ID NO: 3391349 - RNA, 23 nt, Pseudomonas aeruginosa PA01
cuguugcccugggccggcgccag

SEQ ID NO: 3391350 - RNA, 15 nt, Pseudomonas aeruginosa PA01
cuguugccgcgcuug

SEQ ID NO: 3391351 - RNA, 19 nt, Pseudomonas aeruginosa PA01
cuguugccgcugcaggcca

SEQ ID NO: 3391352 - RNA, 22 nt, Pseudomonas aeruginosa PA01
cuguugccguucugugcggcga

SEQ ID NO: 3391353 - RNA, 16 nt, Pseudomonas aeruginosa PA01
cuguugguggggcgcc

SEQ ID NO: 3391354 - RNA, 19 nt, Pseudomonas aeruginosa PA01
cuguugguggggcgccggc

SEQ ID NO: 3391355 - RNA, 21 nt, Pseudomonas aeruginosa PA01
cuguuguugccggucuugccg

SEQ ID NO: 3391356 - RNA, 21 nt, Pseudomonas aeruginosa PA01
cuguuucaacucccaggacac

SEQ ID NO: 3391357 - RNA, 16 nt, Pseudomonas aeruginosa PA01
cuguuucaggccggcg

SEQ ID NO: 3391358 - RNA, 19 nt, Pseudomonas aeruginosa PA01
cuguuucggguccaggcgc

SEQ ID NO: 3391359 - RNA, 20 nt, Pseudomonas aeruginosa PA01
cuguuucuccaguucggcga

SEQ ID NO: 3391360 - RNA, 17 nt, Pseudomonas aeruginosa PA01
cuguuugcggcgcaggc

SEQ ID NO: 3391361 - RNA, 20 nt, Pseudomonas aeruginosa PA01
cuguuugcggcgcaggcgga

SEQ ID NO: 3391362 - RNA, 18 nt, Pseudomonas aeruginosa PA01
cuuaccagaagccggccg

SEQ ID NO: 3391363 - RNA, 17 nt, Pseudomonas aeruginosa PA01
cuuagacccacugaaga

SEQ ID NO: 3391364 - RNA, 21 nt, Pseudomonas aeruginosa PA01
cuuaggcggauaacgccagga

SEQ ID NO: 3391365 - RNA, 14 nt, Pseudomonas aeruginosa PA01
cuuauugaaauuaa

SEQ ID NO: 3391366 - RNA, 15 nt, Pseudomonas aeruginosa PA01
cuucaaaaaccaugc

SEQ ID NO: 3391367 - RNA, 21 nt, Pseudomonas aeruginosa PA01
cuucaaaggaaucuucggcgc

SEQ ID NO: 3391368 - RNA, 13 nt, Pseudomonas aeruginosa PA01
cuucaaccacucc

SEQ ID NO: 3391369 - RNA, 17 nt, Pseudomonas aeruginosa PA01
cuucaaccgcuggucgg

SEQ ID NO: 3391370 - RNA, 22 nt, Pseudomonas aeruginosa PA01
cuucaaccgcuggucggcaucc

SEQ ID NO: 3391371 - RNA, 12 nt, Pseudomonas aeruginosa PA01
cuucaacggugg

SEQ ID NO: 3391372 - RNA, 19 nt, Pseudomonas aeruginosa PA01
cuucacauggugggcgccg

SEQ ID NO: 3391373 - RNA, 20 nt, Pseudomonas aeruginosa PA01
cuucacauggugggcgccgc

SEQ ID NO: 3391374 - RNA, 21 nt, Pseudomonas aeruginosa PA01
cuucacauggugggcgccgcu

SEQ ID NO: 3391375 - RNA, 22 nt, Pseudomonas aeruginosa PA01
cuucacauggugggcgccgcug

SEQ ID NO: 3391376 - RNA, 12 nt, Pseudomonas aeruginosa PA01
cuucaccaccag

SEQ ID NO: 3391377 - RNA, 18 nt, Pseudomonas aeruginosa PA01
cuucaccaccagcgagga

SEQ ID NO: 3391378 - RNA, 17 nt, Pseudomonas aeruginosa PA01
cuucaccaccccacaaa

SEQ ID NO: 3391379 - RNA, 20 nt, Pseudomonas aeruginosa PA01
cuucacccgcagcggcagcg

SEQ ID NO: 3391380 - RNA, 13 nt, Pseudomonas aeruginosa PA01
cuucaccgcgccg

SEQ ID NO: 3391381 - RNA, 17 nt, Pseudomonas aeruginosa PA01
cuucaccgcgccgcgcu

SEQ ID NO: 3391382 - RNA, 21 nt, Pseudomonas aeruginosa PA01
cuucaccgcgccgcgcuuggc

SEQ ID NO: 3391383 - RNA, 17 nt, Pseudomonas aeruginosa PA01
cuucaccggcacgcccu

SEQ ID NO: 3391384 - RNA, 18 nt, Pseudomonas aeruginosa PA01
cuucaccguucccagcag

SEQ ID NO: 3391385 - RNA, 19 nt, Pseudomonas aeruginosa PA01
cuucaccguucccagcagc

SEQ ID NO: 3391386 - RNA, 22 nt, Pseudomonas aeruginosa PA01
cuucacgaauacccgguagacg

SEQ ID NO: 3391387 - RNA, 20 nt, Pseudomonas aeruginosa PA01
cuucacguaguugacccgcc

SEQ ID NO: 3391388 - RNA, 21 nt, Pseudomonas aeruginosa PA01
cuucacguaguugacccgccc

SEQ ID NO: 3391389 - RNA, 23 nt, Pseudomonas aeruginosa PA01
cuucacguaguugacccgccccu

SEQ ID NO: 3391390 - RNA, 18 nt, Pseudomonas aeruginosa PA01
cuucacuuccagcugcca

SEQ ID NO: 3391391 - RNA, 20 nt, Pseudomonas aeruginosa PA01
cuucagacgcaccgagggca

SEQ ID NO: 3391392 - RNA, 19 nt, Pseudomonas aeruginosa PA01
cuucagauaacgucgcagg

SEQ ID NO: 3391393 - RNA, 16 nt, Pseudomonas aeruginosa PA01
cuucagauacuccagc

SEQ ID NO: 3391394 - RNA, 20 nt, Pseudomonas aeruginosa PA01
cuucagauacuccagcagcg

SEQ ID NO: 3391395 - RNA, 17 nt, Pseudomonas aeruginosa PA01
cuucagcaccugcgccg

SEQ ID NO: 3391396 - RNA, 14 nt, Pseudomonas aeruginosa PA01
cuucagcacgccca

SEQ ID NO: 3391397 - RNA, 17 nt, Pseudomonas aeruginosa PA01
cuucagcacgcguccga

SEQ ID NO: 3391398 - RNA, 18 nt, Pseudomonas aeruginosa PA01
cuucagcacuucggcgcg

SEQ ID NO: 3391399 - RNA, 22 nt, Pseudomonas aeruginosa PA01
cuucagcacuucggcgcgcggc

SEQ ID NO: 3391400 - RNA, 13 nt, Pseudomonas aeruginosa PA01
cuucagcagcagg

SEQ ID NO: 3391401 - RNA, 19 nt, Pseudomonas aeruginosa PA01
cuucagcagcaugucgccg

SEQ ID NO: 3391402 - RNA, 20 nt, Pseudomonas aeruginosa PA01
cuucagcagcaugucgccgg

SEQ ID NO: 3391403 - RNA, 16 nt, Pseudomonas aeruginosa PA01
cuucagcaucaggucg

SEQ ID NO: 3391404 - RNA, 22 nt, Pseudomonas aeruginosa PA01
cuucagcaucaggucggcgcgc

SEQ ID NO: 3391405 - RNA, 16 nt, Pseudomonas aeruginosa PA01
cuucagccagaccggc

SEQ ID NO: 3391406 - RNA, 17 nt, Pseudomonas aeruginosa PA01
cuucagccagaccggca

SEQ ID NO: 3391407 - RNA, 14 nt, Pseudomonas aeruginosa PA01
cuucagccccagca

SEQ ID NO: 3391408 - RNA, 15 nt, Pseudomonas aeruginosa PA01
cuucagccccagcac

SEQ ID NO: 3391409 - RNA, 22 nt, Pseudomonas aeruginosa PA01
cuucagccccagcacgccgagc

SEQ ID NO: 3391410 - RNA, 21 nt, Pseudomonas aeruginosa PA01
cuucagcccggcaccaggccg

SEQ ID NO: 3391411 - RNA, 19 nt, Pseudomonas aeruginosa PA01
cuucagccgaccguccgcc

SEQ ID NO: 3391412 - RNA, 22 nt, Pseudomonas aeruginosa PA01
cuucagccgaccguccgccugc

SEQ ID NO: 3391413 - RNA, 22 nt, Pseudomonas aeruginosa PA01
cuucagcgagcggucggccaug

SEQ ID NO: 3391414 - RNA, 16 nt, Pseudomonas aeruginosa PA01
cuucagcgccaggccg

SEQ ID NO: 3391415 - RNA, 17 nt, Pseudomonas aeruginosa PA01
cuucagcgccaggccga

SEQ ID NO: 3391416 - RNA, 16 nt, Pseudomonas aeruginosa PA01
cuucagcgccgccagg

SEQ ID NO: 3391417 - RNA, 13 nt, Pseudomonas aeruginosa PA01
cuucagcgccggg

SEQ ID NO: 3391418 - RNA, 16 nt, Pseudomonas aeruginosa PA01
cuucagcgccuccagc

SEQ ID NO: 3391419 - RNA, 16 nt, Pseudomonas aeruginosa PA01
cuucagcgccucgacc

SEQ ID NO: 3391420 - RNA, 18 nt, Pseudomonas aeruginosa PA01
cuucagcgguggcguugu

SEQ ID NO: 3391421 - RNA, 11 nt, Pseudomonas aeruginosa PA01
cuucagcucca

SEQ ID NO: 3391422 - RNA, 13 nt, Pseudomonas aeruginosa PA01
cuucagcuccagc

SEQ ID NO: 3391423 - RNA, 14 nt, Pseudomonas aeruginosa PA01
cuucagcuccagca

SEQ ID NO: 3391424 - RNA, 18 nt, Pseudomonas aeruginosa PA01
cuucagcucgaggccagg

SEQ ID NO: 3391425 - RNA, 14 nt, Pseudomonas aeruginosa PA01
cuucagcuucuacu

SEQ ID NO: 3391426 - RNA, 14 nt, Pseudomonas aeruginosa PA01
cuucaggccgaagc

SEQ ID NO: 3391427 - RNA, 17 nt, Pseudomonas aeruginosa PA01
cuucaggccgcaguccg

SEQ ID NO: 3391428 - RNA, 15 nt, Pseudomonas aeruginosa PA01
cuucaggccggcgcc

SEQ ID NO: 3391429 - RNA, 19 nt, Pseudomonas aeruginosa PA01
cuucaggccguucaggcgg

SEQ ID NO: 3391430 - RNA, 19 nt, Pseudomonas aeruginosa PA01
cuucaggcgcgcggccagc

SEQ ID NO: 3391431 - RNA, 20 nt, Pseudomonas aeruginosa PA01
cuucaggcgcgcggccagcg

SEQ ID NO: 3391432 - RNA, 22 nt, Pseudomonas aeruginosa PA01
cuucaggcgcgcggccagcgcg

SEQ ID NO: 3391433 - RNA, 23 nt, Pseudomonas aeruginosa PA01
cuucaggcgcuccuugagcagcu

SEQ ID NO: 3391434 - RNA, 15 nt, Pseudomonas aeruginosa PA01
cuucaggcgugggcc

SEQ ID NO: 3391435 - RNA, 18 nt, Pseudomonas aeruginosa PA01
cuucaggcgugggccagc

SEQ ID NO: 3391436 - RNA, 19 nt, Pseudomonas aeruginosa PA01
cuucaggcgugggccagcc

SEQ ID NO: 3391437 - RNA, 16 nt, Pseudomonas aeruginosa PA01
cuucaggcucggccug

SEQ ID NO: 3391438 - RNA, 14 nt, Pseudomonas aeruginosa PA01
cuucaggcugucgg

SEQ ID NO: 3391439 - RNA, 16 nt, Pseudomonas aeruginosa PA01
cuucagggagaggaag

SEQ ID NO: 3391440 - RNA, 17 nt, Pseudomonas aeruginosa PA01
cuucaggguggcgcugc

SEQ ID NO: 3391441 - RNA, 23 nt, Pseudomonas aeruginosa PA01
cuucagguaaggcaccaccgccg

SEQ ID NO: 3391442 - RNA, 22 nt, Pseudomonas aeruginosa PA01
cuucagguagcucaucggcgac

SEQ ID NO: 3391443 - RNA, 23 nt, Pseudomonas aeruginosa PA01
cuucagguagcucaucggcgaca

SEQ ID NO: 3391444 - RNA, 22 nt, Pseudomonas aeruginosa PA01
cuucagguaggcgcgggcguag

SEQ ID NO: 3391445 - RNA, 23 nt, Pseudomonas aeruginosa PA01
cuucagguagugcaacaccuggc

SEQ ID NO: 3391446 - RNA, 21 nt, Pseudomonas aeruginosa PA01
cuucaguaggccagcggcucc

SEQ ID NO: 3391447 - RNA, 22 nt, Pseudomonas aeruginosa PA01
cuucaguaggccagcggcuccu

SEQ ID NO: 3391448 - RNA, 23 nt, Pseudomonas aeruginosa PA01
cuucaguaggccagcggcuccuc

SEQ ID NO: 3391449 - RNA, 19 nt, Pseudomonas aeruginosa PA01
cuucagugcacguuccagc

SEQ ID NO: 3391450 - RNA, 15 nt, Pseudomonas aeruginosa PA01
cuuccuggaagcgau

SEQ ID NO: 3391451 - RNA, 21 nt, Pseudomonas aeruginosa PA01
cuuccuggaagcgaugggcga

SEQ ID NO: 3391452 - RNA, 17 nt, Pseudomonas aeruginosa PA01
cuuccuggaccuccgcc

SEQ ID NO: 3391453 - RNA, 20 nt, Pseudomonas aeruginosa PA01
cuuccuggaccuccgccagg

SEQ ID NO: 3391454 - RNA, 12 nt, Pseudomonas aeruginosa PA01
cuuccuggccgg

SEQ ID NO: 3391455 - RNA, 13 nt, Pseudomonas aeruginosa PA01
cuuccuggcgccg

SEQ ID NO: 3391456 - RNA, 21 nt, Pseudomonas aeruginosa PA01
cuuccugggaauugcgcacgc

SEQ ID NO: 3391457 - RNA, 15 nt, Pseudomonas aeruginosa PA01
cuuccugggaugccg

SEQ ID NO: 3391458 - RNA, 19 nt, Pseudomonas aeruginosa PA01
cuuccugggcgugcuuggc

SEQ ID NO: 3391459 - RNA, 23 nt, Pseudomonas aeruginosa PA01
cuuccugggcuucguccgccugg

SEQ ID NO: 3391460 - RNA, 20 nt, Pseudomonas aeruginosa PA01
cuuccugguggaacagccgc

SEQ ID NO: 3391461 - RNA, 20 nt, Pseudomonas aeruginosa PA01
cuuccugugcgaggcuggcc

SEQ ID NO: 3391462 - RNA, 19 nt, Pseudomonas aeruginosa PA01
cuuccuucucccggcuggu

SEQ ID NO: 3391463 - RNA, 18 nt, Pseudomonas aeruginosa PA01
cuuccuucucgaagccga

SEQ ID NO: 3391464 - RNA, 16 nt, Pseudomonas aeruginosa PA01
cuuccuugaccacggc

SEQ ID NO: 3391465 - RNA, 19 nt, Pseudomonas aeruginosa PA01
cuuccuugaccacggcgag

SEQ ID NO: 3391466 - RNA, 17 nt, Pseudomonas aeruginosa PA01
cuuccuugcccugggcg

SEQ ID NO: 3391467 - RNA, 16 nt, Pseudomonas aeruginosa PA01
cuuccuugcgaucgag

SEQ ID NO: 3391468 - RNA, 17 nt, Pseudomonas aeruginosa PA01
cuuccuugcgcgggcaa

SEQ ID NO: 3391469 - RNA, 23 nt, Pseudomonas aeruginosa PA01
cuuccuugcugaagcccaggcgu

SEQ ID NO: 3391470 - RNA, 13 nt, Pseudomonas aeruginosa PA01
cuuccuuggcggg

SEQ ID NO: 3391471 - RNA, 17 nt, Pseudomonas aeruginosa PA01
cuuccuugucgaucagg

SEQ ID NO: 3391472 - RNA, 19 nt, Pseudomonas aeruginosa PA01
cuucgaacccgcccucgug

SEQ ID NO: 3391473 - RNA, 21 nt, Pseudomonas aeruginosa PA01
cuucgaacccgcccucguggc

SEQ ID NO: 3391474 - RNA, 16 nt, Pseudomonas aeruginosa PA01
cuucgaacgugcgcgc

SEQ ID NO: 3391475 - RNA, 14 nt, Pseudomonas aeruginosa PA01
cuucgaagaccccc

SEQ ID NO: 3391476 - RNA, 19 nt, Pseudomonas aeruginosa PA01
cuucgaagacccccugccg

SEQ ID NO: 3391477 - RNA, 20 nt, Pseudomonas aeruginosa PA01
cuucgaagccgagcugccgg

SEQ ID NO: 3391478 - RNA, 21 nt, Pseudomonas aeruginosa PA01
cuucgaagccgagcugccggg

SEQ ID NO: 3391479 - RNA, 17 nt, Pseudomonas aeruginosa PA01
cuucgaagccggcacgg

SEQ ID NO: 3391480 - RNA, 17 nt, Pseudomonas aeruginosa PA01
cuucgacauaggacugc

SEQ ID NO: 3391481 - RNA, 15 nt, Pseudomonas aeruginosa PA01
cuucgacaugggccg

SEQ ID NO: 3391482 - RNA, 20 nt, Pseudomonas aeruginosa PA01
cuucgacaugggccgcgcag

SEQ ID NO: 3391483 - RNA, 21 nt, Pseudomonas aeruginosa PA01
cuucgacaugggccgcgcaga

SEQ ID NO: 3391484 - RNA, 14 nt, Pseudomonas aeruginosa PA01
cuucgacgacaccu

SEQ ID NO: 3391485 - RNA, 19 nt, Pseudomonas aeruginosa PA01
cuucgacgacaccugcaac

SEQ ID NO: 3391486 - RNA, 16 nt, Pseudomonas aeruginosa PA01
cuucgacgcuggucag

SEQ ID NO: 3391487 - RNA, 20 nt, Pseudomonas aeruginosa PA01
cuucgagcaacacaugcagg

SEQ ID NO: 3391488 - RNA, 20 nt, Pseudomonas aeruginosa PA01
cuucgagccacucgugcaac

SEQ ID NO: 3391489 - RNA, 15 nt, Pseudomonas aeruginosa PA01
cuucgagccuggcca

SEQ ID NO: 3391490 - RNA, 17 nt, Pseudomonas aeruginosa PA01
cuucgagccuggccagg

SEQ ID NO: 3391491 - RNA, 19 nt, Pseudomonas aeruginosa PA01
cuucgagccuggccaggcg

SEQ ID NO: 3391492 - RNA, 22 nt, Pseudomonas aeruginosa PA01
cuucgaggcgggcgucggcguc

SEQ ID NO: 3391493 - RNA, 17 nt, Pseudomonas aeruginosa PA01
cuucgaugaaggucagc

SEQ ID NO: 3391494 - RNA, 16 nt, Pseudomonas aeruginosa PA01
cuucgaugcgccgcag

SEQ ID NO: 3391495 - RNA, 16 nt, Pseudomonas aeruginosa PA01
cuucgcaacggccguu

SEQ ID NO: 3391496 - RNA, 20 nt, Pseudomonas aeruginosa PA01
cuucgcaccagccggccgcg

SEQ ID NO: 3391497 - RNA, 21 nt, Pseudomonas aeruginosa PA01
cuucgcaccagccggccgcgu

SEQ ID NO: 3391498 - RNA, 13 nt, Pseudomonas aeruginosa PA01
cuucgcagauguc

SEQ ID NO: 3391499 - RNA, 19 nt, Pseudomonas aeruginosa PA01
cuucgcaggagucgacgaa

SEQ ID NO: 3391500 - RNA, 15 nt, Pseudomonas aeruginosa PA01
cuucgccagcggcca

SEQ ID NO: 3391501 - RNA, 15 nt, Pseudomonas aeruginosa PA01
cuucgccaguuccuu

SEQ ID NO: 3391502 - RNA, 16 nt, Pseudomonas aeruginosa PA01
cuucgcccauggcacg

SEQ ID NO: 3391503 - RNA, 20 nt, Pseudomonas aeruginosa PA01
cuucgcccauggcacgcagg

SEQ ID NO: 3391504 - RNA, 15 nt, Pseudomonas aeruginosa PA01
cuucgcccgcugcgc

SEQ ID NO: 3391505 - RNA, 16 nt, Pseudomonas aeruginosa PA01
cuucgcccuacgcggc

SEQ ID NO: 3391506 - RNA, 20 nt, Pseudomonas aeruginosa PA01
cuucgcccucagcagcgccg

SEQ ID NO: 3391507 - RNA, 21 nt, Pseudomonas aeruginosa PA01
cuucgcccucagcagcgccgc

SEQ ID NO: 3391508 - RNA, 22 nt, Pseudomonas aeruginosa PA01
cuucgccgaaagcacgcgcauc

SEQ ID NO: 3391509 - RNA, 23 nt, Pseudomonas aeruginosa PA01
cuucgccgaaagcacgcgcaucc

SEQ ID NO: 3391510 - RNA, 16 nt, Pseudomonas aeruginosa PA01
cuucgccgaccagguc

SEQ ID NO: 3391511 - RNA, 17 nt, Pseudomonas aeruginosa PA01
cuucgccgaucaccagg

SEQ ID NO: 3391512 - RNA, 17 nt, Pseudomonas aeruginosa PA01
cuucgccgcccgcgccu

SEQ ID NO: 3391513 - RNA, 18 nt, Pseudomonas aeruginosa PA01
cuucgccgcccucgcagu

SEQ ID NO: 3391514 - RNA, 13 nt, Pseudomonas aeruginosa PA01
cuucgccgccgcg

SEQ ID NO: 3391515 - RNA, 15 nt, Pseudomonas aeruginosa PA01
cuucgccgccgcgcg

SEQ ID NO: 3391516 - RNA, 24 nt, Pseudomonas aeruginosa PA01
cuucgccgccgcgcgcgcggucga

SEQ ID NO: 3391517 - RNA, 20 nt, Pseudomonas aeruginosa PA01
cuucgccggaagcuucaggc

SEQ ID NO: 3391518 - RNA, 17 nt, Pseudomonas aeruginosa PA01
cuucgccggagccuucu

SEQ ID NO: 3391519 - RNA, 17 nt, Pseudomonas aeruginosa PA01
cuucgccggccugcgcg

SEQ ID NO: 3391520 - RNA, 13 nt, Pseudomonas aeruginosa PA01
cuucgccgucgag

SEQ ID NO: 3391521 - RNA, 14 nt, Pseudomonas aeruginosa PA01
cuucgccgucgagc

SEQ ID NO: 3391522 - RNA, 20 nt, Pseudomonas aeruginosa PA01
cuucgccgucgagccagccc

SEQ ID NO: 3391523 - RNA, 18 nt, Pseudomonas aeruginosa PA01
cuucgccuccuucaucuu

SEQ ID NO: 3391524 - RNA, 15 nt, Pseudomonas aeruginosa PA01
cuucgccuggcgcga

SEQ ID NO: 3391525 - RNA, 16 nt, Pseudomonas aeruginosa PA01
cuucgccuucggcgug

SEQ ID NO: 3391526 - RNA, 18 nt, Pseudomonas aeruginosa PA01
cuucgccuucggcgugca

SEQ ID NO: 3391527 - RNA, 22 nt, Pseudomonas aeruginosa PA01
cuucgccuucggcgugcauggc

SEQ ID NO: 3391528 - RNA, 13 nt, Pseudomonas aeruginosa PA01
cuucgccuugccc

SEQ ID NO: 3391529 - RNA, 17 nt, Pseudomonas aeruginosa PA01
cuucgccuugcccuggc

SEQ ID NO: 3391530 - RNA, 22 nt, Pseudomonas aeruginosa PA01
cuucgcgacccucagucgcccc

SEQ ID NO: 3391531 - RNA, 18 nt, Pseudomonas aeruginosa PA01
cuucgcgcagcucggcca

SEQ ID NO: 3391532 - RNA, 22 nt, Pseudomonas aeruginosa PA01
cuucgcgcuccaggcccggcag

SEQ ID NO: 3391533 - RNA, 18 nt, Pseudomonas aeruginosa PA01
cuucgcggaucaacgccg

SEQ ID NO: 3391534 - RNA, 16 nt, Pseudomonas aeruginosa PA01
cuucgcggcggcgcgu

SEQ ID NO: 3391535 - RNA, 18 nt, Pseudomonas aeruginosa PA01
cuucgcgggccaggccga

SEQ ID NO: 3391536 - RNA, 19 nt, Pseudomonas aeruginosa PA01
cuucgcgggccaggccgag

SEQ ID NO: 3391537 - RNA, 20 nt, Pseudomonas aeruginosa PA01
cuucgcgggccaggccgagc

SEQ ID NO: 3391538 - RNA, 20 nt, Pseudomonas aeruginosa PA01
cuucgcgggugaccuggccg

SEQ ID NO: 3391539 - RNA, 21 nt, Pseudomonas aeruginosa PA01
cuucgcgggugaccuggccgc

SEQ ID NO: 3391540 - RNA, 14 nt, Pseudomonas aeruginosa PA01
cuucgcgguagacg

SEQ ID NO: 3391541 - RNA, 14 nt, Pseudomonas aeruginosa PA01
cuucgcgugccaga

SEQ ID NO: 3391542 - RNA, 13 nt, Pseudomonas aeruginosa PA01
cuucgcgugggcc

SEQ ID NO: 3391543 - RNA, 14 nt, Pseudomonas aeruginosa PA01
cuucgcgugggcca

SEQ ID NO: 3391544 - RNA, 16 nt, Pseudomonas aeruginosa PA01
cuucgcgugggccagg

SEQ ID NO: 3391545 - RNA, 18 nt, Pseudomonas aeruginosa PA01
cuucgcgugggccaggga

SEQ ID NO: 3391546 - RNA, 17 nt, Pseudomonas aeruginosa PA01
cuucgcguuggcggugc

SEQ ID NO: 3391547 - RNA, 22 nt, Pseudomonas aeruginosa PA01
cuucgcguuggcggugccgcag

SEQ ID NO: 3391548 - RNA, 22 nt, Pseudomonas aeruginosa PA01
cuucgcugagaccgauccagca

SEQ ID NO: 3391549 - RNA, 15 nt, Pseudomonas aeruginosa PA01
cuucgcuggaccagg

SEQ ID NO: 3391550 - RNA, 17 nt, Pseudomonas aeruginosa PA01
cuucgcuggaccaggcg

SEQ ID NO: 3391551 - RNA, 20 nt, Pseudomonas aeruginosa PA01
cuucgcuggugcucaugccu

SEQ ID NO: 3391552 - RNA, 16 nt, Pseudomonas aeruginosa PA01
cuucuugucgucggac

SEQ ID NO: 3391553 - RNA, 14 nt, Pseudomonas aeruginosa PA01
cuucuuucgacaug

SEQ ID NO: 3391554 - RNA, 19 nt, Pseudomonas aeruginosa PA01
cuucuuuuauacccggcgc

SEQ ID NO: 3391555 - RNA, 18 nt, Pseudomonas aeruginosa PA01
cuugaaaaucaaggauuu

SEQ ID NO: 3391556 - RNA, 22 nt, Pseudomonas aeruginosa PA01
cuugaaaccggcgaaccagugc

SEQ ID NO: 3391557 - RNA, 18 nt, Pseudomonas aeruginosa PA01
cuugaacaccucuucgcc

SEQ ID NO: 3391558 - RNA, 13 nt, Pseudomonas aeruginosa PA01
cuugaacagcagg

SEQ ID NO: 3391559 - RNA, 17 nt, Pseudomonas aeruginosa PA01
cuugaacagggucuugu

SEQ ID NO: 3391560 - RNA, 17 nt, Pseudomonas aeruginosa PA01
cuugaacgcgcgccuga

SEQ ID NO: 3391561 - RNA, 14 nt, Pseudomonas aeruginosa PA01
cuugaacucgcccg

SEQ ID NO: 3391562 - RNA, 20 nt, Pseudomonas aeruginosa PA01
cuugaacucgcccggcucgg

SEQ ID NO: 3391563 - RNA, 17 nt, Pseudomonas aeruginosa PA01
cuugaagaagcugccgg

SEQ ID NO: 3391564 - RNA, 17 nt, Pseudomonas aeruginosa PA01
cuugaagccuucgccca

SEQ ID NO: 3391565 - RNA, 14 nt, Pseudomonas aeruginosa PA01
cuugaagcggccau

SEQ ID NO: 3391566 - RNA, 15 nt, Pseudomonas aeruginosa PA01
cuugaaggcuuccug

SEQ ID NO: 3391567 - RNA, 15 nt, Pseudomonas aeruginosa PA01
cuugaaggugcccag

SEQ ID NO: 3391568 - RNA, 16 nt, Pseudomonas aeruginosa PA01
cuugaaggugcccagg

SEQ ID NO: 3391569 - RNA, 22 nt, Pseudomonas aeruginosa PA01
cuugaagucccauugcaucugc

SEQ ID NO: 3391570 - RNA, 23 nt, Pseudomonas aeruginosa PA01
cuugaccaccaugugcuggcgga

SEQ ID NO: 3391571 - RNA, 17 nt, Pseudomonas aeruginosa PA01
cuugaccaccgccaggc

SEQ ID NO: 3391572 - RNA, 17 nt, Pseudomonas aeruginosa PA01
cuugaccacggcgagga

SEQ ID NO: 3391573 - RNA, 14 nt, Pseudomonas aeruginosa PA01
cuugaccagcggcc

SEQ ID NO: 3391574 - RNA, 18 nt, Pseudomonas aeruginosa PA01
cuugaccagcggcccggc

SEQ ID NO: 3391575 - RNA, 23 nt, Pseudomonas aeruginosa PA01
cuugaccaucuuuuccugcuggc

SEQ ID NO: 3391576 - RNA, 16 nt, Pseudomonas aeruginosa PA01
cuugacccgacugcag

SEQ ID NO: 3391577 - RNA, 20 nt, Pseudomonas aeruginosa PA01
cuugacccgguacagcgccu

SEQ ID NO: 3391578 - RNA, 17 nt, Pseudomonas aeruginosa PA01
cuugacccucugguugg

SEQ ID NO: 3391579 - RNA, 13 nt, Pseudomonas aeruginosa PA01
cuugaccgccgcc

SEQ ID NO: 3391580 - RNA, 15 nt, Pseudomonas aeruginosa PA01
cuugaccgccgccgc

SEQ ID NO: 3391581 - RNA, 17 nt, Pseudomonas aeruginosa PA01
cuugaccgccgccuggg

SEQ ID NO: 3391582 - RNA, 18 nt, Pseudomonas aeruginosa PA01
cuugaccucgacgccgag

SEQ ID NO: 3391583 - RNA, 19 nt, Pseudomonas aeruginosa PA01
cuugaccucgacgccgagc

SEQ ID NO: 3391584 - RNA, 20 nt, Pseudomonas aeruginosa PA01
cuugaccucgacgccgagcc

SEQ ID NO: 3391585 - RNA, 20 nt, Pseudomonas aeruginosa PA01
cuugaccugcugggccagcg

SEQ ID NO: 3391586 - RNA, 14 nt, Pseudomonas aeruginosa PA01
cuugaccuucugca

SEQ ID NO: 3391587 - RNA, 20 nt, Pseudomonas aeruginosa PA01
cuugaccuugcucuucuggc

SEQ ID NO: 3391588 - RNA, 18 nt, Pseudomonas aeruginosa PA01
cuugaccuugucggccga

SEQ ID NO: 3391589 - RNA, 19 nt, Pseudomonas aeruginosa PA01
cuugaccuugucggccgac

SEQ ID NO: 3391590 - RNA, 14 nt, Pseudomonas aeruginosa PA01
cuugacgaaaaagc

SEQ ID NO: 3391591 - RNA, 20 nt, Pseudomonas aeruginosa PA01
cuugacggauaaaauccaca

SEQ ID NO: 3391592 - RNA, 13 nt, Pseudomonas aeruginosa PA01
cuugacguucagg

SEQ ID NO: 3391593 - RNA, 15 nt, Pseudomonas aeruginosa PA01
cuugacuggcagucc

SEQ ID NO: 3391594 - RNA, 17 nt, Pseudomonas aeruginosa PA01
cuugagaccuucgcggg

SEQ ID NO: 3391595 - RNA, 16 nt, Pseudomonas aeruginosa PA01
cuugagcacgguccgc

SEQ ID NO: 3391596 - RNA, 19 nt, Pseudomonas aeruginosa PA01
cuugagcaggcggccgucc

SEQ ID NO: 3391597 - RNA, 23 nt, Pseudomonas aeruginosa PA01
cuugagcaggcggccguccucgg

SEQ ID NO: 3391598 - RNA, 23 nt, Pseudomonas aeruginosa PA01
cuugagcagggcguucuuggccg

SEQ ID NO: 3391599 - RNA, 23 nt, Pseudomonas aeruginosa PA01
cuugagcauccacagggucggca

SEQ ID NO: 3391600 - RNA, 13 nt, Pseudomonas aeruginosa PA01
cuugagcgccagc

SEQ ID NO: 3391601 - RNA, 14 nt, Pseudomonas aeruginosa PA01
cuugagcgccagca

SEQ ID NO: 3391602 - RNA, 15 nt, Pseudomonas aeruginosa PA01
cuugagcgccagcag

SEQ ID NO: 3391603 - RNA, 17 nt, Pseudomonas aeruginosa PA01
cuugagcgccagcaggu

SEQ ID NO: 3391604 - RNA, 13 nt, Pseudomonas aeruginosa PA01
cuugagcgccgaa

SEQ ID NO: 3391605 - RNA, 16 nt, Pseudomonas aeruginosa PA01
cuugagcggaucgucg

SEQ ID NO: 3391606 - RNA, 12 nt, Pseudomonas aeruginosa PA01
cuugagcuggcg

SEQ ID NO: 3391607 - RNA, 14 nt, Pseudomonas aeruginosa PA01
cuugagcuggcgcu

SEQ ID NO: 3391608 - RNA, 21 nt, Pseudomonas aeruginosa PA01
cuugaggaaguagugcagcug

SEQ ID NO: 3391609 - RNA, 22 nt, Pseudomonas aeruginosa PA01
cuugaggaaguagugcagcugc

SEQ ID NO: 3391610 - RNA, 16 nt, Pseudomonas aeruginosa PA01
cuugaggaugucgcgg

SEQ ID NO: 3391611 - RNA, 14 nt, Pseudomonas aeruginosa PA01
cuugaggcgggcca

SEQ ID NO: 3391612 - RNA, 16 nt, Pseudomonas aeruginosa PA01
cuugaggcgggccagc

SEQ ID NO: 3391613 - RNA, 18 nt, Pseudomonas aeruginosa PA01
cuugaggcgggccagcag

SEQ ID NO: 3391614 - RNA, 20 nt, Pseudomonas aeruginosa PA01
cuugaggcgggccagcaggg

SEQ ID NO: 3391615 - RNA, 20 nt, Pseudomonas aeruginosa PA01
cuugagguaggccagcccca

SEQ ID NO: 3391616 - RNA, 18 nt, Pseudomonas aeruginosa PA01
cuugaggucgugcagcac

SEQ ID NO: 3391617 - RNA, 14 nt, Pseudomonas aeruginosa PA01
cuugaggucguugg

SEQ ID NO: 3391618 - RNA, 16 nt, Pseudomonas aeruginosa PA01
cuugaggucguuggcc

SEQ ID NO: 3391619 - RNA, 20 nt, Pseudomonas aeruginosa PA01
cuugaguagcuggcgcaggg

SEQ ID NO: 3391620 - RNA, 21 nt, Pseudomonas aeruginosa PA01
cuugaguagcuggcgcagggc

SEQ ID NO: 3391621 - RNA, 14 nt, Pseudomonas aeruginosa PA01
cuugaucaccgcgg

SEQ ID NO: 3391622 - RNA, 20 nt, Pseudomonas aeruginosa PA01
cuugaucaccgcggugcgga

SEQ ID NO: 3391623 - RNA, 13 nt, Pseudomonas aeruginosa PA01
cuugaucagcgcg

SEQ ID NO: 3391624 - RNA, 14 nt, Pseudomonas aeruginosa PA01
cuugaucagcgcgc

SEQ ID NO: 3391625 - RNA, 15 nt, Pseudomonas aeruginosa PA01
cuugauccgcuccag

SEQ ID NO: 3391626 - RNA, 18 nt, Pseudomonas aeruginosa PA01
cuugauccgcuccagcgc

SEQ ID NO: 3391627 - RNA, 20 nt, Pseudomonas aeruginosa PA01
cuugauccgcuccagcgccu

SEQ ID NO: 3391628 - RNA, 23 nt, Pseudomonas aeruginosa PA01
cuugauccgcuccagcgccucga

SEQ ID NO: 3391629 - RNA, 16 nt, Pseudomonas aeruginosa PA01
cuugaucgucucggug

SEQ ID NO: 3391630 - RNA, 22 nt, Pseudomonas aeruginosa PA01
cuugaugaagcccgcggcaucg

SEQ ID NO: 3391631 - RNA, 21 nt, Pseudomonas aeruginosa PA01
cuugaugaccguccacggcgc

SEQ ID NO: 3391632 - RNA, 16 nt, Pseudomonas aeruginosa PA01
cuugauggugugcagc

SEQ ID NO: 3391633 - RNA, 18 nt, Pseudomonas aeruginosa PA01
cuugauggugugcagcag

SEQ ID NO: 3391634 - RNA, 20 nt, Pseudomonas aeruginosa PA01
cuugauggugugcagcagca

SEQ ID NO: 3391635 - RNA, 20 nt, Pseudomonas aeruginosa PA01
cuugauguaggacaggccga

SEQ ID NO: 3391636 - RNA, 18 nt, Pseudomonas aeruginosa PA01
cuugcacauccagcccug

SEQ ID NO: 3391637 - RNA, 18 nt, Pseudomonas aeruginosa PA01
cuugcagcaacucgccgc

SEQ ID NO: 3391638 - RNA, 20 nt, Pseudomonas aeruginosa PA01
cuugcagccagccgucgucg

SEQ ID NO: 3391639 - RNA, 13 nt, Pseudomonas aeruginosa PA01
cuugcagggccgc

SEQ ID NO: 3391640 - RNA, 15 nt, Pseudomonas aeruginosa PA01
cuugcagggccgcca

SEQ ID NO: 3391641 - RNA, 17 nt, Pseudomonas aeruginosa PA01
cuugcagggccgccagc

SEQ ID NO: 3391642 - RNA, 20 nt, Pseudomonas aeruginosa PA01
cuugcagggccgccagccgc

SEQ ID NO: 3391643 - RNA, 22 nt, Pseudomonas aeruginosa PA01
cuugcagguagcugcuccagcc

SEQ ID NO: 3391644 - RNA, 23 nt, Pseudomonas aeruginosa PA01
cuugcaguucagccacugccgcc

SEQ ID NO: 3391645 - RNA, 22 nt, Pseudomonas aeruginosa PA01
cuugccaagguguggccgagcc

SEQ ID NO: 3391646 - RNA, 18 nt, Pseudomonas aeruginosa PA01
cuugccacugcgcgccag

SEQ ID NO: 3391647 - RNA, 14 nt, Pseudomonas aeruginosa PA01
cuugccagccgcuu

SEQ ID NO: 3391648 - RNA, 14 nt, Pseudomonas aeruginosa PA01
cuugccagggcagg

SEQ ID NO: 3391649 - RNA, 19 nt, Pseudomonas aeruginosa PA01
cuugccauccuccagcacu

SEQ ID NO: 3391650 - RNA, 14 nt, Pseudomonas aeruginosa PA01
cuugcccaugugca

SEQ ID NO: 3391651 - RNA, 20 nt, Pseudomonas aeruginosa PA01
cuugcccgaggugucgccgc

SEQ ID NO: 3391652 - RNA, 21 nt, Pseudomonas aeruginosa PA01
cuugcccgaggugucgccgcg

SEQ ID NO: 3391653 - RNA, 12 nt, Pseudomonas aeruginosa PA01
cuugcccggcgc

SEQ ID NO: 3391654 - RNA, 18 nt, Pseudomonas aeruginosa PA01
cuugcucaggucgucgag

SEQ ID NO: 3391655 - RNA, 15 nt, Pseudomonas aeruginosa PA01
cuugcuccagaucgc

SEQ ID NO: 3391656 - RNA, 14 nt, Pseudomonas aeruginosa PA01
cuugcucgacccgg

SEQ ID NO: 3391657 - RNA, 12 nt, Pseudomonas aeruginosa PA01
cuugcucgcggc

SEQ ID NO: 3391658 - RNA, 14 nt, Pseudomonas aeruginosa PA01
cuugcucucgcgca

SEQ ID NO: 3391659 - RNA, 12 nt, Pseudomonas aeruginosa PA01
cuugcucuucug

SEQ ID NO: 3391660 - RNA, 17 nt, Pseudomonas aeruginosa PA01
cuugcugaagcccaggc

SEQ ID NO: 3391661 - RNA, 14 nt, Pseudomonas aeruginosa PA01
cuugcugaagcccc

SEQ ID NO: 3391662 - RNA, 15 nt, Pseudomonas aeruginosa PA01
cuugcugaagcccca

SEQ ID NO: 3391663 - RNA, 22 nt, Pseudomonas aeruginosa PA01
cuugcugaucagguugccggcg

SEQ ID NO: 3391664 - RNA, 18 nt, Pseudomonas aeruginosa PA01
cuugcugccauggcggcg

SEQ ID NO: 3391665 - RNA, 17 nt, Pseudomonas aeruginosa PA01
cuugcuggcgcgauccg

SEQ ID NO: 3391666 - RNA, 21 nt, Pseudomonas aeruginosa PA01
cuugcuggcgcgauccgcgcg

SEQ ID NO: 3391667 - RNA, 22 nt, Pseudomonas aeruginosa PA01
cuugcuggcguucucggccagg

SEQ ID NO: 3391668 - RNA, 19 nt, Pseudomonas aeruginosa PA01
cuugcuggugcccugggcg

SEQ ID NO: 3391669 - RNA, 15 nt, Pseudomonas aeruginosa PA01
cuugcuguugccgcu

SEQ ID NO: 3391670 - RNA, 17 nt, Pseudomonas aeruginosa PA01
cuuggacagcucgcggg

SEQ ID NO: 3391671 - RNA, 19 nt, Pseudomonas aeruginosa PA01
cuuggcaccgcgcagcguc

SEQ ID NO: 3391672 - RNA, 19 nt, Pseudomonas aeruginosa PA01
cuuggcacgaacccaggcg

SEQ ID NO: 3391673 - RNA, 16 nt, Pseudomonas aeruginosa PA01
cuuggcagucgccgcc

SEQ ID NO: 3391674 - RNA, 14 nt, Pseudomonas aeruginosa PA01
cuuggcaucgccgc

SEQ ID NO: 3391675 - RNA, 15 nt, Pseudomonas aeruginosa PA01
cuuggcaucgccgcc

SEQ ID NO: 3391676 - RNA, 17 nt, Pseudomonas aeruginosa PA01
cuuggccacgacccugc

SEQ ID NO: 3391677 - RNA, 15 nt, Pseudomonas aeruginosa PA01
cuuggccacguccuu

SEQ ID NO: 3391678 - RNA, 16 nt, Pseudomonas aeruginosa PA01
cuuggccacuccgggc

SEQ ID NO: 3391679 - RNA, 16 nt, Pseudomonas aeruginosa PA01
cuuggccagcagcauc

SEQ ID NO: 3391680 - RNA, 20 nt, Pseudomonas aeruginosa PA01
cuuggccagcagcaucggac

SEQ ID NO: 3391681 - RNA, 13 nt, Pseudomonas aeruginosa PA01
cuuggccagcagg

SEQ ID NO: 3391682 - RNA, 16 nt, Pseudomonas aeruginosa PA01
cuuggccagcaggccg

SEQ ID NO: 3391683 - RNA, 18 nt, Pseudomonas aeruginosa PA01
cuuggccagcaggccgag

SEQ ID NO: 3391684 - RNA, 19 nt, Pseudomonas aeruginosa PA01
cuuggccagcaggccgagc

SEQ ID NO: 3391685 - RNA, 12 nt, Pseudomonas aeruginosa PA01
cuuggccagccg

SEQ ID NO: 3391686 - RNA, 13 nt, Pseudomonas aeruginosa PA01
cuuggccagccgc

SEQ ID NO: 3391687 - RNA, 15 nt, Pseudomonas aeruginosa PA01
cuuggccagccgcgc

SEQ ID NO: 3391688 - RNA, 19 nt, Pseudomonas aeruginosa PA01
cuuggccagccgcgcggca

SEQ ID NO: 3391689 - RNA, 14 nt, Pseudomonas aeruginosa PA01
cuuggccaggcgcu

SEQ ID NO: 3391690 - RNA, 17 nt, Pseudomonas aeruginosa PA01
cuuggccaugaugugcg

SEQ ID NO: 3391691 - RNA, 23 nt, Pseudomonas aeruginosa PA01
cuuggcccggcguuucgccgggc

SEQ ID NO: 3391692 - RNA, 16 nt, Pseudomonas aeruginosa PA01
cuuggcccgguuggcc

SEQ ID NO: 3391693 - RNA, 21 nt, Pseudomonas aeruginosa PA01
cuuggcccgguuggccaggac

SEQ ID NO: 3391694 - RNA, 14 nt, Pseudomonas aeruginosa PA01
cuuggcccuggccu

SEQ ID NO: 3391695 - RNA, 15 nt, Pseudomonas aeruginosa PA01
cuuggcccuggccuu

SEQ ID NO: 3391696 - RNA, 22 nt, Pseudomonas aeruginosa PA01
cuuggccuugccguccagccgg

SEQ ID NO: 3391697 - RNA, 14 nt, Pseudomonas aeruginosa PA01
cuuggcgaggcgcg

SEQ ID NO: 3391698 - RNA, 15 nt, Pseudomonas aeruginosa PA01
cuuggcgaggcgcgc

SEQ ID NO: 3391699 - RNA, 15 nt, Pseudomonas aeruginosa PA01
cuuggcgcagguagu

SEQ ID NO: 3391700 - RNA, 16 nt, Pseudomonas aeruginosa PA01
cuuggcgcgacugucg

SEQ ID NO: 3391701 - RNA, 13 nt, Pseudomonas aeruginosa PA01
cuuggcgcgcagg

SEQ ID NO: 3391702 - RNA, 14 nt, Pseudomonas aeruginosa PA01
cuuggcgcgcaggg

SEQ ID NO: 3391703 - RNA, 15 nt, Pseudomonas aeruginosa PA01
cuuggcgcgcagggc

SEQ ID NO: 3391704 - RNA, 13 nt, Pseudomonas aeruginosa PA01
cuuggcgcgcugg

SEQ ID NO: 3391705 - RNA, 14 nt, Pseudomonas aeruginosa PA01
cuuggcgcgcuggc

SEQ ID NO: 3391706 - RNA, 16 nt, Pseudomonas aeruginosa PA01
cuuggcgucgcggcuu

SEQ ID NO: 3391707 - RNA, 14 nt, Pseudomonas aeruginosa PA01
cuuggcucggcagc

SEQ ID NO: 3391708 - RNA, 15 nt, Pseudomonas aeruginosa PA01
cuuggcugcucgccu

SEQ ID NO: 3391709 - RNA, 16 nt, Pseudomonas aeruginosa PA01
cuuggcuucagcuucu

SEQ ID NO: 3391710 - RNA, 12 nt, Pseudomonas aeruginosa PA01
cuuggcuuccug

SEQ ID NO: 3391711 - RNA, 14 nt, Pseudomonas aeruginosa PA01
cuuggcuuccuggc

SEQ ID NO: 3391712 - RNA, 15 nt, Pseudomonas aeruginosa PA01
cuuggcuuccuggcg

SEQ ID NO: 3391713 - RNA, 15 nt, Pseudomonas aeruginosa PA01
cuugggauggccagc

SEQ ID NO: 3391714 - RNA, 12 nt, Pseudomonas aeruginosa PA01
cuugggcaucga

SEQ ID NO: 3391715 - RNA, 22 nt, Pseudomonas aeruginosa PA01
cuugggccaggcauccagcacc

SEQ ID NO: 3391716 - RNA, 19 nt, Pseudomonas aeruginosa PA01
cuugguauccaccucgccc

SEQ ID NO: 3391717 - RNA, 22 nt, Pseudomonas aeruginosa PA01
cuuggucacgccguucaggguc

SEQ ID NO: 3391718 - RNA, 14 nt, Pseudomonas aeruginosa PA01
cuuggucaggccga

SEQ ID NO: 3391719 - RNA, 15 nt, Pseudomonas aeruginosa PA01
cuuggucaggccgac

SEQ ID NO: 3391720 - RNA, 16 nt, Pseudomonas aeruginosa PA01
cuuggucagggucgag

SEQ ID NO: 3391721 - RNA, 23 nt, Pseudomonas aeruginosa PA01
cuuggucagggucgagucggguc

SEQ ID NO: 3391722 - RNA, 17 nt, Pseudomonas aeruginosa PA01
cuuggucaggucgacgc

SEQ ID NO: 3391723 - RNA, 17 nt, Pseudomonas aeruginosa PA01
cuuggucgggcgccgcg

SEQ ID NO: 3391724 - RNA, 19 nt, Pseudomonas aeruginosa PA01
cuuggucgggcgccgcgcc

SEQ ID NO: 3391725 - RNA, 20 nt, Pseudomonas aeruginosa PA01
cuuggugaugaagucggcgu

SEQ ID NO: 3391726 - RNA, 14 nt, Pseudomonas aeruginosa PA01
cuuggugccgaccu

SEQ ID NO: 3391727 - RNA, 17 nt, Pseudomonas aeruginosa PA01
cuuggugccgaccuuca

SEQ ID NO: 3391728 - RNA, 19 nt, Pseudomonas aeruginosa PA01
cuugguguagccgagcacg

SEQ ID NO: 3391729 - RNA, 15 nt, Pseudomonas aeruginosa PA01
cuuggugucggccgc

SEQ ID NO: 3391730 - RNA, 21 nt, Pseudomonas aeruginosa PA01
cuuguacagcuucaggcgcac

SEQ ID NO: 3391731 - RNA, 18 nt, Pseudomonas aeruginosa PA01
cuuguacggcagcggcgu

SEQ ID NO: 3391732 - RNA, 17 nt, Pseudomonas aeruginosa PA01
cuuguagaacggcggca

SEQ ID NO: 3391733 - RNA, 16 nt, Pseudomonas aeruginosa PA01
cuuguagcagccgcag

SEQ ID NO: 3391734 - RNA, 17 nt, Pseudomonas aeruginosa PA01
cuuguauaccagcggcu

SEQ ID NO: 3391735 - RNA, 23 nt, Pseudomonas aeruginosa PA01
cuuguauaccagcggcuggcuga

SEQ ID NO: 3391736 - RNA, 14 nt, Pseudomonas aeruginosa PA01
cuuguccagggccg

SEQ ID NO: 3391737 - RNA, 19 nt, Pseudomonas aeruginosa PA01
cuuguccaggguuuccugg

SEQ ID NO: 3391738 - RNA, 14 nt, Pseudomonas aeruginosa PA01
cuuguccaucggcu

SEQ ID NO: 3391739 - RNA, 21 nt, Pseudomonas aeruginosa PA01
cuuguccggcaccaccagcgc

SEQ ID NO: 3391740 - RNA, 14 nt, Pseudomonas aeruginosa PA01
cuuguccggcccgg

SEQ ID NO: 3391741 - RNA, 21 nt, Pseudomonas aeruginosa PA01
cuuguccggcccggagcgcga

SEQ ID NO: 3391742 - RNA, 23 nt, Pseudomonas aeruginosa PA01
cuuguccggguaguccagcgagu

SEQ ID NO: 3391743 - RNA, 13 nt, Pseudomonas aeruginosa PA01
cuuguccuggaua

SEQ ID NO: 3391744 - RNA, 22 nt, Pseudomonas aeruginosa PA01
cuuguccuggauaagccgcgcc

SEQ ID NO: 3391745 - RNA, 21 nt, Pseudomonas aeruginosa PA01
cuuguccuuccagcucucgcu

SEQ ID NO: 3391746 - RNA, 17 nt, Pseudomonas aeruginosa PA01
cuuguccuuggccuccg

SEQ ID NO: 3391747 - RNA, 18 nt, Pseudomonas aeruginosa PA01
cuugucgaccagcggcgg

SEQ ID NO: 3391748 - RNA, 22 nt, Pseudomonas aeruginosa PA01
cuugucgagguagguccaggcg

SEQ ID NO: 3391749 - RNA, 13 nt, Pseudomonas aeruginosa PA01
cuugucgaucagg

SEQ ID NO: 3391750 - RNA, 19 nt, Pseudomonas aeruginosa PA01
cuugucgaugagccagccu

SEQ ID NO: 3391751 - RNA, 14 nt, Pseudomonas aeruginosa PA01
cuugucgcaccagc

SEQ ID NO: 3391752 - RNA, 16 nt, Pseudomonas aeruginosa PA01
cuugucgcaccagccu

SEQ ID NO: 3391753 - RNA, 12 nt, Pseudomonas aeruginosa PA01
cuugucgccgcu

SEQ ID NO: 3391754 - RNA, 15 nt, Pseudomonas aeruginosa PA01
cuugucgccgcuggg

SEQ ID NO: 3391755 - RNA, 19 nt, Pseudomonas aeruginosa PA01
cuugucgccgcugggcagc

SEQ ID NO: 3391756 - RNA, 18 nt, Pseudomonas aeruginosa PA01
cuugucgcgggucugcga

SEQ ID NO: 3391757 - RNA, 12 nt, Pseudomonas aeruginosa PA01
gaaaacgccgcu

SEQ ID NO: 3391758 - RNA, 15 nt, Pseudomonas aeruginosa PA01
gaaaacgcucaggcc

SEQ ID NO: 3391759 - RNA, 15 nt, Pseudomonas aeruginosa PA01
gaaaacugucggcgg

SEQ ID NO: 3391760 - RNA, 17 nt, Pseudomonas aeruginosa PA01
gaaaagaaaaggccacc

SEQ ID NO: 3391761 - RNA, 19 nt, Pseudomonas aeruginosa PA01
gaaaagaagccccgcagcc

SEQ ID NO: 3391762 - RNA, 21 nt, Pseudomonas aeruginosa PA01
gaaaagaagccgcgcaaggca

SEQ ID NO: 3391763 - RNA, 21 nt, Pseudomonas aeruginosa PA01
gaaaagaaggcggauggcguu

SEQ ID NO: 3391764 - RNA, 12 nt, Pseudomonas aeruginosa PA01
gaaaagcaggcc

SEQ ID NO: 3391765 - RNA, 23 nt, Pseudomonas aeruginosa PA01
gaaaagcccgccaccuggcgggc

SEQ ID NO: 3391766 - RNA, 20 nt, Pseudomonas aeruginosa PA01
gaaaagcgguuucgccaccu

SEQ ID NO: 3391767 - RNA, 13 nt, Pseudomonas aeruginosa PA01
gaaaaggaucgcc

SEQ ID NO: 3391768 - RNA, 16 nt, Pseudomonas aeruginosa PA01
gaaaaggaucgccgcg

SEQ ID NO: 3391769 - RNA, 22 nt, Pseudomonas aeruginosa PA01
gaaaaggcccggcguccucgcg

SEQ ID NO: 3391770 - RNA, 11 nt, Pseudomonas aeruginosa PA01
gaaaaggccgc

SEQ ID NO: 3391771 - RNA, 18 nt, Pseudomonas aeruginosa PA01
gaaaaucauccacaggcg

SEQ ID NO: 3391772 - RNA, 13 nt, Pseudomonas aeruginosa PA01
gaaacaccaggcc

SEQ ID NO: 3391773 - RNA, 17 nt, Pseudomonas aeruginosa PA01
gaaacaccaggccgaug

SEQ ID NO: 3391774 - RNA, 21 nt, Pseudomonas aeruginosa PA01
gaaacaccaggccgaugaacg

SEQ ID NO: 3391775 - RNA, 17 nt, Pseudomonas aeruginosa PA01
gaaacagggcgacgccg

SEQ ID NO: 3391776 - RNA, 21 nt, Pseudomonas aeruginosa PA01
gaaacaguuggacugcgaggc

SEQ ID NO: 3391777 - RNA, 14 nt, Pseudomonas aeruginosa PA01
gaaaccaccaggaa

SEQ ID NO: 3391778 - RNA, 17 nt, Pseudomonas aeruginosa PA01
gaaacccaugcccgccc

SEQ ID NO: 3391779 - RNA, 12 nt, Pseudomonas aeruginosa PA01
gaaaccccacca

SEQ ID NO: 3391780 - RNA, 14 nt, Pseudomonas aeruginosa PA01
gaaaccccggccug

SEQ ID NO: 3391781 - RNA, 20 nt, Pseudomonas aeruginosa PA01
gaaacccgugguccgccagc

SEQ ID NO: 3391782 - RNA, 23 nt, Pseudomonas aeruginosa PA01
gaaacccgugguccgccagcagg

SEQ ID NO: 3391783 - RNA, 18 nt, Pseudomonas aeruginosa PA01
gaaacccuuccagccgcc

SEQ ID NO: 3391784 - RNA, 14 nt, Pseudomonas aeruginosa PA01
gaaaccgaucagca

SEQ ID NO: 3391785 - RNA, 17 nt, Pseudomonas aeruginosa PA01
gaaaccgaucagcaccg

SEQ ID NO: 3391786 - RNA, 13 nt, Pseudomonas aeruginosa PA01
gaaaccgcggccg

SEQ ID NO: 3391787 - RNA, 17 nt, Pseudomonas aeruginosa PA01
gaaaccgcggccggcuu

SEQ ID NO: 3391788 - RNA, 16 nt, Pseudomonas aeruginosa PA01
gaaaccggccagcgca

SEQ ID NO: 3391789 - RNA, 18 nt, Pseudomonas aeruginosa PA01
gaaaccggcgaaccagug

SEQ ID NO: 3391790 - RNA, 19 nt, Pseudomonas aeruginosa PA01
gaaaccguggucgccgcuc

SEQ ID NO: 3391791 - RNA, 13 nt, Pseudomonas aeruginosa PA01
gaaaccucgccga

SEQ ID NO: 3391792 - RNA, 15 nt, Pseudomonas aeruginosa PA01
gaaaccucgccgguc

SEQ ID NO: 3391793 - RNA, 18 nt, Pseudomonas aeruginosa PA01
gaaaccuucgguggcgac

SEQ ID NO: 3391794 - RNA, 14 nt, Pseudomonas aeruginosa PA01
gaaacgaagcuuca

SEQ ID NO: 3391795 - RNA, 15 nt, Pseudomonas aeruginosa PA01
gaaacgcagggccgg

SEQ ID NO: 3391796 - RNA, 19 nt, Pseudomonas aeruginosa PA01
gaaacgcagggccucuucg

SEQ ID NO: 3391797 - RNA, 14 nt, Pseudomonas aeruginosa PA01
gaaacgcgccuccg

SEQ ID NO: 3391798 - RNA, 21 nt, Pseudomonas aeruginosa PA01
gaaacgcgcgcucucgccggc

SEQ ID NO: 3391799 - RNA, 14 nt, Pseudomonas aeruginosa PA01
gaaacgcucggcgu

SEQ ID NO: 3391800 - RNA, 16 nt, Pseudomonas aeruginosa PA01
gaaacgcuggcggccg

SEQ ID NO: 3391801 - RNA, 20 nt, Pseudomonas aeruginosa PA01
gaaacgcuugagcuggcgcu

SEQ ID NO: 3391802 - RNA, 19 nt, Pseudomonas aeruginosa PA01
gaaacggcaggccagcagg

SEQ ID NO: 3391803 - RNA, 18 nt, Pseudomonas aeruginosa PA01
gaaacggcgcgucuccau

SEQ ID NO: 3391804 - RNA, 20 nt, Pseudomonas aeruginosa PA01
gaaacggcggaauuccugcu

SEQ ID NO: 3391805 - RNA, 15 nt, Pseudomonas aeruginosa PA01
gaaacggcugccggu

SEQ ID NO: 3391806 - RNA, 13 nt, Pseudomonas aeruginosa PA01
gaaacgggcgcuc

SEQ ID NO: 3391807 - RNA, 14 nt, Pseudomonas aeruginosa PA01
gaaacgggcgcucu

SEQ ID NO: 3391808 - RNA, 14 nt, Pseudomonas aeruginosa PA01
gaaacgguccacca

SEQ ID NO: 3391809 - RNA, 15 nt, Pseudomonas aeruginosa PA01
gaaacgguccaccag

SEQ ID NO: 3391810 - RNA, 22 nt, Pseudomonas aeruginosa PA01
gaaacggugacgggcauugucc

SEQ ID NO: 3391811 - RNA, 21 nt, Pseudomonas aeruginosa PA01
gaaacgguuggccucggcccg

SEQ ID NO: 3391812 - RNA, 19 nt, Pseudomonas aeruginosa PA01
gaaacucaucaggcugccg

SEQ ID NO: 3391813 - RNA, 14 nt, Pseudomonas aeruginosa PA01
gaaacuccagcagg

SEQ ID NO: 3391814 - RNA, 15 nt, Pseudomonas aeruginosa PA01
gaaacuccagcaggu

SEQ ID NO: 3391815 - RNA, 12 nt, Pseudomonas aeruginosa PA01
gaaacugcgcag

SEQ ID NO: 3391816 - RNA, 13 nt, Pseudomonas aeruginosa PA01
gaaacugcgcagg

SEQ ID NO: 3391817 - RNA, 18 nt, Pseudomonas aeruginosa PA01
gaaacugcgcaggcuggu

SEQ ID NO: 3391818 - RNA, 20 nt, Pseudomonas aeruginosa PA01
gaaagaagccgcacuuccag

SEQ ID NO: 3391819 - RNA, 19 nt, Pseudomonas aeruginosa PA01
gaaagaaggggagccgagg

SEQ ID NO: 3391820 - RNA, 22 nt, Pseudomonas aeruginosa PA01
gaaagaccggcgccccugcggc

SEQ ID NO: 3391821 - RNA, 23 nt, Pseudomonas aeruginosa PA01
gaaagacgcugcgaccuggcgcc

SEQ ID NO: 3391822 - RNA, 22 nt, Pseudomonas aeruginosa PA01
gaaagagccccucucguagagg

SEQ ID NO: 3391823 - RNA, 14 nt, Pseudomonas aeruginosa PA01
gaaagagcccggca

SEQ ID NO: 3391824 - RNA, 18 nt, Pseudomonas aeruginosa PA01
gaaagcacugcggcgguc

SEQ ID NO: 3391825 - RNA, 19 nt, Pseudomonas aeruginosa PA01
gaaagcagaaagccccugc

SEQ ID NO: 3391826 - RNA, 12 nt, Pseudomonas aeruginosa PA01
gaaagccagcaa

SEQ ID NO: 3391827 - RNA, 16 nt, Pseudomonas aeruginosa PA01
gaaagccagcaaaccc

SEQ ID NO: 3391828 - RNA, 18 nt, Pseudomonas aeruginosa PA01
gaaagccaugcccagacg

SEQ ID NO: 3391829 - RNA, 16 nt, Pseudomonas aeruginosa PA01
gaaagccccugccgcg

SEQ ID NO: 3391830 - RNA, 14 nt, Pseudomonas aeruginosa PA01
gaaagccgccgccg

SEQ ID NO: 3391831 - RNA, 16 nt, Pseudomonas aeruginosa PA01
gaaagccucaggcgcu

SEQ ID NO: 3391832 - RNA, 16 nt, Pseudomonas aeruginosa PA01
gaaagccugccgggca

SEQ ID NO: 3391833 - RNA, 14 nt, Pseudomonas aeruginosa PA01
gaaagccuggccgg

SEQ ID NO: 3391834 - RNA, 16 nt, Pseudomonas aeruginosa PA01
gaaagccuggccggcg

SEQ ID NO: 3391835 - RNA, 22 nt, Pseudomonas aeruginosa PA01
gaaagcgacgccgcgauggcuc

SEQ ID NO: 3391836 - RNA, 14 nt, Pseudomonas aeruginosa PA01
gaaagcgauagccg

SEQ ID NO: 3391837 - RNA, 13 nt, Pseudomonas aeruginosa PA01
gaaagcgguaccg

SEQ ID NO: 3391838 - RNA, 19 nt, Pseudomonas aeruginosa PA01
gaaagcgguaccgggccag

SEQ ID NO: 3391839 - RNA, 15 nt, Pseudomonas aeruginosa PA01
gaaagcgucagcgcg

SEQ ID NO: 3391840 - RNA, 17 nt, Pseudomonas aeruginosa PA01
gaaagcgucagcgcgcc

SEQ ID NO: 3391841 - RNA, 18 nt, Pseudomonas aeruginosa PA01
gaaagcgucagcgcgcca

SEQ ID NO: 3391842 - RNA, 22 nt, Pseudomonas aeruginosa PA01
gaaagcguucuucagcacuucg

SEQ ID NO: 3391843 - RNA, 22 nt, Pseudomonas aeruginosa PA01
gaaagcuccucggccuugcugg

SEQ ID NO: 3391844 - RNA, 17 nt, Pseudomonas aeruginosa PA01
gaaaggccgccacggcg

SEQ ID NO: 3391845 - RNA, 14 nt, Pseudomonas aeruginosa PA01
gaaaggccgcgccg

SEQ ID NO: 3391846 - RNA, 15 nt, Pseudomonas aeruginosa PA01
gaaaggccucggcga

SEQ ID NO: 3391847 - RNA, 16 nt, Pseudomonas aeruginosa PA01
gaaaggcgucguugcc

SEQ ID NO: 3391848 - RNA, 22 nt, Pseudomonas aeruginosa PA01
gaaaggcugcuucggcagccuu

SEQ ID NO: 3391849 - RNA, 13 nt, Pseudomonas aeruginosa PA01
gaaagucggcgcg

SEQ ID NO: 3391850 - RNA, 13 nt, Pseudomonas aeruginosa PA01
gaaagucugcacc

SEQ ID NO: 3391851 - RNA, 22 nt, Pseudomonas aeruginosa PA01
gaaauacagcacccgguagccg

SEQ ID NO: 3391852 - RNA, 14 nt, Pseudomonas aeruginosa PA01
gaaauagccggcga

SEQ ID NO: 3391853 - RNA, 21 nt, Pseudomonas aeruginosa PA01
gaaauagccggcgaugccgcc

SEQ ID NO: 3391854 - RNA, 19 nt, Pseudomonas aeruginosa PA01
gaaauagucgcgggccugg

SEQ ID NO: 3391855 - RNA, 20 nt, Pseudomonas aeruginosa PA01
gaaauagucgcgggccuggg

SEQ ID NO: 3391856 - RNA, 19 nt, Pseudomonas aeruginosa PA01
gaaaucaccgcugcgcagg

SEQ ID NO: 3391857 - RNA, 18 nt, Pseudomonas aeruginosa PA01
gaaaucaggaaggucucg

SEQ ID NO: 3391858 - RNA, 22 nt, Pseudomonas aeruginosa PA01
gaaaucaggaaggucucgccgc

SEQ ID NO: 3391859 - RNA, 18 nt, Pseudomonas aeruginosa PA01
gaaaucaucggcccuggg

SEQ ID NO: 3391860 - RNA, 17 nt, Pseudomonas aeruginosa PA01
gaacagcggcuggcccu

SEQ ID NO: 3391861 - RNA, 23 nt, Pseudomonas aeruginosa PA01
gaacagcggcuggcccucggcgu

SEQ ID NO: 3391862 - RNA, 20 nt, Pseudomonas aeruginosa PA01
gaacagcgggucgcggcugg

SEQ ID NO: 3391863 - RNA, 15 nt, Pseudomonas aeruginosa PA01
gaacagcuccuccag

SEQ ID NO: 3391864 - RNA, 16 nt, Pseudomonas aeruginosa PA01
gaacagcuccuccagc

SEQ ID NO: 3391865 - RNA, 20 nt, Pseudomonas aeruginosa PA01
gaacagcuccuccagccgcg

SEQ ID NO: 3391866 - RNA, 14 nt, Pseudomonas aeruginosa PA01
gaacagcuggcgcg

SEQ ID NO: 3391867 - RNA, 12 nt, Pseudomonas aeruginosa PA01
gaacaggaucuc

SEQ ID NO: 3391868 - RNA, 20 nt, Pseudomonas aeruginosa PA01
gaacaggaucuccucggcca

SEQ ID NO: 3391869 - RNA, 19 nt, Pseudomonas aeruginosa PA01
gaacaggcgauagccgacc

SEQ ID NO: 3391870 - RNA, 15 nt, Pseudomonas aeruginosa PA01
gaacaggcuggcguc

SEQ ID NO: 3391871 - RNA, 21 nt, Pseudomonas aeruginosa PA01
gaacaggcugugcgccaggcc

SEQ ID NO: 3391872 - RNA, 19 nt, Pseudomonas aeruginosa PA01
gaacagggccaucagggcg

SEQ ID NO: 3391873 - RNA, 15 nt, Pseudomonas aeruginosa PA01
gaacagggcgaaggc

SEQ ID NO: 3391874 - RNA, 18 nt, Pseudomonas aeruginosa PA01
gaacagggcgagcagggc

SEQ ID NO: 3391875 - RNA, 21 nt, Pseudomonas aeruginosa PA01
gaacagggcgagcagggcgcu

SEQ ID NO: 3391876 - RNA, 21 nt, Pseudomonas aeruginosa PA01
gaacagggucuugucuuucug

SEQ ID NO: 3391877 - RNA, 20 nt, Pseudomonas aeruginosa PA01
gaacagguagcuggaaagcu

SEQ ID NO: 3391878 - RNA, 22 nt, Pseudomonas aeruginosa PA01
gaacagguagcuggaaagcucg

SEQ ID NO: 3391879 - RNA, 20 nt, Pseudomonas aeruginosa PA01
gaacagguaguugaggucgg

SEQ ID NO: 3391880 - RNA, 20 nt, Pseudomonas aeruginosa PA01
gaacaggucgacgccauggc

SEQ ID NO: 3391881 - RNA, 20 nt, Pseudomonas aeruginosa PA01
gaacagguggcuuuccagca

SEQ ID NO: 3391882 - RNA, 12 nt, Pseudomonas aeruginosa PA01
gaacagguucgg

SEQ ID NO: 3391883 - RNA, 14 nt, Pseudomonas aeruginosa PA01
gaacaguucggcga

SEQ ID NO: 3391884 - RNA, 16 nt, Pseudomonas aeruginosa PA01
gaacaucagcagcagg

SEQ ID NO: 3391885 - RNA, 14 nt, Pseudomonas aeruginosa PA01
gaacaucgccagcg

SEQ ID NO: 3391886 - RNA, 16 nt, Pseudomonas aeruginosa PA01
gaacaucgccagcgcc

SEQ ID NO: 3391887 - RNA, 15 nt, Pseudomonas aeruginosa PA01
gaacaucgcccggcg

SEQ ID NO: 3391888 - RNA, 21 nt, Pseudomonas aeruginosa PA01
gaacaucgccugcuuggcggc

SEQ ID NO: 3391889 - RNA, 14 nt, Pseudomonas aeruginosa PA01
gaacaugccgaaga

SEQ ID NO: 3391890 - RNA, 14 nt, Pseudomonas aeruginosa PA01
gaacauggccaccg

SEQ ID NO: 3391891 - RNA, 17 nt, Pseudomonas aeruginosa PA01
gaaccacaccaggucgc

SEQ ID NO: 3391892 - RNA, 18 nt, Pseudomonas aeruginosa PA01
gaaccacaccaggucgcc

SEQ ID NO: 3391893 - RNA, 19 nt, Pseudomonas aeruginosa PA01
gaaccacaccaggucgccg

SEQ ID NO: 3391894 - RNA, 15 nt, Pseudomonas aeruginosa PA01
gaaccacaccugcaa

SEQ ID NO: 3391895 - RNA, 22 nt, Pseudomonas aeruginosa PA01
gaaccacgaagaacggcgcggu

SEQ ID NO: 3391896 - RNA, 19 nt, Pseudomonas aeruginosa PA01
gaaccagacgcucggccag

SEQ ID NO: 3391897 - RNA, 19 nt, Pseudomonas aeruginosa PA01
gaaccagacguugcgcauc

SEQ ID NO: 3391898 - RNA, 15 nt, Pseudomonas aeruginosa PA01
gaaccagcagcaggu

SEQ ID NO: 3391899 - RNA, 15 nt, Pseudomonas aeruginosa PA01
gaaccagccgcguug

SEQ ID NO: 3391900 - RNA, 17 nt, Pseudomonas aeruginosa PA01
gaaccagcucagcucca

SEQ ID NO: 3391901 - RNA, 19 nt, Pseudomonas aeruginosa PA01
gaaccaggcaauggccggc

SEQ ID NO: 3391902 - RNA, 22 nt, Pseudomonas aeruginosa PA01
gaaccaggcaauggccggcggg

SEQ ID NO: 3391903 - RNA, 16 nt, Pseudomonas aeruginosa PA01
gaaccaggcggccgaa

SEQ ID NO: 3391904 - RNA, 19 nt, Pseudomonas aeruginosa PA01
gaaccagggacgcccggag

SEQ ID NO: 3391905 - RNA, 21 nt, Pseudomonas aeruginosa PA01
gaaccaggggucgacgcaggg

SEQ ID NO: 3391906 - RNA, 16 nt, Pseudomonas aeruginosa PA01
gaaccaguccagcacg

SEQ ID NO: 3391907 - RNA, 18 nt, Pseudomonas aeruginosa PA01
gaaccaguccagcacggu

SEQ ID NO: 3391908 - RNA, 16 nt, Pseudomonas aeruginosa PA01
gaaccaguugccgagc

SEQ ID NO: 3391909 - RNA, 17 nt, Pseudomonas aeruginosa PA01
gaaccaguugccgagcu

SEQ ID NO: 3391910 - RNA, 18 nt, Pseudomonas aeruginosa PA01
gaaccauccggaguucgc

SEQ ID NO: 3391911 - RNA, 23 nt, Pseudomonas aeruginosa PA01
gaaccauccggaguucgcccgcc

SEQ ID NO: 3391912 - RNA, 17 nt, Pseudomonas aeruginosa PA01
gaaccauugcggcccgc

SEQ ID NO: 3391913 - RNA, 15 nt, Pseudomonas aeruginosa PA01
gaacccaaucacaac

SEQ ID NO: 3391914 - RNA, 14 nt, Pseudomonas aeruginosa PA01
gaacccagacagcc

SEQ ID NO: 3391915 - RNA, 17 nt, Pseudomonas aeruginosa PA01
gaacccagacagcccuc

SEQ ID NO: 3391916 - RNA, 21 nt, Pseudomonas aeruginosa PA01
gaacccagguucuggucgccg

SEQ ID NO: 3391917 - RNA, 18 nt, Pseudomonas aeruginosa PA01
gaacccauggcgcgaugc

SEQ ID NO: 3391918 - RNA, 17 nt, Pseudomonas aeruginosa PA01
gaaccccgggccgcgca

SEQ ID NO: 3391919 - RNA, 16 nt, Pseudomonas aeruginosa PA01
gaaccccuggcgcucg

SEQ ID NO: 3391920 - RNA, 23 nt, Pseudomonas aeruginosa PA01
gaacccgaaucccuuggcugcuc

SEQ ID NO: 3391921 - RNA, 19 nt, Pseudomonas aeruginosa PA01
gaacccgcccucguggcgg

SEQ ID NO: 3391922 - RNA, 21 nt, Pseudomonas aeruginosa PA01
gaacccggcuuuuuucgcccg

SEQ ID NO: 3391923 - RNA, 22 nt, Pseudomonas aeruginosa PA01
gaacccggcuuuuuucgcccgu

SEQ ID NO: 3391924 - RNA, 20 nt, Pseudomonas aeruginosa PA01
gaacccucggugcggccgag

SEQ ID NO: 3391925 - RNA, 21 nt, Pseudomonas aeruginosa PA01
gaaccgaagguacugccgcua

SEQ ID NO: 3391926 - RNA, 18 nt, Pseudomonas aeruginosa PA01
gaaccgagacccuggcgc

SEQ ID NO: 3391927 - RNA, 19 nt, Pseudomonas aeruginosa PA01
gaaccgagacccuggcgcu

SEQ ID NO: 3391928 - RNA, 23 nt, Pseudomonas aeruginosa PA01
gaaccgagacccuggcgcugucg

SEQ ID NO: 3391929 - RNA, 15 nt, Pseudomonas aeruginosa PA01
gaaccgagcggucgg

SEQ ID NO: 3391930 - RNA, 18 nt, Pseudomonas aeruginosa PA01
gaaccgaguuucccggcg

SEQ ID NO: 3391931 - RNA, 19 nt, Pseudomonas aeruginosa PA01
gaaccgaguuucccggcgc

SEQ ID NO: 3391932 - RNA, 22 nt, Pseudomonas aeruginosa PA01
gaaccgaguuucccggcgcggc

SEQ ID NO: 3391933 - RNA, 23 nt, Pseudomonas aeruginosa PA01
gaaccgauggccagggggccugg

SEQ ID NO: 3391934 - RNA, 12 nt, Pseudomonas aeruginosa PA01
gaaccgccagca

SEQ ID NO: 3391935 - RNA, 21 nt, Pseudomonas aeruginosa PA01
gaaccgcgagaccccggcggc

SEQ ID NO: 3391936 - RNA, 15 nt, Pseudomonas aeruginosa PA01
gaaccgcggcgcccu

SEQ ID NO: 3391937 - RNA, 22 nt, Pseudomonas aeruginosa PA01
gaaccgcggcgcccucugccgg

SEQ ID NO: 3391938 - RNA, 19 nt, Pseudomonas aeruginosa PA01
gaaccgcgucaugcucucg

SEQ ID NO: 3391939 - RNA, 21 nt, Pseudomonas aeruginosa PA01
gaaccggaaaagaagccgcgc

SEQ ID NO: 3391940 - RNA, 22 nt, Pseudomonas aeruginosa PA01
gaaccggaaaagaagccgcgca

SEQ ID NO: 3391941 - RNA, 21 nt, Pseudomonas aeruginosa PA01
gaaccggccauuacgccgagc

SEQ ID NO: 3391942 - RNA, 22 nt, Pseudomonas aeruginosa PA01
gaaccggccauuacgccgagca

SEQ ID NO: 3391943 - RNA, 16 nt, Pseudomonas aeruginosa PA01
gaaccggccggcaggc

SEQ ID NO: 3391944 - RNA, 23 nt, Pseudomonas aeruginosa PA01
gaaccgggucgucagcaggucuc

SEQ ID NO: 3391945 - RNA, 15 nt, Pseudomonas aeruginosa PA01
gaaccguccgcagcg

SEQ ID NO: 3391946 - RNA, 18 nt, Pseudomonas aeruginosa PA01
gaaccguggcggccgccg

SEQ ID NO: 3391947 - RNA, 23 nt, Pseudomonas aeruginosa PA01
gaaccuguccgaacagggcgaag

SEQ ID NO: 3391948 - RNA, 21 nt, Pseudomonas aeruginosa PA01
gaacgaaagaaggggagccga

SEQ ID NO: 3391949 - RNA, 14 nt, Pseudomonas aeruginosa PA01
gaacgaagaagccg

SEQ ID NO: 3391950 - RNA, 20 nt, Pseudomonas aeruginosa PA01
gaacgaagcgcccucgcuga

SEQ ID NO: 3391951 - RNA, 14 nt, Pseudomonas aeruginosa PA01
gaacgacagcacca

SEQ ID NO: 3391952 - RNA, 14 nt, Pseudomonas aeruginosa PA01
gaacgacuccagcu

SEQ ID NO: 3391953 - RNA, 18 nt, Pseudomonas aeruginosa PA01
gaacgacucgucgcccca

SEQ ID NO: 3391954 - RNA, 13 nt, Pseudomonas aeruginosa PA01
gaacgagaagccg

SEQ ID NO: 3391955 - RNA, 23 nt, Pseudomonas aeruginosa PA01
gaacgagaagccgaucaggucgc

SEQ ID NO: 3391956 - RNA, 22 nt, Pseudomonas aeruginosa PA01
gaacgagagguugcuguagaau

SEQ ID NO: 3391957 - RNA, 16 nt, Pseudomonas aeruginosa PA01
gaacgaggcgacccgg

SEQ ID NO: 3391958 - RNA, 20 nt, Pseudomonas aeruginosa PA01
gaacgaggcgacccggguca

SEQ ID NO: 3391959 - RNA, 22 nt, Pseudomonas aeruginosa PA01
gaacgaggcgacccgggucagg

SEQ ID NO: 3391960 - RNA, 18 nt, Pseudomonas aeruginosa PA01
gaacgaguugggcgaccu

SEQ ID NO: 3391961 - RNA, 17 nt, Pseudomonas aeruginosa PA01
gaacuggaucggcccca

SEQ ID NO: 3391962 - RNA, 21 nt, Pseudomonas aeruginosa PA01
gaacuggaugucgcuggccag

SEQ ID NO: 3391963 - RNA, 22 nt, Pseudomonas aeruginosa PA01
gaacuggaugucgcuggccagc

SEQ ID NO: 3391964 - RNA, 17 nt, Pseudomonas aeruginosa PA01
gaacuggccagcaccag

SEQ ID NO: 3391965 - RNA, 11 nt, Pseudomonas aeruginosa PA01
gaacuggcguu

SEQ ID NO: 3391966 - RNA, 14 nt, Pseudomonas aeruginosa PA01
gaacugggcgagca

SEQ ID NO: 3391967 - RNA, 17 nt, Pseudomonas aeruginosa PA01
gaacugggcgagcaucu

SEQ ID NO: 3391968 - RNA, 22 nt, Pseudomonas aeruginosa PA01
gaacugggcgagcaucuucuuc

SEQ ID NO: 3391969 - RNA, 15 nt, Pseudomonas aeruginosa PA01
gaacuggucgcucca

SEQ ID NO: 3391970 - RNA, 23 nt, Pseudomonas aeruginosa PA01
gaacuggucgcuccagccccacu

SEQ ID NO: 3391971 - RNA, 15 nt, Pseudomonas aeruginosa PA01
gaacuucaggccggc

SEQ ID NO: 3391972 - RNA, 16 nt, Pseudomonas aeruginosa PA01
gaacuucaugaugcgc

SEQ ID NO: 3391973 - RNA, 15 nt, Pseudomonas aeruginosa PA01
gaacuuccgccgaau

SEQ ID NO: 3391974 - RNA, 17 nt, Pseudomonas aeruginosa PA01
gaacuugccggcgccau

SEQ ID NO: 3391975 - RNA, 13 nt, Pseudomonas aeruginosa PA01
gaacuugcgcacc

SEQ ID NO: 3391976 - RNA, 15 nt, Pseudomonas aeruginosa PA01
gaacuugcgcaccgc

SEQ ID NO: 3391977 - RNA, 15 nt, Pseudomonas aeruginosa PA01
gaacuugcgccgacc

SEQ ID NO: 3391978 - RNA, 18 nt, Pseudomonas aeruginosa PA01
gaacuugcuguugccgcu

SEQ ID NO: 3391979 - RNA, 22 nt, Pseudomonas aeruginosa PA01
gaacuuggcgcgcagggcaucg

SEQ ID NO: 3391980 - RNA, 14 nt, Pseudomonas aeruginosa PA01
gaacuuguagggcu

SEQ ID NO: 3391981 - RNA, 15 nt, Pseudomonas aeruginosa PA01
gaacuugucgccgcu

SEQ ID NO: 3391982 - RNA, 16 nt, Pseudomonas aeruginosa PA01
gaacuugucgccgcug

SEQ ID NO: 3391983 - RNA, 19 nt, Pseudomonas aeruginosa PA01
gaacuugucgccgcuggac

SEQ ID NO: 3391984 - RNA, 17 nt, Pseudomonas aeruginosa PA01
gaacuuucccguuuugc

SEQ ID NO: 3391985 - RNA, 14 nt, Pseudomonas aeruginosa PA01
gaacuuuucccagc

SEQ ID NO: 3391986 - RNA, 19 nt, Pseudomonas aeruginosa PA01
gaagaacaccacgcggugc

SEQ ID NO: 3391987 - RNA, 16 nt, Pseudomonas aeruginosa PA01
gaagaacaggcgcuuc

SEQ ID NO: 3391988 - RNA, 23 nt, Pseudomonas aeruginosa PA01
gaagaacaggcgcuucagcucga

SEQ ID NO: 3391989 - RNA, 19 nt, Pseudomonas aeruginosa PA01
gaagaaccccggcucaugg

SEQ ID NO: 3391990 - RNA, 14 nt, Pseudomonas aeruginosa PA01
gaagaacgccagcc

SEQ ID NO: 3391991 - RNA, 16 nt, Pseudomonas aeruginosa PA01
gaagaacgccagccca

SEQ ID NO: 3391992 - RNA, 23 nt, Pseudomonas aeruginosa PA01
gaagaacucggcgcugccggcca

SEQ ID NO: 3391993 - RNA, 22 nt, Pseudomonas aeruginosa PA01
gaagaagccauugccgaugugc

SEQ ID NO: 3391994 - RNA, 23 nt, Pseudomonas aeruginosa PA01
gaagaagccgaucaccaccagca

SEQ ID NO: 3391995 - RNA, 20 nt, Pseudomonas aeruginosa PA01
gaagaagcgcaccaccugca

SEQ ID NO: 3391996 - RNA, 12 nt, Pseudomonas aeruginosa PA01
gaagaagcugcc

SEQ ID NO: 3391997 - RNA, 20 nt, Pseudomonas aeruginosa PA01
gaagaagcuucgcuggguuu

SEQ ID NO: 3391998 - RNA, 16 nt, Pseudomonas aeruginosa PA01
gaagaaggcgaucauc

SEQ ID NO: 3391999 - RNA, 18 nt, Pseudomonas aeruginosa PA01
gaagaaggcguccagggc

SEQ ID NO: 3392000 - RNA, 20 nt, Pseudomonas aeruginosa PA01
gaagaaguaaucaccuuccu

SEQ ID NO: 3392001 - RNA, 20 nt, Pseudomonas aeruginosa PA01
gaagaccagcggagcgucgg

SEQ ID NO: 3392002 - RNA, 20 nt, Pseudomonas aeruginosa PA01
gaagaccagucggccguugc

SEQ ID NO: 3392003 - RNA, 17 nt, Pseudomonas aeruginosa PA01
gaagacccccugccgcc

SEQ ID NO: 3392004 - RNA, 19 nt, Pseudomonas aeruginosa PA01
gaagacccccugccgcccu

SEQ ID NO: 3392005 - RNA, 22 nt, Pseudomonas aeruginosa PA01
gaagacccccugcggcccgagg

SEQ ID NO: 3392006 - RNA, 13 nt, Pseudomonas aeruginosa PA01
gaagacccggcgu

SEQ ID NO: 3392007 - RNA, 14 nt, Pseudomonas aeruginosa PA01
gaagacccggcguu

SEQ ID NO: 3392008 - RNA, 12 nt, Pseudomonas aeruginosa PA01
gaagacccugca

SEQ ID NO: 3392009 - RNA, 14 nt, Pseudomonas aeruginosa PA01
gaagacccugcaca

SEQ ID NO: 3392010 - RNA, 19 nt, Pseudomonas aeruginosa PA01
gaagaccuguugcagagcg

SEQ ID NO: 3392011 - RNA, 23 nt, Pseudomonas aeruginosa PA01
gaagaccuguugcagagcggcca

SEQ ID NO: 3392012 - RNA, 21 nt, Pseudomonas aeruginosa PA01
gaagaccuugaacucgcccgg

SEQ ID NO: 3392013 - RNA, 12 nt, Pseudomonas aeruginosa PA01
gaagacgaucuc

SEQ ID NO: 3392014 - RNA, 14 nt, Pseudomonas aeruginosa PA01
gaagacgcccagca

SEQ ID NO: 3392015 - RNA, 16 nt, Pseudomonas aeruginosa PA01
gaagacgcccagcagg

SEQ ID NO: 3392016 - RNA, 18 nt, Pseudomonas aeruginosa PA01
gaagagcagcgcggcggc

SEQ ID NO: 3392017 - RNA, 19 nt, Pseudomonas aeruginosa PA01
gaagagcaucucgccggca

SEQ ID NO: 3392018 - RNA, 15 nt, Pseudomonas aeruginosa PA01
gaagagcuggcggcc

SEQ ID NO: 3392019 - RNA, 19 nt, Pseudomonas aeruginosa PA01
gaagaggaucgcgaagcgc

SEQ ID NO: 3392020 - RNA, 20 nt, Pseudomonas aeruginosa PA01
gaagaggaucgcgaagcgca

SEQ ID NO: 3392021 - RNA, 18 nt, Pseudomonas aeruginosa PA01
gaagaggcccucggcgcc

SEQ ID NO: 3392022 - RNA, 18 nt, Pseudomonas aeruginosa PA01
gaagagguacggccuuca

SEQ ID NO: 3392023 - RNA, 15 nt, Pseudomonas aeruginosa PA01
gaagauaucgccuuc

SEQ ID NO: 3392024 - RNA, 20 nt, Pseudomonas aeruginosa PA01
gaagauaucgccuuccucgg

SEQ ID NO: 3392025 - RNA, 14 nt, Pseudomonas aeruginosa PA01
gaagaucagcgcgg

SEQ ID NO: 3392026 - RNA, 17 nt, Pseudomonas aeruginosa PA01
gaagaucaucugggucc

SEQ ID NO: 3392027 - RNA, 21 nt, Pseudomonas aeruginosa PA01
gaagaucaucuggguccuggu

SEQ ID NO: 3392028 - RNA, 19 nt, Pseudomonas aeruginosa PA01
gaagaucgacaggccgccg

SEQ ID NO: 3392029 - RNA, 19 nt, Pseudomonas aeruginosa PA01
gaagaucgccugcuggccg

SEQ ID NO: 3392030 - RNA, 16 nt, Pseudomonas aeruginosa PA01
gaagaucuccgggucc

SEQ ID NO: 3392031 - RNA, 17 nt, Pseudomonas aeruginosa PA01
gaagaucuuuucgaugg

SEQ ID NO: 3392032 - RNA, 20 nt, Pseudomonas aeruginosa PA01
gaagaugcacaccagcuccc

SEQ ID NO: 3392033 - RNA, 19 nt, Pseudomonas aeruginosa PA01
gaagauggcuaaacaagcc

SEQ ID NO: 3392034 - RNA, 13 nt, Pseudomonas aeruginosa PA01
gaagauuccgcug

SEQ ID NO: 3392035 - RNA, 22 nt, Pseudomonas aeruginosa PA01
gaagcacaccuccagcggcuug

SEQ ID NO: 3392036 - RNA, 17 nt, Pseudomonas aeruginosa PA01
gaagcaccgacucgccc

SEQ ID NO: 3392037 - RNA, 20 nt, Pseudomonas aeruginosa PA01
gaagcagagggcguccugcu

SEQ ID NO: 3392038 - RNA, 18 nt, Pseudomonas aeruginosa PA01
gaagcagccauggcuggu

SEQ ID NO: 3392039 - RNA, 14 nt, Pseudomonas aeruginosa PA01
gaagcagcccagcg

SEQ ID NO: 3392040 - RNA, 21 nt, Pseudomonas aeruginosa PA01
gaagcagccguauggccccuc

SEQ ID NO: 3392041 - RNA, 17 nt, Pseudomonas aeruginosa PA01
gaagccagccaggucgg

SEQ ID NO: 3392042 - RNA, 15 nt, Pseudomonas aeruginosa PA01
gaagcccaccaccac

SEQ ID NO: 3392043 - RNA, 16 nt, Pseudomonas aeruginosa PA01
gaagcccagcaggucg

SEQ ID NO: 3392044 - RNA, 11 nt, Pseudomonas aeruginosa PA01
gaagcccagcg

SEQ ID NO: 3392045 - RNA, 14 nt, Pseudomonas aeruginosa PA01
gaagcccagcgagc

SEQ ID NO: 3392046 - RNA, 13 nt, Pseudomonas aeruginosa PA01
gaagcccagcgcc

SEQ ID NO: 3392047 - RNA, 14 nt, Pseudomonas aeruginosa PA01
gaagcccagcgccg

SEQ ID NO: 3392048 - RNA, 15 nt, Pseudomonas aeruginosa PA01
gaagcccagcgccgc

SEQ ID NO: 3392049 - RNA, 15 nt, Pseudomonas aeruginosa PA01
gaagcccagcgccug

SEQ ID NO: 3392050 - RNA, 23 nt, Pseudomonas aeruginosa PA01
gaagcccagcgccugcaaagagg

SEQ ID NO: 3392051 - RNA, 14 nt, Pseudomonas aeruginosa PA01
gaagcccaggcgcu

SEQ ID NO: 3392052 - RNA, 16 nt, Pseudomonas aeruginosa PA01
gaagcccaggcgcucg

SEQ ID NO: 3392053 - RNA, 13 nt, Pseudomonas aeruginosa PA01
gaagcccaggcug

SEQ ID NO: 3392054 - RNA, 15 nt, Pseudomonas aeruginosa PA01
gaagcccaggcugac

SEQ ID NO: 3392055 - RNA, 22 nt, Pseudomonas aeruginosa PA01
gaagcccagggugacgcucuuc

SEQ ID NO: 3392056 - RNA, 18 nt, Pseudomonas aeruginosa PA01
gaagccccagagcccgcc

SEQ ID NO: 3392057 - RNA, 16 nt, Pseudomonas aeruginosa PA01
gaagccccagccucca

SEQ ID NO: 3392058 - RNA, 14 nt, Pseudomonas aeruginosa PA01
gaagccccgcagcc

SEQ ID NO: 3392059 - RNA, 16 nt, Pseudomonas aeruginosa PA01
gaagccccgcagccgc

SEQ ID NO: 3392060 - RNA, 15 nt, Pseudomonas aeruginosa PA01
gaagccccuggcgcu

SEQ ID NO: 3392061 - RNA, 18 nt, Pseudomonas aeruginosa PA01
gaagccccuggcgcuggg

SEQ ID NO: 3392062 - RNA, 19 nt, Pseudomonas aeruginosa PA01
gaagccccuggcgcugggc

SEQ ID NO: 3392063 - RNA, 23 nt, Pseudomonas aeruginosa PA01
gaagcccgcggcaucggccuggu

SEQ ID NO: 3392064 - RNA, 22 nt, Pseudomonas aeruginosa PA01
gaagcgcugcucgaccaccucg

SEQ ID NO: 3392065 - RNA, 22 nt, Pseudomonas aeruginosa PA01
gaagcgcugcugggcggcgacc

SEQ ID NO: 3392066 - RNA, 17 nt, Pseudomonas aeruginosa PA01
gaagcgcuugcccaggu

SEQ ID NO: 3392067 - RNA, 16 nt, Pseudomonas aeruginosa PA01
gaagcggaagccggga

SEQ ID NO: 3392068 - RNA, 17 nt, Pseudomonas aeruginosa PA01
gaagcggaagcgcagcc

SEQ ID NO: 3392069 - RNA, 18 nt, Pseudomonas aeruginosa PA01
gaagcggaucucgucgcc

SEQ ID NO: 3392070 - RNA, 20 nt, Pseudomonas aeruginosa PA01
gaagcggcaauguccgagca

SEQ ID NO: 3392071 - RNA, 23 nt, Pseudomonas aeruginosa PA01
gaagcggcaauguccgagcaggu

SEQ ID NO: 3392072 - RNA, 22 nt, Pseudomonas aeruginosa PA01
gaagcggcccuugucgccgcug

SEQ ID NO: 3392073 - RNA, 23 nt, Pseudomonas aeruginosa PA01
gaagcggcccuugucgccgcugg

SEQ ID NO: 3392074 - RNA, 15 nt, Pseudomonas aeruginosa PA01
gaagcggccgaccag

SEQ ID NO: 3392075 - RNA, 17 nt, Pseudomonas aeruginosa PA01
gaagcggccgaccaggc

SEQ ID NO: 3392076 - RNA, 14 nt, Pseudomonas aeruginosa PA01
gaagcggccgagca

SEQ ID NO: 3392077 - RNA, 21 nt, Pseudomonas aeruginosa PA01
gaagcggccgagcaccacgcg

SEQ ID NO: 3392078 - RNA, 24 nt, Pseudomonas aeruginosa PA01
gaagcggccgagcaccacgcgcaa

SEQ ID NO: 3392079 - RNA, 13 nt, Pseudomonas aeruginosa PA01
gaagcggccgccg

SEQ ID NO: 3392080 - RNA, 15 nt, Pseudomonas aeruginosa PA01
gaagcggccgccgaa

SEQ ID NO: 3392081 - RNA, 17 nt, Pseudomonas aeruginosa PA01
gaagcggcuggccgcgg

SEQ ID NO: 3392082 - RNA, 19 nt, Pseudomonas aeruginosa PA01
gaagcggcuggccgcggug

SEQ ID NO: 3392083 - RNA, 23 nt, Pseudomonas aeruginosa PA01
gaagcggggcuuuuuccaacgcg

SEQ ID NO: 3392084 - RNA, 19 nt, Pseudomonas aeruginosa PA01
gaagcggguucccugcgcc

SEQ ID NO: 3392085 - RNA, 13 nt, Pseudomonas aeruginosa PA01
gaagcggucgccg

SEQ ID NO: 3392086 - RNA, 15 nt, Pseudomonas aeruginosa PA01
gaagcggucgccggc

SEQ ID NO: 3392087 - RNA, 17 nt, Pseudomonas aeruginosa PA01
gaagcggucgccggcgc

SEQ ID NO: 3392088 - RNA, 18 nt, Pseudomonas aeruginosa PA01
gaagcggucguagcccau

SEQ ID NO: 3392089 - RNA, 18 nt, Pseudomonas aeruginosa PA01
gaagcgguucucguccag

SEQ ID NO: 3392090 - RNA, 15 nt, Pseudomonas aeruginosa PA01
gaagcgucagccgcg

SEQ ID NO: 3392091 - RNA, 17 nt, Pseudomonas aeruginosa PA01
gaagcgucgugcgccgg

SEQ ID NO: 3392092 - RNA, 19 nt, Pseudomonas aeruginosa PA01
gaagcgucgugcgccggcc

SEQ ID NO: 3392093 - RNA, 19 nt, Pseudomonas aeruginosa PA01
gaagcgugggcggccggcc

SEQ ID NO: 3392094 - RNA, 23 nt, Pseudomonas aeruginosa PA01
gaagcgugggcggccggccaggu

SEQ ID NO: 3392095 - RNA, 17 nt, Pseudomonas aeruginosa PA01
gaagcguucgccgaggg

SEQ ID NO: 3392096 - RNA, 19 nt, Pseudomonas aeruginosa PA01
gaagcguucgccgagggca

SEQ ID NO: 3392097 - RNA, 16 nt, Pseudomonas aeruginosa PA01
gaagcguugcagcguc

SEQ ID NO: 3392098 - RNA, 19 nt, Pseudomonas aeruginosa PA01
gaagcguugcucgagccgu

SEQ ID NO: 3392099 - RNA, 22 nt, Pseudomonas aeruginosa PA01
gaagcucaccuugaagccuucg

SEQ ID NO: 3392100 - RNA, 22 nt, Pseudomonas aeruginosa PA01
gaagcuccagcgugcccgcugc

SEQ ID NO: 3392101 - RNA, 15 nt, Pseudomonas aeruginosa PA01
gaagcucggcagcac

SEQ ID NO: 3392102 - RNA, 16 nt, Pseudomonas aeruginosa PA01
gaagcucggccgcucg

SEQ ID NO: 3392103 - RNA, 21 nt, Pseudomonas aeruginosa PA01
gaagcucgggguuuuuuuugc

SEQ ID NO: 3392104 - RNA, 15 nt, Pseudomonas aeruginosa PA01
gaagcucucgccgcg

SEQ ID NO: 3392105 - RNA, 19 nt, Pseudomonas aeruginosa PA01
gaagcucucgccgcgcucg

SEQ ID NO: 3392106 - RNA, 23 nt, Pseudomonas aeruginosa PA01
gaagcucucgccgcgcucgcgca

SEQ ID NO: 3392107 - RNA, 14 nt, Pseudomonas aeruginosa PA01
gaagcugaggccgg

SEQ ID NO: 3392108 - RNA, 18 nt, Pseudomonas aeruginosa PA01
gaagcugccccacaggcc

SEQ ID NO: 3392109 - RNA, 14 nt, Pseudomonas aeruginosa PA01
gaagcugccggcau

SEQ ID NO: 3392110 - RNA, 16 nt, Pseudomonas aeruginosa PA01
gaagcugccggcauug

SEQ ID NO: 3392111 - RNA, 16 nt, Pseudomonas aeruginosa PA01
gaagcugccuuccagc

SEQ ID NO: 3392112 - RNA, 17 nt, Pseudomonas aeruginosa PA01
gaagcugccuuccagca

SEQ ID NO: 3392113 - RNA, 19 nt, Pseudomonas aeruginosa PA01
gaagcugccuuccagcagg

SEQ ID NO: 3392114 - RNA, 17 nt, Pseudomonas aeruginosa PA01
gaagcuggagcagcagc

SEQ ID NO: 3392115 - RNA, 12 nt, Pseudomonas aeruginosa PA01
gaagcuggcgca

SEQ ID NO: 3392116 - RNA, 22 nt, Pseudomonas aeruginosa PA01
gaagcuggggcuguugcugggc

SEQ ID NO: 3392117 - RNA, 16 nt, Pseudomonas aeruginosa PA01
gaagcugucgcccucg

SEQ ID NO: 3392118 - RNA, 14 nt, Pseudomonas aeruginosa PA01
gaagcugucggccc

SEQ ID NO: 3392119 - RNA, 19 nt, Pseudomonas aeruginosa PA01
gaagcuguucuugauccgc

SEQ ID NO: 3392120 - RNA, 14 nt, Pseudomonas aeruginosa PA01
gaagcuuccagcuu

SEQ ID NO: 3392121 - RNA, 14 nt, Pseudomonas aeruginosa PA01
gaagcuucgcuggg

SEQ ID NO: 3392122 - RNA, 17 nt, Pseudomonas aeruginosa PA01
gaagcuuuuccagcgca

SEQ ID NO: 3392123 - RNA, 18 nt, Pseudomonas aeruginosa PA01
gaagcuuuuccagcgcac

SEQ ID NO: 3392124 - RNA, 14 nt, Pseudomonas aeruginosa PA01
gaaggaaaccggcc

SEQ ID NO: 3392125 - RNA, 16 nt, Pseudomonas aeruginosa PA01
gaaggaaaccggccag

SEQ ID NO: 3392126 - RNA, 19 nt, Pseudomonas aeruginosa PA01
gaaggaaaccggccagcgc

SEQ ID NO: 3392127 - RNA, 21 nt, Pseudomonas aeruginosa PA01
gaaggaaaccggccagcgcau

SEQ ID NO: 3392128 - RNA, 22 nt, Pseudomonas aeruginosa PA01
gaaggaacgguugucgaugcgc

SEQ ID NO: 3392129 - RNA, 21 nt, Pseudomonas aeruginosa PA01
gaaggaaucaccacucgccag

SEQ ID NO: 3392130 - RNA, 23 nt, Pseudomonas aeruginosa PA01
gaaggaaugcugccacccggcuc

SEQ ID NO: 3392131 - RNA, 14 nt, Pseudomonas aeruginosa PA01
gaaggacaggccgu

SEQ ID NO: 3392132 - RNA, 17 nt, Pseudomonas aeruginosa PA01
gaaggacugugccugga

SEQ ID NO: 3392133 - RNA, 18 nt, Pseudomonas aeruginosa PA01
gaaggagaacgacaugcu

SEQ ID NO: 3392134 - RNA, 19 nt, Pseudomonas aeruginosa PA01
gaaggcaacagcccgcgcc

SEQ ID NO: 3392135 - RNA, 21 nt, Pseudomonas aeruginosa PA01
gaaggccaccaucgcggcgau

SEQ ID NO: 3392136 - RNA, 17 nt, Pseudomonas aeruginosa PA01
gaaggccacgccgccgu

SEQ ID NO: 3392137 - RNA, 19 nt, Pseudomonas aeruginosa PA01
gaaggccagcuugucggcc

SEQ ID NO: 3392138 - RNA, 22 nt, Pseudomonas aeruginosa PA01
gaaggccagcuugucggccuug

SEQ ID NO: 3392139 - RNA, 14 nt, Pseudomonas aeruginosa PA01
gaaggccaggaccg

SEQ ID NO: 3392140 - RNA, 17 nt, Pseudomonas aeruginosa PA01
gaaggccaggaccgcga

SEQ ID NO: 3392141 - RNA, 16 nt, Pseudomonas aeruginosa PA01
gaaggccaggccggcg

SEQ ID NO: 3392142 - RNA, 17 nt, Pseudomonas aeruginosa PA01
gaaggccaggccggcgc

SEQ ID NO: 3392143 - RNA, 16 nt, Pseudomonas aeruginosa PA01
gaaggccaguccggca

SEQ ID NO: 3392144 - RNA, 19 nt, Pseudomonas aeruginosa PA01
gaaggccccuuucacaugc

SEQ ID NO: 3392145 - RNA, 20 nt, Pseudomonas aeruginosa PA01
gaaggcccgcgagccgcgca

SEQ ID NO: 3392146 - RNA, 23 nt, Pseudomonas aeruginosa PA01
gaaggccgaacgguagguagcgu

SEQ ID NO: 3392147 - RNA, 17 nt, Pseudomonas aeruginosa PA01
gaaggccgacaccucga

SEQ ID NO: 3392148 - RNA, 20 nt, Pseudomonas aeruginosa PA01
gaaggccgacaccucgauca

SEQ ID NO: 3392149 - RNA, 22 nt, Pseudomonas aeruginosa PA01
gaaggccgacaccucgaucagc

SEQ ID NO: 3392150 - RNA, 15 nt, Pseudomonas aeruginosa PA01
gaaggccgcggucgg

SEQ ID NO: 3392151 - RNA, 12 nt, Pseudomonas aeruginosa PA01
gaaggccgcuug

SEQ ID NO: 3392152 - RNA, 23 nt, Pseudomonas aeruginosa PA01
gaaggccgcuuggccauggcgcu

SEQ ID NO: 3392153 - RNA, 20 nt, Pseudomonas aeruginosa PA01
gaaggccucggucaggcgcu

SEQ ID NO: 3392154 - RNA, 21 nt, Pseudomonas aeruginosa PA01
gaaggccucggucaggcgcug

SEQ ID NO: 3392155 - RNA, 22 nt, Pseudomonas aeruginosa PA01
gaaggccucggucaggcgcugg

SEQ ID NO: 3392156 - RNA, 23 nt, Pseudomonas aeruginosa PA01
gaaggccucggucaggcgcuggu

SEQ ID NO: 3392157 - RNA, 23 nt, Pseudomonas aeruginosa PA01
gaaggccucgguggcccacucca

SEQ ID NO: 3392158 - RNA, 18 nt, Pseudomonas aeruginosa PA01
gaaggccucgucgcccgg

SEQ ID NO: 3392159 - RNA, 13 nt, Pseudomonas aeruginosa PA01
gaaggccugcgcu

SEQ ID NO: 3392160 - RNA, 19 nt, Pseudomonas aeruginosa PA01
gaaggccugcgcuuccggc

SEQ ID NO: 3392161 - RNA, 17 nt, Pseudomonas aeruginosa PA01
gaaggccuggccguugc

SEQ ID NO: 3392162 - RNA, 18 nt, Pseudomonas aeruginosa PA01
gaaggccuggccguugcg

SEQ ID NO: 3392163 - RNA, 23 nt, Pseudomonas aeruginosa PA01
gaaggcgaaccacaccaggucgc

SEQ ID NO: 3392164 - RNA, 23 nt, Pseudomonas aeruginosa PA01
gaaggcgagggugaacuggccgu

SEQ ID NO: 3392165 - RNA, 18 nt, Pseudomonas aeruginosa PA01
gaagucgcccgccggcgu

SEQ ID NO: 3392166 - RNA, 21 nt, Pseudomonas aeruginosa PA01
gaagucgcccugcccgguggg

SEQ ID NO: 3392167 - RNA, 13 nt, Pseudomonas aeruginosa PA01
gaagucgccgucg

SEQ ID NO: 3392168 - RNA, 15 nt, Pseudomonas aeruginosa PA01
gaagucgcuggccug

SEQ ID NO: 3392169 - RNA, 16 nt, Pseudomonas aeruginosa PA01
gaagucgcuggccugg

SEQ ID NO: 3392170 - RNA, 18 nt, Pseudomonas aeruginosa PA01
gaagucggcgagccggcg

SEQ ID NO: 3392171 - RNA, 16 nt, Pseudomonas aeruginosa PA01
gaagucggcgcgccag

SEQ ID NO: 3392172 - RNA, 13 nt, Pseudomonas aeruginosa PA01
gaagucggcggcc

SEQ ID NO: 3392173 - RNA, 17 nt, Pseudomonas aeruginosa PA01
gaagucggcggccgccu

SEQ ID NO: 3392174 - RNA, 13 nt, Pseudomonas aeruginosa PA01
gaagucguccagc

SEQ ID NO: 3392175 - RNA, 16 nt, Pseudomonas aeruginosa PA01
gaagucguccagcagg

SEQ ID NO: 3392176 - RNA, 18 nt, Pseudomonas aeruginosa PA01
gaagucguccucgcccug

SEQ ID NO: 3392177 - RNA, 21 nt, Pseudomonas aeruginosa PA01
gaagucgucguccaucgccgc

SEQ ID NO: 3392178 - RNA, 22 nt, Pseudomonas aeruginosa PA01
gaagucgucguccaucgccgcg

SEQ ID NO: 3392179 - RNA, 20 nt, Pseudomonas aeruginosa PA01
gaagucguucccggccuggc

SEQ ID NO: 3392180 - RNA, 23 nt, Pseudomonas aeruginosa PA01
gaagucguucccggccuggcgcg

SEQ ID NO: 3392181 - RNA, 15 nt, Pseudomonas aeruginosa PA01
gaagucugccugucc

SEQ ID NO: 3392182 - RNA, 13 nt, Pseudomonas aeruginosa PA01
gaagugaagcgau

SEQ ID NO: 3392183 - RNA, 19 nt, Pseudomonas aeruginosa PA01
gaagugaccgcgcgccaug

SEQ ID NO: 3392184 - RNA, 14 nt, Pseudomonas aeruginosa PA01
gaagugcgcugcuu

SEQ ID NO: 3392185 - RNA, 15 nt, Pseudomonas aeruginosa PA01
gaaguggaucggccc

SEQ ID NO: 3392186 - RNA, 14 nt, Pseudomonas aeruginosa PA01
gaaguggcagcgcc

SEQ ID NO: 3392187 - RNA, 14 nt, Pseudomonas aeruginosa PA01
gaaguggccggugu

SEQ ID NO: 3392188 - RNA, 13 nt, Pseudomonas aeruginosa PA01
gaaguguuacagc

SEQ ID NO: 3392189 - RNA, 16 nt, Pseudomonas aeruginosa PA01
gaaguguuacagcagg

SEQ ID NO: 3392190 - RNA, 16 nt, Pseudomonas aeruginosa PA01
gaaguuaucggggcca

SEQ ID NO: 3392191 - RNA, 17 nt, Pseudomonas aeruginosa PA01
gaaguucaccucgguga

SEQ ID NO: 3392192 - RNA, 18 nt, Pseudomonas aeruginosa PA01
gaaguucccgccgcucug

SEQ ID NO: 3392193 - RNA, 21 nt, Pseudomonas aeruginosa PA01
gaaguugauggucaggcuggu

SEQ ID NO: 3392194 - RNA, 18 nt, Pseudomonas aeruginosa PA01
gaaguugcaggccagcgc

SEQ ID NO: 3392195 - RNA, 23 nt, Pseudomonas aeruginosa PA01
gaaguugcaggccagcgccaggu

SEQ ID NO: 3392196 - RNA, 15 nt, Pseudomonas aeruginosa PA01
gaaguugccgccagc

SEQ ID NO: 3392197 - RNA, 22 nt, Pseudomonas aeruginosa PA01
gaaguugccgccagcgcggcgc

SEQ ID NO: 3392198 - RNA, 15 nt, Pseudomonas aeruginosa PA01
gaaguugccgccgcu

SEQ ID NO: 3392199 - RNA, 18 nt, Pseudomonas aeruginosa PA01
gaaguugccgccgcuggc

SEQ ID NO: 3392200 - RNA, 23 nt, Pseudomonas aeruginosa PA01
gaaguugcgcacccgcucggccu

SEQ ID NO: 3392201 - RNA, 13 nt, Pseudomonas aeruginosa PA01
gaaguugcgcagc

SEQ ID NO: 3392202 - RNA, 16 nt, Pseudomonas aeruginosa PA01
gaaguuggcggccgac

SEQ ID NO: 3392203 - RNA, 18 nt, Pseudomonas aeruginosa PA01
gaauaaaaaaccggccaa

SEQ ID NO: 3392204 - RNA, 11 nt, Pseudomonas aeruginosa PA01
gaauaaccauu

SEQ ID NO: 3392205 - RNA, 19 nt, Pseudomonas aeruginosa PA01
gaauaaccgcuugcgguua

SEQ ID NO: 3392206 - RNA, 21 nt, Pseudomonas aeruginosa PA01
gaauaacucagcaucagugcu

SEQ ID NO: 3392207 - RNA, 18 nt, Pseudomonas aeruginosa PA01
gaauaccacguggccggc

SEQ ID NO: 3392208 - RNA, 22 nt, Pseudomonas aeruginosa PA01
gaauaccgccagcucgcugucc

SEQ ID NO: 3392209 - RNA, 15 nt, Pseudomonas aeruginosa PA01
gaauaccggccuguc

SEQ ID NO: 3392210 - RNA, 20 nt, Pseudomonas aeruginosa PA01
gaauacgcgguugguuuugc

SEQ ID NO: 3392211 - RNA, 20 nt, Pseudomonas aeruginosa PA01
gaauacugcacgcccaggcg

SEQ ID NO: 3392212 - RNA, 19 nt, Pseudomonas aeruginosa PA01
gaauagcgccgcaggcgcu

SEQ ID NO: 3392213 - RNA, 21 nt, Pseudomonas aeruginosa PA01
gaauaggcgaucuccggcagu

SEQ ID NO: 3392214 - RNA, 17 nt, Pseudomonas aeruginosa PA01
gaauagggcggcgccac

SEQ ID NO: 3392215 - RNA, 15 nt, Pseudomonas aeruginosa PA01
gaauauuucccauau

SEQ ID NO: 3392216 - RNA, 12 nt, Pseudomonas aeruginosa PA01
gaaucaagcaau

SEQ ID NO: 3392217 - RNA, 13 nt, Pseudomonas aeruginosa PA01
gaaucaagcaauu

SEQ ID NO: 3392218 - RNA, 18 nt, Pseudomonas aeruginosa PA01
gaaucaccacucgccagc

SEQ ID NO: 3392219 - RNA, 21 nt, Pseudomonas aeruginosa PA01
gaaucaccacucgccagcgcg

SEQ ID NO: 3392220 - RNA, 11 nt, Pseudomonas aeruginosa PA01
gaaucacgcug

SEQ ID NO: 3392221 - RNA, 20 nt, Pseudomonas aeruginosa PA01
gaaucacgcugcucgcagcc

SEQ ID NO: 3392222 - RNA, 19 nt, Pseudomonas aeruginosa PA01
gaaucacgucgaucugcuc

SEQ ID NO: 3392223 - RNA, 21 nt, Pseudomonas aeruginosa PA01
gaauccagggccgagcacagg

SEQ ID NO: 3392224 - RNA, 22 nt, Pseudomonas aeruginosa PA01
gaauccccaguagcgcuucgcg

SEQ ID NO: 3392225 - RNA, 14 nt, Pseudomonas aeruginosa PA01
gaaucccccccucu

SEQ ID NO: 3392226 - RNA, 19 nt, Pseudomonas aeruginosa PA01
gaaucccuuggcugcucgc

SEQ ID NO: 3392227 - RNA, 15 nt, Pseudomonas aeruginosa PA01
gaauccgcucggugc

SEQ ID NO: 3392228 - RNA, 21 nt, Pseudomonas aeruginosa PA01
gaauccggucggacuccgccc

SEQ ID NO: 3392229 - RNA, 13 nt, Pseudomonas aeruginosa PA01
gaauccuccagcc

SEQ ID NO: 3392230 - RNA, 18 nt, Pseudomonas aeruginosa PA01
gaauccuccagccggcga

SEQ ID NO: 3392231 - RNA, 15 nt, Pseudomonas aeruginosa PA01
gaauccuccgccagc

SEQ ID NO: 3392232 - RNA, 17 nt, Pseudomonas aeruginosa PA01
gaauccuccgccagcgu

SEQ ID NO: 3392233 - RNA, 20 nt, Pseudomonas aeruginosa PA01
gaauccuucgcggcggcgcg

SEQ ID NO: 3392234 - RNA, 14 nt, Pseudomonas aeruginosa PA01
gaaucgaacagggc

SEQ ID NO: 3392235 - RNA, 18 nt, Pseudomonas aeruginosa PA01
gaaucgaacccccgaccu

SEQ ID NO: 3392236 - RNA, 16 nt, Pseudomonas aeruginosa PA01
gaaucgcacuucguca

SEQ ID NO: 3392237 - RNA, 23 nt, Pseudomonas aeruginosa PA01
gaaucgcagccaugaaaaagccg

SEQ ID NO: 3392238 - RNA, 13 nt, Pseudomonas aeruginosa PA01
gaaucgccagcag

SEQ ID NO: 3392239 - RNA, 17 nt, Pseudomonas aeruginosa PA01
gaaucgccuaccagacc

SEQ ID NO: 3392240 - RNA, 18 nt, Pseudomonas aeruginosa PA01
gaaucgccuaccagaccg

SEQ ID NO: 3392241 - RNA, 21 nt, Pseudomonas aeruginosa PA01
gaaucgccuaccagaccgcag

SEQ ID NO: 3392242 - RNA, 14 nt, Pseudomonas aeruginosa PA01
gaaucgccucccug

SEQ ID NO: 3392243 - RNA, 22 nt, Pseudomonas aeruginosa PA01
gaaucggacagguuggcgccgg

SEQ ID NO: 3392244 - RNA, 23 nt, Pseudomonas aeruginosa PA01
gaaucgucacggcgugccgcagg

SEQ ID NO: 3392245 - RNA, 22 nt, Pseudomonas aeruginosa PA01
gaaucgucgaugaggucgcagc

SEQ ID NO: 3392246 - RNA, 22 nt, Pseudomonas aeruginosa PA01
gaaucgucgccggaggggcggc

SEQ ID NO: 3392247 - RNA, 15 nt, Pseudomonas aeruginosa PA01
gaaucugcgccaggu

SEQ ID NO: 3392248 - RNA, 17 nt, Pseudomonas aeruginosa PA01
gaaucuggccgaugccg

SEQ ID NO: 3392249 - RNA, 15 nt, Pseudomonas aeruginosa PA01
gaaugaaaaagggau

SEQ ID NO: 3392250 - RNA, 22 nt, Pseudomonas aeruginosa PA01
gaaugaaaaagggaugccggcg

SEQ ID NO: 3392251 - RNA, 23 nt, Pseudomonas aeruginosa PA01
gaaugaaaaagggaugccggcgg

SEQ ID NO: 3392252 - RNA, 18 nt, Pseudomonas aeruginosa PA01
gaaugcaaaaagcccacu

SEQ ID NO: 3392253 - RNA, 16 nt, Pseudomonas aeruginosa PA01
gaaugcccggcagcgc

SEQ ID NO: 3392254 - RNA, 19 nt, Pseudomonas aeruginosa PA01
gaaugcccgugcgcugcgu

SEQ ID NO: 3392255 - RNA, 20 nt, Pseudomonas aeruginosa PA01
gaaugcccgugcgcugcguu

SEQ ID NO: 3392256 - RNA, 17 nt, Pseudomonas aeruginosa PA01
gaaugccuucaccggcg

SEQ ID NO: 3392257 - RNA, 19 nt, Pseudomonas aeruginosa PA01
gaaugccuucaccggcgga

SEQ ID NO: 3392258 - RNA, 11 nt, Pseudomonas aeruginosa PA01
gaaugccuucg

SEQ ID NO: 3392259 - RNA, 15 nt, Pseudomonas aeruginosa PA01
gaaugcgcaggucgc

SEQ ID NO: 3392260 - RNA, 15 nt, Pseudomonas aeruginosa PA01
gaaugcgccucccgc

SEQ ID NO: 3392261 - RNA, 18 nt, Pseudomonas aeruginosa PA01
gaaugcuccggggucagu

SEQ ID NO: 3392262 - RNA, 23 nt, Pseudomonas aeruginosa PA01
gaaugcugcccggagcggcugcc

SEQ ID NO: 3392263 - RNA, 15 nt, Pseudomonas aeruginosa PA01
gaaugcuugccggcg

SEQ ID NO: 3392264 - RNA, 14 nt, Pseudomonas aeruginosa PA01
gaauggacaggcgc

SEQ ID NO: 3392265 - RNA, 15 nt, Pseudomonas aeruginosa PA01
gaauggacaggcgcc

SEQ ID NO: 3392266 - RNA, 17 nt, Pseudomonas aeruginosa PA01
gaauggacaggcgcccc

SEQ ID NO: 3392267 - RNA, 20 nt, Pseudomonas aeruginosa PA01
gacagcucguggcuggcgcc

SEQ ID NO: 3392268 - RNA, 20 nt, Pseudomonas aeruginosa PA01
gacagcuugacccguugcgc

SEQ ID NO: 3392269 - RNA, 18 nt, Pseudomonas aeruginosa PA01
gacagcuugccguccagc

SEQ ID NO: 3392270 - RNA, 20 nt, Pseudomonas aeruginosa PA01
gacagcuuggccagcaggcc

SEQ ID NO: 3392271 - RNA, 21 nt, Pseudomonas aeruginosa PA01
gacagcuuggccagcaggccg

SEQ ID NO: 3392272 - RNA, 14 nt, Pseudomonas aeruginosa PA01
gacaggaacgcccu

SEQ ID NO: 3392273 - RNA, 16 nt, Pseudomonas aeruginosa PA01
gacaggaagagcaggc

SEQ ID NO: 3392274 - RNA, 18 nt, Pseudomonas aeruginosa PA01
gacaggaagagcaggcgg

SEQ ID NO: 3392275 - RNA, 22 nt, Pseudomonas aeruginosa PA01
gacaggaaucgacccagccgca

SEQ ID NO: 3392276 - RNA, 19 nt, Pseudomonas aeruginosa PA01
gacaggaugcgcuuuuccu

SEQ ID NO: 3392277 - RNA, 17 nt, Pseudomonas aeruginosa PA01
gacaggauggacagcuu

SEQ ID NO: 3392278 - RNA, 13 nt, Pseudomonas aeruginosa PA01
gacaggcagccgg

SEQ ID NO: 3392279 - RNA, 14 nt, Pseudomonas aeruginosa PA01
gacaggcagccggc

SEQ ID NO: 3392280 - RNA, 16 nt, Pseudomonas aeruginosa PA01
gacaggcagccggcca

SEQ ID NO: 3392281 - RNA, 14 nt, Pseudomonas aeruginosa PA01
gacaggcagcgccg

SEQ ID NO: 3392282 - RNA, 16 nt, Pseudomonas aeruginosa PA01
gacaggcagcgccgcc

SEQ ID NO: 3392283 - RNA, 18 nt, Pseudomonas aeruginosa PA01
gacaggcagcgccgccca

SEQ ID NO: 3392284 - RNA, 19 nt, Pseudomonas aeruginosa PA01
gacaggcaucgcucgcaac

SEQ ID NO: 3392285 - RNA, 15 nt, Pseudomonas aeruginosa PA01
gacaggccacccgcc

SEQ ID NO: 3392286 - RNA, 17 nt, Pseudomonas aeruginosa PA01
gacaggccagcucgccc

SEQ ID NO: 3392287 - RNA, 18 nt, Pseudomonas aeruginosa PA01
gacaggccagcucgcccg

SEQ ID NO: 3392288 - RNA, 20 nt, Pseudomonas aeruginosa PA01
gacaggcccuugaacaggcu

SEQ ID NO: 3392289 - RNA, 22 nt, Pseudomonas aeruginosa PA01
gacaggcccuugaacaggcugg

SEQ ID NO: 3392290 - RNA, 16 nt, Pseudomonas aeruginosa PA01
gacaggccgaccagca

SEQ ID NO: 3392291 - RNA, 18 nt, Pseudomonas aeruginosa PA01
gacaggccgaccagcagg

SEQ ID NO: 3392292 - RNA, 20 nt, Pseudomonas aeruginosa PA01
gacaggccgaccagcagggc

SEQ ID NO: 3392293 - RNA, 21 nt, Pseudomonas aeruginosa PA01
gacaggccgaccagcagggcc

SEQ ID NO: 3392294 - RNA, 19 nt, Pseudomonas aeruginosa PA01
gacaggccggugccgccgg

SEQ ID NO: 3392295 - RNA, 20 nt, Pseudomonas aeruginosa PA01
gacaggccggugccgccggc

SEQ ID NO: 3392296 - RNA, 21 nt, Pseudomonas aeruginosa PA01
gacaggccggugccgccggcc

SEQ ID NO: 3392297 - RNA, 22 nt, Pseudomonas aeruginosa PA01
gacaggccggugccgccggcca

SEQ ID NO: 3392298 - RNA, 23 nt, Pseudomonas aeruginosa PA01
gacaggccggugccgccggccac

SEQ ID NO: 3392299 - RNA, 23 nt, Pseudomonas aeruginosa PA01
gacaggccuguggauagaaaagc

SEQ ID NO: 3392300 - RNA, 17 nt, Pseudomonas aeruginosa PA01
gacaggcgucccuggag

SEQ ID NO: 3392301 - RNA, 18 nt, Pseudomonas aeruginosa PA01
gacaggcgucccuggagc

SEQ ID NO: 3392302 - RNA, 20 nt, Pseudomonas aeruginosa PA01
gacaggcgucccuggagcag

SEQ ID NO: 3392303 - RNA, 21 nt, Pseudomonas aeruginosa PA01
gacaggcgucccuggagcagg

SEQ ID NO: 3392304 - RNA, 22 nt, Pseudomonas aeruginosa PA01
gacaggcgucccuggagcaggg

SEQ ID NO: 3392305 - RNA, 13 nt, Pseudomonas aeruginosa PA01
gacaggcuggugc

SEQ ID NO: 3392306 - RNA, 15 nt, Pseudomonas aeruginosa PA01
gacagguacucggcc

SEQ ID NO: 3392307 - RNA, 16 nt, Pseudomonas aeruginosa PA01
gacagguccuggaaca

SEQ ID NO: 3392308 - RNA, 19 nt, Pseudomonas aeruginosa PA01
gacagguccuggaacagga

SEQ ID NO: 3392309 - RNA, 15 nt, Pseudomonas aeruginosa PA01
gacaggucgacggcc

SEQ ID NO: 3392310 - RNA, 17 nt, Pseudomonas aeruginosa PA01
gacaggucgacggcccu

SEQ ID NO: 3392311 - RNA, 21 nt, Pseudomonas aeruginosa PA01
gacaggucggccggcagcucc

SEQ ID NO: 3392312 - RNA, 22 nt, Pseudomonas aeruginosa PA01
gacaggucggccggcagcuccg

SEQ ID NO: 3392313 - RNA, 19 nt, Pseudomonas aeruginosa PA01
gacaggucggcgaaauccu

SEQ ID NO: 3392314 - RNA, 20 nt, Pseudomonas aeruginosa PA01
gacaggucggcgaaauccuc

SEQ ID NO: 3392315 - RNA, 19 nt, Pseudomonas aeruginosa PA01
gacagguucaggacgcucc

SEQ ID NO: 3392316 - RNA, 23 nt, Pseudomonas aeruginosa PA01
gacagguucaggacgcuccugcg

SEQ ID NO: 3392317 - RNA, 16 nt, Pseudomonas aeruginosa PA01
gacagguucaggucga

SEQ ID NO: 3392318 - RNA, 18 nt, Pseudomonas aeruginosa PA01
gacagguuggcgccgggc

SEQ ID NO: 3392319 - RNA, 14 nt, Pseudomonas aeruginosa PA01
gacaguaccuucca

SEQ ID NO: 3392320 - RNA, 15 nt, Pseudomonas aeruginosa PA01
gacagucccaggcca

SEQ ID NO: 3392321 - RNA, 14 nt, Pseudomonas aeruginosa PA01
gacaguucgccgcc

SEQ ID NO: 3392322 - RNA, 16 nt, Pseudomonas aeruginosa PA01
gacaguucgccgcccg

SEQ ID NO: 3392323 - RNA, 20 nt, Pseudomonas aeruginosa PA01
gacaguucgccgcccgaggc

SEQ ID NO: 3392324 - RNA, 21 nt, Pseudomonas aeruginosa PA01
gacaguucgcggaacuucgca

SEQ ID NO: 3392325 - RNA, 16 nt, Pseudomonas aeruginosa PA01
gacauacaggcgcgcc

SEQ ID NO: 3392326 - RNA, 18 nt, Pseudomonas aeruginosa PA01
gacauacaggcgcgccug

SEQ ID NO: 3392327 - RNA, 19 nt, Pseudomonas aeruginosa PA01
gacauacaggcgcgccugg

SEQ ID NO: 3392328 - RNA, 13 nt, Pseudomonas aeruginosa PA01
gacauacuccgcc

SEQ ID NO: 3392329 - RNA, 14 nt, Pseudomonas aeruginosa PA01
gacauacuccgccg

SEQ ID NO: 3392330 - RNA, 17 nt, Pseudomonas aeruginosa PA01
gacauagcgcagcaccg

SEQ ID NO: 3392331 - RNA, 20 nt, Pseudomonas aeruginosa PA01
gacauagcgcagcaccggcu

SEQ ID NO: 3392332 - RNA, 16 nt, Pseudomonas aeruginosa PA01
gacaucaccacgcgau

SEQ ID NO: 3392333 - RNA, 23 nt, Pseudomonas aeruginosa PA01
gacaucaccacgcgauauccgcc

SEQ ID NO: 3392334 - RNA, 13 nt, Pseudomonas aeruginosa PA01
gacauccaccagg

SEQ ID NO: 3392335 - RNA, 20 nt, Pseudomonas aeruginosa PA01
gacauccggguccagcggcc

SEQ ID NO: 3392336 - RNA, 15 nt, Pseudomonas aeruginosa PA01
gacauccucccugcc

SEQ ID NO: 3392337 - RNA, 17 nt, Pseudomonas aeruginosa PA01
gacauccucccugcccg

SEQ ID NO: 3392338 - RNA, 20 nt, Pseudomonas aeruginosa PA01
gacauccucccugcccgcuc

SEQ ID NO: 3392339 - RNA, 16 nt, Pseudomonas aeruginosa PA01
gacauccugucgaggc

SEQ ID NO: 3392340 - RNA, 15 nt, Pseudomonas aeruginosa PA01
gacaucgacgcccuc

SEQ ID NO: 3392341 - RNA, 19 nt, Pseudomonas aeruginosa PA01
gacaucgauaacaccagga

SEQ ID NO: 3392342 - RNA, 21 nt, Pseudomonas aeruginosa PA01
gacaucgauaacaccaggagc

SEQ ID NO: 3392343 - RNA, 19 nt, Pseudomonas aeruginosa PA01
gacaucggagugcaugccg

SEQ ID NO: 3392344 - RNA, 21 nt, Pseudomonas aeruginosa PA01
gacaucggcgauggccaucag

SEQ ID NO: 3392345 - RNA, 17 nt, Pseudomonas aeruginosa PA01
gacaucgucucgcgaca

SEQ ID NO: 3392346 - RNA, 16 nt, Pseudomonas aeruginosa PA01
gacaucuccaggccgc

SEQ ID NO: 3392347 - RNA, 17 nt, Pseudomonas aeruginosa PA01
gacaucuccaggccgcu

SEQ ID NO: 3392348 - RNA, 22 nt, Pseudomonas aeruginosa PA01
gacaucucguccucggggaagc

SEQ ID NO: 3392349 - RNA, 16 nt, Pseudomonas aeruginosa PA01
gacaugaaaaagccgg

SEQ ID NO: 3392350 - RNA, 20 nt, Pseudomonas aeruginosa PA01
gacaugaaaaagccggaggc

SEQ ID NO: 3392351 - RNA, 14 nt, Pseudomonas aeruginosa PA01
gacaugcaccaggc

SEQ ID NO: 3392352 - RNA, 18 nt, Pseudomonas aeruginosa PA01
gacaugcaccaggccgcc

SEQ ID NO: 3392353 - RNA, 13 nt, Pseudomonas aeruginosa PA01
gacaugcaggccg

SEQ ID NO: 3392354 - RNA, 14 nt, Pseudomonas aeruginosa PA01
gacaugcaggccgg

SEQ ID NO: 3392355 - RNA, 16 nt, Pseudomonas aeruginosa PA01
gacaugcaggccggcc

SEQ ID NO: 3392356 - RNA, 17 nt, Pseudomonas aeruginosa PA01
gacaugcaggccggccu

SEQ ID NO: 3392357 - RNA, 20 nt, Pseudomonas aeruginosa PA01
gacaugcaggccggccucca

SEQ ID NO: 3392358 - RNA, 21 nt, Pseudomonas aeruginosa PA01
gacaugccgguucccgcagcg

SEQ ID NO: 3392359 - RNA, 17 nt, Pseudomonas aeruginosa PA01
gacauggaucaccgcca

SEQ ID NO: 3392360 - RNA, 21 nt, Pseudomonas aeruginosa PA01
gacauggaucaccgccaaggc

SEQ ID NO: 3392361 - RNA, 14 nt, Pseudomonas aeruginosa PA01
gacauggaugacca

SEQ ID NO: 3392362 - RNA, 13 nt, Pseudomonas aeruginosa PA01
gacauggcgcucg

SEQ ID NO: 3392363 - RNA, 16 nt, Pseudomonas aeruginosa PA01
gacauucgacagcagg

SEQ ID NO: 3392364 - RNA, 13 nt, Pseudomonas aeruginosa PA01
gaccaacagggcg

SEQ ID NO: 3392365 - RNA, 20 nt, Pseudomonas aeruginosa PA01
gaccaacagggcgucgucga

SEQ ID NO: 3392366 - RNA, 15 nt, Pseudomonas aeruginosa PA01
gaccaacugcgcccc

SEQ ID NO: 3392367 - RNA, 19 nt, Pseudomonas aeruginosa PA01
gaccaacugcgcccccagc

SEQ ID NO: 3392368 - RNA, 20 nt, Pseudomonas aeruginosa PA01
gaccaaggcauugcgcuugc

SEQ ID NO: 3392369 - RNA, 16 nt, Pseudomonas aeruginosa PA01
gaccagcggcccggcg

SEQ ID NO: 3392370 - RNA, 13 nt, Pseudomonas aeruginosa PA01
gaccagcggcggu

SEQ ID NO: 3392371 - RNA, 17 nt, Pseudomonas aeruginosa PA01
gaccagcucgaagccgc

SEQ ID NO: 3392372 - RNA, 20 nt, Pseudomonas aeruginosa PA01
gaccagcucgaagccgccgu

SEQ ID NO: 3392373 - RNA, 23 nt, Pseudomonas aeruginosa PA01
gaccagcucgaagccgccguuga

SEQ ID NO: 3392374 - RNA, 14 nt, Pseudomonas aeruginosa PA01
gaccagcucggcgg

SEQ ID NO: 3392375 - RNA, 21 nt, Pseudomonas aeruginosa PA01
gaccagcuucaaccguggcuc

SEQ ID NO: 3392376 - RNA, 23 nt, Pseudomonas aeruginosa PA01
gaccagcuucaaccguggcucga

SEQ ID NO: 3392377 - RNA, 14 nt, Pseudomonas aeruginosa PA01
gaccagcuugggca

SEQ ID NO: 3392378 - RNA, 19 nt, Pseudomonas aeruginosa PA01
gaccagcuuguggccgguc

SEQ ID NO: 3392379 - RNA, 15 nt, Pseudomonas aeruginosa PA01
gaccaggaaggccgg

SEQ ID NO: 3392380 - RNA, 17 nt, Pseudomonas aeruginosa PA01
gaccaggaaggccgggc

SEQ ID NO: 3392381 - RNA, 22 nt, Pseudomonas aeruginosa PA01
gaccaggaaggccgggcccugg

SEQ ID NO: 3392382 - RNA, 20 nt, Pseudomonas aeruginosa PA01
gaccaggaauuccuggccgg

SEQ ID NO: 3392383 - RNA, 23 nt, Pseudomonas aeruginosa PA01
gaccaggaauuccuggccgguga

SEQ ID NO: 3392384 - RNA, 16 nt, Pseudomonas aeruginosa PA01
gaccaggaucgacccc

SEQ ID NO: 3392385 - RNA, 13 nt, Pseudomonas aeruginosa PA01
gaccaggccgagc

SEQ ID NO: 3392386 - RNA, 14 nt, Pseudomonas aeruginosa PA01
gaccaggccgagca

SEQ ID NO: 3392387 - RNA, 17 nt, Pseudomonas aeruginosa PA01
gaccaggccgagcagga

SEQ ID NO: 3392388 - RNA, 19 nt, Pseudomonas aeruginosa PA01
gaccaggccgagcaggaag

SEQ ID NO: 3392389 - RNA, 19 nt, Pseudomonas aeruginosa PA01
gaccaggccgaucgccucg

SEQ ID NO: 3392390 - RNA, 21 nt, Pseudomonas aeruginosa PA01
gaccaggccguaggcgauggc

SEQ ID NO: 3392391 - RNA, 13 nt, Pseudomonas aeruginosa PA01
gaccaggcggccg

SEQ ID NO: 3392392 - RNA, 14 nt, Pseudomonas aeruginosa PA01
gaccaggcggccgg

SEQ ID NO: 3392393 - RNA, 14 nt, Pseudomonas aeruginosa PA01
gaccaggcggccgu

SEQ ID NO: 3392394 - RNA, 19 nt, Pseudomonas aeruginosa PA01
gaccaggcggccgucggcc

SEQ ID NO: 3392395 - RNA, 20 nt, Pseudomonas aeruginosa PA01
gaccaggcugaucagcccgc

SEQ ID NO: 3392396 - RNA, 21 nt, Pseudomonas aeruginosa PA01
gaccaggcugaucagcccgcu

SEQ ID NO: 3392397 - RNA, 16 nt, Pseudomonas aeruginosa PA01
gaccagggcauccagg

SEQ ID NO: 3392398 - RNA, 21 nt, Pseudomonas aeruginosa PA01
gaccagggcauccagggucgc

SEQ ID NO: 3392399 - RNA, 19 nt, Pseudomonas aeruginosa PA01
gaccagggcgccgggcugc

SEQ ID NO: 3392400 - RNA, 15 nt, Pseudomonas aeruginosa PA01
gaccagggcgggccg

SEQ ID NO: 3392401 - RNA, 18 nt, Pseudomonas aeruginosa PA01
gaccagggcgggccgcuc

SEQ ID NO: 3392402 - RNA, 14 nt, Pseudomonas aeruginosa PA01
gaccaggguggcgg

SEQ ID NO: 3392403 - RNA, 15 nt, Pseudomonas aeruginosa PA01
gaccaggguggcggc

SEQ ID NO: 3392404 - RNA, 18 nt, Pseudomonas aeruginosa PA01
gaccaggguggcggcggc

SEQ ID NO: 3392405 - RNA, 19 nt, Pseudomonas aeruginosa PA01
gaccaggguggggaugcgc

SEQ ID NO: 3392406 - RNA, 22 nt, Pseudomonas aeruginosa PA01
gaccaggguggggaugcgcgag

SEQ ID NO: 3392407 - RNA, 23 nt, Pseudomonas aeruginosa PA01
gaccaggguggggaugcgcgagg

SEQ ID NO: 3392408 - RNA, 19 nt, Pseudomonas aeruginosa PA01
gaccagguagagcagcccg

SEQ ID NO: 3392409 - RNA, 23 nt, Pseudomonas aeruginosa PA01
gaccagguagagcagcccgggca

SEQ ID NO: 3392410 - RNA, 15 nt, Pseudomonas aeruginosa PA01
gaccagguccgccac

SEQ ID NO: 3392411 - RNA, 20 nt, Pseudomonas aeruginosa PA01
gaccagguccggcagcgccu

SEQ ID NO: 3392412 - RNA, 21 nt, Pseudomonas aeruginosa PA01
gaccagguccggcagcgccuu

SEQ ID NO: 3392413 - RNA, 21 nt, Pseudomonas aeruginosa PA01
gaccaggucgaguuuccggug

SEQ ID NO: 3392414 - RNA, 22 nt, Pseudomonas aeruginosa PA01
gaccaggucgccaugcccgucg

SEQ ID NO: 3392415 - RNA, 16 nt, Pseudomonas aeruginosa PA01
gaccaggucgcuggca

SEQ ID NO: 3392416 - RNA, 22 nt, Pseudomonas aeruginosa PA01
gaccaggucgcuggcaccggcc

SEQ ID NO: 3392417 - RNA, 15 nt, Pseudomonas aeruginosa PA01
gaccaguaccagcaa

SEQ ID NO: 3392418 - RNA, 13 nt, Pseudomonas aeruginosa PA01
gaccaguacgucg

SEQ ID NO: 3392419 - RNA, 15 nt, Pseudomonas aeruginosa PA01
gaccagucggccguu

SEQ ID NO: 3392420 - RNA, 14 nt, Pseudomonas aeruginosa PA01
gaccaguucagcgc

SEQ ID NO: 3392421 - RNA, 15 nt, Pseudomonas aeruginosa PA01
gaccaguucagcgcg

SEQ ID NO: 3392422 - RNA, 14 nt, Pseudomonas aeruginosa PA01
gaccaguucgccgc

SEQ ID NO: 3392423 - RNA, 15 nt, Pseudomonas aeruginosa PA01
gaccaguucgccgcc

SEQ ID NO: 3392424 - RNA, 18 nt, Pseudomonas aeruginosa PA01
gaccaguucgccgccgcg

SEQ ID NO: 3392425 - RNA, 16 nt, Pseudomonas aeruginosa PA01
gaccaguugcccgagu

SEQ ID NO: 3392426 - RNA, 23 nt, Pseudomonas aeruginosa PA01
gaccaguugcccgagugccggcg

SEQ ID NO: 3392427 - RNA, 16 nt, Pseudomonas aeruginosa PA01
gaccaguuucuucgcg

SEQ ID NO: 3392428 - RNA, 21 nt, Pseudomonas aeruginosa PA01
gaccauaggcuugcgccgaag

SEQ ID NO: 3392429 - RNA, 15 nt, Pseudomonas aeruginosa PA01
gaccaucaccagcgc

SEQ ID NO: 3392430 - RNA, 18 nt, Pseudomonas aeruginosa PA01
gaccaucaccagcgccgu

SEQ ID NO: 3392431 - RNA, 17 nt, Pseudomonas aeruginosa PA01
gaccaucagcuggaucu

SEQ ID NO: 3392432 - RNA, 21 nt, Pseudomonas aeruginosa PA01
gaccaucgccggcgagccgcu

SEQ ID NO: 3392433 - RNA, 12 nt, Pseudomonas aeruginosa PA01
gaccaucggcac

SEQ ID NO: 3392434 - RNA, 16 nt, Pseudomonas aeruginosa PA01
gaccaucggcggcggc

SEQ ID NO: 3392435 - RNA, 17 nt, Pseudomonas aeruginosa PA01
gaccaucggcggcggcc

SEQ ID NO: 3392436 - RNA, 19 nt, Pseudomonas aeruginosa PA01
gaccaucugccagcucuug

SEQ ID NO: 3392437 - RNA, 16 nt, Pseudomonas aeruginosa PA01
gaccaucuggaucagg

SEQ ID NO: 3392438 - RNA, 19 nt, Pseudomonas aeruginosa PA01
gaccaucuggaucaggaag

SEQ ID NO: 3392439 - RNA, 16 nt, Pseudomonas aeruginosa PA01
gaccaucuuuuccugc

SEQ ID NO: 3392440 - RNA, 23 nt, Pseudomonas aeruginosa PA01
gaccauggugaugcgcaugcugg

SEQ ID NO: 3392441 - RNA, 23 nt, Pseudomonas aeruginosa PA01
gaccaugguguuggcggccuggg

SEQ ID NO: 3392442 - RNA, 21 nt, Pseudomonas aeruginosa PA01
gaccauuucccgcgagcagcc

SEQ ID NO: 3392443 - RNA, 14 nt, Pseudomonas aeruginosa PA01
gaccauuugcgccu

SEQ ID NO: 3392444 - RNA, 15 nt, Pseudomonas aeruginosa PA01
gacccacuccggcag

SEQ ID NO: 3392445 - RNA, 21 nt, Pseudomonas aeruginosa PA01
gacccacuccggcaggcgcuc

SEQ ID NO: 3392446 - RNA, 14 nt, Pseudomonas aeruginosa PA01
gacccacugaagac

SEQ ID NO: 3392447 - RNA, 17 nt, Pseudomonas aeruginosa PA01
gacccacugaagacccg

SEQ ID NO: 3392448 - RNA, 23 nt, Pseudomonas aeruginosa PA01
gacccagaaaccgaucagcaccg

SEQ ID NO: 3392449 - RNA, 18 nt, Pseudomonas aeruginosa PA01
gacccagaccugccgccc

SEQ ID NO: 3392450 - RNA, 14 nt, Pseudomonas aeruginosa PA01
gacccagagccgcu

SEQ ID NO: 3392451 - RNA, 15 nt, Pseudomonas aeruginosa PA01
gacccagagccgcuc

SEQ ID NO: 3392452 - RNA, 22 nt, Pseudomonas aeruginosa PA01
gacccagaugaucuucaucccg

SEQ ID NO: 3392453 - RNA, 16 nt, Pseudomonas aeruginosa PA01
gacccagcgcacgccg

SEQ ID NO: 3392454 - RNA, 14 nt, Pseudomonas aeruginosa PA01
gacccagcgcuggu

SEQ ID NO: 3392455 - RNA, 18 nt, Pseudomonas aeruginosa PA01
gacccaggcccagccggu

SEQ ID NO: 3392456 - RNA, 14 nt, Pseudomonas aeruginosa PA01
gacccaggccgaca

SEQ ID NO: 3392457 - RNA, 20 nt, Pseudomonas aeruginosa PA01
gacccaggcuucggcgcgcu

SEQ ID NO: 3392458 - RNA, 18 nt, Pseudomonas aeruginosa PA01
gacccaggugcgcaggcg

SEQ ID NO: 3392459 - RNA, 19 nt, Pseudomonas aeruginosa PA01
gacccaggugcgcaggcgc

SEQ ID NO: 3392460 - RNA, 20 nt, Pseudomonas aeruginosa PA01
gacccaguugggccaggagg

SEQ ID NO: 3392461 - RNA, 14 nt, Pseudomonas aeruginosa PA01
gaccccacgccggc

SEQ ID NO: 3392462 - RNA, 15 nt, Pseudomonas aeruginosa PA01
gaccccacgccggcc

SEQ ID NO: 3392463 - RNA, 13 nt, Pseudomonas aeruginosa PA01
gaccccauccgca

SEQ ID NO: 3392464 - RNA, 19 nt, Pseudomonas aeruginosa PA01
gacccccugccgcccucgg

SEQ ID NO: 3392465 - RNA, 15 nt, Pseudomonas aeruginosa PA01
gacccccugcggccc

SEQ ID NO: 3392466 - RNA, 16 nt, Pseudomonas aeruginosa PA01
gaccccgaggucggcg

SEQ ID NO: 3392467 - RNA, 17 nt, Pseudomonas aeruginosa PA01
gaccccgaucaccggau

SEQ ID NO: 3392468 - RNA, 21 nt, Pseudomonas aeruginosa PA01
gaccccgccggggcgugcagg

SEQ ID NO: 3392469 - RNA, 18 nt, Pseudomonas aeruginosa PA01
gaccccggaaagguucac

SEQ ID NO: 3392470 - RNA, 12 nt, Pseudomonas aeruginosa PA01
gaccccggccug

SEQ ID NO: 3392471 - RNA, 14 nt, Pseudomonas aeruginosa PA01
gaccgcagccggcg

SEQ ID NO: 3392472 - RNA, 15 nt, Pseudomonas aeruginosa PA01
gaccgcagccggcga

SEQ ID NO: 3392473 - RNA, 22 nt, Pseudomonas aeruginosa PA01
gaccgcaucguuggcgccgucc

SEQ ID NO: 3392474 - RNA, 18 nt, Pseudomonas aeruginosa PA01
gaccgccagacaggccag

SEQ ID NO: 3392475 - RNA, 19 nt, Pseudomonas aeruginosa PA01
gaccgccagacaggccagc

SEQ ID NO: 3392476 - RNA, 22 nt, Pseudomonas aeruginosa PA01
gaccgccagacaggccagcucg

SEQ ID NO: 3392477 - RNA, 12 nt, Pseudomonas aeruginosa PA01
gaccgccaggcg

SEQ ID NO: 3392478 - RNA, 18 nt, Pseudomonas aeruginosa PA01
gaccgccaggcggccgcu

SEQ ID NO: 3392479 - RNA, 20 nt, Pseudomonas aeruginosa PA01
gaccgccaggcggccgcugg

SEQ ID NO: 3392480 - RNA, 12 nt, Pseudomonas aeruginosa PA01
gaccgccauggc

SEQ ID NO: 3392481 - RNA, 14 nt, Pseudomonas aeruginosa PA01
gaccgccauggcgc

SEQ ID NO: 3392482 - RNA, 15 nt, Pseudomonas aeruginosa PA01
gaccgcccaggcugc

SEQ ID NO: 3392483 - RNA, 18 nt, Pseudomonas aeruginosa PA01
gaccgcccaggcugccgc

SEQ ID NO: 3392484 - RNA, 19 nt, Pseudomonas aeruginosa PA01
gaccgcccaggcugccgcc

SEQ ID NO: 3392485 - RNA, 20 nt, Pseudomonas aeruginosa PA01
gaccgcccaggcugccgccg

SEQ ID NO: 3392486 - RNA, 19 nt, Pseudomonas aeruginosa PA01
gaccgcccagggggccggg

SEQ ID NO: 3392487 - RNA, 22 nt, Pseudomonas aeruginosa PA01
gaccgcccagggggccgggccg

SEQ ID NO: 3392488 - RNA, 20 nt, Pseudomonas aeruginosa PA01
gaccgccccggcagccacca

SEQ ID NO: 3392489 - RNA, 22 nt, Pseudomonas aeruginosa PA01
gaccgccccggcagccaccagg

SEQ ID NO: 3392490 - RNA, 23 nt, Pseudomonas aeruginosa PA01
gaccgccccggcagccaccaggu

SEQ ID NO: 3392491 - RNA, 20 nt, Pseudomonas aeruginosa PA01
gaccgcccgccucaggccgg

SEQ ID NO: 3392492 - RNA, 14 nt, Pseudomonas aeruginosa PA01
gaccgccgccgccu

SEQ ID NO: 3392493 - RNA, 15 nt, Pseudomonas aeruginosa PA01
gaccgccgccugggu

SEQ ID NO: 3392494 - RNA, 22 nt, Pseudomonas aeruginosa PA01
gaccgccgccuggguggcgacg

SEQ ID NO: 3392495 - RNA, 23 nt, Pseudomonas aeruginosa PA01
gaccgccgccuggguggcgacga

SEQ ID NO: 3392496 - RNA, 12 nt, Pseudomonas aeruginosa PA01
gaccgccgcuca

SEQ ID NO: 3392497 - RNA, 13 nt, Pseudomonas aeruginosa PA01
gaccgccgcucau

SEQ ID NO: 3392498 - RNA, 19 nt, Pseudomonas aeruginosa PA01
gaccgccgcucaucugcac

SEQ ID NO: 3392499 - RNA, 17 nt, Pseudomonas aeruginosa PA01
gaccgccugccagaccg

SEQ ID NO: 3392500 - RNA, 17 nt, Pseudomonas aeruginosa PA01
gaccgccugcucgcggc

SEQ ID NO: 3392501 - RNA, 21 nt, Pseudomonas aeruginosa PA01
gaccgccugcucgcggcuggc

SEQ ID NO: 3392502 - RNA, 23 nt, Pseudomonas aeruginosa PA01
gaccgccugcucgcggcuggccg

SEQ ID NO: 3392503 - RNA, 13 nt, Pseudomonas aeruginosa PA01
gaccgcgaauggc

SEQ ID NO: 3392504 - RNA, 19 nt, Pseudomonas aeruginosa PA01
gaccgcgaauggcagcagg

SEQ ID NO: 3392505 - RNA, 20 nt, Pseudomonas aeruginosa PA01
gaccgcgaauggcagcaggc

SEQ ID NO: 3392506 - RNA, 16 nt, Pseudomonas aeruginosa PA01
gaccgcgagcgccgcc

SEQ ID NO: 3392507 - RNA, 17 nt, Pseudomonas aeruginosa PA01
gaccgcgagcgccgccu

SEQ ID NO: 3392508 - RNA, 18 nt, Pseudomonas aeruginosa PA01
gaccgcgagcgccgccuu

SEQ ID NO: 3392509 - RNA, 19 nt, Pseudomonas aeruginosa PA01
gaccgcgaguucgccggcc

SEQ ID NO: 3392510 - RNA, 16 nt, Pseudomonas aeruginosa PA01
gaccgcgaugguaugg

SEQ ID NO: 3392511 - RNA, 22 nt, Pseudomonas aeruginosa PA01
gaccgcgaugguauggcggucg

SEQ ID NO: 3392512 - RNA, 13 nt, Pseudomonas aeruginosa PA01
gaccgcgccggcg

SEQ ID NO: 3392513 - RNA, 14 nt, Pseudomonas aeruginosa PA01
gaccgcgccggcga

SEQ ID NO: 3392514 - RNA, 15 nt, Pseudomonas aeruginosa PA01
gaccgcgccggcgau

SEQ ID NO: 3392515 - RNA, 19 nt, Pseudomonas aeruginosa PA01
gaccgcgcgcauggucgcg

SEQ ID NO: 3392516 - RNA, 12 nt, Pseudomonas aeruginosa PA01
gaccgcgcgcca

SEQ ID NO: 3392517 - RNA, 18 nt, Pseudomonas aeruginosa PA01
gaccgcgcgccugcaacg

SEQ ID NO: 3392518 - RNA, 21 nt, Pseudomonas aeruginosa PA01
gaccgcgcgccugcaacgcca

SEQ ID NO: 3392519 - RNA, 15 nt, Pseudomonas aeruginosa PA01
gaccgcgugggccgg

SEQ ID NO: 3392520 - RNA, 17 nt, Pseudomonas aeruginosa PA01
gaccgcgugggccggca

SEQ ID NO: 3392521 - RNA, 18 nt, Pseudomonas aeruginosa PA01
gaccgcucgucaggcgcu

SEQ ID NO: 3392522 - RNA, 13 nt, Pseudomonas aeruginosa PA01
gaccgcuggacca

SEQ ID NO: 3392523 - RNA, 23 nt, Pseudomonas aeruginosa PA01
gaccggaucuaaggggcggcucg

SEQ ID NO: 3392524 - RNA, 17 nt, Pseudomonas aeruginosa PA01
gaccggaugcuccaggu

SEQ ID NO: 3392525 - RNA, 12 nt, Pseudomonas aeruginosa PA01
gaccggcagccg

SEQ ID NO: 3392526 - RNA, 14 nt, Pseudomonas aeruginosa PA01
gaccggcagccggg

SEQ ID NO: 3392527 - RNA, 12 nt, Pseudomonas aeruginosa PA01
gaccggcagcgc

SEQ ID NO: 3392528 - RNA, 17 nt, Pseudomonas aeruginosa PA01
gaccggcagcgccgcca

SEQ ID NO: 3392529 - RNA, 18 nt, Pseudomonas aeruginosa PA01
gaccggcagcgccgccag

SEQ ID NO: 3392530 - RNA, 19 nt, Pseudomonas aeruginosa PA01
gaccggcagcgccgccagc

SEQ ID NO: 3392531 - RNA, 20 nt, Pseudomonas aeruginosa PA01
gaccggcagcgccgccagca

SEQ ID NO: 3392532 - RNA, 21 nt, Pseudomonas aeruginosa PA01
gaccggcagcgccgccagcag

SEQ ID NO: 3392533 - RNA, 22 nt, Pseudomonas aeruginosa PA01
gaccggcagcgccgccagcagg

SEQ ID NO: 3392534 - RNA, 13 nt, Pseudomonas aeruginosa PA01
gaccggcaggucg

SEQ ID NO: 3392535 - RNA, 23 nt, Pseudomonas aeruginosa PA01
gaccggcaggucgggcaacggcu

SEQ ID NO: 3392536 - RNA, 19 nt, Pseudomonas aeruginosa PA01
gaccggcagucccugccag

SEQ ID NO: 3392537 - RNA, 13 nt, Pseudomonas aeruginosa PA01
gaccggccggcuc

SEQ ID NO: 3392538 - RNA, 22 nt, Pseudomonas aeruginosa PA01
gaccggccuuuuucaugggugc

SEQ ID NO: 3392539 - RNA, 16 nt, Pseudomonas aeruginosa PA01
gaccggcgccccugcg

SEQ ID NO: 3392540 - RNA, 21 nt, Pseudomonas aeruginosa PA01
gaccggcgccccugcggcgcc

SEQ ID NO: 3392541 - RNA, 22 nt, Pseudomonas aeruginosa PA01
gaccggcgccccugcggcgccg

SEQ ID NO: 3392542 - RNA, 12 nt, Pseudomonas aeruginosa PA01
gaccggcgcgcc

SEQ ID NO: 3392543 - RNA, 13 nt, Pseudomonas aeruginosa PA01
gaccggcgcgccu

SEQ ID NO: 3392544 - RNA, 14 nt, Pseudomonas aeruginosa PA01
gaccggcgcgccuu

SEQ ID NO: 3392545 - RNA, 15 nt, Pseudomonas aeruginosa PA01
gaccggcuccagggc

SEQ ID NO: 3392546 - RNA, 17 nt, Pseudomonas aeruginosa PA01
gaccggcuccagggcga

SEQ ID NO: 3392547 - RNA, 18 nt, Pseudomonas aeruginosa PA01
gaccggcuccagggcgaa

SEQ ID NO: 3392548 - RNA, 14 nt, Pseudomonas aeruginosa PA01
gaccggcucgucgg

SEQ ID NO: 3392549 - RNA, 12 nt, Pseudomonas aeruginosa PA01
gaccggcugcuu

SEQ ID NO: 3392550 - RNA, 16 nt, Pseudomonas aeruginosa PA01
gaccggcugcuuggcc

SEQ ID NO: 3392551 - RNA, 16 nt, Pseudomonas aeruginosa PA01
gaccggcuuggucacg

SEQ ID NO: 3392552 - RNA, 23 nt, Pseudomonas aeruginosa PA01
gaccggcuuggucacgccguuca

SEQ ID NO: 3392553 - RNA, 16 nt, Pseudomonas aeruginosa PA01
gaccgggauccguucg

SEQ ID NO: 3392554 - RNA, 21 nt, Pseudomonas aeruginosa PA01
gaccgggcauuuccucgauga

SEQ ID NO: 3392555 - RNA, 23 nt, Pseudomonas aeruginosa PA01
gaccgggcauuuccucgaugagc

SEQ ID NO: 3392556 - RNA, 12 nt, Pseudomonas aeruginosa PA01
gaccgggcgccu

SEQ ID NO: 3392557 - RNA, 13 nt, Pseudomonas aeruginosa PA01
gaccgggcgccuc

SEQ ID NO: 3392558 - RNA, 14 nt, Pseudomonas aeruginosa PA01
gaccgggcggcagg

SEQ ID NO: 3392559 - RNA, 15 nt, Pseudomonas aeruginosa PA01
gaccgggcggcaggc

SEQ ID NO: 3392560 - RNA, 16 nt, Pseudomonas aeruginosa PA01
gaccgggcggcgcggc

SEQ ID NO: 3392561 - RNA, 18 nt, Pseudomonas aeruginosa PA01
gaccgggcgggucuggcg

SEQ ID NO: 3392562 - RNA, 20 nt, Pseudomonas aeruginosa PA01
gaccgggcgggucuggcgga

SEQ ID NO: 3392563 - RNA, 19 nt, Pseudomonas aeruginosa PA01
gaccggguccugcagauaa

SEQ ID NO: 3392564 - RNA, 17 nt, Pseudomonas aeruginosa PA01
gaccgguaacuggccag

SEQ ID NO: 3392565 - RNA, 15 nt, Pseudomonas aeruginosa PA01
gaccgguagccauga

SEQ ID NO: 3392566 - RNA, 12 nt, Pseudomonas aeruginosa PA01
gaccggucaggc

SEQ ID NO: 3392567 - RNA, 20 nt, Pseudomonas aeruginosa PA01
gaccgguuaauggcgcucca

SEQ ID NO: 3392568 - RNA, 22 nt, Pseudomonas aeruginosa PA01
gaccgguuccgcgucgccuucg

SEQ ID NO: 3392569 - RNA, 16 nt, Pseudomonas aeruginosa PA01
gaccgucagccaggcu

SEQ ID NO: 3392570 - RNA, 17 nt, Pseudomonas aeruginosa PA01
gaccguccacaccgaga

SEQ ID NO: 3392571 - RNA, 22 nt, Pseudomonas aeruginosa PA01
gaccguccacggcgcgucggcg

SEQ ID NO: 3392572 - RNA, 23 nt, Pseudomonas aeruginosa PA01
gaccguccacggcgcgucggcgg

SEQ ID NO: 3392573 - RNA, 17 nt, Pseudomonas aeruginosa PA01
gaccuguucgcgcccgu

SEQ ID NO: 3392574 - RNA, 16 nt, Pseudomonas aeruginosa PA01
gaccuguugcagagcg

SEQ ID NO: 3392575 - RNA, 19 nt, Pseudomonas aeruginosa PA01
gaccuucaacgguggugga

SEQ ID NO: 3392576 - RNA, 14 nt, Pseudomonas aeruginosa PA01
gaccuucaccacca

SEQ ID NO: 3392577 - RNA, 11 nt, Pseudomonas aeruginosa PA01
gaccuucagau

SEQ ID NO: 3392578 - RNA, 17 nt, Pseudomonas aeruginosa PA01
gaccuucagcaccugcg

SEQ ID NO: 3392579 - RNA, 16 nt, Pseudomonas aeruginosa PA01
gaccuucaucaggcgg

SEQ ID NO: 3392580 - RNA, 17 nt, Pseudomonas aeruginosa PA01
gaccuucaucaggcggc

SEQ ID NO: 3392581 - RNA, 14 nt, Pseudomonas aeruginosa PA01
gaccuuccagccgc

SEQ ID NO: 3392582 - RNA, 13 nt, Pseudomonas aeruginosa PA01
gaccuuccgccag

SEQ ID NO: 3392583 - RNA, 15 nt, Pseudomonas aeruginosa PA01
gaccuuccgccagca

SEQ ID NO: 3392584 - RNA, 16 nt, Pseudomonas aeruginosa PA01
gaccuuccgccagcag

SEQ ID NO: 3392585 - RNA, 19 nt, Pseudomonas aeruginosa PA01
gaccuuccgccagcaggcg

SEQ ID NO: 3392586 - RNA, 17 nt, Pseudomonas aeruginosa PA01
gaccuuccugccagcgc

SEQ ID NO: 3392587 - RNA, 23 nt, Pseudomonas aeruginosa PA01
gaccuucgaggugucguccaucg

SEQ ID NO: 3392588 - RNA, 22 nt, Pseudomonas aeruginosa PA01
gaccuucggaucggucagcgag

SEQ ID NO: 3392589 - RNA, 21 nt, Pseudomonas aeruginosa PA01
gaccuucggugucguauucca

SEQ ID NO: 3392590 - RNA, 14 nt, Pseudomonas aeruginosa PA01
gaccuucugcaccg

SEQ ID NO: 3392591 - RNA, 14 nt, Pseudomonas aeruginosa PA01
gaccuucuguccgu

SEQ ID NO: 3392592 - RNA, 20 nt, Pseudomonas aeruginosa PA01
gaccuugacgaagccggcga

SEQ ID NO: 3392593 - RNA, 13 nt, Pseudomonas aeruginosa PA01
gaccuugcccacc

SEQ ID NO: 3392594 - RNA, 22 nt, Pseudomonas aeruginosa PA01
gaccuugcccaccgggaucugc

SEQ ID NO: 3392595 - RNA, 17 nt, Pseudomonas aeruginosa PA01
gaccuugcccucggcgc

SEQ ID NO: 3392596 - RNA, 13 nt, Pseudomonas aeruginosa PA01
gaccuugcccuug

SEQ ID NO: 3392597 - RNA, 14 nt, Pseudomonas aeruginosa PA01
gaccuugcccuuga

SEQ ID NO: 3392598 - RNA, 23 nt, Pseudomonas aeruginosa PA01
gaccuugcccuugaagcgcuucu

SEQ ID NO: 3392599 - RNA, 13 nt, Pseudomonas aeruginosa PA01
gaccuugccgccg

SEQ ID NO: 3392600 - RNA, 13 nt, Pseudomonas aeruginosa PA01
gaccuugcggccg

SEQ ID NO: 3392601 - RNA, 19 nt, Pseudomonas aeruginosa PA01
gaccuugcgucuucgccga

SEQ ID NO: 3392602 - RNA, 16 nt, Pseudomonas aeruginosa PA01
gaccuuggagccaugc

SEQ ID NO: 3392603 - RNA, 15 nt, Pseudomonas aeruginosa PA01
gaccuuguccaggcg

SEQ ID NO: 3392604 - RNA, 16 nt, Pseudomonas aeruginosa PA01
gaccuuguccaggcgc

SEQ ID NO: 3392605 - RNA, 17 nt, Pseudomonas aeruginosa PA01
gaccuuguccaggcgcu

SEQ ID NO: 3392606 - RNA, 15 nt, Pseudomonas aeruginosa PA01
gaccuuguccagggu

SEQ ID NO: 3392607 - RNA, 17 nt, Pseudomonas aeruginosa PA01
gaccuuguccaggguuu

SEQ ID NO: 3392608 - RNA, 12 nt, Pseudomonas aeruginosa PA01
gaccuuguccug

SEQ ID NO: 3392609 - RNA, 14 nt, Pseudomonas aeruginosa PA01
gaccuuguccuggc

SEQ ID NO: 3392610 - RNA, 17 nt, Pseudomonas aeruginosa PA01
gaccuugucgccgguga

SEQ ID NO: 3392611 - RNA, 17 nt, Pseudomonas aeruginosa PA01
gaccuugucgcgcacca

SEQ ID NO: 3392612 - RNA, 20 nt, Pseudomonas aeruginosa PA01
gaccuugucgcgguugccga

SEQ ID NO: 3392613 - RNA, 20 nt, Pseudomonas aeruginosa PA01
gacgaaacgguagcccgcgg

SEQ ID NO: 3392614 - RNA, 17 nt, Pseudomonas aeruginosa PA01
gacgaaacucaucaggc

SEQ ID NO: 3392615 - RNA, 18 nt, Pseudomonas aeruginosa PA01
gacgaaacucaucaggcu

SEQ ID NO: 3392616 - RNA, 19 nt, Pseudomonas aeruginosa PA01
gacgaaacucaucaggcug

SEQ ID NO: 3392617 - RNA, 20 nt, Pseudomonas aeruginosa PA01
gacgaaacucaucaggcugc

SEQ ID NO: 3392618 - RNA, 23 nt, Pseudomonas aeruginosa PA01
gacgaaacucaucaggcugccga

SEQ ID NO: 3392619 - RNA, 14 nt, Pseudomonas aeruginosa PA01
gacgaaagaagccg

SEQ ID NO: 3392620 - RNA, 17 nt, Pseudomonas aeruginosa PA01
gacgaaagaagccgcac

SEQ ID NO: 3392621 - RNA, 21 nt, Pseudomonas aeruginosa PA01
gacgaaagaagccgcacuucc

SEQ ID NO: 3392622 - RNA, 15 nt, Pseudomonas aeruginosa PA01
gacgaaagagcccgg

SEQ ID NO: 3392623 - RNA, 17 nt, Pseudomonas aeruginosa PA01
gacgaaaggccgcgccg

SEQ ID NO: 3392624 - RNA, 18 nt, Pseudomonas aeruginosa PA01
gacgaaaggccgcgccgg

SEQ ID NO: 3392625 - RNA, 18 nt, Pseudomonas aeruginosa PA01
gacgaaauaaugcggcgc

SEQ ID NO: 3392626 - RNA, 21 nt, Pseudomonas aeruginosa PA01
gacgaaauaaugcggcgcgau

SEQ ID NO: 3392627 - RNA, 23 nt, Pseudomonas aeruginosa PA01
gacgaaauaaugcggcgcgaugc

SEQ ID NO: 3392628 - RNA, 19 nt, Pseudomonas aeruginosa PA01
gacgaaauacucgucgacg

SEQ ID NO: 3392629 - RNA, 14 nt, Pseudomonas aeruginosa PA01
gacgaacaucgcca

SEQ ID NO: 3392630 - RNA, 15 nt, Pseudomonas aeruginosa PA01
gacgaacaucgccag

SEQ ID NO: 3392631 - RNA, 16 nt, Pseudomonas aeruginosa PA01
gacgaacaucgccagc

SEQ ID NO: 3392632 - RNA, 14 nt, Pseudomonas aeruginosa PA01
gacgaacgaagcgc

SEQ ID NO: 3392633 - RNA, 15 nt, Pseudomonas aeruginosa PA01
gacgaacgagaagcc

SEQ ID NO: 3392634 - RNA, 17 nt, Pseudomonas aeruginosa PA01
gacgaacgccuuggugu

SEQ ID NO: 3392635 - RNA, 17 nt, Pseudomonas aeruginosa PA01
gacgaacucgacgcgcc

SEQ ID NO: 3392636 - RNA, 18 nt, Pseudomonas aeruginosa PA01
gacgaacucgacgcgcca

SEQ ID NO: 3392637 - RNA, 19 nt, Pseudomonas aeruginosa PA01
gacgaacucgacgcgccag

SEQ ID NO: 3392638 - RNA, 21 nt, Pseudomonas aeruginosa PA01
gacgaacucgacgcgccaggu

SEQ ID NO: 3392639 - RNA, 15 nt, Pseudomonas aeruginosa PA01
gacgaagaguaaaug

SEQ ID NO: 3392640 - RNA, 15 nt, Pseudomonas aeruginosa PA01
gacgaagcgcaccgg

SEQ ID NO: 3392641 - RNA, 18 nt, Pseudomonas aeruginosa PA01
gacgaagcgccggcggcc

SEQ ID NO: 3392642 - RNA, 19 nt, Pseudomonas aeruginosa PA01
gacgaagcgccggcggccu

SEQ ID NO: 3392643 - RNA, 21 nt, Pseudomonas aeruginosa PA01
gacgaagcgccggcggccugc

SEQ ID NO: 3392644 - RNA, 14 nt, Pseudomonas aeruginosa PA01
gacgaaggccuccu

SEQ ID NO: 3392645 - RNA, 14 nt, Pseudomonas aeruginosa PA01
gacgaaggccuggu

SEQ ID NO: 3392646 - RNA, 15 nt, Pseudomonas aeruginosa PA01
gacgaaggcggcagc

SEQ ID NO: 3392647 - RNA, 16 nt, Pseudomonas aeruginosa PA01
gacgaaggcggcagcg

SEQ ID NO: 3392648 - RNA, 17 nt, Pseudomonas aeruginosa PA01
gacgaagggcucagccc

SEQ ID NO: 3392649 - RNA, 18 nt, Pseudomonas aeruginosa PA01
gacgaagggcucagccca

SEQ ID NO: 3392650 - RNA, 13 nt, Pseudomonas aeruginosa PA01
gacgaaggucggc

SEQ ID NO: 3392651 - RNA, 15 nt, Pseudomonas aeruginosa PA01
gacgaagucgccggc

SEQ ID NO: 3392652 - RNA, 18 nt, Pseudomonas aeruginosa PA01
gacgaagucgccggcauc

SEQ ID NO: 3392653 - RNA, 18 nt, Pseudomonas aeruginosa PA01
gacgaagugaccgcgcgc

SEQ ID NO: 3392654 - RNA, 23 nt, Pseudomonas aeruginosa PA01
gacgaagugaccgcgcgccaugg

SEQ ID NO: 3392655 - RNA, 24 nt, Pseudomonas aeruginosa PA01
gacgaagugaccgcgcgccauggc

SEQ ID NO: 3392656 - RNA, 20 nt, Pseudomonas aeruginosa PA01
gacgaagugauggaagagcg

SEQ ID NO: 3392657 - RNA, 18 nt, Pseudomonas aeruginosa PA01
gacgaaguugagcaccgg

SEQ ID NO: 3392658 - RNA, 20 nt, Pseudomonas aeruginosa PA01
gacgaaguugagcaccggca

SEQ ID NO: 3392659 - RNA, 18 nt, Pseudomonas aeruginosa PA01
gacgaaguugcaggccag

SEQ ID NO: 3392660 - RNA, 20 nt, Pseudomonas aeruginosa PA01
gacgaaguugcaggccagcg

SEQ ID NO: 3392661 - RNA, 17 nt, Pseudomonas aeruginosa PA01
gacgaaguuggcggccg

SEQ ID NO: 3392662 - RNA, 18 nt, Pseudomonas aeruginosa PA01
gacgaaguuggcggccga

SEQ ID NO: 3392663 - RNA, 22 nt, Pseudomonas aeruginosa PA01
gacgaauuccgauuucagcuuc

SEQ ID NO: 3392664 - RNA, 13 nt, Pseudomonas aeruginosa PA01
gacgacaccugca

SEQ ID NO: 3392665 - RNA, 21 nt, Pseudomonas aeruginosa PA01
gacgacaccugcaacgcccgc

SEQ ID NO: 3392666 - RNA, 17 nt, Pseudomonas aeruginosa PA01
gacgacaguaccuucca

SEQ ID NO: 3392667 - RNA, 22 nt, Pseudomonas aeruginosa PA01
gacgacaucucguccucgggga

SEQ ID NO: 3392668 - RNA, 14 nt, Pseudomonas aeruginosa PA01
gacgacgaaagaag

SEQ ID NO: 3392669 - RNA, 16 nt, Pseudomonas aeruginosa PA01
gacgacgaaaggccgc

SEQ ID NO: 3392670 - RNA, 17 nt, Pseudomonas aeruginosa PA01
gacgacgaaaggccgcg

SEQ ID NO: 3392671 - RNA, 18 nt, Pseudomonas aeruginosa PA01
gacgacgaaaggccgcgc

SEQ ID NO: 3392672 - RNA, 19 nt, Pseudomonas aeruginosa PA01
gacgacgaaaggccgcgcc

SEQ ID NO: 3392673 - RNA, 22 nt, Pseudomonas aeruginosa PA01
gacgacgaagugaccgcgcgcc

SEQ ID NO: 3392674 - RNA, 14 nt, Pseudomonas aeruginosa PA01
gacgacgcuggccu

SEQ ID NO: 3392675 - RNA, 17 nt, Pseudomonas aeruginosa PA01
gacgagacgccgaggag

SEQ ID NO: 3392676 - RNA, 14 nt, Pseudomonas aeruginosa PA01
gacgccauccuucg

SEQ ID NO: 3392677 - RNA, 13 nt, Pseudomonas aeruginosa PA01
gacgccauggcgc

SEQ ID NO: 3392678 - RNA, 14 nt, Pseudomonas aeruginosa PA01
gacgccauggcgcu

SEQ ID NO: 3392679 - RNA, 16 nt, Pseudomonas aeruginosa PA01
gacgccauggcgcuuc

SEQ ID NO: 3392680 - RNA, 22 nt, Pseudomonas aeruginosa PA01
gacgccauggguggaacccgcu

SEQ ID NO: 3392681 - RNA, 20 nt, Pseudomonas aeruginosa PA01
gacgccauucaggcggauca

SEQ ID NO: 3392682 - RNA, 12 nt, Pseudomonas aeruginosa PA01
gacgcccagcag

SEQ ID NO: 3392683 - RNA, 16 nt, Pseudomonas aeruginosa PA01
gacgcccagcagggcc

SEQ ID NO: 3392684 - RNA, 20 nt, Pseudomonas aeruginosa PA01
gacgcccauguagaccacca

SEQ ID NO: 3392685 - RNA, 22 nt, Pseudomonas aeruginosa PA01
gacgcccauguagaccaccagc

SEQ ID NO: 3392686 - RNA, 16 nt, Pseudomonas aeruginosa PA01
gacgcccgcagccagc

SEQ ID NO: 3392687 - RNA, 14 nt, Pseudomonas aeruginosa PA01
gacgcccgcuugcg

SEQ ID NO: 3392688 - RNA, 14 nt, Pseudomonas aeruginosa PA01
gacgcccuccagca

SEQ ID NO: 3392689 - RNA, 16 nt, Pseudomonas aeruginosa PA01
gacgcccuccagcacc

SEQ ID NO: 3392690 - RNA, 17 nt, Pseudomonas aeruginosa PA01
gacgcccuccagcaccg

SEQ ID NO: 3392691 - RNA, 19 nt, Pseudomonas aeruginosa PA01
gacgcccuccagcaccgcc

SEQ ID NO: 3392692 - RNA, 22 nt, Pseudomonas aeruginosa PA01
gacgcccuccagcaccgccugg

SEQ ID NO: 3392693 - RNA, 17 nt, Pseudomonas aeruginosa PA01
gacgcccucggcgacga

SEQ ID NO: 3392694 - RNA, 24 nt, Pseudomonas aeruginosa PA01
gacgcccuggaugaucucgcagua

SEQ ID NO: 3392695 - RNA, 22 nt, Pseudomonas aeruginosa PA01
gacgcccuggcgcuugggcgcg

SEQ ID NO: 3392696 - RNA, 13 nt, Pseudomonas aeruginosa PA01
gacgcccugggcg

SEQ ID NO: 3392697 - RNA, 14 nt, Pseudomonas aeruginosa PA01
gacgcccugggcga

SEQ ID NO: 3392698 - RNA, 16 nt, Pseudomonas aeruginosa PA01
gacgcccugggcgacg

SEQ ID NO: 3392699 - RNA, 20 nt, Pseudomonas aeruginosa PA01
gacgcccugggcgacgcgga

SEQ ID NO: 3392700 - RNA, 20 nt, Pseudomonas aeruginosa PA01
gacgcccuugcggcgcggcc

SEQ ID NO: 3392701 - RNA, 14 nt, Pseudomonas aeruginosa PA01
gacgccgaaacgcc

SEQ ID NO: 3392702 - RNA, 19 nt, Pseudomonas aeruginosa PA01
gacgccgaaacgccgacgg

SEQ ID NO: 3392703 - RNA, 16 nt, Pseudomonas aeruginosa PA01
gacgccgaacgcccca

SEQ ID NO: 3392704 - RNA, 18 nt, Pseudomonas aeruginosa PA01
gacgccgaagccgcuggc

SEQ ID NO: 3392705 - RNA, 19 nt, Pseudomonas aeruginosa PA01
gacgccgaagccgcuggca

SEQ ID NO: 3392706 - RNA, 18 nt, Pseudomonas aeruginosa PA01
gacgccgaaggacaggcc

SEQ ID NO: 3392707 - RNA, 20 nt, Pseudomonas aeruginosa PA01
gacgccgagcagcaccaggc

SEQ ID NO: 3392708 - RNA, 11 nt, Pseudomonas aeruginosa PA01
gacgccgagcc

SEQ ID NO: 3392709 - RNA, 19 nt, Pseudomonas aeruginosa PA01
gacgccgagccagccgcgg

SEQ ID NO: 3392710 - RNA, 20 nt, Pseudomonas aeruginosa PA01
gacgccgagccagccgcgga

SEQ ID NO: 3392711 - RNA, 12 nt, Pseudomonas aeruginosa PA01
gacgccgagcug

SEQ ID NO: 3392712 - RNA, 14 nt, Pseudomonas aeruginosa PA01
gacgccgagcugac

SEQ ID NO: 3392713 - RNA, 19 nt, Pseudomonas aeruginosa PA01
gacgccgagcugaccacca

SEQ ID NO: 3392714 - RNA, 22 nt, Pseudomonas aeruginosa PA01
gacgccgagcugaccaccaggg

SEQ ID NO: 3392715 - RNA, 21 nt, Pseudomonas aeruginosa PA01
gacgccgaggagacgcggcau

SEQ ID NO: 3392716 - RNA, 13 nt, Pseudomonas aeruginosa PA01
gacgccgaugcuc

SEQ ID NO: 3392717 - RNA, 14 nt, Pseudomonas aeruginosa PA01
gacgccgcccggca

SEQ ID NO: 3392718 - RNA, 15 nt, Pseudomonas aeruginosa PA01
gacgccgcccggcac

SEQ ID NO: 3392719 - RNA, 16 nt, Pseudomonas aeruginosa PA01
gacgccgcccggcacc

SEQ ID NO: 3392720 - RNA, 21 nt, Pseudomonas aeruginosa PA01
gacgccgcccggcaccggggu

SEQ ID NO: 3392721 - RNA, 14 nt, Pseudomonas aeruginosa PA01
gacgccgcgauggc

SEQ ID NO: 3392722 - RNA, 13 nt, Pseudomonas aeruginosa PA01
gacgccgcgcugc

SEQ ID NO: 3392723 - RNA, 14 nt, Pseudomonas aeruginosa PA01
gacgccgcgcugca

SEQ ID NO: 3392724 - RNA, 14 nt, Pseudomonas aeruginosa PA01
gacgccgcggccgg

SEQ ID NO: 3392725 - RNA, 16 nt, Pseudomonas aeruginosa PA01
gacgccgcggccggcg

SEQ ID NO: 3392726 - RNA, 18 nt, Pseudomonas aeruginosa PA01
gacgccgcggccggcgac

SEQ ID NO: 3392727 - RNA, 19 nt, Pseudomonas aeruginosa PA01
gacgccgcggccggcgacc

SEQ ID NO: 3392728 - RNA, 13 nt, Pseudomonas aeruginosa PA01
gacgccgcguccc

SEQ ID NO: 3392729 - RNA, 16 nt, Pseudomonas aeruginosa PA01
gacgccgcuggaaccg

SEQ ID NO: 3392730 - RNA, 17 nt, Pseudomonas aeruginosa PA01
gacgccgcuggaaccgg

SEQ ID NO: 3392731 - RNA, 21 nt, Pseudomonas aeruginosa PA01
gacgccgcuggaaccggccgg

SEQ ID NO: 3392732 - RNA, 13 nt, Pseudomonas aeruginosa PA01
gacgccgcuggcg

SEQ ID NO: 3392733 - RNA, 15 nt, Pseudomonas aeruginosa PA01
gacgccgcuggcggc

SEQ ID NO: 3392734 - RNA, 14 nt, Pseudomonas aeruginosa PA01
gacgccggacgcac

SEQ ID NO: 3392735 - RNA, 20 nt, Pseudomonas aeruginosa PA01
gacgccggacgcaccagcag

SEQ ID NO: 3392736 - RNA, 22 nt, Pseudomonas aeruginosa PA01
gacgccggacgcaccagcaggc

SEQ ID NO: 3392737 - RNA, 17 nt, Pseudomonas aeruginosa PA01
gacgccggcgacgacga

SEQ ID NO: 3392738 - RNA, 14 nt, Pseudomonas aeruginosa PA01
gacgccggcuucca

SEQ ID NO: 3392739 - RNA, 23 nt, Pseudomonas aeruginosa PA01
gacgccggucgggcacuuguugg

SEQ ID NO: 3392740 - RNA, 17 nt, Pseudomonas aeruginosa PA01
gacgccggugacccacu

SEQ ID NO: 3392741 - RNA, 22 nt, Pseudomonas aeruginosa PA01
gacgccguagcgcaguucgccg

SEQ ID NO: 3392742 - RNA, 14 nt, Pseudomonas aeruginosa PA01
gacgccguccacca

SEQ ID NO: 3392743 - RNA, 16 nt, Pseudomonas aeruginosa PA01
gacgccguccaccagc

SEQ ID NO: 3392744 - RNA, 20 nt, Pseudomonas aeruginosa PA01
gacgccguccaccagccagc

SEQ ID NO: 3392745 - RNA, 21 nt, Pseudomonas aeruginosa PA01
gacgccguccaccagccagcu

SEQ ID NO: 3392746 - RNA, 17 nt, Pseudomonas aeruginosa PA01
gacgccucccaccgcgc

SEQ ID NO: 3392747 - RNA, 21 nt, Pseudomonas aeruginosa PA01
gacgccucccaccgcgcggca

SEQ ID NO: 3392748 - RNA, 22 nt, Pseudomonas aeruginosa PA01
gacgccucggcgcgauccuccg

SEQ ID NO: 3392749 - RNA, 13 nt, Pseudomonas aeruginosa PA01
gacgccucgucgg

SEQ ID NO: 3392750 - RNA, 22 nt, Pseudomonas aeruginosa PA01
gacgccucgucggaggcgagga

SEQ ID NO: 3392751 - RNA, 14 nt, Pseudomonas aeruginosa PA01
gacgccuggcgucc

SEQ ID NO: 3392752 - RNA, 15 nt, Pseudomonas aeruginosa PA01
gacgccugucggcac

SEQ ID NO: 3392753 - RNA, 16 nt, Pseudomonas aeruginosa PA01
gacgccugucggcacg

SEQ ID NO: 3392754 - RNA, 18 nt, Pseudomonas aeruginosa PA01
gacgccuucguggccgcg

SEQ ID NO: 3392755 - RNA, 19 nt, Pseudomonas aeruginosa PA01
gacgcgaccuccggcgcca

SEQ ID NO: 3392756 - RNA, 20 nt, Pseudomonas aeruginosa PA01
gacgcgaccuccggcgccag

SEQ ID NO: 3392757 - RNA, 19 nt, Pseudomonas aeruginosa PA01
gacgcgacgccuucagcau

SEQ ID NO: 3392758 - RNA, 16 nt, Pseudomonas aeruginosa PA01
gacgcgacugcugcug

SEQ ID NO: 3392759 - RNA, 14 nt, Pseudomonas aeruginosa PA01
gacgcgcagcgccg

SEQ ID NO: 3392760 - RNA, 17 nt, Pseudomonas aeruginosa PA01
gacgcgcagcgccgccg

SEQ ID NO: 3392761 - RNA, 20 nt, Pseudomonas aeruginosa PA01
gacgcgcagcgccgccgcgu

SEQ ID NO: 3392762 - RNA, 13 nt, Pseudomonas aeruginosa PA01
gacgcgcagcggc

SEQ ID NO: 3392763 - RNA, 15 nt, Pseudomonas aeruginosa PA01
gacgcgcagcggcgc

SEQ ID NO: 3392764 - RNA, 20 nt, Pseudomonas aeruginosa PA01
gacgcgcagcggcgccgagg

SEQ ID NO: 3392765 - RNA, 12 nt, Pseudomonas aeruginosa PA01
gacgcgcaggcc

SEQ ID NO: 3392766 - RNA, 19 nt, Pseudomonas aeruginosa PA01
gacgcgcagggucaggccc

SEQ ID NO: 3392767 - RNA, 20 nt, Pseudomonas aeruginosa PA01
gacgcgcaugcagggcgucc

SEQ ID NO: 3392768 - RNA, 14 nt, Pseudomonas aeruginosa PA01
gacgcgcaugucga

SEQ ID NO: 3392769 - RNA, 20 nt, Pseudomonas aeruginosa PA01
gacgcgcaugucgagguugc

SEQ ID NO: 3392770 - RNA, 19 nt, Pseudomonas aeruginosa PA01
gacgcgccaggugcgcugg

SEQ ID NO: 3392771 - RNA, 14 nt, Pseudomonas aeruginosa PA01
gacgcgcggcugcu

SEQ ID NO: 3392772 - RNA, 15 nt, Pseudomonas aeruginosa PA01
gacgcgcugccccug

SEQ ID NO: 3392773 - RNA, 12 nt, Pseudomonas aeruginosa PA01
gacgcgcuggac

SEQ ID NO: 3392774 - RNA, 15 nt, Pseudomonas aeruginosa PA01
gacgcgcuuguccuc

SEQ ID NO: 3392775 - RNA, 18 nt, Pseudomonas aeruginosa PA01
gacgcgcuuguccuccag

SEQ ID NO: 3392776 - RNA, 23 nt, Pseudomonas aeruginosa PA01
gacgcgcuuguccuccagcugcg

SEQ ID NO: 3392777 - RNA, 14 nt, Pseudomonas aeruginosa PA01
gacgcggacagccu

SEQ ID NO: 3392778 - RNA, 16 nt, Pseudomonas aeruginosa PA01
gacgcggacagccugg

SEQ ID NO: 3392779 - RNA, 22 nt, Pseudomonas aeruginosa PA01
gacgggagcgcgaggcgcaggc

SEQ ID NO: 3392780 - RNA, 20 nt, Pseudomonas aeruginosa PA01
gacgggcauugucccugcgg

SEQ ID NO: 3392781 - RNA, 17 nt, Pseudomonas aeruginosa PA01
gacgggccgcgccgcaa

SEQ ID NO: 3392782 - RNA, 15 nt, Pseudomonas aeruginosa PA01
gacgggcgaagacga

SEQ ID NO: 3392783 - RNA, 20 nt, Pseudomonas aeruginosa PA01
gacgggcgacgcccauguag

SEQ ID NO: 3392784 - RNA, 20 nt, Pseudomonas aeruginosa PA01
gacgggcgcuuccggcuugg

SEQ ID NO: 3392785 - RNA, 20 nt, Pseudomonas aeruginosa PA01
gacggggaucacucgccgcc

SEQ ID NO: 3392786 - RNA, 17 nt, Pseudomonas aeruginosa PA01
gacggggccucgcugcc

SEQ ID NO: 3392787 - RNA, 19 nt, Pseudomonas aeruginosa PA01
gacggguucuucucgucga

SEQ ID NO: 3392788 - RNA, 23 nt, Pseudomonas aeruginosa PA01
gacggguuugugccguuccagcg

SEQ ID NO: 3392789 - RNA, 21 nt, Pseudomonas aeruginosa PA01
gacgguaccagggaagcgcgc

SEQ ID NO: 3392790 - RNA, 16 nt, Pseudomonas aeruginosa PA01
gacggucagcaggccc

SEQ ID NO: 3392791 - RNA, 14 nt, Pseudomonas aeruginosa PA01
gacggucaggccga

SEQ ID NO: 3392792 - RNA, 21 nt, Pseudomonas aeruginosa PA01
gacggucaggccgagcagcgc

SEQ ID NO: 3392793 - RNA, 22 nt, Pseudomonas aeruginosa PA01
gacggucaggccgagcagcgcc

SEQ ID NO: 3392794 - RNA, 17 nt, Pseudomonas aeruginosa PA01
gacggucggcagguggg

SEQ ID NO: 3392795 - RNA, 14 nt, Pseudomonas aeruginosa PA01
gacggucucgccgc

SEQ ID NO: 3392796 - RNA, 20 nt, Pseudomonas aeruginosa PA01
gacggugaccuugucgcggu

SEQ ID NO: 3392797 - RNA, 21 nt, Pseudomonas aeruginosa PA01
gacggugaccuugucgcgguu

SEQ ID NO: 3392798 - RNA, 18 nt, Pseudomonas aeruginosa PA01
gacggugauagagcacgc

SEQ ID NO: 3392799 - RNA, 14 nt, Pseudomonas aeruginosa PA01
gacggugaucgccg

SEQ ID NO: 3392800 - RNA, 17 nt, Pseudomonas aeruginosa PA01
gacggugaucgccgcga

SEQ ID NO: 3392801 - RNA, 20 nt, Pseudomonas aeruginosa PA01
gacggugauucguccggagc

SEQ ID NO: 3392802 - RNA, 14 nt, Pseudomonas aeruginosa PA01
gacggugcaggccg

SEQ ID NO: 3392803 - RNA, 14 nt, Pseudomonas aeruginosa PA01
gacggugcggccgu

SEQ ID NO: 3392804 - RNA, 14 nt, Pseudomonas aeruginosa PA01
gacgguucagcagc

SEQ ID NO: 3392805 - RNA, 16 nt, Pseudomonas aeruginosa PA01
gacgguucagcagcgg

SEQ ID NO: 3392806 - RNA, 14 nt, Pseudomonas aeruginosa PA01
gacgguucccagaa

SEQ ID NO: 3392807 - RNA, 16 nt, Pseudomonas aeruginosa PA01
gacgguucccagaaaa

SEQ ID NO: 3392808 - RNA, 14 nt, Pseudomonas aeruginosa PA01
gacgguucgauccc

SEQ ID NO: 3392809 - RNA, 12 nt, Pseudomonas aeruginosa PA01
gacgguucgcga

SEQ ID NO: 3392810 - RNA, 14 nt, Pseudomonas aeruginosa PA01
gacguaacggcuug

SEQ ID NO: 3392811 - RNA, 13 nt, Pseudomonas aeruginosa PA01
gacguacagcggg

SEQ ID NO: 3392812 - RNA, 20 nt, Pseudomonas aeruginosa PA01
gacguacagcgggucggcga

SEQ ID NO: 3392813 - RNA, 13 nt, Pseudomonas aeruginosa PA01
gacguacauggga

SEQ ID NO: 3392814 - RNA, 15 nt, Pseudomonas aeruginosa PA01
gacguaccgccugcc

SEQ ID NO: 3392815 - RNA, 17 nt, Pseudomonas aeruginosa PA01
gacguaccgccugccau

SEQ ID NO: 3392816 - RNA, 14 nt, Pseudomonas aeruginosa PA01
gacguaggcggcga

SEQ ID NO: 3392817 - RNA, 20 nt, Pseudomonas aeruginosa PA01
gacguagucggcagucgccg

SEQ ID NO: 3392818 - RNA, 21 nt, Pseudomonas aeruginosa PA01
gacguagucggcagucgccgc

SEQ ID NO: 3392819 - RNA, 20 nt, Pseudomonas aeruginosa PA01
gacgucacggauaggcggcg

SEQ ID NO: 3392820 - RNA, 21 nt, Pseudomonas aeruginosa PA01
gacgucacggauaggcggcgg

SEQ ID NO: 3392821 - RNA, 13 nt, Pseudomonas aeruginosa PA01
gacguccagcgcc

SEQ ID NO: 3392822 - RNA, 22 nt, Pseudomonas aeruginosa PA01
gacguccagcgccacuuccagg

SEQ ID NO: 3392823 - RNA, 16 nt, Pseudomonas aeruginosa PA01
gacguccaucagcguc

SEQ ID NO: 3392824 - RNA, 12 nt, Pseudomonas aeruginosa PA01
gacguccggcag

SEQ ID NO: 3392825 - RNA, 14 nt, Pseudomonas aeruginosa PA01
gacguccuccaccg

SEQ ID NO: 3392826 - RNA, 16 nt, Pseudomonas aeruginosa PA01
gacguccuccaccgcu

SEQ ID NO: 3392827 - RNA, 20 nt, Pseudomonas aeruginosa PA01
gacguccuccaccgcuccgg

SEQ ID NO: 3392828 - RNA, 17 nt, Pseudomonas aeruginosa PA01
gacguccuggccgagcc

SEQ ID NO: 3392829 - RNA, 14 nt, Pseudomonas aeruginosa PA01
gacgucgacgcagc

SEQ ID NO: 3392830 - RNA, 16 nt, Pseudomonas aeruginosa PA01
gacgucgacgcagcgc

SEQ ID NO: 3392831 - RNA, 19 nt, Pseudomonas aeruginosa PA01
gacgucgaggaaggccagg

SEQ ID NO: 3392832 - RNA, 20 nt, Pseudomonas aeruginosa PA01
gacgucgaggaaggccaggu

SEQ ID NO: 3392833 - RNA, 14 nt, Pseudomonas aeruginosa PA01
gacgucgaggucga

SEQ ID NO: 3392834 - RNA, 21 nt, Pseudomonas aeruginosa PA01
gacgucgaggucgacggcggc

SEQ ID NO: 3392835 - RNA, 15 nt, Pseudomonas aeruginosa PA01
gacgucgccccagcc

SEQ ID NO: 3392836 - RNA, 17 nt, Pseudomonas aeruginosa PA01
gacgucgccccagccuu

SEQ ID NO: 3392837 - RNA, 18 nt, Pseudomonas aeruginosa PA01
gacgucgccccagccuug

SEQ ID NO: 3392838 - RNA, 16 nt, Pseudomonas aeruginosa PA01
gacgucgccgaugcgg

SEQ ID NO: 3392839 - RNA, 13 nt, Pseudomonas aeruginosa PA01
gacgucggcggcg

SEQ ID NO: 3392840 - RNA, 16 nt, Pseudomonas aeruginosa PA01
gacgucguagccaggc

SEQ ID NO: 3392841 - RNA, 18 nt, Pseudomonas aeruginosa PA01
gacgucguagccaggcac

SEQ ID NO: 3392842 - RNA, 20 nt, Pseudomonas aeruginosa PA01
gacgucguggauaggcggcg

SEQ ID NO: 3392843 - RNA, 21 nt, Pseudomonas aeruginosa PA01
gacgucguggauaggcggcgg

SEQ ID NO: 3392844 - RNA, 22 nt, Pseudomonas aeruginosa PA01
gacgucguggauaggcggcgga

SEQ ID NO: 3392845 - RNA, 20 nt, Pseudomonas aeruginosa PA01
gacgucuuccgggaccggcu

SEQ ID NO: 3392846 - RNA, 15 nt, Pseudomonas aeruginosa PA01
gacgugaagccccug

SEQ ID NO: 3392847 - RNA, 17 nt, Pseudomonas aeruginosa PA01
gacgugaagccccuggc

SEQ ID NO: 3392848 - RNA, 14 nt, Pseudomonas aeruginosa PA01
gacgugggccugcu

SEQ ID NO: 3392849 - RNA, 13 nt, Pseudomonas aeruginosa PA01
gacguuccaccug

SEQ ID NO: 3392850 - RNA, 13 nt, Pseudomonas aeruginosa PA01
gacguucccgucc

SEQ ID NO: 3392851 - RNA, 20 nt, Pseudomonas aeruginosa PA01
gacguuccgcgauagcucag

SEQ ID NO: 3392852 - RNA, 18 nt, Pseudomonas aeruginosa PA01
gacguucugcccgccggc

SEQ ID NO: 3392853 - RNA, 20 nt, Pseudomonas aeruginosa PA01
gacguucugcccgccggcgc

SEQ ID NO: 3392854 - RNA, 23 nt, Pseudomonas aeruginosa PA01
gacguucugcccgccggcgcccu

SEQ ID NO: 3392855 - RNA, 19 nt, Pseudomonas aeruginosa PA01
gacguugagaaggcgccug

SEQ ID NO: 3392856 - RNA, 23 nt, Pseudomonas aeruginosa PA01
gacguugagaaggcgccugagca

SEQ ID NO: 3392857 - RNA, 13 nt, Pseudomonas aeruginosa PA01
gacguugcgcagg

SEQ ID NO: 3392858 - RNA, 20 nt, Pseudomonas aeruginosa PA01
gacguugcgcaggggcgcgg

SEQ ID NO: 3392859 - RNA, 17 nt, Pseudomonas aeruginosa PA01
gacguugcugcccuggc

SEQ ID NO: 3392860 - RNA, 19 nt, Pseudomonas aeruginosa PA01
gacguugcugcccuggcgc

SEQ ID NO: 3392861 - RNA, 23 nt, Pseudomonas aeruginosa PA01
gacguuggccgggguauccgggc

SEQ ID NO: 3392862 - RNA, 16 nt, Pseudomonas aeruginosa PA01
gacuaccagguucugc

SEQ ID NO: 3392863 - RNA, 17 nt, Pseudomonas aeruginosa PA01
gacuaccgaucggcugc

SEQ ID NO: 3392864 - RNA, 22 nt, Pseudomonas aeruginosa PA01
gacuaccuggggauggccggcg

SEQ ID NO: 3392865 - RNA, 17 nt, Pseudomonas aeruginosa PA01
gacucagcgcgacaggc

SEQ ID NO: 3392866 - RNA, 18 nt, Pseudomonas aeruginosa PA01
gacucagcgcgacaggcu

SEQ ID NO: 3392867 - RNA, 16 nt, Pseudomonas aeruginosa PA01
gacuccagccaggcga

SEQ ID NO: 3392868 - RNA, 22 nt, Pseudomonas aeruginosa PA01
gacuccggccggcggccugagc

SEQ ID NO: 3392869 - RNA, 14 nt, Pseudomonas aeruginosa PA01
gacuccggcgcagc

SEQ ID NO: 3392870 - RNA, 19 nt, Pseudomonas aeruginosa PA01
gacuccggcgcagcccagc

SEQ ID NO: 3392871 - RNA, 17 nt, Pseudomonas aeruginosa PA01
gacuccgggaacagccc

SEQ ID NO: 3392872 - RNA, 21 nt, Pseudomonas aeruginosa PA01
gacuccgggaacagcccgucg

SEQ ID NO: 3392873 - RNA, 16 nt, Pseudomonas aeruginosa PA01
gacucgaagcucuucg

SEQ ID NO: 3392874 - RNA, 13 nt, Pseudomonas aeruginosa PA01
gacucgauaccgu

SEQ ID NO: 3392875 - RNA, 19 nt, Pseudomonas aeruginosa PA01
gacucgaugaacgcccuga

SEQ ID NO: 3392876 - RNA, 16 nt, Pseudomonas aeruginosa PA01
gacucgaugcgcagcu

SEQ ID NO: 3392877 - RNA, 17 nt, Pseudomonas aeruginosa PA01
gacucgaugcgcagcuu

SEQ ID NO: 3392878 - RNA, 18 nt, Pseudomonas aeruginosa PA01
gacucgaugcgcagcuug

SEQ ID NO: 3392879 - RNA, 15 nt, Pseudomonas aeruginosa PA01
gacucgccaucggcc

SEQ ID NO: 3392880 - RNA, 22 nt, Pseudomonas aeruginosa PA01
gacucgccaucggccuggggcu

SEQ ID NO: 3392881 - RNA, 22 nt, Pseudomonas aeruginosa PA01
gagacaggaaucgacccagccg

SEQ ID NO: 3392882 - RNA, 22 nt, Pseudomonas aeruginosa PA01
gagacagguacucggcccgggc

SEQ ID NO: 3392883 - RNA, 15 nt, Pseudomonas aeruginosa PA01
gagacauccggccau

SEQ ID NO: 3392884 - RNA, 22 nt, Pseudomonas aeruginosa PA01
gagaccacggugaucaggcgcu

SEQ ID NO: 3392885 - RNA, 16 nt, Pseudomonas aeruginosa PA01
gagaccccggcggcgc

SEQ ID NO: 3392886 - RNA, 20 nt, Pseudomonas aeruginosa PA01
gagacccgcaacaccuguac

SEQ ID NO: 3392887 - RNA, 19 nt, Pseudomonas aeruginosa PA01
gagacccgguacuccucca

SEQ ID NO: 3392888 - RNA, 22 nt, Pseudomonas aeruginosa PA01
gagacccgguacuccuccagca

SEQ ID NO: 3392889 - RNA, 14 nt, Pseudomonas aeruginosa PA01
gagacccuggcgcu

SEQ ID NO: 3392890 - RNA, 21 nt, Pseudomonas aeruginosa PA01
gagaccgaccgacuuggcagu

SEQ ID NO: 3392891 - RNA, 17 nt, Pseudomonas aeruginosa PA01
gagaccgauccagcagu

SEQ ID NO: 3392892 - RNA, 20 nt, Pseudomonas aeruginosa PA01
gagaccgauccagcagucgc

SEQ ID NO: 3392893 - RNA, 13 nt, Pseudomonas aeruginosa PA01
gagaccggcagcc

SEQ ID NO: 3392894 - RNA, 16 nt, Pseudomonas aeruginosa PA01
gagaccgugccgccgg

SEQ ID NO: 3392895 - RNA, 17 nt, Pseudomonas aeruginosa PA01
gagaccgugccgccggg

SEQ ID NO: 3392896 - RNA, 16 nt, Pseudomonas aeruginosa PA01
gagaccucgcccaucg

SEQ ID NO: 3392897 - RNA, 17 nt, Pseudomonas aeruginosa PA01
gagaccuuccugccagc

SEQ ID NO: 3392898 - RNA, 20 nt, Pseudomonas aeruginosa PA01
gagaccuuccugccagcgcg

SEQ ID NO: 3392899 - RNA, 21 nt, Pseudomonas aeruginosa PA01
gagaccuuccugccagcgcgu

SEQ ID NO: 3392900 - RNA, 16 nt, Pseudomonas aeruginosa PA01
gagacgaucagcagga

SEQ ID NO: 3392901 - RNA, 15 nt, Pseudomonas aeruginosa PA01
gagacgccagccgcc

SEQ ID NO: 3392902 - RNA, 19 nt, Pseudomonas aeruginosa PA01
gagacgccagccgcccugg

SEQ ID NO: 3392903 - RNA, 20 nt, Pseudomonas aeruginosa PA01
gagacgccagccgcccuggc

SEQ ID NO: 3392904 - RNA, 18 nt, Pseudomonas aeruginosa PA01
gagacgcccuggaugauc

SEQ ID NO: 3392905 - RNA, 14 nt, Pseudomonas aeruginosa PA01
gagacgccgcccca

SEQ ID NO: 3392906 - RNA, 20 nt, Pseudomonas aeruginosa PA01
gagacgcgggcccagcggua

SEQ ID NO: 3392907 - RNA, 16 nt, Pseudomonas aeruginosa PA01
gagacgugaagccccu

SEQ ID NO: 3392908 - RNA, 18 nt, Pseudomonas aeruginosa PA01
gagacguugacgaucgcc

SEQ ID NO: 3392909 - RNA, 19 nt, Pseudomonas aeruginosa PA01
gagacguugacgaucgccc

SEQ ID NO: 3392910 - RNA, 14 nt, Pseudomonas aeruginosa PA01
gagacuaccgaucg

SEQ ID NO: 3392911 - RNA, 13 nt, Pseudomonas aeruginosa PA01
gagacucagcgcg

SEQ ID NO: 3392912 - RNA, 13 nt, Pseudomonas aeruginosa PA01
gagacugaacucg

SEQ ID NO: 3392913 - RNA, 18 nt, Pseudomonas aeruginosa PA01
gagagaauccgccguucc

SEQ ID NO: 3392914 - RNA, 13 nt, Pseudomonas aeruginosa PA01
gagagacccgcca

SEQ ID NO: 3392915 - RNA, 16 nt, Pseudomonas aeruginosa PA01
gagagacccgccagcg

SEQ ID NO: 3392916 - RNA, 17 nt, Pseudomonas aeruginosa PA01
gagagacccgccagcgg

SEQ ID NO: 3392917 - RNA, 15 nt, Pseudomonas aeruginosa PA01
gagagcagcacggcc

SEQ ID NO: 3392918 - RNA, 10 nt, Pseudomonas aeruginosa PA01
gagagcaggg

SEQ ID NO: 3392919 - RNA, 22 nt, Pseudomonas aeruginosa PA01
gagagcccgggcgcaacccugc

SEQ ID NO: 3392920 - RNA, 14 nt, Pseudomonas aeruginosa PA01
gagagcgccagcga

SEQ ID NO: 3392921 - RNA, 15 nt, Pseudomonas aeruginosa PA01
gagagcgcugccgca

SEQ ID NO: 3392922 - RNA, 16 nt, Pseudomonas aeruginosa PA01
gagagcggcgccaggc

SEQ ID NO: 3392923 - RNA, 17 nt, Pseudomonas aeruginosa PA01
gagagcggcgccaggcg

SEQ ID NO: 3392924 - RNA, 21 nt, Pseudomonas aeruginosa PA01
gagagcggcgccaggcguucc

SEQ ID NO: 3392925 - RNA, 18 nt, Pseudomonas aeruginosa PA01
gagagcggguagcgccgg

SEQ ID NO: 3392926 - RNA, 19 nt, Pseudomonas aeruginosa PA01
gagagcggguagcgccggu

SEQ ID NO: 3392927 - RNA, 19 nt, Pseudomonas aeruginosa PA01
gagagcguccggcagggcc

SEQ ID NO: 3392928 - RNA, 20 nt, Pseudomonas aeruginosa PA01
gagagcguccggcagggccu

SEQ ID NO: 3392929 - RNA, 15 nt, Pseudomonas aeruginosa PA01
gagagcuguccggcg

SEQ ID NO: 3392930 - RNA, 15 nt, Pseudomonas aeruginosa PA01
gagaggcgugcuggc

SEQ ID NO: 3392931 - RNA, 22 nt, Pseudomonas aeruginosa PA01
gagagggagcgccuggcgucga

SEQ ID NO: 3392932 - RNA, 13 nt, Pseudomonas aeruginosa PA01
gagagggcggcga

SEQ ID NO: 3392933 - RNA, 19 nt, Pseudomonas aeruginosa PA01
gagaggggcgcucguugcg

SEQ ID NO: 3392934 - RNA, 18 nt, Pseudomonas aeruginosa PA01
gagaggggcuacuucgcc

SEQ ID NO: 3392935 - RNA, 20 nt, Pseudomonas aeruginosa PA01
gagaggggcuacuucgccgg

SEQ ID NO: 3392936 - RNA, 23 nt, Pseudomonas aeruginosa PA01
gagaggggcuacuucgccgggug

SEQ ID NO: 3392937 - RNA, 22 nt, Pseudomonas aeruginosa PA01
gagagggucagcaggcugccgu

SEQ ID NO: 3392938 - RNA, 14 nt, Pseudomonas aeruginosa PA01
gagaggguggucgc

SEQ ID NO: 3392939 - RNA, 20 nt, Pseudomonas aeruginosa PA01
gagaggucgccgacacgugu

SEQ ID NO: 3392940 - RNA, 13 nt, Pseudomonas aeruginosa PA01
gagaggucggcgc

SEQ ID NO: 3392941 - RNA, 15 nt, Pseudomonas aeruginosa PA01
gagaggucggcgcgc

SEQ ID NO: 3392942 - RNA, 14 nt, Pseudomonas aeruginosa PA01
gagaggugggccgu

SEQ ID NO: 3392943 - RNA, 20 nt, Pseudomonas aeruginosa PA01
gagaguccuuguccagggcc

SEQ ID NO: 3392944 - RNA, 14 nt, Pseudomonas aeruginosa PA01
gagauacgcuccgg

SEQ ID NO: 3392945 - RNA, 23 nt, Pseudomonas aeruginosa PA01
gagauagagcuucucgucgccgc

SEQ ID NO: 3392946 - RNA, 22 nt, Pseudomonas aeruginosa PA01
gagauauucccgcgacaacggc

SEQ ID NO: 3392947 - RNA, 13 nt, Pseudomonas aeruginosa PA01
gagaucagcgccc

SEQ ID NO: 3392948 - RNA, 14 nt, Pseudomonas aeruginosa PA01
gagauccgccagca

SEQ ID NO: 3392949 - RNA, 15 nt, Pseudomonas aeruginosa PA01
gagauccgccagcag

SEQ ID NO: 3392950 - RNA, 17 nt, Pseudomonas aeruginosa PA01
gagauccgccagcagac

SEQ ID NO: 3392951 - RNA, 21 nt, Pseudomonas aeruginosa PA01
gagauccgccagcagacggca

SEQ ID NO: 3392952 - RNA, 20 nt, Pseudomonas aeruginosa PA01
gagauccuggccggcggcgu

SEQ ID NO: 3392953 - RNA, 17 nt, Pseudomonas aeruginosa PA01
gagaucgagcgcgccca

SEQ ID NO: 3392954 - RNA, 15 nt, Pseudomonas aeruginosa PA01
gagaucgcccagcgg

SEQ ID NO: 3392955 - RNA, 17 nt, Pseudomonas aeruginosa PA01
gagaucgcccagcggcu

SEQ ID NO: 3392956 - RNA, 13 nt, Pseudomonas aeruginosa PA01
gagaucgccgcgc

SEQ ID NO: 3392957 - RNA, 14 nt, Pseudomonas aeruginosa PA01
gagaucgccgcgcc

SEQ ID NO: 3392958 - RNA, 23 nt, Pseudomonas aeruginosa PA01
gagaucggcugcaacgccggccc

SEQ ID NO: 3392959 - RNA, 20 nt, Pseudomonas aeruginosa PA01
gagaucggucaccgugguca

SEQ ID NO: 3392960 - RNA, 15 nt, Pseudomonas aeruginosa PA01
gagaucuucaggccg

SEQ ID NO: 3392961 - RNA, 13 nt, Pseudomonas aeruginosa PA01
gagaugaagcgcc

SEQ ID NO: 3392962 - RNA, 22 nt, Pseudomonas aeruginosa PA01
gagaugcaccggccacucgcag

SEQ ID NO: 3392963 - RNA, 17 nt, Pseudomonas aeruginosa PA01
gagaugcagagaaaagg

SEQ ID NO: 3392964 - RNA, 14 nt, Pseudomonas aeruginosa PA01
gagaugccgaacac

SEQ ID NO: 3392965 - RNA, 13 nt, Pseudomonas aeruginosa PA01
gagaugcucaggc

SEQ ID NO: 3392966 - RNA, 17 nt, Pseudomonas aeruginosa PA01
gagaugcugcgggcgcc

SEQ ID NO: 3392967 - RNA, 17 nt, Pseudomonas aeruginosa PA01
gagauggcacaguuccu

SEQ ID NO: 3392968 - RNA, 22 nt, Pseudomonas aeruginosa PA01
gagauguacaggaugggcgaag

SEQ ID NO: 3392969 - RNA, 19 nt, Pseudomonas aeruginosa PA01
gagauguccaucagccgcg

SEQ ID NO: 3392970 - RNA, 13 nt, Pseudomonas aeruginosa PA01
gagaugugcgcgg

SEQ ID NO: 3392971 - RNA, 15 nt, Pseudomonas aeruginosa PA01
gagcaacacaugcag

SEQ ID NO: 3392972 - RNA, 15 nt, Pseudomonas aeruginosa PA01
gagcaaccgcgaugg

SEQ ID NO: 3392973 - RNA, 20 nt, Pseudomonas aeruginosa PA01
gagcaacucggcggcgagcg

SEQ ID NO: 3392974 - RNA, 24 nt, Pseudomonas aeruginosa PA01
gagcaacucggcggcgagcgccgc

SEQ ID NO: 3392975 - RNA, 14 nt, Pseudomonas aeruginosa PA01
gagcaacugcucgg

SEQ ID NO: 3392976 - RNA, 18 nt, Pseudomonas aeruginosa PA01
gagcaagaguguucccuc

SEQ ID NO: 3392977 - RNA, 13 nt, Pseudomonas aeruginosa PA01
gagcaagccuucc

SEQ ID NO: 3392978 - RNA, 23 nt, Pseudomonas aeruginosa PA01
gagcaauccggcgcugccgaaca

SEQ ID NO: 3392979 - RNA, 21 nt, Pseudomonas aeruginosa PA01
gagcaaugaaaaaggcgaucg

SEQ ID NO: 3392980 - RNA, 16 nt, Pseudomonas aeruginosa PA01
gagcaauugccagagg

SEQ ID NO: 3392981 - RNA, 14 nt, Pseudomonas aeruginosa PA01
gagcaccacgcgca

SEQ ID NO: 3392982 - RNA, 13 nt, Pseudomonas aeruginosa PA01
gagcaccagcagg

SEQ ID NO: 3392983 - RNA, 21 nt, Pseudomonas aeruginosa PA01
gagcaccagcaggucggcgcg

SEQ ID NO: 3392984 - RNA, 18 nt, Pseudomonas aeruginosa PA01
gagcagggucgcgagcag

SEQ ID NO: 3392985 - RNA, 21 nt, Pseudomonas aeruginosa PA01
gagcagggugaagcugcggcu

SEQ ID NO: 3392986 - RNA, 12 nt, Pseudomonas aeruginosa PA01
gagcagggugac

SEQ ID NO: 3392987 - RNA, 23 nt, Pseudomonas aeruginosa PA01
gagcagggugacggugaucgccg

SEQ ID NO: 3392988 - RNA, 12 nt, Pseudomonas aeruginosa PA01
gagcaggucgcg

SEQ ID NO: 3392989 - RNA, 16 nt, Pseudomonas aeruginosa PA01
gagcagucgccuggcc

SEQ ID NO: 3392990 - RNA, 18 nt, Pseudomonas aeruginosa PA01
gagcagucgccuggcccu

SEQ ID NO: 3392991 - RNA, 19 nt, Pseudomonas aeruginosa PA01
gagcaguuccaggcguccg

SEQ ID NO: 3392992 - RNA, 18 nt, Pseudomonas aeruginosa PA01
gagcaguucccccagcac

SEQ ID NO: 3392993 - RNA, 22 nt, Pseudomonas aeruginosa PA01
gagcaguucccccagcaccugg

SEQ ID NO: 3392994 - RNA, 21 nt, Pseudomonas aeruginosa PA01
gagcaucaccgcgguggaggc

SEQ ID NO: 3392995 - RNA, 13 nt, Pseudomonas aeruginosa PA01
gagcaucggcgcg

SEQ ID NO: 3392996 - RNA, 15 nt, Pseudomonas aeruginosa PA01
gagcaucggcgcggc

SEQ ID NO: 3392997 - RNA, 16 nt, Pseudomonas aeruginosa PA01
gagcaucggcgcggcc

SEQ ID NO: 3392998 - RNA, 18 nt, Pseudomonas aeruginosa PA01
gagcaucggcgcggccuu

SEQ ID NO: 3392999 - RNA, 15 nt, Pseudomonas aeruginosa PA01
gagcaucucggccag

SEQ ID NO: 3393000 - RNA, 20 nt, Pseudomonas aeruginosa PA01
gagcaucucggccaggcccu

SEQ ID NO: 3393001 - RNA, 16 nt, Pseudomonas aeruginosa PA01
gagcaucugccgggcg

SEQ ID NO: 3393002 - RNA, 19 nt, Pseudomonas aeruginosa PA01
gagcaucugccgggcgcgc

SEQ ID NO: 3393003 - RNA, 22 nt, Pseudomonas aeruginosa PA01
gagcaucugccgggcgcgcugg

SEQ ID NO: 3393004 - RNA, 14 nt, Pseudomonas aeruginosa PA01
gagcaucuggcccg

SEQ ID NO: 3393005 - RNA, 19 nt, Pseudomonas aeruginosa PA01
gagcaucugggucuucagc

SEQ ID NO: 3393006 - RNA, 22 nt, Pseudomonas aeruginosa PA01
gagcaugacgauaucggcgccg

SEQ ID NO: 3393007 - RNA, 16 nt, Pseudomonas aeruginosa PA01
gagcaugaugcaggca

SEQ ID NO: 3393008 - RNA, 18 nt, Pseudomonas aeruginosa PA01
gagcaugauggugccgcc

SEQ ID NO: 3393009 - RNA, 12 nt, Pseudomonas aeruginosa PA01
gagcauggcguu

SEQ ID NO: 3393010 - RNA, 23 nt, Pseudomonas aeruginosa PA01
gagcauggugucgcucccuacga

SEQ ID NO: 3393011 - RNA, 20 nt, Pseudomonas aeruginosa PA01
gagcaugucgcuccagaccu

SEQ ID NO: 3393012 - RNA, 22 nt, Pseudomonas aeruginosa PA01
gagcauuccgacaaggagcgcg

SEQ ID NO: 3393013 - RNA, 19 nt, Pseudomonas aeruginosa PA01
gagcauuccucagcgccgg

SEQ ID NO: 3393014 - RNA, 23 nt, Pseudomonas aeruginosa PA01
gagcauuccucagcgccgguagc

SEQ ID NO: 3393015 - RNA, 18 nt, Pseudomonas aeruginosa PA01
gagccacauccaguugca

SEQ ID NO: 3393016 - RNA, 21 nt, Pseudomonas aeruginosa PA01
gagccagcccagcggcgcggc

SEQ ID NO: 3393017 - RNA, 12 nt, Pseudomonas aeruginosa PA01
gagccagccgca

SEQ ID NO: 3393018 - RNA, 17 nt, Pseudomonas aeruginosa PA01
gagccagccgcagcccg

SEQ ID NO: 3393019 - RNA, 19 nt, Pseudomonas aeruginosa PA01
gagccagccgcagcccggu

SEQ ID NO: 3393020 - RNA, 12 nt, Pseudomonas aeruginosa PA01
gagccagccgcg

SEQ ID NO: 3393021 - RNA, 18 nt, Pseudomonas aeruginosa PA01
gagccagccguggcaggc

SEQ ID NO: 3393022 - RNA, 22 nt, Pseudomonas aeruginosa PA01
gagccagccguggcaggcgccc

SEQ ID NO: 3393023 - RNA, 15 nt, Pseudomonas aeruginosa PA01
gagccagccugcagc

SEQ ID NO: 3393024 - RNA, 16 nt, Pseudomonas aeruginosa PA01
gagccagccugcagcc

SEQ ID NO: 3393025 - RNA, 23 nt, Pseudomonas aeruginosa PA01
gagccagccugcagccagcuuca

SEQ ID NO: 3393026 - RNA, 9 nt, Pseudomonas aeruginosa PA01
gagccaggc

SEQ ID NO: 3393027 - RNA, 10 nt, Pseudomonas aeruginosa PA01
gagccaggcg

SEQ ID NO: 3393028 - RNA, 21 nt, Pseudomonas aeruginosa PA01
gagccagguacggaugccgcg

SEQ ID NO: 3393029 - RNA, 20 nt, Pseudomonas aeruginosa PA01
gagccagguuuccggcagca

SEQ ID NO: 3393030 - RNA, 18 nt, Pseudomonas aeruginosa PA01
gagccagucgagagcggg

SEQ ID NO: 3393031 - RNA, 16 nt, Pseudomonas aeruginosa PA01
gagccaucgcuccagc

SEQ ID NO: 3393032 - RNA, 14 nt, Pseudomonas aeruginosa PA01
gagccaugggccgg

SEQ ID NO: 3393033 - RNA, 16 nt, Pseudomonas aeruginosa PA01
gagccaugggccggcc

SEQ ID NO: 3393034 - RNA, 22 nt, Pseudomonas aeruginosa PA01
gagccauucggcuuccugggcg

SEQ ID NO: 3393035 - RNA, 23 nt, Pseudomonas aeruginosa PA01
gagccauucggcuuccugggcga

SEQ ID NO: 3393036 - RNA, 20 nt, Pseudomonas aeruginosa PA01
gagcccagcggcagggcggc

SEQ ID NO: 3393037 - RNA, 12 nt, Pseudomonas aeruginosa PA01
gagcccaggcag

SEQ ID NO: 3393038 - RNA, 20 nt, Pseudomonas aeruginosa PA01
gagcccaugaaaaagccccg

SEQ ID NO: 3393039 - RNA, 19 nt, Pseudomonas aeruginosa PA01
gagccccagguaggcgaag

SEQ ID NO: 3393040 - RNA, 13 nt, Pseudomonas aeruginosa PA01
gagccccaugccg

SEQ ID NO: 3393041 - RNA, 14 nt, Pseudomonas aeruginosa PA01
gagcccccggcgcc

SEQ ID NO: 3393042 - RNA, 15 nt, Pseudomonas aeruginosa PA01
gagcccccggcgccc

SEQ ID NO: 3393043 - RNA, 20 nt, Pseudomonas aeruginosa PA01
gagccccggcaggcaggccu

SEQ ID NO: 3393044 - RNA, 20 nt, Pseudomonas aeruginosa PA01
gagccccgguuacucgccgg

SEQ ID NO: 3393045 - RNA, 14 nt, Pseudomonas aeruginosa PA01
gagcccgagugcgc

SEQ ID NO: 3393046 - RNA, 15 nt, Pseudomonas aeruginosa PA01
gagcccgagugcgcc

SEQ ID NO: 3393047 - RNA, 20 nt, Pseudomonas aeruginosa PA01
gagcccgagugcgcccagca

SEQ ID NO: 3393048 - RNA, 21 nt, Pseudomonas aeruginosa PA01
gagcccgagugcgcccagcag

SEQ ID NO: 3393049 - RNA, 22 nt, Pseudomonas aeruginosa PA01
gagcccgagugcgcccagcagc

SEQ ID NO: 3393050 - RNA, 23 nt, Pseudomonas aeruginosa PA01
gagcccgagugcgcccagcagca

SEQ ID NO: 3393051 - RNA, 16 nt, Pseudomonas aeruginosa PA01
gagcccgccgaacagc

SEQ ID NO: 3393052 - RNA, 22 nt, Pseudomonas aeruginosa PA01
gagcccggcaaaugccgggcuu

SEQ ID NO: 3393053 - RNA, 23 nt, Pseudomonas aeruginosa PA01
gagcccggccgggauauggguga

SEQ ID NO: 3393054 - RNA, 17 nt, Pseudomonas aeruginosa PA01
gagcccgucgaagccag

SEQ ID NO: 3393055 - RNA, 15 nt, Pseudomonas aeruginosa PA01
gagcccuugcgcggc

SEQ ID NO: 3393056 - RNA, 23 nt, Pseudomonas aeruginosa PA01
gagccgaacuccggugucaggcc

SEQ ID NO: 3393057 - RNA, 14 nt, Pseudomonas aeruginosa PA01
gagccgagcaggcc

SEQ ID NO: 3393058 - RNA, 16 nt, Pseudomonas aeruginosa PA01
gagccgagcaggccac

SEQ ID NO: 3393059 - RNA, 15 nt, Pseudomonas aeruginosa PA01
gagccgaucaccagc

SEQ ID NO: 3393060 - RNA, 16 nt, Pseudomonas aeruginosa PA01
gagccgaucaccagca

SEQ ID NO: 3393061 - RNA, 14 nt, Pseudomonas aeruginosa PA01
gagccgcagcggcu

SEQ ID NO: 3393062 - RNA, 13 nt, Pseudomonas aeruginosa PA01
gagccgcccucgg

SEQ ID NO: 3393063 - RNA, 12 nt, Pseudomonas aeruginosa PA01
gagccgccgaac

SEQ ID NO: 3393064 - RNA, 13 nt, Pseudomonas aeruginosa PA01
gagccgccgggcg

SEQ ID NO: 3393065 - RNA, 22 nt, Pseudomonas aeruginosa PA01
gagccgccggggaagcugccuu

SEQ ID NO: 3393066 - RNA, 13 nt, Pseudomonas aeruginosa PA01
gagccgcgcagca

SEQ ID NO: 3393067 - RNA, 15 nt, Pseudomonas aeruginosa PA01
gagccgcgcagcagu

SEQ ID NO: 3393068 - RNA, 12 nt, Pseudomonas aeruginosa PA01
gagccgcgccuu

SEQ ID NO: 3393069 - RNA, 23 nt, Pseudomonas aeruginosa PA01
gagccgcgcguaggcuuggucgg

SEQ ID NO: 3393070 - RNA, 15 nt, Pseudomonas aeruginosa PA01
gagccgcgcugcugg

SEQ ID NO: 3393071 - RNA, 19 nt, Pseudomonas aeruginosa PA01
gagccgcugcggcucgccg

SEQ ID NO: 3393072 - RNA, 13 nt, Pseudomonas aeruginosa PA01
gagccgcuggcau

SEQ ID NO: 3393073 - RNA, 13 nt, Pseudomonas aeruginosa PA01
gagccggacggcg

SEQ ID NO: 3393074 - RNA, 16 nt, Pseudomonas aeruginosa PA01
gagccggacggcggcg

SEQ ID NO: 3393075 - RNA, 19 nt, Pseudomonas aeruginosa PA01
gagccggauagaucaggcc

SEQ ID NO: 3393076 - RNA, 21 nt, Pseudomonas aeruginosa PA01
gagccggauagaucaggccgg

SEQ ID NO: 3393077 - RNA, 22 nt, Pseudomonas aeruginosa PA01
gagccggauagaucaggccggc

SEQ ID NO: 3393078 - RNA, 13 nt, Pseudomonas aeruginosa PA01
gagccggccaggc

SEQ ID NO: 3393079 - RNA, 22 nt, Pseudomonas aeruginosa PA01
gagccggcugaugcccgggucg

SEQ ID NO: 3393080 - RNA, 14 nt, Pseudomonas aeruginosa PA01
gagccggcugccga

SEQ ID NO: 3393081 - RNA, 16 nt, Pseudomonas aeruginosa PA01
gagccggguaugcagg

SEQ ID NO: 3393082 - RNA, 17 nt, Pseudomonas aeruginosa PA01
gagccggugccggcggc

SEQ ID NO: 3393083 - RNA, 17 nt, Pseudomonas aeruginosa PA01
gagccguccugcggccg

SEQ ID NO: 3393084 - RNA, 18 nt, Pseudomonas aeruginosa PA01
gagccguccugcggccgc

SEQ ID NO: 3393085 - RNA, 21 nt, Pseudomonas aeruginosa PA01
gagccguccugcggccgcaac

SEQ ID NO: 3393086 - RNA, 17 nt, Pseudomonas aeruginosa PA01
gagcucggccaggcaca

SEQ ID NO: 3393087 - RNA, 14 nt, Pseudomonas aeruginosa PA01
gagcugaccaccag

SEQ ID NO: 3393088 - RNA, 14 nt, Pseudomonas aeruginosa PA01
gagcugcacguugu

SEQ ID NO: 3393089 - RNA, 19 nt, Pseudomonas aeruginosa PA01
gagcugcaugagugucgcc

SEQ ID NO: 3393090 - RNA, 16 nt, Pseudomonas aeruginosa PA01
gagcugccgcaccgcc

SEQ ID NO: 3393091 - RNA, 19 nt, Pseudomonas aeruginosa PA01
gagcugccgcuucggcugc

SEQ ID NO: 3393092 - RNA, 14 nt, Pseudomonas aeruginosa PA01
gagcugcucgaagc

SEQ ID NO: 3393093 - RNA, 15 nt, Pseudomonas aeruginosa PA01
gagcugcucgaagca

SEQ ID NO: 3393094 - RNA, 19 nt, Pseudomonas aeruginosa PA01
gagcugcucgauggcggcc

SEQ ID NO: 3393095 - RNA, 20 nt, Pseudomonas aeruginosa PA01
gagcugcucgauggcggccu

SEQ ID NO: 3393096 - RNA, 21 nt, Pseudomonas aeruginosa PA01
gagcugcucgauggcggccug

SEQ ID NO: 3393097 - RNA, 11 nt, Pseudomonas aeruginosa PA01
gagcugcucgg

SEQ ID NO: 3393098 - RNA, 17 nt, Pseudomonas aeruginosa PA01
gagcuggaaauggcggu

SEQ ID NO: 3393099 - RNA, 20 nt, Pseudomonas aeruginosa PA01
gagcuggaaauggcggucgc

SEQ ID NO: 3393100 - RNA, 17 nt, Pseudomonas aeruginosa PA01
gagcuggaagucgucca

SEQ ID NO: 3393101 - RNA, 21 nt, Pseudomonas aeruginosa PA01
gagcuggaagucguccagcag

SEQ ID NO: 3393102 - RNA, 23 nt, Pseudomonas aeruginosa PA01
gagcuggaagucguccagcaggu

SEQ ID NO: 3393103 - RNA, 18 nt, Pseudomonas aeruginosa PA01
gagcuggacgacgcuggc

SEQ ID NO: 3393104 - RNA, 21 nt, Pseudomonas aeruginosa PA01
gagcuggacgacgcuggccug

SEQ ID NO: 3393105 - RNA, 22 nt, Pseudomonas aeruginosa PA01
gagcuggacgacgcuggccugc

SEQ ID NO: 3393106 - RNA, 14 nt, Pseudomonas aeruginosa PA01
gagcuggcgcaggc

SEQ ID NO: 3393107 - RNA, 16 nt, Pseudomonas aeruginosa PA01
gagcuggcgcaggccu

SEQ ID NO: 3393108 - RNA, 15 nt, Pseudomonas aeruginosa PA01
gagcuggcgcugguc

SEQ ID NO: 3393109 - RNA, 16 nt, Pseudomonas aeruginosa PA01
gagcuggcgcuggucc

SEQ ID NO: 3393110 - RNA, 13 nt, Pseudomonas aeruginosa PA01
gagcuggcggccg

SEQ ID NO: 3393111 - RNA, 19 nt, Pseudomonas aeruginosa PA01
gagcugggcguugcccaug

SEQ ID NO: 3393112 - RNA, 21 nt, Pseudomonas aeruginosa PA01
gagcugguggauguucgccgc

SEQ ID NO: 3393113 - RNA, 22 nt, Pseudomonas aeruginosa PA01
gagcugguggauguucgccgcc

SEQ ID NO: 3393114 - RNA, 22 nt, Pseudomonas aeruginosa PA01
gagcuguccaucucgccgcgca

SEQ ID NO: 3393115 - RNA, 22 nt, Pseudomonas aeruginosa PA01
gagcuguuucagcccacgcgcc

SEQ ID NO: 3393116 - RNA, 11 nt, Pseudomonas aeruginosa PA01
gagcuuccagc

SEQ ID NO: 3393117 - RNA, 19 nt, Pseudomonas aeruginosa PA01
gagcuucccgcauggcacu

SEQ ID NO: 3393118 - RNA, 22 nt, Pseudomonas aeruginosa PA01
gagcuucgccgcgcaagcucgu

SEQ ID NO: 3393119 - RNA, 20 nt, Pseudomonas aeruginosa PA01
gagcuucucgucgccgccgu

SEQ ID NO: 3393120 - RNA, 22 nt, Pseudomonas aeruginosa PA01
gagcuugaugaagcccgcggca

SEQ ID NO: 3393121 - RNA, 18 nt, Pseudomonas aeruginosa PA01
gagcuugcugaagcccca

SEQ ID NO: 3393122 - RNA, 13 nt, Pseudomonas aeruginosa PA01
gagcuuggcccug

SEQ ID NO: 3393123 - RNA, 15 nt, Pseudomonas aeruginosa PA01
gagcuuggcccuggc

SEQ ID NO: 3393124 - RNA, 16 nt, Pseudomonas aeruginosa PA01
gagcuuggcccuggcc

SEQ ID NO: 3393125 - RNA, 17 nt, Pseudomonas aeruginosa PA01
gagcuuguccagggcgc

SEQ ID NO: 3393126 - RNA, 16 nt, Pseudomonas aeruginosa PA01
gaggaacagcaccagc

SEQ ID NO: 3393127 - RNA, 14 nt, Pseudomonas aeruginosa PA01
gaggaacaggucga

SEQ ID NO: 3393128 - RNA, 18 nt, Pseudomonas aeruginosa PA01
gaggaacccaaucacaac

SEQ ID NO: 3393129 - RNA, 22 nt, Pseudomonas aeruginosa PA01
gaggaacgccucgcagagcgcc

SEQ ID NO: 3393130 - RNA, 20 nt, Pseudomonas aeruginosa PA01
gaggaagagcagcgcggcgg

SEQ ID NO: 3393131 - RNA, 23 nt, Pseudomonas aeruginosa PA01
gaggaagagcagcgcggcggcgg

SEQ ID NO: 3393132 - RNA, 14 nt, Pseudomonas aeruginosa PA01
gaggaagccgaccg

SEQ ID NO: 3393133 - RNA, 18 nt, Pseudomonas aeruginosa PA01
gaggaagccgaccggcgc

SEQ ID NO: 3393134 - RNA, 22 nt, Pseudomonas aeruginosa PA01
gaggaagccgaccggcgccggg

SEQ ID NO: 3393135 - RNA, 13 nt, Pseudomonas aeruginosa PA01
gaggaagcgcccg

SEQ ID NO: 3393136 - RNA, 20 nt, Pseudomonas aeruginosa PA01
gaggaagcuccccgcaccug

SEQ ID NO: 3393137 - RNA, 21 nt, Pseudomonas aeruginosa PA01
gaggaagcuccccgcaccugc

SEQ ID NO: 3393138 - RNA, 13 nt, Pseudomonas aeruginosa PA01
gaggaaggccagc

SEQ ID NO: 3393139 - RNA, 17 nt, Pseudomonas aeruginosa PA01
gaggaaggccagcaggg

SEQ ID NO: 3393140 - RNA, 20 nt, Pseudomonas aeruginosa PA01
gaggaaggccagcagggucg

SEQ ID NO: 3393141 - RNA, 18 nt, Pseudomonas aeruginosa PA01
gaggaaggccaggucgcc

SEQ ID NO: 3393142 - RNA, 13 nt, Pseudomonas aeruginosa PA01
gaggaaggcgcgc

SEQ ID NO: 3393143 - RNA, 16 nt, Pseudomonas aeruginosa PA01
gaggaagucggcggcc

SEQ ID NO: 3393144 - RNA, 18 nt, Pseudomonas aeruginosa PA01
gaggaagucggcggccgc

SEQ ID NO: 3393145 - RNA, 19 nt, Pseudomonas aeruginosa PA01
gaggaagucggcggccgcc

SEQ ID NO: 3393146 - RNA, 18 nt, Pseudomonas aeruginosa PA01
gaggaagugcagggcguc

SEQ ID NO: 3393147 - RNA, 20 nt, Pseudomonas aeruginosa PA01
gaggaaucgaacccccgacc

SEQ ID NO: 3393148 - RNA, 14 nt, Pseudomonas aeruginosa PA01
gaggaccgacggca

SEQ ID NO: 3393149 - RNA, 17 nt, Pseudomonas aeruginosa PA01
gaggaccgacggcaacu

SEQ ID NO: 3393150 - RNA, 15 nt, Pseudomonas aeruginosa PA01
gaggaccuggccgcg

SEQ ID NO: 3393151 - RNA, 17 nt, Pseudomonas aeruginosa PA01
gaggacgauggaacgcg

SEQ ID NO: 3393152 - RNA, 12 nt, Pseudomonas aeruginosa PA01
gaggacgccgcc

SEQ ID NO: 3393153 - RNA, 16 nt, Pseudomonas aeruginosa PA01
gaggacgccgccgguc

SEQ ID NO: 3393154 - RNA, 14 nt, Pseudomonas aeruginosa PA01
gaggacgccgggcu

SEQ ID NO: 3393155 - RNA, 17 nt, Pseudomonas aeruginosa PA01
gaggacgcugggacggc

SEQ ID NO: 3393156 - RNA, 20 nt, Pseudomonas aeruginosa PA01
gaggacgcugggacggcugc

SEQ ID NO: 3393157 - RNA, 15 nt, Pseudomonas aeruginosa PA01
gaggaggcgccgggu

SEQ ID NO: 3393158 - RNA, 18 nt, Pseudomonas aeruginosa PA01
gaggauaccgcacggccg

SEQ ID NO: 3393159 - RNA, 18 nt, Pseudomonas aeruginosa PA01
gaggaucacgcagcaggc

SEQ ID NO: 3393160 - RNA, 19 nt, Pseudomonas aeruginosa PA01
gaggaucacgcagcaggcg

SEQ ID NO: 3393161 - RNA, 20 nt, Pseudomonas aeruginosa PA01
gaggaucagccacgggcgcc

SEQ ID NO: 3393162 - RNA, 18 nt, Pseudomonas aeruginosa PA01
gaggaucagccagccggc

SEQ ID NO: 3393163 - RNA, 22 nt, Pseudomonas aeruginosa PA01
gaggaucagccagccggcgaag

SEQ ID NO: 3393164 - RNA, 17 nt, Pseudomonas aeruginosa PA01
gaggaucagcgaacccg

SEQ ID NO: 3393165 - RNA, 16 nt, Pseudomonas aeruginosa PA01
gaggaucagucgcugc

SEQ ID NO: 3393166 - RNA, 17 nt, Pseudomonas aeruginosa PA01
gaggauccacuugccgu

SEQ ID NO: 3393167 - RNA, 22 nt, Pseudomonas aeruginosa PA01
gaggaucgagccuugcggcgcu

SEQ ID NO: 3393168 - RNA, 14 nt, Pseudomonas aeruginosa PA01
gaggaucgccagca

SEQ ID NO: 3393169 - RNA, 14 nt, Pseudomonas aeruginosa PA01
gaggaucgccagga

SEQ ID NO: 3393170 - RNA, 17 nt, Pseudomonas aeruginosa PA01
gaggaucgccaggacgc

SEQ ID NO: 3393171 - RNA, 12 nt, Pseudomonas aeruginosa PA01
gaggaucggcca

SEQ ID NO: 3393172 - RNA, 16 nt, Pseudomonas aeruginosa PA01
gaggaucuccaacugg

SEQ ID NO: 3393173 - RNA, 20 nt, Pseudomonas aeruginosa PA01
gaggaucuccaacuggcggc

SEQ ID NO: 3393174 - RNA, 20 nt, Pseudomonas aeruginosa PA01
gaggaucuccgaguccugcu

SEQ ID NO: 3393175 - RNA, 22 nt, Pseudomonas aeruginosa PA01
gaggaucuccgaguccugcugc

SEQ ID NO: 3393176 - RNA, 14 nt, Pseudomonas aeruginosa PA01
gaggaucuccuggc

SEQ ID NO: 3393177 - RNA, 16 nt, Pseudomonas aeruginosa PA01
gaggaucuccuggcgc

SEQ ID NO: 3393178 - RNA, 19 nt, Pseudomonas aeruginosa PA01
gaggaucuccuggcgcguc

SEQ ID NO: 3393179 - RNA, 13 nt, Pseudomonas aeruginosa PA01
gaggaucucgcgc

SEQ ID NO: 3393180 - RNA, 21 nt, Pseudomonas aeruginosa PA01
gaggaugaucagggcaccgcc

SEQ ID NO: 3393181 - RNA, 19 nt, Pseudomonas aeruginosa PA01
gaggaugccgaucaccgcc

SEQ ID NO: 3393182 - RNA, 15 nt, Pseudomonas aeruginosa PA01
gaggaugcucgccug

SEQ ID NO: 3393183 - RNA, 18 nt, Pseudomonas aeruginosa PA01
gaggaugcugaucagcac

SEQ ID NO: 3393184 - RNA, 13 nt, Pseudomonas aeruginosa PA01
gaggauggucagg

SEQ ID NO: 3393185 - RNA, 16 nt, Pseudomonas aeruginosa PA01
gaggauggucaggccg

SEQ ID NO: 3393186 - RNA, 14 nt, Pseudomonas aeruginosa PA01
gaggauguacaggg

SEQ ID NO: 3393187 - RNA, 23 nt, Pseudomonas aeruginosa PA01
gaggauguacagggucuugccgg

SEQ ID NO: 3393188 - RNA, 20 nt, Pseudomonas aeruginosa PA01
gaggcuggcgcucugcagug

SEQ ID NO: 3393189 - RNA, 21 nt, Pseudomonas aeruginosa PA01
gaggcuggcgcucugcagugu

SEQ ID NO: 3393190 - RNA, 13 nt, Pseudomonas aeruginosa PA01
gaggcuggggacg

SEQ ID NO: 3393191 - RNA, 14 nt, Pseudomonas aeruginosa PA01
gaggcuggggacgg

SEQ ID NO: 3393192 - RNA, 18 nt, Pseudomonas aeruginosa PA01
gaggcuguagcgcuccug

SEQ ID NO: 3393193 - RNA, 14 nt, Pseudomonas aeruginosa PA01
gaggcuguccagca

SEQ ID NO: 3393194 - RNA, 16 nt, Pseudomonas aeruginosa PA01
gaggcuguccagcagg

SEQ ID NO: 3393195 - RNA, 21 nt, Pseudomonas aeruginosa PA01
gaggcugucgucgaggguggc

SEQ ID NO: 3393196 - RNA, 23 nt, Pseudomonas aeruginosa PA01
gaggcugucgucgaggguggcgc

SEQ ID NO: 3393197 - RNA, 19 nt, Pseudomonas aeruginosa PA01
gaggcugugccccaggcac

SEQ ID NO: 3393198 - RNA, 22 nt, Pseudomonas aeruginosa PA01
gaggcugugccccaggcacggc

SEQ ID NO: 3393199 - RNA, 14 nt, Pseudomonas aeruginosa PA01
gaggcugugggucg

SEQ ID NO: 3393200 - RNA, 17 nt, Pseudomonas aeruginosa PA01
gaggcuuuccagcaggc

SEQ ID NO: 3393201 - RNA, 20 nt, Pseudomonas aeruginosa PA01
gaggcuuuccagcaggcgcu

SEQ ID NO: 3393202 - RNA, 17 nt, Pseudomonas aeruginosa PA01
gaggcuuuccugcgccu

SEQ ID NO: 3393203 - RNA, 21 nt, Pseudomonas aeruginosa PA01
gagggaacgucuggccagaag

SEQ ID NO: 3393204 - RNA, 17 nt, Pseudomonas aeruginosa PA01
gagggaaugaagaagcc

SEQ ID NO: 3393205 - RNA, 14 nt, Pseudomonas aeruginosa PA01
gagggacugaagag

SEQ ID NO: 3393206 - RNA, 17 nt, Pseudomonas aeruginosa PA01
gagggagcgccuggcgu

SEQ ID NO: 3393207 - RNA, 18 nt, Pseudomonas aeruginosa PA01
gagggauaccaacuuucc

SEQ ID NO: 3393208 - RNA, 18 nt, Pseudomonas aeruginosa PA01
gagggaucgcgcggcugg

SEQ ID NO: 3393209 - RNA, 18 nt, Pseudomonas aeruginosa PA01
gagggauguuccaggccc

SEQ ID NO: 3393210 - RNA, 16 nt, Pseudomonas aeruginosa PA01
gagggcaaaggcgcgc

SEQ ID NO: 3393211 - RNA, 20 nt, Pseudomonas aeruginosa PA01
gagggcaaaggcgcgcaggg

SEQ ID NO: 3393212 - RNA, 23 nt, Pseudomonas aeruginosa PA01
gagggcaaaggcgcgcagggccg

SEQ ID NO: 3393213 - RNA, 24 nt, Pseudomonas aeruginosa PA01
gagggcaaaggcgcgcagggccgc

SEQ ID NO: 3393214 - RNA, 14 nt, Pseudomonas aeruginosa PA01
gagggcacggccag

SEQ ID NO: 3393215 - RNA, 19 nt, Pseudomonas aeruginosa PA01
gagggcaggaaccagacgu

SEQ ID NO: 3393216 - RNA, 18 nt, Pseudomonas aeruginosa PA01
gagggcaugaccgauggc

SEQ ID NO: 3393217 - RNA, 22 nt, Pseudomonas aeruginosa PA01
gagggcaugaccgauggcgccg

SEQ ID NO: 3393218 - RNA, 17 nt, Pseudomonas aeruginosa PA01
gagggcauuuccugggu

SEQ ID NO: 3393219 - RNA, 20 nt, Pseudomonas aeruginosa PA01
gagggcccggggagggugcc

SEQ ID NO: 3393220 - RNA, 17 nt, Pseudomonas aeruginosa PA01
gagggccgcgccgaccc

SEQ ID NO: 3393221 - RNA, 15 nt, Pseudomonas aeruginosa PA01
gagggccgcgcugcu

SEQ ID NO: 3393222 - RNA, 16 nt, Pseudomonas aeruginosa PA01
gagggccucggcgaag

SEQ ID NO: 3393223 - RNA, 19 nt, Pseudomonas aeruginosa PA01
gagggcgaacagcagcggu

SEQ ID NO: 3393224 - RNA, 19 nt, Pseudomonas aeruginosa PA01
gagggcgacccagcgcugg

SEQ ID NO: 3393225 - RNA, 18 nt, Pseudomonas aeruginosa PA01
gagggcgaccgccaggcg

SEQ ID NO: 3393226 - RNA, 20 nt, Pseudomonas aeruginosa PA01
gagggcgaccgccaggcggc

SEQ ID NO: 3393227 - RNA, 13 nt, Pseudomonas aeruginosa PA01
gagggcgccaggu

SEQ ID NO: 3393228 - RNA, 16 nt, Pseudomonas aeruginosa PA01
gagggcgccaggugca

SEQ ID NO: 3393229 - RNA, 15 nt, Pseudomonas aeruginosa PA01
gagggcgcggcgcca

SEQ ID NO: 3393230 - RNA, 20 nt, Pseudomonas aeruginosa PA01
gagggcgcggcgccagcgcc

SEQ ID NO: 3393231 - RNA, 13 nt, Pseudomonas aeruginosa PA01
gagggcggcgacc

SEQ ID NO: 3393232 - RNA, 14 nt, Pseudomonas aeruginosa PA01
gagggcggcgaccg

SEQ ID NO: 3393233 - RNA, 16 nt, Pseudomonas aeruginosa PA01
gagggcggcgaccugg

SEQ ID NO: 3393234 - RNA, 15 nt, Pseudomonas aeruginosa PA01
gagggcggcggcuca

SEQ ID NO: 3393235 - RNA, 21 nt, Pseudomonas aeruginosa PA01
gagggcggcggcucaggccgc

SEQ ID NO: 3393236 - RNA, 23 nt, Pseudomonas aeruginosa PA01
gagggcggcggcucaggccgccg

SEQ ID NO: 3393237 - RNA, 20 nt, Pseudomonas aeruginosa PA01
gagggcguagugcaucagcc

SEQ ID NO: 3393238 - RNA, 15 nt, Pseudomonas aeruginosa PA01
gagggcgucccgcug

SEQ ID NO: 3393239 - RNA, 22 nt, Pseudomonas aeruginosa PA01
gagggcguccuugcccggcgcc

SEQ ID NO: 3393240 - RNA, 18 nt, Pseudomonas aeruginosa PA01
gagggcugagacgcugcc

SEQ ID NO: 3393241 - RNA, 20 nt, Pseudomonas aeruginosa PA01
gagggcugagacgcugccgu

SEQ ID NO: 3393242 - RNA, 23 nt, Pseudomonas aeruginosa PA01
gagggcugagacgcugccguucg

SEQ ID NO: 3393243 - RNA, 13 nt, Pseudomonas aeruginosa PA01
gagggcugccgcc

SEQ ID NO: 3393244 - RNA, 17 nt, Pseudomonas aeruginosa PA01
gagggcugccgcccggu

SEQ ID NO: 3393245 - RNA, 16 nt, Pseudomonas aeruginosa PA01
gagggcugggcagcgc

SEQ ID NO: 3393246 - RNA, 19 nt, Pseudomonas aeruginosa PA01
gagggcugggcagcgccgc

SEQ ID NO: 3393247 - RNA, 22 nt, Pseudomonas aeruginosa PA01
gagggcuguaaucgccgcuucg

SEQ ID NO: 3393248 - RNA, 16 nt, Pseudomonas aeruginosa PA01
gaggggaaucgccguc

SEQ ID NO: 3393249 - RNA, 13 nt, Pseudomonas aeruginosa PA01
gaggggcgacgga

SEQ ID NO: 3393250 - RNA, 21 nt, Pseudomonas aeruginosa PA01
gaggggcgcucguugcgccgc

SEQ ID NO: 3393251 - RNA, 16 nt, Pseudomonas aeruginosa PA01
gaggggcggagcagcc

SEQ ID NO: 3393252 - RNA, 12 nt, Pseudomonas aeruginosa PA01
gaggggcggccg

SEQ ID NO: 3393253 - RNA, 14 nt, Pseudomonas aeruginosa PA01
gaggggcggccgcc

SEQ ID NO: 3393254 - RNA, 12 nt, Pseudomonas aeruginosa PA01
gaggggcugcgg

SEQ ID NO: 3393255 - RNA, 18 nt, Pseudomonas aeruginosa PA01
gaggguauugaggaucca

SEQ ID NO: 3393256 - RNA, 18 nt, Pseudomonas aeruginosa PA01
gagggucagaccagcccu

SEQ ID NO: 3393257 - RNA, 19 nt, Pseudomonas aeruginosa PA01
gagggucagcaggcugccg

SEQ ID NO: 3393258 - RNA, 20 nt, Pseudomonas aeruginosa PA01
gagggucagcaggcugccgu

SEQ ID NO: 3393259 - RNA, 20 nt, Pseudomonas aeruginosa PA01
gagggucagccggccgaucu

SEQ ID NO: 3393260 - RNA, 14 nt, Pseudomonas aeruginosa PA01
gagggucaggccga

SEQ ID NO: 3393261 - RNA, 15 nt, Pseudomonas aeruginosa PA01
gagggucaggccgag

SEQ ID NO: 3393262 - RNA, 21 nt, Pseudomonas aeruginosa PA01
gagggucaggccgagggcugc

SEQ ID NO: 3393263 - RNA, 13 nt, Pseudomonas aeruginosa PA01
gagggucgccagc

SEQ ID NO: 3393264 - RNA, 12 nt, Pseudomonas aeruginosa PA01
gagggucgccuu

SEQ ID NO: 3393265 - RNA, 17 nt, Pseudomonas aeruginosa PA01
gagggucgcgccgacga

SEQ ID NO: 3393266 - RNA, 14 nt, Pseudomonas aeruginosa PA01
gagggucugcucga

SEQ ID NO: 3393267 - RNA, 17 nt, Pseudomonas aeruginosa PA01
gagggucugcugguagc

SEQ ID NO: 3393268 - RNA, 19 nt, Pseudomonas aeruginosa PA01
gagggucugcugguagcug

SEQ ID NO: 3393269 - RNA, 23 nt, Pseudomonas aeruginosa PA01
gagggugaucagccgagguucuu

SEQ ID NO: 3393270 - RNA, 19 nt, Pseudomonas aeruginosa PA01
gagggugaucagcuccgcc

SEQ ID NO: 3393271 - RNA, 21 nt, Pseudomonas aeruginosa PA01
gaggguggcgcccaugccgcc

SEQ ID NO: 3393272 - RNA, 13 nt, Pseudomonas aeruginosa PA01
gaggguggcgccg

SEQ ID NO: 3393273 - RNA, 15 nt, Pseudomonas aeruginosa PA01
gaggguggcgcuggc

SEQ ID NO: 3393274 - RNA, 14 nt, Pseudomonas aeruginosa PA01
gaggguggucagcc

SEQ ID NO: 3393275 - RNA, 14 nt, Pseudomonas aeruginosa PA01
gaggguggucgcgc

SEQ ID NO: 3393276 - RNA, 16 nt, Pseudomonas aeruginosa PA01
gaggguguucagcggc

SEQ ID NO: 3393277 - RNA, 17 nt, Pseudomonas aeruginosa PA01
gaggguguucagcggcg

SEQ ID NO: 3393278 - RNA, 17 nt, Pseudomonas aeruginosa PA01
gaggguugucaccggca

SEQ ID NO: 3393279 - RNA, 20 nt, Pseudomonas aeruginosa PA01
gaggguugucaccggcaggg

SEQ ID NO: 3393280 - RNA, 23 nt, Pseudomonas aeruginosa PA01
gaggguugucaccggcagggcga

SEQ ID NO: 3393281 - RNA, 15 nt, Pseudomonas aeruginosa PA01
gaggguuuccaccug

SEQ ID NO: 3393282 - RNA, 18 nt, Pseudomonas aeruginosa PA01
gagguagaacaggcugcc

SEQ ID NO: 3393283 - RNA, 19 nt, Pseudomonas aeruginosa PA01
gagguagaacaggcugccg

SEQ ID NO: 3393284 - RNA, 14 nt, Pseudomonas aeruginosa PA01
gagguagagcacgc

SEQ ID NO: 3393285 - RNA, 15 nt, Pseudomonas aeruginosa PA01
gagguagcugcgccg

SEQ ID NO: 3393286 - RNA, 15 nt, Pseudomonas aeruginosa PA01
gagguaggccagccc

SEQ ID NO: 3393287 - RNA, 19 nt, Pseudomonas aeruginosa PA01
gagguauugcgcguggcgu

SEQ ID NO: 3393288 - RNA, 22 nt, Pseudomonas aeruginosa PA01
gaggucaguucggugccgccgg

SEQ ID NO: 3393289 - RNA, 15 nt, Pseudomonas aeruginosa PA01
gagguccggcuccgg

SEQ ID NO: 3393290 - RNA, 16 nt, Pseudomonas aeruginosa PA01
gauaccagcgccgcuc

SEQ ID NO: 3393291 - RNA, 14 nt, Pseudomonas aeruginosa PA01
gauacccaccggcu

SEQ ID NO: 3393292 - RNA, 15 nt, Pseudomonas aeruginosa PA01
gauacccagcgggca

SEQ ID NO: 3393293 - RNA, 12 nt, Pseudomonas aeruginosa PA01
gauacccaggcc

SEQ ID NO: 3393294 - RNA, 14 nt, Pseudomonas aeruginosa PA01
gauacccaggccgu

SEQ ID NO: 3393295 - RNA, 22 nt, Pseudomonas aeruginosa PA01
gauacccaggccgucgagggca

SEQ ID NO: 3393296 - RNA, 16 nt, Pseudomonas aeruginosa PA01
gauacccuggccggcc

SEQ ID NO: 3393297 - RNA, 20 nt, Pseudomonas aeruginosa PA01
gauacccugggagccgccgg

SEQ ID NO: 3393298 - RNA, 16 nt, Pseudomonas aeruginosa PA01
gauaccgcacggccgu

SEQ ID NO: 3393299 - RNA, 18 nt, Pseudomonas aeruginosa PA01
gauaccgcacggccguca

SEQ ID NO: 3393300 - RNA, 14 nt, Pseudomonas aeruginosa PA01
gauaccgcuggcca

SEQ ID NO: 3393301 - RNA, 19 nt, Pseudomonas aeruginosa PA01
gauaccggccaucagcacc

SEQ ID NO: 3393302 - RNA, 20 nt, Pseudomonas aeruginosa PA01
gauacgcaggaacuggucga

SEQ ID NO: 3393303 - RNA, 15 nt, Pseudomonas aeruginosa PA01
gauacgcaucugcuc

SEQ ID NO: 3393304 - RNA, 22 nt, Pseudomonas aeruginosa PA01
gauacgcggcccggaaugcaaa

SEQ ID NO: 3393305 - RNA, 20 nt, Pseudomonas aeruginosa PA01
gauacgcuccggugccaggg

SEQ ID NO: 3393306 - RNA, 14 nt, Pseudomonas aeruginosa PA01
gauacgcucggcca

SEQ ID NO: 3393307 - RNA, 18 nt, Pseudomonas aeruginosa PA01
gauacggcaggguagcca

SEQ ID NO: 3393308 - RNA, 13 nt, Pseudomonas aeruginosa PA01
gauacggcgcagc

SEQ ID NO: 3393309 - RNA, 22 nt, Pseudomonas aeruginosa PA01
gauacgucuucgauggcggccg

SEQ ID NO: 3393310 - RNA, 12 nt, Pseudomonas aeruginosa PA01
gauacuccuuca

SEQ ID NO: 3393311 - RNA, 21 nt, Pseudomonas aeruginosa PA01
gauagagcacgcccauggaga

SEQ ID NO: 3393312 - RNA, 19 nt, Pseudomonas aeruginosa PA01
gauagagcuucucgucgcc

SEQ ID NO: 3393313 - RNA, 20 nt, Pseudomonas aeruginosa PA01
gauagagcuucucgucgccg

SEQ ID NO: 3393314 - RNA, 17 nt, Pseudomonas aeruginosa PA01
gauagccgaccaggccg

SEQ ID NO: 3393315 - RNA, 14 nt, Pseudomonas aeruginosa PA01
gauagccggggccg

SEQ ID NO: 3393316 - RNA, 22 nt, Pseudomonas aeruginosa PA01
gauagccgugcagcagcgaccu

SEQ ID NO: 3393317 - RNA, 18 nt, Pseudomonas aeruginosa PA01
gauagcgcgcaggcgcua

SEQ ID NO: 3393318 - RNA, 17 nt, Pseudomonas aeruginosa PA01
gauagcggcgcgaggcc

SEQ ID NO: 3393319 - RNA, 15 nt, Pseudomonas aeruginosa PA01
gauagcuuuccaggg

SEQ ID NO: 3393320 - RNA, 16 nt, Pseudomonas aeruginosa PA01
gauaggcgccggcgcg

SEQ ID NO: 3393321 - RNA, 13 nt, Pseudomonas aeruginosa PA01
gauaggcggcgga

SEQ ID NO: 3393322 - RNA, 15 nt, Pseudomonas aeruginosa PA01
gauagggcaucagcc

SEQ ID NO: 3393323 - RNA, 17 nt, Pseudomonas aeruginosa PA01
gauagggcaucagcccc

SEQ ID NO: 3393324 - RNA, 17 nt, Pseudomonas aeruginosa PA01
gauagucguucuuccug

SEQ ID NO: 3393325 - RNA, 18 nt, Pseudomonas aeruginosa PA01
gauagugcggccaggcgu

SEQ ID NO: 3393326 - RNA, 14 nt, Pseudomonas aeruginosa PA01
gauauaacgcgagc

SEQ ID NO: 3393327 - RNA, 12 nt, Pseudomonas aeruginosa PA01
gauauagcccug

SEQ ID NO: 3393328 - RNA, 23 nt, Pseudomonas aeruginosa PA01
gauauagcccugggcgccgccgg

SEQ ID NO: 3393329 - RNA, 15 nt, Pseudomonas aeruginosa PA01
gauauagcuggucaa

SEQ ID NO: 3393330 - RNA, 21 nt, Pseudomonas aeruginosa PA01
gauauaggcgacgaucagccc

SEQ ID NO: 3393331 - RNA, 20 nt, Pseudomonas aeruginosa PA01
gauaucacgccccuccuucg

SEQ ID NO: 3393332 - RNA, 15 nt, Pseudomonas aeruginosa PA01
gauauccagcggcag

SEQ ID NO: 3393333 - RNA, 16 nt, Pseudomonas aeruginosa PA01
gauauccagcggcagc

SEQ ID NO: 3393334 - RNA, 17 nt, Pseudomonas aeruginosa PA01
gauauccagcggcagcc

SEQ ID NO: 3393335 - RNA, 17 nt, Pseudomonas aeruginosa PA01
gauauccagggccagga

SEQ ID NO: 3393336 - RNA, 18 nt, Pseudomonas aeruginosa PA01
gauauccagggccaggau

SEQ ID NO: 3393337 - RNA, 23 nt, Pseudomonas aeruginosa PA01
gauauccccccacccgucccgcg

SEQ ID NO: 3393338 - RNA, 18 nt, Pseudomonas aeruginosa PA01
gauauccgggcccaggcu

SEQ ID NO: 3393339 - RNA, 14 nt, Pseudomonas aeruginosa PA01
gauaucgcuggcgc

SEQ ID NO: 3393340 - RNA, 22 nt, Pseudomonas aeruginosa PA01
gauaucggcgccggccuccagc

SEQ ID NO: 3393341 - RNA, 18 nt, Pseudomonas aeruginosa PA01
gauaucgucgggacgcau

SEQ ID NO: 3393342 - RNA, 20 nt, Pseudomonas aeruginosa PA01
gauaucguuguucagcaggg

SEQ ID NO: 3393343 - RNA, 12 nt, Pseudomonas aeruginosa PA01
gauaucugggcc

SEQ ID NO: 3393344 - RNA, 14 nt, Pseudomonas aeruginosa PA01
gauaugcaggucga

SEQ ID NO: 3393345 - RNA, 15 nt, Pseudomonas aeruginosa PA01
gauaugccgcucagc

SEQ ID NO: 3393346 - RNA, 18 nt, Pseudomonas aeruginosa PA01
gauaugccgcucagcgga

SEQ ID NO: 3393347 - RNA, 14 nt, Pseudomonas aeruginosa PA01
gauaugcgccgcca

SEQ ID NO: 3393348 - RNA, 21 nt, Pseudomonas aeruginosa PA01
gauauggaccggcucgucggc

SEQ ID NO: 3393349 - RNA, 16 nt, Pseudomonas aeruginosa PA01
gauauggccguagccg

SEQ ID NO: 3393350 - RNA, 22 nt, Pseudomonas aeruginosa PA01
gauauggccguagccggugccg

SEQ ID NO: 3393351 - RNA, 22 nt, Pseudomonas aeruginosa PA01
gauaugggugaugaccccggcg

SEQ ID NO: 3393352 - RNA, 22 nt, Pseudomonas aeruginosa PA01
gauauguccgguuggcggauga

SEQ ID NO: 3393353 - RNA, 17 nt, Pseudomonas aeruginosa PA01
gauauucgacgcgcggc

SEQ ID NO: 3393354 - RNA, 14 nt, Pseudomonas aeruginosa PA01
gauauugccgcggg

SEQ ID NO: 3393355 - RNA, 21 nt, Pseudomonas aeruginosa PA01
gaucaaccccuggaucuccug

SEQ ID NO: 3393356 - RNA, 13 nt, Pseudomonas aeruginosa PA01
gaucaacgccggu

SEQ ID NO: 3393357 - RNA, 13 nt, Pseudomonas aeruginosa PA01
gaucaacgcggcc

SEQ ID NO: 3393358 - RNA, 18 nt, Pseudomonas aeruginosa PA01
gaucaacgcggccagcag

SEQ ID NO: 3393359 - RNA, 23 nt, Pseudomonas aeruginosa PA01
gaucaacuccgccaggcgcucca

SEQ ID NO: 3393360 - RNA, 20 nt, Pseudomonas aeruginosa PA01
gaucaacuggucgcagccgc

SEQ ID NO: 3393361 - RNA, 22 nt, Pseudomonas aeruginosa PA01
gaucaauugccgguagccggcg

SEQ ID NO: 3393362 - RNA, 18 nt, Pseudomonas aeruginosa PA01
gaucacauacaccuugcg

SEQ ID NO: 3393363 - RNA, 23 nt, Pseudomonas aeruginosa PA01
gaucacauacaccuugcgacagg

SEQ ID NO: 3393364 - RNA, 20 nt, Pseudomonas aeruginosa PA01
gaucacaucgcccggcagca

SEQ ID NO: 3393365 - RNA, 22 nt, Pseudomonas aeruginosa PA01
gaucaccaccaccgucuggcgc

SEQ ID NO: 3393366 - RNA, 23 nt, Pseudomonas aeruginosa PA01
gaucaccaccaccgucuggcgca

SEQ ID NO: 3393367 - RNA, 13 nt, Pseudomonas aeruginosa PA01
gaucaccaccacg

SEQ ID NO: 3393368 - RNA, 21 nt, Pseudomonas aeruginosa PA01
gaucaccaccacgccgucgcc

SEQ ID NO: 3393369 - RNA, 14 nt, Pseudomonas aeruginosa PA01
gaucaccaccagca

SEQ ID NO: 3393370 - RNA, 16 nt, Pseudomonas aeruginosa PA01
gaucaccaccagcgcc

SEQ ID NO: 3393371 - RNA, 18 nt, Pseudomonas aeruginosa PA01
gaucaccaccagcgccgc

SEQ ID NO: 3393372 - RNA, 16 nt, Pseudomonas aeruginosa PA01
gaucaccaccggcugg

SEQ ID NO: 3393373 - RNA, 18 nt, Pseudomonas aeruginosa PA01
gaucaccaccggcuggcg

SEQ ID NO: 3393374 - RNA, 21 nt, Pseudomonas aeruginosa PA01
gaucaccagcaauugccggcg

SEQ ID NO: 3393375 - RNA, 14 nt, Pseudomonas aeruginosa PA01
gaucaccagccacu

SEQ ID NO: 3393376 - RNA, 18 nt, Pseudomonas aeruginosa PA01
gaucaccagcgccaggcc

SEQ ID NO: 3393377 - RNA, 20 nt, Pseudomonas aeruginosa PA01
gaucaccagcgccaggccgc

SEQ ID NO: 3393378 - RNA, 22 nt, Pseudomonas aeruginosa PA01
gaucaccagcgccaggccgccg

SEQ ID NO: 3393379 - RNA, 22 nt, Pseudomonas aeruginosa PA01
gaucaccagggucggcaccugc

SEQ ID NO: 3393380 - RNA, 12 nt, Pseudomonas aeruginosa PA01
gaucacccccag

SEQ ID NO: 3393381 - RNA, 15 nt, Pseudomonas aeruginosa PA01
gaucacccccagcga

SEQ ID NO: 3393382 - RNA, 17 nt, Pseudomonas aeruginosa PA01
gaucacccccagcgagc

SEQ ID NO: 3393383 - RNA, 14 nt, Pseudomonas aeruginosa PA01
gaucacccggcgaa

SEQ ID NO: 3393384 - RNA, 18 nt, Pseudomonas aeruginosa PA01
gaucaccgcaucgaaggc

SEQ ID NO: 3393385 - RNA, 22 nt, Pseudomonas aeruginosa PA01
gaucaccgcaucgaaggcgccg

SEQ ID NO: 3393386 - RNA, 17 nt, Pseudomonas aeruginosa PA01
gaucaccgcggcgcuga

SEQ ID NO: 3393387 - RNA, 19 nt, Pseudomonas aeruginosa PA01
gaucaccgcggcgcugaag

SEQ ID NO: 3393388 - RNA, 21 nt, Pseudomonas aeruginosa PA01
gaucaccgcggugcggauggc

SEQ ID NO: 3393389 - RNA, 23 nt, Pseudomonas aeruginosa PA01
gaucaccggaucgaugcccggcu

SEQ ID NO: 3393390 - RNA, 17 nt, Pseudomonas aeruginosa PA01
gaucaccggcuggcccu

SEQ ID NO: 3393391 - RNA, 13 nt, Pseudomonas aeruginosa PA01
gaucaccggggcc

SEQ ID NO: 3393392 - RNA, 21 nt, Pseudomonas aeruginosa PA01
gaucagggccucgccacgcuu

SEQ ID NO: 3393393 - RNA, 14 nt, Pseudomonas aeruginosa PA01
gaucagguccuggc

SEQ ID NO: 3393394 - RNA, 16 nt, Pseudomonas aeruginosa PA01
gaucagguccuggccg

SEQ ID NO: 3393395 - RNA, 17 nt, Pseudomonas aeruginosa PA01
gaucagguccuggccga

SEQ ID NO: 3393396 - RNA, 17 nt, Pseudomonas aeruginosa PA01
gaucaggucgccagcgc

SEQ ID NO: 3393397 - RNA, 20 nt, Pseudomonas aeruginosa PA01
gaucaggucgccgccgccgg

SEQ ID NO: 3393398 - RNA, 17 nt, Pseudomonas aeruginosa PA01
gaucaggucgccgcuga

SEQ ID NO: 3393399 - RNA, 14 nt, Pseudomonas aeruginosa PA01
gaucaggucgcgcg

SEQ ID NO: 3393400 - RNA, 22 nt, Pseudomonas aeruginosa PA01
gaucaggucgcgcgccuucagc

SEQ ID NO: 3393401 - RNA, 14 nt, Pseudomonas aeruginosa PA01
gaucaggucggccg

SEQ ID NO: 3393402 - RNA, 16 nt, Pseudomonas aeruginosa PA01
gaucaggucggccgcc

SEQ ID NO: 3393403 - RNA, 18 nt, Pseudomonas aeruginosa PA01
gaucaggucggccgccuc

SEQ ID NO: 3393404 - RNA, 14 nt, Pseudomonas aeruginosa PA01
gaucaggugcagga

SEQ ID NO: 3393405 - RNA, 20 nt, Pseudomonas aeruginosa PA01
gaucaggugcaggaacagcc

SEQ ID NO: 3393406 - RNA, 17 nt, Pseudomonas aeruginosa PA01
gaucagguugaagagca

SEQ ID NO: 3393407 - RNA, 22 nt, Pseudomonas aeruginosa PA01
gaucagguugaagagcagcacc

SEQ ID NO: 3393408 - RNA, 23 nt, Pseudomonas aeruginosa PA01
gaucagguugaagagcagcacca

SEQ ID NO: 3393409 - RNA, 16 nt, Pseudomonas aeruginosa PA01
gaucagguugccggcg

SEQ ID NO: 3393410 - RNA, 16 nt, Pseudomonas aeruginosa PA01
gaucaguaccggcagc

SEQ ID NO: 3393411 - RNA, 20 nt, Pseudomonas aeruginosa PA01
gaucaguaccggcagcgccg

SEQ ID NO: 3393412 - RNA, 19 nt, Pseudomonas aeruginosa PA01
gaucagucaggaucggcgc

SEQ ID NO: 3393413 - RNA, 20 nt, Pseudomonas aeruginosa PA01
gaucagucaggaucggcgcc

SEQ ID NO: 3393414 - RNA, 19 nt, Pseudomonas aeruginosa PA01
gaucagucgucguccagcg

SEQ ID NO: 3393415 - RNA, 22 nt, Pseudomonas aeruginosa PA01
gaucagugcaucggccgccagg

SEQ ID NO: 3393416 - RNA, 23 nt, Pseudomonas aeruginosa PA01
gaucaguggucgcagcuccagcg

SEQ ID NO: 3393417 - RNA, 18 nt, Pseudomonas aeruginosa PA01
gaucaguucggagaagga

SEQ ID NO: 3393418 - RNA, 21 nt, Pseudomonas aeruginosa PA01
gaucaguucgugccaggcgac

SEQ ID NO: 3393419 - RNA, 14 nt, Pseudomonas aeruginosa PA01
gaucaucagcaggg

SEQ ID NO: 3393420 - RNA, 22 nt, Pseudomonas aeruginosa PA01
gaucaucagcagggucagggca

SEQ ID NO: 3393421 - RNA, 22 nt, Pseudomonas aeruginosa PA01
gaucauccgcaccauccgccgc

SEQ ID NO: 3393422 - RNA, 14 nt, Pseudomonas aeruginosa PA01
gaucaucgccaccg

SEQ ID NO: 3393423 - RNA, 16 nt, Pseudomonas aeruginosa PA01
gaucaucgccaccggu

SEQ ID NO: 3393424 - RNA, 15 nt, Pseudomonas aeruginosa PA01
gaucaucgccagcgg

SEQ ID NO: 3393425 - RNA, 19 nt, Pseudomonas aeruginosa PA01
gaucaucgccugcuggugg

SEQ ID NO: 3393426 - RNA, 14 nt, Pseudomonas aeruginosa PA01
gaucaucggcuggc

SEQ ID NO: 3393427 - RNA, 16 nt, Pseudomonas aeruginosa PA01
gaucaucggcuggccg

SEQ ID NO: 3393428 - RNA, 20 nt, Pseudomonas aeruginosa PA01
gaucaucggcuggccgaggg

SEQ ID NO: 3393429 - RNA, 22 nt, Pseudomonas aeruginosa PA01
gaucaucggcuggccgagggcg

SEQ ID NO: 3393430 - RNA, 14 nt, Pseudomonas aeruginosa PA01
gaucaucggcuggu

SEQ ID NO: 3393431 - RNA, 17 nt, Pseudomonas aeruginosa PA01
gaucaucguccugccgg

SEQ ID NO: 3393432 - RNA, 22 nt, Pseudomonas aeruginosa PA01
gaucaucugaccuuucaccggu

SEQ ID NO: 3393433 - RNA, 13 nt, Pseudomonas aeruginosa PA01
gaucaucugggcc

SEQ ID NO: 3393434 - RNA, 14 nt, Pseudomonas aeruginosa PA01
gaucaucugggcca

SEQ ID NO: 3393435 - RNA, 20 nt, Pseudomonas aeruginosa PA01
gaucaucugggccaucgccg

SEQ ID NO: 3393436 - RNA, 21 nt, Pseudomonas aeruginosa PA01
gaucaucugggccaucgccgg

SEQ ID NO: 3393437 - RNA, 23 nt, Pseudomonas aeruginosa PA01
gaucaucugggccaucgccggcc

SEQ ID NO: 3393438 - RNA, 17 nt, Pseudomonas aeruginosa PA01
gaucaugggggccagca

SEQ ID NO: 3393439 - RNA, 23 nt, Pseudomonas aeruginosa PA01
gaucaugggggccagcagggccg

SEQ ID NO: 3393440 - RNA, 20 nt, Pseudomonas aeruginosa PA01
gaucaugggugaagaccagu

SEQ ID NO: 3393441 - RNA, 16 nt, Pseudomonas aeruginosa PA01
gaucauguagagcagg

SEQ ID NO: 3393442 - RNA, 14 nt, Pseudomonas aeruginosa PA01
gauccacagcaggu

SEQ ID NO: 3393443 - RNA, 15 nt, Pseudomonas aeruginosa PA01
gauccaccgccaggg

SEQ ID NO: 3393444 - RNA, 14 nt, Pseudomonas aeruginosa PA01
gauccacgccuggc

SEQ ID NO: 3393445 - RNA, 14 nt, Pseudomonas aeruginosa PA01
gauccacucgcccu

SEQ ID NO: 3393446 - RNA, 22 nt, Pseudomonas aeruginosa PA01
gauccacucgcccuugaccagu

SEQ ID NO: 3393447 - RNA, 16 nt, Pseudomonas aeruginosa PA01
gauccacuugccgccg

SEQ ID NO: 3393448 - RNA, 21 nt, Pseudomonas aeruginosa PA01
gauccacuugccgccgccgga

SEQ ID NO: 3393449 - RNA, 22 nt, Pseudomonas aeruginosa PA01
gauccagccggcauccagcauc

SEQ ID NO: 3393450 - RNA, 15 nt, Pseudomonas aeruginosa PA01
gauccagcggcaggu

SEQ ID NO: 3393451 - RNA, 13 nt, Pseudomonas aeruginosa PA01
gauccagcuggcg

SEQ ID NO: 3393452 - RNA, 14 nt, Pseudomonas aeruginosa PA01
gauccagcuggcgc

SEQ ID NO: 3393453 - RNA, 15 nt, Pseudomonas aeruginosa PA01
gauccagcuggcgcg

SEQ ID NO: 3393454 - RNA, 16 nt, Pseudomonas aeruginosa PA01
gauccagcuggcgcgu

SEQ ID NO: 3393455 - RNA, 18 nt, Pseudomonas aeruginosa PA01
gauccaggucgaucagca

SEQ ID NO: 3393456 - RNA, 20 nt, Pseudomonas aeruginosa PA01
gauccaggugcgcggcagga

SEQ ID NO: 3393457 - RNA, 19 nt, Pseudomonas aeruginosa PA01
gaucccaggucggcgggca

SEQ ID NO: 3393458 - RNA, 19 nt, Pseudomonas aeruginosa PA01
gauccccaacccggccagc

SEQ ID NO: 3393459 - RNA, 21 nt, Pseudomonas aeruginosa PA01
gauccccaacccggccagccc

SEQ ID NO: 3393460 - RNA, 12 nt, Pseudomonas aeruginosa PA01
gaucccccgccc

SEQ ID NO: 3393461 - RNA, 15 nt, Pseudomonas aeruginosa PA01
gauccccucccgcgc

SEQ ID NO: 3393462 - RNA, 17 nt, Pseudomonas aeruginosa PA01
gauccccucccgcgcca

SEQ ID NO: 3393463 - RNA, 19 nt, Pseudomonas aeruginosa PA01
gauccccucccgcgccagc

SEQ ID NO: 3393464 - RNA, 20 nt, Pseudomonas aeruginosa PA01
gauccccucccgcgccagcg

SEQ ID NO: 3393465 - RNA, 14 nt, Pseudomonas aeruginosa PA01
gauccccuccucca

SEQ ID NO: 3393466 - RNA, 15 nt, Pseudomonas aeruginosa PA01
gauccccuccuccag

SEQ ID NO: 3393467 - RNA, 16 nt, Pseudomonas aeruginosa PA01
gauccccuccuccagc

SEQ ID NO: 3393468 - RNA, 19 nt, Pseudomonas aeruginosa PA01
gaucccgacgcccuccagc

SEQ ID NO: 3393469 - RNA, 22 nt, Pseudomonas aeruginosa PA01
gaucccgacgcccuccagcacc

SEQ ID NO: 3393470 - RNA, 11 nt, Pseudomonas aeruginosa PA01
gaucccggcgg

SEQ ID NO: 3393471 - RNA, 17 nt, Pseudomonas aeruginosa PA01
gaucccggcggcgaccc

SEQ ID NO: 3393472 - RNA, 18 nt, Pseudomonas aeruginosa PA01
gaucccggcggcgaccca

SEQ ID NO: 3393473 - RNA, 12 nt, Pseudomonas aeruginosa PA01
gaucccggcggu

SEQ ID NO: 3393474 - RNA, 22 nt, Pseudomonas aeruginosa PA01
gaucccgucaucacccaccaau

SEQ ID NO: 3393475 - RNA, 20 nt, Pseudomonas aeruginosa PA01
gaucccguguaccacgcccg

SEQ ID NO: 3393476 - RNA, 22 nt, Pseudomonas aeruginosa PA01
gaucccguguaccacgcccgcg

SEQ ID NO: 3393477 - RNA, 19 nt, Pseudomonas aeruginosa PA01
gauccgaccuggggcggcc

SEQ ID NO: 3393478 - RNA, 22 nt, Pseudomonas aeruginosa PA01
gauccgaccuggggcggccuca

SEQ ID NO: 3393479 - RNA, 18 nt, Pseudomonas aeruginosa PA01
gauccgcacccgggcaac

SEQ ID NO: 3393480 - RNA, 18 nt, Pseudomonas aeruginosa PA01
gauccgccgugaggcgcg

SEQ ID NO: 3393481 - RNA, 21 nt, Pseudomonas aeruginosa PA01
gauccgccgugaggcgcgcgc

SEQ ID NO: 3393482 - RNA, 23 nt, Pseudomonas aeruginosa PA01
gauccgccgugaggcgcgcgccg

SEQ ID NO: 3393483 - RNA, 20 nt, Pseudomonas aeruginosa PA01
gauccgcgaauagggcggcg

SEQ ID NO: 3393484 - RNA, 19 nt, Pseudomonas aeruginosa PA01
gauccgcgacaguucgccg

SEQ ID NO: 3393485 - RNA, 21 nt, Pseudomonas aeruginosa PA01
gauccgcgacaguucgccgcc

SEQ ID NO: 3393486 - RNA, 14 nt, Pseudomonas aeruginosa PA01
gauccgcgccugcu

SEQ ID NO: 3393487 - RNA, 15 nt, Pseudomonas aeruginosa PA01
gauccgcgccugcuu

SEQ ID NO: 3393488 - RNA, 19 nt, Pseudomonas aeruginosa PA01
gauccgcggaucguccggg

SEQ ID NO: 3393489 - RNA, 20 nt, Pseudomonas aeruginosa PA01
gauccgcguggcgugcucgg

SEQ ID NO: 3393490 - RNA, 20 nt, Pseudomonas aeruginosa PA01
gauccgcguuaccguccgcg

SEQ ID NO: 3393491 - RNA, 13 nt, Pseudomonas aeruginosa PA01
gauccgcuccagc

SEQ ID NO: 3393492 - RNA, 17 nt, Pseudomonas aeruginosa PA01
gauccgcuccagcgccu

SEQ ID NO: 3393493 - RNA, 19 nt, Pseudomonas aeruginosa PA01
gauccgcuccagcgccucg

SEQ ID NO: 3393494 - RNA, 14 nt, Pseudomonas aeruginosa PA01
gaucucgccauggc

SEQ ID NO: 3393495 - RNA, 16 nt, Pseudomonas aeruginosa PA01
gaucucgccauggcgg

SEQ ID NO: 3393496 - RNA, 22 nt, Pseudomonas aeruginosa PA01
gaucucgccgaaggugcaggcc

SEQ ID NO: 3393497 - RNA, 15 nt, Pseudomonas aeruginosa PA01
gaucucgcgccccgg

SEQ ID NO: 3393498 - RNA, 19 nt, Pseudomonas aeruginosa PA01
gaucucgcgccccgggacc

SEQ ID NO: 3393499 - RNA, 20 nt, Pseudomonas aeruginosa PA01
gaucucgcggcgcggcgggu

SEQ ID NO: 3393500 - RNA, 17 nt, Pseudomonas aeruginosa PA01
gaucucgcguuccagca

SEQ ID NO: 3393501 - RNA, 17 nt, Pseudomonas aeruginosa PA01
gaucucggcgcgggcau

SEQ ID NO: 3393502 - RNA, 22 nt, Pseudomonas aeruginosa PA01
gaucucggcggccaggcggcua

SEQ ID NO: 3393503 - RNA, 20 nt, Pseudomonas aeruginosa PA01
gaucucggugggcuugccgg

SEQ ID NO: 3393504 - RNA, 16 nt, Pseudomonas aeruginosa PA01
gaucucgucgaagcgc

SEQ ID NO: 3393505 - RNA, 16 nt, Pseudomonas aeruginosa PA01
gaucucgugggccagc

SEQ ID NO: 3393506 - RNA, 18 nt, Pseudomonas aeruginosa PA01
gaucucgugggccagcag

SEQ ID NO: 3393507 - RNA, 22 nt, Pseudomonas aeruginosa PA01
gaucucuacuaccgccagcgca

SEQ ID NO: 3393508 - RNA, 23 nt, Pseudomonas aeruginosa PA01
gaucucuacuaccgccagcgcac

SEQ ID NO: 3393509 - RNA, 18 nt, Pseudomonas aeruginosa PA01
gaucucucaguccaucgu

SEQ ID NO: 3393510 - RNA, 19 nt, Pseudomonas aeruginosa PA01
gaucucugcgagacgggcg

SEQ ID NO: 3393511 - RNA, 18 nt, Pseudomonas aeruginosa PA01
gaucucuucccggcucgg

SEQ ID NO: 3393512 - RNA, 13 nt, Pseudomonas aeruginosa PA01
gaucugcaccgcc

SEQ ID NO: 3393513 - RNA, 15 nt, Pseudomonas aeruginosa PA01
gaucugcaccgccca

SEQ ID NO: 3393514 - RNA, 20 nt, Pseudomonas aeruginosa PA01
gaucugcaccgcccagccga

SEQ ID NO: 3393515 - RNA, 21 nt, Pseudomonas aeruginosa PA01
gaucugccgguaauuggccag

SEQ ID NO: 3393516 - RNA, 23 nt, Pseudomonas aeruginosa PA01
gaucugccgguaggucaccaggu

SEQ ID NO: 3393517 - RNA, 19 nt, Pseudomonas aeruginosa PA01
gaucugcgaauagacgccg

SEQ ID NO: 3393518 - RNA, 23 nt, Pseudomonas aeruginosa PA01
gaucugcgaauagacgccgcuga

SEQ ID NO: 3393519 - RNA, 21 nt, Pseudomonas aeruginosa PA01
gaucugcgggaacuuggcgcg

SEQ ID NO: 3393520 - RNA, 14 nt, Pseudomonas aeruginosa PA01
gaucugcuccugca

SEQ ID NO: 3393521 - RNA, 16 nt, Pseudomonas aeruginosa PA01
gaucugcugcaacaug

SEQ ID NO: 3393522 - RNA, 19 nt, Pseudomonas aeruginosa PA01
gaucugcugcaacauggcg

SEQ ID NO: 3393523 - RNA, 14 nt, Pseudomonas aeruginosa PA01
gaucugcugguuga

SEQ ID NO: 3393524 - RNA, 22 nt, Pseudomonas aeruginosa PA01
gaucugcugguugaggccgucc

SEQ ID NO: 3393525 - RNA, 17 nt, Pseudomonas aeruginosa PA01
gaucugcuugcgcgccg

SEQ ID NO: 3393526 - RNA, 13 nt, Pseudomonas aeruginosa PA01
gaucuggccaccc

SEQ ID NO: 3393527 - RNA, 18 nt, Pseudomonas aeruginosa PA01
gaucuggcccugcaacag

SEQ ID NO: 3393528 - RNA, 21 nt, Pseudomonas aeruginosa PA01
gaucuggguuucgucgcggac

SEQ ID NO: 3393529 - RNA, 21 nt, Pseudomonas aeruginosa PA01
gaucugguagaccaccgugcg

SEQ ID NO: 3393530 - RNA, 14 nt, Pseudomonas aeruginosa PA01
gaucugguagcggg

SEQ ID NO: 3393531 - RNA, 16 nt, Pseudomonas aeruginosa PA01
gaucugguagcgggcc

SEQ ID NO: 3393532 - RNA, 23 nt, Pseudomonas aeruginosa PA01
gaucugguagcgggccaucaggu

SEQ ID NO: 3393533 - RNA, 18 nt, Pseudomonas aeruginosa PA01
gaucugguggaacagcau

SEQ ID NO: 3393534 - RNA, 19 nt, Pseudomonas aeruginosa PA01
gaucugucgauaccagcgc

SEQ ID NO: 3393535 - RNA, 20 nt, Pseudomonas aeruginosa PA01
gaucugugcggugccgcgca

SEQ ID NO: 3393536 - RNA, 22 nt, Pseudomonas aeruginosa PA01
gaucugugcggugccgcgcagc

SEQ ID NO: 3393537 - RNA, 13 nt, Pseudomonas aeruginosa PA01
gaucuucagcagc

SEQ ID NO: 3393538 - RNA, 18 nt, Pseudomonas aeruginosa PA01
gaucuucagcagcaggcg

SEQ ID NO: 3393539 - RNA, 14 nt, Pseudomonas aeruginosa PA01
gaucuucaggccga

SEQ ID NO: 3393540 - RNA, 16 nt, Pseudomonas aeruginosa PA01
gaucuucaggccgaag

SEQ ID NO: 3393541 - RNA, 22 nt, Pseudomonas aeruginosa PA01
gaucuucagguaggcgcgggcg

SEQ ID NO: 3393542 - RNA, 22 nt, Pseudomonas aeruginosa PA01
gaucuucgccuccuucaucuug

SEQ ID NO: 3393543 - RNA, 18 nt, Pseudomonas aeruginosa PA01
gaucuucuaccuggcgcu

SEQ ID NO: 3393544 - RNA, 20 nt, Pseudomonas aeruginosa PA01
gaucuucuccgauuccugcg

SEQ ID NO: 3393545 - RNA, 16 nt, Pseudomonas aeruginosa PA01
gaucuucuccgccgcg

SEQ ID NO: 3393546 - RNA, 14 nt, Pseudomonas aeruginosa PA01
gaucuucugcaccc

SEQ ID NO: 3393547 - RNA, 13 nt, Pseudomonas aeruginosa PA01
gaucuucuguccc

SEQ ID NO: 3393548 - RNA, 16 nt, Pseudomonas aeruginosa PA01
gaucuuguccgggaag

SEQ ID NO: 3393549 - RNA, 16 nt, Pseudomonas aeruginosa PA01
gaugaaacgcagggcc

SEQ ID NO: 3393550 - RNA, 15 nt, Pseudomonas aeruginosa PA01
gaugaaacgggcgau

SEQ ID NO: 3393551 - RNA, 16 nt, Pseudomonas aeruginosa PA01
gaugaaauagccggcg

SEQ ID NO: 3393552 - RNA, 17 nt, Pseudomonas aeruginosa PA01
gaugaaauagccggcga

SEQ ID NO: 3393553 - RNA, 20 nt, Pseudomonas aeruginosa PA01
gaugaaauagcucugccgau

SEQ ID NO: 3393554 - RNA, 22 nt, Pseudomonas aeruginosa PA01
gaugaaauagcucugccgaucc

SEQ ID NO: 3393555 - RNA, 17 nt, Pseudomonas aeruginosa PA01
gaugaacagugcgcccg

SEQ ID NO: 3393556 - RNA, 14 nt, Pseudomonas aeruginosa PA01
gaugaacgccgcga

SEQ ID NO: 3393557 - RNA, 13 nt, Pseudomonas aeruginosa PA01
gaugaacgcgcgg

SEQ ID NO: 3393558 - RNA, 19 nt, Pseudomonas aeruginosa PA01
gaugaagaagccauugccg

SEQ ID NO: 3393559 - RNA, 16 nt, Pseudomonas aeruginosa PA01
gaugaagaucaucugg

SEQ ID NO: 3393560 - RNA, 17 nt, Pseudomonas aeruginosa PA01
gaugaagccgcgaccgg

SEQ ID NO: 3393561 - RNA, 18 nt, Pseudomonas aeruginosa PA01
gaugaagccgcgaccggg

SEQ ID NO: 3393562 - RNA, 13 nt, Pseudomonas aeruginosa PA01
gaugaagcgccgc

SEQ ID NO: 3393563 - RNA, 13 nt, Pseudomonas aeruginosa PA01
gaugaagcgcugc

SEQ ID NO: 3393564 - RNA, 23 nt, Pseudomonas aeruginosa PA01
gaugaagcgcugcugggcggcga

SEQ ID NO: 3393565 - RNA, 16 nt, Pseudomonas aeruginosa PA01
gaugaaggucagcacg

SEQ ID NO: 3393566 - RNA, 14 nt, Pseudomonas aeruginosa PA01
gaugaaugcgcagg

SEQ ID NO: 3393567 - RNA, 14 nt, Pseudomonas aeruginosa PA01
gaugaccagcgcau

SEQ ID NO: 3393568 - RNA, 16 nt, Pseudomonas aeruginosa PA01
gaugaccaggguggcg

SEQ ID NO: 3393569 - RNA, 23 nt, Pseudomonas aeruginosa PA01
gaugaccaggguggcggcggcga

SEQ ID NO: 3393570 - RNA, 14 nt, Pseudomonas aeruginosa PA01
gaugaccccggcga

SEQ ID NO: 3393571 - RNA, 15 nt, Pseudomonas aeruginosa PA01
gaugaccccggcgau

SEQ ID NO: 3393572 - RNA, 22 nt, Pseudomonas aeruginosa PA01
gaugacccgcaccuugcccugc

SEQ ID NO: 3393573 - RNA, 15 nt, Pseudomonas aeruginosa PA01
gaugacccgcucgcc

SEQ ID NO: 3393574 - RNA, 19 nt, Pseudomonas aeruginosa PA01
gaugaccgccccggcagcc

SEQ ID NO: 3393575 - RNA, 22 nt, Pseudomonas aeruginosa PA01
gaugaccuucggaucggucagc

SEQ ID NO: 3393576 - RNA, 17 nt, Pseudomonas aeruginosa PA01
gaugacgauggccgccg

SEQ ID NO: 3393577 - RNA, 18 nt, Pseudomonas aeruginosa PA01
gaugacgauggccgccgc

SEQ ID NO: 3393578 - RNA, 19 nt, Pseudomonas aeruginosa PA01
gaugacgauggccgccgcc

SEQ ID NO: 3393579 - RNA, 20 nt, Pseudomonas aeruginosa PA01
gaugacguugcugcccuggc

SEQ ID NO: 3393580 - RNA, 17 nt, Pseudomonas aeruginosa PA01
gaugagcaugccgcaga

SEQ ID NO: 3393581 - RNA, 15 nt, Pseudomonas aeruginosa PA01
gaugagccgcugguc

SEQ ID NO: 3393582 - RNA, 23 nt, Pseudomonas aeruginosa PA01
gaugaggucgcagcguuccagcg

SEQ ID NO: 3393583 - RNA, 19 nt, Pseudomonas aeruginosa PA01
gaugauacgcacgcuggug

SEQ ID NO: 3393584 - RNA, 16 nt, Pseudomonas aeruginosa PA01
gaugaucaccagaccg

SEQ ID NO: 3393585 - RNA, 23 nt, Pseudomonas aeruginosa PA01
gaugaucagcccuucgcgcucga

SEQ ID NO: 3393586 - RNA, 14 nt, Pseudomonas aeruginosa PA01
gaugaucagggcac

SEQ ID NO: 3393587 - RNA, 14 nt, Pseudomonas aeruginosa PA01
gaugaucaggucgg

SEQ ID NO: 3393588 - RNA, 21 nt, Pseudomonas aeruginosa PA01
gaugauccacuugccgccgcc

SEQ ID NO: 3393589 - RNA, 12 nt, Pseudomonas aeruginosa PA01
gaugaucgccgg

SEQ ID NO: 3393590 - RNA, 15 nt, Pseudomonas aeruginosa PA01
gaugaucgcgugggc

SEQ ID NO: 3393591 - RNA, 18 nt, Pseudomonas aeruginosa PA01
gaugaucgcgugggccac

SEQ ID NO: 3393592 - RNA, 21 nt, Pseudomonas aeruginosa PA01
gaugaucuccgcgccgggcug

SEQ ID NO: 3393593 - RNA, 15 nt, Pseudomonas aeruginosa PA01
gaugaucuugucgug

SEQ ID NO: 3393594 - RNA, 22 nt, Pseudomonas aeruginosa PA01
gaugaugacgagggacugaaga

SEQ ID NO: 3393595 - RNA, 21 nt, Pseudomonas aeruginosa PA01
gaugaugccgcggcgauaggc

SEQ ID NO: 3393596 - RNA, 15 nt, Pseudomonas aeruginosa PA01
gaugcgccagcggcc

SEQ ID NO: 3393597 - RNA, 23 nt, Pseudomonas aeruginosa PA01
gaugcgccagcggcccggcaggc

SEQ ID NO: 3393598 - RNA, 15 nt, Pseudomonas aeruginosa PA01
gaugcgccccagcgc

SEQ ID NO: 3393599 - RNA, 16 nt, Pseudomonas aeruginosa PA01
gaugcgccccagcgcc

SEQ ID NO: 3393600 - RNA, 18 nt, Pseudomonas aeruginosa PA01
gaugcgccccagcgccug

SEQ ID NO: 3393601 - RNA, 16 nt, Pseudomonas aeruginosa PA01
gaugcgcccgccgcga

SEQ ID NO: 3393602 - RNA, 19 nt, Pseudomonas aeruginosa PA01
gaugcgccgguccuugucc

SEQ ID NO: 3393603 - RNA, 17 nt, Pseudomonas aeruginosa PA01
gaugcgccucagcggcc

SEQ ID NO: 3393604 - RNA, 20 nt, Pseudomonas aeruginosa PA01
gaugcgcgaauaccgcgcgc

SEQ ID NO: 3393605 - RNA, 22 nt, Pseudomonas aeruginosa PA01
gaugcgcgaauaccgcgcgcgc

SEQ ID NO: 3393606 - RNA, 21 nt, Pseudomonas aeruginosa PA01
gaugcgcgcccugacgaugca

SEQ ID NO: 3393607 - RNA, 14 nt, Pseudomonas aeruginosa PA01
gaugcgcgcggcga

SEQ ID NO: 3393608 - RNA, 13 nt, Pseudomonas aeruginosa PA01
gaugcgcggcagc

SEQ ID NO: 3393609 - RNA, 23 nt, Pseudomonas aeruginosa PA01
gaugcgcggcagcaggcgggcga

SEQ ID NO: 3393610 - RNA, 15 nt, Pseudomonas aeruginosa PA01
gaugcgcgucgccga

SEQ ID NO: 3393611 - RNA, 18 nt, Pseudomonas aeruginosa PA01
gaugcgcgucgccgaacg

SEQ ID NO: 3393612 - RNA, 21 nt, Pseudomonas aeruginosa PA01
gaugcgcgugguaucggcgcu

SEQ ID NO: 3393613 - RNA, 18 nt, Pseudomonas aeruginosa PA01
gaugcggcccgccggcga

SEQ ID NO: 3393614 - RNA, 17 nt, Pseudomonas aeruginosa PA01
gaugcgguaggugcucu

SEQ ID NO: 3393615 - RNA, 18 nt, Pseudomonas aeruginosa PA01
gaugcgguaggugcucuu

SEQ ID NO: 3393616 - RNA, 17 nt, Pseudomonas aeruginosa PA01
gaugcgguagucgcugc

SEQ ID NO: 3393617 - RNA, 20 nt, Pseudomonas aeruginosa PA01
gaugcgguagucgcugcugg

SEQ ID NO: 3393618 - RNA, 22 nt, Pseudomonas aeruginosa PA01
gaugcgguagucgcugcuggcg

SEQ ID NO: 3393619 - RNA, 14 nt, Pseudomonas aeruginosa PA01
gaugcggucaugcc

SEQ ID NO: 3393620 - RNA, 16 nt, Pseudomonas aeruginosa PA01
gaugcggugcgccucc

SEQ ID NO: 3393621 - RNA, 14 nt, Pseudomonas aeruginosa PA01
gaugcgguugccgg

SEQ ID NO: 3393622 - RNA, 17 nt, Pseudomonas aeruginosa PA01
gaugcgucgcaccaggu

SEQ ID NO: 3393623 - RNA, 16 nt, Pseudomonas aeruginosa PA01
gaugcguuugucgacc

SEQ ID NO: 3393624 - RNA, 17 nt, Pseudomonas aeruginosa PA01
gaugcguuugucgaccu

SEQ ID NO: 3393625 - RNA, 16 nt, Pseudomonas aeruginosa PA01
gaugcuaucgcguggc

SEQ ID NO: 3393626 - RNA, 15 nt, Pseudomonas aeruginosa PA01
gaugcucaccgcgcu

SEQ ID NO: 3393627 - RNA, 18 nt, Pseudomonas aeruginosa PA01
gaugcucagcgccggcca

SEQ ID NO: 3393628 - RNA, 16 nt, Pseudomonas aeruginosa PA01
gaugcucaggcgcugc

SEQ ID NO: 3393629 - RNA, 18 nt, Pseudomonas aeruginosa PA01
gaugcucaggcgcugcug

SEQ ID NO: 3393630 - RNA, 20 nt, Pseudomonas aeruginosa PA01
gaugcuccagguucggcgcc

SEQ ID NO: 3393631 - RNA, 23 nt, Pseudomonas aeruginosa PA01
gaugcuccagguucggcgccagc

SEQ ID NO: 3393632 - RNA, 14 nt, Pseudomonas aeruginosa PA01
gaugcuccgcgccu

SEQ ID NO: 3393633 - RNA, 13 nt, Pseudomonas aeruginosa PA01
gaugcucgccugg

SEQ ID NO: 3393634 - RNA, 19 nt, Pseudomonas aeruginosa PA01
gaugcucgguugccaggcc

SEQ ID NO: 3393635 - RNA, 21 nt, Pseudomonas aeruginosa PA01
gaugcugaucacccgcccgcc

SEQ ID NO: 3393636 - RNA, 15 nt, Pseudomonas aeruginosa PA01
gaugcugaucagcac

SEQ ID NO: 3393637 - RNA, 18 nt, Pseudomonas aeruginosa PA01
gaugcugaucuucugucc

SEQ ID NO: 3393638 - RNA, 14 nt, Pseudomonas aeruginosa PA01
gaugcugcgggcgc

SEQ ID NO: 3393639 - RNA, 15 nt, Pseudomonas aeruginosa PA01
gaugcugcgggcgcc

SEQ ID NO: 3393640 - RNA, 23 nt, Pseudomonas aeruginosa PA01
gaugcugcgggcgccgccgcugg

SEQ ID NO: 3393641 - RNA, 21 nt, Pseudomonas aeruginosa PA01
gaugcugcugaucaggaggau

SEQ ID NO: 3393642 - RNA, 17 nt, Pseudomonas aeruginosa PA01
gaugcuguaguugacgu

SEQ ID NO: 3393643 - RNA, 17 nt, Pseudomonas aeruginosa PA01
gaugcuguucagcagga

SEQ ID NO: 3393644 - RNA, 17 nt, Pseudomonas aeruginosa PA01
gaugcuuagcccgggau

SEQ ID NO: 3393645 - RNA, 13 nt, Pseudomonas aeruginosa PA01
gaugcuuucgagc

SEQ ID NO: 3393646 - RNA, 17 nt, Pseudomonas aeruginosa PA01
gauggaaaucggccacu

SEQ ID NO: 3393647 - RNA, 22 nt, Pseudomonas aeruginosa PA01
gauggaacgaagaaccccggcc

SEQ ID NO: 3393648 - RNA, 20 nt, Pseudomonas aeruginosa PA01
gauggaacgcggguugcccg

SEQ ID NO: 3393649 - RNA, 21 nt, Pseudomonas aeruginosa PA01
gauggaagagcgccgcggcgg

SEQ ID NO: 3393650 - RNA, 21 nt, Pseudomonas aeruginosa PA01
gauggaaguugcgcacccgcu

SEQ ID NO: 3393651 - RNA, 23 nt, Pseudomonas aeruginosa PA01
gauggacagcuuggccagcaggc

SEQ ID NO: 3393652 - RNA, 23 nt, Pseudomonas aeruginosa PA01
gauggauacccuucaucccuucu

SEQ ID NO: 3393653 - RNA, 16 nt, Pseudomonas aeruginosa PA01
gauggcagccuuggcc

SEQ ID NO: 3393654 - RNA, 13 nt, Pseudomonas aeruginosa PA01
gauggccagcccg

SEQ ID NO: 3393655 - RNA, 19 nt, Pseudomonas aeruginosa PA01
gauggccagggggccuggc

SEQ ID NO: 3393656 - RNA, 23 nt, Pseudomonas aeruginosa PA01
gauggccaucagggucggcccgg

SEQ ID NO: 3393657 - RNA, 11 nt, Pseudomonas aeruginosa PA01
gauggcccaga

SEQ ID NO: 3393658 - RNA, 21 nt, Pseudomonas aeruginosa PA01
gauggcccagauauccagggc

SEQ ID NO: 3393659 - RNA, 21 nt, Pseudomonas aeruginosa PA01
gauggcccagaugaucaggcc

SEQ ID NO: 3393660 - RNA, 23 nt, Pseudomonas aeruginosa PA01
gauggcccagaugaucaggccga

SEQ ID NO: 3393661 - RNA, 14 nt, Pseudomonas aeruginosa PA01
gauggccccggcga

SEQ ID NO: 3393662 - RNA, 15 nt, Pseudomonas aeruginosa PA01
gauggccccggcgau

SEQ ID NO: 3393663 - RNA, 20 nt, Pseudomonas aeruginosa PA01
gauggcccguuccaccgccu

SEQ ID NO: 3393664 - RNA, 18 nt, Pseudomonas aeruginosa PA01
gauggcccuucgcccugc

SEQ ID NO: 3393665 - RNA, 13 nt, Pseudomonas aeruginosa PA01
gauggccgccagc

SEQ ID NO: 3393666 - RNA, 14 nt, Pseudomonas aeruginosa PA01
gauggccgccagca

SEQ ID NO: 3393667 - RNA, 16 nt, Pseudomonas aeruginosa PA01
gauggccgccagcagg

SEQ ID NO: 3393668 - RNA, 22 nt, Pseudomonas aeruginosa PA01
gauggccgccagcaggccgaag

SEQ ID NO: 3393669 - RNA, 15 nt, Pseudomonas aeruginosa PA01
gauggccgccgccgc

SEQ ID NO: 3393670 - RNA, 16 nt, Pseudomonas aeruginosa PA01
gauggccgccgccgcc

SEQ ID NO: 3393671 - RNA, 23 nt, Pseudomonas aeruginosa PA01
gauggccgccgccgccgucgacu

SEQ ID NO: 3393672 - RNA, 19 nt, Pseudomonas aeruginosa PA01
gauggccggcaccagcagu

SEQ ID NO: 3393673 - RNA, 14 nt, Pseudomonas aeruginosa PA01
gauggccggcagca

SEQ ID NO: 3393674 - RNA, 17 nt, Pseudomonas aeruginosa PA01
gauggccggcagcagcg

SEQ ID NO: 3393675 - RNA, 20 nt, Pseudomonas aeruginosa PA01
gauggccggcagcagcgcca

SEQ ID NO: 3393676 - RNA, 15 nt, Pseudomonas aeruginosa PA01
gauggccggcgcggc

SEQ ID NO: 3393677 - RNA, 15 nt, Pseudomonas aeruginosa PA01
gauggccguccaggc

SEQ ID NO: 3393678 - RNA, 18 nt, Pseudomonas aeruginosa PA01
gauggccguccaggcugc

SEQ ID NO: 3393679 - RNA, 14 nt, Pseudomonas aeruginosa PA01
gauggccuggucgg

SEQ ID NO: 3393680 - RNA, 17 nt, Pseudomonas aeruginosa PA01
gauggccuggucggcgc

SEQ ID NO: 3393681 - RNA, 14 nt, Pseudomonas aeruginosa PA01
gauggcgaagcgcu

SEQ ID NO: 3393682 - RNA, 23 nt, Pseudomonas aeruginosa PA01
gauggcgaagcgcuugcccaggu

SEQ ID NO: 3393683 - RNA, 17 nt, Pseudomonas aeruginosa PA01
gauggcgacguucugcu

SEQ ID NO: 3393684 - RNA, 23 nt, Pseudomonas aeruginosa PA01
gauggcgacguucugcucgcugc

SEQ ID NO: 3393685 - RNA, 15 nt, Pseudomonas aeruginosa PA01
gauggcgcgcgggcc

SEQ ID NO: 3393686 - RNA, 20 nt, Pseudomonas aeruginosa PA01
gauggcgcggugggccuuga

SEQ ID NO: 3393687 - RNA, 23 nt, Pseudomonas aeruginosa PA01
gauggcgcugccaaacgccgucu

SEQ ID NO: 3393688 - RNA, 20 nt, Pseudomonas aeruginosa PA01
gauggcggcauugagggcga

SEQ ID NO: 3393689 - RNA, 17 nt, Pseudomonas aeruginosa PA01
gauggcggccgccauuc

SEQ ID NO: 3393690 - RNA, 22 nt, Pseudomonas aeruginosa PA01
gauggcgggcucuaugcgcggg

SEQ ID NO: 3393691 - RNA, 19 nt, Pseudomonas aeruginosa PA01
gauggcguagaggcucggc

SEQ ID NO: 3393692 - RNA, 22 nt, Pseudomonas aeruginosa PA01
gauggcguagaggcucggcggc

SEQ ID NO: 3393693 - RNA, 19 nt, Pseudomonas aeruginosa PA01
gauggcguguucgucgauc

SEQ ID NO: 3393694 - RNA, 22 nt, Pseudomonas aeruginosa PA01
gauggcguuugcgucauccgcc

SEQ ID NO: 3393695 - RNA, 15 nt, Pseudomonas aeruginosa PA01
gauggcucauggcau

SEQ ID NO: 3393696 - RNA, 16 nt, Pseudomonas aeruginosa PA01
gauggcucgcggcgcu

SEQ ID NO: 3393697 - RNA, 18 nt, Pseudomonas aeruginosa PA01
gauggcucgcggcgcucg

SEQ ID NO: 3393698 - RNA, 19 nt, Pseudomonas aeruginosa PA01
gauucgaagguagcggucg

SEQ ID NO: 3393699 - RNA, 18 nt, Pseudomonas aeruginosa PA01
gauucgccgaggaacuuc

SEQ ID NO: 3393700 - RNA, 21 nt, Pseudomonas aeruginosa PA01
gauucgccggccaccaggcuu

SEQ ID NO: 3393701 - RNA, 12 nt, Pseudomonas aeruginosa PA01
gauucggccugc

SEQ ID NO: 3393702 - RNA, 14 nt, Pseudomonas aeruginosa PA01
gauucggccugccg

SEQ ID NO: 3393703 - RNA, 17 nt, Pseudomonas aeruginosa PA01
gauucggguagucuucg

SEQ ID NO: 3393704 - RNA, 23 nt, Pseudomonas aeruginosa PA01
gauucggguagucuucgaugcgc

SEQ ID NO: 3393705 - RNA, 13 nt, Pseudomonas aeruginosa PA01
gauugaccucccg

SEQ ID NO: 3393706 - RNA, 18 nt, Pseudomonas aeruginosa PA01
gauugaugaagcgcugcu

SEQ ID NO: 3393707 - RNA, 21 nt, Pseudomonas aeruginosa PA01
gauugcagguaguucuccagg

SEQ ID NO: 3393708 - RNA, 15 nt, Pseudomonas aeruginosa PA01
gauugcaugaccuuc

SEQ ID NO: 3393709 - RNA, 12 nt, Pseudomonas aeruginosa PA01
gauugccagcag

SEQ ID NO: 3393710 - RNA, 17 nt, Pseudomonas aeruginosa PA01
gauugcguacgcccagc

SEQ ID NO: 3393711 - RNA, 18 nt, Pseudomonas aeruginosa PA01
gauugcugggugcggugg

SEQ ID NO: 3393712 - RNA, 15 nt, Pseudomonas aeruginosa PA01
gauuggaauugcuga

SEQ ID NO: 3393713 - RNA, 18 nt, Pseudomonas aeruginosa PA01
gauuggccgggccgaugc

SEQ ID NO: 3393714 - RNA, 15 nt, Pseudomonas aeruginosa PA01
gauugucgcgaucca

SEQ ID NO: 3393715 - RNA, 20 nt, Pseudomonas aeruginosa PA01
gauugucgcgauccaccgcc

SEQ ID NO: 3393716 - RNA, 11 nt, Pseudomonas aeruginosa PA01
gauugugcagg

SEQ ID NO: 3393717 - RNA, 12 nt, Pseudomonas aeruginosa PA01
gauugugcaggg

SEQ ID NO: 3393718 - RNA, 12 nt, Pseudomonas aeruginosa PA01
gauuguucggua

SEQ ID NO: 3393719 - RNA, 16 nt, Pseudomonas aeruginosa PA01
gauuuacaggacugug

SEQ ID NO: 3393720 - RNA, 19 nt, Pseudomonas aeruginosa PA01
gauuuacaggacugugcuu

SEQ ID NO: 3393721 - RNA, 21 nt, Pseudomonas aeruginosa PA01
gauuucacggcggauaaccgc

SEQ ID NO: 3393722 - RNA, 22 nt, Pseudomonas aeruginosa PA01
gauuucacggcggauaaccgcg

SEQ ID NO: 3393723 - RNA, 13 nt, Pseudomonas aeruginosa PA01
gauuuccaccggc

SEQ ID NO: 3393724 - RNA, 15 nt, Pseudomonas aeruginosa PA01
gauuucccccggucc

SEQ ID NO: 3393725 - RNA, 23 nt, Pseudomonas aeruginosa PA01
gauuuccgcgcccggcuggccau

SEQ ID NO: 3393726 - RNA, 14 nt, Pseudomonas aeruginosa PA01
gauuuccgcggccg

SEQ ID NO: 3393727 - RNA, 16 nt, Pseudomonas aeruginosa PA01
gauuuccgcggccggc

SEQ ID NO: 3393728 - RNA, 17 nt, Pseudomonas aeruginosa PA01
gauuuccgcggccggca

SEQ ID NO: 3393729 - RNA, 18 nt, Pseudomonas aeruginosa PA01
gauuuccgcggccggcag

SEQ ID NO: 3393730 - RNA, 19 nt, Pseudomonas aeruginosa PA01
gauuuccggcuugccgaug

SEQ ID NO: 3393731 - RNA, 16 nt, Pseudomonas aeruginosa PA01
gauuuccucgcugcgg

SEQ ID NO: 3393732 - RNA, 19 nt, Pseudomonas aeruginosa PA01
gauuuccucgcugcgggcg

SEQ ID NO: 3393733 - RNA, 15 nt, Pseudomonas aeruginosa PA01
gauuucguuggccca

SEQ ID NO: 3393734 - RNA, 17 nt, Pseudomonas aeruginosa PA01
gauuucuucagccuggg

SEQ ID NO: 3393735 - RNA, 17 nt, Pseudomonas aeruginosa PA01
gauuuucuccggcgccg

SEQ ID NO: 3393736 - RNA, 21 nt, Pseudomonas aeruginosa PA01
gauuuucuccggcgccgggcu

SEQ ID NO: 3393737 - RNA, 19 nt, Pseudomonas aeruginosa PA01
gcaaaaaugcccuuggcuu

SEQ ID NO: 3393738 - RNA, 18 nt, Pseudomonas aeruginosa PA01
gcaaacccauuucccgca

SEQ ID NO: 3393739 - RNA, 17 nt, Pseudomonas aeruginosa PA01
gcaaacgccauccgccu

SEQ ID NO: 3393740 - RNA, 20 nt, Pseudomonas aeruginosa PA01
gcaaacgccauccgccuucu

SEQ ID NO: 3393741 - RNA, 19 nt, Pseudomonas aeruginosa PA01
gcaaacgccgccaccaacc

SEQ ID NO: 3393742 - RNA, 16 nt, Pseudomonas aeruginosa PA01
gcaaagaggcgcucaa

SEQ ID NO: 3393743 - RNA, 16 nt, Pseudomonas aeruginosa PA01
gcaaagcccgcuccgc

SEQ ID NO: 3393744 - RNA, 22 nt, Pseudomonas aeruginosa PA01
gcaaagccgcuguacaagcgca

SEQ ID NO: 3393745 - RNA, 17 nt, Pseudomonas aeruginosa PA01
gcaaagcgcgggcugcc

SEQ ID NO: 3393746 - RNA, 14 nt, Pseudomonas aeruginosa PA01
gcaaagcggcgacg

SEQ ID NO: 3393747 - RNA, 22 nt, Pseudomonas aeruginosa PA01
gcaaagcggcgacgccacccgc

SEQ ID NO: 3393748 - RNA, 14 nt, Pseudomonas aeruginosa PA01
gcaaaggcccggcg

SEQ ID NO: 3393749 - RNA, 18 nt, Pseudomonas aeruginosa PA01
gcaaaggcccggcgcggu

SEQ ID NO: 3393750 - RNA, 22 nt, Pseudomonas aeruginosa PA01
gcaaaggcgcgcagggccgcgg

SEQ ID NO: 3393751 - RNA, 23 nt, Pseudomonas aeruginosa PA01
gcaaaggcgcgcagggccgcggc

SEQ ID NO: 3393752 - RNA, 21 nt, Pseudomonas aeruginosa PA01
gcaaaggucggcgaaggcgaa

SEQ ID NO: 3393753 - RNA, 18 nt, Pseudomonas aeruginosa PA01
gcaaaugccgcaaacccc

SEQ ID NO: 3393754 - RNA, 19 nt, Pseudomonas aeruginosa PA01
gcaacaaggcauucaccag

SEQ ID NO: 3393755 - RNA, 21 nt, Pseudomonas aeruginosa PA01
gcaacaaggcauucaccagcg

SEQ ID NO: 3393756 - RNA, 18 nt, Pseudomonas aeruginosa PA01
gcaacaccaucggcccca

SEQ ID NO: 3393757 - RNA, 19 nt, Pseudomonas aeruginosa PA01
gcaacacccaggccugggu

SEQ ID NO: 3393758 - RNA, 18 nt, Pseudomonas aeruginosa PA01
gcaacaccgcgcagauga

SEQ ID NO: 3393759 - RNA, 12 nt, Pseudomonas aeruginosa PA01
gcaacaccuggc

SEQ ID NO: 3393760 - RNA, 16 nt, Pseudomonas aeruginosa PA01
gcaacaccuggcgcuc

SEQ ID NO: 3393761 - RNA, 19 nt, Pseudomonas aeruginosa PA01
gcaacaccuggcgcucgcc

SEQ ID NO: 3393762 - RNA, 20 nt, Pseudomonas aeruginosa PA01
gcaacaccuggcgcucgccg

SEQ ID NO: 3393763 - RNA, 19 nt, Pseudomonas aeruginosa PA01
gcaacaccuugcgcaccgc

SEQ ID NO: 3393764 - RNA, 15 nt, Pseudomonas aeruginosa PA01
gcaacagaucuuccu

SEQ ID NO: 3393765 - RNA, 17 nt, Pseudomonas aeruginosa PA01
gcaacagcaggagaagc

SEQ ID NO: 3393766 - RNA, 13 nt, Pseudomonas aeruginosa PA01
gcaacagcccgcg

SEQ ID NO: 3393767 - RNA, 13 nt, Pseudomonas aeruginosa PA01
gcaacagcgccgc

SEQ ID NO: 3393768 - RNA, 14 nt, Pseudomonas aeruginosa PA01
gcaacagcgccgcg

SEQ ID NO: 3393769 - RNA, 16 nt, Pseudomonas aeruginosa PA01
gcaacagcgccgcgcg

SEQ ID NO: 3393770 - RNA, 21 nt, Pseudomonas aeruginosa PA01
gcaacagcgccgcgcgcuugu

SEQ ID NO: 3393771 - RNA, 14 nt, Pseudomonas aeruginosa PA01
gcaacagcgcggcg

SEQ ID NO: 3393772 - RNA, 17 nt, Pseudomonas aeruginosa PA01
gcaacagcgcggcggug

SEQ ID NO: 3393773 - RNA, 14 nt, Pseudomonas aeruginosa PA01
gcaacagggcauug

SEQ ID NO: 3393774 - RNA, 23 nt, Pseudomonas aeruginosa PA01
gcaacagggcauuggccaucagc

SEQ ID NO: 3393775 - RNA, 14 nt, Pseudomonas aeruginosa PA01
gcaacaggucgagg

SEQ ID NO: 3393776 - RNA, 19 nt, Pseudomonas aeruginosa PA01
gcaacaguggguaggccag

SEQ ID NO: 3393777 - RNA, 20 nt, Pseudomonas aeruginosa PA01
gcaacaguggguaggccagg

SEQ ID NO: 3393778 - RNA, 21 nt, Pseudomonas aeruginosa PA01
gcaacaguggguaggccaggc

SEQ ID NO: 3393779 - RNA, 19 nt, Pseudomonas aeruginosa PA01
gcaacaguucugccgcaga

SEQ ID NO: 3393780 - RNA, 19 nt, Pseudomonas aeruginosa PA01
gcaacaguugccgcagcag

SEQ ID NO: 3393781 - RNA, 15 nt, Pseudomonas aeruginosa PA01
gcaaccagcccuggc

SEQ ID NO: 3393782 - RNA, 16 nt, Pseudomonas aeruginosa PA01
gcaaccagcccuggcg

SEQ ID NO: 3393783 - RNA, 20 nt, Pseudomonas aeruginosa PA01
gcaacccagggcgcugccga

SEQ ID NO: 3393784 - RNA, 22 nt, Pseudomonas aeruginosa PA01
gcaacccaugccgcaagcuccc

SEQ ID NO: 3393785 - RNA, 22 nt, Pseudomonas aeruginosa PA01
gcaaccccuucggucgcgcccc

SEQ ID NO: 3393786 - RNA, 14 nt, Pseudomonas aeruginosa PA01
gcaacccgcccggc

SEQ ID NO: 3393787 - RNA, 15 nt, Pseudomonas aeruginosa PA01
gcaacccgcccggcu

SEQ ID NO: 3393788 - RNA, 21 nt, Pseudomonas aeruginosa PA01
gcaacccgcccuugcucgcgg

SEQ ID NO: 3393789 - RNA, 23 nt, Pseudomonas aeruginosa PA01
gcaacccgcccuugcucgcggcg

SEQ ID NO: 3393790 - RNA, 15 nt, Pseudomonas aeruginosa PA01
gcaacccgccgcuga

SEQ ID NO: 3393791 - RNA, 18 nt, Pseudomonas aeruginosa PA01
gcaacccgccgcugauca

SEQ ID NO: 3393792 - RNA, 17 nt, Pseudomonas aeruginosa PA01
gcaacccgcuccgucgc

SEQ ID NO: 3393793 - RNA, 13 nt, Pseudomonas aeruginosa PA01
gcaacccggccca

SEQ ID NO: 3393794 - RNA, 20 nt, Pseudomonas aeruginosa PA01
gcaaccgauauggcuggcgc

SEQ ID NO: 3393795 - RNA, 21 nt, Pseudomonas aeruginosa PA01
gcaaccgauauggcuggcgca

SEQ ID NO: 3393796 - RNA, 13 nt, Pseudomonas aeruginosa PA01
gcaaccgcagacu

SEQ ID NO: 3393797 - RNA, 18 nt, Pseudomonas aeruginosa PA01
gcaaccgcagacuccggc

SEQ ID NO: 3393798 - RNA, 12 nt, Pseudomonas aeruginosa PA01
gcaaccgcccga

SEQ ID NO: 3393799 - RNA, 15 nt, Pseudomonas aeruginosa PA01
gcaaccgccgccgca

SEQ ID NO: 3393800 - RNA, 14 nt, Pseudomonas aeruginosa PA01
gcaaccgcggcggc

SEQ ID NO: 3393801 - RNA, 20 nt, Pseudomonas aeruginosa PA01
gcaagcucgacgagccgcga

SEQ ID NO: 3393802 - RNA, 14 nt, Pseudomonas aeruginosa PA01
gcaagcucgucacc

SEQ ID NO: 3393803 - RNA, 24 nt, Pseudomonas aeruginosa PA01
gcaagcucgucacccgcgccugca

SEQ ID NO: 3393804 - RNA, 15 nt, Pseudomonas aeruginosa PA01
gcaagcugcacggcg

SEQ ID NO: 3393805 - RNA, 18 nt, Pseudomonas aeruginosa PA01
gcaagcugcacggcgacc

SEQ ID NO: 3393806 - RNA, 20 nt, Pseudomonas aeruginosa PA01
gcaagcugcacggcgacccg

SEQ ID NO: 3393807 - RNA, 17 nt, Pseudomonas aeruginosa PA01
gcaaggaacuggaagcc

SEQ ID NO: 3393808 - RNA, 12 nt, Pseudomonas aeruginosa PA01
gcaaggaccugc

SEQ ID NO: 3393809 - RNA, 15 nt, Pseudomonas aeruginosa PA01
gcaaggaccugcugc

SEQ ID NO: 3393810 - RNA, 16 nt, Pseudomonas aeruginosa PA01
gcaaggaccugcugcc

SEQ ID NO: 3393811 - RNA, 18 nt, Pseudomonas aeruginosa PA01
gcaaggaccugcugcccg

SEQ ID NO: 3393812 - RNA, 19 nt, Pseudomonas aeruginosa PA01
gcaaggaccugcugcccgg

SEQ ID NO: 3393813 - RNA, 19 nt, Pseudomonas aeruginosa PA01
gcaaggcacacgcccggca

SEQ ID NO: 3393814 - RNA, 15 nt, Pseudomonas aeruginosa PA01
gcaaggcagcguccg

SEQ ID NO: 3393815 - RNA, 19 nt, Pseudomonas aeruginosa PA01
gcaaggcagcguccgaacg

SEQ ID NO: 3393816 - RNA, 22 nt, Pseudomonas aeruginosa PA01
gcaaggccaagucggccgccca

SEQ ID NO: 3393817 - RNA, 18 nt, Pseudomonas aeruginosa PA01
gcaaggccagcggcaucc

SEQ ID NO: 3393818 - RNA, 18 nt, Pseudomonas aeruginosa PA01
gcaaggccagggcggcgc

SEQ ID NO: 3393819 - RNA, 19 nt, Pseudomonas aeruginosa PA01
gcaaggccagggcggcgcc

SEQ ID NO: 3393820 - RNA, 19 nt, Pseudomonas aeruginosa PA01
gcaaggccgaagaggcccu

SEQ ID NO: 3393821 - RNA, 14 nt, Pseudomonas aeruginosa PA01
gcaaggcgcagcug

SEQ ID NO: 3393822 - RNA, 12 nt, Pseudomonas aeruginosa PA01
gcaaggcgguga

SEQ ID NO: 3393823 - RNA, 18 nt, Pseudomonas aeruginosa PA01
gcaaggcggugaccagcg

SEQ ID NO: 3393824 - RNA, 20 nt, Pseudomonas aeruginosa PA01
gcaaggcggugaccagcggc

SEQ ID NO: 3393825 - RNA, 21 nt, Pseudomonas aeruginosa PA01
gcaaggcgucauagcagcgcc

SEQ ID NO: 3393826 - RNA, 14 nt, Pseudomonas aeruginosa PA01
gcaaggcuucggcg

SEQ ID NO: 3393827 - RNA, 20 nt, Pseudomonas aeruginosa PA01
gcaaggcuucggcggucagg

SEQ ID NO: 3393828 - RNA, 15 nt, Pseudomonas aeruginosa PA01
gcaagggcgccgccg

SEQ ID NO: 3393829 - RNA, 16 nt, Pseudomonas aeruginosa PA01
gcaagggcgccgccga

SEQ ID NO: 3393830 - RNA, 23 nt, Pseudomonas aeruginosa PA01
gcaagggcgucugggacggcagc

SEQ ID NO: 3393831 - RNA, 15 nt, Pseudomonas aeruginosa PA01
gcaagggugcucagg

SEQ ID NO: 3393832 - RNA, 20 nt, Pseudomonas aeruginosa PA01
gcaaggucgucucagaccuu

SEQ ID NO: 3393833 - RNA, 23 nt, Pseudomonas aeruginosa PA01
gcaaggucgucucagaccuuccu

SEQ ID NO: 3393834 - RNA, 19 nt, Pseudomonas aeruginosa PA01
gcaaggugcgggccgucgu

SEQ ID NO: 3393835 - RNA, 16 nt, Pseudomonas aeruginosa PA01
gcaagucgaacaggcc

SEQ ID NO: 3393836 - RNA, 12 nt, Pseudomonas aeruginosa PA01
gcaaguggcggc

SEQ ID NO: 3393837 - RNA, 20 nt, Pseudomonas aeruginosa PA01
gcaagugggucacggugagg

SEQ ID NO: 3393838 - RNA, 23 nt, Pseudomonas aeruginosa PA01
gcaagugggucacggugaggacc

SEQ ID NO: 3393839 - RNA, 18 nt, Pseudomonas aeruginosa PA01
gcaaguucgcauaggcgg

SEQ ID NO: 3393840 - RNA, 20 nt, Pseudomonas aeruginosa PA01
gcaaguucgcauaggcggcc

SEQ ID NO: 3393841 - RNA, 16 nt, Pseudomonas aeruginosa PA01
gcaauacccgccgcug

SEQ ID NO: 3393842 - RNA, 19 nt, Pseudomonas aeruginosa PA01
gcaaucaucgcgucgccga

SEQ ID NO: 3393843 - RNA, 21 nt, Pseudomonas aeruginosa PA01
gcaaucaucgcgucgccgaac

SEQ ID NO: 3393844 - RNA, 15 nt, Pseudomonas aeruginosa PA01
gcaauccgccgcucc

SEQ ID NO: 3393845 - RNA, 16 nt, Pseudomonas aeruginosa PA01
gcaauccggcgcugcc

SEQ ID NO: 3393846 - RNA, 18 nt, Pseudomonas aeruginosa PA01
gcaauccggcgcugccga

SEQ ID NO: 3393847 - RNA, 14 nt, Pseudomonas aeruginosa PA01
gcaauccucggugc

SEQ ID NO: 3393848 - RNA, 17 nt, Pseudomonas aeruginosa PA01
gcaaucgaccaucaucc

SEQ ID NO: 3393849 - RNA, 21 nt, Pseudomonas aeruginosa PA01
gcaaucgaccaucauccgcgu

SEQ ID NO: 3393850 - RNA, 23 nt, Pseudomonas aeruginosa PA01
gcaaucgaccaucauccgcgugg

SEQ ID NO: 3393851 - RNA, 18 nt, Pseudomonas aeruginosa PA01
gcaaucgaucgcuucgcg

SEQ ID NO: 3393852 - RNA, 12 nt, Pseudomonas aeruginosa PA01
gcaaucgcugcc

SEQ ID NO: 3393853 - RNA, 13 nt, Pseudomonas aeruginosa PA01
gcaaucgcugccg

SEQ ID NO: 3393854 - RNA, 13 nt, Pseudomonas aeruginosa PA01
gcaaucggcgagc

SEQ ID NO: 3393855 - RNA, 13 nt, Pseudomonas aeruginosa PA01
gcaaugccagcgc

SEQ ID NO: 3393856 - RNA, 14 nt, Pseudomonas aeruginosa PA01
gcaaugccagcgcc

SEQ ID NO: 3393857 - RNA, 15 nt, Pseudomonas aeruginosa PA01
gcaaugccagcgcca

SEQ ID NO: 3393858 - RNA, 17 nt, Pseudomonas aeruginosa PA01
gcaaugccagcgccacg

SEQ ID NO: 3393859 - RNA, 19 nt, Pseudomonas aeruginosa PA01
gcaaugccagcgccacgcc

SEQ ID NO: 3393860 - RNA, 13 nt, Pseudomonas aeruginosa PA01
gcaaugcccagcg

SEQ ID NO: 3393861 - RNA, 15 nt, Pseudomonas aeruginosa PA01
gcaaugcccagcgca

SEQ ID NO: 3393862 - RNA, 17 nt, Pseudomonas aeruginosa PA01
gcaaugcccagcgcagg

SEQ ID NO: 3393863 - RNA, 13 nt, Pseudomonas aeruginosa PA01
gcaaugcccgcgc

SEQ ID NO: 3393864 - RNA, 15 nt, Pseudomonas aeruginosa PA01
gcaaugcccgcgccu

SEQ ID NO: 3393865 - RNA, 13 nt, Pseudomonas aeruginosa PA01
gcaaugcggcgau

SEQ ID NO: 3393866 - RNA, 15 nt, Pseudomonas aeruginosa PA01
gcaauggaugaacgu

SEQ ID NO: 3393867 - RNA, 22 nt, Pseudomonas aeruginosa PA01
gcaauggauguugccgccgccg

SEQ ID NO: 3393868 - RNA, 15 nt, Pseudomonas aeruginosa PA01
gcaauggccggcggg

SEQ ID NO: 3393869 - RNA, 13 nt, Pseudomonas aeruginosa PA01
gcaauggcggugu

SEQ ID NO: 3393870 - RNA, 22 nt, Pseudomonas aeruginosa PA01
gcaauggggcgcugguccuuca

SEQ ID NO: 3393871 - RNA, 19 nt, Pseudomonas aeruginosa PA01
gcaauggggcggccggcgc

SEQ ID NO: 3393872 - RNA, 22 nt, Pseudomonas aeruginosa PA01
gcaauggggcggccggcgcgga

SEQ ID NO: 3393873 - RNA, 21 nt, Pseudomonas aeruginosa PA01
gcaauucgugugggugcuugu

SEQ ID NO: 3393874 - RNA, 16 nt, Pseudomonas aeruginosa PA01
gcaauugaucauccag

SEQ ID NO: 3393875 - RNA, 15 nt, Pseudomonas aeruginosa PA01
gcaauugcuugcgcu

SEQ ID NO: 3393876 - RNA, 15 nt, Pseudomonas aeruginosa PA01
gcacaacgccuuccu

SEQ ID NO: 3393877 - RNA, 21 nt, Pseudomonas aeruginosa PA01
gcacaaugaaaaacgccggcg

SEQ ID NO: 3393878 - RNA, 17 nt, Pseudomonas aeruginosa PA01
gcacaccagcuccccgu

SEQ ID NO: 3393879 - RNA, 13 nt, Pseudomonas aeruginosa PA01
gcacaccuggucu

SEQ ID NO: 3393880 - RNA, 22 nt, Pseudomonas aeruginosa PA01
gcacaccuggucuucgguggcg

SEQ ID NO: 3393881 - RNA, 17 nt, Pseudomonas aeruginosa PA01
gcacacggucgagaccc

SEQ ID NO: 3393882 - RNA, 22 nt, Pseudomonas aeruginosa PA01
gcacacggucgagacccgcaac

SEQ ID NO: 3393883 - RNA, 14 nt, Pseudomonas aeruginosa PA01
gcacagccaggggc

SEQ ID NO: 3393884 - RNA, 19 nt, Pseudomonas aeruginosa PA01
gcacagccaggggcacgcu

SEQ ID NO: 3393885 - RNA, 19 nt, Pseudomonas aeruginosa PA01
gcacagccauagugcuggg

SEQ ID NO: 3393886 - RNA, 13 nt, Pseudomonas aeruginosa PA01
gcacagccccagc

SEQ ID NO: 3393887 - RNA, 22 nt, Pseudomonas aeruginosa PA01
gcacagccccagccucggcagg

SEQ ID NO: 3393888 - RNA, 17 nt, Pseudomonas aeruginosa PA01
gcacagcgcccagacac

SEQ ID NO: 3393889 - RNA, 22 nt, Pseudomonas aeruginosa PA01
gcacagcgcccagacacgccuc

SEQ ID NO: 3393890 - RNA, 18 nt, Pseudomonas aeruginosa PA01
gcacagcguggccagcgc

SEQ ID NO: 3393891 - RNA, 19 nt, Pseudomonas aeruginosa PA01
gcacagcguggccagcgcc

SEQ ID NO: 3393892 - RNA, 21 nt, Pseudomonas aeruginosa PA01
gcacagcguggccagcgccca

SEQ ID NO: 3393893 - RNA, 20 nt, Pseudomonas aeruginosa PA01
gcacaggcggaaggccucgg

SEQ ID NO: 3393894 - RNA, 22 nt, Pseudomonas aeruginosa PA01
gcacaggcggaaggccucggug

SEQ ID NO: 3393895 - RNA, 20 nt, Pseudomonas aeruginosa PA01
gcacaggcggcuguugccgu

SEQ ID NO: 3393896 - RNA, 19 nt, Pseudomonas aeruginosa PA01
gcacaggcguaccagcuug

SEQ ID NO: 3393897 - RNA, 13 nt, Pseudomonas aeruginosa PA01
gcacaggcuggcc

SEQ ID NO: 3393898 - RNA, 15 nt, Pseudomonas aeruginosa PA01
gcacaggcuggccag

SEQ ID NO: 3393899 - RNA, 16 nt, Pseudomonas aeruginosa PA01
gcacaggcuggccaga

SEQ ID NO: 3393900 - RNA, 20 nt, Pseudomonas aeruginosa PA01
gcacagggcgacuaccaggu

SEQ ID NO: 3393901 - RNA, 18 nt, Pseudomonas aeruginosa PA01
gcacagguagaggucgaa

SEQ ID NO: 3393902 - RNA, 20 nt, Pseudomonas aeruginosa PA01
gcacagguagaggucgaaag

SEQ ID NO: 3393903 - RNA, 21 nt, Pseudomonas aeruginosa PA01
gcacagguccagcaaggugcg

SEQ ID NO: 3393904 - RNA, 17 nt, Pseudomonas aeruginosa PA01
gcacaguuccuguacca

SEQ ID NO: 3393905 - RNA, 19 nt, Pseudomonas aeruginosa PA01
gcacaguuccuguaccagg

SEQ ID NO: 3393906 - RNA, 19 nt, Pseudomonas aeruginosa PA01
gcacaguugcgcgccggcg

SEQ ID NO: 3393907 - RNA, 20 nt, Pseudomonas aeruginosa PA01
gcacauagagggucagccgg

SEQ ID NO: 3393908 - RNA, 22 nt, Pseudomonas aeruginosa PA01
gcacauagagggucagccggcc

SEQ ID NO: 3393909 - RNA, 15 nt, Pseudomonas aeruginosa PA01
gcacauagcugccga

SEQ ID NO: 3393910 - RNA, 17 nt, Pseudomonas aeruginosa PA01
gcacauagcugccgaau

SEQ ID NO: 3393911 - RNA, 19 nt, Pseudomonas aeruginosa PA01
gcacaucaccuucgcccuc

SEQ ID NO: 3393912 - RNA, 19 nt, Pseudomonas aeruginosa PA01
gcacaugccgagcgaaauc

SEQ ID NO: 3393913 - RNA, 21 nt, Pseudomonas aeruginosa PA01
gcacaugugcguauggaucug

SEQ ID NO: 3393914 - RNA, 15 nt, Pseudomonas aeruginosa PA01
gcaccacagcaccac

SEQ ID NO: 3393915 - RNA, 21 nt, Pseudomonas aeruginosa PA01
gcaccacagcaccacgcuccu

SEQ ID NO: 3393916 - RNA, 23 nt, Pseudomonas aeruginosa PA01
gcaccaccaccgacaggccgacc

SEQ ID NO: 3393917 - RNA, 22 nt, Pseudomonas aeruginosa PA01
gcaccaccacucgcgagcuggc

SEQ ID NO: 3393918 - RNA, 14 nt, Pseudomonas aeruginosa PA01
gcaccaccagcgcg

SEQ ID NO: 3393919 - RNA, 18 nt, Pseudomonas aeruginosa PA01
gcaccaccagcgcgcgcu

SEQ ID NO: 3393920 - RNA, 23 nt, Pseudomonas aeruginosa PA01
gcaccaccagcgcgcgcuggcgc

SEQ ID NO: 3393921 - RNA, 22 nt, Pseudomonas aeruginosa PA01
gcaccacccaucugccggccac

SEQ ID NO: 3393922 - RNA, 15 nt, Pseudomonas aeruginosa PA01
gcaccacccgcugca

SEQ ID NO: 3393923 - RNA, 15 nt, Pseudomonas aeruginosa PA01
gcaccacccggccgc

SEQ ID NO: 3393924 - RNA, 16 nt, Pseudomonas aeruginosa PA01
gcaccacccggccgcg

SEQ ID NO: 3393925 - RNA, 15 nt, Pseudomonas aeruginosa PA01
gcaccacccggcgca

SEQ ID NO: 3393926 - RNA, 16 nt, Pseudomonas aeruginosa PA01
gcaccacccggcgcac

SEQ ID NO: 3393927 - RNA, 18 nt, Pseudomonas aeruginosa PA01
gcaccacccggcgcacgc

SEQ ID NO: 3393928 - RNA, 19 nt, Pseudomonas aeruginosa PA01
gcaccacccggcgcacgcc

SEQ ID NO: 3393929 - RNA, 21 nt, Pseudomonas aeruginosa PA01
gcaccacccggcgcacgccgg

SEQ ID NO: 3393930 - RNA, 19 nt, Pseudomonas aeruginosa PA01
gcaccaccgagagcggcgc

SEQ ID NO: 3393931 - RNA, 23 nt, Pseudomonas aeruginosa PA01
gcaccaccgagagcggcgccagg

SEQ ID NO: 3393932 - RNA, 16 nt, Pseudomonas aeruginosa PA01
gcaccaccgccgccag

SEQ ID NO: 3393933 - RNA, 17 nt, Pseudomonas aeruginosa PA01
gcaccaccgccgccagc

SEQ ID NO: 3393934 - RNA, 18 nt, Pseudomonas aeruginosa PA01
gcaccaccgccgccagca

SEQ ID NO: 3393935 - RNA, 20 nt, Pseudomonas aeruginosa PA01
gcaccaccgccgccagcaac

SEQ ID NO: 3393936 - RNA, 21 nt, Pseudomonas aeruginosa PA01
gcaccaccgccgccagcaacg

SEQ ID NO: 3393937 - RNA, 14 nt, Pseudomonas aeruginosa PA01
gcaccaccucgcca

SEQ ID NO: 3393938 - RNA, 17 nt, Pseudomonas aeruginosa PA01
gcaccaccucgccaagc

SEQ ID NO: 3393939 - RNA, 20 nt, Pseudomonas aeruginosa PA01
gcaccaccucgccaagcugg

SEQ ID NO: 3393940 - RNA, 13 nt, Pseudomonas aeruginosa PA01
gcaccaccugcuu

SEQ ID NO: 3393941 - RNA, 21 nt, Pseudomonas aeruginosa PA01
gcaccaccugcuugggcgccu

SEQ ID NO: 3393942 - RNA, 22 nt, Pseudomonas aeruginosa PA01
gcaccaccugcuugggcgccuc

SEQ ID NO: 3393943 - RNA, 15 nt, Pseudomonas aeruginosa PA01
gcaccacgccgcugg

SEQ ID NO: 3393944 - RNA, 16 nt, Pseudomonas aeruginosa PA01
gcaccacgccgcuggc

SEQ ID NO: 3393945 - RNA, 21 nt, Pseudomonas aeruginosa PA01
gcaccacgcgcaagccagcca

SEQ ID NO: 3393946 - RNA, 22 nt, Pseudomonas aeruginosa PA01
gcaccacgcgcaagccagccau

SEQ ID NO: 3393947 - RNA, 14 nt, Pseudomonas aeruginosa PA01
gcaccacguagccg

SEQ ID NO: 3393948 - RNA, 18 nt, Pseudomonas aeruginosa PA01
gcaccacguagccggcgu

SEQ ID NO: 3393949 - RNA, 16 nt, Pseudomonas aeruginosa PA01
gcaccacguucggcgc

SEQ ID NO: 3393950 - RNA, 20 nt, Pseudomonas aeruginosa PA01
gcaccacguucggcgcgggu

SEQ ID NO: 3393951 - RNA, 19 nt, Pseudomonas aeruginosa PA01
gcaccacugcaacacuucc

SEQ ID NO: 3393952 - RNA, 22 nt, Pseudomonas aeruginosa PA01
gcaccacugcaacacuuccuuc

SEQ ID NO: 3393953 - RNA, 18 nt, Pseudomonas aeruginosa PA01
gcaccagcacggugcugg

SEQ ID NO: 3393954 - RNA, 22 nt, Pseudomonas aeruginosa PA01
gcaccagcacguugccauccag

SEQ ID NO: 3393955 - RNA, 22 nt, Pseudomonas aeruginosa PA01
gcaccagcacuuccggcgcgga

SEQ ID NO: 3393956 - RNA, 15 nt, Pseudomonas aeruginosa PA01
gcaccagcaggagca

SEQ ID NO: 3393957 - RNA, 18 nt, Pseudomonas aeruginosa PA01
gcaccagcaggccgauca

SEQ ID NO: 3393958 - RNA, 13 nt, Pseudomonas aeruginosa PA01
gcaccagcaggcg

SEQ ID NO: 3393959 - RNA, 15 nt, Pseudomonas aeruginosa PA01
gcaccagcaggcgca

SEQ ID NO: 3393960 - RNA, 18 nt, Pseudomonas aeruginosa PA01
gcaccagcaggcgcaacc

SEQ ID NO: 3393961 - RNA, 15 nt, Pseudomonas aeruginosa PA01
gcaccagcaggucga

SEQ ID NO: 3393962 - RNA, 15 nt, Pseudomonas aeruginosa PA01
gcaccagcaggucgg

SEQ ID NO: 3393963 - RNA, 18 nt, Pseudomonas aeruginosa PA01
gcaccagcaggucggcgc

SEQ ID NO: 3393964 - RNA, 19 nt, Pseudomonas aeruginosa PA01
gcaccagcaggucggcgcg

SEQ ID NO: 3393965 - RNA, 20 nt, Pseudomonas aeruginosa PA01
gcaccagcaggucggcgcga

SEQ ID NO: 3393966 - RNA, 18 nt, Pseudomonas aeruginosa PA01
gcaccagccaguccggca

SEQ ID NO: 3393967 - RNA, 23 nt, Pseudomonas aeruginosa PA01
gcaccagccaguccggcagcacg

SEQ ID NO: 3393968 - RNA, 12 nt, Pseudomonas aeruginosa PA01
gcaccagccggc

SEQ ID NO: 3393969 - RNA, 17 nt, Pseudomonas aeruginosa PA01
gcaccagccggccgcgu

SEQ ID NO: 3393970 - RNA, 15 nt, Pseudomonas aeruginosa PA01
gcaccagccggcgcu

SEQ ID NO: 3393971 - RNA, 12 nt, Pseudomonas aeruginosa PA01
gcaccagccuuc

SEQ ID NO: 3393972 - RNA, 18 nt, Pseudomonas aeruginosa PA01
gcaccagccuuccggcac

SEQ ID NO: 3393973 - RNA, 12 nt, Pseudomonas aeruginosa PA01
gcaccagcggac

SEQ ID NO: 3393974 - RNA, 14 nt, Pseudomonas aeruginosa PA01
gcaccaggccaggc

SEQ ID NO: 3393975 - RNA, 20 nt, Pseudomonas aeruginosa PA01
gcaccaggccaggcugcgcu

SEQ ID NO: 3393976 - RNA, 14 nt, Pseudomonas aeruginosa PA01
gcaccaggccgcca

SEQ ID NO: 3393977 - RNA, 21 nt, Pseudomonas aeruginosa PA01
gcaccaggccgccaugcucgg

SEQ ID NO: 3393978 - RNA, 22 nt, Pseudomonas aeruginosa PA01
gcaccaggccgccaugcucggc

SEQ ID NO: 3393979 - RNA, 12 nt, Pseudomonas aeruginosa PA01
gcaccaggcgau

SEQ ID NO: 3393980 - RNA, 20 nt, Pseudomonas aeruginosa PA01
gcaccaggcgaugcgccgga

SEQ ID NO: 3393981 - RNA, 22 nt, Pseudomonas aeruginosa PA01
gcaccaggcucgccccggcggc

SEQ ID NO: 3393982 - RNA, 13 nt, Pseudomonas aeruginosa PA01
gcaccagggccag

SEQ ID NO: 3393983 - RNA, 14 nt, Pseudomonas aeruginosa PA01
gcaccagggccagg

SEQ ID NO: 3393984 - RNA, 15 nt, Pseudomonas aeruginosa PA01
gcaccagggccagga

SEQ ID NO: 3393985 - RNA, 16 nt, Pseudomonas aeruginosa PA01
gcaccagggccaggag

SEQ ID NO: 3393986 - RNA, 18 nt, Pseudomonas aeruginosa PA01
gcaccagggccaggagca

SEQ ID NO: 3393987 - RNA, 19 nt, Pseudomonas aeruginosa PA01
gcaccagggucgggccgcg

SEQ ID NO: 3393988 - RNA, 21 nt, Pseudomonas aeruginosa PA01
gcaccagggucgggccgcgcu

SEQ ID NO: 3393989 - RNA, 18 nt, Pseudomonas aeruginosa PA01
gcaccaggucgcgcuugu

SEQ ID NO: 3393990 - RNA, 16 nt, Pseudomonas aeruginosa PA01
gcaccagucccuggcc

SEQ ID NO: 3393991 - RNA, 19 nt, Pseudomonas aeruginosa PA01
gcaccagucccuggccggc

SEQ ID NO: 3393992 - RNA, 22 nt, Pseudomonas aeruginosa PA01
gcaccagucccuggccggcgau

SEQ ID NO: 3393993 - RNA, 13 nt, Pseudomonas aeruginosa PA01
gcaccaucagcca

SEQ ID NO: 3393994 - RNA, 17 nt, Pseudomonas aeruginosa PA01
gcaccaucagccagccc

SEQ ID NO: 3393995 - RNA, 18 nt, Pseudomonas aeruginosa PA01
gcaccaucagccagccca

SEQ ID NO: 3393996 - RNA, 20 nt, Pseudomonas aeruginosa PA01
gcaccaucagccagcccagu

SEQ ID NO: 3393997 - RNA, 13 nt, Pseudomonas aeruginosa PA01
gcaccauccgccg

SEQ ID NO: 3393998 - RNA, 15 nt, Pseudomonas aeruginosa PA01
gcaccauccgccgca

SEQ ID NO: 3393999 - RNA, 17 nt, Pseudomonas aeruginosa PA01
gcaccauccgccgcagg

SEQ ID NO: 3394000 - RNA, 18 nt, Pseudomonas aeruginosa PA01
gcaccauccucguaggug

SEQ ID NO: 3394001 - RNA, 15 nt, Pseudomonas aeruginosa PA01
gcaccaugcagcggc

SEQ ID NO: 3394002 - RNA, 17 nt, Pseudomonas aeruginosa PA01
gcaccaugcagcggcau

SEQ ID NO: 3394003 - RNA, 18 nt, Pseudomonas aeruginosa PA01
gcaccaugcagcggcaug

SEQ ID NO: 3394004 - RNA, 23 nt, Pseudomonas aeruginosa PA01
gcaccaugcagcggcauggucag

SEQ ID NO: 3394005 - RNA, 23 nt, Pseudomonas aeruginosa PA01
gcaccggcggcgccaggccggcg

SEQ ID NO: 3394006 - RNA, 21 nt, Pseudomonas aeruginosa PA01
gcaccggcuucuggaaggcgg

SEQ ID NO: 3394007 - RNA, 23 nt, Pseudomonas aeruginosa PA01
gcaccgggacgaagcggaagccg

SEQ ID NO: 3394008 - RNA, 17 nt, Pseudomonas aeruginosa PA01
gcaccgggaggcgccgc

SEQ ID NO: 3394009 - RNA, 21 nt, Pseudomonas aeruginosa PA01
gcaccgggaggcgccgcgcca

SEQ ID NO: 3394010 - RNA, 14 nt, Pseudomonas aeruginosa PA01
gcaccgggccgacc

SEQ ID NO: 3394011 - RNA, 17 nt, Pseudomonas aeruginosa PA01
gcaccgggccgaccugc

SEQ ID NO: 3394012 - RNA, 15 nt, Pseudomonas aeruginosa PA01
gcaccggggugaucc

SEQ ID NO: 3394013 - RNA, 18 nt, Pseudomonas aeruginosa PA01
gcaccggggugauccagc

SEQ ID NO: 3394014 - RNA, 19 nt, Pseudomonas aeruginosa PA01
gcaccggggugauccagcu

SEQ ID NO: 3394015 - RNA, 20 nt, Pseudomonas aeruginosa PA01
gcaccggggugauccagcug

SEQ ID NO: 3394016 - RNA, 16 nt, Pseudomonas aeruginosa PA01
gcaccgguucgacacg

SEQ ID NO: 3394017 - RNA, 15 nt, Pseudomonas aeruginosa PA01
gcaccguagcggcug

SEQ ID NO: 3394018 - RNA, 17 nt, Pseudomonas aeruginosa PA01
gcaccguagcggcugcg

SEQ ID NO: 3394019 - RNA, 18 nt, Pseudomonas aeruginosa PA01
gcaccguaggccaggcag

SEQ ID NO: 3394020 - RNA, 12 nt, Pseudomonas aeruginosa PA01
gcaccgucaagg

SEQ ID NO: 3394021 - RNA, 15 nt, Pseudomonas aeruginosa PA01
gcaccgucaagggcc

SEQ ID NO: 3394022 - RNA, 20 nt, Pseudomonas aeruginosa PA01
gcaccgucaccuguucggcg

SEQ ID NO: 3394023 - RNA, 22 nt, Pseudomonas aeruginosa PA01
gcaccgucaccuguucggcgcu

SEQ ID NO: 3394024 - RNA, 13 nt, Pseudomonas aeruginosa PA01
gcaccgucauggu

SEQ ID NO: 3394025 - RNA, 15 nt, Pseudomonas aeruginosa PA01
gcaccgucauggugc

SEQ ID NO: 3394026 - RNA, 21 nt, Pseudomonas aeruginosa PA01
gcaccgucauggugcguuacc

SEQ ID NO: 3394027 - RNA, 15 nt, Pseudomonas aeruginosa PA01
gcaccgucgagcacc

SEQ ID NO: 3394028 - RNA, 18 nt, Pseudomonas aeruginosa PA01
gcaccgucgagcaccagg

SEQ ID NO: 3394029 - RNA, 14 nt, Pseudomonas aeruginosa PA01
gcaccguggcgcca

SEQ ID NO: 3394030 - RNA, 18 nt, Pseudomonas aeruginosa PA01
gcaccguggucagcacca

SEQ ID NO: 3394031 - RNA, 22 nt, Pseudomonas aeruginosa PA01
gcaccuacccgagcaacugcuc

SEQ ID NO: 3394032 - RNA, 21 nt, Pseudomonas aeruginosa PA01
gcaccuacuaccgcugggacg

SEQ ID NO: 3394033 - RNA, 14 nt, Pseudomonas aeruginosa PA01
gcaccucgaccgcg

SEQ ID NO: 3394034 - RNA, 19 nt, Pseudomonas aeruginosa PA01
gcaccucgaccgcgccggc

SEQ ID NO: 3394035 - RNA, 20 nt, Pseudomonas aeruginosa PA01
gcaccucgaccgcgccggcg

SEQ ID NO: 3394036 - RNA, 21 nt, Pseudomonas aeruginosa PA01
gcaccucgaccgcgccggcga

SEQ ID NO: 3394037 - RNA, 22 nt, Pseudomonas aeruginosa PA01
gcaccucgcccuugcugcccag

SEQ ID NO: 3394038 - RNA, 13 nt, Pseudomonas aeruginosa PA01
gcaccucggccag

SEQ ID NO: 3394039 - RNA, 15 nt, Pseudomonas aeruginosa PA01
gcaccucggccaggc

SEQ ID NO: 3394040 - RNA, 18 nt, Pseudomonas aeruginosa PA01
gcaccucggccaggcggu

SEQ ID NO: 3394041 - RNA, 16 nt, Pseudomonas aeruginosa PA01
gcaccucguccagcag

SEQ ID NO: 3394042 - RNA, 14 nt, Pseudomonas aeruginosa PA01
gcaccugcagacgg

SEQ ID NO: 3394043 - RNA, 22 nt, Pseudomonas aeruginosa PA01
gcaccugcagacgguucagcag

SEQ ID NO: 3394044 - RNA, 23 nt, Pseudomonas aeruginosa PA01
gcaccugcagacgguucagcagc

SEQ ID NO: 3394045 - RNA, 12 nt, Pseudomonas aeruginosa PA01
gcaccugcgccc

SEQ ID NO: 3394046 - RNA, 16 nt, Pseudomonas aeruginosa PA01
gcaccugcgccccggu

SEQ ID NO: 3394047 - RNA, 13 nt, Pseudomonas aeruginosa PA01
gcaccugcgccga

SEQ ID NO: 3394048 - RNA, 14 nt, Pseudomonas aeruginosa PA01
gcaccugcgggcug

SEQ ID NO: 3394049 - RNA, 17 nt, Pseudomonas aeruginosa PA01
gcaccuggcagugcgcc

SEQ ID NO: 3394050 - RNA, 19 nt, Pseudomonas aeruginosa PA01
gcaccuggcagugcgccgg

SEQ ID NO: 3394051 - RNA, 20 nt, Pseudomonas aeruginosa PA01
gcaccuggcagugcgccggc

SEQ ID NO: 3394052 - RNA, 21 nt, Pseudomonas aeruginosa PA01
gcaccuggcagugcgccggca

SEQ ID NO: 3394053 - RNA, 22 nt, Pseudomonas aeruginosa PA01
gcaccuggcagugcgccggcau

SEQ ID NO: 3394054 - RNA, 18 nt, Pseudomonas aeruginosa PA01
gcaccuggcgaugcccug

SEQ ID NO: 3394055 - RNA, 19 nt, Pseudomonas aeruginosa PA01
gcaccuggcgaugcccugg

SEQ ID NO: 3394056 - RNA, 21 nt, Pseudomonas aeruginosa PA01
gcaccuggcgaugcccuggcc

SEQ ID NO: 3394057 - RNA, 22 nt, Pseudomonas aeruginosa PA01
gcaccuggcgaugcccuggccg

SEQ ID NO: 3394058 - RNA, 23 nt, Pseudomonas aeruginosa PA01
gcaccuggcgaugcccuggccgc

SEQ ID NO: 3394059 - RNA, 18 nt, Pseudomonas aeruginosa PA01
gcaccuggcggucgccgc

SEQ ID NO: 3394060 - RNA, 22 nt, Pseudomonas aeruginosa PA01
gcaccuggcggucgccgccggc

SEQ ID NO: 3394061 - RNA, 23 nt, Pseudomonas aeruginosa PA01
gcaccuggcggucgccgccggcg

SEQ ID NO: 3394062 - RNA, 19 nt, Pseudomonas aeruginosa PA01
gcaccugggcguuggccag

SEQ ID NO: 3394063 - RNA, 21 nt, Pseudomonas aeruginosa PA01
gcaccugggcguuggccagcg

SEQ ID NO: 3394064 - RNA, 22 nt, Pseudomonas aeruginosa PA01
gcaccugggcguuggccagcgc

SEQ ID NO: 3394065 - RNA, 23 nt, Pseudomonas aeruginosa PA01
gcaccugggcguuggccagcgcc

SEQ ID NO: 3394066 - RNA, 19 nt, Pseudomonas aeruginosa PA01
gcaccugggugcuuuccug

SEQ ID NO: 3394067 - RNA, 21 nt, Pseudomonas aeruginosa PA01
gcaccugggugcuuuccugcu

SEQ ID NO: 3394068 - RNA, 22 nt, Pseudomonas aeruginosa PA01
gcaccugggugcuuuccugcuc

SEQ ID NO: 3394069 - RNA, 21 nt, Pseudomonas aeruginosa PA01
gcaccugguggacacccugcu

SEQ ID NO: 3394070 - RNA, 22 nt, Pseudomonas aeruginosa PA01
gcaccugguggacacccugcug

SEQ ID NO: 3394071 - RNA, 17 nt, Pseudomonas aeruginosa PA01
gcaccuguuucagcggg

SEQ ID NO: 3394072 - RNA, 12 nt, Pseudomonas aeruginosa PA01
gcaccuucaccg

SEQ ID NO: 3394073 - RNA, 19 nt, Pseudomonas aeruginosa PA01
gcaccuucaucaccagguc

SEQ ID NO: 3394074 - RNA, 21 nt, Pseudomonas aeruginosa PA01
gcaccuugagggccuuggccu

SEQ ID NO: 3394075 - RNA, 14 nt, Pseudomonas aeruginosa PA01
gcaccuugcccugc

SEQ ID NO: 3394076 - RNA, 21 nt, Pseudomonas aeruginosa PA01
gcaccuugcgaaaagcccgcc

SEQ ID NO: 3394077 - RNA, 21 nt, Pseudomonas aeruginosa PA01
gcaccuuggcuugcagguagc

SEQ ID NO: 3394078 - RNA, 23 nt, Pseudomonas aeruginosa PA01
gcaccuuggcuugcagguagcug

SEQ ID NO: 3394079 - RNA, 12 nt, Pseudomonas aeruginosa PA01
gcaccuugucgc

SEQ ID NO: 3394080 - RNA, 17 nt, Pseudomonas aeruginosa PA01
gcaccuugucgcugacc

SEQ ID NO: 3394081 - RNA, 15 nt, Pseudomonas aeruginosa PA01
gcaccuugugcugcc

SEQ ID NO: 3394082 - RNA, 19 nt, Pseudomonas aeruginosa PA01
gcacgaaagccaugcccag

SEQ ID NO: 3394083 - RNA, 13 nt, Pseudomonas aeruginosa PA01
gcacgaacagggu

SEQ ID NO: 3394084 - RNA, 15 nt, Pseudomonas aeruginosa PA01
gcacgaacagggucu

SEQ ID NO: 3394085 - RNA, 22 nt, Pseudomonas aeruginosa PA01
gcacgaacaggugcugguggcc

SEQ ID NO: 3394086 - RNA, 21 nt, Pseudomonas aeruginosa PA01
gcacgaaccauugcggcccgc

SEQ ID NO: 3394087 - RNA, 22 nt, Pseudomonas aeruginosa PA01
gcacgaaccauugcggcccgcc

SEQ ID NO: 3394088 - RNA, 19 nt, Pseudomonas aeruginosa PA01
gcacgaacccaggcgcugc

SEQ ID NO: 3394089 - RNA, 12 nt, Pseudomonas aeruginosa PA01
gcacgaaccguc

SEQ ID NO: 3394090 - RNA, 15 nt, Pseudomonas aeruginosa PA01
gcacgaaccguccgc

SEQ ID NO: 3394091 - RNA, 18 nt, Pseudomonas aeruginosa PA01
gcacgaaccguccgcagc

SEQ ID NO: 3394092 - RNA, 18 nt, Pseudomonas aeruginosa PA01
gcacgaauuuccuggcgc

SEQ ID NO: 3394093 - RNA, 20 nt, Pseudomonas aeruginosa PA01
gcacgaccacaucggccagu

SEQ ID NO: 3394094 - RNA, 15 nt, Pseudomonas aeruginosa PA01
gcacgacgccggugc

SEQ ID NO: 3394095 - RNA, 20 nt, Pseudomonas aeruginosa PA01
gcacgacgccggugccagga

SEQ ID NO: 3394096 - RNA, 16 nt, Pseudomonas aeruginosa PA01
gcacgagcuuggccac

SEQ ID NO: 3394097 - RNA, 20 nt, Pseudomonas aeruginosa PA01
gcacgagcuuggccacuccg

SEQ ID NO: 3394098 - RNA, 17 nt, Pseudomonas aeruginosa PA01
gcacgaggauuuccgcg

SEQ ID NO: 3394099 - RNA, 13 nt, Pseudomonas aeruginosa PA01
gcacgaggcgggc

SEQ ID NO: 3394100 - RNA, 18 nt, Pseudomonas aeruginosa PA01
gcacgaggcgggcuggaa

SEQ ID NO: 3394101 - RNA, 19 nt, Pseudomonas aeruginosa PA01
gcacgaggcgggcuggaaa

SEQ ID NO: 3394102 - RNA, 21 nt, Pseudomonas aeruginosa PA01
gcacgaggcgggcuggaaaac

SEQ ID NO: 3394103 - RNA, 18 nt, Pseudomonas aeruginosa PA01
gcacgagucgaggcgaug

SEQ ID NO: 3394104 - RNA, 18 nt, Pseudomonas aeruginosa PA01
gcacgaucugcgccgcaa

SEQ ID NO: 3394105 - RNA, 15 nt, Pseudomonas aeruginosa PA01
gcacgaugaggcgug

SEQ ID NO: 3394106 - RNA, 14 nt, Pseudomonas aeruginosa PA01
gcacggggcgccug

SEQ ID NO: 3394107 - RNA, 16 nt, Pseudomonas aeruginosa PA01
gcacggggcgccuguc

SEQ ID NO: 3394108 - RNA, 20 nt, Pseudomonas aeruginosa PA01
gcacggggcgccuguccggg

SEQ ID NO: 3394109 - RNA, 15 nt, Pseudomonas aeruginosa PA01
gcacgguagccgccc

SEQ ID NO: 3394110 - RNA, 24 nt, Pseudomonas aeruginosa PA01
gcacggucauggccagcucgaccu

SEQ ID NO: 3394111 - RNA, 17 nt, Pseudomonas aeruginosa PA01
gcacgguccgcgaaccg

SEQ ID NO: 3394112 - RNA, 18 nt, Pseudomonas aeruginosa PA01
gcacggugaaccaggcgc

SEQ ID NO: 3394113 - RNA, 21 nt, Pseudomonas aeruginosa PA01
gcacggugaaccaggcgccga

SEQ ID NO: 3394114 - RNA, 21 nt, Pseudomonas aeruginosa PA01
gcacggugacacccugccgcg

SEQ ID NO: 3394115 - RNA, 22 nt, Pseudomonas aeruginosa PA01
gcacgguguuguggcuggccuc

SEQ ID NO: 3394116 - RNA, 17 nt, Pseudomonas aeruginosa PA01
gcacguacguccagggc

SEQ ID NO: 3394117 - RNA, 18 nt, Pseudomonas aeruginosa PA01
gcacguacguccagggca

SEQ ID NO: 3394118 - RNA, 14 nt, Pseudomonas aeruginosa PA01
gcacguagccgccc

SEQ ID NO: 3394119 - RNA, 22 nt, Pseudomonas aeruginosa PA01
gcacguagccgcccuuuuccgg

SEQ ID NO: 3394120 - RNA, 16 nt, Pseudomonas aeruginosa PA01
gcacgucaccguccuu

SEQ ID NO: 3394121 - RNA, 22 nt, Pseudomonas aeruginosa PA01
gcacgucgagguagaacaggcu

SEQ ID NO: 3394122 - RNA, 22 nt, Pseudomonas aeruginosa PA01
gcacgucgauauccagcggcag

SEQ ID NO: 3394123 - RNA, 23 nt, Pseudomonas aeruginosa PA01
gcacgucgauauccagcggcagc

SEQ ID NO: 3394124 - RNA, 16 nt, Pseudomonas aeruginosa PA01
gcacgucgccuucgcu

SEQ ID NO: 3394125 - RNA, 20 nt, Pseudomonas aeruginosa PA01
gcacgucgccuucgcugaga

SEQ ID NO: 3394126 - RNA, 21 nt, Pseudomonas aeruginosa PA01
gcacgucgguucagcgcggag

SEQ ID NO: 3394127 - RNA, 17 nt, Pseudomonas aeruginosa PA01
gcacgucguccagcgcc

SEQ ID NO: 3394128 - RNA, 19 nt, Pseudomonas aeruginosa PA01
gcacgucguccagcgccga

SEQ ID NO: 3394129 - RNA, 18 nt, Pseudomonas aeruginosa PA01
gcacgucuugcaggcuca

SEQ ID NO: 3394130 - RNA, 13 nt, Pseudomonas aeruginosa PA01
gcacgugcagcgg

SEQ ID NO: 3394131 - RNA, 16 nt, Pseudomonas aeruginosa PA01
gcacgugcagcggcag

SEQ ID NO: 3394132 - RNA, 22 nt, Pseudomonas aeruginosa PA01
gcacgugcagcggcagcgucuc

SEQ ID NO: 3394133 - RNA, 17 nt, Pseudomonas aeruginosa PA01
gcacgugcagcucggca

SEQ ID NO: 3394134 - RNA, 18 nt, Pseudomonas aeruginosa PA01
gcacguggaguucaccgu

SEQ ID NO: 3394135 - RNA, 13 nt, Pseudomonas aeruginosa PA01
gcacguuccagcu

SEQ ID NO: 3394136 - RNA, 19 nt, Pseudomonas aeruginosa PA01
gcacguuccagcucggugc

SEQ ID NO: 3394137 - RNA, 17 nt, Pseudomonas aeruginosa PA01
gcacguugcugugcugc

SEQ ID NO: 3394138 - RNA, 18 nt, Pseudomonas aeruginosa PA01
gcacguugcugugcugca

SEQ ID NO: 3394139 - RNA, 23 nt, Pseudomonas aeruginosa PA01
gcacguugcugugcugcaccagc

SEQ ID NO: 3394140 - RNA, 16 nt, Pseudomonas aeruginosa PA01
gcacguuguucaccgu

SEQ ID NO: 3394141 - RNA, 22 nt, Pseudomonas aeruginosa PA01
gcacguuguucaccgugauccc

SEQ ID NO: 3394142 - RNA, 11 nt, Pseudomonas aeruginosa PA01
gcacuacgccc

SEQ ID NO: 3394143 - RNA, 16 nt, Pseudomonas aeruginosa PA01
gcacucagccagcggc

SEQ ID NO: 3394144 - RNA, 23 nt, Pseudomonas aeruginosa PA01
gcacucaggaaaaaacgccgguc

SEQ ID NO: 3394145 - RNA, 15 nt, Pseudomonas aeruginosa PA01
gcacucauagcucag

SEQ ID NO: 3394146 - RNA, 19 nt, Pseudomonas aeruginosa PA01
gcacucauagcucagcugg

SEQ ID NO: 3394147 - RNA, 20 nt, Pseudomonas aeruginosa PA01
gcacucauagcucagcugga

SEQ ID NO: 3394148 - RNA, 21 nt, Pseudomonas aeruginosa PA01
gcacucauagcucagcuggau

SEQ ID NO: 3394149 - RNA, 18 nt, Pseudomonas aeruginosa PA01
gcacuccggcauaccgcc

SEQ ID NO: 3394150 - RNA, 19 nt, Pseudomonas aeruginosa PA01
gcacucgaugaacagcgcg

SEQ ID NO: 3394151 - RNA, 21 nt, Pseudomonas aeruginosa PA01
gcacucgaugaacagcgcgaa

SEQ ID NO: 3394152 - RNA, 13 nt, Pseudomonas aeruginosa PA01
gcacucgccgggc

SEQ ID NO: 3394153 - RNA, 18 nt, Pseudomonas aeruginosa PA01
gcacucgcuccuccgggc

SEQ ID NO: 3394154 - RNA, 16 nt, Pseudomonas aeruginosa PA01
gcacucggcgaccacc

SEQ ID NO: 3394155 - RNA, 18 nt, Pseudomonas aeruginosa PA01
gcacucggcgaccacccg

SEQ ID NO: 3394156 - RNA, 12 nt, Pseudomonas aeruginosa PA01
gcacucuuccug

SEQ ID NO: 3394157 - RNA, 13 nt, Pseudomonas aeruginosa PA01
gcacugccaggag

SEQ ID NO: 3394158 - RNA, 20 nt, Pseudomonas aeruginosa PA01
gcacugccaggagcacgccg

SEQ ID NO: 3394159 - RNA, 22 nt, Pseudomonas aeruginosa PA01
gcacugccaggagcacgccgug

SEQ ID NO: 3394160 - RNA, 15 nt, Pseudomonas aeruginosa PA01
gcacuggucggccag

SEQ ID NO: 3394161 - RNA, 20 nt, Pseudomonas aeruginosa PA01
gcacuggucggccaguuccu

SEQ ID NO: 3394162 - RNA, 22 nt, Pseudomonas aeruginosa PA01
gcacugguggacggucucgccg

SEQ ID NO: 3394163 - RNA, 19 nt, Pseudomonas aeruginosa PA01
gcacuguuccucagccccu

SEQ ID NO: 3394164 - RNA, 20 nt, Pseudomonas aeruginosa PA01
gcacuuccacuccaggcggc

SEQ ID NO: 3394165 - RNA, 22 nt, Pseudomonas aeruginosa PA01
gcacuuccacuccaggcggcgg

SEQ ID NO: 3394166 - RNA, 23 nt, Pseudomonas aeruginosa PA01
gcacuuccacuccaggcggcggu

SEQ ID NO: 3394167 - RNA, 20 nt, Pseudomonas aeruginosa PA01
gcacuucccaggugcccugg

SEQ ID NO: 3394168 - RNA, 17 nt, Pseudomonas aeruginosa PA01
gcacuucccgcccccuc

SEQ ID NO: 3394169 - RNA, 19 nt, Pseudomonas aeruginosa PA01
gcacuuccggacugcccag

SEQ ID NO: 3394170 - RNA, 15 nt, Pseudomonas aeruginosa PA01
gcacuuccggcgcgg

SEQ ID NO: 3394171 - RNA, 19 nt, Pseudomonas aeruginosa PA01
gcacuuccugaaggcgcgg

SEQ ID NO: 3394172 - RNA, 13 nt, Pseudomonas aeruginosa PA01
gcacuucgaccag

SEQ ID NO: 3394173 - RNA, 15 nt, Pseudomonas aeruginosa PA01
gcacuucggcgcgcg

SEQ ID NO: 3394174 - RNA, 16 nt, Pseudomonas aeruginosa PA01
gcacuucggcgcgcgg

SEQ ID NO: 3394175 - RNA, 14 nt, Pseudomonas aeruginosa PA01
gcacuugcggcagu

SEQ ID NO: 3394176 - RNA, 17 nt, Pseudomonas aeruginosa PA01
gcacuugcggcaguccu

SEQ ID NO: 3394177 - RNA, 20 nt, Pseudomonas aeruginosa PA01
gcacuuguugguauggcagc

SEQ ID NO: 3394178 - RNA, 15 nt, Pseudomonas aeruginosa PA01
gcagaaaaacccagc

SEQ ID NO: 3394179 - RNA, 19 nt, Pseudomonas aeruginosa PA01
gcagaaagccccugccgcg

SEQ ID NO: 3394180 - RNA, 23 nt, Pseudomonas aeruginosa PA01
gcagaaccagacgcucggccagc

SEQ ID NO: 3394181 - RNA, 14 nt, Pseudomonas aeruginosa PA01
gcagaaccgccagc

SEQ ID NO: 3394182 - RNA, 15 nt, Pseudomonas aeruginosa PA01
gcagaaccgccagca

SEQ ID NO: 3394183 - RNA, 16 nt, Pseudomonas aeruginosa PA01
gcagaaccgccagcag

SEQ ID NO: 3394184 - RNA, 17 nt, Pseudomonas aeruginosa PA01
gcagaaccgccagcagu

SEQ ID NO: 3394185 - RNA, 20 nt, Pseudomonas aeruginosa PA01
gcagaacgcggaaaccugca

SEQ ID NO: 3394186 - RNA, 15 nt, Pseudomonas aeruginosa PA01
gcagaacggauagcg

SEQ ID NO: 3394187 - RNA, 19 nt, Pseudomonas aeruginosa PA01
gcagaacugccgggccagc

SEQ ID NO: 3394188 - RNA, 20 nt, Pseudomonas aeruginosa PA01
gcagaacugccgggccagcu

SEQ ID NO: 3394189 - RNA, 20 nt, Pseudomonas aeruginosa PA01
gcagaacuugcgcaccgcgc

SEQ ID NO: 3394190 - RNA, 23 nt, Pseudomonas aeruginosa PA01
gcagaacuugcgcaccgcgccgg

SEQ ID NO: 3394191 - RNA, 19 nt, Pseudomonas aeruginosa PA01
gcagaagacgcccagcagg

SEQ ID NO: 3394192 - RNA, 20 nt, Pseudomonas aeruginosa PA01
gcagaagacgcccagcaggg

SEQ ID NO: 3394193 - RNA, 21 nt, Pseudomonas aeruginosa PA01
gcagaaggcgcuuucguaggg

SEQ ID NO: 3394194 - RNA, 16 nt, Pseudomonas aeruginosa PA01
gcagacaccaccaggu

SEQ ID NO: 3394195 - RNA, 18 nt, Pseudomonas aeruginosa PA01
gcagacaggccuccagca

SEQ ID NO: 3394196 - RNA, 22 nt, Pseudomonas aeruginosa PA01
gcagacaggccuccagcaacgc

SEQ ID NO: 3394197 - RNA, 15 nt, Pseudomonas aeruginosa PA01
gcagacaucgccgag

SEQ ID NO: 3394198 - RNA, 17 nt, Pseudomonas aeruginosa PA01
gcagaccagcgaaccgc

SEQ ID NO: 3394199 - RNA, 19 nt, Pseudomonas aeruginosa PA01
gcagaccagcgaaccgccg

SEQ ID NO: 3394200 - RNA, 13 nt, Pseudomonas aeruginosa PA01
gcagaccagcgca

SEQ ID NO: 3394201 - RNA, 21 nt, Pseudomonas aeruginosa PA01
gcagaccagcgcaagcggcgg

SEQ ID NO: 3394202 - RNA, 19 nt, Pseudomonas aeruginosa PA01
gcagaccaggccgagcagg

SEQ ID NO: 3394203 - RNA, 15 nt, Pseudomonas aeruginosa PA01
gcagaccgacccuca

SEQ ID NO: 3394204 - RNA, 17 nt, Pseudomonas aeruginosa PA01
gcagaccugcagcagga

SEQ ID NO: 3394205 - RNA, 24 nt, Pseudomonas aeruginosa PA01
gcagaccugcagcaggaucagcgc

SEQ ID NO: 3394206 - RNA, 16 nt, Pseudomonas aeruginosa PA01
gcagaccuggugggcg

SEQ ID NO: 3394207 - RNA, 14 nt, Pseudomonas aeruginosa PA01
gcagcacggcggcu

SEQ ID NO: 3394208 - RNA, 22 nt, Pseudomonas aeruginosa PA01
gcagcacggcggcuacccgcgc

SEQ ID NO: 3394209 - RNA, 22 nt, Pseudomonas aeruginosa PA01
gcagcacgguguuguggcuggc

SEQ ID NO: 3394210 - RNA, 21 nt, Pseudomonas aeruginosa PA01
gcagcacuuccugaaggcgcg

SEQ ID NO: 3394211 - RNA, 22 nt, Pseudomonas aeruginosa PA01
gcagcacuuccugaaggcgcgg

SEQ ID NO: 3394212 - RNA, 23 nt, Pseudomonas aeruginosa PA01
gcagcagaaguuguucgaugcgu

SEQ ID NO: 3394213 - RNA, 19 nt, Pseudomonas aeruginosa PA01
gcagcagagcgccacgggu

SEQ ID NO: 3394214 - RNA, 21 nt, Pseudomonas aeruginosa PA01
gcagcagagguagagcuuggc

SEQ ID NO: 3394215 - RNA, 12 nt, Pseudomonas aeruginosa PA01
gcagcagcaggu

SEQ ID NO: 3394216 - RNA, 20 nt, Pseudomonas aeruginosa PA01
gcagcagcaugaugccgagg

SEQ ID NO: 3394217 - RNA, 14 nt, Pseudomonas aeruginosa PA01
gcagcagccaaccg

SEQ ID NO: 3394218 - RNA, 19 nt, Pseudomonas aeruginosa PA01
gcagcagccaaccgucgcc

SEQ ID NO: 3394219 - RNA, 21 nt, Pseudomonas aeruginosa PA01
gcagcagccaaccgucgcccu

SEQ ID NO: 3394220 - RNA, 20 nt, Pseudomonas aeruginosa PA01
gcagcagcgaacgccgcagc

SEQ ID NO: 3394221 - RNA, 24 nt, Pseudomonas aeruginosa PA01
gcagcagcgaacgccgcagcucgg

SEQ ID NO: 3394222 - RNA, 13 nt, Pseudomonas aeruginosa PA01
gcagcagcgaccu

SEQ ID NO: 3394223 - RNA, 12 nt, Pseudomonas aeruginosa PA01
gcagcagcgcca

SEQ ID NO: 3394224 - RNA, 14 nt, Pseudomonas aeruginosa PA01
gcagcagcgccagg

SEQ ID NO: 3394225 - RNA, 15 nt, Pseudomonas aeruginosa PA01
gcagcagcgccagga

SEQ ID NO: 3394226 - RNA, 14 nt, Pseudomonas aeruginosa PA01
gcagcagcgccagu

SEQ ID NO: 3394227 - RNA, 15 nt, Pseudomonas aeruginosa PA01
gcagcagcgccaugc

SEQ ID NO: 3394228 - RNA, 14 nt, Pseudomonas aeruginosa PA01
gcagcagcgccgcg

SEQ ID NO: 3394229 - RNA, 15 nt, Pseudomonas aeruginosa PA01
gcagcagcgccgcga

SEQ ID NO: 3394230 - RNA, 19 nt, Pseudomonas aeruginosa PA01
gcagcagcgccgcgaacac

SEQ ID NO: 3394231 - RNA, 23 nt, Pseudomonas aeruginosa PA01
gcagcagcgccgcgaacacaccc

SEQ ID NO: 3394232 - RNA, 19 nt, Pseudomonas aeruginosa PA01
gcagcagcgccuucaccgu

SEQ ID NO: 3394233 - RNA, 17 nt, Pseudomonas aeruginosa PA01
gcagcagcggaucggcg

SEQ ID NO: 3394234 - RNA, 19 nt, Pseudomonas aeruginosa PA01
gcagcagcggaucggcggu

SEQ ID NO: 3394235 - RNA, 13 nt, Pseudomonas aeruginosa PA01
gcagcagcggcga

SEQ ID NO: 3394236 - RNA, 15 nt, Pseudomonas aeruginosa PA01
gcagcagcggcgaca

SEQ ID NO: 3394237 - RNA, 21 nt, Pseudomonas aeruginosa PA01
gcagcagcggcgacaccgcca

SEQ ID NO: 3394238 - RNA, 16 nt, Pseudomonas aeruginosa PA01
gcagcagcucguccau

SEQ ID NO: 3394239 - RNA, 14 nt, Pseudomonas aeruginosa PA01
gcagcaggaucagc

SEQ ID NO: 3394240 - RNA, 18 nt, Pseudomonas aeruginosa PA01
gcagcaggaucagcgcau

SEQ ID NO: 3394241 - RNA, 12 nt, Pseudomonas aeruginosa PA01
gcagcaggaucc

SEQ ID NO: 3394242 - RNA, 15 nt, Pseudomonas aeruginosa PA01
gcagcaggauccagg

SEQ ID NO: 3394243 - RNA, 18 nt, Pseudomonas aeruginosa PA01
gcagcaggauccaggugc

SEQ ID NO: 3394244 - RNA, 18 nt, Pseudomonas aeruginosa PA01
gcagcaggcacagggcga

SEQ ID NO: 3394245 - RNA, 11 nt, Pseudomonas aeruginosa PA01
gcagcaggccg

SEQ ID NO: 3394246 - RNA, 17 nt, Pseudomonas aeruginosa PA01
gcagcaggccgcuggcg

SEQ ID NO: 3394247 - RNA, 19 nt, Pseudomonas aeruginosa PA01
gcagcaggccgcuggcgac

SEQ ID NO: 3394248 - RNA, 14 nt, Pseudomonas aeruginosa PA01
gcagcaggccggcg

SEQ ID NO: 3394249 - RNA, 17 nt, Pseudomonas aeruginosa PA01
gcagcaggccggcgacc

SEQ ID NO: 3394250 - RNA, 20 nt, Pseudomonas aeruginosa PA01
gcagcaggccggcgaccagc

SEQ ID NO: 3394251 - RNA, 14 nt, Pseudomonas aeruginosa PA01
gcagcaggcgcucg

SEQ ID NO: 3394252 - RNA, 15 nt, Pseudomonas aeruginosa PA01
gcagcaggcgcucgg

SEQ ID NO: 3394253 - RNA, 14 nt, Pseudomonas aeruginosa PA01
gcagcaggcgggcg

SEQ ID NO: 3394254 - RNA, 23 nt, Pseudomonas aeruginosa PA01
gcagcagggcguaggcgucgcga

SEQ ID NO: 3394255 - RNA, 17 nt, Pseudomonas aeruginosa PA01
gcagcagggcgucggcg

SEQ ID NO: 3394256 - RNA, 23 nt, Pseudomonas aeruginosa PA01
gcagcaggguaccgcuggcgcug

SEQ ID NO: 3394257 - RNA, 17 nt, Pseudomonas aeruginosa PA01
gcagcagggucagcagc

SEQ ID NO: 3394258 - RNA, 15 nt, Pseudomonas aeruginosa PA01
gcagcagggucgggg

SEQ ID NO: 3394259 - RNA, 21 nt, Pseudomonas aeruginosa PA01
gcagcagguagugcggcgggc

SEQ ID NO: 3394260 - RNA, 22 nt, Pseudomonas aeruginosa PA01
gcagcagguagugcggcgggcg

SEQ ID NO: 3394261 - RNA, 21 nt, Pseudomonas aeruginosa PA01
gcagcagguagugcucggcca

SEQ ID NO: 3394262 - RNA, 23 nt, Pseudomonas aeruginosa PA01
gcagcagguagugcucggccagu

SEQ ID NO: 3394263 - RNA, 20 nt, Pseudomonas aeruginosa PA01
gcagcaggucgagcaguucc

SEQ ID NO: 3394264 - RNA, 14 nt, Pseudomonas aeruginosa PA01
gcagcaggucgcgc

SEQ ID NO: 3394265 - RNA, 15 nt, Pseudomonas aeruginosa PA01
gcagcaggucgucgg

SEQ ID NO: 3394266 - RNA, 16 nt, Pseudomonas aeruginosa PA01
gcagcaggucgucggc

SEQ ID NO: 3394267 - RNA, 17 nt, Pseudomonas aeruginosa PA01
gcagcagguuccuccug

SEQ ID NO: 3394268 - RNA, 18 nt, Pseudomonas aeruginosa PA01
gcagcagguuccuccugg

SEQ ID NO: 3394269 - RNA, 17 nt, Pseudomonas aeruginosa PA01
gcagcagguugaccccg

SEQ ID NO: 3394270 - RNA, 20 nt, Pseudomonas aeruginosa PA01
gcagcagguugaccccgcgg

SEQ ID NO: 3394271 - RNA, 18 nt, Pseudomonas aeruginosa PA01
gcagcagucgcagcucgg

SEQ ID NO: 3394272 - RNA, 13 nt, Pseudomonas aeruginosa PA01
gcagcaucagccg

SEQ ID NO: 3394273 - RNA, 16 nt, Pseudomonas aeruginosa PA01
gcagcaucuucucggc

SEQ ID NO: 3394274 - RNA, 19 nt, Pseudomonas aeruginosa PA01
gcagcaucuucucggcgau

SEQ ID NO: 3394275 - RNA, 23 nt, Pseudomonas aeruginosa PA01
gcagcaucuucucggcgauucgc

SEQ ID NO: 3394276 - RNA, 20 nt, Pseudomonas aeruginosa PA01
gcagcaugccgcucugccag

SEQ ID NO: 3394277 - RNA, 17 nt, Pseudomonas aeruginosa PA01
gcagcaugggauggcgc

SEQ ID NO: 3394278 - RNA, 19 nt, Pseudomonas aeruginosa PA01
gcagcaugggauggcgcgg

SEQ ID NO: 3394279 - RNA, 20 nt, Pseudomonas aeruginosa PA01
gcagcaugggauggcgcggu

SEQ ID NO: 3394280 - RNA, 17 nt, Pseudomonas aeruginosa PA01
gcagcaugucgccgggg

SEQ ID NO: 3394281 - RNA, 18 nt, Pseudomonas aeruginosa PA01
gcagcaugucgccgggga

SEQ ID NO: 3394282 - RNA, 18 nt, Pseudomonas aeruginosa PA01
gcagccaaccgucgcccu

SEQ ID NO: 3394283 - RNA, 19 nt, Pseudomonas aeruginosa PA01
gcagccaaggaugcgccag

SEQ ID NO: 3394284 - RNA, 20 nt, Pseudomonas aeruginosa PA01
gcagccaaggaugcgccagc

SEQ ID NO: 3394285 - RNA, 23 nt, Pseudomonas aeruginosa PA01
gcagccaaggaugcgccagcggc

SEQ ID NO: 3394286 - RNA, 17 nt, Pseudomonas aeruginosa PA01
gcagccacaggcgccag

SEQ ID NO: 3394287 - RNA, 19 nt, Pseudomonas aeruginosa PA01
gcagccacccgcgggcagc

SEQ ID NO: 3394288 - RNA, 20 nt, Pseudomonas aeruginosa PA01
gcagccacccgcgggcagca

SEQ ID NO: 3394289 - RNA, 13 nt, Pseudomonas aeruginosa PA01
gcagccacccgcu

SEQ ID NO: 3394290 - RNA, 18 nt, Pseudomonas aeruginosa PA01
gcagccacccgcucgacc

SEQ ID NO: 3394291 - RNA, 20 nt, Pseudomonas aeruginosa PA01
gcagccacggcacacgucgg

SEQ ID NO: 3394292 - RNA, 16 nt, Pseudomonas aeruginosa PA01
gcagccacucggccag

SEQ ID NO: 3394293 - RNA, 18 nt, Pseudomonas aeruginosa PA01
gcagccacucggccaggc

SEQ ID NO: 3394294 - RNA, 20 nt, Pseudomonas aeruginosa PA01
gcagccacucggccaggcgc

SEQ ID NO: 3394295 - RNA, 12 nt, Pseudomonas aeruginosa PA01
gcagccacuggc

SEQ ID NO: 3394296 - RNA, 16 nt, Pseudomonas aeruginosa PA01
gcagccacuggcggac

SEQ ID NO: 3394297 - RNA, 22 nt, Pseudomonas aeruginosa PA01
gcagccacuguccaugaaugcc

SEQ ID NO: 3394298 - RNA, 17 nt, Pseudomonas aeruginosa PA01
gcagccagacccagugg

SEQ ID NO: 3394299 - RNA, 17 nt, Pseudomonas aeruginosa PA01
gcagccagagcuccagg

SEQ ID NO: 3394300 - RNA, 13 nt, Pseudomonas aeruginosa PA01
gcagccagccgcc

SEQ ID NO: 3394301 - RNA, 15 nt, Pseudomonas aeruginosa PA01
gcagccagccgccga

SEQ ID NO: 3394302 - RNA, 15 nt, Pseudomonas aeruginosa PA01
gcagccagccgucgu

SEQ ID NO: 3394303 - RNA, 22 nt, Pseudomonas aeruginosa PA01
gcagccagccgucgucguccac

SEQ ID NO: 3394304 - RNA, 17 nt, Pseudomonas aeruginosa PA01
gcagccagccucaggua

SEQ ID NO: 3394305 - RNA, 21 nt, Pseudomonas aeruginosa PA01
gcagccagcuucagccgaccg

SEQ ID NO: 3394306 - RNA, 11 nt, Pseudomonas aeruginosa PA01
gcagccaggcg

SEQ ID NO: 3394307 - RNA, 21 nt, Pseudomonas aeruginosa PA01
gcagccaggcgaagcggcugg

SEQ ID NO: 3394308 - RNA, 22 nt, Pseudomonas aeruginosa PA01
gcagccaggcgaagcggcuggc

SEQ ID NO: 3394309 - RNA, 22 nt, Pseudomonas aeruginosa PA01
gcagcgccaguuggacgcggcc

SEQ ID NO: 3394310 - RNA, 18 nt, Pseudomonas aeruginosa PA01
gcagcgccauggggauca

SEQ ID NO: 3394311 - RNA, 22 nt, Pseudomonas aeruginosa PA01
gcagcgccauggggaucaccgg

SEQ ID NO: 3394312 - RNA, 13 nt, Pseudomonas aeruginosa PA01
gcagcgccccagc

SEQ ID NO: 3394313 - RNA, 15 nt, Pseudomonas aeruginosa PA01
gcagcgccccagcac

SEQ ID NO: 3394314 - RNA, 20 nt, Pseudomonas aeruginosa PA01
gcagcgccccagcaccucgc

SEQ ID NO: 3394315 - RNA, 23 nt, Pseudomonas aeruginosa PA01
gcagcgccccagcaccucgccgu

SEQ ID NO: 3394316 - RNA, 21 nt, Pseudomonas aeruginosa PA01
gcagcgccccucccagccaca

SEQ ID NO: 3394317 - RNA, 19 nt, Pseudomonas aeruginosa PA01
gcagcgcccgauaggcgcc

SEQ ID NO: 3394318 - RNA, 20 nt, Pseudomonas aeruginosa PA01
gcagcgcccgauaggcgccg

SEQ ID NO: 3394319 - RNA, 13 nt, Pseudomonas aeruginosa PA01
gcagcgccgaaca

SEQ ID NO: 3394320 - RNA, 12 nt, Pseudomonas aeruginosa PA01
gcagcgccgagg

SEQ ID NO: 3394321 - RNA, 13 nt, Pseudomonas aeruginosa PA01
gcagcgccgccag

SEQ ID NO: 3394322 - RNA, 14 nt, Pseudomonas aeruginosa PA01
gcagcgccgccagc

SEQ ID NO: 3394323 - RNA, 19 nt, Pseudomonas aeruginosa PA01
gcagcgccgccagcaggau

SEQ ID NO: 3394324 - RNA, 12 nt, Pseudomonas aeruginosa PA01
gcagcgccgccc

SEQ ID NO: 3394325 - RNA, 13 nt, Pseudomonas aeruginosa PA01
gcagcgccgcccu

SEQ ID NO: 3394326 - RNA, 14 nt, Pseudomonas aeruginosa PA01
gcagcgccgcccug

SEQ ID NO: 3394327 - RNA, 15 nt, Pseudomonas aeruginosa PA01
gcagcgccgcccugu

SEQ ID NO: 3394328 - RNA, 15 nt, Pseudomonas aeruginosa PA01
gcagcgccgccgcgu

SEQ ID NO: 3394329 - RNA, 13 nt, Pseudomonas aeruginosa PA01
gcagcgccgccgg

SEQ ID NO: 3394330 - RNA, 15 nt, Pseudomonas aeruginosa PA01
gcagcgccgccgggc

SEQ ID NO: 3394331 - RNA, 12 nt, Pseudomonas aeruginosa PA01
gcagcgccgcga

SEQ ID NO: 3394332 - RNA, 13 nt, Pseudomonas aeruginosa PA01
gcagcgccgcgcg

SEQ ID NO: 3394333 - RNA, 15 nt, Pseudomonas aeruginosa PA01
gcagcgccgcgcggc

SEQ ID NO: 3394334 - RNA, 12 nt, Pseudomonas aeruginosa PA01
gcagcgccgggc

SEQ ID NO: 3394335 - RNA, 14 nt, Pseudomonas aeruginosa PA01
gcagcgccgggcau

SEQ ID NO: 3394336 - RNA, 13 nt, Pseudomonas aeruginosa PA01
gcagcgccguugc

SEQ ID NO: 3394337 - RNA, 19 nt, Pseudomonas aeruginosa PA01
gcagcgccguugccgaugc

SEQ ID NO: 3394338 - RNA, 16 nt, Pseudomonas aeruginosa PA01
gcagcgccuccagcgu

SEQ ID NO: 3394339 - RNA, 13 nt, Pseudomonas aeruginosa PA01
gcagcgccuccuc

SEQ ID NO: 3394340 - RNA, 23 nt, Pseudomonas aeruginosa PA01
gcagcgccucggcaucgaccagg

SEQ ID NO: 3394341 - RNA, 15 nt, Pseudomonas aeruginosa PA01
gcagcgccucggcgg

SEQ ID NO: 3394342 - RNA, 16 nt, Pseudomonas aeruginosa PA01
gcagcgccucggcggc

SEQ ID NO: 3394343 - RNA, 16 nt, Pseudomonas aeruginosa PA01
gcagcgccucguggaa

SEQ ID NO: 3394344 - RNA, 14 nt, Pseudomonas aeruginosa PA01
gcagcgccuguucc

SEQ ID NO: 3394345 - RNA, 15 nt, Pseudomonas aeruginosa PA01
gcagcgccuguucca

SEQ ID NO: 3394346 - RNA, 23 nt, Pseudomonas aeruginosa PA01
gcagcgccuguuccagggccugc

SEQ ID NO: 3394347 - RNA, 21 nt, Pseudomonas aeruginosa PA01
gcagcgccuucaccguuccca

SEQ ID NO: 3394348 - RNA, 23 nt, Pseudomonas aeruginosa PA01
gcagcgcgauaucgcaggccagg

SEQ ID NO: 3394349 - RNA, 14 nt, Pseudomonas aeruginosa PA01
gcagcgcgcgccga

SEQ ID NO: 3394350 - RNA, 15 nt, Pseudomonas aeruginosa PA01
gcagcgcgcgccgag

SEQ ID NO: 3394351 - RNA, 18 nt, Pseudomonas aeruginosa PA01
gcagcgcgcgcuggucgu

SEQ ID NO: 3394352 - RNA, 13 nt, Pseudomonas aeruginosa PA01
gcagcgcgcggcc

SEQ ID NO: 3394353 - RNA, 14 nt, Pseudomonas aeruginosa PA01
gcagcgcgcggcca

SEQ ID NO: 3394354 - RNA, 16 nt, Pseudomonas aeruginosa PA01
gcagcgcgcggccagu

SEQ ID NO: 3394355 - RNA, 15 nt, Pseudomonas aeruginosa PA01
gcagcgcgcggcucg

SEQ ID NO: 3394356 - RNA, 14 nt, Pseudomonas aeruginosa PA01
gcagcgcgcgucgg

SEQ ID NO: 3394357 - RNA, 15 nt, Pseudomonas aeruginosa PA01
gcagcgcgcgucggu

SEQ ID NO: 3394358 - RNA, 15 nt, Pseudomonas aeruginosa PA01
gcagcgcggcgcugg

SEQ ID NO: 3394359 - RNA, 12 nt, Pseudomonas aeruginosa PA01
gcagcgcggcgg

SEQ ID NO: 3394360 - RNA, 13 nt, Pseudomonas aeruginosa PA01
gcagcgcggcggc

SEQ ID NO: 3394361 - RNA, 14 nt, Pseudomonas aeruginosa PA01
gcagcgcggcggcg

SEQ ID NO: 3394362 - RNA, 15 nt, Pseudomonas aeruginosa PA01
gcagcgcggcggcgg

SEQ ID NO: 3394363 - RNA, 21 nt, Pseudomonas aeruginosa PA01
gcagcgcggcggcggccagca

SEQ ID NO: 3394364 - RNA, 22 nt, Pseudomonas aeruginosa PA01
gcagcgcggcggcggccagcag

SEQ ID NO: 3394365 - RNA, 14 nt, Pseudomonas aeruginosa PA01
gcagcgcgggggcu

SEQ ID NO: 3394366 - RNA, 22 nt, Pseudomonas aeruginosa PA01
gcagcgcggucauccgcccugc

SEQ ID NO: 3394367 - RNA, 23 nt, Pseudomonas aeruginosa PA01
gcagcgcggucauccgcccugcg

SEQ ID NO: 3394368 - RNA, 18 nt, Pseudomonas aeruginosa PA01
gcagcgcguagaccaccu

SEQ ID NO: 3394369 - RNA, 16 nt, Pseudomonas aeruginosa PA01
gcagcgcuagcgcaug

SEQ ID NO: 3394370 - RNA, 23 nt, Pseudomonas aeruginosa PA01
gcagcgcucacgcaccucgucga

SEQ ID NO: 3394371 - RNA, 12 nt, Pseudomonas aeruginosa PA01
gcagcgcuggcg

SEQ ID NO: 3394372 - RNA, 17 nt, Pseudomonas aeruginosa PA01
gcagcgcuggcgaucac

SEQ ID NO: 3394373 - RNA, 17 nt, Pseudomonas aeruginosa PA01
gcagcgcuucguugcuc

SEQ ID NO: 3394374 - RNA, 22 nt, Pseudomonas aeruginosa PA01
gcagcgcuucguugcuccugcg

SEQ ID NO: 3394375 - RNA, 18 nt, Pseudomonas aeruginosa PA01
gcagcgcuuguagcagcc

SEQ ID NO: 3394376 - RNA, 20 nt, Pseudomonas aeruginosa PA01
gcagcgcuuguagcagccgc

SEQ ID NO: 3394377 - RNA, 23 nt, Pseudomonas aeruginosa PA01
gcagcgcuuguagcagccgcagg

SEQ ID NO: 3394378 - RNA, 19 nt, Pseudomonas aeruginosa PA01
gcagcggaaaugcucgccg

SEQ ID NO: 3394379 - RNA, 14 nt, Pseudomonas aeruginosa PA01
gcagcggaagcccu

SEQ ID NO: 3394380 - RNA, 17 nt, Pseudomonas aeruginosa PA01
gcagcggaagcccugcu

SEQ ID NO: 3394381 - RNA, 17 nt, Pseudomonas aeruginosa PA01
gcagcggaucggcggug

SEQ ID NO: 3394382 - RNA, 20 nt, Pseudomonas aeruginosa PA01
gcagcggcaaaggcccggcg

SEQ ID NO: 3394383 - RNA, 22 nt, Pseudomonas aeruginosa PA01
gcagcggcaaaggcccggcgcg

SEQ ID NO: 3394384 - RNA, 15 nt, Pseudomonas aeruginosa PA01
gcagcggcaccagca

SEQ ID NO: 3394385 - RNA, 17 nt, Pseudomonas aeruginosa PA01
gcagcggcaccagcacg

SEQ ID NO: 3394386 - RNA, 22 nt, Pseudomonas aeruginosa PA01
gcagcggcagccacucggccag

SEQ ID NO: 3394387 - RNA, 23 nt, Pseudomonas aeruginosa PA01
gcagcggcagccacucggccagg

SEQ ID NO: 3394388 - RNA, 16 nt, Pseudomonas aeruginosa PA01
gcagcggcagcgccag

SEQ ID NO: 3394389 - RNA, 18 nt, Pseudomonas aeruginosa PA01
gcagcggcagcgccaggu

SEQ ID NO: 3394390 - RNA, 13 nt, Pseudomonas aeruginosa PA01
gcagcggcagcgg

SEQ ID NO: 3394391 - RNA, 14 nt, Pseudomonas aeruginosa PA01
gcagcggcagcggc

SEQ ID NO: 3394392 - RNA, 23 nt, Pseudomonas aeruginosa PA01
gcagcggcagcgucucggcugcc

SEQ ID NO: 3394393 - RNA, 14 nt, Pseudomonas aeruginosa PA01
gcagcggcaggcca

SEQ ID NO: 3394394 - RNA, 19 nt, Pseudomonas aeruginosa PA01
gcagcggcaggccacggcc

SEQ ID NO: 3394395 - RNA, 22 nt, Pseudomonas aeruginosa PA01
gcagcggcaggccacggccgcu

SEQ ID NO: 3394396 - RNA, 20 nt, Pseudomonas aeruginosa PA01
gcagcggcaugcccugccgg

SEQ ID NO: 3394397 - RNA, 15 nt, Pseudomonas aeruginosa PA01
gcagcggcccuugcc

SEQ ID NO: 3394398 - RNA, 14 nt, Pseudomonas aeruginosa PA01
gcagcggcgacacc

SEQ ID NO: 3394399 - RNA, 20 nt, Pseudomonas aeruginosa PA01
gcagcggcgacaccgccagc

SEQ ID NO: 3394400 - RNA, 15 nt, Pseudomonas aeruginosa PA01
gcagcggcgccgagg

SEQ ID NO: 3394401 - RNA, 17 nt, Pseudomonas aeruginosa PA01
gcagcggcgcgccaugc

SEQ ID NO: 3394402 - RNA, 19 nt, Pseudomonas aeruginosa PA01
gcagcggcgcuacgaaggc

SEQ ID NO: 3394403 - RNA, 21 nt, Pseudomonas aeruginosa PA01
gcagcggcggauacaggcgca

SEQ ID NO: 3394404 - RNA, 15 nt, Pseudomonas aeruginosa PA01
gcagcggcggcgccg

SEQ ID NO: 3394405 - RNA, 19 nt, Pseudomonas aeruginosa PA01
gcagcggcggcgccggcag

SEQ ID NO: 3394406 - RNA, 18 nt, Pseudomonas aeruginosa PA01
gcagcggcgucugccgcu

SEQ ID NO: 3394407 - RNA, 18 nt, Pseudomonas aeruginosa PA01
gcagcggcucacgcccca

SEQ ID NO: 3394408 - RNA, 15 nt, Pseudomonas aeruginosa PA01
gcagcggcuggccgu

SEQ ID NO: 3394409 - RNA, 18 nt, Pseudomonas aeruginosa PA01
gcagcggcuggccgucga

SEQ ID NO: 3394410 - RNA, 20 nt, Pseudomonas aeruginosa PA01
gcagcggcuggccgucgacc

SEQ ID NO: 3394411 - RNA, 17 nt, Pseudomonas aeruginosa PA01
gcagcggcuguugccgg

SEQ ID NO: 3394412 - RNA, 18 nt, Pseudomonas aeruginosa PA01
gcaggaccacgcugguca

SEQ ID NO: 3394413 - RNA, 16 nt, Pseudomonas aeruginosa PA01
gcaggacccgcgacuc

SEQ ID NO: 3394414 - RNA, 13 nt, Pseudomonas aeruginosa PA01
gcaggaccuggcc

SEQ ID NO: 3394415 - RNA, 14 nt, Pseudomonas aeruginosa PA01
gcaggaccuggccg

SEQ ID NO: 3394416 - RNA, 17 nt, Pseudomonas aeruginosa PA01
gcaggaccuggcugagg

SEQ ID NO: 3394417 - RNA, 18 nt, Pseudomonas aeruginosa PA01
gcaggacgaagucgccgg

SEQ ID NO: 3394418 - RNA, 12 nt, Pseudomonas aeruginosa PA01
gcaggacgagga

SEQ ID NO: 3394419 - RNA, 19 nt, Pseudomonas aeruginosa PA01
gcaggacgaugaucaccag

SEQ ID NO: 3394420 - RNA, 19 nt, Pseudomonas aeruginosa PA01
gcaggacgccgaacccgcc

SEQ ID NO: 3394421 - RNA, 12 nt, Pseudomonas aeruginosa PA01
gcaggacggcga

SEQ ID NO: 3394422 - RNA, 16 nt, Pseudomonas aeruginosa PA01
gcaggacggcgacccg

SEQ ID NO: 3394423 - RNA, 19 nt, Pseudomonas aeruginosa PA01
gcaggacgucgaggucgac

SEQ ID NO: 3394424 - RNA, 21 nt, Pseudomonas aeruginosa PA01
gcaggacgucguagccaggca

SEQ ID NO: 3394425 - RNA, 23 nt, Pseudomonas aeruginosa PA01
gcaggacgucguagccaggcacc

SEQ ID NO: 3394426 - RNA, 18 nt, Pseudomonas aeruginosa PA01
gcaggagaagcgccucgc

SEQ ID NO: 3394427 - RNA, 22 nt, Pseudomonas aeruginosa PA01
gcaggagcaugucuucgucgcg

SEQ ID NO: 3394428 - RNA, 22 nt, Pseudomonas aeruginosa PA01
gcaggagcgccaucagcgacca

SEQ ID NO: 3394429 - RNA, 20 nt, Pseudomonas aeruginosa PA01
gcaggaggauacggcgcagc

SEQ ID NO: 3394430 - RNA, 19 nt, Pseudomonas aeruginosa PA01
gcaggauaucgcccagggc

SEQ ID NO: 3394431 - RNA, 20 nt, Pseudomonas aeruginosa PA01
gcaggauaucgcccagggcc

SEQ ID NO: 3394432 - RNA, 21 nt, Pseudomonas aeruginosa PA01
gcaggauaucgcccagggcca

SEQ ID NO: 3394433 - RNA, 14 nt, Pseudomonas aeruginosa PA01
gcaggaucaccugc

SEQ ID NO: 3394434 - RNA, 16 nt, Pseudomonas aeruginosa PA01
gcaggaucaccugcuu

SEQ ID NO: 3394435 - RNA, 16 nt, Pseudomonas aeruginosa PA01
gcaggaucaggcucga

SEQ ID NO: 3394436 - RNA, 23 nt, Pseudomonas aeruginosa PA01
gcaggaucaguucgugccaggcg

SEQ ID NO: 3394437 - RNA, 14 nt, Pseudomonas aeruginosa PA01
gcaggaucgacagc

SEQ ID NO: 3394438 - RNA, 16 nt, Pseudomonas aeruginosa PA01
gcaggaucgacagcag

SEQ ID NO: 3394439 - RNA, 17 nt, Pseudomonas aeruginosa PA01
gcaggaucgacagcagc

SEQ ID NO: 3394440 - RNA, 17 nt, Pseudomonas aeruginosa PA01
gcaggaucgagcccugg

SEQ ID NO: 3394441 - RNA, 18 nt, Pseudomonas aeruginosa PA01
gcaggaucgagcccuggu

SEQ ID NO: 3394442 - RNA, 17 nt, Pseudomonas aeruginosa PA01
gcaggaucggcgcgguc

SEQ ID NO: 3394443 - RNA, 22 nt, Pseudomonas aeruginosa PA01
gcaggaucugcugcaacauggc

SEQ ID NO: 3394444 - RNA, 15 nt, Pseudomonas aeruginosa PA01
gcaggaugcagucgg

SEQ ID NO: 3394445 - RNA, 14 nt, Pseudomonas aeruginosa PA01
gcaggaugccgcug

SEQ ID NO: 3394446 - RNA, 19 nt, Pseudomonas aeruginosa PA01
gcaggaugcugcacagcca

SEQ ID NO: 3394447 - RNA, 21 nt, Pseudomonas aeruginosa PA01
gcaggcaaaaaaaaggggcgg

SEQ ID NO: 3394448 - RNA, 21 nt, Pseudomonas aeruginosa PA01
gcaggcaaaaagaaaccccgc

SEQ ID NO: 3394449 - RNA, 16 nt, Pseudomonas aeruginosa PA01
gcaggcacagggcgac

SEQ ID NO: 3394450 - RNA, 13 nt, Pseudomonas aeruginosa PA01
gcaggcacccgcg

SEQ ID NO: 3394451 - RNA, 20 nt, Pseudomonas aeruginosa PA01
gcaggcacgcugccagcagg

SEQ ID NO: 3394452 - RNA, 21 nt, Pseudomonas aeruginosa PA01
gcaggcacgcugccagcaggc

SEQ ID NO: 3394453 - RNA, 22 nt, Pseudomonas aeruginosa PA01
gcaggcacgcugccagcaggcc

SEQ ID NO: 3394454 - RNA, 18 nt, Pseudomonas aeruginosa PA01
gcaggcacggaagcgcug

SEQ ID NO: 3394455 - RNA, 15 nt, Pseudomonas aeruginosa PA01
gcaggcagcacaugc

SEQ ID NO: 3394456 - RNA, 20 nt, Pseudomonas aeruginosa PA01
gcaggcagcacaugccacgc

SEQ ID NO: 3394457 - RNA, 15 nt, Pseudomonas aeruginosa PA01
gcaggcagcgcgcgu

SEQ ID NO: 3394458 - RNA, 13 nt, Pseudomonas aeruginosa PA01
gcaggcaggucgc

SEQ ID NO: 3394459 - RNA, 14 nt, Pseudomonas aeruginosa PA01
gcaggcaggucgcu

SEQ ID NO: 3394460 - RNA, 19 nt, Pseudomonas aeruginosa PA01
gcaggcagucccagaaggc

SEQ ID NO: 3394461 - RNA, 23 nt, Pseudomonas aeruginosa PA01
gcaggcagucccagaaggccagg

SEQ ID NO: 3394462 - RNA, 17 nt, Pseudomonas aeruginosa PA01
gcaggcagugccgggcg

SEQ ID NO: 3394463 - RNA, 18 nt, Pseudomonas aeruginosa PA01
gcaggcaguggcgccagc

SEQ ID NO: 3394464 - RNA, 20 nt, Pseudomonas aeruginosa PA01
gcaggcaguggcgccagcca

SEQ ID NO: 3394465 - RNA, 22 nt, Pseudomonas aeruginosa PA01
gcaggcaguggcgccagccagc

SEQ ID NO: 3394466 - RNA, 18 nt, Pseudomonas aeruginosa PA01
gcaggcaugcggccccgg

SEQ ID NO: 3394467 - RNA, 18 nt, Pseudomonas aeruginosa PA01
gcaggccacgcaccagcu

SEQ ID NO: 3394468 - RNA, 22 nt, Pseudomonas aeruginosa PA01
gcaggccacgcaccagcucccg

SEQ ID NO: 3394469 - RNA, 23 nt, Pseudomonas aeruginosa PA01
gcaggccacgcaccagcucccgg

SEQ ID NO: 3394470 - RNA, 17 nt, Pseudomonas aeruginosa PA01
gcaggccacggccgcug

SEQ ID NO: 3394471 - RNA, 14 nt, Pseudomonas aeruginosa PA01
gcaggccagcgcca

SEQ ID NO: 3394472 - RNA, 16 nt, Pseudomonas aeruginosa PA01
gcaggccagcgccagg

SEQ ID NO: 3394473 - RNA, 17 nt, Pseudomonas aeruginosa PA01
gcaggccagcgccaggu

SEQ ID NO: 3394474 - RNA, 20 nt, Pseudomonas aeruginosa PA01
gcaggccagcgccagguugg

SEQ ID NO: 3394475 - RNA, 12 nt, Pseudomonas aeruginosa PA01
gcaggccaggcc

SEQ ID NO: 3394476 - RNA, 13 nt, Pseudomonas aeruginosa PA01
gcaggccaggccc

SEQ ID NO: 3394477 - RNA, 14 nt, Pseudomonas aeruginosa PA01
gcaggccaggcccc

SEQ ID NO: 3394478 - RNA, 17 nt, Pseudomonas aeruginosa PA01
gcaggccaggccccagg

SEQ ID NO: 3394479 - RNA, 20 nt, Pseudomonas aeruginosa PA01
gcaggccaggccccagggcc

SEQ ID NO: 3394480 - RNA, 14 nt, Pseudomonas aeruginosa PA01
gcaggccaggcgca

SEQ ID NO: 3394481 - RNA, 12 nt, Pseudomonas aeruginosa PA01
gcaggccagggc

SEQ ID NO: 3394482 - RNA, 20 nt, Pseudomonas aeruginosa PA01
gcaggccaugggugucggcg

SEQ ID NO: 3394483 - RNA, 21 nt, Pseudomonas aeruginosa PA01
gcaggccaugggugucggcga

SEQ ID NO: 3394484 - RNA, 22 nt, Pseudomonas aeruginosa PA01
gcaggccaugggugucggcgau

SEQ ID NO: 3394485 - RNA, 23 nt, Pseudomonas aeruginosa PA01
gcaggccaugggugucggcgauc

SEQ ID NO: 3394486 - RNA, 22 nt, Pseudomonas aeruginosa PA01
gcaggcccagccauugcgccag

SEQ ID NO: 3394487 - RNA, 20 nt, Pseudomonas aeruginosa PA01
gcaggcccaugauggucggc

SEQ ID NO: 3394488 - RNA, 21 nt, Pseudomonas aeruginosa PA01
gcaggcccaugauggucggca

SEQ ID NO: 3394489 - RNA, 22 nt, Pseudomonas aeruginosa PA01
gcaggcccaugauggucggcac

SEQ ID NO: 3394490 - RNA, 22 nt, Pseudomonas aeruginosa PA01
gcaggccccuugcgcuguuccg

SEQ ID NO: 3394491 - RNA, 16 nt, Pseudomonas aeruginosa PA01
gcaggcccgagccgga

SEQ ID NO: 3394492 - RNA, 18 nt, Pseudomonas aeruginosa PA01
gcaggcccgagccggacg

SEQ ID NO: 3394493 - RNA, 19 nt, Pseudomonas aeruginosa PA01
gcaggcccgagccggacga

SEQ ID NO: 3394494 - RNA, 16 nt, Pseudomonas aeruginosa PA01
gcaggcccggccgccu

SEQ ID NO: 3394495 - RNA, 17 nt, Pseudomonas aeruginosa PA01
gcaggcccggccgccug

SEQ ID NO: 3394496 - RNA, 12 nt, Pseudomonas aeruginosa PA01
gcaggcccugcc

SEQ ID NO: 3394497 - RNA, 22 nt, Pseudomonas aeruginosa PA01
gcaggccgaagcgugggcggcc

SEQ ID NO: 3394498 - RNA, 14 nt, Pseudomonas aeruginosa PA01
gcaggccgaaggcc

SEQ ID NO: 3394499 - RNA, 16 nt, Pseudomonas aeruginosa PA01
gcaggccgaaggccag

SEQ ID NO: 3394500 - RNA, 22 nt, Pseudomonas aeruginosa PA01
gcaggccgaaggccaggaccgc

SEQ ID NO: 3394501 - RNA, 18 nt, Pseudomonas aeruginosa PA01
gcaggccgaauccgccgg

SEQ ID NO: 3394502 - RNA, 21 nt, Pseudomonas aeruginosa PA01
gcaggccgaauccgccggcga

SEQ ID NO: 3394503 - RNA, 22 nt, Pseudomonas aeruginosa PA01
gcaggccgaauccgccggcgau

SEQ ID NO: 3394504 - RNA, 24 nt, Pseudomonas aeruginosa PA01
gcaggccgaauccgccggcgaugc

SEQ ID NO: 3394505 - RNA, 13 nt, Pseudomonas aeruginosa PA01
gcaggccgaccuc

SEQ ID NO: 3394506 - RNA, 12 nt, Pseudomonas aeruginosa PA01
gcaggccgacgg

SEQ ID NO: 3394507 - RNA, 17 nt, Pseudomonas aeruginosa PA01
gcaggccgacggcgcgc

SEQ ID NO: 3394508 - RNA, 20 nt, Pseudomonas aeruginosa PA01
gcaggccgacggcgcgcugc

SEQ ID NO: 3394509 - RNA, 23 nt, Pseudomonas aeruginosa PA01
gcaggccgacggcgcgcugcgug

SEQ ID NO: 3394510 - RNA, 17 nt, Pseudomonas aeruginosa PA01
gcaggccgacguagccg

SEQ ID NO: 3394511 - RNA, 24 nt, Pseudomonas aeruginosa PA01
gcaggccgagaagguucucggcca

SEQ ID NO: 3394512 - RNA, 17 nt, Pseudomonas aeruginosa PA01
gcaggccgaggaggacg

SEQ ID NO: 3394513 - RNA, 17 nt, Pseudomonas aeruginosa PA01
gcaggccgaggccggcg

SEQ ID NO: 3394514 - RNA, 15 nt, Pseudomonas aeruginosa PA01
gcaggcggccguccu

SEQ ID NO: 3394515 - RNA, 12 nt, Pseudomonas aeruginosa PA01
gcaggcggcugg

SEQ ID NO: 3394516 - RNA, 15 nt, Pseudomonas aeruginosa PA01
gcaggcggcuggcgc

SEQ ID NO: 3394517 - RNA, 15 nt, Pseudomonas aeruginosa PA01
gcaggcgggcggcgu

SEQ ID NO: 3394518 - RNA, 17 nt, Pseudomonas aeruginosa PA01
gcaggcgguagcgccgc

SEQ ID NO: 3394519 - RNA, 19 nt, Pseudomonas aeruginosa PA01
gcaggcgguagcgccgcgc

SEQ ID NO: 3394520 - RNA, 16 nt, Pseudomonas aeruginosa PA01
gcaggcggucagcgcg

SEQ ID NO: 3394521 - RNA, 14 nt, Pseudomonas aeruginosa PA01
gcaggcggucgccg

SEQ ID NO: 3394522 - RNA, 22 nt, Pseudomonas aeruginosa PA01
gcaggcggucggaaagcagggc

SEQ ID NO: 3394523 - RNA, 21 nt, Pseudomonas aeruginosa PA01
gcaggcggucggccaucuggc

SEQ ID NO: 3394524 - RNA, 16 nt, Pseudomonas aeruginosa PA01
gcaggcguuauccgcc

SEQ ID NO: 3394525 - RNA, 15 nt, Pseudomonas aeruginosa PA01
gcaggcguucggcga

SEQ ID NO: 3394526 - RNA, 19 nt, Pseudomonas aeruginosa PA01
gcaggcguugcagugcgcc

SEQ ID NO: 3394527 - RNA, 23 nt, Pseudomonas aeruginosa PA01
gcaggcguugcagugcgccgcag

SEQ ID NO: 3394528 - RNA, 17 nt, Pseudomonas aeruginosa PA01
gcaggcucacgcguucg

SEQ ID NO: 3394529 - RNA, 22 nt, Pseudomonas aeruginosa PA01
gcaggcucacgcguucggcgau

SEQ ID NO: 3394530 - RNA, 24 nt, Pseudomonas aeruginosa PA01
gcaggcucacgcguucggcgaugc

SEQ ID NO: 3394531 - RNA, 14 nt, Pseudomonas aeruginosa PA01
gcaggcucagcgca

SEQ ID NO: 3394532 - RNA, 15 nt, Pseudomonas aeruginosa PA01
gcaggcucagcgcau

SEQ ID NO: 3394533 - RNA, 19 nt, Pseudomonas aeruginosa PA01
gcaggcucaguucggccag

SEQ ID NO: 3394534 - RNA, 23 nt, Pseudomonas aeruginosa PA01
gcaggcucaguucggccagcggc

SEQ ID NO: 3394535 - RNA, 18 nt, Pseudomonas aeruginosa PA01
gcaggcucaucgcccgcc

SEQ ID NO: 3394536 - RNA, 16 nt, Pseudomonas aeruginosa PA01
gcaggcucaugcccag

SEQ ID NO: 3394537 - RNA, 17 nt, Pseudomonas aeruginosa PA01
gcaggcucaugcccagc

SEQ ID NO: 3394538 - RNA, 19 nt, Pseudomonas aeruginosa PA01
gcaggcucgacaggucggc

SEQ ID NO: 3394539 - RNA, 20 nt, Pseudomonas aeruginosa PA01
gcaggcucgacaggucggcg

SEQ ID NO: 3394540 - RNA, 15 nt, Pseudomonas aeruginosa PA01
gcaggcucucgcgca

SEQ ID NO: 3394541 - RNA, 16 nt, Pseudomonas aeruginosa PA01
gcaggcucucgcgcag

SEQ ID NO: 3394542 - RNA, 17 nt, Pseudomonas aeruginosa PA01
gcaggcucucgcgcagc

SEQ ID NO: 3394543 - RNA, 18 nt, Pseudomonas aeruginosa PA01
gcaggcucucgcgcagca

SEQ ID NO: 3394544 - RNA, 12 nt, Pseudomonas aeruginosa PA01
gcaggcugccga

SEQ ID NO: 3394545 - RNA, 16 nt, Pseudomonas aeruginosa PA01
gcaggcugccggacgc

SEQ ID NO: 3394546 - RNA, 19 nt, Pseudomonas aeruginosa PA01
gcaggcugccguccaggcg

SEQ ID NO: 3394547 - RNA, 14 nt, Pseudomonas aeruginosa PA01
gcaggcugccguug

SEQ ID NO: 3394548 - RNA, 13 nt, Pseudomonas aeruginosa PA01
gcaggcugccuuc

SEQ ID NO: 3394549 - RNA, 18 nt, Pseudomonas aeruginosa PA01
gcaggcugccuucgacgu

SEQ ID NO: 3394550 - RNA, 15 nt, Pseudomonas aeruginosa PA01
gcaggcugcgccgcu

SEQ ID NO: 3394551 - RNA, 17 nt, Pseudomonas aeruginosa PA01
gcaggcugcgccgcugc

SEQ ID NO: 3394552 - RNA, 20 nt, Pseudomonas aeruginosa PA01
gcaggcuggccgagcgccgc

SEQ ID NO: 3394553 - RNA, 24 nt, Pseudomonas aeruginosa PA01
gcaggcuggcguugacugccugca

SEQ ID NO: 3394554 - RNA, 20 nt, Pseudomonas aeruginosa PA01
gcaggcugguaugcagcaac

SEQ ID NO: 3394555 - RNA, 21 nt, Pseudomonas aeruginosa PA01
gcaggcugguaugcagcaacc

SEQ ID NO: 3394556 - RNA, 24 nt, Pseudomonas aeruginosa PA01
gcaggcuguacagcaggagcgcca

SEQ ID NO: 3394557 - RNA, 16 nt, Pseudomonas aeruginosa PA01
gcaggcugucggccag

SEQ ID NO: 3394558 - RNA, 17 nt, Pseudomonas aeruginosa PA01
gcaggcugugccauucc

SEQ ID NO: 3394559 - RNA, 22 nt, Pseudomonas aeruginosa PA01
gcaggcuuggucagggucgagu

SEQ ID NO: 3394560 - RNA, 19 nt, Pseudomonas aeruginosa PA01
gcaggcuuuccagcccggc

SEQ ID NO: 3394561 - RNA, 16 nt, Pseudomonas aeruginosa PA01
gcagggaaggcgcgcu

SEQ ID NO: 3394562 - RNA, 18 nt, Pseudomonas aeruginosa PA01
gcagggagaaccaggcgg

SEQ ID NO: 3394563 - RNA, 17 nt, Pseudomonas aeruginosa PA01
gcagggaggagggcgag

SEQ ID NO: 3394564 - RNA, 13 nt, Pseudomonas aeruginosa PA01
gcagggaggcgca

SEQ ID NO: 3394565 - RNA, 22 nt, Pseudomonas aeruginosa PA01
gcagggaggcgcacaucacccg

SEQ ID NO: 3394566 - RNA, 16 nt, Pseudomonas aeruginosa PA01
gcagggaguccgccag

SEQ ID NO: 3394567 - RNA, 22 nt, Pseudomonas aeruginosa PA01
gcagggauuccgggucgaggcu

SEQ ID NO: 3394568 - RNA, 13 nt, Pseudomonas aeruginosa PA01
gcagggcacagcc

SEQ ID NO: 3394569 - RNA, 14 nt, Pseudomonas aeruginosa PA01
gcagggcacagcca

SEQ ID NO: 3394570 - RNA, 23 nt, Pseudomonas aeruginosa PA01
gcagggcagccgccgcggcaccg

SEQ ID NO: 3394571 - RNA, 13 nt, Pseudomonas aeruginosa PA01
gcagggcagcggc

SEQ ID NO: 3394572 - RNA, 15 nt, Pseudomonas aeruginosa PA01
gcagggcaucgacga

SEQ ID NO: 3394573 - RNA, 18 nt, Pseudomonas aeruginosa PA01
gcagggccagcaacaggc

SEQ ID NO: 3394574 - RNA, 15 nt, Pseudomonas aeruginosa PA01
gcagggccagcagcg

SEQ ID NO: 3394575 - RNA, 13 nt, Pseudomonas aeruginosa PA01
gcagggccagcca

SEQ ID NO: 3394576 - RNA, 14 nt, Pseudomonas aeruginosa PA01
gcagggccagcgcc

SEQ ID NO: 3394577 - RNA, 18 nt, Pseudomonas aeruginosa PA01
gcagggccagcgccuggc

SEQ ID NO: 3394578 - RNA, 21 nt, Pseudomonas aeruginosa PA01
gcagggccagcgccuggcgca

SEQ ID NO: 3394579 - RNA, 11 nt, Pseudomonas aeruginosa PA01
gcagggccagg

SEQ ID NO: 3394580 - RNA, 13 nt, Pseudomonas aeruginosa PA01
gcagggccaggcc

SEQ ID NO: 3394581 - RNA, 18 nt, Pseudomonas aeruginosa PA01
gcagggccaggccgagcg

SEQ ID NO: 3394582 - RNA, 20 nt, Pseudomonas aeruginosa PA01
gcagggcccauuccacgugc

SEQ ID NO: 3394583 - RNA, 20 nt, Pseudomonas aeruginosa PA01
gcagggccgagcgcagcgcc

SEQ ID NO: 3394584 - RNA, 22 nt, Pseudomonas aeruginosa PA01
gcagggccgccagccgccagga

SEQ ID NO: 3394585 - RNA, 12 nt, Pseudomonas aeruginosa PA01
gcagggccgccg

SEQ ID NO: 3394586 - RNA, 15 nt, Pseudomonas aeruginosa PA01
gcagggccgccgagg

SEQ ID NO: 3394587 - RNA, 16 nt, Pseudomonas aeruginosa PA01
gcagggccgccgaggu

SEQ ID NO: 3394588 - RNA, 14 nt, Pseudomonas aeruginosa PA01
gcagggccgcggcg

SEQ ID NO: 3394589 - RNA, 15 nt, Pseudomonas aeruginosa PA01
gcagggccgcggcgg

SEQ ID NO: 3394590 - RNA, 23 nt, Pseudomonas aeruginosa PA01
gcagggccgcggcggauaacgcc

SEQ ID NO: 3394591 - RNA, 23 nt, Pseudomonas aeruginosa PA01
gcagggccgcggcguugucggcc

SEQ ID NO: 3394592 - RNA, 13 nt, Pseudomonas aeruginosa PA01
gcagggccucgcu

SEQ ID NO: 3394593 - RNA, 21 nt, Pseudomonas aeruginosa PA01
gcagggcgauccagaagauca

SEQ ID NO: 3394594 - RNA, 18 nt, Pseudomonas aeruginosa PA01
gcagggcgauccgcccgc

SEQ ID NO: 3394595 - RNA, 21 nt, Pseudomonas aeruginosa PA01
gcagggcgauccgcccgcaug

SEQ ID NO: 3394596 - RNA, 17 nt, Pseudomonas aeruginosa PA01
gcagggcgaugccgaug

SEQ ID NO: 3394597 - RNA, 22 nt, Pseudomonas aeruginosa PA01
gcagggcgaugccgauggcgcc

SEQ ID NO: 3394598 - RNA, 16 nt, Pseudomonas aeruginosa PA01
gcagggcgcaaccugg

SEQ ID NO: 3394599 - RNA, 20 nt, Pseudomonas aeruginosa PA01
gcagggcgcaaccugguuca

SEQ ID NO: 3394600 - RNA, 13 nt, Pseudomonas aeruginosa PA01
gcagggcgcccgc

SEQ ID NO: 3394601 - RNA, 14 nt, Pseudomonas aeruginosa PA01
gcagggcgcccgcc

SEQ ID NO: 3394602 - RNA, 22 nt, Pseudomonas aeruginosa PA01
gcagggcgccgucgggggcgcg

SEQ ID NO: 3394603 - RNA, 17 nt, Pseudomonas aeruginosa PA01
gcagggcgcguccagcu

SEQ ID NO: 3394604 - RNA, 12 nt, Pseudomonas aeruginosa PA01
gcagggcgcuga

SEQ ID NO: 3394605 - RNA, 18 nt, Pseudomonas aeruginosa PA01
gcagggcgcugagcgcgg

SEQ ID NO: 3394606 - RNA, 22 nt, Pseudomonas aeruginosa PA01
gcagggcggauaaucgcagcgc

SEQ ID NO: 3394607 - RNA, 14 nt, Pseudomonas aeruginosa PA01
gcagggcggcgaug

SEQ ID NO: 3394608 - RNA, 20 nt, Pseudomonas aeruginosa PA01
gcagggcggcgaugaccagg

SEQ ID NO: 3394609 - RNA, 13 nt, Pseudomonas aeruginosa PA01
gcagggcggcgcc

SEQ ID NO: 3394610 - RNA, 17 nt, Pseudomonas aeruginosa PA01
gcagggcggcgccugga

SEQ ID NO: 3394611 - RNA, 20 nt, Pseudomonas aeruginosa PA01
gcagggcggcgccuggagca

SEQ ID NO: 3394612 - RNA, 16 nt, Pseudomonas aeruginosa PA01
gcagggcggcgcugug

SEQ ID NO: 3394613 - RNA, 21 nt, Pseudomonas aeruginosa PA01
gcagggcguccaguagcgccu

SEQ ID NO: 3394614 - RNA, 21 nt, Pseudomonas aeruginosa PA01
gcagggcgucccguuccggcg

SEQ ID NO: 3394615 - RNA, 21 nt, Pseudomonas aeruginosa PA01
gcagggcgucgaaggcggcgc

SEQ ID NO: 3394616 - RNA, 21 nt, Pseudomonas aeruginosa PA01
gcagguccgacggaaauaggc

SEQ ID NO: 3394617 - RNA, 24 nt, Pseudomonas aeruginosa PA01
gcagguccgcgccucgcgcaacgc

SEQ ID NO: 3394618 - RNA, 20 nt, Pseudomonas aeruginosa PA01
gcagguccggguugucguug

SEQ ID NO: 3394619 - RNA, 16 nt, Pseudomonas aeruginosa PA01
gcaggucgagcaguuc

SEQ ID NO: 3394620 - RNA, 18 nt, Pseudomonas aeruginosa PA01
gcaggucgagcaguuccg

SEQ ID NO: 3394621 - RNA, 16 nt, Pseudomonas aeruginosa PA01
gcaggucgcgacaggu

SEQ ID NO: 3394622 - RNA, 20 nt, Pseudomonas aeruginosa PA01
gcaggucgcgcggcgccugc

SEQ ID NO: 3394623 - RNA, 18 nt, Pseudomonas aeruginosa PA01
gcaggucgcggccccagc

SEQ ID NO: 3394624 - RNA, 14 nt, Pseudomonas aeruginosa PA01
gcaggucgcggugc

SEQ ID NO: 3394625 - RNA, 13 nt, Pseudomonas aeruginosa PA01
gcaggucgcugcc

SEQ ID NO: 3394626 - RNA, 22 nt, Pseudomonas aeruginosa PA01
gcaggucgcugcccucgaccag

SEQ ID NO: 3394627 - RNA, 24 nt, Pseudomonas aeruginosa PA01
gcaggucgcugcccucgaccaggu

SEQ ID NO: 3394628 - RNA, 14 nt, Pseudomonas aeruginosa PA01
gcaggucgcuggcg

SEQ ID NO: 3394629 - RNA, 15 nt, Pseudomonas aeruginosa PA01
gcaggucgcuggcgu

SEQ ID NO: 3394630 - RNA, 22 nt, Pseudomonas aeruginosa PA01
gcaggucgcuggcgucgaccgc

SEQ ID NO: 3394631 - RNA, 15 nt, Pseudomonas aeruginosa PA01
gcaggucggacaggc

SEQ ID NO: 3394632 - RNA, 15 nt, Pseudomonas aeruginosa PA01
gcaggucggcagcgu

SEQ ID NO: 3394633 - RNA, 18 nt, Pseudomonas aeruginosa PA01
gcaggucggccucggcga

SEQ ID NO: 3394634 - RNA, 13 nt, Pseudomonas aeruginosa PA01
gcaggucggccug

SEQ ID NO: 3394635 - RNA, 21 nt, Pseudomonas aeruginosa PA01
gcaggucggcgcgacggccca

SEQ ID NO: 3394636 - RNA, 13 nt, Pseudomonas aeruginosa PA01
gcaggucgucggc

SEQ ID NO: 3394637 - RNA, 19 nt, Pseudomonas aeruginosa PA01
gcaggucgucggcgaaagc

SEQ ID NO: 3394638 - RNA, 15 nt, Pseudomonas aeruginosa PA01
gcaggucgugcugga

SEQ ID NO: 3394639 - RNA, 20 nt, Pseudomonas aeruginosa PA01
gcaggucguugacgaucugc

SEQ ID NO: 3394640 - RNA, 21 nt, Pseudomonas aeruginosa PA01
gcaggucucaccgcccugcgc

SEQ ID NO: 3394641 - RNA, 16 nt, Pseudomonas aeruginosa PA01
gcaggucucgacgcgc

SEQ ID NO: 3394642 - RNA, 21 nt, Pseudomonas aeruginosa PA01
gcaggucuuccaccgcgucga

SEQ ID NO: 3394643 - RNA, 15 nt, Pseudomonas aeruginosa PA01
gcaggugcaccgcgc

SEQ ID NO: 3394644 - RNA, 19 nt, Pseudomonas aeruginosa PA01
gcaggugcaccgcgcugga

SEQ ID NO: 3394645 - RNA, 22 nt, Pseudomonas aeruginosa PA01
gcaggugcaccgcgcuggagac

SEQ ID NO: 3394646 - RNA, 16 nt, Pseudomonas aeruginosa PA01
gcaggugcccuggcag

SEQ ID NO: 3394647 - RNA, 19 nt, Pseudomonas aeruginosa PA01
gcaggugcccuggcagacg

SEQ ID NO: 3394648 - RNA, 19 nt, Pseudomonas aeruginosa PA01
gcaggugccgcucguccag

SEQ ID NO: 3394649 - RNA, 20 nt, Pseudomonas aeruginosa PA01
gcaggugcuuggcaccgcgc

SEQ ID NO: 3394650 - RNA, 16 nt, Pseudomonas aeruginosa PA01
gcagguggacggcauu

SEQ ID NO: 3394651 - RNA, 14 nt, Pseudomonas aeruginosa PA01
gcagguggccggaa

SEQ ID NO: 3394652 - RNA, 17 nt, Pseudomonas aeruginosa PA01
gcagguggcgcacugcc

SEQ ID NO: 3394653 - RNA, 18 nt, Pseudomonas aeruginosa PA01
gcagguggcgcacugcca

SEQ ID NO: 3394654 - RNA, 21 nt, Pseudomonas aeruginosa PA01
gcagguggcgcacugccagga

SEQ ID NO: 3394655 - RNA, 22 nt, Pseudomonas aeruginosa PA01
gcagguggcgcagccguccauc

SEQ ID NO: 3394656 - RNA, 14 nt, Pseudomonas aeruginosa PA01
gcagguggcuggcc

SEQ ID NO: 3394657 - RNA, 16 nt, Pseudomonas aeruginosa PA01
gcagguggcuggucag

SEQ ID NO: 3394658 - RNA, 19 nt, Pseudomonas aeruginosa PA01
gcagguggucguugcgcgc

SEQ ID NO: 3394659 - RNA, 22 nt, Pseudomonas aeruginosa PA01
gcagguguucgcaaagcucgcg

SEQ ID NO: 3394660 - RNA, 16 nt, Pseudomonas aeruginosa PA01
gcagguguucggcggc

SEQ ID NO: 3394661 - RNA, 18 nt, Pseudomonas aeruginosa PA01
gcagguguucggcggcgu

SEQ ID NO: 3394662 - RNA, 19 nt, Pseudomonas aeruginosa PA01
gcagguguucggcggcgug

SEQ ID NO: 3394663 - RNA, 21 nt, Pseudomonas aeruginosa PA01
gcagguucaccgccucggaga

SEQ ID NO: 3394664 - RNA, 19 nt, Pseudomonas aeruginosa PA01
gcagguucagcaggucgcg

SEQ ID NO: 3394665 - RNA, 21 nt, Pseudomonas aeruginosa PA01
gcagguucaucgccgccaggc

SEQ ID NO: 3394666 - RNA, 22 nt, Pseudomonas aeruginosa PA01
gcagguucaucgccgccaggca

SEQ ID NO: 3394667 - RNA, 23 nt, Pseudomonas aeruginosa PA01
gcagguucaucgccgccaggcag

SEQ ID NO: 3394668 - RNA, 20 nt, Pseudomonas aeruginosa PA01
gcagguucgaaugcugcccg

SEQ ID NO: 3394669 - RNA, 16 nt, Pseudomonas aeruginosa PA01
gcagguugaccccgcg

SEQ ID NO: 3394670 - RNA, 18 nt, Pseudomonas aeruginosa PA01
gcagguugaccccgcggc

SEQ ID NO: 3394671 - RNA, 22 nt, Pseudomonas aeruginosa PA01
gcagguugaugugcaguucgac

SEQ ID NO: 3394672 - RNA, 16 nt, Pseudomonas aeruginosa PA01
gcagguugcacggccg

SEQ ID NO: 3394673 - RNA, 14 nt, Pseudomonas aeruginosa PA01
gcagguugcgcugg

SEQ ID NO: 3394674 - RNA, 17 nt, Pseudomonas aeruginosa PA01
gcagguugcgcuggcgc

SEQ ID NO: 3394675 - RNA, 18 nt, Pseudomonas aeruginosa PA01
gcagguugcgcuggcgca

SEQ ID NO: 3394676 - RNA, 20 nt, Pseudomonas aeruginosa PA01
gcagguugcgcuggcgcagc

SEQ ID NO: 3394677 - RNA, 16 nt, Pseudomonas aeruginosa PA01
gcagguugcgggagca

SEQ ID NO: 3394678 - RNA, 13 nt, Pseudomonas aeruginosa PA01
gcagguuggcccc

SEQ ID NO: 3394679 - RNA, 14 nt, Pseudomonas aeruginosa PA01
gcagguuggccccg

SEQ ID NO: 3394680 - RNA, 16 nt, Pseudomonas aeruginosa PA01
gcagguuguccagggc

SEQ ID NO: 3394681 - RNA, 17 nt, Pseudomonas aeruginosa PA01
gcagguuguccagggca

SEQ ID NO: 3394682 - RNA, 18 nt, Pseudomonas aeruginosa PA01
gcagguuguccagggcau

SEQ ID NO: 3394683 - RNA, 20 nt, Pseudomonas aeruginosa PA01
gcagguugugguugggcagg

SEQ ID NO: 3394684 - RNA, 18 nt, Pseudomonas aeruginosa PA01
gcagguuguucgccgcag

SEQ ID NO: 3394685 - RNA, 19 nt, Pseudomonas aeruginosa PA01
gcaguaacgccugucgcuc

SEQ ID NO: 3394686 - RNA, 20 nt, Pseudomonas aeruginosa PA01
gcaguacagcucggcgcccu

SEQ ID NO: 3394687 - RNA, 16 nt, Pseudomonas aeruginosa PA01
gcaguacccggccgcc

SEQ ID NO: 3394688 - RNA, 20 nt, Pseudomonas aeruginosa PA01
gcaguaccugcucacggccg

SEQ ID NO: 3394689 - RNA, 14 nt, Pseudomonas aeruginosa PA01
gcaguacgaucagc

SEQ ID NO: 3394690 - RNA, 14 nt, Pseudomonas aeruginosa PA01
gcaguacgcucugg

SEQ ID NO: 3394691 - RNA, 19 nt, Pseudomonas aeruginosa PA01
gcaguacucaugaccgccg

SEQ ID NO: 3394692 - RNA, 15 nt, Pseudomonas aeruginosa PA01
gcaguacuuggccag

SEQ ID NO: 3394693 - RNA, 12 nt, Pseudomonas aeruginosa PA01
gcaguagcugga

SEQ ID NO: 3394694 - RNA, 15 nt, Pseudomonas aeruginosa PA01
gcaguaggccuggua

SEQ ID NO: 3394695 - RNA, 16 nt, Pseudomonas aeruginosa PA01
gcaguaggcgcugccg

SEQ ID NO: 3394696 - RNA, 13 nt, Pseudomonas aeruginosa PA01
gcaguccaggccg

SEQ ID NO: 3394697 - RNA, 19 nt, Pseudomonas aeruginosa PA01
gcagucccagaaggccagg

SEQ ID NO: 3394698 - RNA, 22 nt, Pseudomonas aeruginosa PA01
gcagucccagaaggccagggca

SEQ ID NO: 3394699 - RNA, 23 nt, Pseudomonas aeruginosa PA01
gcagucccagaaggccagggcau

SEQ ID NO: 3394700 - RNA, 20 nt, Pseudomonas aeruginosa PA01
gcagucccgccaggcgccga

SEQ ID NO: 3394701 - RNA, 14 nt, Pseudomonas aeruginosa PA01
gcagucccgcgcgg

SEQ ID NO: 3394702 - RNA, 19 nt, Pseudomonas aeruginosa PA01
gcagucccugccaggggcu

SEQ ID NO: 3394703 - RNA, 15 nt, Pseudomonas aeruginosa PA01
gcaguccgguagcgc

SEQ ID NO: 3394704 - RNA, 16 nt, Pseudomonas aeruginosa PA01
gcaguccucgccguug

SEQ ID NO: 3394705 - RNA, 20 nt, Pseudomonas aeruginosa PA01
gcaguccucgccguuggcga

SEQ ID NO: 3394706 - RNA, 13 nt, Pseudomonas aeruginosa PA01
gcaguccuggcgg

SEQ ID NO: 3394707 - RNA, 15 nt, Pseudomonas aeruginosa PA01
gcaguccuggcggua

SEQ ID NO: 3394708 - RNA, 22 nt, Pseudomonas aeruginosa PA01
gcaguccuggcgguagcccggc

SEQ ID NO: 3394709 - RNA, 17 nt, Pseudomonas aeruginosa PA01
gcagucgcacagccagg

SEQ ID NO: 3394710 - RNA, 20 nt, Pseudomonas aeruginosa PA01
gcagucgcacagccaggggc

SEQ ID NO: 3394711 - RNA, 21 nt, Pseudomonas aeruginosa PA01
gcagucgcacagccaggggca

SEQ ID NO: 3394712 - RNA, 14 nt, Pseudomonas aeruginosa PA01
gcagucgcagcucg

SEQ ID NO: 3394713 - RNA, 16 nt, Pseudomonas aeruginosa PA01
gcagucgccgcaccgg

SEQ ID NO: 3394714 - RNA, 22 nt, Pseudomonas aeruginosa PA01
gcagucgccgccaguucggcca

SEQ ID NO: 3394715 - RNA, 18 nt, Pseudomonas aeruginosa PA01
gcagucgcggaagcggca

SEQ ID NO: 3394716 - RNA, 21 nt, Pseudomonas aeruginosa PA01
gcagucgcggaagcggcaaug

SEQ ID NO: 3394717 - RNA, 17 nt, Pseudomonas aeruginosa PA01
gcagucgcggcccuggu

SEQ ID NO: 3394718 - RNA, 13 nt, Pseudomonas aeruginosa PA01
gcauccuggcggu

SEQ ID NO: 3394719 - RNA, 14 nt, Pseudomonas aeruginosa PA01
gcaucgaaggcgcc

SEQ ID NO: 3394720 - RNA, 16 nt, Pseudomonas aeruginosa PA01
gcaucgaaggcgccgg

SEQ ID NO: 3394721 - RNA, 20 nt, Pseudomonas aeruginosa PA01
gcaucgaaggcgccggcaug

SEQ ID NO: 3394722 - RNA, 15 nt, Pseudomonas aeruginosa PA01
gcaucgaccagcagc

SEQ ID NO: 3394723 - RNA, 16 nt, Pseudomonas aeruginosa PA01
gcaucgaccuugcccu

SEQ ID NO: 3394724 - RNA, 14 nt, Pseudomonas aeruginosa PA01
gcaucgacgccagc

SEQ ID NO: 3394725 - RNA, 23 nt, Pseudomonas aeruginosa PA01
gcaucgacgccagcggcgaucgc

SEQ ID NO: 3394726 - RNA, 14 nt, Pseudomonas aeruginosa PA01
gcaucgaggccgcc

SEQ ID NO: 3394727 - RNA, 15 nt, Pseudomonas aeruginosa PA01
gcaucgaggccgccc

SEQ ID NO: 3394728 - RNA, 16 nt, Pseudomonas aeruginosa PA01
gcaucgaggccgccca

SEQ ID NO: 3394729 - RNA, 18 nt, Pseudomonas aeruginosa PA01
gcaucgaggccgcccagc

SEQ ID NO: 3394730 - RNA, 23 nt, Pseudomonas aeruginosa PA01
gcaucgaggccgcccagcgcagc

SEQ ID NO: 3394731 - RNA, 15 nt, Pseudomonas aeruginosa PA01
gcaucgaggccggca

SEQ ID NO: 3394732 - RNA, 16 nt, Pseudomonas aeruginosa PA01
gcaucgaggccggcau

SEQ ID NO: 3394733 - RNA, 18 nt, Pseudomonas aeruginosa PA01
gcaucgaggccggcaugc

SEQ ID NO: 3394734 - RNA, 14 nt, Pseudomonas aeruginosa PA01
gcaucgauccgcac

SEQ ID NO: 3394735 - RNA, 19 nt, Pseudomonas aeruginosa PA01
gcaucgaucuugcccaugu

SEQ ID NO: 3394736 - RNA, 21 nt, Pseudomonas aeruginosa PA01
gcaucgaugaccuucgaggug

SEQ ID NO: 3394737 - RNA, 18 nt, Pseudomonas aeruginosa PA01
gcaucgcaucggcgaccu

SEQ ID NO: 3394738 - RNA, 23 nt, Pseudomonas aeruginosa PA01
gcaucgccaccgcggauccacgc

SEQ ID NO: 3394739 - RNA, 17 nt, Pseudomonas aeruginosa PA01
gcaucgccauggcgcug

SEQ ID NO: 3394740 - RNA, 18 nt, Pseudomonas aeruginosa PA01
gcaucgccauggcgcugc

SEQ ID NO: 3394741 - RNA, 12 nt, Pseudomonas aeruginosa PA01
gcaucgccgaca

SEQ ID NO: 3394742 - RNA, 13 nt, Pseudomonas aeruginosa PA01
gcaucgccgccca

SEQ ID NO: 3394743 - RNA, 15 nt, Pseudomonas aeruginosa PA01
gcaucgccgcccagu

SEQ ID NO: 3394744 - RNA, 14 nt, Pseudomonas aeruginosa PA01
gcaucgccggcagc

SEQ ID NO: 3394745 - RNA, 19 nt, Pseudomonas aeruginosa PA01
gcaucgccggcagcgccgc

SEQ ID NO: 3394746 - RNA, 21 nt, Pseudomonas aeruginosa PA01
gcaucgccggcagcgccgcgc

SEQ ID NO: 3394747 - RNA, 22 nt, Pseudomonas aeruginosa PA01
gcaucgccggcagcgccgcgcg

SEQ ID NO: 3394748 - RNA, 18 nt, Pseudomonas aeruginosa PA01
gcaucgccugggccggcg

SEQ ID NO: 3394749 - RNA, 20 nt, Pseudomonas aeruginosa PA01
gcaucgcgaaaacucccggc

SEQ ID NO: 3394750 - RNA, 21 nt, Pseudomonas aeruginosa PA01
gcaucgcgaaaacucccggcc

SEQ ID NO: 3394751 - RNA, 15 nt, Pseudomonas aeruginosa PA01
gcaucgcgacagggc

SEQ ID NO: 3394752 - RNA, 22 nt, Pseudomonas aeruginosa PA01
gcaucgcgcacaugccgagcga

SEQ ID NO: 3394753 - RNA, 20 nt, Pseudomonas aeruginosa PA01
gcaucgcggacaccgcggug

SEQ ID NO: 3394754 - RNA, 12 nt, Pseudomonas aeruginosa PA01
gcaucgcgggcg

SEQ ID NO: 3394755 - RNA, 16 nt, Pseudomonas aeruginosa PA01
gcaucgcgggcgugcu

SEQ ID NO: 3394756 - RNA, 23 nt, Pseudomonas aeruginosa PA01
gcaucgcgggcgugcuccagcac

SEQ ID NO: 3394757 - RNA, 18 nt, Pseudomonas aeruginosa PA01
gcaucgcucgcaacgcug

SEQ ID NO: 3394758 - RNA, 19 nt, Pseudomonas aeruginosa PA01
gcaucgcugaccucgagcu

SEQ ID NO: 3394759 - RNA, 15 nt, Pseudomonas aeruginosa PA01
gcaucggagaccacg

SEQ ID NO: 3394760 - RNA, 20 nt, Pseudomonas aeruginosa PA01
gcaucggccaccuucgcccg

SEQ ID NO: 3394761 - RNA, 18 nt, Pseudomonas aeruginosa PA01
gcaucggccauucggccu

SEQ ID NO: 3394762 - RNA, 13 nt, Pseudomonas aeruginosa PA01
gcaucggccgcca

SEQ ID NO: 3394763 - RNA, 13 nt, Pseudomonas aeruginosa PA01
gcaucggccggga

SEQ ID NO: 3394764 - RNA, 14 nt, Pseudomonas aeruginosa PA01
gcaucggccgggau

SEQ ID NO: 3394765 - RNA, 15 nt, Pseudomonas aeruginosa PA01
gcaucggcgccgcgc

SEQ ID NO: 3394766 - RNA, 13 nt, Pseudomonas aeruginosa PA01
gcaucggcgccuc

SEQ ID NO: 3394767 - RNA, 13 nt, Pseudomonas aeruginosa PA01
gcaucggcgcgcc

SEQ ID NO: 3394768 - RNA, 14 nt, Pseudomonas aeruginosa PA01
gcaucggcgcgccg

SEQ ID NO: 3394769 - RNA, 15 nt, Pseudomonas aeruginosa PA01
gcaucggcgcgccga

SEQ ID NO: 3394770 - RNA, 17 nt, Pseudomonas aeruginosa PA01
gcaucggcucggcaagc

SEQ ID NO: 3394771 - RNA, 22 nt, Pseudomonas aeruginosa PA01
gcaucggugaccugguagucgc

SEQ ID NO: 3394772 - RNA, 16 nt, Pseudomonas aeruginosa PA01
gcaucggugccggcag

SEQ ID NO: 3394773 - RNA, 18 nt, Pseudomonas aeruginosa PA01
gcaucggugccggcaggc

SEQ ID NO: 3394774 - RNA, 21 nt, Pseudomonas aeruginosa PA01
gcaucgguggugugauccugc

SEQ ID NO: 3394775 - RNA, 20 nt, Pseudomonas aeruginosa PA01
gcaucgucgaaacgcuggcg

SEQ ID NO: 3394776 - RNA, 19 nt, Pseudomonas aeruginosa PA01
gcaucgucgaagcugaggu

SEQ ID NO: 3394777 - RNA, 20 nt, Pseudomonas aeruginosa PA01
gcaucgugcuucucaccgag

SEQ ID NO: 3394778 - RNA, 14 nt, Pseudomonas aeruginosa PA01
gcaucguuggcgcc

SEQ ID NO: 3394779 - RNA, 15 nt, Pseudomonas aeruginosa PA01
gcaucguuggcgccg

SEQ ID NO: 3394780 - RNA, 16 nt, Pseudomonas aeruginosa PA01
gcaucguuggcgccgu

SEQ ID NO: 3394781 - RNA, 19 nt, Pseudomonas aeruginosa PA01
gcaucguuggcgccguccu

SEQ ID NO: 3394782 - RNA, 24 nt, Pseudomonas aeruginosa PA01
gcaucguuggcgccguccugcaac

SEQ ID NO: 3394783 - RNA, 23 nt, Pseudomonas aeruginosa PA01
gcaucuccccaccaacucagucg

SEQ ID NO: 3394784 - RNA, 17 nt, Pseudomonas aeruginosa PA01
gcaucucgccggcacug

SEQ ID NO: 3394785 - RNA, 15 nt, Pseudomonas aeruginosa PA01
gcaucucggccaccu

SEQ ID NO: 3394786 - RNA, 23 nt, Pseudomonas aeruginosa PA01
gcaucucggccaccugcuccggc

SEQ ID NO: 3394787 - RNA, 18 nt, Pseudomonas aeruginosa PA01
gcaucucggccaggcccu

SEQ ID NO: 3394788 - RNA, 18 nt, Pseudomonas aeruginosa PA01
gcaucucuuccucgcugc

SEQ ID NO: 3394789 - RNA, 19 nt, Pseudomonas aeruginosa PA01
gcaucugcgacaugccggu

SEQ ID NO: 3394790 - RNA, 19 nt, Pseudomonas aeruginosa PA01
gcaucugcgcguagcgguc

SEQ ID NO: 3394791 - RNA, 12 nt, Pseudomonas aeruginosa PA01
gcaucuggcccg

SEQ ID NO: 3394792 - RNA, 14 nt, Pseudomonas aeruginosa PA01
gcaucuggugcgcg

SEQ ID NO: 3394793 - RNA, 18 nt, Pseudomonas aeruginosa PA01
gcaucuggugcgcgucca

SEQ ID NO: 3394794 - RNA, 16 nt, Pseudomonas aeruginosa PA01
gcaucuucaaucgcgc

SEQ ID NO: 3394795 - RNA, 19 nt, Pseudomonas aeruginosa PA01
gcaucuucugcgcguugca

SEQ ID NO: 3394796 - RNA, 17 nt, Pseudomonas aeruginosa PA01
gcaucuugcccagccga

SEQ ID NO: 3394797 - RNA, 15 nt, Pseudomonas aeruginosa PA01
gcaugaaaaaacccg

SEQ ID NO: 3394798 - RNA, 17 nt, Pseudomonas aeruginosa PA01
gcaugaaaaagcccggc

SEQ ID NO: 3394799 - RNA, 13 nt, Pseudomonas aeruginosa PA01
gcaugaaggcgcu

SEQ ID NO: 3394800 - RNA, 15 nt, Pseudomonas aeruginosa PA01
gcaugaaggcgcuga

SEQ ID NO: 3394801 - RNA, 22 nt, Pseudomonas aeruginosa PA01
gcaugaaggcgcugagcgccuc

SEQ ID NO: 3394802 - RNA, 14 nt, Pseudomonas aeruginosa PA01
gcaugaccgagcau

SEQ ID NO: 3394803 - RNA, 23 nt, Pseudomonas aeruginosa PA01
gcaugaccgagcaugcgcggcag

SEQ ID NO: 3394804 - RNA, 14 nt, Pseudomonas aeruginosa PA01
gcaugaccgauggc

SEQ ID NO: 3394805 - RNA, 18 nt, Pseudomonas aeruginosa PA01
gcaugaccgauggcgccg

SEQ ID NO: 3394806 - RNA, 21 nt, Pseudomonas aeruginosa PA01
gcaugaccgauggcgccgcga

SEQ ID NO: 3394807 - RNA, 16 nt, Pseudomonas aeruginosa PA01
gcaugaccuccagggc

SEQ ID NO: 3394808 - RNA, 20 nt, Pseudomonas aeruginosa PA01
gcaugaccuccagggccagc

SEQ ID NO: 3394809 - RNA, 20 nt, Pseudomonas aeruginosa PA01
gcaugaccuucagcaccugc

SEQ ID NO: 3394810 - RNA, 22 nt, Pseudomonas aeruginosa PA01
gcaugaccuucagcaccugcgc

SEQ ID NO: 3394811 - RNA, 15 nt, Pseudomonas aeruginosa PA01
gcaugacggauccac

SEQ ID NO: 3394812 - RNA, 13 nt, Pseudomonas aeruginosa PA01
gcaugaugcaggc

SEQ ID NO: 3394813 - RNA, 15 nt, Pseudomonas aeruginosa PA01
gcaugaugcaggcag

SEQ ID NO: 3394814 - RNA, 18 nt, Pseudomonas aeruginosa PA01
gcaugaugccgaggcggc

SEQ ID NO: 3394815 - RNA, 20 nt, Pseudomonas aeruginosa PA01
gcaugaugccgaggcggccg

SEQ ID NO: 3394816 - RNA, 14 nt, Pseudomonas aeruginosa PA01
gcaugaugcgcccg

SEQ ID NO: 3394817 - RNA, 18 nt, Pseudomonas aeruginosa PA01
gcaugauggugccgccgg

SEQ ID NO: 3394818 - RNA, 19 nt, Pseudomonas aeruginosa PA01
gcaugauuucguuggccca

SEQ ID NO: 3394819 - RNA, 14 nt, Pseudomonas aeruginosa PA01
gcaugcaagagguc

SEQ ID NO: 3394820 - RNA, 19 nt, Pseudomonas aeruginosa PA01
gcaugcaccuaccaguagu

SEQ ID NO: 3394821 - RNA, 18 nt, Pseudomonas aeruginosa PA01
gcauuggccaggccccag

SEQ ID NO: 3394822 - RNA, 15 nt, Pseudomonas aeruginosa PA01
gcauuggccaucagc

SEQ ID NO: 3394823 - RNA, 22 nt, Pseudomonas aeruginosa PA01
gcauuggccaucagcgccgccu

SEQ ID NO: 3394824 - RNA, 23 nt, Pseudomonas aeruginosa PA01
gcauuggccaucagcgccgccuc

SEQ ID NO: 3394825 - RNA, 15 nt, Pseudomonas aeruginosa PA01
gcauuggugcugccg

SEQ ID NO: 3394826 - RNA, 16 nt, Pseudomonas aeruginosa PA01
gcauuggugcugcgcg

SEQ ID NO: 3394827 - RNA, 14 nt, Pseudomonas aeruginosa PA01
gcauugucccugcg

SEQ ID NO: 3394828 - RNA, 13 nt, Pseudomonas aeruginosa PA01
gcauuucagcgga

SEQ ID NO: 3394829 - RNA, 12 nt, Pseudomonas aeruginosa PA01
gcauuuccucga

SEQ ID NO: 3394830 - RNA, 22 nt, Pseudomonas aeruginosa PA01
gcauuuccugggugccgcgaau

SEQ ID NO: 3394831 - RNA, 15 nt, Pseudomonas aeruginosa PA01
gccaaaaagcaggac

SEQ ID NO: 3394832 - RNA, 22 nt, Pseudomonas aeruginosa PA01
gccaaacccagcgacaacggcg

SEQ ID NO: 3394833 - RNA, 20 nt, Pseudomonas aeruginosa PA01
gccaaagaaaaggcccgcug

SEQ ID NO: 3394834 - RNA, 12 nt, Pseudomonas aeruginosa PA01
gccaaagccgca

SEQ ID NO: 3394835 - RNA, 13 nt, Pseudomonas aeruginosa PA01
gccaaccaccggc

SEQ ID NO: 3394836 - RNA, 16 nt, Pseudomonas aeruginosa PA01
gccaaccaccggcgca

SEQ ID NO: 3394837 - RNA, 15 nt, Pseudomonas aeruginosa PA01
gccaaccagauccgg

SEQ ID NO: 3394838 - RNA, 22 nt, Pseudomonas aeruginosa PA01
gccaaccaugguuuccgccgga

SEQ ID NO: 3394839 - RNA, 14 nt, Pseudomonas aeruginosa PA01
gccaaccgggcagc

SEQ ID NO: 3394840 - RNA, 21 nt, Pseudomonas aeruginosa PA01
gccaaccgggcagcagccgga

SEQ ID NO: 3394841 - RNA, 16 nt, Pseudomonas aeruginosa PA01
gccaaccgucgcccug

SEQ ID NO: 3394842 - RNA, 18 nt, Pseudomonas aeruginosa PA01
gccaaccgucgcccuggu

SEQ ID NO: 3394843 - RNA, 19 nt, Pseudomonas aeruginosa PA01
gccaaccgucgcccuggug

SEQ ID NO: 3394844 - RNA, 20 nt, Pseudomonas aeruginosa PA01
gccaaccgucgcccuggugc

SEQ ID NO: 3394845 - RNA, 22 nt, Pseudomonas aeruginosa PA01
gccaaccgucgcccuggugcac

SEQ ID NO: 3394846 - RNA, 16 nt, Pseudomonas aeruginosa PA01
gccaaccucuccccag

SEQ ID NO: 3394847 - RNA, 17 nt, Pseudomonas aeruginosa PA01
gccaaccucuccccaga

SEQ ID NO: 3394848 - RNA, 14 nt, Pseudomonas aeruginosa PA01
gccaacgccaccgc

SEQ ID NO: 3394849 - RNA, 14 nt, Pseudomonas aeruginosa PA01
gccaacgcccgggc

SEQ ID NO: 3394850 - RNA, 14 nt, Pseudomonas aeruginosa PA01
gccaacgcgccguc

SEQ ID NO: 3394851 - RNA, 21 nt, Pseudomonas aeruginosa PA01
gccaacggcguuauccgccgc

SEQ ID NO: 3394852 - RNA, 22 nt, Pseudomonas aeruginosa PA01
gccaacgguagcggaucagccg

SEQ ID NO: 3394853 - RNA, 15 nt, Pseudomonas aeruginosa PA01
gccaacucggccugg

SEQ ID NO: 3394854 - RNA, 15 nt, Pseudomonas aeruginosa PA01
gccaacugagcggcg

SEQ ID NO: 3394855 - RNA, 16 nt, Pseudomonas aeruginosa PA01
gccaacugagcggcgg

SEQ ID NO: 3394856 - RNA, 19 nt, Pseudomonas aeruginosa PA01
gccaacugcuucaggcgcg

SEQ ID NO: 3394857 - RNA, 23 nt, Pseudomonas aeruginosa PA01
gccaacugcuucaggcgcgcggc

SEQ ID NO: 3394858 - RNA, 18 nt, Pseudomonas aeruginosa PA01
gccaacuggcgcaacugc

SEQ ID NO: 3394859 - RNA, 18 nt, Pseudomonas aeruginosa PA01
gccaacuuccaaucgggg

SEQ ID NO: 3394860 - RNA, 14 nt, Pseudomonas aeruginosa PA01
gccaagccaccagc

SEQ ID NO: 3394861 - RNA, 15 nt, Pseudomonas aeruginosa PA01
gccaagccaccagcg

SEQ ID NO: 3394862 - RNA, 13 nt, Pseudomonas aeruginosa PA01
gccaagcccggcg

SEQ ID NO: 3394863 - RNA, 22 nt, Pseudomonas aeruginosa PA01
gccaagcccggcgagagcgucc

SEQ ID NO: 3394864 - RNA, 13 nt, Pseudomonas aeruginosa PA01
gccaagcuggcga

SEQ ID NO: 3394865 - RNA, 23 nt, Pseudomonas aeruginosa PA01
gccaagcuggcgaucgaccugcc

SEQ ID NO: 3394866 - RNA, 18 nt, Pseudomonas aeruginosa PA01
gccaagcuuguugcgcag

SEQ ID NO: 3394867 - RNA, 17 nt, Pseudomonas aeruginosa PA01
gccaaggaugcgccagc

SEQ ID NO: 3394868 - RNA, 18 nt, Pseudomonas aeruginosa PA01
gccaaggaugcgccagcg

SEQ ID NO: 3394869 - RNA, 18 nt, Pseudomonas aeruginosa PA01
gccaaggcccugcugcag

SEQ ID NO: 3394870 - RNA, 19 nt, Pseudomonas aeruginosa PA01
gccaaggcccugcugcagg

SEQ ID NO: 3394871 - RNA, 13 nt, Pseudomonas aeruginosa PA01
gccaaggccgcca

SEQ ID NO: 3394872 - RNA, 16 nt, Pseudomonas aeruginosa PA01
gccaaggccgccaggc

SEQ ID NO: 3394873 - RNA, 13 nt, Pseudomonas aeruginosa PA01
gccaaggccucgg

SEQ ID NO: 3394874 - RNA, 16 nt, Pseudomonas aeruginosa PA01
gccaagggcgccgccg

SEQ ID NO: 3394875 - RNA, 17 nt, Pseudomonas aeruginosa PA01
gccaagggcgccgccga

SEQ ID NO: 3394876 - RNA, 21 nt, Pseudomonas aeruginosa PA01
gccaaggucggucucgccacc

SEQ ID NO: 3394877 - RNA, 23 nt, Pseudomonas aeruginosa PA01
gccaaggucggucucgccacccc

SEQ ID NO: 3394878 - RNA, 18 nt, Pseudomonas aeruginosa PA01
gccaagguguggccgagc

SEQ ID NO: 3394879 - RNA, 23 nt, Pseudomonas aeruginosa PA01
gccaagguguggccgagccccgg

SEQ ID NO: 3394880 - RNA, 16 nt, Pseudomonas aeruginosa PA01
gccaagucggccgccc

SEQ ID NO: 3394881 - RNA, 17 nt, Pseudomonas aeruginosa PA01
gccaagucggccgccca

SEQ ID NO: 3394882 - RNA, 20 nt, Pseudomonas aeruginosa PA01
gccaagucggccgcccagcg

SEQ ID NO: 3394883 - RNA, 17 nt, Pseudomonas aeruginosa PA01
gccaaguugccuggcag

SEQ ID NO: 3394884 - RNA, 17 nt, Pseudomonas aeruginosa PA01
gccaaucaggugcguac

SEQ ID NO: 3394885 - RNA, 13 nt, Pseudomonas aeruginosa PA01
gccaauccgggcg

SEQ ID NO: 3394886 - RNA, 23 nt, Pseudomonas aeruginosa PA01
gccaaugccuuccgacgccgcgu

SEQ ID NO: 3394887 - RNA, 15 nt, Pseudomonas aeruginosa PA01
gccaauggccgggcu

SEQ ID NO: 3394888 - RNA, 21 nt, Pseudomonas aeruginosa PA01
gccaauggccgggcuucuuca

SEQ ID NO: 3394889 - RNA, 16 nt, Pseudomonas aeruginosa PA01
gccaauggccgguuuu

SEQ ID NO: 3394890 - RNA, 20 nt, Pseudomonas aeruginosa PA01
gccacaaggaaaaacggggc

SEQ ID NO: 3394891 - RNA, 15 nt, Pseudomonas aeruginosa PA01
gccacacauccagug

SEQ ID NO: 3394892 - RNA, 16 nt, Pseudomonas aeruginosa PA01
gccacacauccagugu

SEQ ID NO: 3394893 - RNA, 22 nt, Pseudomonas aeruginosa PA01
gccacacauccaguguggcggc

SEQ ID NO: 3394894 - RNA, 20 nt, Pseudomonas aeruginosa PA01
gccacacggcuaucagguga

SEQ ID NO: 3394895 - RNA, 17 nt, Pseudomonas aeruginosa PA01
gccacagaggucgcuga

SEQ ID NO: 3394896 - RNA, 19 nt, Pseudomonas aeruginosa PA01
gccacagaggucgcugacc

SEQ ID NO: 3394897 - RNA, 14 nt, Pseudomonas aeruginosa PA01
gccacagaucgcca

SEQ ID NO: 3394898 - RNA, 13 nt, Pseudomonas aeruginosa PA01
gccacaggcccug

SEQ ID NO: 3394899 - RNA, 21 nt, Pseudomonas aeruginosa PA01
gccacaggcccuggaucaccg

SEQ ID NO: 3394900 - RNA, 16 nt, Pseudomonas aeruginosa PA01
gccacaggcgccaguc

SEQ ID NO: 3394901 - RNA, 19 nt, Pseudomonas aeruginosa PA01
gccacaggcguuauccgcc

SEQ ID NO: 3394902 - RNA, 22 nt, Pseudomonas aeruginosa PA01
gccacaggcguuauccgccgau

SEQ ID NO: 3394903 - RNA, 20 nt, Pseudomonas aeruginosa PA01
gccacagguggaucgcggcg

SEQ ID NO: 3394904 - RNA, 23 nt, Pseudomonas aeruginosa PA01
gccacaguuucauggugcccagc

SEQ ID NO: 3394905 - RNA, 18 nt, Pseudomonas aeruginosa PA01
gccaccaccgugaccagc

SEQ ID NO: 3394906 - RNA, 15 nt, Pseudomonas aeruginosa PA01
gccaccacgaucagg

SEQ ID NO: 3394907 - RNA, 19 nt, Pseudomonas aeruginosa PA01
gccaccacgaucaggcccu

SEQ ID NO: 3394908 - RNA, 20 nt, Pseudomonas aeruginosa PA01
gccaccacggcgaagccgcg

SEQ ID NO: 3394909 - RNA, 21 nt, Pseudomonas aeruginosa PA01
gccaccacggcgaagccgcgc

SEQ ID NO: 3394910 - RNA, 22 nt, Pseudomonas aeruginosa PA01
gccaccacggcgaagccgcgcc

SEQ ID NO: 3394911 - RNA, 18 nt, Pseudomonas aeruginosa PA01
gccaccacuucgcggacc

SEQ ID NO: 3394912 - RNA, 15 nt, Pseudomonas aeruginosa PA01
gccaccagagccagc

SEQ ID NO: 3394913 - RNA, 19 nt, Pseudomonas aeruginosa PA01
gccaccagagccagccgcg

SEQ ID NO: 3394914 - RNA, 13 nt, Pseudomonas aeruginosa PA01
gccaccagcaccu

SEQ ID NO: 3394915 - RNA, 16 nt, Pseudomonas aeruginosa PA01
gccaccagcaccugcg

SEQ ID NO: 3394916 - RNA, 13 nt, Pseudomonas aeruginosa PA01
gccaccagcagga

SEQ ID NO: 3394917 - RNA, 16 nt, Pseudomonas aeruginosa PA01
gccaccagcaggaagc

SEQ ID NO: 3394918 - RNA, 15 nt, Pseudomonas aeruginosa PA01
gccaccagcagggcc

SEQ ID NO: 3394919 - RNA, 18 nt, Pseudomonas aeruginosa PA01
gccaccagcagggccagg

SEQ ID NO: 3394920 - RNA, 19 nt, Pseudomonas aeruginosa PA01
gccaccagcagggccaggc

SEQ ID NO: 3394921 - RNA, 20 nt, Pseudomonas aeruginosa PA01
gccaccagcagggccaggcc

SEQ ID NO: 3394922 - RNA, 22 nt, Pseudomonas aeruginosa PA01
gccaccagcagggccaggccga

SEQ ID NO: 3394923 - RNA, 20 nt, Pseudomonas aeruginosa PA01
gccacgccggcgcuccuccu

SEQ ID NO: 3394924 - RNA, 22 nt, Pseudomonas aeruginosa PA01
gccacgccggucucgauggcag

SEQ ID NO: 3394925 - RNA, 14 nt, Pseudomonas aeruginosa PA01
gccacgcgaccagc

SEQ ID NO: 3394926 - RNA, 15 nt, Pseudomonas aeruginosa PA01
gccacgcgaccagcg

SEQ ID NO: 3394927 - RNA, 20 nt, Pseudomonas aeruginosa PA01
gccacgcgaccagcgccagg

SEQ ID NO: 3394928 - RNA, 21 nt, Pseudomonas aeruginosa PA01
gccacgcgaccagcgccaggc

SEQ ID NO: 3394929 - RNA, 20 nt, Pseudomonas aeruginosa PA01
gccacgcgagaagccgccca

SEQ ID NO: 3394930 - RNA, 15 nt, Pseudomonas aeruginosa PA01
gccacgcucuccguc

SEQ ID NO: 3394931 - RNA, 20 nt, Pseudomonas aeruginosa PA01
gccacgcucucgaacagcag

SEQ ID NO: 3394932 - RNA, 22 nt, Pseudomonas aeruginosa PA01
gccacgcucucgaacagcagca

SEQ ID NO: 3394933 - RNA, 18 nt, Pseudomonas aeruginosa PA01
gccacgcugaucaucagc

SEQ ID NO: 3394934 - RNA, 16 nt, Pseudomonas aeruginosa PA01
gccacgcugcugccgg

SEQ ID NO: 3394935 - RNA, 17 nt, Pseudomonas aeruginosa PA01
gccacgcugcugccggc

SEQ ID NO: 3394936 - RNA, 17 nt, Pseudomonas aeruginosa PA01
gccacgcuucugcgccu

SEQ ID NO: 3394937 - RNA, 19 nt, Pseudomonas aeruginosa PA01
gccacgcuucugcgccucc

SEQ ID NO: 3394938 - RNA, 21 nt, Pseudomonas aeruginosa PA01
gccacggaaggccacgccgcc

SEQ ID NO: 3394939 - RNA, 16 nt, Pseudomonas aeruginosa PA01
gccacggacgcgcagg

SEQ ID NO: 3394940 - RNA, 18 nt, Pseudomonas aeruginosa PA01
gccacggauaugcgccgc

SEQ ID NO: 3394941 - RNA, 20 nt, Pseudomonas aeruginosa PA01
gccacggauaugcgccgcca

SEQ ID NO: 3394942 - RNA, 21 nt, Pseudomonas aeruginosa PA01
gccacggauaugcgccgccac

SEQ ID NO: 3394943 - RNA, 17 nt, Pseudomonas aeruginosa PA01
gccacggcacacgucgg

SEQ ID NO: 3394944 - RNA, 14 nt, Pseudomonas aeruginosa PA01
gccacggccagcag

SEQ ID NO: 3394945 - RNA, 15 nt, Pseudomonas aeruginosa PA01
gccacggccagcagg

SEQ ID NO: 3394946 - RNA, 16 nt, Pseudomonas aeruginosa PA01
gccacggccagcagga

SEQ ID NO: 3394947 - RNA, 14 nt, Pseudomonas aeruginosa PA01
gccacggccgcugc

SEQ ID NO: 3394948 - RNA, 15 nt, Pseudomonas aeruginosa PA01
gccacggccgcugcg

SEQ ID NO: 3394949 - RNA, 18 nt, Pseudomonas aeruginosa PA01
gccacggccgcugcgcag

SEQ ID NO: 3394950 - RNA, 20 nt, Pseudomonas aeruginosa PA01
gccacggccgcugcgcaggc

SEQ ID NO: 3394951 - RNA, 21 nt, Pseudomonas aeruginosa PA01
gccacggccgcugcgcaggcc

SEQ ID NO: 3394952 - RNA, 24 nt, Pseudomonas aeruginosa PA01
gccacggccgcugcgcaggccgag

SEQ ID NO: 3394953 - RNA, 13 nt, Pseudomonas aeruginosa PA01
gccacggccggcg

SEQ ID NO: 3394954 - RNA, 19 nt, Pseudomonas aeruginosa PA01
gccacggcgagagcgccga

SEQ ID NO: 3394955 - RNA, 18 nt, Pseudomonas aeruginosa PA01
gccacggcgaucgccggg

SEQ ID NO: 3394956 - RNA, 19 nt, Pseudomonas aeruginosa PA01
gccacggcgaucgccgggu

SEQ ID NO: 3394957 - RNA, 20 nt, Pseudomonas aeruginosa PA01
gccacggcgcgcuccggcgc

SEQ ID NO: 3394958 - RNA, 22 nt, Pseudomonas aeruginosa PA01
gccacggcgcgcuccggcgcgc

SEQ ID NO: 3394959 - RNA, 22 nt, Pseudomonas aeruginosa PA01
gccacggcgcggaacaucgccc

SEQ ID NO: 3394960 - RNA, 23 nt, Pseudomonas aeruginosa PA01
gccacggcgcggaacaucgcccg

SEQ ID NO: 3394961 - RNA, 16 nt, Pseudomonas aeruginosa PA01
gccacggcggauugac

SEQ ID NO: 3394962 - RNA, 22 nt, Pseudomonas aeruginosa PA01
gccacggcgguuucgucgaagc

SEQ ID NO: 3394963 - RNA, 20 nt, Pseudomonas aeruginosa PA01
gccacgggcgccagcgguuc

SEQ ID NO: 3394964 - RNA, 19 nt, Pseudomonas aeruginosa PA01
gccacggggccccucgccg

SEQ ID NO: 3394965 - RNA, 22 nt, Pseudomonas aeruginosa PA01
gccacggggccccucgccguga

SEQ ID NO: 3394966 - RNA, 15 nt, Pseudomonas aeruginosa PA01
gccacguacagcgcg

SEQ ID NO: 3394967 - RNA, 20 nt, Pseudomonas aeruginosa PA01
gccacguagggcguggugua

SEQ ID NO: 3394968 - RNA, 16 nt, Pseudomonas aeruginosa PA01
gccacguccagcggca

SEQ ID NO: 3394969 - RNA, 15 nt, Pseudomonas aeruginosa PA01
gccacguccuuggug

SEQ ID NO: 3394970 - RNA, 16 nt, Pseudomonas aeruginosa PA01
gccacgucgccccagg

SEQ ID NO: 3394971 - RNA, 19 nt, Pseudomonas aeruginosa PA01
gccacgucgccccagggaa

SEQ ID NO: 3394972 - RNA, 23 nt, Pseudomonas aeruginosa PA01
gccacgugcggggugcgcuggaa

SEQ ID NO: 3394973 - RNA, 19 nt, Pseudomonas aeruginosa PA01
gccacuaucgccaacgcca

SEQ ID NO: 3394974 - RNA, 17 nt, Pseudomonas aeruginosa PA01
gccacuauuccuugcgc

SEQ ID NO: 3394975 - RNA, 19 nt, Pseudomonas aeruginosa PA01
gccacuauuccuugcgcca

SEQ ID NO: 3394976 - RNA, 20 nt, Pseudomonas aeruginosa PA01
gccacuauuccuugcgccau

SEQ ID NO: 3394977 - RNA, 14 nt, Pseudomonas aeruginosa PA01
gccacuccagcccc

SEQ ID NO: 3394978 - RNA, 17 nt, Pseudomonas aeruginosa PA01
gccacuccagccccgcg

SEQ ID NO: 3394979 - RNA, 15 nt, Pseudomonas aeruginosa PA01
gccacucccggcccu

SEQ ID NO: 3394980 - RNA, 20 nt, Pseudomonas aeruginosa PA01
gccacucccggcccuugagc

SEQ ID NO: 3394981 - RNA, 21 nt, Pseudomonas aeruginosa PA01
gccacucccggcccuugagca

SEQ ID NO: 3394982 - RNA, 16 nt, Pseudomonas aeruginosa PA01
gccacuccgggcuggu

SEQ ID NO: 3394983 - RNA, 15 nt, Pseudomonas aeruginosa PA01
gccacucgcagccgc

SEQ ID NO: 3394984 - RNA, 16 nt, Pseudomonas aeruginosa PA01
gccacucgcagccgcg

SEQ ID NO: 3394985 - RNA, 18 nt, Pseudomonas aeruginosa PA01
gccacucggccaggcgcc

SEQ ID NO: 3394986 - RNA, 19 nt, Pseudomonas aeruginosa PA01
gccacucggccaggcgcca

SEQ ID NO: 3394987 - RNA, 21 nt, Pseudomonas aeruginosa PA01
gccacucggccaggcgccagg

SEQ ID NO: 3394988 - RNA, 22 nt, Pseudomonas aeruginosa PA01
gccacucggccaggcgccaggg

SEQ ID NO: 3394989 - RNA, 12 nt, Pseudomonas aeruginosa PA01
gccacucggcgu

SEQ ID NO: 3394990 - RNA, 19 nt, Pseudomonas aeruginosa PA01
gccacugaacuggaucggc

SEQ ID NO: 3394991 - RNA, 16 nt, Pseudomonas aeruginosa PA01
gccacugacgcgcagc

SEQ ID NO: 3394992 - RNA, 17 nt, Pseudomonas aeruginosa PA01
gccacugacgcgcagcg

SEQ ID NO: 3394993 - RNA, 16 nt, Pseudomonas aeruginosa PA01
gccacugauaccgcug

SEQ ID NO: 3394994 - RNA, 17 nt, Pseudomonas aeruginosa PA01
gccacugauaccgcugg

SEQ ID NO: 3394995 - RNA, 20 nt, Pseudomonas aeruginosa PA01
gccacugauaccgcuggcca

SEQ ID NO: 3394996 - RNA, 23 nt, Pseudomonas aeruginosa PA01
gccacugauaccgcuggccaggu

SEQ ID NO: 3394997 - RNA, 13 nt, Pseudomonas aeruginosa PA01
gccacugccgccu

SEQ ID NO: 3394998 - RNA, 14 nt, Pseudomonas aeruginosa PA01
gccacugccgccuc

SEQ ID NO: 3394999 - RNA, 16 nt, Pseudomonas aeruginosa PA01
gccacugccgccucag

SEQ ID NO: 3395000 - RNA, 13 nt, Pseudomonas aeruginosa PA01
gccacugcgcgcc

SEQ ID NO: 3395001 - RNA, 14 nt, Pseudomonas aeruginosa PA01
gccacugcgcgcca

SEQ ID NO: 3395002 - RNA, 14 nt, Pseudomonas aeruginosa PA01
gccacugcuuggcg

SEQ ID NO: 3395003 - RNA, 17 nt, Pseudomonas aeruginosa PA01
gccacugcuuggcgaac

SEQ ID NO: 3395004 - RNA, 19 nt, Pseudomonas aeruginosa PA01
gccacugcuuggcgaacuc

SEQ ID NO: 3395005 - RNA, 17 nt, Pseudomonas aeruginosa PA01
gccacuggcggaccgcc

SEQ ID NO: 3395006 - RNA, 20 nt, Pseudomonas aeruginosa PA01
gccacuggcggaccgccucg

SEQ ID NO: 3395007 - RNA, 12 nt, Pseudomonas aeruginosa PA01
gccacuguccau

SEQ ID NO: 3395008 - RNA, 18 nt, Pseudomonas aeruginosa PA01
gccacuucaagcuggcgc

SEQ ID NO: 3395009 - RNA, 19 nt, Pseudomonas aeruginosa PA01
gccacuucaagcuggcgca

SEQ ID NO: 3395010 - RNA, 14 nt, Pseudomonas aeruginosa PA01
gccacuuccagcac

SEQ ID NO: 3395011 - RNA, 19 nt, Pseudomonas aeruginosa PA01
gccacuuccagcacgccga

SEQ ID NO: 3395012 - RNA, 20 nt, Pseudomonas aeruginosa PA01
gccacuuccagcacgccgau

SEQ ID NO: 3395013 - RNA, 18 nt, Pseudomonas aeruginosa PA01
gccacuucccggcgcaga

SEQ ID NO: 3395014 - RNA, 15 nt, Pseudomonas aeruginosa PA01
gccacuucguccggc

SEQ ID NO: 3395015 - RNA, 21 nt, Pseudomonas aeruginosa PA01
gccacuucguccggccgcccg

SEQ ID NO: 3395016 - RNA, 19 nt, Pseudomonas aeruginosa PA01
gccacuugcgggugcgcag

SEQ ID NO: 3395017 - RNA, 21 nt, Pseudomonas aeruginosa PA01
gccacuugcgggugcgcaggc

SEQ ID NO: 3395018 - RNA, 14 nt, Pseudomonas aeruginosa PA01
gccagaaaacccag

SEQ ID NO: 3395019 - RNA, 20 nt, Pseudomonas aeruginosa PA01
gccagaaaacccagcgaagc

SEQ ID NO: 3395020 - RNA, 19 nt, Pseudomonas aeruginosa PA01
gccagaaagccucaggcgc

SEQ ID NO: 3395021 - RNA, 20 nt, Pseudomonas aeruginosa PA01
gccagaaagccucaggcgcu

SEQ ID NO: 3395022 - RNA, 22 nt, Pseudomonas aeruginosa PA01
gccagaaagccucaggcgcugc

SEQ ID NO: 3395023 - RNA, 11 nt, Pseudomonas aeruginosa PA01
gccagaagcga

SEQ ID NO: 3395024 - RNA, 18 nt, Pseudomonas aeruginosa PA01
gccagaagcgacugucca

SEQ ID NO: 3395025 - RNA, 13 nt, Pseudomonas aeruginosa PA01
gccagcaggcgau

SEQ ID NO: 3395026 - RNA, 15 nt, Pseudomonas aeruginosa PA01
gccagcaggcgauac

SEQ ID NO: 3395027 - RNA, 13 nt, Pseudomonas aeruginosa PA01
gccagcaggcgca

SEQ ID NO: 3395028 - RNA, 19 nt, Pseudomonas aeruginosa PA01
gccagcaggcgcagcagcg

SEQ ID NO: 3395029 - RNA, 15 nt, Pseudomonas aeruginosa PA01
gccagcaggcgcagg

SEQ ID NO: 3395030 - RNA, 14 nt, Pseudomonas aeruginosa PA01
gccagcaggcgccg

SEQ ID NO: 3395031 - RNA, 17 nt, Pseudomonas aeruginosa PA01
gccagcaggcgccggcg

SEQ ID NO: 3395032 - RNA, 18 nt, Pseudomonas aeruginosa PA01
gccagcaggcgccggcgg

SEQ ID NO: 3395033 - RNA, 13 nt, Pseudomonas aeruginosa PA01
gccagcaggcgcg

SEQ ID NO: 3395034 - RNA, 15 nt, Pseudomonas aeruginosa PA01
gccagcaggcgcggg

SEQ ID NO: 3395035 - RNA, 16 nt, Pseudomonas aeruginosa PA01
gccagcaggcgcgggc

SEQ ID NO: 3395036 - RNA, 19 nt, Pseudomonas aeruginosa PA01
gccagcaggcgcgggcugg

SEQ ID NO: 3395037 - RNA, 23 nt, Pseudomonas aeruginosa PA01
gccagcaggcgcgggcuggccac

SEQ ID NO: 3395038 - RNA, 14 nt, Pseudomonas aeruginosa PA01
gccagcaggcgcuc

SEQ ID NO: 3395039 - RNA, 15 nt, Pseudomonas aeruginosa PA01
gccagcaggcgcucg

SEQ ID NO: 3395040 - RNA, 20 nt, Pseudomonas aeruginosa PA01
gccagcaggcgcucggcgac

SEQ ID NO: 3395041 - RNA, 21 nt, Pseudomonas aeruginosa PA01
gccagcaggcgcucggcgacg

SEQ ID NO: 3395042 - RNA, 15 nt, Pseudomonas aeruginosa PA01
gccagcaggcguugc

SEQ ID NO: 3395043 - RNA, 11 nt, Pseudomonas aeruginosa PA01
gccagcaggcu

SEQ ID NO: 3395044 - RNA, 13 nt, Pseudomonas aeruginosa PA01
gccagcaggcuca

SEQ ID NO: 3395045 - RNA, 16 nt, Pseudomonas aeruginosa PA01
gccagcaggcuggcgg

SEQ ID NO: 3395046 - RNA, 17 nt, Pseudomonas aeruginosa PA01
gccagcaggcuggcggc

SEQ ID NO: 3395047 - RNA, 13 nt, Pseudomonas aeruginosa PA01
gccagcaggcugu

SEQ ID NO: 3395048 - RNA, 16 nt, Pseudomonas aeruginosa PA01
gccagcagggccgccg

SEQ ID NO: 3395049 - RNA, 17 nt, Pseudomonas aeruginosa PA01
gccagcagggccgccga

SEQ ID NO: 3395050 - RNA, 18 nt, Pseudomonas aeruginosa PA01
gccagcagggccgccgag

SEQ ID NO: 3395051 - RNA, 13 nt, Pseudomonas aeruginosa PA01
gccagcagggucu

SEQ ID NO: 3395052 - RNA, 20 nt, Pseudomonas aeruginosa PA01
gccagcagggucucgcugcu

SEQ ID NO: 3395053 - RNA, 18 nt, Pseudomonas aeruginosa PA01
gccagcagguacagcagc

SEQ ID NO: 3395054 - RNA, 22 nt, Pseudomonas aeruginosa PA01
gccagcagguacagcagcuuca

SEQ ID NO: 3395055 - RNA, 21 nt, Pseudomonas aeruginosa PA01
gccagcagguagacgcaggug

SEQ ID NO: 3395056 - RNA, 15 nt, Pseudomonas aeruginosa PA01
gccagcagguagccu

SEQ ID NO: 3395057 - RNA, 18 nt, Pseudomonas aeruginosa PA01
gccagcaggucgcgcugg

SEQ ID NO: 3395058 - RNA, 19 nt, Pseudomonas aeruginosa PA01
gccagcaggucgcgcuggg

SEQ ID NO: 3395059 - RNA, 20 nt, Pseudomonas aeruginosa PA01
gccagcaggucgcgcugggc

SEQ ID NO: 3395060 - RNA, 22 nt, Pseudomonas aeruginosa PA01
gccagcaggucgcgcugggcga

SEQ ID NO: 3395061 - RNA, 14 nt, Pseudomonas aeruginosa PA01
gccagcaggucggc

SEQ ID NO: 3395062 - RNA, 18 nt, Pseudomonas aeruginosa PA01
gccagcaggucggccugc

SEQ ID NO: 3395063 - RNA, 22 nt, Pseudomonas aeruginosa PA01
gccagcaggucggccugcugcu

SEQ ID NO: 3395064 - RNA, 12 nt, Pseudomonas aeruginosa PA01
gccagcaggugg

SEQ ID NO: 3395065 - RNA, 16 nt, Pseudomonas aeruginosa PA01
gccagcagguggucga

SEQ ID NO: 3395066 - RNA, 21 nt, Pseudomonas aeruginosa PA01
gccagcagguggucgaugggc

SEQ ID NO: 3395067 - RNA, 23 nt, Pseudomonas aeruginosa PA01
gccagcagguggucgaugggcga

SEQ ID NO: 3395068 - RNA, 23 nt, Pseudomonas aeruginosa PA01
gccagcagucguugacggugcug

SEQ ID NO: 3395069 - RNA, 19 nt, Pseudomonas aeruginosa PA01
gccagcaguggcuccgcgc

SEQ ID NO: 3395070 - RNA, 20 nt, Pseudomonas aeruginosa PA01
gccagcaguggcuccgcgcg

SEQ ID NO: 3395071 - RNA, 21 nt, Pseudomonas aeruginosa PA01
gccagcaguggcuccgcgcgu

SEQ ID NO: 3395072 - RNA, 17 nt, Pseudomonas aeruginosa PA01
gccagcaguugcaacag

SEQ ID NO: 3395073 - RNA, 18 nt, Pseudomonas aeruginosa PA01
gccagcaguugcaacagc

SEQ ID NO: 3395074 - RNA, 20 nt, Pseudomonas aeruginosa PA01
gccagcaguugcaacagcgc

SEQ ID NO: 3395075 - RNA, 21 nt, Pseudomonas aeruginosa PA01
gccagcaguugcaacagcgcg

SEQ ID NO: 3395076 - RNA, 20 nt, Pseudomonas aeruginosa PA01
gccagcaucgcaucggcgac

SEQ ID NO: 3395077 - RNA, 23 nt, Pseudomonas aeruginosa PA01
gccagccaacugcuucaggcgcg

SEQ ID NO: 3395078 - RNA, 15 nt, Pseudomonas aeruginosa PA01
gccagccagagcagc

SEQ ID NO: 3395079 - RNA, 20 nt, Pseudomonas aeruginosa PA01
gccagccagagccagucgag

SEQ ID NO: 3395080 - RNA, 14 nt, Pseudomonas aeruginosa PA01
gccagccagcccgg

SEQ ID NO: 3395081 - RNA, 15 nt, Pseudomonas aeruginosa PA01
gccagccagcccggc

SEQ ID NO: 3395082 - RNA, 14 nt, Pseudomonas aeruginosa PA01
gccagccagccgcg

SEQ ID NO: 3395083 - RNA, 15 nt, Pseudomonas aeruginosa PA01
gccagccagccgcgc

SEQ ID NO: 3395084 - RNA, 16 nt, Pseudomonas aeruginosa PA01
gccagccagccgcgcg

SEQ ID NO: 3395085 - RNA, 12 nt, Pseudomonas aeruginosa PA01
gccagccagggc

SEQ ID NO: 3395086 - RNA, 13 nt, Pseudomonas aeruginosa PA01
gccagccagggca

SEQ ID NO: 3395087 - RNA, 14 nt, Pseudomonas aeruginosa PA01
gccagccagggcag

SEQ ID NO: 3395088 - RNA, 15 nt, Pseudomonas aeruginosa PA01
gccagccagggcagc

SEQ ID NO: 3395089 - RNA, 21 nt, Pseudomonas aeruginosa PA01
gccagccaugugcuccuugac

SEQ ID NO: 3395090 - RNA, 12 nt, Pseudomonas aeruginosa PA01
gccagcccagaa

SEQ ID NO: 3395091 - RNA, 17 nt, Pseudomonas aeruginosa PA01
gccagcccagaacagca

SEQ ID NO: 3395092 - RNA, 14 nt, Pseudomonas aeruginosa PA01
gccagcccagcggc

SEQ ID NO: 3395093 - RNA, 15 nt, Pseudomonas aeruginosa PA01
gccagcccagcggcg

SEQ ID NO: 3395094 - RNA, 17 nt, Pseudomonas aeruginosa PA01
gccagcccagcggcgcg

SEQ ID NO: 3395095 - RNA, 11 nt, Pseudomonas aeruginosa PA01
gccagcccagu

SEQ ID NO: 3395096 - RNA, 16 nt, Pseudomonas aeruginosa PA01
gccagcccagugcugg

SEQ ID NO: 3395097 - RNA, 19 nt, Pseudomonas aeruginosa PA01
gccagcccagugcuggcgu

SEQ ID NO: 3395098 - RNA, 12 nt, Pseudomonas aeruginosa PA01
gccagccccaga

SEQ ID NO: 3395099 - RNA, 15 nt, Pseudomonas aeruginosa PA01
gccagccccaggccg

SEQ ID NO: 3395100 - RNA, 20 nt, Pseudomonas aeruginosa PA01
gccagccccaggccgcccuu

SEQ ID NO: 3395101 - RNA, 15 nt, Pseudomonas aeruginosa PA01
gccagccccaggcgc

SEQ ID NO: 3395102 - RNA, 16 nt, Pseudomonas aeruginosa PA01
gccagccccaggcgcg

SEQ ID NO: 3395103 - RNA, 17 nt, Pseudomonas aeruginosa PA01
gccagccccaggcgcgg

SEQ ID NO: 3395104 - RNA, 18 nt, Pseudomonas aeruginosa PA01
gccagccccaggcgcggc

SEQ ID NO: 3395105 - RNA, 22 nt, Pseudomonas aeruginosa PA01
gccagccccaggcgcggcgucg

SEQ ID NO: 3395106 - RNA, 17 nt, Pseudomonas aeruginosa PA01
gccagcccccucgcccu

SEQ ID NO: 3395107 - RNA, 15 nt, Pseudomonas aeruginosa PA01
gccagccccugcgga

SEQ ID NO: 3395108 - RNA, 16 nt, Pseudomonas aeruginosa PA01
gccagcccgccaccga

SEQ ID NO: 3395109 - RNA, 15 nt, Pseudomonas aeruginosa PA01
gccagcccggagccg

SEQ ID NO: 3395110 - RNA, 12 nt, Pseudomonas aeruginosa PA01
gccagcccggca

SEQ ID NO: 3395111 - RNA, 14 nt, Pseudomonas aeruginosa PA01
gccagcccggcagg

SEQ ID NO: 3395112 - RNA, 17 nt, Pseudomonas aeruginosa PA01
gccagcccggcaggucg

SEQ ID NO: 3395113 - RNA, 20 nt, Pseudomonas aeruginosa PA01
gccagcccggcaggucgagg

SEQ ID NO: 3395114 - RNA, 12 nt, Pseudomonas aeruginosa PA01
gccagcccggcc

SEQ ID NO: 3395115 - RNA, 17 nt, Pseudomonas aeruginosa PA01
gccagcccggccucgcc

SEQ ID NO: 3395116 - RNA, 20 nt, Pseudomonas aeruginosa PA01
gccagcccggccucgccggu

SEQ ID NO: 3395117 - RNA, 21 nt, Pseudomonas aeruginosa PA01
gccagcccggccucgccgguc

SEQ ID NO: 3395118 - RNA, 22 nt, Pseudomonas aeruginosa PA01
gccagcccggccucgccggucg

SEQ ID NO: 3395119 - RNA, 15 nt, Pseudomonas aeruginosa PA01
gccagcccggcggug

SEQ ID NO: 3395120 - RNA, 20 nt, Pseudomonas aeruginosa PA01
gccagcccggcggugaugcc

SEQ ID NO: 3395121 - RNA, 15 nt, Pseudomonas aeruginosa PA01
gccagcccucgccca

SEQ ID NO: 3395122 - RNA, 12 nt, Pseudomonas aeruginosa PA01
gccagcccuggu

SEQ ID NO: 3395123 - RNA, 21 nt, Pseudomonas aeruginosa PA01
gccagcccuuucagcggcugc

SEQ ID NO: 3395124 - RNA, 22 nt, Pseudomonas aeruginosa PA01
gccagcccuuucagcggcugcc

SEQ ID NO: 3395125 - RNA, 16 nt, Pseudomonas aeruginosa PA01
gccagccgacuggcgg

SEQ ID NO: 3395126 - RNA, 18 nt, Pseudomonas aeruginosa PA01
gccagccgagcaacucgg

SEQ ID NO: 3395127 - RNA, 21 nt, Pseudomonas aeruginosa PA01
gccagccgagcaacucggcgg

SEQ ID NO: 3395128 - RNA, 22 nt, Pseudomonas aeruginosa PA01
gccagcggaacgaaggacaggu

SEQ ID NO: 3395129 - RNA, 19 nt, Pseudomonas aeruginosa PA01
gccagcggaugcuggcgga

SEQ ID NO: 3395130 - RNA, 10 nt, Pseudomonas aeruginosa PA01
gccagcggca

SEQ ID NO: 3395131 - RNA, 17 nt, Pseudomonas aeruginosa PA01
gccagcggcagcgguuc

SEQ ID NO: 3395132 - RNA, 14 nt, Pseudomonas aeruginosa PA01
gccagcggcauccg

SEQ ID NO: 3395133 - RNA, 18 nt, Pseudomonas aeruginosa PA01
gccagcggcauccgccgc

SEQ ID NO: 3395134 - RNA, 19 nt, Pseudomonas aeruginosa PA01
gccagcggcauccgccgcu

SEQ ID NO: 3395135 - RNA, 15 nt, Pseudomonas aeruginosa PA01
gccagcggccagggc

SEQ ID NO: 3395136 - RNA, 15 nt, Pseudomonas aeruginosa PA01
gccagcggcccggca

SEQ ID NO: 3395137 - RNA, 17 nt, Pseudomonas aeruginosa PA01
gccagcggcccggcagg

SEQ ID NO: 3395138 - RNA, 15 nt, Pseudomonas aeruginosa PA01
gccagcggcgaucgc

SEQ ID NO: 3395139 - RNA, 16 nt, Pseudomonas aeruginosa PA01
gccagcggcgaucgcc

SEQ ID NO: 3395140 - RNA, 20 nt, Pseudomonas aeruginosa PA01
gccagcggcgaucgccuggu

SEQ ID NO: 3395141 - RNA, 21 nt, Pseudomonas aeruginosa PA01
gccagcggcgaucgccugguc

SEQ ID NO: 3395142 - RNA, 23 nt, Pseudomonas aeruginosa PA01
gccagcggcgaucgccuggucga

SEQ ID NO: 3395143 - RNA, 15 nt, Pseudomonas aeruginosa PA01
gccagcggcgcuugc

SEQ ID NO: 3395144 - RNA, 20 nt, Pseudomonas aeruginosa PA01
gccagcggcgcuugcgggcg

SEQ ID NO: 3395145 - RNA, 21 nt, Pseudomonas aeruginosa PA01
gccagcggcguauccucggcc

SEQ ID NO: 3395146 - RNA, 15 nt, Pseudomonas aeruginosa PA01
gccagcggcuccucg

SEQ ID NO: 3395147 - RNA, 16 nt, Pseudomonas aeruginosa PA01
gccagcggcuccucgg

SEQ ID NO: 3395148 - RNA, 18 nt, Pseudomonas aeruginosa PA01
gccagcggcuccucggcc

SEQ ID NO: 3395149 - RNA, 11 nt, Pseudomonas aeruginosa PA01
gccagcgggcg

SEQ ID NO: 3395150 - RNA, 15 nt, Pseudomonas aeruginosa PA01
gccagcgggcgccgc

SEQ ID NO: 3395151 - RNA, 20 nt, Pseudomonas aeruginosa PA01
gccagcgguacccgccggcc

SEQ ID NO: 3395152 - RNA, 21 nt, Pseudomonas aeruginosa PA01
gccagcgguacccgccggcca

SEQ ID NO: 3395153 - RNA, 17 nt, Pseudomonas aeruginosa PA01
gccagcgguugagcagg

SEQ ID NO: 3395154 - RNA, 18 nt, Pseudomonas aeruginosa PA01
gccagcguccuucggcgc

SEQ ID NO: 3395155 - RNA, 19 nt, Pseudomonas aeruginosa PA01
gccagcguccuucggcgcu

SEQ ID NO: 3395156 - RNA, 13 nt, Pseudomonas aeruginosa PA01
gccagcgucgccg

SEQ ID NO: 3395157 - RNA, 15 nt, Pseudomonas aeruginosa PA01
gccagcgucgccgcc

SEQ ID NO: 3395158 - RNA, 16 nt, Pseudomonas aeruginosa PA01
gccagcgucgccgccg

SEQ ID NO: 3395159 - RNA, 17 nt, Pseudomonas aeruginosa PA01
gccagcgucgccgccgc

SEQ ID NO: 3395160 - RNA, 22 nt, Pseudomonas aeruginosa PA01
gccagcgucgccgccgcgggcg

SEQ ID NO: 3395161 - RNA, 21 nt, Pseudomonas aeruginosa PA01
gccagcgucgccugccaggcg

SEQ ID NO: 3395162 - RNA, 18 nt, Pseudomonas aeruginosa PA01
gccagcgugaagaccugg

SEQ ID NO: 3395163 - RNA, 19 nt, Pseudomonas aeruginosa PA01
gccagcgugaagaccuggu

SEQ ID NO: 3395164 - RNA, 17 nt, Pseudomonas aeruginosa PA01
gccagcguugcaggucg

SEQ ID NO: 3395165 - RNA, 18 nt, Pseudomonas aeruginosa PA01
gccagcguugcaggucga

SEQ ID NO: 3395166 - RNA, 22 nt, Pseudomonas aeruginosa PA01
gccagcguuucgaagccgccgc

SEQ ID NO: 3395167 - RNA, 16 nt, Pseudomonas aeruginosa PA01
gccagcuaccggcagg

SEQ ID NO: 3395168 - RNA, 18 nt, Pseudomonas aeruginosa PA01
gccagcuaccggcagggu

SEQ ID NO: 3395169 - RNA, 14 nt, Pseudomonas aeruginosa PA01
gccagcuccagcac

SEQ ID NO: 3395170 - RNA, 16 nt, Pseudomonas aeruginosa PA01
gccagcuccagcaccg

SEQ ID NO: 3395171 - RNA, 13 nt, Pseudomonas aeruginosa PA01
gccagcuccagcg

SEQ ID NO: 3395172 - RNA, 15 nt, Pseudomonas aeruginosa PA01
gccagcuccagcgcc

SEQ ID NO: 3395173 - RNA, 20 nt, Pseudomonas aeruginosa PA01
gccagcuccagcgcccaggu

SEQ ID NO: 3395174 - RNA, 21 nt, Pseudomonas aeruginosa PA01
gccagcuccagcgcccaggug

SEQ ID NO: 3395175 - RNA, 19 nt, Pseudomonas aeruginosa PA01
gccagcuccgccugaccgc

SEQ ID NO: 3395176 - RNA, 21 nt, Pseudomonas aeruginosa PA01
gccagcuccgccugaccgcug

SEQ ID NO: 3395177 - RNA, 20 nt, Pseudomonas aeruginosa PA01
gccagcuccuugcucucgcg

SEQ ID NO: 3395178 - RNA, 21 nt, Pseudomonas aeruginosa PA01
gccagcuccuugcucucgcgc

SEQ ID NO: 3395179 - RNA, 17 nt, Pseudomonas aeruginosa PA01
gccagcucgaacagcac

SEQ ID NO: 3395180 - RNA, 18 nt, Pseudomonas aeruginosa PA01
gccagcucgaacagcacc

SEQ ID NO: 3395181 - RNA, 13 nt, Pseudomonas aeruginosa PA01
gccagcucgaccu

SEQ ID NO: 3395182 - RNA, 14 nt, Pseudomonas aeruginosa PA01
gccagcucgaccuu

SEQ ID NO: 3395183 - RNA, 19 nt, Pseudomonas aeruginosa PA01
gccagcucgaccuugcccu

SEQ ID NO: 3395184 - RNA, 16 nt, Pseudomonas aeruginosa PA01
gccagcucgcccgccu

SEQ ID NO: 3395185 - RNA, 18 nt, Pseudomonas aeruginosa PA01
gccagcucgcccgccucg

SEQ ID NO: 3395186 - RNA, 12 nt, Pseudomonas aeruginosa PA01
gccagcucgccg

SEQ ID NO: 3395187 - RNA, 14 nt, Pseudomonas aeruginosa PA01
gccagcucgccgcg

SEQ ID NO: 3395188 - RNA, 16 nt, Pseudomonas aeruginosa PA01
gccagcucgccgcgcu

SEQ ID NO: 3395189 - RNA, 20 nt, Pseudomonas aeruginosa PA01
gccagcucgccgcgcuccag

SEQ ID NO: 3395190 - RNA, 21 nt, Pseudomonas aeruginosa PA01
gccagcucgccgcgcuccagu

SEQ ID NO: 3395191 - RNA, 17 nt, Pseudomonas aeruginosa PA01
gccagcucgccggucaa

SEQ ID NO: 3395192 - RNA, 18 nt, Pseudomonas aeruginosa PA01
gccagcucgcuguccagc

SEQ ID NO: 3395193 - RNA, 18 nt, Pseudomonas aeruginosa PA01
gccagcucggacaagggc

SEQ ID NO: 3395194 - RNA, 19 nt, Pseudomonas aeruginosa PA01
gccagcucggacaagggcc

SEQ ID NO: 3395195 - RNA, 12 nt, Pseudomonas aeruginosa PA01
gccagcucggcc

SEQ ID NO: 3395196 - RNA, 13 nt, Pseudomonas aeruginosa PA01
gccagcucggccg

SEQ ID NO: 3395197 - RNA, 22 nt, Pseudomonas aeruginosa PA01
gccagcucggccggcaggcugu

SEQ ID NO: 3395198 - RNA, 13 nt, Pseudomonas aeruginosa PA01
gccagcucggcga

SEQ ID NO: 3395199 - RNA, 14 nt, Pseudomonas aeruginosa PA01
gccagcucggcgag

SEQ ID NO: 3395200 - RNA, 15 nt, Pseudomonas aeruginosa PA01
gccagcucuugcccu

SEQ ID NO: 3395201 - RNA, 20 nt, Pseudomonas aeruginosa PA01
gccagcucuugcccugccag

SEQ ID NO: 3395202 - RNA, 22 nt, Pseudomonas aeruginosa PA01
gccagcucuugcccugccagcg

SEQ ID NO: 3395203 - RNA, 12 nt, Pseudomonas aeruginosa PA01
gccagcuggcga

SEQ ID NO: 3395204 - RNA, 13 nt, Pseudomonas aeruginosa PA01
gccagcuucagcc

SEQ ID NO: 3395205 - RNA, 15 nt, Pseudomonas aeruginosa PA01
gccagcuucagccga

SEQ ID NO: 3395206 - RNA, 16 nt, Pseudomonas aeruginosa PA01
gccagcuuccaggcgc

SEQ ID NO: 3395207 - RNA, 13 nt, Pseudomonas aeruginosa PA01
gccagcuucucca

SEQ ID NO: 3395208 - RNA, 15 nt, Pseudomonas aeruginosa PA01
gccagcuucuccagc

SEQ ID NO: 3395209 - RNA, 23 nt, Pseudomonas aeruginosa PA01
gccagcuucuccagcagggucgc

SEQ ID NO: 3395210 - RNA, 22 nt, Pseudomonas aeruginosa PA01
gccagcuuguaguagcgcccga

SEQ ID NO: 3395211 - RNA, 13 nt, Pseudomonas aeruginosa PA01
gccagcuuguccg

SEQ ID NO: 3395212 - RNA, 17 nt, Pseudomonas aeruginosa PA01
gccaggaaaucgagcgc

SEQ ID NO: 3395213 - RNA, 19 nt, Pseudomonas aeruginosa PA01
gccaggaaaucgagcgcca

SEQ ID NO: 3395214 - RNA, 14 nt, Pseudomonas aeruginosa PA01
gccaggaacgccuc

SEQ ID NO: 3395215 - RNA, 19 nt, Pseudomonas aeruginosa PA01
gccaggaacgccucugcgc

SEQ ID NO: 3395216 - RNA, 19 nt, Pseudomonas aeruginosa PA01
gccaggaagagcccgccac

SEQ ID NO: 3395217 - RNA, 21 nt, Pseudomonas aeruginosa PA01
gccaggaagagcccgccacgc

SEQ ID NO: 3395218 - RNA, 15 nt, Pseudomonas aeruginosa PA01
gccaggaagccgcgc

SEQ ID NO: 3395219 - RNA, 15 nt, Pseudomonas aeruginosa PA01
gccaggaagcgggcc

SEQ ID NO: 3395220 - RNA, 14 nt, Pseudomonas aeruginosa PA01
gccaggaaggccgc

SEQ ID NO: 3395221 - RNA, 16 nt, Pseudomonas aeruginosa PA01
gccaggaaggccgcuu

SEQ ID NO: 3395222 - RNA, 21 nt, Pseudomonas aeruginosa PA01
gccaggaaggccgcuucgccg

SEQ ID NO: 3395223 - RNA, 19 nt, Pseudomonas aeruginosa PA01
gccaggacaauggacaagc

SEQ ID NO: 3395224 - RNA, 13 nt, Pseudomonas aeruginosa PA01
gccaggaccagcc

SEQ ID NO: 3395225 - RNA, 17 nt, Pseudomonas aeruginosa PA01
gccaggaccagcccguu

SEQ ID NO: 3395226 - RNA, 13 nt, Pseudomonas aeruginosa PA01
gccaggaccaggg

SEQ ID NO: 3395227 - RNA, 14 nt, Pseudomonas aeruginosa PA01
gccaggaccagggc

SEQ ID NO: 3395228 - RNA, 21 nt, Pseudomonas aeruginosa PA01
gccaggaccucgaagcuggcc

SEQ ID NO: 3395229 - RNA, 22 nt, Pseudomonas aeruginosa PA01
gccaggaccucgaagcuggcca

SEQ ID NO: 3395230 - RNA, 18 nt, Pseudomonas aeruginosa PA01
gccaggacgccaccaggc

SEQ ID NO: 3395231 - RNA, 20 nt, Pseudomonas aeruginosa PA01
gccaggcgaggaacagcgag

SEQ ID NO: 3395232 - RNA, 21 nt, Pseudomonas aeruginosa PA01
gccaggcgauccagcggguag

SEQ ID NO: 3395233 - RNA, 21 nt, Pseudomonas aeruginosa PA01
gccaggcgaugaacggcguca

SEQ ID NO: 3395234 - RNA, 21 nt, Pseudomonas aeruginosa PA01
gccaggcgauggugcgcucgc

SEQ ID NO: 3395235 - RNA, 22 nt, Pseudomonas aeruginosa PA01
gccaggcgauggugcgcucgcg

SEQ ID NO: 3395236 - RNA, 23 nt, Pseudomonas aeruginosa PA01
gccaggcgauggugcgcucgcgg

SEQ ID NO: 3395237 - RNA, 14 nt, Pseudomonas aeruginosa PA01
gccaggcgcaccag

SEQ ID NO: 3395238 - RNA, 18 nt, Pseudomonas aeruginosa PA01
gccaggcgcaccagcagg

SEQ ID NO: 3395239 - RNA, 19 nt, Pseudomonas aeruginosa PA01
gccaggcgcaccagcaggc

SEQ ID NO: 3395240 - RNA, 14 nt, Pseudomonas aeruginosa PA01
gccaggcgcagcca

SEQ ID NO: 3395241 - RNA, 15 nt, Pseudomonas aeruginosa PA01
gccaggcgcagccag

SEQ ID NO: 3395242 - RNA, 15 nt, Pseudomonas aeruginosa PA01
gccaggcgcaguagg

SEQ ID NO: 3395243 - RNA, 17 nt, Pseudomonas aeruginosa PA01
gccaggcgcagugccug

SEQ ID NO: 3395244 - RNA, 17 nt, Pseudomonas aeruginosa PA01
gccaggcgccagggccg

SEQ ID NO: 3395245 - RNA, 15 nt, Pseudomonas aeruginosa PA01
gccaggcgccgauca

SEQ ID NO: 3395246 - RNA, 12 nt, Pseudomonas aeruginosa PA01
gccaggcgcggu

SEQ ID NO: 3395247 - RNA, 13 nt, Pseudomonas aeruginosa PA01
gccaggcgcgguu

SEQ ID NO: 3395248 - RNA, 21 nt, Pseudomonas aeruginosa PA01
gccaggcgcgguugccgcugc

SEQ ID NO: 3395249 - RNA, 13 nt, Pseudomonas aeruginosa PA01
gccaggcgcgucg

SEQ ID NO: 3395250 - RNA, 15 nt, Pseudomonas aeruginosa PA01
gccaggcgcgucgcg

SEQ ID NO: 3395251 - RNA, 18 nt, Pseudomonas aeruginosa PA01
gccaggcgcgucgcggcc

SEQ ID NO: 3395252 - RNA, 18 nt, Pseudomonas aeruginosa PA01
gccaggcgcgucuccagc

SEQ ID NO: 3395253 - RNA, 22 nt, Pseudomonas aeruginosa PA01
gccaggcgcgucuccagcucgg

SEQ ID NO: 3395254 - RNA, 13 nt, Pseudomonas aeruginosa PA01
gccaggcgcucca

SEQ ID NO: 3395255 - RNA, 17 nt, Pseudomonas aeruginosa PA01
gccaggcgcuccagggc

SEQ ID NO: 3395256 - RNA, 13 nt, Pseudomonas aeruginosa PA01
gccaggcgcuccu

SEQ ID NO: 3395257 - RNA, 17 nt, Pseudomonas aeruginosa PA01
gccaggcgcuccuccag

SEQ ID NO: 3395258 - RNA, 21 nt, Pseudomonas aeruginosa PA01
gccaggcgcuccuccagcgcc

SEQ ID NO: 3395259 - RNA, 22 nt, Pseudomonas aeruginosa PA01
gccaggcgcuccuccagcgccg

SEQ ID NO: 3395260 - RNA, 23 nt, Pseudomonas aeruginosa PA01
gccaggcgcuccuccagcgccgc

SEQ ID NO: 3395261 - RNA, 13 nt, Pseudomonas aeruginosa PA01
gccaggcgcucgc

SEQ ID NO: 3395262 - RNA, 14 nt, Pseudomonas aeruginosa PA01
gccaggcgcucgcg

SEQ ID NO: 3395263 - RNA, 17 nt, Pseudomonas aeruginosa PA01
gccaggcgcucgcgcug

SEQ ID NO: 3395264 - RNA, 15 nt, Pseudomonas aeruginosa PA01
gccaggcgcuggcga

SEQ ID NO: 3395265 - RNA, 18 nt, Pseudomonas aeruginosa PA01
gccaggcgcugguccagc

SEQ ID NO: 3395266 - RNA, 13 nt, Pseudomonas aeruginosa PA01
gccaggcgcuugu

SEQ ID NO: 3395267 - RNA, 15 nt, Pseudomonas aeruginosa PA01
gccaggcggccgacg

SEQ ID NO: 3395268 - RNA, 16 nt, Pseudomonas aeruginosa PA01
gccaggcggccgacga

SEQ ID NO: 3395269 - RNA, 13 nt, Pseudomonas aeruginosa PA01
gccaggcggccgc

SEQ ID NO: 3395270 - RNA, 14 nt, Pseudomonas aeruginosa PA01
gccaggcggccgcu

SEQ ID NO: 3395271 - RNA, 19 nt, Pseudomonas aeruginosa PA01
gccaggcggccgcuggcga

SEQ ID NO: 3395272 - RNA, 12 nt, Pseudomonas aeruginosa PA01
gccaggcggcuc

SEQ ID NO: 3395273 - RNA, 15 nt, Pseudomonas aeruginosa PA01
gccaggcggcucccu

SEQ ID NO: 3395274 - RNA, 17 nt, Pseudomonas aeruginosa PA01
gccaggcgguccagcca

SEQ ID NO: 3395275 - RNA, 18 nt, Pseudomonas aeruginosa PA01
gccaggcgguccagccag

SEQ ID NO: 3395276 - RNA, 17 nt, Pseudomonas aeruginosa PA01
gccaggcguauucggcg

SEQ ID NO: 3395277 - RNA, 18 nt, Pseudomonas aeruginosa PA01
gccaggcguauucggcga

SEQ ID NO: 3395278 - RNA, 20 nt, Pseudomonas aeruginosa PA01
gccaggcguauucggcgacc

SEQ ID NO: 3395279 - RNA, 21 nt, Pseudomonas aeruginosa PA01
gccaggcguauucggcgacca

SEQ ID NO: 3395280 - RNA, 20 nt, Pseudomonas aeruginosa PA01
gccaggcgucccguuccgcu

SEQ ID NO: 3395281 - RNA, 16 nt, Pseudomonas aeruginosa PA01
gccaggcguuccagcu

SEQ ID NO: 3395282 - RNA, 21 nt, Pseudomonas aeruginosa PA01
gccaggcguuccagcucggcg

SEQ ID NO: 3395283 - RNA, 22 nt, Pseudomonas aeruginosa PA01
gccaggcguuccagcucggcga

SEQ ID NO: 3395284 - RNA, 13 nt, Pseudomonas aeruginosa PA01
gccaggcucgccg

SEQ ID NO: 3395285 - RNA, 15 nt, Pseudomonas aeruginosa PA01
gccaggcucgccgcc

SEQ ID NO: 3395286 - RNA, 19 nt, Pseudomonas aeruginosa PA01
gccaggcucgccgccagca

SEQ ID NO: 3395287 - RNA, 21 nt, Pseudomonas aeruginosa PA01
gccaggcucgccgccagcagg

SEQ ID NO: 3395288 - RNA, 22 nt, Pseudomonas aeruginosa PA01
gccaggcucgccgccagcagga

SEQ ID NO: 3395289 - RNA, 13 nt, Pseudomonas aeruginosa PA01
gccaggcucgcga

SEQ ID NO: 3395290 - RNA, 15 nt, Pseudomonas aeruginosa PA01
gccaggcucgcgaug

SEQ ID NO: 3395291 - RNA, 16 nt, Pseudomonas aeruginosa PA01
gccaggcucgcgaugc

SEQ ID NO: 3395292 - RNA, 17 nt, Pseudomonas aeruginosa PA01
gccaggcucgcgaugcu

SEQ ID NO: 3395293 - RNA, 19 nt, Pseudomonas aeruginosa PA01
gccaggcucgguucugcgc

SEQ ID NO: 3395294 - RNA, 22 nt, Pseudomonas aeruginosa PA01
gccaggcucgguucugcgcacc

SEQ ID NO: 3395295 - RNA, 23 nt, Pseudomonas aeruginosa PA01
gccaggcucuucuucgaaccgca

SEQ ID NO: 3395296 - RNA, 14 nt, Pseudomonas aeruginosa PA01
gccaggcugaccgc

SEQ ID NO: 3395297 - RNA, 20 nt, Pseudomonas aeruginosa PA01
gccaggcugaccgcgugggc

SEQ ID NO: 3395298 - RNA, 13 nt, Pseudomonas aeruginosa PA01
gccaggcuggcca

SEQ ID NO: 3395299 - RNA, 23 nt, Pseudomonas aeruginosa PA01
gccaggcuggccacgaacaggcu

SEQ ID NO: 3395300 - RNA, 22 nt, Pseudomonas aeruginosa PA01
gccaggcuggcugguaacgggc

SEQ ID NO: 3395301 - RNA, 20 nt, Pseudomonas aeruginosa PA01
gccaggcuggguuggcgcga

SEQ ID NO: 3395302 - RNA, 21 nt, Pseudomonas aeruginosa PA01
gccaggcuggguuggcgcgag

SEQ ID NO: 3395303 - RNA, 19 nt, Pseudomonas aeruginosa PA01
gccaggcugucagggcgca

SEQ ID NO: 3395304 - RNA, 17 nt, Pseudomonas aeruginosa PA01
gccaggcuuuccgccga

SEQ ID NO: 3395305 - RNA, 18 nt, Pseudomonas aeruginosa PA01
gccaggcuuuccgccgag

SEQ ID NO: 3395306 - RNA, 13 nt, Pseudomonas aeruginosa PA01
gccagggaaaagc

SEQ ID NO: 3395307 - RNA, 14 nt, Pseudomonas aeruginosa PA01
gccagggaaaagcc

SEQ ID NO: 3395308 - RNA, 18 nt, Pseudomonas aeruginosa PA01
gccagggaaaagcccagg

SEQ ID NO: 3395309 - RNA, 17 nt, Pseudomonas aeruginosa PA01
gccagggagcaggacgc

SEQ ID NO: 3395310 - RNA, 21 nt, Pseudomonas aeruginosa PA01
gccagggagcaggacgccgaa

SEQ ID NO: 3395311 - RNA, 16 nt, Pseudomonas aeruginosa PA01
gccagggaggcgcugg

SEQ ID NO: 3395312 - RNA, 21 nt, Pseudomonas aeruginosa PA01
gccagggaggcgcuggccagc

SEQ ID NO: 3395313 - RNA, 21 nt, Pseudomonas aeruginosa PA01
gccagggagucgcuggccauc

SEQ ID NO: 3395314 - RNA, 23 nt, Pseudomonas aeruginosa PA01
gccagggcaacgccaggcuguca

SEQ ID NO: 3395315 - RNA, 14 nt, Pseudomonas aeruginosa PA01
gccagggcagcagg

SEQ ID NO: 3395316 - RNA, 15 nt, Pseudomonas aeruginosa PA01
gccagggcagcaggu

SEQ ID NO: 3395317 - RNA, 16 nt, Pseudomonas aeruginosa PA01
gccagggcagcagguc

SEQ ID NO: 3395318 - RNA, 20 nt, Pseudomonas aeruginosa PA01
gccagggcagggaguccgcc

SEQ ID NO: 3395319 - RNA, 22 nt, Pseudomonas aeruginosa PA01
gccagggcaugggucagcgcca

SEQ ID NO: 3395320 - RNA, 15 nt, Pseudomonas aeruginosa PA01
gccagggcccacagu

SEQ ID NO: 3395321 - RNA, 19 nt, Pseudomonas aeruginosa PA01
gccagggcccacagugcca

SEQ ID NO: 3395322 - RNA, 21 nt, Pseudomonas aeruginosa PA01
gccagggcccacagugccagg

SEQ ID NO: 3395323 - RNA, 16 nt, Pseudomonas aeruginosa PA01
gccagggccgcgagag

SEQ ID NO: 3395324 - RNA, 21 nt, Pseudomonas aeruginosa PA01
gccagggccgcgagagguuca

SEQ ID NO: 3395325 - RNA, 15 nt, Pseudomonas aeruginosa PA01
gccagggccgcucga

SEQ ID NO: 3395326 - RNA, 19 nt, Pseudomonas aeruginosa PA01
gccagggccgcucgagggc

SEQ ID NO: 3395327 - RNA, 20 nt, Pseudomonas aeruginosa PA01
gccagggcgaacagcgccgc

SEQ ID NO: 3395328 - RNA, 22 nt, Pseudomonas aeruginosa PA01
gccagggcgaacagcgccgcgg

SEQ ID NO: 3395329 - RNA, 17 nt, Pseudomonas aeruginosa PA01
gccagggcgaggccgcu

SEQ ID NO: 3395330 - RNA, 18 nt, Pseudomonas aeruginosa PA01
gccagggcgaggccgcuc

SEQ ID NO: 3395331 - RNA, 19 nt, Pseudomonas aeruginosa PA01
gccagggcgaggccgcucu

SEQ ID NO: 3395332 - RNA, 13 nt, Pseudomonas aeruginosa PA01
gccagggcgcggu

SEQ ID NO: 3395333 - RNA, 17 nt, Pseudomonas aeruginosa PA01
gccagugcaugcgugca

SEQ ID NO: 3395334 - RNA, 14 nt, Pseudomonas aeruginosa PA01
gccagugccucgcg

SEQ ID NO: 3395335 - RNA, 15 nt, Pseudomonas aeruginosa PA01
gccagugccucgcgc

SEQ ID NO: 3395336 - RNA, 12 nt, Pseudomonas aeruginosa PA01
gccagugcucga

SEQ ID NO: 3395337 - RNA, 13 nt, Pseudomonas aeruginosa PA01
gccaguggcuggc

SEQ ID NO: 3395338 - RNA, 18 nt, Pseudomonas aeruginosa PA01
gccaguuccggcaacagu

SEQ ID NO: 3395339 - RNA, 22 nt, Pseudomonas aeruginosa PA01
gccaguuccggggucagcgccu

SEQ ID NO: 3395340 - RNA, 21 nt, Pseudomonas aeruginosa PA01
gccaguuccgugucgagggcg

SEQ ID NO: 3395341 - RNA, 13 nt, Pseudomonas aeruginosa PA01
gccaguuccuucg

SEQ ID NO: 3395342 - RNA, 17 nt, Pseudomonas aeruginosa PA01
gccaguuccuucgccga

SEQ ID NO: 3395343 - RNA, 20 nt, Pseudomonas aeruginosa PA01
gccaguuccuugaggucguc

SEQ ID NO: 3395344 - RNA, 15 nt, Pseudomonas aeruginosa PA01
gccaguucgccggug

SEQ ID NO: 3395345 - RNA, 16 nt, Pseudomonas aeruginosa PA01
gccaguucgccgguga

SEQ ID NO: 3395346 - RNA, 18 nt, Pseudomonas aeruginosa PA01
gccaguucgcgcaggugc

SEQ ID NO: 3395347 - RNA, 20 nt, Pseudomonas aeruginosa PA01
gccaguucggccaucagcac

SEQ ID NO: 3395348 - RNA, 15 nt, Pseudomonas aeruginosa PA01
gccaguucggggucg

SEQ ID NO: 3395349 - RNA, 21 nt, Pseudomonas aeruginosa PA01
gccaguucggggucggccugc

SEQ ID NO: 3395350 - RNA, 15 nt, Pseudomonas aeruginosa PA01
gccaguucgucgagc

SEQ ID NO: 3395351 - RNA, 22 nt, Pseudomonas aeruginosa PA01
gccaguucgucgagcaugccga

SEQ ID NO: 3395352 - RNA, 23 nt, Pseudomonas aeruginosa PA01
gccaguucgucgagcaugccgag

SEQ ID NO: 3395353 - RNA, 19 nt, Pseudomonas aeruginosa PA01
gccaguucucgcagcaggc

SEQ ID NO: 3395354 - RNA, 20 nt, Pseudomonas aeruginosa PA01
gccaguucucgcagcaggcg

SEQ ID NO: 3395355 - RNA, 13 nt, Pseudomonas aeruginosa PA01
gccaguugcgcuc

SEQ ID NO: 3395356 - RNA, 16 nt, Pseudomonas aeruginosa PA01
gccaguugcgcuccgg

SEQ ID NO: 3395357 - RNA, 23 nt, Pseudomonas aeruginosa PA01
gccaguugcgcuccgguggcgga

SEQ ID NO: 3395358 - RNA, 18 nt, Pseudomonas aeruginosa PA01
gccaguuggaaguugccg

SEQ ID NO: 3395359 - RNA, 14 nt, Pseudomonas aeruginosa PA01
gccaguuggcccuu

SEQ ID NO: 3395360 - RNA, 16 nt, Pseudomonas aeruginosa PA01
gccaguuggcccuuga

SEQ ID NO: 3395361 - RNA, 17 nt, Pseudomonas aeruginosa PA01
gccaguuggcccuugac

SEQ ID NO: 3395362 - RNA, 17 nt, Pseudomonas aeruginosa PA01
gccaguuggugcacgcg

SEQ ID NO: 3395363 - RNA, 21 nt, Pseudomonas aeruginosa PA01
gccaguuggugcacgcgccgg

SEQ ID NO: 3395364 - RNA, 19 nt, Pseudomonas aeruginosa PA01
gccaguuucuaucucccua

SEQ ID NO: 3395365 - RNA, 13 nt, Pseudomonas aeruginosa PA01
gccauacagcgcc

SEQ ID NO: 3395366 - RNA, 15 nt, Pseudomonas aeruginosa PA01
gccauacagcgccca

SEQ ID NO: 3395367 - RNA, 19 nt, Pseudomonas aeruginosa PA01
gccauaccggcaaggcggc

SEQ ID NO: 3395368 - RNA, 18 nt, Pseudomonas aeruginosa PA01
gccauaccuccagccagc

SEQ ID NO: 3395369 - RNA, 20 nt, Pseudomonas aeruginosa PA01
gccauacucggacggcucgc

SEQ ID NO: 3395370 - RNA, 17 nt, Pseudomonas aeruginosa PA01
gccauagagugcccagg

SEQ ID NO: 3395371 - RNA, 21 nt, Pseudomonas aeruginosa PA01
gccauagagugcccaggcgcu

SEQ ID NO: 3395372 - RNA, 14 nt, Pseudomonas aeruginosa PA01
gccauagccgacga

SEQ ID NO: 3395373 - RNA, 21 nt, Pseudomonas aeruginosa PA01
gccauagcgccggcaccgagg

SEQ ID NO: 3395374 - RNA, 13 nt, Pseudomonas aeruginosa PA01
gccauagcgcgcc

SEQ ID NO: 3395375 - RNA, 14 nt, Pseudomonas aeruginosa PA01
gccauagcgcgccg

SEQ ID NO: 3395376 - RNA, 16 nt, Pseudomonas aeruginosa PA01
gccauagcgcgccggg

SEQ ID NO: 3395377 - RNA, 17 nt, Pseudomonas aeruginosa PA01
gccauagcgcgccgggu

SEQ ID NO: 3395378 - RNA, 18 nt, Pseudomonas aeruginosa PA01
gccauagcgcgccggguu

SEQ ID NO: 3395379 - RNA, 20 nt, Pseudomonas aeruginosa PA01
gccauaggaugccgaggugu

SEQ ID NO: 3395380 - RNA, 23 nt, Pseudomonas aeruginosa PA01
gccauaggcauauucuucaacag

SEQ ID NO: 3395381 - RNA, 12 nt, Pseudomonas aeruginosa PA01
gccauaggcggc

SEQ ID NO: 3395382 - RNA, 16 nt, Pseudomonas aeruginosa PA01
gccauaggcggcgcag

SEQ ID NO: 3395383 - RNA, 17 nt, Pseudomonas aeruginosa PA01
gccauaggcggcgcaga

SEQ ID NO: 3395384 - RNA, 15 nt, Pseudomonas aeruginosa PA01
gccauauagcgcugu

SEQ ID NO: 3395385 - RNA, 17 nt, Pseudomonas aeruginosa PA01
gccauauuucgaagggu

SEQ ID NO: 3395386 - RNA, 16 nt, Pseudomonas aeruginosa PA01
gccaucaacggauauc

SEQ ID NO: 3395387 - RNA, 17 nt, Pseudomonas aeruginosa PA01
gccaucaccagcggcga

SEQ ID NO: 3395388 - RNA, 22 nt, Pseudomonas aeruginosa PA01
gccaucaccagcggcgagcagg

SEQ ID NO: 3395389 - RNA, 13 nt, Pseudomonas aeruginosa PA01
gccaucagcacca

SEQ ID NO: 3395390 - RNA, 15 nt, Pseudomonas aeruginosa PA01
gccaucagcaccagg

SEQ ID NO: 3395391 - RNA, 21 nt, Pseudomonas aeruginosa PA01
gccaucagcaccaggaagccc

SEQ ID NO: 3395392 - RNA, 19 nt, Pseudomonas aeruginosa PA01
gccaucagcacgaaagcca

SEQ ID NO: 3395393 - RNA, 15 nt, Pseudomonas aeruginosa PA01
gccaucagcgccagg

SEQ ID NO: 3395394 - RNA, 16 nt, Pseudomonas aeruginosa PA01
gccaucagcgccaggg

SEQ ID NO: 3395395 - RNA, 20 nt, Pseudomonas aeruginosa PA01
gccaucagcgccgccucgcu

SEQ ID NO: 3395396 - RNA, 14 nt, Pseudomonas aeruginosa PA01
gccaucaggccgcg

SEQ ID NO: 3395397 - RNA, 16 nt, Pseudomonas aeruginosa PA01
gccaucaggccgcggc

SEQ ID NO: 3395398 - RNA, 19 nt, Pseudomonas aeruginosa PA01
gccaucaggccgcggcccu

SEQ ID NO: 3395399 - RNA, 15 nt, Pseudomonas aeruginosa PA01
gccaucaggcgcugu

SEQ ID NO: 3395400 - RNA, 13 nt, Pseudomonas aeruginosa PA01
gccaucagggucg

SEQ ID NO: 3395401 - RNA, 19 nt, Pseudomonas aeruginosa PA01
gccaucagugacauccucc

SEQ ID NO: 3395402 - RNA, 17 nt, Pseudomonas aeruginosa PA01
gccaucagugccugcac

SEQ ID NO: 3395403 - RNA, 15 nt, Pseudomonas aeruginosa PA01
gccauccagccaggc

SEQ ID NO: 3395404 - RNA, 18 nt, Pseudomonas aeruginosa PA01
gccauccagccaggcgcu

SEQ ID NO: 3395405 - RNA, 20 nt, Pseudomonas aeruginosa PA01
gccauccagccaggcgcucu

SEQ ID NO: 3395406 - RNA, 13 nt, Pseudomonas aeruginosa PA01
gccauccagcgcc

SEQ ID NO: 3395407 - RNA, 14 nt, Pseudomonas aeruginosa PA01
gccauccagcgccu

SEQ ID NO: 3395408 - RNA, 14 nt, Pseudomonas aeruginosa PA01
gccauccccgaggc

SEQ ID NO: 3395409 - RNA, 21 nt, Pseudomonas aeruginosa PA01
gccauccccgaggcgacgccc

SEQ ID NO: 3395410 - RNA, 23 nt, Pseudomonas aeruginosa PA01
gccauccccgaggcgacgcccug

SEQ ID NO: 3395411 - RNA, 21 nt, Pseudomonas aeruginosa PA01
gccaucccucuaucacacugu

SEQ ID NO: 3395412 - RNA, 19 nt, Pseudomonas aeruginosa PA01
gccauccgcagucuucucg

SEQ ID NO: 3395413 - RNA, 12 nt, Pseudomonas aeruginosa PA01
gccauccgccuu

SEQ ID NO: 3395414 - RNA, 13 nt, Pseudomonas aeruginosa PA01
gccauccgcgccg

SEQ ID NO: 3395415 - RNA, 14 nt, Pseudomonas aeruginosa PA01
gccauccgcgccga

SEQ ID NO: 3395416 - RNA, 16 nt, Pseudomonas aeruginosa PA01
gccauccgcgccgacc

SEQ ID NO: 3395417 - RNA, 19 nt, Pseudomonas aeruginosa PA01
gccauccgcgccgaccagc

SEQ ID NO: 3395418 - RNA, 17 nt, Pseudomonas aeruginosa PA01
gccauccggggugggca

SEQ ID NO: 3395419 - RNA, 15 nt, Pseudomonas aeruginosa PA01
gccauccuccagcac

SEQ ID NO: 3395420 - RNA, 16 nt, Pseudomonas aeruginosa PA01
gccauccuccagcgcc

SEQ ID NO: 3395421 - RNA, 18 nt, Pseudomonas aeruginosa PA01
gccauccuccagcgccgc

SEQ ID NO: 3395422 - RNA, 19 nt, Pseudomonas aeruginosa PA01
gccauccuccagcgccgca

SEQ ID NO: 3395423 - RNA, 16 nt, Pseudomonas aeruginosa PA01
gccauccuccgaggcc

SEQ ID NO: 3395424 - RNA, 13 nt, Pseudomonas aeruginosa PA01
gccauccuggccg

SEQ ID NO: 3395425 - RNA, 14 nt, Pseudomonas aeruginosa PA01
gccauccuggccgg

SEQ ID NO: 3395426 - RNA, 14 nt, Pseudomonas aeruginosa PA01
gccauccuggucgc

SEQ ID NO: 3395427 - RNA, 14 nt, Pseudomonas aeruginosa PA01
gccauccuucggcg

SEQ ID NO: 3395428 - RNA, 16 nt, Pseudomonas aeruginosa PA01
gccaucgaaaucgccc

SEQ ID NO: 3395429 - RNA, 12 nt, Pseudomonas aeruginosa PA01
gccaucgaccag

SEQ ID NO: 3395430 - RNA, 20 nt, Pseudomonas aeruginosa PA01
gccaucgaccaggaauuccu

SEQ ID NO: 3395431 - RNA, 19 nt, Pseudomonas aeruginosa PA01
gccaucgaggccaggccga

SEQ ID NO: 3395432 - RNA, 20 nt, Pseudomonas aeruginosa PA01
gccaucgaggccaggccgag

SEQ ID NO: 3395433 - RNA, 22 nt, Pseudomonas aeruginosa PA01
gccaucgaggccaggccgagcg

SEQ ID NO: 3395434 - RNA, 23 nt, Pseudomonas aeruginosa PA01
gccaucgaggccaggccgagcgc

SEQ ID NO: 3395435 - RNA, 12 nt, Pseudomonas aeruginosa PA01
gccaucgaucag

SEQ ID NO: 3395436 - RNA, 23 nt, Pseudomonas aeruginosa PA01
gccauucgaauggcgccggccag

SEQ ID NO: 3395437 - RNA, 14 nt, Pseudomonas aeruginosa PA01
gccauucgccgcga

SEQ ID NO: 3395438 - RNA, 22 nt, Pseudomonas aeruginosa PA01
gccauucgccgcgacgcuccag

SEQ ID NO: 3395439 - RNA, 21 nt, Pseudomonas aeruginosa PA01
gccauucgcugucgagcaggg

SEQ ID NO: 3395440 - RNA, 15 nt, Pseudomonas aeruginosa PA01
gccauucggcgacgg

SEQ ID NO: 3395441 - RNA, 17 nt, Pseudomonas aeruginosa PA01
gccauucggcuuccugg

SEQ ID NO: 3395442 - RNA, 14 nt, Pseudomonas aeruginosa PA01
gccauucucgccau

SEQ ID NO: 3395443 - RNA, 16 nt, Pseudomonas aeruginosa PA01
gccauugaacggaccu

SEQ ID NO: 3395444 - RNA, 14 nt, Pseudomonas aeruginosa PA01
gccauugaaggccg

SEQ ID NO: 3395445 - RNA, 23 nt, Pseudomonas aeruginosa PA01
gccauugcagguaguccagccag

SEQ ID NO: 3395446 - RNA, 21 nt, Pseudomonas aeruginosa PA01
gccauugcccgguggccuccu

SEQ ID NO: 3395447 - RNA, 23 nt, Pseudomonas aeruginosa PA01
gccauugccgaugugcacgcuga

SEQ ID NO: 3395448 - RNA, 13 nt, Pseudomonas aeruginosa PA01
gccauugccgcca

SEQ ID NO: 3395449 - RNA, 14 nt, Pseudomonas aeruginosa PA01
gccauugccgccag

SEQ ID NO: 3395450 - RNA, 17 nt, Pseudomonas aeruginosa PA01
gccauugccgccaggug

SEQ ID NO: 3395451 - RNA, 20 nt, Pseudomonas aeruginosa PA01
gccauugcuugagcaguucg

SEQ ID NO: 3395452 - RNA, 16 nt, Pseudomonas aeruginosa PA01
gccauuggccaggguc

SEQ ID NO: 3395453 - RNA, 13 nt, Pseudomonas aeruginosa PA01
gccauugugcgcg

SEQ ID NO: 3395454 - RNA, 15 nt, Pseudomonas aeruginosa PA01
gccauuucaaggcga

SEQ ID NO: 3395455 - RNA, 14 nt, Pseudomonas aeruginosa PA01
gccauuucugcugu

SEQ ID NO: 3395456 - RNA, 15 nt, Pseudomonas aeruginosa PA01
gccauuucugcugug

SEQ ID NO: 3395457 - RNA, 22 nt, Pseudomonas aeruginosa PA01
gcccaacagcggugugcucagg

SEQ ID NO: 3395458 - RNA, 20 nt, Pseudomonas aeruginosa PA01
gcccaacgucuucaggcgcu

SEQ ID NO: 3395459 - RNA, 20 nt, Pseudomonas aeruginosa PA01
gcccaacuggcggaugcguu

SEQ ID NO: 3395460 - RNA, 14 nt, Pseudomonas aeruginosa PA01
gcccaagccgagcg

SEQ ID NO: 3395461 - RNA, 18 nt, Pseudomonas aeruginosa PA01
gcccaagggccugggcgc

SEQ ID NO: 3395462 - RNA, 21 nt, Pseudomonas aeruginosa PA01
gcccaagggccugggcgccgc

SEQ ID NO: 3395463 - RNA, 20 nt, Pseudomonas aeruginosa PA01
gcccaagggcuccgcaagga

SEQ ID NO: 3395464 - RNA, 15 nt, Pseudomonas aeruginosa PA01
gcccaauacccacag

SEQ ID NO: 3395465 - RNA, 16 nt, Pseudomonas aeruginosa PA01
gcccaauacccacagg

SEQ ID NO: 3395466 - RNA, 23 nt, Pseudomonas aeruginosa PA01
gcccaauacccacaggguggcgg

SEQ ID NO: 3395467 - RNA, 15 nt, Pseudomonas aeruginosa PA01
gcccaauccgcgccg

SEQ ID NO: 3395468 - RNA, 16 nt, Pseudomonas aeruginosa PA01
gcccaauccgcgccgg

SEQ ID NO: 3395469 - RNA, 17 nt, Pseudomonas aeruginosa PA01
gcccacaaccugccgau

SEQ ID NO: 3395470 - RNA, 21 nt, Pseudomonas aeruginosa PA01
gcccacaaccugccgaucgcc

SEQ ID NO: 3395471 - RNA, 16 nt, Pseudomonas aeruginosa PA01
gcccacagugccaggc

SEQ ID NO: 3395472 - RNA, 17 nt, Pseudomonas aeruginosa PA01
gcccacagugccaggcu

SEQ ID NO: 3395473 - RNA, 11 nt, Pseudomonas aeruginosa PA01
gcccaccaacg

SEQ ID NO: 3395474 - RNA, 15 nt, Pseudomonas aeruginosa PA01
gcccaccaccaggac

SEQ ID NO: 3395475 - RNA, 16 nt, Pseudomonas aeruginosa PA01
gcccaccagcgucgcc

SEQ ID NO: 3395476 - RNA, 19 nt, Pseudomonas aeruginosa PA01
gcccaccagcgucgccagg

SEQ ID NO: 3395477 - RNA, 20 nt, Pseudomonas aeruginosa PA01
gcccaccagcgucgccaggc

SEQ ID NO: 3395478 - RNA, 21 nt, Pseudomonas aeruginosa PA01
gcccaccagcgucgccaggcc

SEQ ID NO: 3395479 - RNA, 23 nt, Pseudomonas aeruginosa PA01
gcccaccagcgucgccaggccgu

SEQ ID NO: 3395480 - RNA, 15 nt, Pseudomonas aeruginosa PA01
gcccaccaggucgcc

SEQ ID NO: 3395481 - RNA, 16 nt, Pseudomonas aeruginosa PA01
gcccaccaggucgccg

SEQ ID NO: 3395482 - RNA, 21 nt, Pseudomonas aeruginosa PA01
gcccacccccagcccggccau

SEQ ID NO: 3395483 - RNA, 23 nt, Pseudomonas aeruginosa PA01
gcccacccccagcccggccaucc

SEQ ID NO: 3395484 - RNA, 19 nt, Pseudomonas aeruginosa PA01
gcccacccccggcccggcc

SEQ ID NO: 3395485 - RNA, 22 nt, Pseudomonas aeruginosa PA01
gcccaccccggacugcccgacg

SEQ ID NO: 3395486 - RNA, 12 nt, Pseudomonas aeruginosa PA01
gcccacccugcg

SEQ ID NO: 3395487 - RNA, 13 nt, Pseudomonas aeruginosa PA01
gcccacccugcgc

SEQ ID NO: 3395488 - RNA, 18 nt, Pseudomonas aeruginosa PA01
gcccacccugcgcgagga

SEQ ID NO: 3395489 - RNA, 12 nt, Pseudomonas aeruginosa PA01
gcccaccgcggg

SEQ ID NO: 3395490 - RNA, 17 nt, Pseudomonas aeruginosa PA01
gcccaccgcgggggucg

SEQ ID NO: 3395491 - RNA, 20 nt, Pseudomonas aeruginosa PA01
gcccaccugaacgcgcccgg

SEQ ID NO: 3395492 - RNA, 16 nt, Pseudomonas aeruginosa PA01
gcccacgcagaaggcg

SEQ ID NO: 3395493 - RNA, 22 nt, Pseudomonas aeruginosa PA01
gcccacgcagaaggcgcuuucg

SEQ ID NO: 3395494 - RNA, 17 nt, Pseudomonas aeruginosa PA01
gcccacgcccaucggcg

SEQ ID NO: 3395495 - RNA, 23 nt, Pseudomonas aeruginosa PA01
gcccacgcccaucggcgucggcu

SEQ ID NO: 3395496 - RNA, 15 nt, Pseudomonas aeruginosa PA01
gcccacgccgaaggc

SEQ ID NO: 3395497 - RNA, 15 nt, Pseudomonas aeruginosa PA01
gcccacgccuugcag

SEQ ID NO: 3395498 - RNA, 17 nt, Pseudomonas aeruginosa PA01
gcccacgccuugcagca

SEQ ID NO: 3395499 - RNA, 20 nt, Pseudomonas aeruginosa PA01
gcccacgccuugcagcaccg

SEQ ID NO: 3395500 - RNA, 22 nt, Pseudomonas aeruginosa PA01
gcccacgccuugcagcaccgcc

SEQ ID NO: 3395501 - RNA, 14 nt, Pseudomonas aeruginosa PA01
gcccacgcgccugg

SEQ ID NO: 3395502 - RNA, 16 nt, Pseudomonas aeruginosa PA01
gcccacgcgccuggcc

SEQ ID NO: 3395503 - RNA, 17 nt, Pseudomonas aeruginosa PA01
gcccacgcgccuggccg

SEQ ID NO: 3395504 - RNA, 20 nt, Pseudomonas aeruginosa PA01
gcccacgcgccuggccgucu

SEQ ID NO: 3395505 - RNA, 15 nt, Pseudomonas aeruginosa PA01
gcccacggccaggcc

SEQ ID NO: 3395506 - RNA, 16 nt, Pseudomonas aeruginosa PA01
gcccacggccaggccc

SEQ ID NO: 3395507 - RNA, 21 nt, Pseudomonas aeruginosa PA01
gcccacggcgagacuaccgau

SEQ ID NO: 3395508 - RNA, 13 nt, Pseudomonas aeruginosa PA01
gcccacggcgccu

SEQ ID NO: 3395509 - RNA, 18 nt, Pseudomonas aeruginosa PA01
gcccacgggcggccgacg

SEQ ID NO: 3395510 - RNA, 22 nt, Pseudomonas aeruginosa PA01
gcccacgggcggccgacgugca

SEQ ID NO: 3395511 - RNA, 11 nt, Pseudomonas aeruginosa PA01
gcccacuccaa

SEQ ID NO: 3395512 - RNA, 19 nt, Pseudomonas aeruginosa PA01
gcccacuccuccgccugca

SEQ ID NO: 3395513 - RNA, 21 nt, Pseudomonas aeruginosa PA01
gcccacuccuccgccugcacg

SEQ ID NO: 3395514 - RNA, 18 nt, Pseudomonas aeruginosa PA01
gcccacucgauggugggc

SEQ ID NO: 3395515 - RNA, 21 nt, Pseudomonas aeruginosa PA01
gcccacucgauggugggcucu

SEQ ID NO: 3395516 - RNA, 13 nt, Pseudomonas aeruginosa PA01
gcccacucuucag

SEQ ID NO: 3395517 - RNA, 18 nt, Pseudomonas aeruginosa PA01
gcccacucuucagucccu

SEQ ID NO: 3395518 - RNA, 13 nt, Pseudomonas aeruginosa PA01
gcccagaacagca

SEQ ID NO: 3395519 - RNA, 14 nt, Pseudomonas aeruginosa PA01
gcccagaacagcaa

SEQ ID NO: 3395520 - RNA, 21 nt, Pseudomonas aeruginosa PA01
gcccagaacagcaaagcgcag

SEQ ID NO: 3395521 - RNA, 23 nt, Pseudomonas aeruginosa PA01
gcccagaacagcaaagcgcaggu

SEQ ID NO: 3395522 - RNA, 12 nt, Pseudomonas aeruginosa PA01
gcccagacccca

SEQ ID NO: 3395523 - RNA, 15 nt, Pseudomonas aeruginosa PA01
gcccagacgccgcuc

SEQ ID NO: 3395524 - RNA, 16 nt, Pseudomonas aeruginosa PA01
gcccagacgccgcucu

SEQ ID NO: 3395525 - RNA, 16 nt, Pseudomonas aeruginosa PA01
gcccagagcagcacca

SEQ ID NO: 3395526 - RNA, 23 nt, Pseudomonas aeruginosa PA01
gcccagaucauguagagcaggcu

SEQ ID NO: 3395527 - RNA, 18 nt, Pseudomonas aeruginosa PA01
gcccagauccccugcagg

SEQ ID NO: 3395528 - RNA, 18 nt, Pseudomonas aeruginosa PA01
gcccagaugaucaggccg

SEQ ID NO: 3395529 - RNA, 20 nt, Pseudomonas aeruginosa PA01
gcccagaugaucaggccgag

SEQ ID NO: 3395530 - RNA, 22 nt, Pseudomonas aeruginosa PA01
gcccagaugaucaggccgagca

SEQ ID NO: 3395531 - RNA, 23 nt, Pseudomonas aeruginosa PA01
gcccagaugaucaggccgagcac

SEQ ID NO: 3395532 - RNA, 13 nt, Pseudomonas aeruginosa PA01
gcccagcaccaca

SEQ ID NO: 3395533 - RNA, 15 nt, Pseudomonas aeruginosa PA01
gcccagcaccacagc

SEQ ID NO: 3395534 - RNA, 16 nt, Pseudomonas aeruginosa PA01
gcccagcaccacagca

SEQ ID NO: 3395535 - RNA, 19 nt, Pseudomonas aeruginosa PA01
gcccagcaccacagcacca

SEQ ID NO: 3395536 - RNA, 14 nt, Pseudomonas aeruginosa PA01
gcccagcaccgagc

SEQ ID NO: 3395537 - RNA, 21 nt, Pseudomonas aeruginosa PA01
gcccagcaccgagcugaucgc

SEQ ID NO: 3395538 - RNA, 14 nt, Pseudomonas aeruginosa PA01
gcccaggccgaagu

SEQ ID NO: 3395539 - RNA, 20 nt, Pseudomonas aeruginosa PA01
gcccaggccgccgauccagg

SEQ ID NO: 3395540 - RNA, 15 nt, Pseudomonas aeruginosa PA01
gcccaggccgcuggc

SEQ ID NO: 3395541 - RNA, 15 nt, Pseudomonas aeruginosa PA01
gcccaggccgggucg

SEQ ID NO: 3395542 - RNA, 14 nt, Pseudomonas aeruginosa PA01
gcccaggcgcaccu

SEQ ID NO: 3395543 - RNA, 17 nt, Pseudomonas aeruginosa PA01
gcccaggcgccgcucga

SEQ ID NO: 3395544 - RNA, 21 nt, Pseudomonas aeruginosa PA01
gcccaggcgccgcucgaugcc

SEQ ID NO: 3395545 - RNA, 14 nt, Pseudomonas aeruginosa PA01
gcccaggcgcucgg

SEQ ID NO: 3395546 - RNA, 16 nt, Pseudomonas aeruginosa PA01
gcccaggcgcucggcg

SEQ ID NO: 3395547 - RNA, 17 nt, Pseudomonas aeruginosa PA01
gcccaggcgcucggcga

SEQ ID NO: 3395548 - RNA, 20 nt, Pseudomonas aeruginosa PA01
gcccaggcgcucggcgaccu

SEQ ID NO: 3395549 - RNA, 22 nt, Pseudomonas aeruginosa PA01
gcccaggcgcucggcgaccuug

SEQ ID NO: 3395550 - RNA, 24 nt, Pseudomonas aeruginosa PA01
gcccaggcgcucggcgaccuugcg

SEQ ID NO: 3395551 - RNA, 22 nt, Pseudomonas aeruginosa PA01
gcccaggcgcucggcggcgcgc

SEQ ID NO: 3395552 - RNA, 14 nt, Pseudomonas aeruginosa PA01
gcccaggcgcuggc

SEQ ID NO: 3395553 - RNA, 15 nt, Pseudomonas aeruginosa PA01
gcccaggcgcuggcg

SEQ ID NO: 3395554 - RNA, 18 nt, Pseudomonas aeruginosa PA01
gcccaggcgcuggcgccg

SEQ ID NO: 3395555 - RNA, 22 nt, Pseudomonas aeruginosa PA01
gcccaggcgcuggcgccgaugc

SEQ ID NO: 3395556 - RNA, 23 nt, Pseudomonas aeruginosa PA01
gcccaggcgcuggcgccgaugcu

SEQ ID NO: 3395557 - RNA, 19 nt, Pseudomonas aeruginosa PA01
gcccaggcgguuguucagc

SEQ ID NO: 3395558 - RNA, 15 nt, Pseudomonas aeruginosa PA01
gcccaggcgucgcgc

SEQ ID NO: 3395559 - RNA, 17 nt, Pseudomonas aeruginosa PA01
gcccaggcgucgcgcca

SEQ ID NO: 3395560 - RNA, 21 nt, Pseudomonas aeruginosa PA01
gcccaggcgucgcgccagcac

SEQ ID NO: 3395561 - RNA, 20 nt, Pseudomonas aeruginosa PA01
gcccaggcugaggucgcggg

SEQ ID NO: 3395562 - RNA, 12 nt, Pseudomonas aeruginosa PA01
gcccaggcugcc

SEQ ID NO: 3395563 - RNA, 17 nt, Pseudomonas aeruginosa PA01
gcccaggcugccgccgc

SEQ ID NO: 3395564 - RNA, 23 nt, Pseudomonas aeruginosa PA01
gcccaggcugccgccgccgucga

SEQ ID NO: 3395565 - RNA, 17 nt, Pseudomonas aeruginosa PA01
gcccaggcugccggcca

SEQ ID NO: 3395566 - RNA, 20 nt, Pseudomonas aeruginosa PA01
gcccaggcugccggccaggu

SEQ ID NO: 3395567 - RNA, 15 nt, Pseudomonas aeruginosa PA01
gcccaggcuggcggc

SEQ ID NO: 3395568 - RNA, 16 nt, Pseudomonas aeruginosa PA01
gcccaggcuggcggcc

SEQ ID NO: 3395569 - RNA, 17 nt, Pseudomonas aeruginosa PA01
gcccagggacgcgccgg

SEQ ID NO: 3395570 - RNA, 18 nt, Pseudomonas aeruginosa PA01
gcccagggacgcgccggc

SEQ ID NO: 3395571 - RNA, 12 nt, Pseudomonas aeruginosa PA01
gcccagggccag

SEQ ID NO: 3395572 - RNA, 13 nt, Pseudomonas aeruginosa PA01
gcccagggccagc

SEQ ID NO: 3395573 - RNA, 17 nt, Pseudomonas aeruginosa PA01
gcccagggccagcagcg

SEQ ID NO: 3395574 - RNA, 23 nt, Pseudomonas aeruginosa PA01
gcccagggccagcagcggcggcg

SEQ ID NO: 3395575 - RNA, 15 nt, Pseudomonas aeruginosa PA01
gcccagggccagcgg

SEQ ID NO: 3395576 - RNA, 16 nt, Pseudomonas aeruginosa PA01
gcccagggccagcggg

SEQ ID NO: 3395577 - RNA, 17 nt, Pseudomonas aeruginosa PA01
gcccagggccagcgggu

SEQ ID NO: 3395578 - RNA, 19 nt, Pseudomonas aeruginosa PA01
gcccagggccagcggguug

SEQ ID NO: 3395579 - RNA, 16 nt, Pseudomonas aeruginosa PA01
gcccagggcccagagc

SEQ ID NO: 3395580 - RNA, 18 nt, Pseudomonas aeruginosa PA01
gcccagggcgaucgucga

SEQ ID NO: 3395581 - RNA, 16 nt, Pseudomonas aeruginosa PA01
gcccagggcguggucg

SEQ ID NO: 3395582 - RNA, 23 nt, Pseudomonas aeruginosa PA01
gcccagggcguggucggcggccu

SEQ ID NO: 3395583 - RNA, 17 nt, Pseudomonas aeruginosa PA01
gcccagggcuucgcggu

SEQ ID NO: 3395584 - RNA, 15 nt, Pseudomonas aeruginosa PA01
gcccagggggccggg

SEQ ID NO: 3395585 - RNA, 20 nt, Pseudomonas aeruginosa PA01
gcccagggggccgggccgau

SEQ ID NO: 3395586 - RNA, 17 nt, Pseudomonas aeruginosa PA01
gcccagggugacgcucu

SEQ ID NO: 3395587 - RNA, 15 nt, Pseudomonas aeruginosa PA01
gcccagguacugggc

SEQ ID NO: 3395588 - RNA, 17 nt, Pseudomonas aeruginosa PA01
gcccagguacugggcga

SEQ ID NO: 3395589 - RNA, 18 nt, Pseudomonas aeruginosa PA01
gcccagguagccggcgag

SEQ ID NO: 3395590 - RNA, 21 nt, Pseudomonas aeruginosa PA01
gcccagguaggcgaugcgcgu

SEQ ID NO: 3395591 - RNA, 17 nt, Pseudomonas aeruginosa PA01
gcccagguagucgccca

SEQ ID NO: 3395592 - RNA, 19 nt, Pseudomonas aeruginosa PA01
gcccagguagucgcccagc

SEQ ID NO: 3395593 - RNA, 15 nt, Pseudomonas aeruginosa PA01
gcccaggugcgccga

SEQ ID NO: 3395594 - RNA, 17 nt, Pseudomonas aeruginosa PA01
gcccaggugcgccgagc

SEQ ID NO: 3395595 - RNA, 20 nt, Pseudomonas aeruginosa PA01
gcccaggugcgccgagcgcu

SEQ ID NO: 3395596 - RNA, 23 nt, Pseudomonas aeruginosa PA01
gcccaggugcgccgagcgcucgc

SEQ ID NO: 3395597 - RNA, 16 nt, Pseudomonas aeruginosa PA01
gcccagguggcaggcc

SEQ ID NO: 3395598 - RNA, 17 nt, Pseudomonas aeruginosa PA01
gcccagguggcaggccu

SEQ ID NO: 3395599 - RNA, 20 nt, Pseudomonas aeruginosa PA01
gcccagguggcaggccugga

SEQ ID NO: 3395600 - RNA, 16 nt, Pseudomonas aeruginosa PA01
gcccaguacccgcugg

SEQ ID NO: 3395601 - RNA, 14 nt, Pseudomonas aeruginosa PA01
gcccaguaccgcca

SEQ ID NO: 3395602 - RNA, 17 nt, Pseudomonas aeruginosa PA01
gcccagugcccggcaga

SEQ ID NO: 3395603 - RNA, 18 nt, Pseudomonas aeruginosa PA01
gcccagugguuccaggag

SEQ ID NO: 3395604 - RNA, 11 nt, Pseudomonas aeruginosa PA01
gcccaguucgc

SEQ ID NO: 3395605 - RNA, 16 nt, Pseudomonas aeruginosa PA01
gcccaguucgccggcc

SEQ ID NO: 3395606 - RNA, 17 nt, Pseudomonas aeruginosa PA01
gcccaguucgccggcca

SEQ ID NO: 3395607 - RNA, 18 nt, Pseudomonas aeruginosa PA01
gcccaguucgccggccag

SEQ ID NO: 3395608 - RNA, 21 nt, Pseudomonas aeruginosa PA01
gcccaguucgccggccagcac

SEQ ID NO: 3395609 - RNA, 23 nt, Pseudomonas aeruginosa PA01
gcccaguucgccggccagcaccu

SEQ ID NO: 3395610 - RNA, 15 nt, Pseudomonas aeruginosa PA01
gcccaguucgcgcgg

SEQ ID NO: 3395611 - RNA, 13 nt, Pseudomonas aeruginosa PA01
gcccaguucgcug

SEQ ID NO: 3395612 - RNA, 16 nt, Pseudomonas aeruginosa PA01
gcccaguucuucgccg

SEQ ID NO: 3395613 - RNA, 18 nt, Pseudomonas aeruginosa PA01
gcccaguucuucgccgcc

SEQ ID NO: 3395614 - RNA, 20 nt, Pseudomonas aeruginosa PA01
gcccaguucuucgccgcccg

SEQ ID NO: 3395615 - RNA, 22 nt, Pseudomonas aeruginosa PA01
gcccaguucuucgccgcccgcg

SEQ ID NO: 3395616 - RNA, 19 nt, Pseudomonas aeruginosa PA01
gcccaguugcccggccugg

SEQ ID NO: 3395617 - RNA, 15 nt, Pseudomonas aeruginosa PA01
gcccaguugcgccgc

SEQ ID NO: 3395618 - RNA, 17 nt, Pseudomonas aeruginosa PA01
gcccaguugcgcggcga

SEQ ID NO: 3395619 - RNA, 18 nt, Pseudomonas aeruginosa PA01
gcccaguugcgcggcgag

SEQ ID NO: 3395620 - RNA, 19 nt, Pseudomonas aeruginosa PA01
gcccaguugcgcggcgagu

SEQ ID NO: 3395621 - RNA, 21 nt, Pseudomonas aeruginosa PA01
gcccauacaccaggccggcgg

SEQ ID NO: 3395622 - RNA, 19 nt, Pseudomonas aeruginosa PA01
gcccaucaggaugcggugc

SEQ ID NO: 3395623 - RNA, 19 nt, Pseudomonas aeruginosa PA01
gcccaucaggcucaggcgu

SEQ ID NO: 3395624 - RNA, 16 nt, Pseudomonas aeruginosa PA01
gcccauccgaggaugg

SEQ ID NO: 3395625 - RNA, 14 nt, Pseudomonas aeruginosa PA01
gcccauccgccgca

SEQ ID NO: 3395626 - RNA, 16 nt, Pseudomonas aeruginosa PA01
gcccauccgccgcagg

SEQ ID NO: 3395627 - RNA, 21 nt, Pseudomonas aeruginosa PA01
gcccauccgccgcaggaaggc

SEQ ID NO: 3395628 - RNA, 14 nt, Pseudomonas aeruginosa PA01
gcccauccgcucgg

SEQ ID NO: 3395629 - RNA, 18 nt, Pseudomonas aeruginosa PA01
gcccauccgcucggcgag

SEQ ID NO: 3395630 - RNA, 19 nt, Pseudomonas aeruginosa PA01
gcccauccgcucggcgagu

SEQ ID NO: 3395631 - RNA, 23 nt, Pseudomonas aeruginosa PA01
gcccauccuggcgaucaggccaa

SEQ ID NO: 3395632 - RNA, 16 nt, Pseudomonas aeruginosa PA01
gcccaucgccaccagc

SEQ ID NO: 3395633 - RNA, 14 nt, Pseudomonas aeruginosa PA01
gcccaucgccaggg

SEQ ID NO: 3395634 - RNA, 14 nt, Pseudomonas aeruginosa PA01
gcccaucgccucca

SEQ ID NO: 3395635 - RNA, 16 nt, Pseudomonas aeruginosa PA01
gcccaucgccuccacg

SEQ ID NO: 3395636 - RNA, 21 nt, Pseudomonas aeruginosa PA01
gcccaucgccuccacggcggc

SEQ ID NO: 3395637 - RNA, 14 nt, Pseudomonas aeruginosa PA01
gcccaucggcgucg

SEQ ID NO: 3395638 - RNA, 20 nt, Pseudomonas aeruginosa PA01
gcccaucggcgucggcuggu

SEQ ID NO: 3395639 - RNA, 23 nt, Pseudomonas aeruginosa PA01
gcccaucggcgucggcuggucga

SEQ ID NO: 3395640 - RNA, 14 nt, Pseudomonas aeruginosa PA01
gcccccgccgcuga

SEQ ID NO: 3395641 - RNA, 22 nt, Pseudomonas aeruginosa PA01
gcccccgccgcugaggcucgcc

SEQ ID NO: 3395642 - RNA, 13 nt, Pseudomonas aeruginosa PA01
gcccccgccggcc

SEQ ID NO: 3395643 - RNA, 15 nt, Pseudomonas aeruginosa PA01
gcccccgccggccgg

SEQ ID NO: 3395644 - RNA, 22 nt, Pseudomonas aeruginosa PA01
gcccccggcaacacccucccua

SEQ ID NO: 3395645 - RNA, 14 nt, Pseudomonas aeruginosa PA01
gcccccggcgccac

SEQ ID NO: 3395646 - RNA, 13 nt, Pseudomonas aeruginosa PA01
gcccccggcgccc

SEQ ID NO: 3395647 - RNA, 22 nt, Pseudomonas aeruginosa PA01
gcccccuccccuguggucaggc

SEQ ID NO: 3395648 - RNA, 15 nt, Pseudomonas aeruginosa PA01
gcccccuggccguug

SEQ ID NO: 3395649 - RNA, 19 nt, Pseudomonas aeruginosa PA01
gccccgacugucgugccuc

SEQ ID NO: 3395650 - RNA, 21 nt, Pseudomonas aeruginosa PA01
gccccgacugucgugccucca

SEQ ID NO: 3395651 - RNA, 23 nt, Pseudomonas aeruginosa PA01
gccccgacugucgugccuccagc

SEQ ID NO: 3395652 - RNA, 13 nt, Pseudomonas aeruginosa PA01
gccccgagaaaac

SEQ ID NO: 3395653 - RNA, 18 nt, Pseudomonas aeruginosa PA01
gccccgagaaaacccugg

SEQ ID NO: 3395654 - RNA, 19 nt, Pseudomonas aeruginosa PA01
gccccgagaaaacccuggg

SEQ ID NO: 3395655 - RNA, 20 nt, Pseudomonas aeruginosa PA01
gccccgagaaaacccuggga

SEQ ID NO: 3395656 - RNA, 14 nt, Pseudomonas aeruginosa PA01
gccccgagcgggcc

SEQ ID NO: 3395657 - RNA, 24 nt, Pseudomonas aeruginosa PA01
gccccgagcgggccgagggugauc

SEQ ID NO: 3395658 - RNA, 16 nt, Pseudomonas aeruginosa PA01
gccccgaggccagcag

SEQ ID NO: 3395659 - RNA, 18 nt, Pseudomonas aeruginosa PA01
gccccgaggccagcaggc

SEQ ID NO: 3395660 - RNA, 14 nt, Pseudomonas aeruginosa PA01
gccccgaucgccuc

SEQ ID NO: 3395661 - RNA, 15 nt, Pseudomonas aeruginosa PA01
gccccgaucgccucg

SEQ ID NO: 3395662 - RNA, 20 nt, Pseudomonas aeruginosa PA01
gccccgcaaggugcgggccg

SEQ ID NO: 3395663 - RNA, 17 nt, Pseudomonas aeruginosa PA01
gccccgcaaugcggggc

SEQ ID NO: 3395664 - RNA, 13 nt, Pseudomonas aeruginosa PA01
gccccgcaccagc

SEQ ID NO: 3395665 - RNA, 17 nt, Pseudomonas aeruginosa PA01
gccccgcaccagccagc

SEQ ID NO: 3395666 - RNA, 19 nt, Pseudomonas aeruginosa PA01
gccccgcaccagccagccc

SEQ ID NO: 3395667 - RNA, 13 nt, Pseudomonas aeruginosa PA01
gccccgcagccgc

SEQ ID NO: 3395668 - RNA, 18 nt, Pseudomonas aeruginosa PA01
gccccgcagccgcggggc

SEQ ID NO: 3395669 - RNA, 15 nt, Pseudomonas aeruginosa PA01
gccccgcaucgcggg

SEQ ID NO: 3395670 - RNA, 14 nt, Pseudomonas aeruginosa PA01
gccccgccaggagc

SEQ ID NO: 3395671 - RNA, 15 nt, Pseudomonas aeruginosa PA01
gccccgccaggagcc

SEQ ID NO: 3395672 - RNA, 12 nt, Pseudomonas aeruginosa PA01
gccccgccgaag

SEQ ID NO: 3395673 - RNA, 12 nt, Pseudomonas aeruginosa PA01
gccccgccgacu

SEQ ID NO: 3395674 - RNA, 21 nt, Pseudomonas aeruginosa PA01
gccccgccgacuggcagcgau

SEQ ID NO: 3395675 - RNA, 23 nt, Pseudomonas aeruginosa PA01
gccccgccgacuggcagcgauaa

SEQ ID NO: 3395676 - RNA, 12 nt, Pseudomonas aeruginosa PA01
gccccgccgagg

SEQ ID NO: 3395677 - RNA, 13 nt, Pseudomonas aeruginosa PA01
gccccgccgccag

SEQ ID NO: 3395678 - RNA, 14 nt, Pseudomonas aeruginosa PA01
gccccgccgccagg

SEQ ID NO: 3395679 - RNA, 16 nt, Pseudomonas aeruginosa PA01
gccccgccgccaggcg

SEQ ID NO: 3395680 - RNA, 13 nt, Pseudomonas aeruginosa PA01
gccccgccggcgc

SEQ ID NO: 3395681 - RNA, 12 nt, Pseudomonas aeruginosa PA01
gccccgccggga

SEQ ID NO: 3395682 - RNA, 22 nt, Pseudomonas aeruginosa PA01
gccccgccgggagcggccgugc

SEQ ID NO: 3395683 - RNA, 15 nt, Pseudomonas aeruginosa PA01
gccccgccggggcgu

SEQ ID NO: 3395684 - RNA, 17 nt, Pseudomonas aeruginosa PA01
gccccgccuaccggggc

SEQ ID NO: 3395685 - RNA, 13 nt, Pseudomonas aeruginosa PA01
gccccgcgaacgc

SEQ ID NO: 3395686 - RNA, 18 nt, Pseudomonas aeruginosa PA01
gccccgcgaacgcggggc

SEQ ID NO: 3395687 - RNA, 14 nt, Pseudomonas aeruginosa PA01
gccccgcgauugca

SEQ ID NO: 3395688 - RNA, 15 nt, Pseudomonas aeruginosa PA01
gccccgcgguacccg

SEQ ID NO: 3395689 - RNA, 16 nt, Pseudomonas aeruginosa PA01
gccccgcguucgcggg

SEQ ID NO: 3395690 - RNA, 16 nt, Pseudomonas aeruginosa PA01
gccccgcuacccugcc

SEQ ID NO: 3395691 - RNA, 16 nt, Pseudomonas aeruginosa PA01
gccccgcuauggcggg

SEQ ID NO: 3395692 - RNA, 19 nt, Pseudomonas aeruginosa PA01
gccccgcucgucauggcgc

SEQ ID NO: 3395693 - RNA, 21 nt, Pseudomonas aeruginosa PA01
gccccgcucgucauggcgcac

SEQ ID NO: 3395694 - RNA, 22 nt, Pseudomonas aeruginosa PA01
gccccgcuggcccaacagcggu

SEQ ID NO: 3395695 - RNA, 18 nt, Pseudomonas aeruginosa PA01
gccccgcuucggcggggc

SEQ ID NO: 3395696 - RNA, 16 nt, Pseudomonas aeruginosa PA01
gccccgcuugccgucg

SEQ ID NO: 3395697 - RNA, 17 nt, Pseudomonas aeruginosa PA01
gccccgcuugccgucga

SEQ ID NO: 3395698 - RNA, 22 nt, Pseudomonas aeruginosa PA01
gccccggaccggcucucuucgg

SEQ ID NO: 3395699 - RNA, 14 nt, Pseudomonas aeruginosa PA01
gccccggaggcggu

SEQ ID NO: 3395700 - RNA, 19 nt, Pseudomonas aeruginosa PA01
gccccggcaagcgccggca

SEQ ID NO: 3395701 - RNA, 23 nt, Pseudomonas aeruginosa PA01
gccccggcaagggccugcucagc

SEQ ID NO: 3395702 - RNA, 14 nt, Pseudomonas aeruginosa PA01
gccccggcagccac

SEQ ID NO: 3395703 - RNA, 16 nt, Pseudomonas aeruginosa PA01
gccccggcagccacca

SEQ ID NO: 3395704 - RNA, 17 nt, Pseudomonas aeruginosa PA01
gccccggcagccaccag

SEQ ID NO: 3395705 - RNA, 19 nt, Pseudomonas aeruginosa PA01
gccccggcagccaccaggu

SEQ ID NO: 3395706 - RNA, 12 nt, Pseudomonas aeruginosa PA01
gccccggcaggc

SEQ ID NO: 3395707 - RNA, 16 nt, Pseudomonas aeruginosa PA01
gccccggcaggcaggc

SEQ ID NO: 3395708 - RNA, 20 nt, Pseudomonas aeruginosa PA01
gccccggcaggcaggccugg

SEQ ID NO: 3395709 - RNA, 21 nt, Pseudomonas aeruginosa PA01
gccccggcaggcaggccuggg

SEQ ID NO: 3395710 - RNA, 22 nt, Pseudomonas aeruginosa PA01
gccccggcaggcaggccugggc

SEQ ID NO: 3395711 - RNA, 15 nt, Pseudomonas aeruginosa PA01
gccccggccagguac

SEQ ID NO: 3395712 - RNA, 22 nt, Pseudomonas aeruginosa PA01
gccccggccagguaccggccag

SEQ ID NO: 3395713 - RNA, 15 nt, Pseudomonas aeruginosa PA01
gccccggcccggcgu

SEQ ID NO: 3395714 - RNA, 22 nt, Pseudomonas aeruginosa PA01
gccccggcccggcgugagcagg

SEQ ID NO: 3395715 - RNA, 14 nt, Pseudomonas aeruginosa PA01
gccccggccgcgcc

SEQ ID NO: 3395716 - RNA, 17 nt, Pseudomonas aeruginosa PA01
gccccggccgcgccagc

SEQ ID NO: 3395717 - RNA, 15 nt, Pseudomonas aeruginosa PA01
gccccggccggcagg

SEQ ID NO: 3395718 - RNA, 18 nt, Pseudomonas aeruginosa PA01
gccccggcgagcgagcgg

SEQ ID NO: 3395719 - RNA, 14 nt, Pseudomonas aeruginosa PA01
gccccggcgucggc

SEQ ID NO: 3395720 - RNA, 15 nt, Pseudomonas aeruginosa PA01
gccccggcgucggcg

SEQ ID NO: 3395721 - RNA, 20 nt, Pseudomonas aeruginosa PA01
gccccggcgucggcgcgggc

SEQ ID NO: 3395722 - RNA, 13 nt, Pseudomonas aeruginosa PA01
gccccggcuuggc

SEQ ID NO: 3395723 - RNA, 14 nt, Pseudomonas aeruginosa PA01
gccccggcuuggcg

SEQ ID NO: 3395724 - RNA, 15 nt, Pseudomonas aeruginosa PA01
gccccgggaccauca

SEQ ID NO: 3395725 - RNA, 13 nt, Pseudomonas aeruginosa PA01
gccccgggcgccg

SEQ ID NO: 3395726 - RNA, 14 nt, Pseudomonas aeruginosa PA01
gccccgggucgcug

SEQ ID NO: 3395727 - RNA, 19 nt, Pseudomonas aeruginosa PA01
gccccgggucgcugcucag

SEQ ID NO: 3395728 - RNA, 20 nt, Pseudomonas aeruginosa PA01
gccccgggucgcugcucagg

SEQ ID NO: 3395729 - RNA, 19 nt, Pseudomonas aeruginosa PA01
gccccgggucggcacggcc

SEQ ID NO: 3395730 - RNA, 15 nt, Pseudomonas aeruginosa PA01
gccccggucucgcgc

SEQ ID NO: 3395731 - RNA, 16 nt, Pseudomonas aeruginosa PA01
gccccggucucgcgca

SEQ ID NO: 3395732 - RNA, 18 nt, Pseudomonas aeruginosa PA01
gccccggucucgcgcagc

SEQ ID NO: 3395733 - RNA, 20 nt, Pseudomonas aeruginosa PA01
gccccggugauguaggccgc

SEQ ID NO: 3395734 - RNA, 22 nt, Pseudomonas aeruginosa PA01
gccccggugauguaggccgcuu

SEQ ID NO: 3395735 - RNA, 19 nt, Pseudomonas aeruginosa PA01
gccccgguuacucgccggc

SEQ ID NO: 3395736 - RNA, 20 nt, Pseudomonas aeruginosa PA01
gccccgguuacucgccggca

SEQ ID NO: 3395737 - RNA, 21 nt, Pseudomonas aeruginosa PA01
gccccgguuacucgccggcau

SEQ ID NO: 3395738 - RNA, 15 nt, Pseudomonas aeruginosa PA01
gccccgguuggcgcc

SEQ ID NO: 3395739 - RNA, 19 nt, Pseudomonas aeruginosa PA01
gccccgucccuaccagcgc

SEQ ID NO: 3395740 - RNA, 16 nt, Pseudomonas aeruginosa PA01
gccccgucggcccucc

SEQ ID NO: 3395741 - RNA, 19 nt, Pseudomonas aeruginosa PA01
gccccgucggcccuccccu

SEQ ID NO: 3395742 - RNA, 13 nt, Pseudomonas aeruginosa PA01
gccccgugcaccg

SEQ ID NO: 3395743 - RNA, 19 nt, Pseudomonas aeruginosa PA01
gcccgcagccacaggcgcc

SEQ ID NO: 3395744 - RNA, 23 nt, Pseudomonas aeruginosa PA01
gcccgcagccacaggcgccaguc

SEQ ID NO: 3395745 - RNA, 14 nt, Pseudomonas aeruginosa PA01
gcccgcagccacgg

SEQ ID NO: 3395746 - RNA, 15 nt, Pseudomonas aeruginosa PA01
gcccgcagccacggc

SEQ ID NO: 3395747 - RNA, 17 nt, Pseudomonas aeruginosa PA01
gcccgcagccacggcac

SEQ ID NO: 3395748 - RNA, 14 nt, Pseudomonas aeruginosa PA01
gcccgcagccagcc

SEQ ID NO: 3395749 - RNA, 15 nt, Pseudomonas aeruginosa PA01
gcccgcagccagccu

SEQ ID NO: 3395750 - RNA, 16 nt, Pseudomonas aeruginosa PA01
gcccgcagccagccuc

SEQ ID NO: 3395751 - RNA, 22 nt, Pseudomonas aeruginosa PA01
gcccgcagccagccucagguac

SEQ ID NO: 3395752 - RNA, 21 nt, Pseudomonas aeruginosa PA01
gcccgcaguuccucgccgcug

SEQ ID NO: 3395753 - RNA, 23 nt, Pseudomonas aeruginosa PA01
gcccgcaguuccucgccgcugcu

SEQ ID NO: 3395754 - RNA, 22 nt, Pseudomonas aeruginosa PA01
gcccgcaucccaguagccgguc

SEQ ID NO: 3395755 - RNA, 21 nt, Pseudomonas aeruginosa PA01
gcccgcaugaacgccucgcca

SEQ ID NO: 3395756 - RNA, 16 nt, Pseudomonas aeruginosa PA01
gcccgcaugccagggc

SEQ ID NO: 3395757 - RNA, 19 nt, Pseudomonas aeruginosa PA01
gcccgcaugccagggccuu

SEQ ID NO: 3395758 - RNA, 20 nt, Pseudomonas aeruginosa PA01
gcccgccaacguccucgaug

SEQ ID NO: 3395759 - RNA, 17 nt, Pseudomonas aeruginosa PA01
gcccgccaagggcgccg

SEQ ID NO: 3395760 - RNA, 18 nt, Pseudomonas aeruginosa PA01
gcccgccaagggcgccgc

SEQ ID NO: 3395761 - RNA, 19 nt, Pseudomonas aeruginosa PA01
gcccgccaagggcgccgcc

SEQ ID NO: 3395762 - RNA, 16 nt, Pseudomonas aeruginosa PA01
gcccgccacagaucgc

SEQ ID NO: 3395763 - RNA, 18 nt, Pseudomonas aeruginosa PA01
gcccgccacagaucgcca

SEQ ID NO: 3395764 - RNA, 19 nt, Pseudomonas aeruginosa PA01
gcccgccacagaucgccag

SEQ ID NO: 3395765 - RNA, 22 nt, Pseudomonas aeruginosa PA01
gcccgccaccgacccucggcga

SEQ ID NO: 3395766 - RNA, 18 nt, Pseudomonas aeruginosa PA01
gcccgccaccuggcgggc

SEQ ID NO: 3395767 - RNA, 19 nt, Pseudomonas aeruginosa PA01
gcccgccacggcgcgcucc

SEQ ID NO: 3395768 - RNA, 12 nt, Pseudomonas aeruginosa PA01
gcccgccagcag

SEQ ID NO: 3395769 - RNA, 19 nt, Pseudomonas aeruginosa PA01
gcccgccagcaggcgccgg

SEQ ID NO: 3395770 - RNA, 15 nt, Pseudomonas aeruginosa PA01
gcccgccaggucgag

SEQ ID NO: 3395771 - RNA, 18 nt, Pseudomonas aeruginosa PA01
gcccgccagguggcgggc

SEQ ID NO: 3395772 - RNA, 21 nt, Pseudomonas aeruginosa PA01
gcccgcccaguugcgggccuc

SEQ ID NO: 3395773 - RNA, 13 nt, Pseudomonas aeruginosa PA01
gcccgccccgcac

SEQ ID NO: 3395774 - RNA, 15 nt, Pseudomonas aeruginosa PA01
gcccgccccgcacca

SEQ ID NO: 3395775 - RNA, 17 nt, Pseudomonas aeruginosa PA01
gcccgccccgcaccagc

SEQ ID NO: 3395776 - RNA, 14 nt, Pseudomonas aeruginosa PA01
gcccgccccuuucc

SEQ ID NO: 3395777 - RNA, 12 nt, Pseudomonas aeruginosa PA01
gcccgcccggca

SEQ ID NO: 3395778 - RNA, 17 nt, Pseudomonas aeruginosa PA01
gcccgcccggcaccacc

SEQ ID NO: 3395779 - RNA, 19 nt, Pseudomonas aeruginosa PA01
gcccgcccggcaccaccgg

SEQ ID NO: 3395780 - RNA, 21 nt, Pseudomonas aeruginosa PA01
gcccgcccucgucgcaccugu

SEQ ID NO: 3395781 - RNA, 21 nt, Pseudomonas aeruginosa PA01
gcccgccgccggggcgggccg

SEQ ID NO: 3395782 - RNA, 12 nt, Pseudomonas aeruginosa PA01
gcccgccgccug

SEQ ID NO: 3395783 - RNA, 13 nt, Pseudomonas aeruginosa PA01
gcccgccgccugg

SEQ ID NO: 3395784 - RNA, 18 nt, Pseudomonas aeruginosa PA01
gcccgccgcgagcgccgc

SEQ ID NO: 3395785 - RNA, 13 nt, Pseudomonas aeruginosa PA01
gcccgccgcggcg

SEQ ID NO: 3395786 - RNA, 16 nt, Pseudomonas aeruginosa PA01
gcccgccgcggcgagc

SEQ ID NO: 3395787 - RNA, 14 nt, Pseudomonas aeruginosa PA01
gcccgccggcgaac

SEQ ID NO: 3395788 - RNA, 15 nt, Pseudomonas aeruginosa PA01
gcccgccggcgaacg

SEQ ID NO: 3395789 - RNA, 13 nt, Pseudomonas aeruginosa PA01
gcccgccggcgau

SEQ ID NO: 3395790 - RNA, 16 nt, Pseudomonas aeruginosa PA01
gcccgccggcgaugcg

SEQ ID NO: 3395791 - RNA, 12 nt, Pseudomonas aeruginosa PA01
gcccgccggcgc

SEQ ID NO: 3395792 - RNA, 14 nt, Pseudomonas aeruginosa PA01
gcccgccggcgccc

SEQ ID NO: 3395793 - RNA, 17 nt, Pseudomonas aeruginosa PA01
gcccgccggcgcccugg

SEQ ID NO: 3395794 - RNA, 20 nt, Pseudomonas aeruginosa PA01
gcccgccggcgcccugggcg

SEQ ID NO: 3395795 - RNA, 13 nt, Pseudomonas aeruginosa PA01
gcccgccggcgcg

SEQ ID NO: 3395796 - RNA, 16 nt, Pseudomonas aeruginosa PA01
gcccgccggcgcgccc

SEQ ID NO: 3395797 - RNA, 22 nt, Pseudomonas aeruginosa PA01
gcccgccggcgcgcccaggccc

SEQ ID NO: 3395798 - RNA, 12 nt, Pseudomonas aeruginosa PA01
gcccgccggcgu

SEQ ID NO: 3395799 - RNA, 18 nt, Pseudomonas aeruginosa PA01
gcccgccggcgugccgac

SEQ ID NO: 3395800 - RNA, 19 nt, Pseudomonas aeruginosa PA01
gcccgccggcgugccgacc

SEQ ID NO: 3395801 - RNA, 15 nt, Pseudomonas aeruginosa PA01
gcccgccggucaacc

SEQ ID NO: 3395802 - RNA, 21 nt, Pseudomonas aeruginosa PA01
gcccgccggucaaccgcgggc

SEQ ID NO: 3395803 - RNA, 17 nt, Pseudomonas aeruginosa PA01
gcccgccgucauggcgg

SEQ ID NO: 3395804 - RNA, 18 nt, Pseudomonas aeruginosa PA01
gcccgccgucauggcggg

SEQ ID NO: 3395805 - RNA, 13 nt, Pseudomonas aeruginosa PA01
gcccgccguccuc

SEQ ID NO: 3395806 - RNA, 17 nt, Pseudomonas aeruginosa PA01
gcccgccguccuccagc

SEQ ID NO: 3395807 - RNA, 12 nt, Pseudomonas aeruginosa PA01
gcccgccgugcg

SEQ ID NO: 3395808 - RNA, 13 nt, Pseudomonas aeruginosa PA01
gcccgccgugcgc

SEQ ID NO: 3395809 - RNA, 20 nt, Pseudomonas aeruginosa PA01
gcccgccgugcgcuccgcca

SEQ ID NO: 3395810 - RNA, 21 nt, Pseudomonas aeruginosa PA01
gcccgccgugcgcuccgccag

SEQ ID NO: 3395811 - RNA, 16 nt, Pseudomonas aeruginosa PA01
gcccgccucaggccgg

SEQ ID NO: 3395812 - RNA, 12 nt, Pseudomonas aeruginosa PA01
gcccgccucgcg

SEQ ID NO: 3395813 - RNA, 15 nt, Pseudomonas aeruginosa PA01
gcccgccucggcggc

SEQ ID NO: 3395814 - RNA, 16 nt, Pseudomonas aeruginosa PA01
gcccgccucggcggcu

SEQ ID NO: 3395815 - RNA, 19 nt, Pseudomonas aeruginosa PA01
gcccgccugaaggcgggcu

SEQ ID NO: 3395816 - RNA, 16 nt, Pseudomonas aeruginosa PA01
gcccgccugauggcga

SEQ ID NO: 3395817 - RNA, 18 nt, Pseudomonas aeruginosa PA01
gcccgccuucaggcgggc

SEQ ID NO: 3395818 - RNA, 20 nt, Pseudomonas aeruginosa PA01
gcccgccuugauggcgggcu

SEQ ID NO: 3395819 - RNA, 15 nt, Pseudomonas aeruginosa PA01
gcccgccuuguucgc

SEQ ID NO: 3395820 - RNA, 19 nt, Pseudomonas aeruginosa PA01
gcccgccuuguucgccagc

SEQ ID NO: 3395821 - RNA, 21 nt, Pseudomonas aeruginosa PA01
gcccgccuuguucgccagcac

SEQ ID NO: 3395822 - RNA, 15 nt, Pseudomonas aeruginosa PA01
gcccgcgagccgcgc

SEQ ID NO: 3395823 - RNA, 18 nt, Pseudomonas aeruginosa PA01
gcccgcgagccgcgcagc

SEQ ID NO: 3395824 - RNA, 16 nt, Pseudomonas aeruginosa PA01
gcccgcgagccguccu

SEQ ID NO: 3395825 - RNA, 19 nt, Pseudomonas aeruginosa PA01
gcccgcgagccguccugcg

SEQ ID NO: 3395826 - RNA, 21 nt, Pseudomonas aeruginosa PA01
gcccgcgagccguccugcggc

SEQ ID NO: 3395827 - RNA, 22 nt, Pseudomonas aeruginosa PA01
gcccgcgagccguccugcggcc

SEQ ID NO: 3395828 - RNA, 23 nt, Pseudomonas aeruginosa PA01
gcccgcgcauggagacggcccgc

SEQ ID NO: 3395829 - RNA, 13 nt, Pseudomonas aeruginosa PA01
gcccgcgccgccg

SEQ ID NO: 3395830 - RNA, 16 nt, Pseudomonas aeruginosa PA01
gcccgcgccgccggua

SEQ ID NO: 3395831 - RNA, 16 nt, Pseudomonas aeruginosa PA01
gcccgcgccgccucga

SEQ ID NO: 3395832 - RNA, 13 nt, Pseudomonas aeruginosa PA01
gcccgcgccgcga

SEQ ID NO: 3395833 - RNA, 14 nt, Pseudomonas aeruginosa PA01
gcccgcgccuccag

SEQ ID NO: 3395834 - RNA, 21 nt, Pseudomonas aeruginosa PA01
gcccgcgccuccaggcgcgcc

SEQ ID NO: 3395835 - RNA, 14 nt, Pseudomonas aeruginosa PA01
gcccgcgccucgcu

SEQ ID NO: 3395836 - RNA, 14 nt, Pseudomonas aeruginosa PA01
gcccgcgccugggc

SEQ ID NO: 3395837 - RNA, 15 nt, Pseudomonas aeruginosa PA01
gcccgcgcgacagcu

SEQ ID NO: 3395838 - RNA, 22 nt, Pseudomonas aeruginosa PA01
gcccgcgcgacagcucuggggu

SEQ ID NO: 3395839 - RNA, 15 nt, Pseudomonas aeruginosa PA01
gcccgcgcggcaacg

SEQ ID NO: 3395840 - RNA, 14 nt, Pseudomonas aeruginosa PA01
gcccgcgcucggcc

SEQ ID NO: 3395841 - RNA, 15 nt, Pseudomonas aeruginosa PA01
gcccgcgcucggccg

SEQ ID NO: 3395842 - RNA, 16 nt, Pseudomonas aeruginosa PA01
gcccgcgcucggccgc

SEQ ID NO: 3395843 - RNA, 17 nt, Pseudomonas aeruginosa PA01
gcccgcgcucggccgcc

SEQ ID NO: 3395844 - RNA, 21 nt, Pseudomonas aeruginosa PA01
gcccgcgcucggccgccuggc

SEQ ID NO: 3395845 - RNA, 22 nt, Pseudomonas aeruginosa PA01
gcccgcgcucggccgccuggcg

SEQ ID NO: 3395846 - RNA, 16 nt, Pseudomonas aeruginosa PA01
gcccggccaggcgaua

SEQ ID NO: 3395847 - RNA, 17 nt, Pseudomonas aeruginosa PA01
gcccggccaggcgcggc

SEQ ID NO: 3395848 - RNA, 18 nt, Pseudomonas aeruginosa PA01
gcccggccaggcgcggcg

SEQ ID NO: 3395849 - RNA, 20 nt, Pseudomonas aeruginosa PA01
gcccggccaggcgcggcgcc

SEQ ID NO: 3395850 - RNA, 21 nt, Pseudomonas aeruginosa PA01
gcccggccagguaggcgacga

SEQ ID NO: 3395851 - RNA, 18 nt, Pseudomonas aeruginosa PA01
gcccggccauccuggccg

SEQ ID NO: 3395852 - RNA, 20 nt, Pseudomonas aeruginosa PA01
gcccggccauccuggccggu

SEQ ID NO: 3395853 - RNA, 12 nt, Pseudomonas aeruginosa PA01
gcccggccaugc

SEQ ID NO: 3395854 - RNA, 18 nt, Pseudomonas aeruginosa PA01
gcccggccaugccgccga

SEQ ID NO: 3395855 - RNA, 20 nt, Pseudomonas aeruginosa PA01
gcccggccaugccgccgacg

SEQ ID NO: 3395856 - RNA, 16 nt, Pseudomonas aeruginosa PA01
gcccggccgcaggcag

SEQ ID NO: 3395857 - RNA, 13 nt, Pseudomonas aeruginosa PA01
gcccggccgccug

SEQ ID NO: 3395858 - RNA, 14 nt, Pseudomonas aeruginosa PA01
gcccggccgccugc

SEQ ID NO: 3395859 - RNA, 11 nt, Pseudomonas aeruginosa PA01
gcccggccgcu

SEQ ID NO: 3395860 - RNA, 13 nt, Pseudomonas aeruginosa PA01
gcccggccgcugc

SEQ ID NO: 3395861 - RNA, 15 nt, Pseudomonas aeruginosa PA01
gcccggccgcugccg

SEQ ID NO: 3395862 - RNA, 17 nt, Pseudomonas aeruginosa PA01
gcccggccgcugccggg

SEQ ID NO: 3395863 - RNA, 18 nt, Pseudomonas aeruginosa PA01
gcccggccgcugccgggc

SEQ ID NO: 3395864 - RNA, 19 nt, Pseudomonas aeruginosa PA01
gcccggccgcugccgggcu

SEQ ID NO: 3395865 - RNA, 15 nt, Pseudomonas aeruginosa PA01
gcccggccgcuggau

SEQ ID NO: 3395866 - RNA, 19 nt, Pseudomonas aeruginosa PA01
gcccggccgcuggaugccg

SEQ ID NO: 3395867 - RNA, 15 nt, Pseudomonas aeruginosa PA01
gcccggccuccccgg

SEQ ID NO: 3395868 - RNA, 14 nt, Pseudomonas aeruginosa PA01
gcccggccucgccg

SEQ ID NO: 3395869 - RNA, 18 nt, Pseudomonas aeruginosa PA01
gcccggccucgccggucg

SEQ ID NO: 3395870 - RNA, 13 nt, Pseudomonas aeruginosa PA01
gcccggccuggcg

SEQ ID NO: 3395871 - RNA, 19 nt, Pseudomonas aeruginosa PA01
gcccggccuggcgucccgg

SEQ ID NO: 3395872 - RNA, 12 nt, Pseudomonas aeruginosa PA01
gcccggccuggu

SEQ ID NO: 3395873 - RNA, 18 nt, Pseudomonas aeruginosa PA01
gcccggccuucaccgcgc

SEQ ID NO: 3395874 - RNA, 20 nt, Pseudomonas aeruginosa PA01
gcccggccuucaccgcgccg

SEQ ID NO: 3395875 - RNA, 15 nt, Pseudomonas aeruginosa PA01
gcccggcgaacagcg

SEQ ID NO: 3395876 - RNA, 20 nt, Pseudomonas aeruginosa PA01
gcccggcgaacagcgcuucc

SEQ ID NO: 3395877 - RNA, 23 nt, Pseudomonas aeruginosa PA01
gcccggcgaacagcgcuuccugg

SEQ ID NO: 3395878 - RNA, 16 nt, Pseudomonas aeruginosa PA01
gcccggcgaaugccgg

SEQ ID NO: 3395879 - RNA, 12 nt, Pseudomonas aeruginosa PA01
gcccggcgagag

SEQ ID NO: 3395880 - RNA, 15 nt, Pseudomonas aeruginosa PA01
gcccggcgagagcgu

SEQ ID NO: 3395881 - RNA, 17 nt, Pseudomonas aeruginosa PA01
gcccggcgagagcgucc

SEQ ID NO: 3395882 - RNA, 21 nt, Pseudomonas aeruginosa PA01
gcccggcgagagcguccggca

SEQ ID NO: 3395883 - RNA, 16 nt, Pseudomonas aeruginosa PA01
gcccggcgaggucggg

SEQ ID NO: 3395884 - RNA, 12 nt, Pseudomonas aeruginosa PA01
gcccggcgcaga

SEQ ID NO: 3395885 - RNA, 15 nt, Pseudomonas aeruginosa PA01
gcccggcgcagaacu

SEQ ID NO: 3395886 - RNA, 20 nt, Pseudomonas aeruginosa PA01
gcccggcgcagaacugccgg

SEQ ID NO: 3395887 - RNA, 22 nt, Pseudomonas aeruginosa PA01
gcccggcgcagaacugccgggc

SEQ ID NO: 3395888 - RNA, 19 nt, Pseudomonas aeruginosa PA01
gcccggcgcaugccgcagg

SEQ ID NO: 3395889 - RNA, 15 nt, Pseudomonas aeruginosa PA01
gcccggcgccaggcu

SEQ ID NO: 3395890 - RNA, 12 nt, Pseudomonas aeruginosa PA01
gcccggcgcgac

SEQ ID NO: 3395891 - RNA, 13 nt, Pseudomonas aeruginosa PA01
gcccggcgcgacg

SEQ ID NO: 3395892 - RNA, 17 nt, Pseudomonas aeruginosa PA01
gcccggcgcgacgcucc

SEQ ID NO: 3395893 - RNA, 20 nt, Pseudomonas aeruginosa PA01
gcccggcgcgacgcuccagg

SEQ ID NO: 3395894 - RNA, 12 nt, Pseudomonas aeruginosa PA01
gcccggcgcggc

SEQ ID NO: 3395895 - RNA, 16 nt, Pseudomonas aeruginosa PA01
gcccggcgcggcggcc

SEQ ID NO: 3395896 - RNA, 23 nt, Pseudomonas aeruginosa PA01
gcccggcgcgguuucgcagcgcu

SEQ ID NO: 3395897 - RNA, 15 nt, Pseudomonas aeruginosa PA01
gcccggcgcuccaac

SEQ ID NO: 3395898 - RNA, 18 nt, Pseudomonas aeruginosa PA01
gcccggcgcuccaacagc

SEQ ID NO: 3395899 - RNA, 14 nt, Pseudomonas aeruginosa PA01
gcccggcgcugcuu

SEQ ID NO: 3395900 - RNA, 12 nt, Pseudomonas aeruginosa PA01
gcccggcggcgg

SEQ ID NO: 3395901 - RNA, 23 nt, Pseudomonas aeruginosa PA01
gcccggcggcggcaccgacgccg

SEQ ID NO: 3395902 - RNA, 17 nt, Pseudomonas aeruginosa PA01
gcccggcggugaugccg

SEQ ID NO: 3395903 - RNA, 16 nt, Pseudomonas aeruginosa PA01
gcccggcguccucgcg

SEQ ID NO: 3395904 - RNA, 13 nt, Pseudomonas aeruginosa PA01
gcccggcgugagc

SEQ ID NO: 3395905 - RNA, 15 nt, Pseudomonas aeruginosa PA01
gcccggcgugagcag

SEQ ID NO: 3395906 - RNA, 16 nt, Pseudomonas aeruginosa PA01
gcccggcgugagcagg

SEQ ID NO: 3395907 - RNA, 17 nt, Pseudomonas aeruginosa PA01
gcccggcgugagcaggg

SEQ ID NO: 3395908 - RNA, 21 nt, Pseudomonas aeruginosa PA01
gcccggcgugagcagggccga

SEQ ID NO: 3395909 - RNA, 20 nt, Pseudomonas aeruginosa PA01
gcccggcguggacccacgca

SEQ ID NO: 3395910 - RNA, 18 nt, Pseudomonas aeruginosa PA01
gcccggcguuucgccggg

SEQ ID NO: 3395911 - RNA, 13 nt, Pseudomonas aeruginosa PA01
gcccggcuccaac

SEQ ID NO: 3395912 - RNA, 17 nt, Pseudomonas aeruginosa PA01
gcccggcuccagccggg

SEQ ID NO: 3395913 - RNA, 18 nt, Pseudomonas aeruginosa PA01
gcccggcuccagccgggc

SEQ ID NO: 3395914 - RNA, 19 nt, Pseudomonas aeruginosa PA01
gcccggcuccagccgggcu

SEQ ID NO: 3395915 - RNA, 15 nt, Pseudomonas aeruginosa PA01
gcccggcuccgggua

SEQ ID NO: 3395916 - RNA, 23 nt, Pseudomonas aeruginosa PA01
gcccggcuccggguacuggcgcu

SEQ ID NO: 3395917 - RNA, 21 nt, Pseudomonas aeruginosa PA01
gcccggcucgaccuugcuggu

SEQ ID NO: 3395918 - RNA, 13 nt, Pseudomonas aeruginosa PA01
gcccggcucgccc

SEQ ID NO: 3395919 - RNA, 16 nt, Pseudomonas aeruginosa PA01
gcccggcucgcccaug

SEQ ID NO: 3395920 - RNA, 14 nt, Pseudomonas aeruginosa PA01
gcccggcucgccgc

SEQ ID NO: 3395921 - RNA, 15 nt, Pseudomonas aeruginosa PA01
gcccggcucgccgcc

SEQ ID NO: 3395922 - RNA, 13 nt, Pseudomonas aeruginosa PA01
gcccggcugcaca

SEQ ID NO: 3395923 - RNA, 15 nt, Pseudomonas aeruginosa PA01
gcccggcugcacagg

SEQ ID NO: 3395924 - RNA, 16 nt, Pseudomonas aeruginosa PA01
gcccggcugcacaggu

SEQ ID NO: 3395925 - RNA, 22 nt, Pseudomonas aeruginosa PA01
gcccggcuggcguaccucgcca

SEQ ID NO: 3395926 - RNA, 18 nt, Pseudomonas aeruginosa PA01
gcccggcugguugccagc

SEQ ID NO: 3395927 - RNA, 20 nt, Pseudomonas aeruginosa PA01
gcccggcugguugccagcag

SEQ ID NO: 3395928 - RNA, 21 nt, Pseudomonas aeruginosa PA01
gcccggcugguugccagcagc

SEQ ID NO: 3395929 - RNA, 22 nt, Pseudomonas aeruginosa PA01
gcccggcugguugccagcagcg

SEQ ID NO: 3395930 - RNA, 17 nt, Pseudomonas aeruginosa PA01
gcccggcuucgcuggug

SEQ ID NO: 3395931 - RNA, 19 nt, Pseudomonas aeruginosa PA01
gcccggcuucgcuggugcu

SEQ ID NO: 3395932 - RNA, 14 nt, Pseudomonas aeruginosa PA01
gcccggcuucggcg

SEQ ID NO: 3395933 - RNA, 17 nt, Pseudomonas aeruginosa PA01
gcccggcuucggcggcg

SEQ ID NO: 3395934 - RNA, 20 nt, Pseudomonas aeruginosa PA01
gcccggcuucggcggcgcgc

SEQ ID NO: 3395935 - RNA, 18 nt, Pseudomonas aeruginosa PA01
gcccggcuuuccucggcc

SEQ ID NO: 3395936 - RNA, 20 nt, Pseudomonas aeruginosa PA01
gcccggcuuuccucggccau

SEQ ID NO: 3395937 - RNA, 22 nt, Pseudomonas aeruginosa PA01
gcccggcuuuccucggccaugc

SEQ ID NO: 3395938 - RNA, 12 nt, Pseudomonas aeruginosa PA01
gcccgggaucga

SEQ ID NO: 3395939 - RNA, 20 nt, Pseudomonas aeruginosa PA01
gcccgggaucgaugcgcgcc

SEQ ID NO: 3395940 - RNA, 17 nt, Pseudomonas aeruginosa PA01
gcccgggcaacugccga

SEQ ID NO: 3395941 - RNA, 13 nt, Pseudomonas aeruginosa PA01
gcccgggcgcaac

SEQ ID NO: 3395942 - RNA, 14 nt, Pseudomonas aeruginosa PA01
gcccgggcgccacc

SEQ ID NO: 3395943 - RNA, 15 nt, Pseudomonas aeruginosa PA01
gcccgggcgccaccg

SEQ ID NO: 3395944 - RNA, 23 nt, Pseudomonas aeruginosa PA01
gcccgggcguuggcuccgggccg

SEQ ID NO: 3395945 - RNA, 17 nt, Pseudomonas aeruginosa PA01
gcccggggcucugccgg

SEQ ID NO: 3395946 - RNA, 19 nt, Pseudomonas aeruginosa PA01
gcccggggcucugccggug

SEQ ID NO: 3395947 - RNA, 20 nt, Pseudomonas aeruginosa PA01
gcccggggcucugccggugu

SEQ ID NO: 3395948 - RNA, 23 nt, Pseudomonas aeruginosa PA01
gcccgggguauggccuucgcuga

SEQ ID NO: 3395949 - RNA, 13 nt, Pseudomonas aeruginosa PA01
gcccucagcagcg

SEQ ID NO: 3395950 - RNA, 15 nt, Pseudomonas aeruginosa PA01
gcccucagcagcgcc

SEQ ID NO: 3395951 - RNA, 16 nt, Pseudomonas aeruginosa PA01
gcccucagcagcgccg

SEQ ID NO: 3395952 - RNA, 14 nt, Pseudomonas aeruginosa PA01
gcccucagcggcgg

SEQ ID NO: 3395953 - RNA, 22 nt, Pseudomonas aeruginosa PA01
gcccucagggaagaugcacacc

SEQ ID NO: 3395954 - RNA, 14 nt, Pseudomonas aeruginosa PA01
gcccuccagcaccc

SEQ ID NO: 3395955 - RNA, 17 nt, Pseudomonas aeruginosa PA01
gcccuccagcacccagg

SEQ ID NO: 3395956 - RNA, 20 nt, Pseudomonas aeruginosa PA01
gcccuccagcacccagguag

SEQ ID NO: 3395957 - RNA, 23 nt, Pseudomonas aeruginosa PA01
gcccuccagcaccgccuggcgca

SEQ ID NO: 3395958 - RNA, 12 nt, Pseudomonas aeruginosa PA01
gcccuccaggcg

SEQ ID NO: 3395959 - RNA, 13 nt, Pseudomonas aeruginosa PA01
gcccuccaggcga

SEQ ID NO: 3395960 - RNA, 14 nt, Pseudomonas aeruginosa PA01
gcccuccaggcgaa

SEQ ID NO: 3395961 - RNA, 16 nt, Pseudomonas aeruginosa PA01
gcccuccaucagcgcc

SEQ ID NO: 3395962 - RNA, 13 nt, Pseudomonas aeruginosa PA01
gcccuccauccag

SEQ ID NO: 3395963 - RNA, 12 nt, Pseudomonas aeruginosa PA01
gcccuccccugg

SEQ ID NO: 3395964 - RNA, 16 nt, Pseudomonas aeruginosa PA01
gcccuccggcgcguug

SEQ ID NO: 3395965 - RNA, 22 nt, Pseudomonas aeruginosa PA01
gcccuccggcgcguuggcuggc

SEQ ID NO: 3395966 - RNA, 22 nt, Pseudomonas aeruginosa PA01
gcccuccugcucgauccagccg

SEQ ID NO: 3395967 - RNA, 17 nt, Pseudomonas aeruginosa PA01
gcccuccugggccuguc

SEQ ID NO: 3395968 - RNA, 23 nt, Pseudomonas aeruginosa PA01
gcccuccugggccugucgggggc

SEQ ID NO: 3395969 - RNA, 13 nt, Pseudomonas aeruginosa PA01
gcccucgaacggc

SEQ ID NO: 3395970 - RNA, 18 nt, Pseudomonas aeruginosa PA01
gcccucgaacggcgugag

SEQ ID NO: 3395971 - RNA, 13 nt, Pseudomonas aeruginosa PA01
gcccucgaagccc

SEQ ID NO: 3395972 - RNA, 16 nt, Pseudomonas aeruginosa PA01
gcccucgaagcccugc

SEQ ID NO: 3395973 - RNA, 14 nt, Pseudomonas aeruginosa PA01
gcccucgaccaggu

SEQ ID NO: 3395974 - RNA, 18 nt, Pseudomonas aeruginosa PA01
gcccucgaccagguccgg

SEQ ID NO: 3395975 - RNA, 21 nt, Pseudomonas aeruginosa PA01
gcccucgaccagguccggcag

SEQ ID NO: 3395976 - RNA, 15 nt, Pseudomonas aeruginosa PA01
gcccucgaccuggcu

SEQ ID NO: 3395977 - RNA, 13 nt, Pseudomonas aeruginosa PA01
gcccucgacgaua

SEQ ID NO: 3395978 - RNA, 22 nt, Pseudomonas aeruginosa PA01
gcccucgauguaggccucggcc

SEQ ID NO: 3395979 - RNA, 23 nt, Pseudomonas aeruginosa PA01
gcccucgauguaggccucggccu

SEQ ID NO: 3395980 - RNA, 13 nt, Pseudomonas aeruginosa PA01
gcccucgcagccg

SEQ ID NO: 3395981 - RNA, 15 nt, Pseudomonas aeruginosa PA01
gcccucgcagccggc

SEQ ID NO: 3395982 - RNA, 18 nt, Pseudomonas aeruginosa PA01
gcccucgcagccggcggc

SEQ ID NO: 3395983 - RNA, 21 nt, Pseudomonas aeruginosa PA01
gcccucgcaguacagcucggc

SEQ ID NO: 3395984 - RNA, 13 nt, Pseudomonas aeruginosa PA01
gcccucgccaauc

SEQ ID NO: 3395985 - RNA, 23 nt, Pseudomonas aeruginosa PA01
gcccucgcccaggugcgccgagc

SEQ ID NO: 3395986 - RNA, 15 nt, Pseudomonas aeruginosa PA01
gcccucgcgacggca

SEQ ID NO: 3395987 - RNA, 12 nt, Pseudomonas aeruginosa PA01
gcccucgcgccc

SEQ ID NO: 3395988 - RNA, 14 nt, Pseudomonas aeruginosa PA01
gcccucgcgcccgg

SEQ ID NO: 3395989 - RNA, 15 nt, Pseudomonas aeruginosa PA01
gcccucgcgcuggac

SEQ ID NO: 3395990 - RNA, 13 nt, Pseudomonas aeruginosa PA01
gcccucgcggacg

SEQ ID NO: 3395991 - RNA, 15 nt, Pseudomonas aeruginosa PA01
gcccucgcggacgcu

SEQ ID NO: 3395992 - RNA, 18 nt, Pseudomonas aeruginosa PA01
gcccucgcggacgcuggc

SEQ ID NO: 3395993 - RNA, 19 nt, Pseudomonas aeruginosa PA01
gcccucgcggacgcuggcg

SEQ ID NO: 3395994 - RNA, 20 nt, Pseudomonas aeruginosa PA01
gcccucgcggacgcuggcga

SEQ ID NO: 3395995 - RNA, 12 nt, Pseudomonas aeruginosa PA01
gcccucgcggag

SEQ ID NO: 3395996 - RNA, 13 nt, Pseudomonas aeruginosa PA01
gcccucgcggauc

SEQ ID NO: 3395997 - RNA, 18 nt, Pseudomonas aeruginosa PA01
gcccucgcggaucugcuc

SEQ ID NO: 3395998 - RNA, 23 nt, Pseudomonas aeruginosa PA01
gcccucgcggaucugcuccugca

SEQ ID NO: 3395999 - RNA, 13 nt, Pseudomonas aeruginosa PA01
gcccucgcggcgg

SEQ ID NO: 3396000 - RNA, 15 nt, Pseudomonas aeruginosa PA01
gcccucgcggcggca

SEQ ID NO: 3396001 - RNA, 16 nt, Pseudomonas aeruginosa PA01
gcccucgcggcggcag

SEQ ID NO: 3396002 - RNA, 17 nt, Pseudomonas aeruginosa PA01
gcccucgcggcggcagg

SEQ ID NO: 3396003 - RNA, 20 nt, Pseudomonas aeruginosa PA01
gcccucgcggcggcaggcca

SEQ ID NO: 3396004 - RNA, 21 nt, Pseudomonas aeruginosa PA01
gcccucgcggcggcaggccag

SEQ ID NO: 3396005 - RNA, 18 nt, Pseudomonas aeruginosa PA01
gcccucgcuccaacgcag

SEQ ID NO: 3396006 - RNA, 20 nt, Pseudomonas aeruginosa PA01
gcccucgcuccaacgcaggc

SEQ ID NO: 3396007 - RNA, 22 nt, Pseudomonas aeruginosa PA01
gcccucgcuccaacgcaggcgc

SEQ ID NO: 3396008 - RNA, 23 nt, Pseudomonas aeruginosa PA01
gcccucgcuccaacgcaggcgca

SEQ ID NO: 3396009 - RNA, 24 nt, Pseudomonas aeruginosa PA01
gcccucgcuccaacgcaggcgcau

SEQ ID NO: 3396010 - RNA, 18 nt, Pseudomonas aeruginosa PA01
gcccucgcucguuccgcg

SEQ ID NO: 3396011 - RNA, 22 nt, Pseudomonas aeruginosa PA01
gcccucgcucguuccgcggagu

SEQ ID NO: 3396012 - RNA, 14 nt, Pseudomonas aeruginosa PA01
gcccucgcugagca

SEQ ID NO: 3396013 - RNA, 12 nt, Pseudomonas aeruginosa PA01
gcccucggccag

SEQ ID NO: 3396014 - RNA, 16 nt, Pseudomonas aeruginosa PA01
gcccucggccaggcau

SEQ ID NO: 3396015 - RNA, 17 nt, Pseudomonas aeruginosa PA01
gcccucggccaggcauu

SEQ ID NO: 3396016 - RNA, 17 nt, Pseudomonas aeruginosa PA01
gcccucggcccggagcc

SEQ ID NO: 3396017 - RNA, 13 nt, Pseudomonas aeruginosa PA01
gcccucggcgccc

SEQ ID NO: 3396018 - RNA, 14 nt, Pseudomonas aeruginosa PA01
gcccucggcgcccg

SEQ ID NO: 3396019 - RNA, 19 nt, Pseudomonas aeruginosa PA01
gcccucggcgcccgccugc

SEQ ID NO: 3396020 - RNA, 20 nt, Pseudomonas aeruginosa PA01
gcccucggcgcccgccugca

SEQ ID NO: 3396021 - RNA, 14 nt, Pseudomonas aeruginosa PA01
gcccucggcgccga

SEQ ID NO: 3396022 - RNA, 15 nt, Pseudomonas aeruginosa PA01
gcccucggcgccgag

SEQ ID NO: 3396023 - RNA, 13 nt, Pseudomonas aeruginosa PA01
gcccucggcgcug

SEQ ID NO: 3396024 - RNA, 16 nt, Pseudomonas aeruginosa PA01
gcccucggcgcuggcc

SEQ ID NO: 3396025 - RNA, 17 nt, Pseudomonas aeruginosa PA01
gcccucggcgcuggcca

SEQ ID NO: 3396026 - RNA, 18 nt, Pseudomonas aeruginosa PA01
gcccucggcgcuggccag

SEQ ID NO: 3396027 - RNA, 15 nt, Pseudomonas aeruginosa PA01
gcccucggcggcgag

SEQ ID NO: 3396028 - RNA, 17 nt, Pseudomonas aeruginosa PA01
gcccucggcggcgagcg

SEQ ID NO: 3396029 - RNA, 22 nt, Pseudomonas aeruginosa PA01
gcccucggcggcgagcgggucg

SEQ ID NO: 3396030 - RNA, 14 nt, Pseudomonas aeruginosa PA01
gcccucgggccgca

SEQ ID NO: 3396031 - RNA, 16 nt, Pseudomonas aeruginosa PA01
gcccucgggccgcagg

SEQ ID NO: 3396032 - RNA, 17 nt, Pseudomonas aeruginosa PA01
gcccucgggccgcaggg

SEQ ID NO: 3396033 - RNA, 18 nt, Pseudomonas aeruginosa PA01
gcccucgggccgcagggg

SEQ ID NO: 3396034 - RNA, 20 nt, Pseudomonas aeruginosa PA01
gcccucggugauaccgccgg

SEQ ID NO: 3396035 - RNA, 22 nt, Pseudomonas aeruginosa PA01
gcccucggugauaccgccggcg

SEQ ID NO: 3396036 - RNA, 23 nt, Pseudomonas aeruginosa PA01
gcccucggugauaccgccggcgg

SEQ ID NO: 3396037 - RNA, 22 nt, Pseudomonas aeruginosa PA01
gcccucggugcgguuggagcgg

SEQ ID NO: 3396038 - RNA, 16 nt, Pseudomonas aeruginosa PA01
gcccucgucgcaccug

SEQ ID NO: 3396039 - RNA, 22 nt, Pseudomonas aeruginosa PA01
gcccucgucgcaccuguuccag

SEQ ID NO: 3396040 - RNA, 21 nt, Pseudomonas aeruginosa PA01
gcccucguugauuccgccgga

SEQ ID NO: 3396041 - RNA, 20 nt, Pseudomonas aeruginosa PA01
gcccucucaggagcgccgcg

SEQ ID NO: 3396042 - RNA, 21 nt, Pseudomonas aeruginosa PA01
gcccucucaggagcgccgcgc

SEQ ID NO: 3396043 - RNA, 16 nt, Pseudomonas aeruginosa PA01
gcccucucucgccucg

SEQ ID NO: 3396044 - RNA, 18 nt, Pseudomonas aeruginosa PA01
gcccucucucgccucggc

SEQ ID NO: 3396045 - RNA, 15 nt, Pseudomonas aeruginosa PA01
gcccucugccggucg

SEQ ID NO: 3396046 - RNA, 20 nt, Pseudomonas aeruginosa PA01
gcccugacauccuuggucag

SEQ ID NO: 3396047 - RNA, 18 nt, Pseudomonas aeruginosa PA01
gcccugacccgcaccggc

SEQ ID NO: 3396048 - RNA, 19 nt, Pseudomonas aeruginosa PA01
gcccugacccgcaccggca

SEQ ID NO: 3396049 - RNA, 23 nt, Pseudomonas aeruginosa PA01
gcccugaggcuuuccugcgccuc

SEQ ID NO: 3396050 - RNA, 17 nt, Pseudomonas aeruginosa PA01
gcccugcaaagcggcga

SEQ ID NO: 3396051 - RNA, 22 nt, Pseudomonas aeruginosa PA01
gcccugcaacacguagcgcagg

SEQ ID NO: 3396052 - RNA, 22 nt, Pseudomonas aeruginosa PA01
gcccugguaggugcgcuggcgc

SEQ ID NO: 3396053 - RNA, 23 nt, Pseudomonas aeruginosa PA01
gcccugguaggugcgcuggcgcc

SEQ ID NO: 3396054 - RNA, 22 nt, Pseudomonas aeruginosa PA01
gcccuggucgacauagcgcagc

SEQ ID NO: 3396055 - RNA, 23 nt, Pseudomonas aeruginosa PA01
gcccuggucgacauagcgcagca

SEQ ID NO: 3396056 - RNA, 15 nt, Pseudomonas aeruginosa PA01
gcccuggucggcggu

SEQ ID NO: 3396057 - RNA, 17 nt, Pseudomonas aeruginosa PA01
gcccuggugcacggcga

SEQ ID NO: 3396058 - RNA, 18 nt, Pseudomonas aeruginosa PA01
gcccuggugcacggcgac

SEQ ID NO: 3396059 - RNA, 22 nt, Pseudomonas aeruginosa PA01
gcccuggugcacggcgacccgc

SEQ ID NO: 3396060 - RNA, 16 nt, Pseudomonas aeruginosa PA01
gcccugguggugauca

SEQ ID NO: 3396061 - RNA, 19 nt, Pseudomonas aeruginosa PA01
gcccugguggugaucagcg

SEQ ID NO: 3396062 - RNA, 22 nt, Pseudomonas aeruginosa PA01
gcccugguggugaucagcggcc

SEQ ID NO: 3396063 - RNA, 23 nt, Pseudomonas aeruginosa PA01
gcccugguggugaucagcggccg

SEQ ID NO: 3396064 - RNA, 18 nt, Pseudomonas aeruginosa PA01
gcccugguugcggaacgg

SEQ ID NO: 3396065 - RNA, 20 nt, Pseudomonas aeruginosa PA01
gcccuguacauagcggguca

SEQ ID NO: 3396066 - RNA, 13 nt, Pseudomonas aeruginosa PA01
gcccuguucggcg

SEQ ID NO: 3396067 - RNA, 14 nt, Pseudomonas aeruginosa PA01
gcccuguucgucug

SEQ ID NO: 3396068 - RNA, 15 nt, Pseudomonas aeruginosa PA01
gcccuguucgucugg

SEQ ID NO: 3396069 - RNA, 19 nt, Pseudomonas aeruginosa PA01
gcccuguucgucuggcgcc

SEQ ID NO: 3396070 - RNA, 20 nt, Pseudomonas aeruginosa PA01
gcccuguuucggguccaggc

SEQ ID NO: 3396071 - RNA, 21 nt, Pseudomonas aeruginosa PA01
gcccuguuucggguccaggcg

SEQ ID NO: 3396072 - RNA, 23 nt, Pseudomonas aeruginosa PA01
gcccuguuucggguccaggcgcc

SEQ ID NO: 3396073 - RNA, 24 nt, Pseudomonas aeruginosa PA01
gcccuguuucggguccaggcgcca

SEQ ID NO: 3396074 - RNA, 20 nt, Pseudomonas aeruginosa PA01
gcccuucaaaaaccaugcgg

SEQ ID NO: 3396075 - RNA, 21 nt, Pseudomonas aeruginosa PA01
gcccuucaucauuucccgucc

SEQ ID NO: 3396076 - RNA, 20 nt, Pseudomonas aeruginosa PA01
gcccuucgaacccgcccucg

SEQ ID NO: 3396077 - RNA, 19 nt, Pseudomonas aeruginosa PA01
gcccuucgagaaacugcag

SEQ ID NO: 3396078 - RNA, 12 nt, Pseudomonas aeruginosa PA01
gcccuucgcccu

SEQ ID NO: 3396079 - RNA, 17 nt, Pseudomonas aeruginosa PA01
gcccuucgcccugcgug

SEQ ID NO: 3396080 - RNA, 21 nt, Pseudomonas aeruginosa PA01
gcccuucgguuucgcgccaug

SEQ ID NO: 3396081 - RNA, 15 nt, Pseudomonas aeruginosa PA01
gcccuucuccgccag

SEQ ID NO: 3396082 - RNA, 22 nt, Pseudomonas aeruginosa PA01
gcccuugacccgguacagcgcc

SEQ ID NO: 3396083 - RNA, 18 nt, Pseudomonas aeruginosa PA01
gcccuugacgucguucag

SEQ ID NO: 3396084 - RNA, 20 nt, Pseudomonas aeruginosa PA01
gcccuugacguucaggcugu

SEQ ID NO: 3396085 - RNA, 17 nt, Pseudomonas aeruginosa PA01
gcccuugagcauggcgu

SEQ ID NO: 3396086 - RNA, 21 nt, Pseudomonas aeruginosa PA01
gcccuugaggaaguugcgcag

SEQ ID NO: 3396087 - RNA, 23 nt, Pseudomonas aeruginosa PA01
gcccuugaggaaguugcgcagca

SEQ ID NO: 3396088 - RNA, 18 nt, Pseudomonas aeruginosa PA01
gcccuugagggccucggc

SEQ ID NO: 3396089 - RNA, 20 nt, Pseudomonas aeruginosa PA01
gcccuugagggccucggcga

SEQ ID NO: 3396090 - RNA, 15 nt, Pseudomonas aeruginosa PA01
gcccuugcaaccgcc

SEQ ID NO: 3396091 - RNA, 21 nt, Pseudomonas aeruginosa PA01
gcccuugcaaccgccgccgca

SEQ ID NO: 3396092 - RNA, 13 nt, Pseudomonas aeruginosa PA01
gcccuugcccgga

SEQ ID NO: 3396093 - RNA, 13 nt, Pseudomonas aeruginosa PA01
gcccuugccggga

SEQ ID NO: 3396094 - RNA, 15 nt, Pseudomonas aeruginosa PA01
gcccuugccgggaag

SEQ ID NO: 3396095 - RNA, 17 nt, Pseudomonas aeruginosa PA01
gcccuugcgccgcgguu

SEQ ID NO: 3396096 - RNA, 21 nt, Pseudomonas aeruginosa PA01
gcccuugcggcccgccucggc

SEQ ID NO: 3396097 - RNA, 16 nt, Pseudomonas aeruginosa PA01
gcccuugcggcgcggc

SEQ ID NO: 3396098 - RNA, 16 nt, Pseudomonas aeruginosa PA01
gcccuugcugcccagu

SEQ ID NO: 3396099 - RNA, 22 nt, Pseudomonas aeruginosa PA01
gcccuuggaguugaugaagcac

SEQ ID NO: 3396100 - RNA, 14 nt, Pseudomonas aeruginosa PA01
gcccuuggccagcg

SEQ ID NO: 3396101 - RNA, 14 nt, Pseudomonas aeruginosa PA01
gcccuuggcggcgc

SEQ ID NO: 3396102 - RNA, 21 nt, Pseudomonas aeruginosa PA01
gcccuuggcuuccuggcgccg

SEQ ID NO: 3396103 - RNA, 16 nt, Pseudomonas aeruginosa PA01
gcccuugggaccgggc

SEQ ID NO: 3396104 - RNA, 18 nt, Pseudomonas aeruginosa PA01
gcccuuggucaggccgac

SEQ ID NO: 3396105 - RNA, 18 nt, Pseudomonas aeruginosa PA01
gcccuuguacagcuucag

SEQ ID NO: 3396106 - RNA, 23 nt, Pseudomonas aeruginosa PA01
gcccuuguacagcuucaggcgca

SEQ ID NO: 3396107 - RNA, 22 nt, Pseudomonas aeruginosa PA01
gcccuuguagaucgacagccac

SEQ ID NO: 3396108 - RNA, 16 nt, Pseudomonas aeruginosa PA01
gcccuugucgcccuuc

SEQ ID NO: 3396109 - RNA, 20 nt, Pseudomonas aeruginosa PA01
gcccuugucgccgcugggca

SEQ ID NO: 3396110 - RNA, 22 nt, Pseudomonas aeruginosa PA01
gcccuugucgccgcugggcagc

SEQ ID NO: 3396111 - RNA, 22 nt, Pseudomonas aeruginosa PA01
gcccuugugaaagggcggcagc

SEQ ID NO: 3396112 - RNA, 20 nt, Pseudomonas aeruginosa PA01
gcccuuuucaauuccgccgc

SEQ ID NO: 3396113 - RNA, 16 nt, Pseudomonas aeruginosa PA01
gcccuuuuccaccggc

SEQ ID NO: 3396114 - RNA, 17 nt, Pseudomonas aeruginosa PA01
gcccuuuuccuccaggg

SEQ ID NO: 3396115 - RNA, 17 nt, Pseudomonas aeruginosa PA01
gcccuuuuucgucgcca

SEQ ID NO: 3396116 - RNA, 22 nt, Pseudomonas aeruginosa PA01
gcccuuuuucgucgccagcccg

SEQ ID NO: 3396117 - RNA, 18 nt, Pseudomonas aeruginosa PA01
gccgaaaaauucagcgca

SEQ ID NO: 3396118 - RNA, 21 nt, Pseudomonas aeruginosa PA01
gccgaaaagaagccccgcagc

SEQ ID NO: 3396119 - RNA, 12 nt, Pseudomonas aeruginosa PA01
gccgaaagcacu

SEQ ID NO: 3396120 - RNA, 21 nt, Pseudomonas aeruginosa PA01
gccgaaagcacugcggcgguc

SEQ ID NO: 3396121 - RNA, 22 nt, Pseudomonas aeruginosa PA01
gccgaaagcacugcggcggucc

SEQ ID NO: 3396122 - RNA, 20 nt, Pseudomonas aeruginosa PA01
gccgaaaggccguuguagag

SEQ ID NO: 3396123 - RNA, 15 nt, Pseudomonas aeruginosa PA01
gccgaaauagcgcgc

SEQ ID NO: 3396124 - RNA, 16 nt, Pseudomonas aeruginosa PA01
gccgaaauagcgcgcc

SEQ ID NO: 3396125 - RNA, 21 nt, Pseudomonas aeruginosa PA01
gccgaaaucgaugucgcggcg

SEQ ID NO: 3396126 - RNA, 22 nt, Pseudomonas aeruginosa PA01
gccgaaaucgaugucgcggcgc

SEQ ID NO: 3396127 - RNA, 19 nt, Pseudomonas aeruginosa PA01
gccgaaaugcugcaggccg

SEQ ID NO: 3396128 - RNA, 22 nt, Pseudomonas aeruginosa PA01
gccgaaauggcgguggccgugg

SEQ ID NO: 3396129 - RNA, 24 nt, Pseudomonas aeruginosa PA01
gccgaaauggcgguggccgugggc

SEQ ID NO: 3396130 - RNA, 15 nt, Pseudomonas aeruginosa PA01
gccgaaauugaccag

SEQ ID NO: 3396131 - RNA, 16 nt, Pseudomonas aeruginosa PA01
gccgaaauugaccagg

SEQ ID NO: 3396132 - RNA, 13 nt, Pseudomonas aeruginosa PA01
gccgaacaccugc

SEQ ID NO: 3396133 - RNA, 22 nt, Pseudomonas aeruginosa PA01
gccgaacaccugcaucaccagg

SEQ ID NO: 3396134 - RNA, 17 nt, Pseudomonas aeruginosa PA01
gccgaacagacgcaggc

SEQ ID NO: 3396135 - RNA, 19 nt, Pseudomonas aeruginosa PA01
gccgaacagacgcaggcag

SEQ ID NO: 3396136 - RNA, 21 nt, Pseudomonas aeruginosa PA01
gccgaacagacgcaggcaggu

SEQ ID NO: 3396137 - RNA, 12 nt, Pseudomonas aeruginosa PA01
gccgaacagcaa

SEQ ID NO: 3396138 - RNA, 20 nt, Pseudomonas aeruginosa PA01
gccgaacagcaacaccgcgc

SEQ ID NO: 3396139 - RNA, 22 nt, Pseudomonas aeruginosa PA01
gccgaacagcaacaccgcgcag

SEQ ID NO: 3396140 - RNA, 23 nt, Pseudomonas aeruginosa PA01
gccgaacagcaacaccgcgcaga

SEQ ID NO: 3396141 - RNA, 12 nt, Pseudomonas aeruginosa PA01
gccgaacagcag

SEQ ID NO: 3396142 - RNA, 16 nt, Pseudomonas aeruginosa PA01
gccgaacagccgcccc

SEQ ID NO: 3396143 - RNA, 23 nt, Pseudomonas aeruginosa PA01
gccgaacagccgccccaccacca

SEQ ID NO: 3396144 - RNA, 20 nt, Pseudomonas aeruginosa PA01
gccgaacaggaucuccucgg

SEQ ID NO: 3396145 - RNA, 15 nt, Pseudomonas aeruginosa PA01
gccgaacaggcgucc

SEQ ID NO: 3396146 - RNA, 13 nt, Pseudomonas aeruginosa PA01
gccgaacagggcg

SEQ ID NO: 3396147 - RNA, 19 nt, Pseudomonas aeruginosa PA01
gccgaacaguucggcggug

SEQ ID NO: 3396148 - RNA, 19 nt, Pseudomonas aeruginosa PA01
gccgaacaugccgaagagc

SEQ ID NO: 3396149 - RNA, 18 nt, Pseudomonas aeruginosa PA01
gccgaacgccaccagggc

SEQ ID NO: 3396150 - RNA, 15 nt, Pseudomonas aeruginosa PA01
gccgaacgccccagu

SEQ ID NO: 3396151 - RNA, 21 nt, Pseudomonas aeruginosa PA01
gccgaacggaucgcgucgcag

SEQ ID NO: 3396152 - RNA, 17 nt, Pseudomonas aeruginosa PA01
gccgaacgguagguagc

SEQ ID NO: 3396153 - RNA, 19 nt, Pseudomonas aeruginosa PA01
gccgacaggucggccggca

SEQ ID NO: 3396154 - RNA, 14 nt, Pseudomonas aeruginosa PA01
gccgacauccuguc

SEQ ID NO: 3396155 - RNA, 23 nt, Pseudomonas aeruginosa PA01
gccgacaucggagugcaugccgg

SEQ ID NO: 3396156 - RNA, 19 nt, Pseudomonas aeruginosa PA01
gccgaccacaugggcgacc

SEQ ID NO: 3396157 - RNA, 13 nt, Pseudomonas aeruginosa PA01
gccgaccacgacc

SEQ ID NO: 3396158 - RNA, 20 nt, Pseudomonas aeruginosa PA01
gccgaccacgaccgcgucca

SEQ ID NO: 3396159 - RNA, 23 nt, Pseudomonas aeruginosa PA01
gccgaccacguaguaggcgcggg

SEQ ID NO: 3396160 - RNA, 22 nt, Pseudomonas aeruginosa PA01
gccgaccacucgcgagauggcg

SEQ ID NO: 3396161 - RNA, 21 nt, Pseudomonas aeruginosa PA01
gccgaccacuuccagguagcc

SEQ ID NO: 3396162 - RNA, 14 nt, Pseudomonas aeruginosa PA01
gccgaccagcaaca

SEQ ID NO: 3396163 - RNA, 14 nt, Pseudomonas aeruginosa PA01
gccgaccagcaggg

SEQ ID NO: 3396164 - RNA, 16 nt, Pseudomonas aeruginosa PA01
gccgaccagcagggcc

SEQ ID NO: 3396165 - RNA, 17 nt, Pseudomonas aeruginosa PA01
gccgaccagcagggcca

SEQ ID NO: 3396166 - RNA, 23 nt, Pseudomonas aeruginosa PA01
gccgaccagcagggccagcagcg

SEQ ID NO: 3396167 - RNA, 15 nt, Pseudomonas aeruginosa PA01
gccgaccagccgcag

SEQ ID NO: 3396168 - RNA, 16 nt, Pseudomonas aeruginosa PA01
gccgaccagccgcagg

SEQ ID NO: 3396169 - RNA, 22 nt, Pseudomonas aeruginosa PA01
gccgaccagccgcaggcugccg

SEQ ID NO: 3396170 - RNA, 16 nt, Pseudomonas aeruginosa PA01
gccgaccagcgccgac

SEQ ID NO: 3396171 - RNA, 12 nt, Pseudomonas aeruginosa PA01
gccgaccaggcc

SEQ ID NO: 3396172 - RNA, 13 nt, Pseudomonas aeruginosa PA01
gccgaccaggccg

SEQ ID NO: 3396173 - RNA, 17 nt, Pseudomonas aeruginosa PA01
gccgaccaggccgaucg

SEQ ID NO: 3396174 - RNA, 23 nt, Pseudomonas aeruginosa PA01
gccgaccaggccguaggcgaugg

SEQ ID NO: 3396175 - RNA, 19 nt, Pseudomonas aeruginosa PA01
gccgaccaggcggccgucg

SEQ ID NO: 3396176 - RNA, 21 nt, Pseudomonas aeruginosa PA01
gccgaccaggcggccgucggc

SEQ ID NO: 3396177 - RNA, 17 nt, Pseudomonas aeruginosa PA01
gccgaccagguccgcca

SEQ ID NO: 3396178 - RNA, 16 nt, Pseudomonas aeruginosa PA01
gccgacccagagcgcg

SEQ ID NO: 3396179 - RNA, 18 nt, Pseudomonas aeruginosa PA01
gccgacccagagcgcgcc

SEQ ID NO: 3396180 - RNA, 18 nt, Pseudomonas aeruginosa PA01
gccgacccgcagcggcgc

SEQ ID NO: 3396181 - RNA, 22 nt, Pseudomonas aeruginosa PA01
gccgacccgcaggccggccagg

SEQ ID NO: 3396182 - RNA, 16 nt, Pseudomonas aeruginosa PA01
gccgacccgugcgccg

SEQ ID NO: 3396183 - RNA, 17 nt, Pseudomonas aeruginosa PA01
gccgacccgugcgccgc

SEQ ID NO: 3396184 - RNA, 19 nt, Pseudomonas aeruginosa PA01
gccgacccgugcgccgcgg

SEQ ID NO: 3396185 - RNA, 20 nt, Pseudomonas aeruginosa PA01
gccgacccuagggucggcgu

SEQ ID NO: 3396186 - RNA, 16 nt, Pseudomonas aeruginosa PA01
gccgaccgacuggccg

SEQ ID NO: 3396187 - RNA, 12 nt, Pseudomonas aeruginosa PA01
gccgaccgagca

SEQ ID NO: 3396188 - RNA, 19 nt, Pseudomonas aeruginosa PA01
gccgaccgagcagcggacg

SEQ ID NO: 3396189 - RNA, 16 nt, Pseudomonas aeruginosa PA01
gccgaccgcaccgcca

SEQ ID NO: 3396190 - RNA, 19 nt, Pseudomonas aeruginosa PA01
gccgaccgcaccgccagcg

SEQ ID NO: 3396191 - RNA, 23 nt, Pseudomonas aeruginosa PA01
gccgaccgcaccgccagcgucgc

SEQ ID NO: 3396192 - RNA, 24 nt, Pseudomonas aeruginosa PA01
gccgaccgcaccgccagcgucgcc

SEQ ID NO: 3396193 - RNA, 20 nt, Pseudomonas aeruginosa PA01
gccgaccgccaaggucgguc

SEQ ID NO: 3396194 - RNA, 13 nt, Pseudomonas aeruginosa PA01
gccgaccgccagg

SEQ ID NO: 3396195 - RNA, 15 nt, Pseudomonas aeruginosa PA01
gccgaccgccaggcc

SEQ ID NO: 3396196 - RNA, 13 nt, Pseudomonas aeruginosa PA01
gccgaccgcgcgc

SEQ ID NO: 3396197 - RNA, 18 nt, Pseudomonas aeruginosa PA01
gccgaccgcgcgccugca

SEQ ID NO: 3396198 - RNA, 14 nt, Pseudomonas aeruginosa PA01
gccgaccggcgccg

SEQ ID NO: 3396199 - RNA, 16 nt, Pseudomonas aeruginosa PA01
gccgaccggcgccggg

SEQ ID NO: 3396200 - RNA, 22 nt, Pseudomonas aeruginosa PA01
gccgaccgggcgggucuggcgg

SEQ ID NO: 3396201 - RNA, 14 nt, Pseudomonas aeruginosa PA01
gccgaccguccgcc

SEQ ID NO: 3396202 - RNA, 17 nt, Pseudomonas aeruginosa PA01
gccgaccguccgccugc

SEQ ID NO: 3396203 - RNA, 20 nt, Pseudomonas aeruginosa PA01
gccgaccguccgccugcgga

SEQ ID NO: 3396204 - RNA, 21 nt, Pseudomonas aeruginosa PA01
gccgaccgugagcuuguccag

SEQ ID NO: 3396205 - RNA, 14 nt, Pseudomonas aeruginosa PA01
gccgaccucggccg

SEQ ID NO: 3396206 - RNA, 15 nt, Pseudomonas aeruginosa PA01
gccgaccucggccgc

SEQ ID NO: 3396207 - RNA, 17 nt, Pseudomonas aeruginosa PA01
gccgaccucggccgcca

SEQ ID NO: 3396208 - RNA, 18 nt, Pseudomonas aeruginosa PA01
gccgaccucggcggucag

SEQ ID NO: 3396209 - RNA, 20 nt, Pseudomonas aeruginosa PA01
gccgaccucggcggucaggu

SEQ ID NO: 3396210 - RNA, 16 nt, Pseudomonas aeruginosa PA01
gccgaccuguaccgcu

SEQ ID NO: 3396211 - RNA, 21 nt, Pseudomonas aeruginosa PA01
gccgaccuguaccgcucccca

SEQ ID NO: 3396212 - RNA, 12 nt, Pseudomonas aeruginosa PA01
gccgaccuucac

SEQ ID NO: 3396213 - RNA, 14 nt, Pseudomonas aeruginosa PA01
gccgaccuucacca

SEQ ID NO: 3396214 - RNA, 16 nt, Pseudomonas aeruginosa PA01
gccgaccuucaccacc

SEQ ID NO: 3396215 - RNA, 19 nt, Pseudomonas aeruginosa PA01
gccgaccuucaccaccagc

SEQ ID NO: 3396216 - RNA, 19 nt, Pseudomonas aeruginosa PA01
gccgaccuugcgucuucgc

SEQ ID NO: 3396217 - RNA, 20 nt, Pseudomonas aeruginosa PA01
gccgaccuugcgucuucgcc

SEQ ID NO: 3396218 - RNA, 22 nt, Pseudomonas aeruginosa PA01
gccgaccuugcgucuucgccga

SEQ ID NO: 3396219 - RNA, 18 nt, Pseudomonas aeruginosa PA01
gccgaccuuguccacguc

SEQ ID NO: 3396220 - RNA, 13 nt, Pseudomonas aeruginosa PA01
gccgacgaacagc

SEQ ID NO: 3396221 - RNA, 15 nt, Pseudomonas aeruginosa PA01
gccgacgaacagcca

SEQ ID NO: 3396222 - RNA, 18 nt, Pseudomonas aeruginosa PA01
gccgacgaacagccagag

SEQ ID NO: 3396223 - RNA, 23 nt, Pseudomonas aeruginosa PA01
gccgacgaagaccuugaacucgc

SEQ ID NO: 3396224 - RNA, 12 nt, Pseudomonas aeruginosa PA01
gccgacgaaggc

SEQ ID NO: 3396225 - RNA, 14 nt, Pseudomonas aeruginosa PA01
gccgacgaaggccg

SEQ ID NO: 3396226 - RNA, 15 nt, Pseudomonas aeruginosa PA01
gccgacgaaggccgc

SEQ ID NO: 3396227 - RNA, 20 nt, Pseudomonas aeruginosa PA01
gccgacgaaggccgcggucg

SEQ ID NO: 3396228 - RNA, 13 nt, Pseudomonas aeruginosa PA01
gccgacgaaggcg

SEQ ID NO: 3396229 - RNA, 15 nt, Pseudomonas aeruginosa PA01
gccgacgaaggcgag

SEQ ID NO: 3396230 - RNA, 12 nt, Pseudomonas aeruginosa PA01
gccgacgacccg

SEQ ID NO: 3396231 - RNA, 19 nt, Pseudomonas aeruginosa PA01
gccgacgagcagcucgccg

SEQ ID NO: 3396232 - RNA, 23 nt, Pseudomonas aeruginosa PA01
gccgacgagcagcucgccggcgu

SEQ ID NO: 3396233 - RNA, 20 nt, Pseudomonas aeruginosa PA01
gccgacgauccggccgaucu

SEQ ID NO: 3396234 - RNA, 21 nt, Pseudomonas aeruginosa PA01
gccgacgauguucgaggcgcc

SEQ ID NO: 3396235 - RNA, 22 nt, Pseudomonas aeruginosa PA01
gccgacgauguucgaggcgccg

SEQ ID NO: 3396236 - RNA, 23 nt, Pseudomonas aeruginosa PA01
gccgacgauguucgaggcgccga

SEQ ID NO: 3396237 - RNA, 16 nt, Pseudomonas aeruginosa PA01
gccgacgauguuguug

SEQ ID NO: 3396238 - RNA, 16 nt, Pseudomonas aeruginosa PA01
gccgacgccaccagcc

SEQ ID NO: 3396239 - RNA, 17 nt, Pseudomonas aeruginosa PA01
gccgacgccaccagcca

SEQ ID NO: 3396240 - RNA, 18 nt, Pseudomonas aeruginosa PA01
gccgacgccaccagccag

SEQ ID NO: 3396241 - RNA, 20 nt, Pseudomonas aeruginosa PA01
gccgacgccaccagccaggc

SEQ ID NO: 3396242 - RNA, 14 nt, Pseudomonas aeruginosa PA01
gccgacgccgagca

SEQ ID NO: 3396243 - RNA, 16 nt, Pseudomonas aeruginosa PA01
gccgacgccgagcagc

SEQ ID NO: 3396244 - RNA, 17 nt, Pseudomonas aeruginosa PA01
gccgacgccgagcagca

SEQ ID NO: 3396245 - RNA, 18 nt, Pseudomonas aeruginosa PA01
gccgacgccgagcagcac

SEQ ID NO: 3396246 - RNA, 17 nt, Pseudomonas aeruginosa PA01
gccgacgccgcggccgg

SEQ ID NO: 3396247 - RNA, 19 nt, Pseudomonas aeruginosa PA01
gccgacgccgcggccggcg

SEQ ID NO: 3396248 - RNA, 12 nt, Pseudomonas aeruginosa PA01
gccgacgccgga

SEQ ID NO: 3396249 - RNA, 15 nt, Pseudomonas aeruginosa PA01
gccgacgccggacga

SEQ ID NO: 3396250 - RNA, 13 nt, Pseudomonas aeruginosa PA01
gccgacgcgcagc

SEQ ID NO: 3396251 - RNA, 13 nt, Pseudomonas aeruginosa PA01
gccgacgcgcugc

SEQ ID NO: 3396252 - RNA, 16 nt, Pseudomonas aeruginosa PA01
gccgacgcugaucauc

SEQ ID NO: 3396253 - RNA, 16 nt, Pseudomonas aeruginosa PA01
gccgacgcuuccucgc

SEQ ID NO: 3396254 - RNA, 17 nt, Pseudomonas aeruginosa PA01
gccgacgcuuccucgcu

SEQ ID NO: 3396255 - RNA, 19 nt, Pseudomonas aeruginosa PA01
gccgacggacguccuccug

SEQ ID NO: 3396256 - RNA, 20 nt, Pseudomonas aeruginosa PA01
gccgagcccgagugcgccca

SEQ ID NO: 3396257 - RNA, 23 nt, Pseudomonas aeruginosa PA01
gccgagccgacauccugucgagg

SEQ ID NO: 3396258 - RNA, 14 nt, Pseudomonas aeruginosa PA01
gccgagccggcugc

SEQ ID NO: 3396259 - RNA, 17 nt, Pseudomonas aeruginosa PA01
gccgagccggcugccga

SEQ ID NO: 3396260 - RNA, 18 nt, Pseudomonas aeruginosa PA01
gccgagcgaaaucggcag

SEQ ID NO: 3396261 - RNA, 23 nt, Pseudomonas aeruginosa PA01
gccgagcgaaaucggcaggcugc

SEQ ID NO: 3396262 - RNA, 15 nt, Pseudomonas aeruginosa PA01
gccgagcgacuccgg

SEQ ID NO: 3396263 - RNA, 22 nt, Pseudomonas aeruginosa PA01
gccgagcgacuccgggaacagc

SEQ ID NO: 3396264 - RNA, 13 nt, Pseudomonas aeruginosa PA01
gccgagcgcagcg

SEQ ID NO: 3396265 - RNA, 15 nt, Pseudomonas aeruginosa PA01
gccgagcgccagggc

SEQ ID NO: 3396266 - RNA, 16 nt, Pseudomonas aeruginosa PA01
gccgagcgccagggcc

SEQ ID NO: 3396267 - RNA, 17 nt, Pseudomonas aeruginosa PA01
gccgagcgccagggcca

SEQ ID NO: 3396268 - RNA, 18 nt, Pseudomonas aeruginosa PA01
gccgagcgccagggccag

SEQ ID NO: 3396269 - RNA, 14 nt, Pseudomonas aeruginosa PA01
gccgagcgccgcca

SEQ ID NO: 3396270 - RNA, 16 nt, Pseudomonas aeruginosa PA01
gccgagcgccgccagg

SEQ ID NO: 3396271 - RNA, 18 nt, Pseudomonas aeruginosa PA01
gccgagcgccgccaggca

SEQ ID NO: 3396272 - RNA, 19 nt, Pseudomonas aeruginosa PA01
gccgagcgccgccaggcag

SEQ ID NO: 3396273 - RNA, 20 nt, Pseudomonas aeruginosa PA01
gccgagcgccgccaggcagg

SEQ ID NO: 3396274 - RNA, 14 nt, Pseudomonas aeruginosa PA01
gccgagcgccgccu

SEQ ID NO: 3396275 - RNA, 17 nt, Pseudomonas aeruginosa PA01
gccgagcgccgccuggg

SEQ ID NO: 3396276 - RNA, 16 nt, Pseudomonas aeruginosa PA01
gccgagcgccuggcaa

SEQ ID NO: 3396277 - RNA, 19 nt, Pseudomonas aeruginosa PA01
gccgagcgccuggcaaccg

SEQ ID NO: 3396278 - RNA, 16 nt, Pseudomonas aeruginosa PA01
gccgagcgcgaucagc

SEQ ID NO: 3396279 - RNA, 22 nt, Pseudomonas aeruginosa PA01
gccgagcgcgaucagccgcucc

SEQ ID NO: 3396280 - RNA, 16 nt, Pseudomonas aeruginosa PA01
gccgagcgcgccgccg

SEQ ID NO: 3396281 - RNA, 18 nt, Pseudomonas aeruginosa PA01
gccgagcgcgccgccgau

SEQ ID NO: 3396282 - RNA, 14 nt, Pseudomonas aeruginosa PA01
gccgagcgcucgcc

SEQ ID NO: 3396283 - RNA, 15 nt, Pseudomonas aeruginosa PA01
gccgagcgcucgccg

SEQ ID NO: 3396284 - RNA, 16 nt, Pseudomonas aeruginosa PA01
gccgagcgcucgccgu

SEQ ID NO: 3396285 - RNA, 18 nt, Pseudomonas aeruginosa PA01
gccgagcgcucgccguca

SEQ ID NO: 3396286 - RNA, 16 nt, Pseudomonas aeruginosa PA01
gccgagcggaaaagca

SEQ ID NO: 3396287 - RNA, 16 nt, Pseudomonas aeruginosa PA01
gccgagcggcaaggcc

SEQ ID NO: 3396288 - RNA, 14 nt, Pseudomonas aeruginosa PA01
gccgagcguggugc

SEQ ID NO: 3396289 - RNA, 23 nt, Pseudomonas aeruginosa PA01
gccgagcguugggccucgcugcg

SEQ ID NO: 3396290 - RNA, 13 nt, Pseudomonas aeruginosa PA01
gccgagcugacca

SEQ ID NO: 3396291 - RNA, 16 nt, Pseudomonas aeruginosa PA01
gccgagcugaccacca

SEQ ID NO: 3396292 - RNA, 18 nt, Pseudomonas aeruginosa PA01
gccgagcugaccaccagg

SEQ ID NO: 3396293 - RNA, 21 nt, Pseudomonas aeruginosa PA01
gccgagcugaccaccagggcg

SEQ ID NO: 3396294 - RNA, 13 nt, Pseudomonas aeruginosa PA01
gccgagcugccgg

SEQ ID NO: 3396295 - RNA, 15 nt, Pseudomonas aeruginosa PA01
gccgagcugccgggc

SEQ ID NO: 3396296 - RNA, 18 nt, Pseudomonas aeruginosa PA01
gccgagcugccgggcgag

SEQ ID NO: 3396297 - RNA, 21 nt, Pseudomonas aeruginosa PA01
gccgagcugccgggcgagcug

SEQ ID NO: 3396298 - RNA, 15 nt, Pseudomonas aeruginosa PA01
gccgagcugcucgaa

SEQ ID NO: 3396299 - RNA, 14 nt, Pseudomonas aeruginosa PA01
gccgagcuggcgcg

SEQ ID NO: 3396300 - RNA, 18 nt, Pseudomonas aeruginosa PA01
gccgagcuggcgcgcguc

SEQ ID NO: 3396301 - RNA, 14 nt, Pseudomonas aeruginosa PA01
gccgagcugggcgu

SEQ ID NO: 3396302 - RNA, 21 nt, Pseudomonas aeruginosa PA01
gccgagcugggcguugcccau

SEQ ID NO: 3396303 - RNA, 22 nt, Pseudomonas aeruginosa PA01
gccgagcuugaccuugccgccg

SEQ ID NO: 3396304 - RNA, 23 nt, Pseudomonas aeruginosa PA01
gccgagcuugaccuugccgccgg

SEQ ID NO: 3396305 - RNA, 21 nt, Pseudomonas aeruginosa PA01
gccgaggaacauccgcggccc

SEQ ID NO: 3396306 - RNA, 17 nt, Pseudomonas aeruginosa PA01
gccgaggaagccgaccg

SEQ ID NO: 3396307 - RNA, 18 nt, Pseudomonas aeruginosa PA01
gccgaggaagccgaccgg

SEQ ID NO: 3396308 - RNA, 21 nt, Pseudomonas aeruginosa PA01
gccgaggaagccgaccggcgc

SEQ ID NO: 3396309 - RNA, 17 nt, Pseudomonas aeruginosa PA01
gccgaggaaggcgcugg

SEQ ID NO: 3396310 - RNA, 20 nt, Pseudomonas aeruginosa PA01
gccgaggaaggcgcuggcgc

SEQ ID NO: 3396311 - RNA, 21 nt, Pseudomonas aeruginosa PA01
gccgaggaaggcgcuggcgcu

SEQ ID NO: 3396312 - RNA, 13 nt, Pseudomonas aeruginosa PA01
gccgaggaagucg

SEQ ID NO: 3396313 - RNA, 18 nt, Pseudomonas aeruginosa PA01
gccgaggaagucggcggc

SEQ ID NO: 3396314 - RNA, 21 nt, Pseudomonas aeruginosa PA01
gccgaggaagucggcggccgc

SEQ ID NO: 3396315 - RNA, 22 nt, Pseudomonas aeruginosa PA01
gccgaggaggaucucgcgcccc

SEQ ID NO: 3396316 - RNA, 17 nt, Pseudomonas aeruginosa PA01
gccgaggaggaugccga

SEQ ID NO: 3396317 - RNA, 15 nt, Pseudomonas aeruginosa PA01
gccgaggaggccagc

SEQ ID NO: 3396318 - RNA, 19 nt, Pseudomonas aeruginosa PA01
gccgaggaggccagcagca

SEQ ID NO: 3396319 - RNA, 21 nt, Pseudomonas aeruginosa PA01
gccgaggauacgcucaggaag

SEQ ID NO: 3396320 - RNA, 17 nt, Pseudomonas aeruginosa PA01
gccgaggauagcgucca

SEQ ID NO: 3396321 - RNA, 15 nt, Pseudomonas aeruginosa PA01
gccgaggaugcucgc

SEQ ID NO: 3396322 - RNA, 17 nt, Pseudomonas aeruginosa PA01
gccgaggaugcucgccu

SEQ ID NO: 3396323 - RNA, 14 nt, Pseudomonas aeruginosa PA01
gccgaggcagccgu

SEQ ID NO: 3396324 - RNA, 14 nt, Pseudomonas aeruginosa PA01
gccgaggcccuaca

SEQ ID NO: 3396325 - RNA, 13 nt, Pseudomonas aeruginosa PA01
gccgaggccgagg

SEQ ID NO: 3396326 - RNA, 13 nt, Pseudomonas aeruginosa PA01
gccgaggccgccg

SEQ ID NO: 3396327 - RNA, 14 nt, Pseudomonas aeruginosa PA01
gccgaggccgccgc

SEQ ID NO: 3396328 - RNA, 12 nt, Pseudomonas aeruginosa PA01
gccgaggccggc

SEQ ID NO: 3396329 - RNA, 12 nt, Pseudomonas aeruginosa PA01
gccgaggcgcgc

SEQ ID NO: 3396330 - RNA, 13 nt, Pseudomonas aeruginosa PA01
gccgaggcgcgcc

SEQ ID NO: 3396331 - RNA, 14 nt, Pseudomonas aeruginosa PA01
gccgaggcgcgcca

SEQ ID NO: 3396332 - RNA, 16 nt, Pseudomonas aeruginosa PA01
gccgaggcgcgccacg

SEQ ID NO: 3396333 - RNA, 17 nt, Pseudomonas aeruginosa PA01
gccgaggcgcgccacgc

SEQ ID NO: 3396334 - RNA, 20 nt, Pseudomonas aeruginosa PA01
gccgaggcgcgccacgcaau

SEQ ID NO: 3396335 - RNA, 14 nt, Pseudomonas aeruginosa PA01
gccgaggcggaaga

SEQ ID NO: 3396336 - RNA, 13 nt, Pseudomonas aeruginosa PA01
gccgaggcggccg

SEQ ID NO: 3396337 - RNA, 18 nt, Pseudomonas aeruginosa PA01
gccgaggcggccgagggc

SEQ ID NO: 3396338 - RNA, 15 nt, Pseudomonas aeruginosa PA01
gccgaggcggccgua

SEQ ID NO: 3396339 - RNA, 19 nt, Pseudomonas aeruginosa PA01
gccgaggcggccguagccg

SEQ ID NO: 3396340 - RNA, 13 nt, Pseudomonas aeruginosa PA01
gccgaggcggcgc

SEQ ID NO: 3396341 - RNA, 14 nt, Pseudomonas aeruginosa PA01
gccgaggcgucgaa

SEQ ID NO: 3396342 - RNA, 16 nt, Pseudomonas aeruginosa PA01
gccgaggcugcgggcg

SEQ ID NO: 3396343 - RNA, 17 nt, Pseudomonas aeruginosa PA01
gccgaggcugcgggcga

SEQ ID NO: 3396344 - RNA, 17 nt, Pseudomonas aeruginosa PA01
gccgaggcugugggucg

SEQ ID NO: 3396345 - RNA, 18 nt, Pseudomonas aeruginosa PA01
gccgaggcuuuccagcag

SEQ ID NO: 3396346 - RNA, 21 nt, Pseudomonas aeruginosa PA01
gccgaggcuuuccagcaggcg

SEQ ID NO: 3396347 - RNA, 14 nt, Pseudomonas aeruginosa PA01
gccgagggcaaggu

SEQ ID NO: 3396348 - RNA, 14 nt, Pseudomonas aeruginosa PA01
gccgagggcaccga

SEQ ID NO: 3396349 - RNA, 17 nt, Pseudomonas aeruginosa PA01
gccgagggcaccgacga

SEQ ID NO: 3396350 - RNA, 15 nt, Pseudomonas aeruginosa PA01
gccgagggcagccuc

SEQ ID NO: 3396351 - RNA, 22 nt, Pseudomonas aeruginosa PA01
gccgagggcgaguucggcgagc

SEQ ID NO: 3396352 - RNA, 13 nt, Pseudomonas aeruginosa PA01
gccgagggcgcca

SEQ ID NO: 3396353 - RNA, 14 nt, Pseudomonas aeruginosa PA01
gccgagggcgccag

SEQ ID NO: 3396354 - RNA, 15 nt, Pseudomonas aeruginosa PA01
gccgagggcgccagg

SEQ ID NO: 3396355 - RNA, 16 nt, Pseudomonas aeruginosa PA01
gccgagggcgccaggu

SEQ ID NO: 3396356 - RNA, 17 nt, Pseudomonas aeruginosa PA01
gccgagggcgccaggug

SEQ ID NO: 3396357 - RNA, 18 nt, Pseudomonas aeruginosa PA01
gccgagggcgccaggugc

SEQ ID NO: 3396358 - RNA, 12 nt, Pseudomonas aeruginosa PA01
gccgagggcgcg

SEQ ID NO: 3396359 - RNA, 19 nt, Pseudomonas aeruginosa PA01
gccgaucuucagcagcagg

SEQ ID NO: 3396360 - RNA, 21 nt, Pseudomonas aeruginosa PA01
gccgaucuucagcagcaggcg

SEQ ID NO: 3396361 - RNA, 23 nt, Pseudomonas aeruginosa PA01
gccgaucuucagcagcaggcgcu

SEQ ID NO: 3396362 - RNA, 15 nt, Pseudomonas aeruginosa PA01
gccgaucuucgccga

SEQ ID NO: 3396363 - RNA, 17 nt, Pseudomonas aeruginosa PA01
gccgaucuucgccgaca

SEQ ID NO: 3396364 - RNA, 19 nt, Pseudomonas aeruginosa PA01
gccgaugaaagagcccgcg

SEQ ID NO: 3396365 - RNA, 17 nt, Pseudomonas aeruginosa PA01
gccgaugaaauagccgg

SEQ ID NO: 3396366 - RNA, 19 nt, Pseudomonas aeruginosa PA01
gccgaugaaauagccggcg

SEQ ID NO: 3396367 - RNA, 20 nt, Pseudomonas aeruginosa PA01
gccgaugaaauagccggcga

SEQ ID NO: 3396368 - RNA, 13 nt, Pseudomonas aeruginosa PA01
gccgaugaacgcc

SEQ ID NO: 3396369 - RNA, 23 nt, Pseudomonas aeruginosa PA01
gccgaugaacgccgcgaaauggc

SEQ ID NO: 3396370 - RNA, 17 nt, Pseudomonas aeruginosa PA01
gccgaugaucuccgcgc

SEQ ID NO: 3396371 - RNA, 20 nt, Pseudomonas aeruginosa PA01
gccgaugaucuccgcgccgg

SEQ ID NO: 3396372 - RNA, 21 nt, Pseudomonas aeruginosa PA01
gccgaugaucuccgcgccggg

SEQ ID NO: 3396373 - RNA, 23 nt, Pseudomonas aeruginosa PA01
gccgaugaucuccgcgccgggcu

SEQ ID NO: 3396374 - RNA, 13 nt, Pseudomonas aeruginosa PA01
gccgaugcccagg

SEQ ID NO: 3396375 - RNA, 14 nt, Pseudomonas aeruginosa PA01
gccgaugcccaggc

SEQ ID NO: 3396376 - RNA, 15 nt, Pseudomonas aeruginosa PA01
gccgaugcccaggcc

SEQ ID NO: 3396377 - RNA, 16 nt, Pseudomonas aeruginosa PA01
gccgaugcccaggccg

SEQ ID NO: 3396378 - RNA, 17 nt, Pseudomonas aeruginosa PA01
gccgaugcccaggccga

SEQ ID NO: 3396379 - RNA, 15 nt, Pseudomonas aeruginosa PA01
gccgaugcccgggcg

SEQ ID NO: 3396380 - RNA, 14 nt, Pseudomonas aeruginosa PA01
gccgaugccgaccu

SEQ ID NO: 3396381 - RNA, 21 nt, Pseudomonas aeruginosa PA01
gccgaugccgaccuugccggu

SEQ ID NO: 3396382 - RNA, 22 nt, Pseudomonas aeruginosa PA01
gccgaugccgaccuugccgguu

SEQ ID NO: 3396383 - RNA, 23 nt, Pseudomonas aeruginosa PA01
gccgaugccgaccuugccgguua

SEQ ID NO: 3396384 - RNA, 13 nt, Pseudomonas aeruginosa PA01
gccgaugccgacg

SEQ ID NO: 3396385 - RNA, 14 nt, Pseudomonas aeruginosa PA01
gccgaugccggccg

SEQ ID NO: 3396386 - RNA, 17 nt, Pseudomonas aeruginosa PA01
gccgaugccggccggca

SEQ ID NO: 3396387 - RNA, 22 nt, Pseudomonas aeruginosa PA01
gccgaugccggccggcagcgag

SEQ ID NO: 3396388 - RNA, 14 nt, Pseudomonas aeruginosa PA01
gccgaugccgggca

SEQ ID NO: 3396389 - RNA, 13 nt, Pseudomonas aeruginosa PA01
gccgaugcgccga

SEQ ID NO: 3396390 - RNA, 14 nt, Pseudomonas aeruginosa PA01
gccgaugcgccgac

SEQ ID NO: 3396391 - RNA, 15 nt, Pseudomonas aeruginosa PA01
gccgaugcgccgacg

SEQ ID NO: 3396392 - RNA, 14 nt, Pseudomonas aeruginosa PA01
gccgaugcgcgacu

SEQ ID NO: 3396393 - RNA, 17 nt, Pseudomonas aeruginosa PA01
gccgaugcgcgacucga

SEQ ID NO: 3396394 - RNA, 19 nt, Pseudomonas aeruginosa PA01
gccgaugcuaucgcguggc

SEQ ID NO: 3396395 - RNA, 16 nt, Pseudomonas aeruginosa PA01
gccgaugcucgcgcca

SEQ ID NO: 3396396 - RNA, 21 nt, Pseudomonas aeruginosa PA01
gccgauggaaaucggccacuc

SEQ ID NO: 3396397 - RNA, 17 nt, Pseudomonas aeruginosa PA01
gccgauggacaggcugg

SEQ ID NO: 3396398 - RNA, 19 nt, Pseudomonas aeruginosa PA01
gccgauggagauguagucg

SEQ ID NO: 3396399 - RNA, 16 nt, Pseudomonas aeruginosa PA01
gccgauggccccggcg

SEQ ID NO: 3396400 - RNA, 14 nt, Pseudomonas aeruginosa PA01
gccgauggcgccgc

SEQ ID NO: 3396401 - RNA, 15 nt, Pseudomonas aeruginosa PA01
gccgauggcgccgcc

SEQ ID NO: 3396402 - RNA, 16 nt, Pseudomonas aeruginosa PA01
gccgauggcgccgccg

SEQ ID NO: 3396403 - RNA, 17 nt, Pseudomonas aeruginosa PA01
gccgauggcgccgccga

SEQ ID NO: 3396404 - RNA, 21 nt, Pseudomonas aeruginosa PA01
gccgauggcgccgccgagguu

SEQ ID NO: 3396405 - RNA, 21 nt, Pseudomonas aeruginosa PA01
gccgauggcugucggcgccca

SEQ ID NO: 3396406 - RNA, 23 nt, Pseudomonas aeruginosa PA01
gccgauggucucucucugcaugg

SEQ ID NO: 3396407 - RNA, 18 nt, Pseudomonas aeruginosa PA01
gccgaugguuucgugcca

SEQ ID NO: 3396408 - RNA, 15 nt, Pseudomonas aeruginosa PA01
gccgauguacggcac

SEQ ID NO: 3396409 - RNA, 19 nt, Pseudomonas aeruginosa PA01
gccgauguacggcaccacc

SEQ ID NO: 3396410 - RNA, 20 nt, Pseudomonas aeruginosa PA01
gccgauguacggcaccacca

SEQ ID NO: 3396411 - RNA, 23 nt, Pseudomonas aeruginosa PA01
gccgauguacggcaccaccaccg

SEQ ID NO: 3396412 - RNA, 19 nt, Pseudomonas aeruginosa PA01
gccgauguccucgaacagc

SEQ ID NO: 3396413 - RNA, 20 nt, Pseudomonas aeruginosa PA01
gccgauguccucgaacagcu

SEQ ID NO: 3396414 - RNA, 16 nt, Pseudomonas aeruginosa PA01
gccgaugucguagccg

SEQ ID NO: 3396415 - RNA, 23 nt, Pseudomonas aeruginosa PA01
gccgaugucguagccgcgcgcca

SEQ ID NO: 3396416 - RNA, 16 nt, Pseudomonas aeruginosa PA01
gccgaugugcacgcug

SEQ ID NO: 3396417 - RNA, 14 nt, Pseudomonas aeruginosa PA01
gccgauuccugggc

SEQ ID NO: 3396418 - RNA, 20 nt, Pseudomonas aeruginosa PA01
gccgauugccagaguugccu

SEQ ID NO: 3396419 - RNA, 17 nt, Pseudomonas aeruginosa PA01
gccgauugugcagggcc

SEQ ID NO: 3396420 - RNA, 18 nt, Pseudomonas aeruginosa PA01
gccgauuucgaugacgcc

SEQ ID NO: 3396421 - RNA, 20 nt, Pseudomonas aeruginosa PA01
gccgauuucgcagaacgcgg

SEQ ID NO: 3396422 - RNA, 17 nt, Pseudomonas aeruginosa PA01
gccgauuuucugccgcg

SEQ ID NO: 3396423 - RNA, 17 nt, Pseudomonas aeruginosa PA01
gccgcaaacccccugcg

SEQ ID NO: 3396424 - RNA, 18 nt, Pseudomonas aeruginosa PA01
gccgcaaacccccugcgc

SEQ ID NO: 3396425 - RNA, 20 nt, Pseudomonas aeruginosa PA01
gccgcaaacccccugcgcgg

SEQ ID NO: 3396426 - RNA, 15 nt, Pseudomonas aeruginosa PA01
gccgcaaccagcccu

SEQ ID NO: 3396427 - RNA, 17 nt, Pseudomonas aeruginosa PA01
gccgcaaccagcccugg

SEQ ID NO: 3396428 - RNA, 17 nt, Pseudomonas aeruginosa PA01
gccgcaaccgcccgagc

SEQ ID NO: 3396429 - RNA, 21 nt, Pseudomonas aeruginosa PA01
gccgcaagcuccccgccgcca

SEQ ID NO: 3396430 - RNA, 23 nt, Pseudomonas aeruginosa PA01
gccgcaagcuccccgccgccagg

SEQ ID NO: 3396431 - RNA, 15 nt, Pseudomonas aeruginosa PA01
gccgcaaggccaggg

SEQ ID NO: 3396432 - RNA, 16 nt, Pseudomonas aeruginosa PA01
gccgcaaggccagggc

SEQ ID NO: 3396433 - RNA, 17 nt, Pseudomonas aeruginosa PA01
gccgcaagggcgucgcu

SEQ ID NO: 3396434 - RNA, 17 nt, Pseudomonas aeruginosa PA01
gccgcaaguaccgccgg

SEQ ID NO: 3396435 - RNA, 18 nt, Pseudomonas aeruginosa PA01
gccgcaaguggcggcuga

SEQ ID NO: 3396436 - RNA, 12 nt, Pseudomonas aeruginosa PA01
gccgcacaccgc

SEQ ID NO: 3396437 - RNA, 19 nt, Pseudomonas aeruginosa PA01
gccgcacaccgcgcgcgcc

SEQ ID NO: 3396438 - RNA, 20 nt, Pseudomonas aeruginosa PA01
gccgcacaccgcgcgcgccu

SEQ ID NO: 3396439 - RNA, 13 nt, Pseudomonas aeruginosa PA01
gccgcacaggcug

SEQ ID NO: 3396440 - RNA, 14 nt, Pseudomonas aeruginosa PA01
gccgcacaggcugg

SEQ ID NO: 3396441 - RNA, 16 nt, Pseudomonas aeruginosa PA01
gccgcacaggcuggcc

SEQ ID NO: 3396442 - RNA, 23 nt, Pseudomonas aeruginosa PA01
gccgcacaguugcgcgccggcgg

SEQ ID NO: 3396443 - RNA, 20 nt, Pseudomonas aeruginosa PA01
gccgcaccacguagccggcg

SEQ ID NO: 3396444 - RNA, 22 nt, Pseudomonas aeruginosa PA01
gccgcaccacguagccggcguc

SEQ ID NO: 3396445 - RNA, 21 nt, Pseudomonas aeruginosa PA01
gccgcaccccauccucgccgg

SEQ ID NO: 3396446 - RNA, 14 nt, Pseudomonas aeruginosa PA01
gccgcaccgccucg

SEQ ID NO: 3396447 - RNA, 19 nt, Pseudomonas aeruginosa PA01
gccgcaccggcgauggccg

SEQ ID NO: 3396448 - RNA, 12 nt, Pseudomonas aeruginosa PA01
gccgcacuucca

SEQ ID NO: 3396449 - RNA, 16 nt, Pseudomonas aeruginosa PA01
gccgcagacaucgccg

SEQ ID NO: 3396450 - RNA, 20 nt, Pseudomonas aeruginosa PA01
gccgcagacaucgccgaggg

SEQ ID NO: 3396451 - RNA, 21 nt, Pseudomonas aeruginosa PA01
gccgcagacaucgccgagggc

SEQ ID NO: 3396452 - RNA, 13 nt, Pseudomonas aeruginosa PA01
gccgcagaccagc

SEQ ID NO: 3396453 - RNA, 17 nt, Pseudomonas aeruginosa PA01
gccgcagaccagcgaac

SEQ ID NO: 3396454 - RNA, 23 nt, Pseudomonas aeruginosa PA01
gccgcagacguggcauucgucgc

SEQ ID NO: 3396455 - RNA, 14 nt, Pseudomonas aeruginosa PA01
gccgcagagcauca

SEQ ID NO: 3396456 - RNA, 17 nt, Pseudomonas aeruginosa PA01
gccgcagagccagccgc

SEQ ID NO: 3396457 - RNA, 19 nt, Pseudomonas aeruginosa PA01
gccgcagagccagccgcag

SEQ ID NO: 3396458 - RNA, 20 nt, Pseudomonas aeruginosa PA01
gccgcagagccagccgcagc

SEQ ID NO: 3396459 - RNA, 16 nt, Pseudomonas aeruginosa PA01
gccgcagaucaucgca

SEQ ID NO: 3396460 - RNA, 20 nt, Pseudomonas aeruginosa PA01
gccgcagcaagucgaacagg

SEQ ID NO: 3396461 - RNA, 20 nt, Pseudomonas aeruginosa PA01
gccgccaggcagaccaggcc

SEQ ID NO: 3396462 - RNA, 22 nt, Pseudomonas aeruginosa PA01
gccgccaggcagaccaggccga

SEQ ID NO: 3396463 - RNA, 16 nt, Pseudomonas aeruginosa PA01
gccgccaggcagaccu

SEQ ID NO: 3396464 - RNA, 23 nt, Pseudomonas aeruginosa PA01
gccgccaggcagaccugcagcag

SEQ ID NO: 3396465 - RNA, 16 nt, Pseudomonas aeruginosa PA01
gccgccaggcaggccg

SEQ ID NO: 3396466 - RNA, 17 nt, Pseudomonas aeruginosa PA01
gccgccaggcaggccgg

SEQ ID NO: 3396467 - RNA, 22 nt, Pseudomonas aeruginosa PA01
gccgccaggcaggccgggcugg

SEQ ID NO: 3396468 - RNA, 23 nt, Pseudomonas aeruginosa PA01
gccgccaggcaggccgggcuggc

SEQ ID NO: 3396469 - RNA, 22 nt, Pseudomonas aeruginosa PA01
gccgccaggcccugggcggcgg

SEQ ID NO: 3396470 - RNA, 23 nt, Pseudomonas aeruginosa PA01
gccgccaggccucggcgcgggcc

SEQ ID NO: 3396471 - RNA, 13 nt, Pseudomonas aeruginosa PA01
gccgccaggcgcg

SEQ ID NO: 3396472 - RNA, 13 nt, Pseudomonas aeruginosa PA01
gccgccaggcgcu

SEQ ID NO: 3396473 - RNA, 14 nt, Pseudomonas aeruginosa PA01
gccgccaggcgcug

SEQ ID NO: 3396474 - RNA, 17 nt, Pseudomonas aeruginosa PA01
gccgccaggcgcuggcg

SEQ ID NO: 3396475 - RNA, 23 nt, Pseudomonas aeruginosa PA01
gccgccaggcggcaagggcgucu

SEQ ID NO: 3396476 - RNA, 14 nt, Pseudomonas aeruginosa PA01
gccgccagggcguc

SEQ ID NO: 3396477 - RNA, 17 nt, Pseudomonas aeruginosa PA01
gccgccagggcgucgga

SEQ ID NO: 3396478 - RNA, 15 nt, Pseudomonas aeruginosa PA01
gccgccagggucagc

SEQ ID NO: 3396479 - RNA, 18 nt, Pseudomonas aeruginosa PA01
gccgccagggucagcucg

SEQ ID NO: 3396480 - RNA, 20 nt, Pseudomonas aeruginosa PA01
gccgccagggucagcucgac

SEQ ID NO: 3396481 - RNA, 15 nt, Pseudomonas aeruginosa PA01
gccgccagguccgcc

SEQ ID NO: 3396482 - RNA, 13 nt, Pseudomonas aeruginosa PA01
gccgccaguucgc

SEQ ID NO: 3396483 - RNA, 22 nt, Pseudomonas aeruginosa PA01
gccgccaguucgcgcaggugcu

SEQ ID NO: 3396484 - RNA, 17 nt, Pseudomonas aeruginosa PA01
gccgccaguucggccau

SEQ ID NO: 3396485 - RNA, 21 nt, Pseudomonas aeruginosa PA01
gccgccaguucggccaucagc

SEQ ID NO: 3396486 - RNA, 23 nt, Pseudomonas aeruginosa PA01
gccgccaguugcuugaucgccag

SEQ ID NO: 3396487 - RNA, 21 nt, Pseudomonas aeruginosa PA01
gccgccauagagugcccaggc

SEQ ID NO: 3396488 - RNA, 23 nt, Pseudomonas aeruginosa PA01
gccgccaucaccagcggcgagca

SEQ ID NO: 3396489 - RNA, 18 nt, Pseudomonas aeruginosa PA01
gccgccaucgaccaggaa

SEQ ID NO: 3396490 - RNA, 20 nt, Pseudomonas aeruginosa PA01
gccgccaucgacguagagga

SEQ ID NO: 3396491 - RNA, 13 nt, Pseudomonas aeruginosa PA01
gccgccaucgccc

SEQ ID NO: 3396492 - RNA, 15 nt, Pseudomonas aeruginosa PA01
gccgccaucgccucg

SEQ ID NO: 3396493 - RNA, 18 nt, Pseudomonas aeruginosa PA01
gccgccaucgccucgccg

SEQ ID NO: 3396494 - RNA, 16 nt, Pseudomonas aeruginosa PA01
gccgccaugcucggcc

SEQ ID NO: 3396495 - RNA, 18 nt, Pseudomonas aeruginosa PA01
gccgccaugcucggccag

SEQ ID NO: 3396496 - RNA, 19 nt, Pseudomonas aeruginosa PA01
gccgccaugcucggccagc

SEQ ID NO: 3396497 - RNA, 12 nt, Pseudomonas aeruginosa PA01
gccgcccagcac

SEQ ID NO: 3396498 - RNA, 15 nt, Pseudomonas aeruginosa PA01
gccgcccagcagcac

SEQ ID NO: 3396499 - RNA, 15 nt, Pseudomonas aeruginosa PA01
gccgcccagcgcagc

SEQ ID NO: 3396500 - RNA, 17 nt, Pseudomonas aeruginosa PA01
gccgcccagcgcagccu

SEQ ID NO: 3396501 - RNA, 19 nt, Pseudomonas aeruginosa PA01
gccgcccagcgcagccugc

SEQ ID NO: 3396502 - RNA, 21 nt, Pseudomonas aeruginosa PA01
gccgcccagcgcagccugcug

SEQ ID NO: 3396503 - RNA, 13 nt, Pseudomonas aeruginosa PA01
gccgcccagcgga

SEQ ID NO: 3396504 - RNA, 19 nt, Pseudomonas aeruginosa PA01
gccgcccagcggaugcgcg

SEQ ID NO: 3396505 - RNA, 18 nt, Pseudomonas aeruginosa PA01
gccgcccagguugaugcc

SEQ ID NO: 3396506 - RNA, 19 nt, Pseudomonas aeruginosa PA01
gccgcccagguugaugccg

SEQ ID NO: 3396507 - RNA, 15 nt, Pseudomonas aeruginosa PA01
gccgccccaccacca

SEQ ID NO: 3396508 - RNA, 20 nt, Pseudomonas aeruginosa PA01
gccgccccacgggucgucgc

SEQ ID NO: 3396509 - RNA, 23 nt, Pseudomonas aeruginosa PA01
gccgccccacgggucgucgcccu

SEQ ID NO: 3396510 - RNA, 11 nt, Pseudomonas aeruginosa PA01
gccgccccagc

SEQ ID NO: 3396511 - RNA, 14 nt, Pseudomonas aeruginosa PA01
gccgccccagcaac

SEQ ID NO: 3396512 - RNA, 18 nt, Pseudomonas aeruginosa PA01
gccgccccagccucggca

SEQ ID NO: 3396513 - RNA, 18 nt, Pseudomonas aeruginosa PA01
gccgcccccagcgcgccg

SEQ ID NO: 3396514 - RNA, 19 nt, Pseudomonas aeruginosa PA01
gccgcccccagcgcgccgc

SEQ ID NO: 3396515 - RNA, 18 nt, Pseudomonas aeruginosa PA01
gccgcccccggcccgggc

SEQ ID NO: 3396516 - RNA, 15 nt, Pseudomonas aeruginosa PA01
gccgccccguuggcg

SEQ ID NO: 3396517 - RNA, 17 nt, Pseudomonas aeruginosa PA01
gccgcccgagccgcugc

SEQ ID NO: 3396518 - RNA, 18 nt, Pseudomonas aeruginosa PA01
gccgcccgagccgcugca

SEQ ID NO: 3396519 - RNA, 16 nt, Pseudomonas aeruginosa PA01
gccgcccgaggcgacc

SEQ ID NO: 3396520 - RNA, 17 nt, Pseudomonas aeruginosa PA01
gccgcccgaggcgaccu

SEQ ID NO: 3396521 - RNA, 13 nt, Pseudomonas aeruginosa PA01
gccgcccgcgccu

SEQ ID NO: 3396522 - RNA, 19 nt, Pseudomonas aeruginosa PA01
gccgcccgcgccuccaggc

SEQ ID NO: 3396523 - RNA, 22 nt, Pseudomonas aeruginosa PA01
gccgcccgcgccuccaggcgcg

SEQ ID NO: 3396524 - RNA, 19 nt, Pseudomonas aeruginosa PA01
gccgcccgcggaccgggcg

SEQ ID NO: 3396525 - RNA, 12 nt, Pseudomonas aeruginosa PA01
gccgcccgcuca

SEQ ID NO: 3396526 - RNA, 11 nt, Pseudomonas aeruginosa PA01
gccgcccggca

SEQ ID NO: 3396527 - RNA, 13 nt, Pseudomonas aeruginosa PA01
gccgcccggcagc

SEQ ID NO: 3396528 - RNA, 16 nt, Pseudomonas aeruginosa PA01
gccgcccggcagcggc

SEQ ID NO: 3396529 - RNA, 17 nt, Pseudomonas aeruginosa PA01
gccgcccggcagcggcu

SEQ ID NO: 3396530 - RNA, 22 nt, Pseudomonas aeruginosa PA01
gccgcccggcagcggcuggccg

SEQ ID NO: 3396531 - RNA, 24 nt, Pseudomonas aeruginosa PA01
gccgcccggcagcggcuggccguc

SEQ ID NO: 3396532 - RNA, 12 nt, Pseudomonas aeruginosa PA01
gccgcccggcca

SEQ ID NO: 3396533 - RNA, 15 nt, Pseudomonas aeruginosa PA01
gccgcccggccaggc

SEQ ID NO: 3396534 - RNA, 17 nt, Pseudomonas aeruginosa PA01
gccgcccggccaggcca

SEQ ID NO: 3396535 - RNA, 20 nt, Pseudomonas aeruginosa PA01
gccgcccggccaggccacgg

SEQ ID NO: 3396536 - RNA, 14 nt, Pseudomonas aeruginosa PA01
gccgcccggccgcu

SEQ ID NO: 3396537 - RNA, 17 nt, Pseudomonas aeruginosa PA01
gccgcccggccgcugga

SEQ ID NO: 3396538 - RNA, 20 nt, Pseudomonas aeruginosa PA01
gccgcccggccgcuggaugc

SEQ ID NO: 3396539 - RNA, 20 nt, Pseudomonas aeruginosa PA01
gccgcccggcucgccgccgg

SEQ ID NO: 3396540 - RNA, 14 nt, Pseudomonas aeruginosa PA01
gccgcccggucuag

SEQ ID NO: 3396541 - RNA, 20 nt, Pseudomonas aeruginosa PA01
gccgcccggucuagcgcccc

SEQ ID NO: 3396542 - RNA, 17 nt, Pseudomonas aeruginosa PA01
gccgcccgguucguaga

SEQ ID NO: 3396543 - RNA, 18 nt, Pseudomonas aeruginosa PA01
gccgcccgucgcgccggc

SEQ ID NO: 3396544 - RNA, 20 nt, Pseudomonas aeruginosa PA01
gccgcccgucgcgccggcca

SEQ ID NO: 3396545 - RNA, 21 nt, Pseudomonas aeruginosa PA01
gccgcccgucgcgccggccau

SEQ ID NO: 3396546 - RNA, 16 nt, Pseudomonas aeruginosa PA01
gccgcccuccaucagc

SEQ ID NO: 3396547 - RNA, 16 nt, Pseudomonas aeruginosa PA01
gccgcccucgggccgc

SEQ ID NO: 3396548 - RNA, 17 nt, Pseudomonas aeruginosa PA01
gccgcccucgggccgca

SEQ ID NO: 3396549 - RNA, 19 nt, Pseudomonas aeruginosa PA01
gccgcccucgggccgcagg

SEQ ID NO: 3396550 - RNA, 15 nt, Pseudomonas aeruginosa PA01
gccgcccucggggcc

SEQ ID NO: 3396551 - RNA, 16 nt, Pseudomonas aeruginosa PA01
gccgcccucggggccg

SEQ ID NO: 3396552 - RNA, 24 nt, Pseudomonas aeruginosa PA01
gccgcccugcucuugccgacaagc

SEQ ID NO: 3396553 - RNA, 11 nt, Pseudomonas aeruginosa PA01
gccgcccugga

SEQ ID NO: 3396554 - RNA, 13 nt, Pseudomonas aeruginosa PA01
gccgcccuggccg

SEQ ID NO: 3396555 - RNA, 14 nt, Pseudomonas aeruginosa PA01
gccgcccuggccga

SEQ ID NO: 3396556 - RNA, 16 nt, Pseudomonas aeruginosa PA01
gccgcccuggccgagc

SEQ ID NO: 3396557 - RNA, 14 nt, Pseudomonas aeruginosa PA01
gccgcccuggccgc

SEQ ID NO: 3396558 - RNA, 15 nt, Pseudomonas aeruginosa PA01
gccgcccuggccgcc

SEQ ID NO: 3396559 - RNA, 11 nt, Pseudomonas aeruginosa PA01
gccgcccuggg

SEQ ID NO: 3396560 - RNA, 23 nt, Pseudomonas aeruginosa PA01
gccgcccuguucgucuggcgccu

SEQ ID NO: 3396561 - RNA, 12 nt, Pseudomonas aeruginosa PA01
gccgcccuugcg

SEQ ID NO: 3396562 - RNA, 20 nt, Pseudomonas aeruginosa PA01
gccgcccuugcggcccgccu

SEQ ID NO: 3396563 - RNA, 23 nt, Pseudomonas aeruginosa PA01
gccgcccuugcggcccgccucgg

SEQ ID NO: 3396564 - RNA, 20 nt, Pseudomonas aeruginosa PA01
gccgccggcgaacagccagc

SEQ ID NO: 3396565 - RNA, 17 nt, Pseudomonas aeruginosa PA01
gccgccggcgaccgcgc

SEQ ID NO: 3396566 - RNA, 13 nt, Pseudomonas aeruginosa PA01
gccgccggcgacg

SEQ ID NO: 3396567 - RNA, 18 nt, Pseudomonas aeruginosa PA01
gccgccggcgaggaucgc

SEQ ID NO: 3396568 - RNA, 13 nt, Pseudomonas aeruginosa PA01
gccgccggcgccc

SEQ ID NO: 3396569 - RNA, 16 nt, Pseudomonas aeruginosa PA01
gccgccggcgcccugc

SEQ ID NO: 3396570 - RNA, 21 nt, Pseudomonas aeruginosa PA01
gccgccggcgcccugcucugg

SEQ ID NO: 3396571 - RNA, 13 nt, Pseudomonas aeruginosa PA01
gccgccggcgccg

SEQ ID NO: 3396572 - RNA, 16 nt, Pseudomonas aeruginosa PA01
gccgccggcggccagg

SEQ ID NO: 3396573 - RNA, 20 nt, Pseudomonas aeruginosa PA01
gccgccggcguuauccgccg

SEQ ID NO: 3396574 - RNA, 17 nt, Pseudomonas aeruginosa PA01
gccgccggcuccuugcg

SEQ ID NO: 3396575 - RNA, 20 nt, Pseudomonas aeruginosa PA01
gccgccgggaaucuggccga

SEQ ID NO: 3396576 - RNA, 14 nt, Pseudomonas aeruginosa PA01
gccgccgggcgcgc

SEQ ID NO: 3396577 - RNA, 15 nt, Pseudomonas aeruginosa PA01
gccgccgggcgcgcg

SEQ ID NO: 3396578 - RNA, 17 nt, Pseudomonas aeruginosa PA01
gccgccgggcgcgcgcc

SEQ ID NO: 3396579 - RNA, 14 nt, Pseudomonas aeruginosa PA01
gccgccgggcggcg

SEQ ID NO: 3396580 - RNA, 20 nt, Pseudomonas aeruginosa PA01
gccgccgggcggcgucgcgg

SEQ ID NO: 3396581 - RNA, 20 nt, Pseudomonas aeruginosa PA01
gccgccgggcuucgguguau

SEQ ID NO: 3396582 - RNA, 18 nt, Pseudomonas aeruginosa PA01
gccgccggggaagcugcc

SEQ ID NO: 3396583 - RNA, 20 nt, Pseudomonas aeruginosa PA01
gccgccggggaucagcgaga

SEQ ID NO: 3396584 - RNA, 16 nt, Pseudomonas aeruginosa PA01
gccgccggggcgcagg

SEQ ID NO: 3396585 - RNA, 19 nt, Pseudomonas aeruginosa PA01
gccgccggggcgcaggucg

SEQ ID NO: 3396586 - RNA, 21 nt, Pseudomonas aeruginosa PA01
gccgccggggcgcaggucgcu

SEQ ID NO: 3396587 - RNA, 16 nt, Pseudomonas aeruginosa PA01
gccgccggggcgggcc

SEQ ID NO: 3396588 - RNA, 18 nt, Pseudomonas aeruginosa PA01
gccgccggggcgggccgc

SEQ ID NO: 3396589 - RNA, 17 nt, Pseudomonas aeruginosa PA01
gccgccggucuucacgc

SEQ ID NO: 3396590 - RNA, 15 nt, Pseudomonas aeruginosa PA01
gccgccggugaacag

SEQ ID NO: 3396591 - RNA, 16 nt, Pseudomonas aeruginosa PA01
gccgccggugaacagg

SEQ ID NO: 3396592 - RNA, 13 nt, Pseudomonas aeruginosa PA01
gccgccggugcac

SEQ ID NO: 3396593 - RNA, 21 nt, Pseudomonas aeruginosa PA01
gccgccggugcaccaggcgau

SEQ ID NO: 3396594 - RNA, 17 nt, Pseudomonas aeruginosa PA01
gccgccgguucgcaggc

SEQ ID NO: 3396595 - RNA, 22 nt, Pseudomonas aeruginosa PA01
gccgccgguucgcaggccaggc

SEQ ID NO: 3396596 - RNA, 22 nt, Pseudomonas aeruginosa PA01
gccgccguagaguucggcugcg

SEQ ID NO: 3396597 - RNA, 14 nt, Pseudomonas aeruginosa PA01
gccgccgucgacac

SEQ ID NO: 3396598 - RNA, 19 nt, Pseudomonas aeruginosa PA01
gccgccgucgcggccaucg

SEQ ID NO: 3396599 - RNA, 14 nt, Pseudomonas aeruginosa PA01
gccgccgucggacu

SEQ ID NO: 3396600 - RNA, 23 nt, Pseudomonas aeruginosa PA01
gccgccgucggacucgacgucau

SEQ ID NO: 3396601 - RNA, 18 nt, Pseudomonas aeruginosa PA01
gccgccgucuccgccgcu

SEQ ID NO: 3396602 - RNA, 20 nt, Pseudomonas aeruginosa PA01
gccgccgugaucucgaacuc

SEQ ID NO: 3396603 - RNA, 22 nt, Pseudomonas aeruginosa PA01
gccgccguggcugugcuggcca

SEQ ID NO: 3396604 - RNA, 22 nt, Pseudomonas aeruginosa PA01
gccgccguguaaugacuccggu

SEQ ID NO: 3396605 - RNA, 17 nt, Pseudomonas aeruginosa PA01
gccgccguugacgauca

SEQ ID NO: 3396606 - RNA, 14 nt, Pseudomonas aeruginosa PA01
gccgccguugagga

SEQ ID NO: 3396607 - RNA, 15 nt, Pseudomonas aeruginosa PA01
gccgccguuguagcg

SEQ ID NO: 3396608 - RNA, 20 nt, Pseudomonas aeruginosa PA01
gccgccuauccacgacgucg

SEQ ID NO: 3396609 - RNA, 21 nt, Pseudomonas aeruginosa PA01
gccgccuauccacgacgucgg

SEQ ID NO: 3396610 - RNA, 22 nt, Pseudomonas aeruginosa PA01
gccgccuauccacgacgucggc

SEQ ID NO: 3396611 - RNA, 20 nt, Pseudomonas aeruginosa PA01
gccgccuauccgugacgucg

SEQ ID NO: 3396612 - RNA, 21 nt, Pseudomonas aeruginosa PA01
gccgccuauccgugacgucgg

SEQ ID NO: 3396613 - RNA, 17 nt, Pseudomonas aeruginosa PA01
gccgccuauggcggaua

SEQ ID NO: 3396614 - RNA, 14 nt, Pseudomonas aeruginosa PA01
gccgccucgaaggc

SEQ ID NO: 3396615 - RNA, 19 nt, Pseudomonas aeruginosa PA01
gccgccucgaaggccggca

SEQ ID NO: 3396616 - RNA, 14 nt, Pseudomonas aeruginosa PA01
gccgccucgauggc

SEQ ID NO: 3396617 - RNA, 17 nt, Pseudomonas aeruginosa PA01
gccgccucgauggcggc

SEQ ID NO: 3396618 - RNA, 18 nt, Pseudomonas aeruginosa PA01
gccgccucgauggcggca

SEQ ID NO: 3396619 - RNA, 21 nt, Pseudomonas aeruginosa PA01
gccgccucgcgccgcgccagc

SEQ ID NO: 3396620 - RNA, 15 nt, Pseudomonas aeruginosa PA01
gccgccucgcugggc

SEQ ID NO: 3396621 - RNA, 13 nt, Pseudomonas aeruginosa PA01
gccgccucggcgu

SEQ ID NO: 3396622 - RNA, 19 nt, Pseudomonas aeruginosa PA01
gccgccucgggcagccccu

SEQ ID NO: 3396623 - RNA, 21 nt, Pseudomonas aeruginosa PA01
gccgccucgggcagccccuug

SEQ ID NO: 3396624 - RNA, 23 nt, Pseudomonas aeruginosa PA01
gccgccucuaugaaccggggcgg

SEQ ID NO: 3396625 - RNA, 13 nt, Pseudomonas aeruginosa PA01
gccgccugcaggg

SEQ ID NO: 3396626 - RNA, 21 nt, Pseudomonas aeruginosa PA01
gccgccugccuuccuugacca

SEQ ID NO: 3396627 - RNA, 12 nt, Pseudomonas aeruginosa PA01
gccgccugcgcc

SEQ ID NO: 3396628 - RNA, 20 nt, Pseudomonas aeruginosa PA01
gccgccugcggcuugcccug

SEQ ID NO: 3396629 - RNA, 16 nt, Pseudomonas aeruginosa PA01
gccgccugcucggccu

SEQ ID NO: 3396630 - RNA, 18 nt, Pseudomonas aeruginosa PA01
gccgccugcucggccugc

SEQ ID NO: 3396631 - RNA, 20 nt, Pseudomonas aeruginosa PA01
gccgccuggccggccagcca

SEQ ID NO: 3396632 - RNA, 23 nt, Pseudomonas aeruginosa PA01
gccgccuggccggccagccaggc

SEQ ID NO: 3396633 - RNA, 15 nt, Pseudomonas aeruginosa PA01
gccgccuggccggug

SEQ ID NO: 3396634 - RNA, 17 nt, Pseudomonas aeruginosa PA01
gccgccuggccggugac

SEQ ID NO: 3396635 - RNA, 11 nt, Pseudomonas aeruginosa PA01
gccgccuggcg

SEQ ID NO: 3396636 - RNA, 12 nt, Pseudomonas aeruginosa PA01
gccgccuggcgc

SEQ ID NO: 3396637 - RNA, 16 nt, Pseudomonas aeruginosa PA01
gccgccuggcgcaugg

SEQ ID NO: 3396638 - RNA, 22 nt, Pseudomonas aeruginosa PA01
gccgccuggcgcauggcgcucu

SEQ ID NO: 3396639 - RNA, 21 nt, Pseudomonas aeruginosa PA01
gccgccuggcgugccgccagg

SEQ ID NO: 3396640 - RNA, 22 nt, Pseudomonas aeruginosa PA01
gccgccuggcgugccgccaggc

SEQ ID NO: 3396641 - RNA, 15 nt, Pseudomonas aeruginosa PA01
gccgccuggguggcg

SEQ ID NO: 3396642 - RNA, 19 nt, Pseudomonas aeruginosa PA01
gccgccuggguggcgacga

SEQ ID NO: 3396643 - RNA, 18 nt, Pseudomonas aeruginosa PA01
gccgccuggucggggccg

SEQ ID NO: 3396644 - RNA, 21 nt, Pseudomonas aeruginosa PA01
gccgccuggucggggccggcg

SEQ ID NO: 3396645 - RNA, 18 nt, Pseudomonas aeruginosa PA01
gccgccuggugcccgaug

SEQ ID NO: 3396646 - RNA, 15 nt, Pseudomonas aeruginosa PA01
gccgccuuccucggc

SEQ ID NO: 3396647 - RNA, 20 nt, Pseudomonas aeruginosa PA01
gccgccuuccucggccgcca

SEQ ID NO: 3396648 - RNA, 23 nt, Pseudomonas aeruginosa PA01
gccgccuuccucggccgccaggc

SEQ ID NO: 3396649 - RNA, 16 nt, Pseudomonas aeruginosa PA01
gccgccuucgcgggcc

SEQ ID NO: 3396650 - RNA, 19 nt, Pseudomonas aeruginosa PA01
gccgccuucgcgggccagg

SEQ ID NO: 3396651 - RNA, 20 nt, Pseudomonas aeruginosa PA01
gccgccuucgcgggccaggc

SEQ ID NO: 3396652 - RNA, 21 nt, Pseudomonas aeruginosa PA01
gccgccuucgcgggccaggcc

SEQ ID NO: 3396653 - RNA, 17 nt, Pseudomonas aeruginosa PA01
gccgccuugaccugcug

SEQ ID NO: 3396654 - RNA, 21 nt, Pseudomonas aeruginosa PA01
gccgccuugaccugcugggcc

SEQ ID NO: 3396655 - RNA, 22 nt, Pseudomonas aeruginosa PA01
gccgccuugaccugcugggcca

SEQ ID NO: 3396656 - RNA, 23 nt, Pseudomonas aeruginosa PA01
gccgccuugaccugcugggccag

SEQ ID NO: 3396657 - RNA, 16 nt, Pseudomonas aeruginosa PA01
gccgccuugagcggcg

SEQ ID NO: 3396658 - RNA, 23 nt, Pseudomonas aeruginosa PA01
gccgccuugagcggcgcccuggc

SEQ ID NO: 3396659 - RNA, 21 nt, Pseudomonas aeruginosa PA01
gccgccuugcguaccagcgcg

SEQ ID NO: 3396660 - RNA, 17 nt, Pseudomonas aeruginosa PA01
gccgccuugcucgaccc

SEQ ID NO: 3396661 - RNA, 17 nt, Pseudomonas aeruginosa PA01
gccgccuuguuccaggc

SEQ ID NO: 3396662 - RNA, 19 nt, Pseudomonas aeruginosa PA01
gccgccuuguuccaggcgu

SEQ ID NO: 3396663 - RNA, 17 nt, Pseudomonas aeruginosa PA01
gccgccuuucugcccgg

SEQ ID NO: 3396664 - RNA, 19 nt, Pseudomonas aeruginosa PA01
gccgccuuucugcccggcu

SEQ ID NO: 3396665 - RNA, 15 nt, Pseudomonas aeruginosa PA01
gccgcgaaccggguc

SEQ ID NO: 3396666 - RNA, 17 nt, Pseudomonas aeruginosa PA01
gccgcgccgagccggcu

SEQ ID NO: 3396667 - RNA, 16 nt, Pseudomonas aeruginosa PA01
gccgcgccgcaagggc

SEQ ID NO: 3396668 - RNA, 22 nt, Pseudomonas aeruginosa PA01
gccgcgccgcaagggcgucgcu

SEQ ID NO: 3396669 - RNA, 12 nt, Pseudomonas aeruginosa PA01
gccgcgccgccc

SEQ ID NO: 3396670 - RNA, 21 nt, Pseudomonas aeruginosa PA01
gccgcgccgcccuggccgccc

SEQ ID NO: 3396671 - RNA, 13 nt, Pseudomonas aeruginosa PA01
gccgcgccgccga

SEQ ID NO: 3396672 - RNA, 14 nt, Pseudomonas aeruginosa PA01
gccgcgccgccgag

SEQ ID NO: 3396673 - RNA, 15 nt, Pseudomonas aeruginosa PA01
gccgcgccgccgagg

SEQ ID NO: 3396674 - RNA, 17 nt, Pseudomonas aeruginosa PA01
gccgcgccgccgagggc

SEQ ID NO: 3396675 - RNA, 16 nt, Pseudomonas aeruginosa PA01
gccgcgccgcucaggc

SEQ ID NO: 3396676 - RNA, 22 nt, Pseudomonas aeruginosa PA01
gccgcgccgcucaggcgucccg

SEQ ID NO: 3396677 - RNA, 14 nt, Pseudomonas aeruginosa PA01
gccgcgccggccgu

SEQ ID NO: 3396678 - RNA, 12 nt, Pseudomonas aeruginosa PA01
gccgcgccggcg

SEQ ID NO: 3396679 - RNA, 17 nt, Pseudomonas aeruginosa PA01
gccgcgccggcgaucgc

SEQ ID NO: 3396680 - RNA, 12 nt, Pseudomonas aeruginosa PA01
gccgcgccggcu

SEQ ID NO: 3396681 - RNA, 16 nt, Pseudomonas aeruginosa PA01
gccgcgccggcucccu

SEQ ID NO: 3396682 - RNA, 16 nt, Pseudomonas aeruginosa PA01
gccgcgccggggcagc

SEQ ID NO: 3396683 - RNA, 19 nt, Pseudomonas aeruginosa PA01
gccgcgccggggcagcagg

SEQ ID NO: 3396684 - RNA, 16 nt, Pseudomonas aeruginosa PA01
gccgcgccucgucgcg

SEQ ID NO: 3396685 - RNA, 17 nt, Pseudomonas aeruginosa PA01
gccgcgccucgucgcgc

SEQ ID NO: 3396686 - RNA, 23 nt, Pseudomonas aeruginosa PA01
gccgcgccucgucgcgccaggcg

SEQ ID NO: 3396687 - RNA, 15 nt, Pseudomonas aeruginosa PA01
gccgcgccugcugcg

SEQ ID NO: 3396688 - RNA, 18 nt, Pseudomonas aeruginosa PA01
gccgcgccugcugcgggu

SEQ ID NO: 3396689 - RNA, 20 nt, Pseudomonas aeruginosa PA01
gccgcgccuucagcgccagc

SEQ ID NO: 3396690 - RNA, 14 nt, Pseudomonas aeruginosa PA01
gccgcgccuucgag

SEQ ID NO: 3396691 - RNA, 14 nt, Pseudomonas aeruginosa PA01
gccgcgccuucugc

SEQ ID NO: 3396692 - RNA, 19 nt, Pseudomonas aeruginosa PA01
gccgcgccuucugcaccuu

SEQ ID NO: 3396693 - RNA, 22 nt, Pseudomonas aeruginosa PA01
gccgcgccuuucgcucaggccu

SEQ ID NO: 3396694 - RNA, 16 nt, Pseudomonas aeruginosa PA01
gccgcgcgaccgcggc

SEQ ID NO: 3396695 - RNA, 18 nt, Pseudomonas aeruginosa PA01
gccgcgcgauggccggcg

SEQ ID NO: 3396696 - RNA, 14 nt, Pseudomonas aeruginosa PA01
gccgcgcgccagca

SEQ ID NO: 3396697 - RNA, 12 nt, Pseudomonas aeruginosa PA01
gccgcgcgccgc

SEQ ID NO: 3396698 - RNA, 14 nt, Pseudomonas aeruginosa PA01
gccgcgcgccgcau

SEQ ID NO: 3396699 - RNA, 15 nt, Pseudomonas aeruginosa PA01
gccgcgcgccgcauc

SEQ ID NO: 3396700 - RNA, 18 nt, Pseudomonas aeruginosa PA01
gccgcgcgccgcaucgcu

SEQ ID NO: 3396701 - RNA, 14 nt, Pseudomonas aeruginosa PA01
gccgcgcgccuggc

SEQ ID NO: 3396702 - RNA, 14 nt, Pseudomonas aeruginosa PA01
gccgcgcgcgcggu

SEQ ID NO: 3396703 - RNA, 16 nt, Pseudomonas aeruginosa PA01
gccgcgcgcgcggucg

SEQ ID NO: 3396704 - RNA, 13 nt, Pseudomonas aeruginosa PA01
gccgcgcgcgucg

SEQ ID NO: 3396705 - RNA, 14 nt, Pseudomonas aeruginosa PA01
gccgcgcgcgucga

SEQ ID NO: 3396706 - RNA, 12 nt, Pseudomonas aeruginosa PA01
gccgcgcgcugg

SEQ ID NO: 3396707 - RNA, 21 nt, Pseudomonas aeruginosa PA01
gccgcgcggcauagcgcagcc

SEQ ID NO: 3396708 - RNA, 15 nt, Pseudomonas aeruginosa PA01
gccgcgcggcgcccc

SEQ ID NO: 3396709 - RNA, 20 nt, Pseudomonas aeruginosa PA01
gccgcgcggcuugccggcgc

SEQ ID NO: 3396710 - RNA, 23 nt, Pseudomonas aeruginosa PA01
gccgcgcggcuugccggcgcgcg

SEQ ID NO: 3396711 - RNA, 18 nt, Pseudomonas aeruginosa PA01
gccgcgcggucgagcucg

SEQ ID NO: 3396712 - RNA, 22 nt, Pseudomonas aeruginosa PA01
gccgcgcggucgagcucggcca

SEQ ID NO: 3396713 - RNA, 21 nt, Pseudomonas aeruginosa PA01
gccgcgcguaggcuuggucgg

SEQ ID NO: 3396714 - RNA, 15 nt, Pseudomonas aeruginosa PA01
gccgcgcuccaacag

SEQ ID NO: 3396715 - RNA, 13 nt, Pseudomonas aeruginosa PA01
gccgcgcuccagu

SEQ ID NO: 3396716 - RNA, 17 nt, Pseudomonas aeruginosa PA01
gccgcgcucgacgguca

SEQ ID NO: 3396717 - RNA, 19 nt, Pseudomonas aeruginosa PA01
gccgcgcucgacggucagc

SEQ ID NO: 3396718 - RNA, 14 nt, Pseudomonas aeruginosa PA01
gccgcgcucgcgga

SEQ ID NO: 3396719 - RNA, 16 nt, Pseudomonas aeruginosa PA01
gccgcgcucgcggaac

SEQ ID NO: 3396720 - RNA, 23 nt, Pseudomonas aeruginosa PA01
gccgcgcucggaucaggcgggcu

SEQ ID NO: 3396721 - RNA, 14 nt, Pseudomonas aeruginosa PA01
gccgcgcucggcca

SEQ ID NO: 3396722 - RNA, 12 nt, Pseudomonas aeruginosa PA01
gccgcgcugcaa

SEQ ID NO: 3396723 - RNA, 18 nt, Pseudomonas aeruginosa PA01
gccgcgcugcaagggcac

SEQ ID NO: 3396724 - RNA, 15 nt, Pseudomonas aeruginosa PA01
gccgcgcugcaggcg

SEQ ID NO: 3396725 - RNA, 14 nt, Pseudomonas aeruginosa PA01
gccgcgcugcgcca

SEQ ID NO: 3396726 - RNA, 16 nt, Pseudomonas aeruginosa PA01
gccgcgcugcgccagg

SEQ ID NO: 3396727 - RNA, 17 nt, Pseudomonas aeruginosa PA01
gccgcgcugcgccaggc

SEQ ID NO: 3396728 - RNA, 20 nt, Pseudomonas aeruginosa PA01
gccgcgcugcgccaggccgu

SEQ ID NO: 3396729 - RNA, 16 nt, Pseudomonas aeruginosa PA01
gccgcgcugcugccau

SEQ ID NO: 3396730 - RNA, 13 nt, Pseudomonas aeruginosa PA01
gccgcgcugucgg

SEQ ID NO: 3396731 - RNA, 17 nt, Pseudomonas aeruginosa PA01
gccgcgcugucggccuc

SEQ ID NO: 3396732 - RNA, 19 nt, Pseudomonas aeruginosa PA01
gccgcgcugucggccucga

SEQ ID NO: 3396733 - RNA, 20 nt, Pseudomonas aeruginosa PA01
gccgcgcugucggccucgac

SEQ ID NO: 3396734 - RNA, 18 nt, Pseudomonas aeruginosa PA01
gccgcgcuucaccagagc

SEQ ID NO: 3396735 - RNA, 13 nt, Pseudomonas aeruginosa PA01
gccgcgcuucagg

SEQ ID NO: 3396736 - RNA, 14 nt, Pseudomonas aeruginosa PA01
gccgcgcuucaggc

SEQ ID NO: 3396737 - RNA, 14 nt, Pseudomonas aeruginosa PA01
gccgcgcuugccgu

SEQ ID NO: 3396738 - RNA, 16 nt, Pseudomonas aeruginosa PA01
gccgcgcuugccgucg

SEQ ID NO: 3396739 - RNA, 17 nt, Pseudomonas aeruginosa PA01
gccgcgcuugccgucgc

SEQ ID NO: 3396740 - RNA, 18 nt, Pseudomonas aeruginosa PA01
gccgcgcuugccgucgcg

SEQ ID NO: 3396741 - RNA, 14 nt, Pseudomonas aeruginosa PA01
gccgcgcuuggccu

SEQ ID NO: 3396742 - RNA, 16 nt, Pseudomonas aeruginosa PA01
gccgcggaaggcccgc

SEQ ID NO: 3396743 - RNA, 20 nt, Pseudomonas aeruginosa PA01
gccgcggaaggcccgcgagc

SEQ ID NO: 3396744 - RNA, 19 nt, Pseudomonas aeruginosa PA01
gccgcggaagugcgccggu

SEQ ID NO: 3396745 - RNA, 17 nt, Pseudomonas aeruginosa PA01
gccgcggaauggcgcgc

SEQ ID NO: 3396746 - RNA, 14 nt, Pseudomonas aeruginosa PA01
gccgcggacggcac

SEQ ID NO: 3396747 - RNA, 20 nt, Pseudomonas aeruginosa PA01
gccgcggacggcacggggcg

SEQ ID NO: 3396748 - RNA, 15 nt, Pseudomonas aeruginosa PA01
gccgcggacggccgg

SEQ ID NO: 3396749 - RNA, 12 nt, Pseudomonas aeruginosa PA01
gccgcggagcac

SEQ ID NO: 3396750 - RNA, 14 nt, Pseudomonas aeruginosa PA01
gccgcggagcaccg

SEQ ID NO: 3396751 - RNA, 17 nt, Pseudomonas aeruginosa PA01
gccgcggagcaccgcgc

SEQ ID NO: 3396752 - RNA, 18 nt, Pseudomonas aeruginosa PA01
gccgcggagcaccgcgcc

SEQ ID NO: 3396753 - RNA, 21 nt, Pseudomonas aeruginosa PA01
gccgcggauacggcaggggcu

SEQ ID NO: 3396754 - RNA, 19 nt, Pseudomonas aeruginosa PA01
gccgcggaucaccuggccg

SEQ ID NO: 3396755 - RNA, 22 nt, Pseudomonas aeruginosa PA01
gccgcggaucaccuggccgugc

SEQ ID NO: 3396756 - RNA, 17 nt, Pseudomonas aeruginosa PA01
gccgcggaugacgggcg

SEQ ID NO: 3396757 - RNA, 18 nt, Pseudomonas aeruginosa PA01
gccgcggaugacgggcga

SEQ ID NO: 3396758 - RNA, 19 nt, Pseudomonas aeruginosa PA01
gccgcggaugacgggcgaa

SEQ ID NO: 3396759 - RNA, 18 nt, Pseudomonas aeruginosa PA01
gccgcggcaaugcggcga

SEQ ID NO: 3396760 - RNA, 19 nt, Pseudomonas aeruginosa PA01
gccgcggcaaugcggcgau

SEQ ID NO: 3396761 - RNA, 22 nt, Pseudomonas aeruginosa PA01
gccgcggcaaugcggcgauggc

SEQ ID NO: 3396762 - RNA, 13 nt, Pseudomonas aeruginosa PA01
gccgcggcaccgg

SEQ ID NO: 3396763 - RNA, 22 nt, Pseudomonas aeruginosa PA01
gccgcggcagaucccaucgccc

SEQ ID NO: 3396764 - RNA, 23 nt, Pseudomonas aeruginosa PA01
gccgcggccagcccccucgcccu

SEQ ID NO: 3396765 - RNA, 14 nt, Pseudomonas aeruginosa PA01
gccgcggcccggcg

SEQ ID NO: 3396766 - RNA, 15 nt, Pseudomonas aeruginosa PA01
gccgcggcccggcgc

SEQ ID NO: 3396767 - RNA, 18 nt, Pseudomonas aeruginosa PA01
gccgcggcccggcgcugc

SEQ ID NO: 3396768 - RNA, 14 nt, Pseudomonas aeruginosa PA01
gccgcggcccugcg

SEQ ID NO: 3396769 - RNA, 14 nt, Pseudomonas aeruginosa PA01
gccgcguucgccga

SEQ ID NO: 3396770 - RNA, 15 nt, Pseudomonas aeruginosa PA01
gccgcguucgccgag

SEQ ID NO: 3396771 - RNA, 16 nt, Pseudomonas aeruginosa PA01
gccgcguucgccgagc

SEQ ID NO: 3396772 - RNA, 17 nt, Pseudomonas aeruginosa PA01
gccgcguucgccgagcu

SEQ ID NO: 3396773 - RNA, 18 nt, Pseudomonas aeruginosa PA01
gccgcguucgccgagcug

SEQ ID NO: 3396774 - RNA, 18 nt, Pseudomonas aeruginosa PA01
gccgcguucgccgaggcg

SEQ ID NO: 3396775 - RNA, 23 nt, Pseudomonas aeruginosa PA01
gccgcguucgccgaggcggcgca

SEQ ID NO: 3396776 - RNA, 22 nt, Pseudomonas aeruginosa PA01
gccgcguugcauguccucggcg

SEQ ID NO: 3396777 - RNA, 23 nt, Pseudomonas aeruginosa PA01
gccgcguugcauguccucggcgc

SEQ ID NO: 3396778 - RNA, 15 nt, Pseudomonas aeruginosa PA01
gccgcguugucccug

SEQ ID NO: 3396779 - RNA, 13 nt, Pseudomonas aeruginosa PA01
gccgcuacgcggc

SEQ ID NO: 3396780 - RNA, 17 nt, Pseudomonas aeruginosa PA01
gccgcuagcccugcugc

SEQ ID NO: 3396781 - RNA, 16 nt, Pseudomonas aeruginosa PA01
gccgcuagggcgcccu

SEQ ID NO: 3396782 - RNA, 13 nt, Pseudomonas aeruginosa PA01
gccgcuaucgccg

SEQ ID NO: 3396783 - RNA, 14 nt, Pseudomonas aeruginosa PA01
gccgcuaucgccgc

SEQ ID NO: 3396784 - RNA, 15 nt, Pseudomonas aeruginosa PA01
gccgcuaucgccgcc

SEQ ID NO: 3396785 - RNA, 17 nt, Pseudomonas aeruginosa PA01
gccgcuaucgccgccgc

SEQ ID NO: 3396786 - RNA, 14 nt, Pseudomonas aeruginosa PA01
gccgcuaucgcugg

SEQ ID NO: 3396787 - RNA, 22 nt, Pseudomonas aeruginosa PA01
gccgcuaucgcuggcgcagccg

SEQ ID NO: 3396788 - RNA, 23 nt, Pseudomonas aeruginosa PA01
gccgcuaucgcuggcgcagccgc

SEQ ID NO: 3396789 - RNA, 21 nt, Pseudomonas aeruginosa PA01
gccgcuaugggcaccgcgccg

SEQ ID NO: 3396790 - RNA, 16 nt, Pseudomonas aeruginosa PA01
gccgcucacccugucc

SEQ ID NO: 3396791 - RNA, 18 nt, Pseudomonas aeruginosa PA01
gccgcucaccgccacccc

SEQ ID NO: 3396792 - RNA, 14 nt, Pseudomonas aeruginosa PA01
gccgcucaggcugu

SEQ ID NO: 3396793 - RNA, 13 nt, Pseudomonas aeruginosa PA01
gccgcucauccgc

SEQ ID NO: 3396794 - RNA, 14 nt, Pseudomonas aeruginosa PA01
gccgcucauccgcu

SEQ ID NO: 3396795 - RNA, 15 nt, Pseudomonas aeruginosa PA01
gccgcucaucugcac

SEQ ID NO: 3396796 - RNA, 20 nt, Pseudomonas aeruginosa PA01
gccgcucaucugcaccacgu

SEQ ID NO: 3396797 - RNA, 15 nt, Pseudomonas aeruginosa PA01
gccgcuccacacccg

SEQ ID NO: 3396798 - RNA, 15 nt, Pseudomonas aeruginosa PA01
gccgcuccaggaucg

SEQ ID NO: 3396799 - RNA, 18 nt, Pseudomonas aeruginosa PA01
gccgcuccaggaucgccu

SEQ ID NO: 3396800 - RNA, 19 nt, Pseudomonas aeruginosa PA01
gccgcucccggcuugcuga

SEQ ID NO: 3396801 - RNA, 16 nt, Pseudomonas aeruginosa PA01
gccgcuccgcgccacg

SEQ ID NO: 3396802 - RNA, 18 nt, Pseudomonas aeruginosa PA01
gccgcuccgcgccacgcu

SEQ ID NO: 3396803 - RNA, 19 nt, Pseudomonas aeruginosa PA01
gccgcuccgcgccacgcuc

SEQ ID NO: 3396804 - RNA, 15 nt, Pseudomonas aeruginosa PA01
gccgcuccggcugcg

SEQ ID NO: 3396805 - RNA, 12 nt, Pseudomonas aeruginosa PA01
gccgcuccuccu

SEQ ID NO: 3396806 - RNA, 16 nt, Pseudomonas aeruginosa PA01
gccgcuccuccucgcu

SEQ ID NO: 3396807 - RNA, 21 nt, Pseudomonas aeruginosa PA01
gccgcuccuccucgcucugcg

SEQ ID NO: 3396808 - RNA, 23 nt, Pseudomonas aeruginosa PA01
gccgcuccuccucgcucugcgcc

SEQ ID NO: 3396809 - RNA, 14 nt, Pseudomonas aeruginosa PA01
gccgcuccuggcag

SEQ ID NO: 3396810 - RNA, 15 nt, Pseudomonas aeruginosa PA01
gccgcuccuggcagg

SEQ ID NO: 3396811 - RNA, 13 nt, Pseudomonas aeruginosa PA01
gccgcucgaugcc

SEQ ID NO: 3396812 - RNA, 16 nt, Pseudomonas aeruginosa PA01
gccgcucgaugcccgc

SEQ ID NO: 3396813 - RNA, 18 nt, Pseudomonas aeruginosa PA01
gccgcucgaugcccgcca

SEQ ID NO: 3396814 - RNA, 21 nt, Pseudomonas aeruginosa PA01
gccgcucgaugcccgccagca

SEQ ID NO: 3396815 - RNA, 15 nt, Pseudomonas aeruginosa PA01
gccgcucgcgcggca

SEQ ID NO: 3396816 - RNA, 14 nt, Pseudomonas aeruginosa PA01
gccgcucgcguccg

SEQ ID NO: 3396817 - RNA, 17 nt, Pseudomonas aeruginosa PA01
gccgcucgcguccgcag

SEQ ID NO: 3396818 - RNA, 12 nt, Pseudomonas aeruginosa PA01
gccgcucggcga

SEQ ID NO: 3396819 - RNA, 14 nt, Pseudomonas aeruginosa PA01
gccgcucggcgagc

SEQ ID NO: 3396820 - RNA, 22 nt, Pseudomonas aeruginosa PA01
gccgcucggcgagccgccgggc

SEQ ID NO: 3396821 - RNA, 12 nt, Pseudomonas aeruginosa PA01
gccgcucggcgg

SEQ ID NO: 3396822 - RNA, 13 nt, Pseudomonas aeruginosa PA01
gccgcucggcgua

SEQ ID NO: 3396823 - RNA, 20 nt, Pseudomonas aeruginosa PA01
gccgcucggcguagccggcg

SEQ ID NO: 3396824 - RNA, 21 nt, Pseudomonas aeruginosa PA01
gccgcucggcguagccggcga

SEQ ID NO: 3396825 - RNA, 16 nt, Pseudomonas aeruginosa PA01
gccgcucguccaguuc

SEQ ID NO: 3396826 - RNA, 17 nt, Pseudomonas aeruginosa PA01
gccgcucguccaguucc

SEQ ID NO: 3396827 - RNA, 23 nt, Pseudomonas aeruginosa PA01
gccgcucguccaguuccaggguc

SEQ ID NO: 3396828 - RNA, 17 nt, Pseudomonas aeruginosa PA01
gccgcucguuggcggcc

SEQ ID NO: 3396829 - RNA, 20 nt, Pseudomonas aeruginosa PA01
gccgcucguuggcggccagc

SEQ ID NO: 3396830 - RNA, 21 nt, Pseudomonas aeruginosa PA01
gccgcucguuggcggccagca

SEQ ID NO: 3396831 - RNA, 22 nt, Pseudomonas aeruginosa PA01
gccgcucugccagaaggccugc

SEQ ID NO: 3396832 - RNA, 15 nt, Pseudomonas aeruginosa PA01
gccgcucugcccgac

SEQ ID NO: 3396833 - RNA, 16 nt, Pseudomonas aeruginosa PA01
gccgcucugcccgacc

SEQ ID NO: 3396834 - RNA, 17 nt, Pseudomonas aeruginosa PA01
gccgcucugcccgaccg

SEQ ID NO: 3396835 - RNA, 18 nt, Pseudomonas aeruginosa PA01
gccgcucugcccgaccgg

SEQ ID NO: 3396836 - RNA, 16 nt, Pseudomonas aeruginosa PA01
gccgcucugcuggccg

SEQ ID NO: 3396837 - RNA, 17 nt, Pseudomonas aeruginosa PA01
gccgcucugcuggccgc

SEQ ID NO: 3396838 - RNA, 17 nt, Pseudomonas aeruginosa PA01
gccgcucuggcugcugg

SEQ ID NO: 3396839 - RNA, 21 nt, Pseudomonas aeruginosa PA01
gccgcucuucugguaggccag

SEQ ID NO: 3396840 - RNA, 22 nt, Pseudomonas aeruginosa PA01
gccgcucuucugguaggccagc

SEQ ID NO: 3396841 - RNA, 20 nt, Pseudomonas aeruginosa PA01
gccgcugaaaucggagaagu

SEQ ID NO: 3396842 - RNA, 18 nt, Pseudomonas aeruginosa PA01
gccgcugaaguccuggcc

SEQ ID NO: 3396843 - RNA, 20 nt, Pseudomonas aeruginosa PA01
gccgcugaaguccuggccga

SEQ ID NO: 3396844 - RNA, 20 nt, Pseudomonas aeruginosa PA01
gccgcugaauaccaccgggc

SEQ ID NO: 3396845 - RNA, 21 nt, Pseudomonas aeruginosa PA01
gccgcugaauaccaccgggcc

SEQ ID NO: 3396846 - RNA, 21 nt, Pseudomonas aeruginosa PA01
gccgcugacggucugccagcu

SEQ ID NO: 3396847 - RNA, 16 nt, Pseudomonas aeruginosa PA01
gccgcugagcagcagg

SEQ ID NO: 3396848 - RNA, 14 nt, Pseudomonas aeruginosa PA01
gccgcugaggcucg

SEQ ID NO: 3396849 - RNA, 17 nt, Pseudomonas aeruginosa PA01
gccgcugaggcucgccg

SEQ ID NO: 3396850 - RNA, 20 nt, Pseudomonas aeruginosa PA01
gccgcugaggcucgccgggu

SEQ ID NO: 3396851 - RNA, 16 nt, Pseudomonas aeruginosa PA01
gccgcugaucaguacc

SEQ ID NO: 3396852 - RNA, 14 nt, Pseudomonas aeruginosa PA01
gccgcugcacgccu

SEQ ID NO: 3396853 - RNA, 21 nt, Pseudomonas aeruginosa PA01
gccgcugcacgccuuccgggu

SEQ ID NO: 3396854 - RNA, 12 nt, Pseudomonas aeruginosa PA01
gccgcugcaggc

SEQ ID NO: 3396855 - RNA, 13 nt, Pseudomonas aeruginosa PA01
gccgcugcaggcc

SEQ ID NO: 3396856 - RNA, 14 nt, Pseudomonas aeruginosa PA01
gccgcugcaggcca

SEQ ID NO: 3396857 - RNA, 17 nt, Pseudomonas aeruginosa PA01
gccgcugcaggccaccg

SEQ ID NO: 3396858 - RNA, 20 nt, Pseudomonas aeruginosa PA01
gccgcugcauggggaugguc

SEQ ID NO: 3396859 - RNA, 14 nt, Pseudomonas aeruginosa PA01
gccgcugccgccgc

SEQ ID NO: 3396860 - RNA, 17 nt, Pseudomonas aeruginosa PA01
gccgcugccgccgcgca

SEQ ID NO: 3396861 - RNA, 21 nt, Pseudomonas aeruginosa PA01
gccgcugccgccgcgcaggcg

SEQ ID NO: 3396862 - RNA, 16 nt, Pseudomonas aeruginosa PA01
gccgcugccgcucugg

SEQ ID NO: 3396863 - RNA, 13 nt, Pseudomonas aeruginosa PA01
gccgcugccgggc

SEQ ID NO: 3396864 - RNA, 20 nt, Pseudomonas aeruginosa PA01
gccgcugccguugcaggccc

SEQ ID NO: 3396865 - RNA, 23 nt, Pseudomonas aeruginosa PA01
gccgcugccguugcaggcccagc

SEQ ID NO: 3396866 - RNA, 22 nt, Pseudomonas aeruginosa PA01
gccgcugccugucgcagcgggc

SEQ ID NO: 3396867 - RNA, 12 nt, Pseudomonas aeruginosa PA01
gccgcugcgcag

SEQ ID NO: 3396868 - RNA, 13 nt, Pseudomonas aeruginosa PA01
gccgcugcgcagg

SEQ ID NO: 3396869 - RNA, 17 nt, Pseudomonas aeruginosa PA01
gccgcugcgcaggccga

SEQ ID NO: 3396870 - RNA, 18 nt, Pseudomonas aeruginosa PA01
gccgcugcgcaggccgag

SEQ ID NO: 3396871 - RNA, 19 nt, Pseudomonas aeruginosa PA01
gccgcugcgcaggccgaga

SEQ ID NO: 3396872 - RNA, 23 nt, Pseudomonas aeruginosa PA01
gccggaccucucucgcugcgcgg

SEQ ID NO: 3396873 - RNA, 13 nt, Pseudomonas aeruginosa PA01
gccggacgcacca

SEQ ID NO: 3396874 - RNA, 17 nt, Pseudomonas aeruginosa PA01
gccggacgcaccagcag

SEQ ID NO: 3396875 - RNA, 18 nt, Pseudomonas aeruginosa PA01
gccggacgcaccagcagg

SEQ ID NO: 3396876 - RNA, 19 nt, Pseudomonas aeruginosa PA01
gccggacgcaccagcaggc

SEQ ID NO: 3396877 - RNA, 15 nt, Pseudomonas aeruginosa PA01
gccggacgcgacugc

SEQ ID NO: 3396878 - RNA, 16 nt, Pseudomonas aeruginosa PA01
gccggacgcgacugcu

SEQ ID NO: 3396879 - RNA, 13 nt, Pseudomonas aeruginosa PA01
gccggacggcggc

SEQ ID NO: 3396880 - RNA, 14 nt, Pseudomonas aeruginosa PA01
gccggacggcggcg

SEQ ID NO: 3396881 - RNA, 16 nt, Pseudomonas aeruginosa PA01
gccggacggcggcguc

SEQ ID NO: 3396882 - RNA, 17 nt, Pseudomonas aeruginosa PA01
gccggacguuuccagcg

SEQ ID NO: 3396883 - RNA, 19 nt, Pseudomonas aeruginosa PA01
gccggacguuuccagcggc

SEQ ID NO: 3396884 - RNA, 17 nt, Pseudomonas aeruginosa PA01
gccggacuccgacgcgu

SEQ ID NO: 3396885 - RNA, 17 nt, Pseudomonas aeruginosa PA01
gccggagaacgccgcca

SEQ ID NO: 3396886 - RNA, 23 nt, Pseudomonas aeruginosa PA01
gccggagaacgccgccacgccga

SEQ ID NO: 3396887 - RNA, 24 nt, Pseudomonas aeruginosa PA01
gccggagaacgccgccacgccgau

SEQ ID NO: 3396888 - RNA, 14 nt, Pseudomonas aeruginosa PA01
gccggagagcagca

SEQ ID NO: 3396889 - RNA, 21 nt, Pseudomonas aeruginosa PA01
gccggagagcagcacggccuc

SEQ ID NO: 3396890 - RNA, 22 nt, Pseudomonas aeruginosa PA01
gccggagagcgaauacaccgag

SEQ ID NO: 3396891 - RNA, 18 nt, Pseudomonas aeruginosa PA01
gccggagaugugcgcggu

SEQ ID NO: 3396892 - RNA, 13 nt, Pseudomonas aeruginosa PA01
gccggagcaggcc

SEQ ID NO: 3396893 - RNA, 15 nt, Pseudomonas aeruginosa PA01
gccggagcaggccau

SEQ ID NO: 3396894 - RNA, 18 nt, Pseudomonas aeruginosa PA01
gccggagccaccgggauc

SEQ ID NO: 3396895 - RNA, 14 nt, Pseudomonas aeruginosa PA01
gccggagcugguca

SEQ ID NO: 3396896 - RNA, 15 nt, Pseudomonas aeruginosa PA01
gccggaggcagcgau

SEQ ID NO: 3396897 - RNA, 16 nt, Pseudomonas aeruginosa PA01
gccggaggcagcgaug

SEQ ID NO: 3396898 - RNA, 17 nt, Pseudomonas aeruginosa PA01
gccggaggcagcgaugc

SEQ ID NO: 3396899 - RNA, 19 nt, Pseudomonas aeruginosa PA01
gccggaggggaugugcuca

SEQ ID NO: 3396900 - RNA, 23 nt, Pseudomonas aeruginosa PA01
gccggaggggaugugcucagcga

SEQ ID NO: 3396901 - RNA, 15 nt, Pseudomonas aeruginosa PA01
gccggaggggcggcc

SEQ ID NO: 3396902 - RNA, 17 nt, Pseudomonas aeruginosa PA01
gccggaggggcggccgc

SEQ ID NO: 3396903 - RNA, 19 nt, Pseudomonas aeruginosa PA01
gccggaggggcggccgccg

SEQ ID NO: 3396904 - RNA, 20 nt, Pseudomonas aeruginosa PA01
gccggaggggcggccgccga

SEQ ID NO: 3396905 - RNA, 22 nt, Pseudomonas aeruginosa PA01
gccggaggggcggccgccgagc

SEQ ID NO: 3396906 - RNA, 23 nt, Pseudomonas aeruginosa PA01
gccggaggggcggccgccgagca

SEQ ID NO: 3396907 - RNA, 15 nt, Pseudomonas aeruginosa PA01
gccggagucguagcg

SEQ ID NO: 3396908 - RNA, 22 nt, Pseudomonas aeruginosa PA01
gccggagucguagcgcgcggcg

SEQ ID NO: 3396909 - RNA, 23 nt, Pseudomonas aeruginosa PA01
gccggagucguagcgcgcggcga

SEQ ID NO: 3396910 - RNA, 21 nt, Pseudomonas aeruginosa PA01
gccggauagaucaggccggcg

SEQ ID NO: 3396911 - RNA, 16 nt, Pseudomonas aeruginosa PA01
gccggaucggccuugg

SEQ ID NO: 3396912 - RNA, 17 nt, Pseudomonas aeruginosa PA01
gccggaucggccuuggc

SEQ ID NO: 3396913 - RNA, 19 nt, Pseudomonas aeruginosa PA01
gccggaucggccuuggcga

SEQ ID NO: 3396914 - RNA, 17 nt, Pseudomonas aeruginosa PA01
gccggaucggcugaccg

SEQ ID NO: 3396915 - RNA, 18 nt, Pseudomonas aeruginosa PA01
gccggaucggcugaccgg

SEQ ID NO: 3396916 - RNA, 15 nt, Pseudomonas aeruginosa PA01
gccggaugccaccgc

SEQ ID NO: 3396917 - RNA, 18 nt, Pseudomonas aeruginosa PA01
gccggaugggcgagcugc

SEQ ID NO: 3396918 - RNA, 20 nt, Pseudomonas aeruginosa PA01
gccggauucgcgcagcaggc

SEQ ID NO: 3396919 - RNA, 23 nt, Pseudomonas aeruginosa PA01
gccggauucgcgcagcaggcggc

SEQ ID NO: 3396920 - RNA, 16 nt, Pseudomonas aeruginosa PA01
gccggauuggccgagg

SEQ ID NO: 3396921 - RNA, 17 nt, Pseudomonas aeruginosa PA01
gccggauuggccgaggu

SEQ ID NO: 3396922 - RNA, 18 nt, Pseudomonas aeruginosa PA01
gccggauuggccgaggug

SEQ ID NO: 3396923 - RNA, 15 nt, Pseudomonas aeruginosa PA01
gccggauuucacggc

SEQ ID NO: 3396924 - RNA, 15 nt, Pseudomonas aeruginosa PA01
gccggcaaacgccgc

SEQ ID NO: 3396925 - RNA, 17 nt, Pseudomonas aeruginosa PA01
gccggcaaacgccgcca

SEQ ID NO: 3396926 - RNA, 18 nt, Pseudomonas aeruginosa PA01
gccggcaaacgccgccac

SEQ ID NO: 3396927 - RNA, 23 nt, Pseudomonas aeruginosa PA01
gccggcaaacgccgccaccaacc

SEQ ID NO: 3396928 - RNA, 13 nt, Pseudomonas aeruginosa PA01
gccggcaacagca

SEQ ID NO: 3396929 - RNA, 14 nt, Pseudomonas aeruginosa PA01
gccggcaacagcag

SEQ ID NO: 3396930 - RNA, 15 nt, Pseudomonas aeruginosa PA01
gccggcaacagcagc

SEQ ID NO: 3396931 - RNA, 16 nt, Pseudomonas aeruginosa PA01
gccggcaacagcagca

SEQ ID NO: 3396932 - RNA, 22 nt, Pseudomonas aeruginosa PA01
gccggcaacgaacuucagggcu

SEQ ID NO: 3396933 - RNA, 19 nt, Pseudomonas aeruginosa PA01
gccggcaagcgugccccga

SEQ ID NO: 3396934 - RNA, 14 nt, Pseudomonas aeruginosa PA01
gccggcaccagcag

SEQ ID NO: 3396935 - RNA, 13 nt, Pseudomonas aeruginosa PA01
gccggcacccuga

SEQ ID NO: 3396936 - RNA, 14 nt, Pseudomonas aeruginosa PA01
gccggcacccugac

SEQ ID NO: 3396937 - RNA, 21 nt, Pseudomonas aeruginosa PA01
gccggcacccugaccgcgagc

SEQ ID NO: 3396938 - RNA, 22 nt, Pseudomonas aeruginosa PA01
gccggcacccugaccgcgagcg

SEQ ID NO: 3396939 - RNA, 22 nt, Pseudomonas aeruginosa PA01
gccggcaccgucgagcaccagg

SEQ ID NO: 3396940 - RNA, 12 nt, Pseudomonas aeruginosa PA01
gccggcacggca

SEQ ID NO: 3396941 - RNA, 14 nt, Pseudomonas aeruginosa PA01
gccggcacggcauc

SEQ ID NO: 3396942 - RNA, 21 nt, Pseudomonas aeruginosa PA01
gccggcacuguuccucagccc

SEQ ID NO: 3396943 - RNA, 23 nt, Pseudomonas aeruginosa PA01
gccggcacuguuccucagccccu

SEQ ID NO: 3396944 - RNA, 14 nt, Pseudomonas aeruginosa PA01
gccggcagcagcgc

SEQ ID NO: 3396945 - RNA, 15 nt, Pseudomonas aeruginosa PA01
gccggcagcagcgcc

SEQ ID NO: 3396946 - RNA, 17 nt, Pseudomonas aeruginosa PA01
gccggcagcagcgccag

SEQ ID NO: 3396947 - RNA, 19 nt, Pseudomonas aeruginosa PA01
gccggcagcagcgccagga

SEQ ID NO: 3396948 - RNA, 21 nt, Pseudomonas aeruginosa PA01
gccggcagcagcgccaggaag

SEQ ID NO: 3396949 - RNA, 17 nt, Pseudomonas aeruginosa PA01
gccggcagcgaccacca

SEQ ID NO: 3396950 - RNA, 22 nt, Pseudomonas aeruginosa PA01
gccggcagcgaccaccaccagg

SEQ ID NO: 3396951 - RNA, 14 nt, Pseudomonas aeruginosa PA01
gccggcagcgagcg

SEQ ID NO: 3396952 - RNA, 13 nt, Pseudomonas aeruginosa PA01
gccggcagcgccg

SEQ ID NO: 3396953 - RNA, 16 nt, Pseudomonas aeruginosa PA01
gccggcagcgccgcgc

SEQ ID NO: 3396954 - RNA, 17 nt, Pseudomonas aeruginosa PA01
gccggcagcgccgcgcg

SEQ ID NO: 3396955 - RNA, 13 nt, Pseudomonas aeruginosa PA01
gccggcagcuccg

SEQ ID NO: 3396956 - RNA, 14 nt, Pseudomonas aeruginosa PA01
gccggcagcuccgg

SEQ ID NO: 3396957 - RNA, 16 nt, Pseudomonas aeruginosa PA01
gccggcagcuccggcg

SEQ ID NO: 3396958 - RNA, 21 nt, Pseudomonas aeruginosa PA01
gccggcagcucggccgagggc

SEQ ID NO: 3396959 - RNA, 15 nt, Pseudomonas aeruginosa PA01
gccggcaggaacgcc

SEQ ID NO: 3396960 - RNA, 18 nt, Pseudomonas aeruginosa PA01
gccggcaggaacgcccgc

SEQ ID NO: 3396961 - RNA, 14 nt, Pseudomonas aeruginosa PA01
gccggcaggaggau

SEQ ID NO: 3396962 - RNA, 13 nt, Pseudomonas aeruginosa PA01
gccggcaggccga

SEQ ID NO: 3396963 - RNA, 14 nt, Pseudomonas aeruginosa PA01
gccggcaggccgau

SEQ ID NO: 3396964 - RNA, 15 nt, Pseudomonas aeruginosa PA01
gccggcaggccgaua

SEQ ID NO: 3396965 - RNA, 17 nt, Pseudomonas aeruginosa PA01
gccggcaggccgauggc

SEQ ID NO: 3396966 - RNA, 18 nt, Pseudomonas aeruginosa PA01
gccggcaggccgauggcc

SEQ ID NO: 3396967 - RNA, 21 nt, Pseudomonas aeruginosa PA01
gccggcaggccuucggcgccg

SEQ ID NO: 3396968 - RNA, 17 nt, Pseudomonas aeruginosa PA01
gccggcaggcugugcca

SEQ ID NO: 3396969 - RNA, 18 nt, Pseudomonas aeruginosa PA01
gccggcagguagaccucg

SEQ ID NO: 3396970 - RNA, 22 nt, Pseudomonas aeruginosa PA01
gccggcagguugugguugggca

SEQ ID NO: 3396971 - RNA, 17 nt, Pseudomonas aeruginosa PA01
gccggcagugugccgcc

SEQ ID NO: 3396972 - RNA, 22 nt, Pseudomonas aeruginosa PA01
gccggcauagccgaacuccgcc

SEQ ID NO: 3396973 - RNA, 23 nt, Pseudomonas aeruginosa PA01
gccggcauagccgaacuccgcca

SEQ ID NO: 3396974 - RNA, 15 nt, Pseudomonas aeruginosa PA01
gccggcgaaccaggc

SEQ ID NO: 3396975 - RNA, 18 nt, Pseudomonas aeruginosa PA01
gccggcgaaccaggcggc

SEQ ID NO: 3396976 - RNA, 19 nt, Pseudomonas aeruginosa PA01
gccggcgaaccaggcggcc

SEQ ID NO: 3396977 - RNA, 20 nt, Pseudomonas aeruginosa PA01
gccggcgaaccaggcggccg

SEQ ID NO: 3396978 - RNA, 22 nt, Pseudomonas aeruginosa PA01
gccggcgaacucguagacgaau

SEQ ID NO: 3396979 - RNA, 23 nt, Pseudomonas aeruginosa PA01
gccggcgaacucguuguacucga

SEQ ID NO: 3396980 - RNA, 16 nt, Pseudomonas aeruginosa PA01
gccggcgaagggcagg

SEQ ID NO: 3396981 - RNA, 18 nt, Pseudomonas aeruginosa PA01
gccggcgaagggcaggcc

SEQ ID NO: 3396982 - RNA, 19 nt, Pseudomonas aeruginosa PA01
gccggcgaagggcaggccg

SEQ ID NO: 3396983 - RNA, 23 nt, Pseudomonas aeruginosa PA01
gccggcgaagggcaggccgauca

SEQ ID NO: 3396984 - RNA, 17 nt, Pseudomonas aeruginosa PA01
gccggcgaccagcgucg

SEQ ID NO: 3396985 - RNA, 22 nt, Pseudomonas aeruginosa PA01
gccggcgaccagcgucgcgcgu

SEQ ID NO: 3396986 - RNA, 17 nt, Pseudomonas aeruginosa PA01
gccggcgaccgcgcgca

SEQ ID NO: 3396987 - RNA, 16 nt, Pseudomonas aeruginosa PA01
gccggcgaccuugucc

SEQ ID NO: 3396988 - RNA, 23 nt, Pseudomonas aeruginosa PA01
gccggcgaccuuguccaggcgcu

SEQ ID NO: 3396989 - RNA, 13 nt, Pseudomonas aeruginosa PA01
gccggcgacgacg

SEQ ID NO: 3396990 - RNA, 20 nt, Pseudomonas aeruginosa PA01
gccggcgacgacgaucccgg

SEQ ID NO: 3396991 - RNA, 21 nt, Pseudomonas aeruginosa PA01
gccggcgacgacgaucccggc

SEQ ID NO: 3396992 - RNA, 14 nt, Pseudomonas aeruginosa PA01
gccggcgacgaggu

SEQ ID NO: 3396993 - RNA, 20 nt, Pseudomonas aeruginosa PA01
gccggcgacgcaggacgucg

SEQ ID NO: 3396994 - RNA, 21 nt, Pseudomonas aeruginosa PA01
gccggcgacggucagcaggcc

SEQ ID NO: 3396995 - RNA, 22 nt, Pseudomonas aeruginosa PA01
gccggcgacggucagcaggccc

SEQ ID NO: 3396996 - RNA, 24 nt, Pseudomonas aeruginosa PA01
gccggcgacggucagcaggcccga

SEQ ID NO: 3396997 - RNA, 15 nt, Pseudomonas aeruginosa PA01
gccggcgagccaggu

SEQ ID NO: 3396998 - RNA, 13 nt, Pseudomonas aeruginosa PA01
gccggcgagccgc

SEQ ID NO: 3396999 - RNA, 18 nt, Pseudomonas aeruginosa PA01
gccggcgagccgcuggca

SEQ ID NO: 3397000 - RNA, 17 nt, Pseudomonas aeruginosa PA01
gccggcgagcgccugga

SEQ ID NO: 3397001 - RNA, 16 nt, Pseudomonas aeruginosa PA01
gccggcgagggcggcg

SEQ ID NO: 3397002 - RNA, 17 nt, Pseudomonas aeruginosa PA01
gccggcgagggcggcga

SEQ ID NO: 3397003 - RNA, 22 nt, Pseudomonas aeruginosa PA01
gccggcgagggcggcgaccugg

SEQ ID NO: 3397004 - RNA, 21 nt, Pseudomonas aeruginosa PA01
gccggcgaucagaacgaugcc

SEQ ID NO: 3397005 - RNA, 15 nt, Pseudomonas aeruginosa PA01
gccggcgaucagcgc

SEQ ID NO: 3397006 - RNA, 21 nt, Pseudomonas aeruginosa PA01
gccggcgaucagcgcuuccag

SEQ ID NO: 3397007 - RNA, 19 nt, Pseudomonas aeruginosa PA01
gccggcgaucagcucgcgg

SEQ ID NO: 3397008 - RNA, 21 nt, Pseudomonas aeruginosa PA01
gccggcgaucagcucgcggua

SEQ ID NO: 3397009 - RNA, 15 nt, Pseudomonas aeruginosa PA01
gccggcgaucaucca

SEQ ID NO: 3397010 - RNA, 19 nt, Pseudomonas aeruginosa PA01
gccggcgaucauccagccc

SEQ ID NO: 3397011 - RNA, 13 nt, Pseudomonas aeruginosa PA01
gccggcgauccgc

SEQ ID NO: 3397012 - RNA, 13 nt, Pseudomonas aeruginosa PA01
gccggcgaucgcc

SEQ ID NO: 3397013 - RNA, 18 nt, Pseudomonas aeruginosa PA01
gccggcgaucgccaggcg

SEQ ID NO: 3397014 - RNA, 14 nt, Pseudomonas aeruginosa PA01
gccggcgaucgccg

SEQ ID NO: 3397015 - RNA, 16 nt, Pseudomonas aeruginosa PA01
gccggcgaucgccggc

SEQ ID NO: 3397016 - RNA, 17 nt, Pseudomonas aeruginosa PA01
gccggcgaucgccggcg

SEQ ID NO: 3397017 - RNA, 19 nt, Pseudomonas aeruginosa PA01
gccggcgaugcccaggccg

SEQ ID NO: 3397018 - RNA, 20 nt, Pseudomonas aeruginosa PA01
gccggcgaugcccaggccgc

SEQ ID NO: 3397019 - RNA, 23 nt, Pseudomonas aeruginosa PA01
gccggcgaugcccaggccgccga

SEQ ID NO: 3397020 - RNA, 19 nt, Pseudomonas aeruginosa PA01
gccggcgaugccgcccagc

SEQ ID NO: 3397021 - RNA, 22 nt, Pseudomonas aeruginosa PA01
gccggcgaugccgcccagcacc

SEQ ID NO: 3397022 - RNA, 20 nt, Pseudomonas aeruginosa PA01
gccggcgaugcgcaggccgg

SEQ ID NO: 3397023 - RNA, 13 nt, Pseudomonas aeruginosa PA01
gccggcgaugcgu

SEQ ID NO: 3397024 - RNA, 14 nt, Pseudomonas aeruginosa PA01
gccggcgauggccc

SEQ ID NO: 3397025 - RNA, 20 nt, Pseudomonas aeruginosa PA01
gccggcgauggcccagauga

SEQ ID NO: 3397026 - RNA, 15 nt, Pseudomonas aeruginosa PA01
gccggcgauggccgc

SEQ ID NO: 3397027 - RNA, 17 nt, Pseudomonas aeruginosa PA01
gccggcgauggccgccu

SEQ ID NO: 3397028 - RNA, 18 nt, Pseudomonas aeruginosa PA01
gccggcgauggccgccug

SEQ ID NO: 3397029 - RNA, 19 nt, Pseudomonas aeruginosa PA01
gccggcgauggccgccugc

SEQ ID NO: 3397030 - RNA, 16 nt, Pseudomonas aeruginosa PA01
gccggcgaugugcggc

SEQ ID NO: 3397031 - RNA, 20 nt, Pseudomonas aeruginosa PA01
gccggcgaugugcggcgugg

SEQ ID NO: 3397032 - RNA, 20 nt, Pseudomonas aeruginosa PA01
gccggcgauguucgcccccu

SEQ ID NO: 3397033 - RNA, 21 nt, Pseudomonas aeruginosa PA01
gccggcgauguucgcccccuu

SEQ ID NO: 3397034 - RNA, 18 nt, Pseudomonas aeruginosa PA01
gccggcgcagaucgcggc

SEQ ID NO: 3397035 - RNA, 14 nt, Pseudomonas aeruginosa PA01
gccggcgcaucagc

SEQ ID NO: 3397036 - RNA, 19 nt, Pseudomonas aeruginosa PA01
gccggcgcaucagcgccgg

SEQ ID NO: 3397037 - RNA, 21 nt, Pseudomonas aeruginosa PA01
gccggcgcaucagcgccgguu

SEQ ID NO: 3397038 - RNA, 16 nt, Pseudomonas aeruginosa PA01
gccggcgcaucgucga

SEQ ID NO: 3397039 - RNA, 15 nt, Pseudomonas aeruginosa PA01
gccggcgcaugcgcc

SEQ ID NO: 3397040 - RNA, 18 nt, Pseudomonas aeruginosa PA01
gccggcgcaugcgccggc

SEQ ID NO: 3397041 - RNA, 13 nt, Pseudomonas aeruginosa PA01
gccggcgccagca

SEQ ID NO: 3397042 - RNA, 15 nt, Pseudomonas aeruginosa PA01
gccggcgccagcagg

SEQ ID NO: 3397043 - RNA, 11 nt, Pseudomonas aeruginosa PA01
gccggcgcccu

SEQ ID NO: 3397044 - RNA, 13 nt, Pseudomonas aeruginosa PA01
gccggcgcccugc

SEQ ID NO: 3397045 - RNA, 17 nt, Pseudomonas aeruginosa PA01
gccggcgcccugggcgc

SEQ ID NO: 3397046 - RNA, 14 nt, Pseudomonas aeruginosa PA01
gccggcgcccuucg

SEQ ID NO: 3397047 - RNA, 12 nt, Pseudomonas aeruginosa PA01
gccggcgccgau

SEQ ID NO: 3397048 - RNA, 21 nt, Pseudomonas aeruginosa PA01
gccggcgccgauauugaacga

SEQ ID NO: 3397049 - RNA, 15 nt, Pseudomonas aeruginosa PA01
gccggcgccgaugcg

SEQ ID NO: 3397050 - RNA, 13 nt, Pseudomonas aeruginosa PA01
gccggcgccgauu

SEQ ID NO: 3397051 - RNA, 15 nt, Pseudomonas aeruginosa PA01
gccggcgccgauucc

SEQ ID NO: 3397052 - RNA, 20 nt, Pseudomonas aeruginosa PA01
gccggcgccgauuccugggc

SEQ ID NO: 3397053 - RNA, 13 nt, Pseudomonas aeruginosa PA01
gccggcgccgccg

SEQ ID NO: 3397054 - RNA, 14 nt, Pseudomonas aeruginosa PA01
gccggcgccgccga

SEQ ID NO: 3397055 - RNA, 14 nt, Pseudomonas aeruginosa PA01
gccggcgccgccgg

SEQ ID NO: 3397056 - RNA, 13 nt, Pseudomonas aeruginosa PA01
gccggcgccgccu

SEQ ID NO: 3397057 - RNA, 21 nt, Pseudomonas aeruginosa PA01
gccggcgccgccucgggcagc

SEQ ID NO: 3397058 - RNA, 13 nt, Pseudomonas aeruginosa PA01
gccggcgccgcgg

SEQ ID NO: 3397059 - RNA, 14 nt, Pseudomonas aeruginosa PA01
gccggcgccgcggu

SEQ ID NO: 3397060 - RNA, 14 nt, Pseudomonas aeruginosa PA01
gccggcgccgucga

SEQ ID NO: 3397061 - RNA, 11 nt, Pseudomonas aeruginosa PA01
gccggcgccuu

SEQ ID NO: 3397062 - RNA, 18 nt, Pseudomonas aeruginosa PA01
gccggcgccuugcgccag

SEQ ID NO: 3397063 - RNA, 19 nt, Pseudomonas aeruginosa PA01
gccggcgccuugcgccagg

SEQ ID NO: 3397064 - RNA, 20 nt, Pseudomonas aeruginosa PA01
gccggcgccuugcgccaggc

SEQ ID NO: 3397065 - RNA, 21 nt, Pseudomonas aeruginosa PA01
gccggcgccuugcgccaggcc

SEQ ID NO: 3397066 - RNA, 20 nt, Pseudomonas aeruginosa PA01
gccggcgcgauccuggcggc

SEQ ID NO: 3397067 - RNA, 21 nt, Pseudomonas aeruginosa PA01
gccggcgcgcacggaggcgcu

SEQ ID NO: 3397068 - RNA, 24 nt, Pseudomonas aeruginosa PA01
gccggcgcgcacggucuuggcguu

SEQ ID NO: 3397069 - RNA, 14 nt, Pseudomonas aeruginosa PA01
gccggcgcgcccag

SEQ ID NO: 3397070 - RNA, 15 nt, Pseudomonas aeruginosa PA01
gccggcgcgcccagg

SEQ ID NO: 3397071 - RNA, 16 nt, Pseudomonas aeruginosa PA01
gccggcgcgcccaggc

SEQ ID NO: 3397072 - RNA, 18 nt, Pseudomonas aeruginosa PA01
gccggcgcgcccaggccc

SEQ ID NO: 3397073 - RNA, 18 nt, Pseudomonas aeruginosa PA01
gccggcgcgccccugcgc

SEQ ID NO: 3397074 - RNA, 14 nt, Pseudomonas aeruginosa PA01
gccggcgcgcccgg

SEQ ID NO: 3397075 - RNA, 20 nt, Pseudomonas aeruginosa PA01
gccggcgcgcccggcgcccu

SEQ ID NO: 3397076 - RNA, 17 nt, Pseudomonas aeruginosa PA01
gccggcuuccucgcccu

SEQ ID NO: 3397077 - RNA, 19 nt, Pseudomonas aeruginosa PA01
gccggcuuccucgcccuca

SEQ ID NO: 3397078 - RNA, 19 nt, Pseudomonas aeruginosa PA01
gccggcuucuacgccuugc

SEQ ID NO: 3397079 - RNA, 19 nt, Pseudomonas aeruginosa PA01
gccggcuugcugcaggugg

SEQ ID NO: 3397080 - RNA, 17 nt, Pseudomonas aeruginosa PA01
gccgggaaacagggcga

SEQ ID NO: 3397081 - RNA, 21 nt, Pseudomonas aeruginosa PA01
gccgggaaacagggcgacgcc

SEQ ID NO: 3397082 - RNA, 22 nt, Pseudomonas aeruginosa PA01
gccgggaaacagggcgacgccg

SEQ ID NO: 3397083 - RNA, 14 nt, Pseudomonas aeruginosa PA01
gccgggaagccgcu

SEQ ID NO: 3397084 - RNA, 17 nt, Pseudomonas aeruginosa PA01
gccgggaagcgcaggcc

SEQ ID NO: 3397085 - RNA, 19 nt, Pseudomonas aeruginosa PA01
gccgggaagcgcaggccgc

SEQ ID NO: 3397086 - RNA, 21 nt, Pseudomonas aeruginosa PA01
gccgggaagucguucccggcc

SEQ ID NO: 3397087 - RNA, 17 nt, Pseudomonas aeruginosa PA01
gccgggaauccccagua

SEQ ID NO: 3397088 - RNA, 14 nt, Pseudomonas aeruginosa PA01
gccgggaaucgcca

SEQ ID NO: 3397089 - RNA, 17 nt, Pseudomonas aeruginosa PA01
gccgggaaucgccagca

SEQ ID NO: 3397090 - RNA, 23 nt, Pseudomonas aeruginosa PA01
gccgggaaucgccagcaggcugu

SEQ ID NO: 3397091 - RNA, 21 nt, Pseudomonas aeruginosa PA01
gccgggaauggagaugccgaa

SEQ ID NO: 3397092 - RNA, 13 nt, Pseudomonas aeruginosa PA01
gccgggaccacgc

SEQ ID NO: 3397093 - RNA, 19 nt, Pseudomonas aeruginosa PA01
gccgggaccacgcucaggu

SEQ ID NO: 3397094 - RNA, 22 nt, Pseudomonas aeruginosa PA01
gccgggaccacgcucaggucgg

SEQ ID NO: 3397095 - RNA, 15 nt, Pseudomonas aeruginosa PA01
gccgggacccuggua

SEQ ID NO: 3397096 - RNA, 16 nt, Pseudomonas aeruginosa PA01
gccgggagcggccgug

SEQ ID NO: 3397097 - RNA, 16 nt, Pseudomonas aeruginosa PA01
gccgggauacagcagc

SEQ ID NO: 3397098 - RNA, 22 nt, Pseudomonas aeruginosa PA01
gccgggauacagcagccaagga

SEQ ID NO: 3397099 - RNA, 15 nt, Pseudomonas aeruginosa PA01
gccgggauauccagg

SEQ ID NO: 3397100 - RNA, 17 nt, Pseudomonas aeruginosa PA01
gccgggauaugggugau

SEQ ID NO: 3397101 - RNA, 17 nt, Pseudomonas aeruginosa PA01
gccgggaucaccucgaa

SEQ ID NO: 3397102 - RNA, 18 nt, Pseudomonas aeruginosa PA01
gccgggaucuccucgacg

SEQ ID NO: 3397103 - RNA, 21 nt, Pseudomonas aeruginosa PA01
gccgggaucuccucgacggcg

SEQ ID NO: 3397104 - RNA, 16 nt, Pseudomonas aeruginosa PA01
gccgggaugcucaccg

SEQ ID NO: 3397105 - RNA, 19 nt, Pseudomonas aeruginosa PA01
gccgggaugcucaccgcgc

SEQ ID NO: 3397106 - RNA, 20 nt, Pseudomonas aeruginosa PA01
gccgggauuguugcggcggg

SEQ ID NO: 3397107 - RNA, 22 nt, Pseudomonas aeruginosa PA01
gccgggauuguugcggcggguc

SEQ ID NO: 3397108 - RNA, 21 nt, Pseudomonas aeruginosa PA01
gccgggcaacgauucgacgca

SEQ ID NO: 3397109 - RNA, 23 nt, Pseudomonas aeruginosa PA01
gccgggcaacgauucgacgcagc

SEQ ID NO: 3397110 - RNA, 18 nt, Pseudomonas aeruginosa PA01
gccgggcaacgccaggcc

SEQ ID NO: 3397111 - RNA, 21 nt, Pseudomonas aeruginosa PA01
gccgggcaacgccaggccgcu

SEQ ID NO: 3397112 - RNA, 22 nt, Pseudomonas aeruginosa PA01
gccgggcaacgccaggccgcuu

SEQ ID NO: 3397113 - RNA, 17 nt, Pseudomonas aeruginosa PA01
gccgggcaacgcgcaga

SEQ ID NO: 3397114 - RNA, 18 nt, Pseudomonas aeruginosa PA01
gccgggcaacgcgcagag

SEQ ID NO: 3397115 - RNA, 18 nt, Pseudomonas aeruginosa PA01
gccgggcaagcucgacga

SEQ ID NO: 3397116 - RNA, 17 nt, Pseudomonas aeruginosa PA01
gccgggcaccccgagcg

SEQ ID NO: 3397117 - RNA, 13 nt, Pseudomonas aeruginosa PA01
gccgggcaccguc

SEQ ID NO: 3397118 - RNA, 18 nt, Pseudomonas aeruginosa PA01
gccgggcagacuucgccg

SEQ ID NO: 3397119 - RNA, 19 nt, Pseudomonas aeruginosa PA01
gccgggcagacuucgccgu

SEQ ID NO: 3397120 - RNA, 21 nt, Pseudomonas aeruginosa PA01
gccgggcagacuucgccgugc

SEQ ID NO: 3397121 - RNA, 16 nt, Pseudomonas aeruginosa PA01
gccgggcaggccgagg

SEQ ID NO: 3397122 - RNA, 20 nt, Pseudomonas aeruginosa PA01
gccgggcagugcgcccucga

SEQ ID NO: 3397123 - RNA, 20 nt, Pseudomonas aeruginosa PA01
gccgggcaucaugccgagca

SEQ ID NO: 3397124 - RNA, 19 nt, Pseudomonas aeruginosa PA01
gccgggcauucgcagcggc

SEQ ID NO: 3397125 - RNA, 21 nt, Pseudomonas aeruginosa PA01
gccgggcauucgcagcggccc

SEQ ID NO: 3397126 - RNA, 22 nt, Pseudomonas aeruginosa PA01
gccgggcauucgcagcggcccc

SEQ ID NO: 3397127 - RNA, 14 nt, Pseudomonas aeruginosa PA01
gccgggccagcucc

SEQ ID NO: 3397128 - RNA, 22 nt, Pseudomonas aeruginosa PA01
gccgggccagcuccagcaccgg

SEQ ID NO: 3397129 - RNA, 19 nt, Pseudomonas aeruginosa PA01
gccgggcccugggccccgg

SEQ ID NO: 3397130 - RNA, 12 nt, Pseudomonas aeruginosa PA01
gccgggccgagg

SEQ ID NO: 3397131 - RNA, 18 nt, Pseudomonas aeruginosa PA01
gccgggccgaucuucgcc

SEQ ID NO: 3397132 - RNA, 19 nt, Pseudomonas aeruginosa PA01
gccgggccgaucuucgccg

SEQ ID NO: 3397133 - RNA, 20 nt, Pseudomonas aeruginosa PA01
gccgggccgaucuucgccga

SEQ ID NO: 3397134 - RNA, 22 nt, Pseudomonas aeruginosa PA01
gccgggccgaucuucgccgaca

SEQ ID NO: 3397135 - RNA, 24 nt, Pseudomonas aeruginosa PA01
gccgggccgaucuucgccgacaga

SEQ ID NO: 3397136 - RNA, 14 nt, Pseudomonas aeruginosa PA01
gccgggccgaugcg

SEQ ID NO: 3397137 - RNA, 15 nt, Pseudomonas aeruginosa PA01
gccgggccgaugcgc

SEQ ID NO: 3397138 - RNA, 15 nt, Pseudomonas aeruginosa PA01
gccgggccgcagcgc

SEQ ID NO: 3397139 - RNA, 21 nt, Pseudomonas aeruginosa PA01
gccgggccgcagcgcagccga

SEQ ID NO: 3397140 - RNA, 12 nt, Pseudomonas aeruginosa PA01
gccgggccgccu

SEQ ID NO: 3397141 - RNA, 17 nt, Pseudomonas aeruginosa PA01
gccgggccgccuugcgc

SEQ ID NO: 3397142 - RNA, 20 nt, Pseudomonas aeruginosa PA01
gccgggccgccuugcgcagc

SEQ ID NO: 3397143 - RNA, 14 nt, Pseudomonas aeruginosa PA01
gccgggccggccag

SEQ ID NO: 3397144 - RNA, 19 nt, Pseudomonas aeruginosa PA01
gccgggccggccagggcga

SEQ ID NO: 3397145 - RNA, 12 nt, Pseudomonas aeruginosa PA01
gccgggccucgg

SEQ ID NO: 3397146 - RNA, 13 nt, Pseudomonas aeruginosa PA01
gccgggcgagcug

SEQ ID NO: 3397147 - RNA, 12 nt, Pseudomonas aeruginosa PA01
gccgggcgcccg

SEQ ID NO: 3397148 - RNA, 15 nt, Pseudomonas aeruginosa PA01
gccgggcgcgaugcc

SEQ ID NO: 3397149 - RNA, 14 nt, Pseudomonas aeruginosa PA01
gccgggcgcgcgcc

SEQ ID NO: 3397150 - RNA, 12 nt, Pseudomonas aeruginosa PA01
gccgggcgcgcu

SEQ ID NO: 3397151 - RNA, 16 nt, Pseudomonas aeruginosa PA01
gccgggcgcgcugguc

SEQ ID NO: 3397152 - RNA, 17 nt, Pseudomonas aeruginosa PA01
gccgggcggacgcuggg

SEQ ID NO: 3397153 - RNA, 18 nt, Pseudomonas aeruginosa PA01
gccgggcggacgcugggc

SEQ ID NO: 3397154 - RNA, 21 nt, Pseudomonas aeruginosa PA01
gccgggcggacgcugggcugg

SEQ ID NO: 3397155 - RNA, 21 nt, Pseudomonas aeruginosa PA01
gccgggcggaugaccugucca

SEQ ID NO: 3397156 - RNA, 22 nt, Pseudomonas aeruginosa PA01
gccgggcggaugaccuguccag

SEQ ID NO: 3397157 - RNA, 15 nt, Pseudomonas aeruginosa PA01
gccgggcggcggcgc

SEQ ID NO: 3397158 - RNA, 20 nt, Pseudomonas aeruginosa PA01
gccgggcguuuucguugccg

SEQ ID NO: 3397159 - RNA, 23 nt, Pseudomonas aeruginosa PA01
gccgggcuagguuuccccguggc

SEQ ID NO: 3397160 - RNA, 17 nt, Pseudomonas aeruginosa PA01
gccgggcucacucccgu

SEQ ID NO: 3397161 - RNA, 21 nt, Pseudomonas aeruginosa PA01
gccgggcucacucccguccag

SEQ ID NO: 3397162 - RNA, 14 nt, Pseudomonas aeruginosa PA01
gccgggcuccagca

SEQ ID NO: 3397163 - RNA, 17 nt, Pseudomonas aeruginosa PA01
gccgggcuccgccgcga

SEQ ID NO: 3397164 - RNA, 19 nt, Pseudomonas aeruginosa PA01
gccgggcuccgccgcgagc

SEQ ID NO: 3397165 - RNA, 20 nt, Pseudomonas aeruginosa PA01
gccgggcuccgccgcgagcg

SEQ ID NO: 3397166 - RNA, 20 nt, Pseudomonas aeruginosa PA01
gccgggcucugguagccgca

SEQ ID NO: 3397167 - RNA, 17 nt, Pseudomonas aeruginosa PA01
gccgggcucuucggagg

SEQ ID NO: 3397168 - RNA, 13 nt, Pseudomonas aeruginosa PA01
gccgggcugccga

SEQ ID NO: 3397169 - RNA, 14 nt, Pseudomonas aeruginosa PA01
gccgggcugccgaa

SEQ ID NO: 3397170 - RNA, 16 nt, Pseudomonas aeruginosa PA01
gccgggcugccgaaca

SEQ ID NO: 3397171 - RNA, 20 nt, Pseudomonas aeruginosa PA01
gccgggcugccgaacaggcg

SEQ ID NO: 3397172 - RNA, 22 nt, Pseudomonas aeruginosa PA01
gccgggcugccgaacaggcguc

SEQ ID NO: 3397173 - RNA, 19 nt, Pseudomonas aeruginosa PA01
gccgggcuggccaccgcca

SEQ ID NO: 3397174 - RNA, 13 nt, Pseudomonas aeruginosa PA01
gccgggcuggccg

SEQ ID NO: 3397175 - RNA, 16 nt, Pseudomonas aeruginosa PA01
gccgggcuggccgucg

SEQ ID NO: 3397176 - RNA, 21 nt, Pseudomonas aeruginosa PA01
gccgggcuuccuggccggggg

SEQ ID NO: 3397177 - RNA, 11 nt, Pseudomonas aeruginosa PA01
gccgggcuucg

SEQ ID NO: 3397178 - RNA, 17 nt, Pseudomonas aeruginosa PA01
gccggucccgggcuccg

SEQ ID NO: 3397179 - RNA, 19 nt, Pseudomonas aeruginosa PA01
gccgguccgacaaucagcg

SEQ ID NO: 3397180 - RNA, 18 nt, Pseudomonas aeruginosa PA01
gccgguccuuguccgggu

SEQ ID NO: 3397181 - RNA, 15 nt, Pseudomonas aeruginosa PA01
gccggucgcaaccgg

SEQ ID NO: 3397182 - RNA, 18 nt, Pseudomonas aeruginosa PA01
gccggucgcgcucaggcg

SEQ ID NO: 3397183 - RNA, 19 nt, Pseudomonas aeruginosa PA01
gccggucgcgcucaggcgc

SEQ ID NO: 3397184 - RNA, 19 nt, Pseudomonas aeruginosa PA01
gccggucggaacgaccacg

SEQ ID NO: 3397185 - RNA, 20 nt, Pseudomonas aeruginosa PA01
gccggucggaacgaccacgc

SEQ ID NO: 3397186 - RNA, 22 nt, Pseudomonas aeruginosa PA01
gccggucggccuugaggcgggc

SEQ ID NO: 3397187 - RNA, 24 nt, Pseudomonas aeruginosa PA01
gccggucggccuugaggcgggcca

SEQ ID NO: 3397188 - RNA, 18 nt, Pseudomonas aeruginosa PA01
gccggucugcugcgcgca

SEQ ID NO: 3397189 - RNA, 23 nt, Pseudomonas aeruginosa PA01
gccggucuucacgccuugcugcg

SEQ ID NO: 3397190 - RNA, 19 nt, Pseudomonas aeruginosa PA01
gccggucuugccggcugcg

SEQ ID NO: 3397191 - RNA, 14 nt, Pseudomonas aeruginosa PA01
gccggugaacaggu

SEQ ID NO: 3397192 - RNA, 22 nt, Pseudomonas aeruginosa PA01
gccggugaacagguagcuggaa

SEQ ID NO: 3397193 - RNA, 23 nt, Pseudomonas aeruginosa PA01
gccggugaacagguagcuggaaa

SEQ ID NO: 3397194 - RNA, 20 nt, Pseudomonas aeruginosa PA01
gccggugacauucgacagca

SEQ ID NO: 3397195 - RNA, 21 nt, Pseudomonas aeruginosa PA01
gccggugacauucgacagcag

SEQ ID NO: 3397196 - RNA, 22 nt, Pseudomonas aeruginosa PA01
gccggugacccacuccggcagg

SEQ ID NO: 3397197 - RNA, 24 nt, Pseudomonas aeruginosa PA01
gccggugacccacuccggcaggcg

SEQ ID NO: 3397198 - RNA, 17 nt, Pseudomonas aeruginosa PA01
gccggugacgaaaccgg

SEQ ID NO: 3397199 - RNA, 22 nt, Pseudomonas aeruginosa PA01
gccggugacgaaaccggcgucc

SEQ ID NO: 3397200 - RNA, 23 nt, Pseudomonas aeruginosa PA01
gccggugacgaaaccggcguccu

SEQ ID NO: 3397201 - RNA, 17 nt, Pseudomonas aeruginosa PA01
gccggugacgcugcuca

SEQ ID NO: 3397202 - RNA, 17 nt, Pseudomonas aeruginosa PA01
gccggugaggcgcagca

SEQ ID NO: 3397203 - RNA, 17 nt, Pseudomonas aeruginosa PA01
gccggugaucgagccgc

SEQ ID NO: 3397204 - RNA, 17 nt, Pseudomonas aeruginosa PA01
gccggugaucucgcggc

SEQ ID NO: 3397205 - RNA, 18 nt, Pseudomonas aeruginosa PA01
gccggugaucucgcggcg

SEQ ID NO: 3397206 - RNA, 19 nt, Pseudomonas aeruginosa PA01
gccggugaucucgcggcgc

SEQ ID NO: 3397207 - RNA, 22 nt, Pseudomonas aeruginosa PA01
gccggugaucucgcggcgcggc

SEQ ID NO: 3397208 - RNA, 19 nt, Pseudomonas aeruginosa PA01
gccggugauguaggacgcc

SEQ ID NO: 3397209 - RNA, 20 nt, Pseudomonas aeruginosa PA01
gccggugauguaggacgccu

SEQ ID NO: 3397210 - RNA, 16 nt, Pseudomonas aeruginosa PA01
gccggugaugucggcg

SEQ ID NO: 3397211 - RNA, 13 nt, Pseudomonas aeruginosa PA01
gccggugcaccag

SEQ ID NO: 3397212 - RNA, 16 nt, Pseudomonas aeruginosa PA01
gccggugcaccaggcg

SEQ ID NO: 3397213 - RNA, 19 nt, Pseudomonas aeruginosa PA01
gccggugcaccaggcgaug

SEQ ID NO: 3397214 - RNA, 22 nt, Pseudomonas aeruginosa PA01
gccggugcaccaggcgaugcgc

SEQ ID NO: 3397215 - RNA, 22 nt, Pseudomonas aeruginosa PA01
gccggugcagaagacgcccagc

SEQ ID NO: 3397216 - RNA, 15 nt, Pseudomonas aeruginosa PA01
gccggugccaggacc

SEQ ID NO: 3397217 - RNA, 16 nt, Pseudomonas aeruginosa PA01
gccggugccaggacca

SEQ ID NO: 3397218 - RNA, 14 nt, Pseudomonas aeruginosa PA01
gccggugccgcccu

SEQ ID NO: 3397219 - RNA, 17 nt, Pseudomonas aeruginosa PA01
gccggugccgcccuggg

SEQ ID NO: 3397220 - RNA, 14 nt, Pseudomonas aeruginosa PA01
gccggugccgccgg

SEQ ID NO: 3397221 - RNA, 17 nt, Pseudomonas aeruginosa PA01
gccggugccgccggcca

SEQ ID NO: 3397222 - RNA, 19 nt, Pseudomonas aeruginosa PA01
gccggugccgccggccacc

SEQ ID NO: 3397223 - RNA, 14 nt, Pseudomonas aeruginosa PA01
gccggugccggcgg

SEQ ID NO: 3397224 - RNA, 16 nt, Pseudomonas aeruginosa PA01
gccggugccggcggcg

SEQ ID NO: 3397225 - RNA, 21 nt, Pseudomonas aeruginosa PA01
gccggugccggcggcggacgc

SEQ ID NO: 3397226 - RNA, 20 nt, Pseudomonas aeruginosa PA01
gccggugcggguggucgccg

SEQ ID NO: 3397227 - RNA, 20 nt, Pseudomonas aeruginosa PA01
gccggugcuggugcggccga

SEQ ID NO: 3397228 - RNA, 14 nt, Pseudomonas aeruginosa PA01
gccgguggccaggc

SEQ ID NO: 3397229 - RNA, 12 nt, Pseudomonas aeruginosa PA01
gccgguggcgcc

SEQ ID NO: 3397230 - RNA, 23 nt, Pseudomonas aeruginosa PA01
gccgguggcgcccagccagagcg

SEQ ID NO: 3397231 - RNA, 20 nt, Pseudomonas aeruginosa PA01
gccgguggcguuauucgccc

SEQ ID NO: 3397232 - RNA, 20 nt, Pseudomonas aeruginosa PA01
gccgguggucgguucgucga

SEQ ID NO: 3397233 - RNA, 20 nt, Pseudomonas aeruginosa PA01
gccggugugacggccggggc

SEQ ID NO: 3397234 - RNA, 20 nt, Pseudomonas aeruginosa PA01
gccggugugcgacuggggca

SEQ ID NO: 3397235 - RNA, 21 nt, Pseudomonas aeruginosa PA01
gccgguuaucgaggcgucggc

SEQ ID NO: 3397236 - RNA, 20 nt, Pseudomonas aeruginosa PA01
gccgguucaguucagccggu

SEQ ID NO: 3397237 - RNA, 13 nt, Pseudomonas aeruginosa PA01
gccgguucccgca

SEQ ID NO: 3397238 - RNA, 14 nt, Pseudomonas aeruginosa PA01
gccgguucccgcag

SEQ ID NO: 3397239 - RNA, 22 nt, Pseudomonas aeruginosa PA01
gccgguucccgcagcgaucagc

SEQ ID NO: 3397240 - RNA, 19 nt, Pseudomonas aeruginosa PA01
gccgguuccgaaucgccua

SEQ ID NO: 3397241 - RNA, 16 nt, Pseudomonas aeruginosa PA01
gccgguucgcaggcca

SEQ ID NO: 3397242 - RNA, 19 nt, Pseudomonas aeruginosa PA01
gccgguucgcaggccaggc

SEQ ID NO: 3397243 - RNA, 20 nt, Pseudomonas aeruginosa PA01
gccgguucgcaggccaggcg

SEQ ID NO: 3397244 - RNA, 21 nt, Pseudomonas aeruginosa PA01
gccgguucgcaggccaggcgc

SEQ ID NO: 3397245 - RNA, 19 nt, Pseudomonas aeruginosa PA01
gccgguucguugaccgucc

SEQ ID NO: 3397246 - RNA, 14 nt, Pseudomonas aeruginosa PA01
gccgguugcggcgc

SEQ ID NO: 3397247 - RNA, 16 nt, Pseudomonas aeruginosa PA01
gccgguugcggcgccg

SEQ ID NO: 3397248 - RNA, 17 nt, Pseudomonas aeruginosa PA01
gccgguugcggcgccgg

SEQ ID NO: 3397249 - RNA, 16 nt, Pseudomonas aeruginosa PA01
gccgguugcugcugcg

SEQ ID NO: 3397250 - RNA, 17 nt, Pseudomonas aeruginosa PA01
gccgguugcugcuugcg

SEQ ID NO: 3397251 - RNA, 16 nt, Pseudomonas aeruginosa PA01
gccgguuucgaccggc

SEQ ID NO: 3397252 - RNA, 18 nt, Pseudomonas aeruginosa PA01
gccgguuucgaccggcgc

SEQ ID NO: 3397253 - RNA, 20 nt, Pseudomonas aeruginosa PA01
gccgguuucgaccggcgcgc

SEQ ID NO: 3397254 - RNA, 21 nt, Pseudomonas aeruginosa PA01
gccgguuuuuuauugccagcg

SEQ ID NO: 3397255 - RNA, 20 nt, Pseudomonas aeruginosa PA01
gccgguuuuuuuaugccugc

SEQ ID NO: 3397256 - RNA, 14 nt, Pseudomonas aeruginosa PA01
gccguacagcaggc

SEQ ID NO: 3397257 - RNA, 16 nt, Pseudomonas aeruginosa PA01
gccguacagcaggcag

SEQ ID NO: 3397258 - RNA, 19 nt, Pseudomonas aeruginosa PA01
gccguacagcccccgccgg

SEQ ID NO: 3397259 - RNA, 21 nt, Pseudomonas aeruginosa PA01
gccguacagcccccgccggcc

SEQ ID NO: 3397260 - RNA, 22 nt, Pseudomonas aeruginosa PA01
gccguacagcccccgccggccg

SEQ ID NO: 3397261 - RNA, 13 nt, Pseudomonas aeruginosa PA01
gccguacaggcca

SEQ ID NO: 3397262 - RNA, 14 nt, Pseudomonas aeruginosa PA01
gccguacaggucgg

SEQ ID NO: 3397263 - RNA, 15 nt, Pseudomonas aeruginosa PA01
gccguacaggucggc

SEQ ID NO: 3397264 - RNA, 17 nt, Pseudomonas aeruginosa PA01
gccguacaggucggcgc

SEQ ID NO: 3397265 - RNA, 22 nt, Pseudomonas aeruginosa PA01
gccguacaggucggcgccggug

SEQ ID NO: 3397266 - RNA, 17 nt, Pseudomonas aeruginosa PA01
gccguaccagucgcccg

SEQ ID NO: 3397267 - RNA, 19 nt, Pseudomonas aeruginosa PA01
gccguaccagucgcccgcu

SEQ ID NO: 3397268 - RNA, 15 nt, Pseudomonas aeruginosa PA01
gccguacuucagggu

SEQ ID NO: 3397269 - RNA, 17 nt, Pseudomonas aeruginosa PA01
gccguacuucaggguga

SEQ ID NO: 3397270 - RNA, 21 nt, Pseudomonas aeruginosa PA01
gccguacuucagggugacguc

SEQ ID NO: 3397271 - RNA, 22 nt, Pseudomonas aeruginosa PA01
gccguacuugaaggugcccagg

SEQ ID NO: 3397272 - RNA, 17 nt, Pseudomonas aeruginosa PA01
gccguagaacgccagga

SEQ ID NO: 3397273 - RNA, 15 nt, Pseudomonas aeruginosa PA01
gccguagaccaccag

SEQ ID NO: 3397274 - RNA, 17 nt, Pseudomonas aeruginosa PA01
gccguagaccaccagca

SEQ ID NO: 3397275 - RNA, 18 nt, Pseudomonas aeruginosa PA01
gccguagaccaccagcag

SEQ ID NO: 3397276 - RNA, 20 nt, Pseudomonas aeruginosa PA01
gccguagaccaccagcagca

SEQ ID NO: 3397277 - RNA, 18 nt, Pseudomonas aeruginosa PA01
gccguagacguagucggc

SEQ ID NO: 3397278 - RNA, 17 nt, Pseudomonas aeruginosa PA01
gccguagaggucgccgu

SEQ ID NO: 3397279 - RNA, 23 nt, Pseudomonas aeruginosa PA01
gccguucacgccuggcggcuggc

SEQ ID NO: 3397280 - RNA, 12 nt, Pseudomonas aeruginosa PA01
gccguucagcgu

SEQ ID NO: 3397281 - RNA, 18 nt, Pseudomonas aeruginosa PA01
gccguucagcucccaggc

SEQ ID NO: 3397282 - RNA, 14 nt, Pseudomonas aeruginosa PA01
gccguucaggccgg

SEQ ID NO: 3397283 - RNA, 16 nt, Pseudomonas aeruginosa PA01
gccguucaggccggcg

SEQ ID NO: 3397284 - RNA, 18 nt, Pseudomonas aeruginosa PA01
gccguucaggccggcgcc

SEQ ID NO: 3397285 - RNA, 19 nt, Pseudomonas aeruginosa PA01
gccguucaggccggcgccg

SEQ ID NO: 3397286 - RNA, 14 nt, Pseudomonas aeruginosa PA01
gccguucaggcgcg

SEQ ID NO: 3397287 - RNA, 15 nt, Pseudomonas aeruginosa PA01
gccguuccagcggca

SEQ ID NO: 3397288 - RNA, 16 nt, Pseudomonas aeruginosa PA01
gccguuccagcggcac

SEQ ID NO: 3397289 - RNA, 13 nt, Pseudomonas aeruginosa PA01
gccguuccaggcg

SEQ ID NO: 3397290 - RNA, 14 nt, Pseudomonas aeruginosa PA01
gccguuccaggcgg

SEQ ID NO: 3397291 - RNA, 13 nt, Pseudomonas aeruginosa PA01
gccguucccgguc

SEQ ID NO: 3397292 - RNA, 19 nt, Pseudomonas aeruginosa PA01
gccguuccuccucgccgcc

SEQ ID NO: 3397293 - RNA, 23 nt, Pseudomonas aeruginosa PA01
gccguuccuccucgccgccgacc

SEQ ID NO: 3397294 - RNA, 21 nt, Pseudomonas aeruginosa PA01
gccguucgaaucuucguaggu

SEQ ID NO: 3397295 - RNA, 16 nt, Pseudomonas aeruginosa PA01
gccguucgcccgcggc

SEQ ID NO: 3397296 - RNA, 21 nt, Pseudomonas aeruginosa PA01
gccguucgcccgcggcggcga

SEQ ID NO: 3397297 - RNA, 13 nt, Pseudomonas aeruginosa PA01
gccguucgcccuu

SEQ ID NO: 3397298 - RNA, 14 nt, Pseudomonas aeruginosa PA01
gccguucgcccuuc

SEQ ID NO: 3397299 - RNA, 19 nt, Pseudomonas aeruginosa PA01
gccguucgucaccggcgcc

SEQ ID NO: 3397300 - RNA, 13 nt, Pseudomonas aeruginosa PA01
gccguucucccgc

SEQ ID NO: 3397301 - RNA, 21 nt, Pseudomonas aeruginosa PA01
gccguucucccgcgcgcugug

SEQ ID NO: 3397302 - RNA, 17 nt, Pseudomonas aeruginosa PA01
gccguucucggugacca

SEQ ID NO: 3397303 - RNA, 19 nt, Pseudomonas aeruginosa PA01
gccguucucggugaccacc

SEQ ID NO: 3397304 - RNA, 22 nt, Pseudomonas aeruginosa PA01
gccguucuuguugagcuggccg

SEQ ID NO: 3397305 - RNA, 23 nt, Pseudomonas aeruginosa PA01
gccguucuuguugagcuggccga

SEQ ID NO: 3397306 - RNA, 15 nt, Pseudomonas aeruginosa PA01
gccguugaaacgcuc

SEQ ID NO: 3397307 - RNA, 20 nt, Pseudomonas aeruginosa PA01
gccguugaaacgcucggcgu

SEQ ID NO: 3397308 - RNA, 16 nt, Pseudomonas aeruginosa PA01
gccguugaccagcgcg

SEQ ID NO: 3397309 - RNA, 16 nt, Pseudomonas aeruginosa PA01
gccguugaggccgucg

SEQ ID NO: 3397310 - RNA, 19 nt, Pseudomonas aeruginosa PA01
gccguugaggccgucgaag

SEQ ID NO: 3397311 - RNA, 15 nt, Pseudomonas aeruginosa PA01
gccguugaugacgaa

SEQ ID NO: 3397312 - RNA, 13 nt, Pseudomonas aeruginosa PA01
gccguugcccucg

SEQ ID NO: 3397313 - RNA, 20 nt, Pseudomonas aeruginosa PA01
gccguugcccucgcgcugga

SEQ ID NO: 3397314 - RNA, 16 nt, Pseudomonas aeruginosa PA01
gccguugccuucgccg

SEQ ID NO: 3397315 - RNA, 13 nt, Pseudomonas aeruginosa PA01
gccguugcgcagg

SEQ ID NO: 3397316 - RNA, 13 nt, Pseudomonas aeruginosa PA01
gccguugcggcag

SEQ ID NO: 3397317 - RNA, 18 nt, Pseudomonas aeruginosa PA01
gccguugcggcagcaucc

SEQ ID NO: 3397318 - RNA, 13 nt, Pseudomonas aeruginosa PA01
gccguugcggccc

SEQ ID NO: 3397319 - RNA, 17 nt, Pseudomonas aeruginosa PA01
gccguugcucacgccga

SEQ ID NO: 3397320 - RNA, 20 nt, Pseudomonas aeruginosa PA01
gccguugcucacgccgaacu

SEQ ID NO: 3397321 - RNA, 15 nt, Pseudomonas aeruginosa PA01
gccguuggccagcag

SEQ ID NO: 3397322 - RNA, 18 nt, Pseudomonas aeruginosa PA01
gccguuggccagcaggcg

SEQ ID NO: 3397323 - RNA, 21 nt, Pseudomonas aeruginosa PA01
gccguuggccagcaggcgccg

SEQ ID NO: 3397324 - RNA, 15 nt, Pseudomonas aeruginosa PA01
gccguuggccgagcg

SEQ ID NO: 3397325 - RNA, 19 nt, Pseudomonas aeruginosa PA01
gccguuggccuucacuucg

SEQ ID NO: 3397326 - RNA, 16 nt, Pseudomonas aeruginosa PA01
gccguuggcgaacuuc

SEQ ID NO: 3397327 - RNA, 22 nt, Pseudomonas aeruginosa PA01
gccguuggcgaacuucaggccg

SEQ ID NO: 3397328 - RNA, 22 nt, Pseudomonas aeruginosa PA01
gccguuggcgaggacuuucuug

SEQ ID NO: 3397329 - RNA, 13 nt, Pseudomonas aeruginosa PA01
gccguuggcgucg

SEQ ID NO: 3397330 - RNA, 15 nt, Pseudomonas aeruginosa PA01
gccguuggcgucgcg

SEQ ID NO: 3397331 - RNA, 16 nt, Pseudomonas aeruginosa PA01
gccguuggcgucgcgc

SEQ ID NO: 3397332 - RNA, 20 nt, Pseudomonas aeruginosa PA01
gccguuggcgucgcgcacga

SEQ ID NO: 3397333 - RNA, 22 nt, Pseudomonas aeruginosa PA01
gccguuggcgucgcgcacgagg

SEQ ID NO: 3397334 - RNA, 14 nt, Pseudomonas aeruginosa PA01
gccguugggccagg

SEQ ID NO: 3397335 - RNA, 23 nt, Pseudomonas aeruginosa PA01
gccguuguagaucggcagcauca

SEQ ID NO: 3397336 - RNA, 17 nt, Pseudomonas aeruginosa PA01
gccguuguagcugacca

SEQ ID NO: 3397337 - RNA, 17 nt, Pseudomonas aeruginosa PA01
gccguuuuacucgucgc

SEQ ID NO: 3397338 - RNA, 21 nt, Pseudomonas aeruginosa PA01
gccguuuuuuaugccgaggcg

SEQ ID NO: 3397339 - RNA, 22 nt, Pseudomonas aeruginosa PA01
gccguuuuuuaugccgaggcgu

SEQ ID NO: 3397340 - RNA, 23 nt, Pseudomonas aeruginosa PA01
gccguuuuuuaugccgaggcgua

SEQ ID NO: 3397341 - RNA, 15 nt, Pseudomonas aeruginosa PA01
gccuaccagaccgca

SEQ ID NO: 3397342 - RNA, 17 nt, Pseudomonas aeruginosa PA01
gccuaccagaccgcagc

SEQ ID NO: 3397343 - RNA, 23 nt, Pseudomonas aeruginosa PA01
gccuaccagaccgcagccggcga

SEQ ID NO: 3397344 - RNA, 16 nt, Pseudomonas aeruginosa PA01
gccuacccgcgcuucu

SEQ ID NO: 3397345 - RNA, 19 nt, Pseudomonas aeruginosa PA01
gccuaccggggcgcgggcg

SEQ ID NO: 3397346 - RNA, 19 nt, Pseudomonas aeruginosa PA01
gccuaccgucacgcggacc

SEQ ID NO: 3397347 - RNA, 12 nt, Pseudomonas aeruginosa PA01
gccuacugcugg

SEQ ID NO: 3397348 - RNA, 16 nt, Pseudomonas aeruginosa PA01
gccuacugcuggacgg

SEQ ID NO: 3397349 - RNA, 19 nt, Pseudomonas aeruginosa PA01
gccuacugggcguggcggc

SEQ ID NO: 3397350 - RNA, 21 nt, Pseudomonas aeruginosa PA01
gccuacugggcguggcggccg

SEQ ID NO: 3397351 - RNA, 22 nt, Pseudomonas aeruginosa PA01
gccuacugggcguggcggccgc

SEQ ID NO: 3397352 - RNA, 16 nt, Pseudomonas aeruginosa PA01
gccuacuucucgacga

SEQ ID NO: 3397353 - RNA, 21 nt, Pseudomonas aeruginosa PA01
gccuacuucucgacgaaggcg

SEQ ID NO: 3397354 - RNA, 23 nt, Pseudomonas aeruginosa PA01
gccuacuucucgacgaaggcgcg

SEQ ID NO: 3397355 - RNA, 14 nt, Pseudomonas aeruginosa PA01
gccuacuugaucag

SEQ ID NO: 3397356 - RNA, 22 nt, Pseudomonas aeruginosa PA01
gccuauccacgacgucggcggc

SEQ ID NO: 3397357 - RNA, 20 nt, Pseudomonas aeruginosa PA01
gccuauggcguuauucgccc

SEQ ID NO: 3397358 - RNA, 17 nt, Pseudomonas aeruginosa PA01
gccucaacgaccgccca

SEQ ID NO: 3397359 - RNA, 20 nt, Pseudomonas aeruginosa PA01
gccucaacgaccgcccaggc

SEQ ID NO: 3397360 - RNA, 17 nt, Pseudomonas aeruginosa PA01
gccucaaggcaucgcga

SEQ ID NO: 3397361 - RNA, 13 nt, Pseudomonas aeruginosa PA01
gccucaccccacg

SEQ ID NO: 3397362 - RNA, 23 nt, Pseudomonas aeruginosa PA01
gccucaccccacgggcgacccag

SEQ ID NO: 3397363 - RNA, 13 nt, Pseudomonas aeruginosa PA01
gccucacccugcu

SEQ ID NO: 3397364 - RNA, 15 nt, Pseudomonas aeruginosa PA01
gccucacccugcugg

SEQ ID NO: 3397365 - RNA, 19 nt, Pseudomonas aeruginosa PA01
gccucacggucgcaggggc

SEQ ID NO: 3397366 - RNA, 17 nt, Pseudomonas aeruginosa PA01
gccucagaacugcucgg

SEQ ID NO: 3397367 - RNA, 19 nt, Pseudomonas aeruginosa PA01
gccucagaacugcucggcg

SEQ ID NO: 3397368 - RNA, 16 nt, Pseudomonas aeruginosa PA01
gccucagagucgcacc

SEQ ID NO: 3397369 - RNA, 22 nt, Pseudomonas aeruginosa PA01
gccucagagucgcaccgggagg

SEQ ID NO: 3397370 - RNA, 23 nt, Pseudomonas aeruginosa PA01
gccucagcgaaacucgugcucca

SEQ ID NO: 3397371 - RNA, 22 nt, Pseudomonas aeruginosa PA01
gccucagcggaacuugcgccga

SEQ ID NO: 3397372 - RNA, 13 nt, Pseudomonas aeruginosa PA01
gccucagcggccu

SEQ ID NO: 3397373 - RNA, 12 nt, Pseudomonas aeruginosa PA01
gccucaggccgg

SEQ ID NO: 3397374 - RNA, 16 nt, Pseudomonas aeruginosa PA01
gccucaggccuggcgc

SEQ ID NO: 3397375 - RNA, 16 nt, Pseudomonas aeruginosa PA01
gccucaggcgcugcgc

SEQ ID NO: 3397376 - RNA, 20 nt, Pseudomonas aeruginosa PA01
gccucaggcgcugcgcggcc

SEQ ID NO: 3397377 - RNA, 21 nt, Pseudomonas aeruginosa PA01
gccucaggcgcugcgcggccu

SEQ ID NO: 3397378 - RNA, 17 nt, Pseudomonas aeruginosa PA01
gccucagggcgcgaagu

SEQ ID NO: 3397379 - RNA, 21 nt, Pseudomonas aeruginosa PA01
gccucaguuuucuaaccggcg

SEQ ID NO: 3397380 - RNA, 22 nt, Pseudomonas aeruginosa PA01
gccucaguuuucuaaccggcgu

SEQ ID NO: 3397381 - RNA, 20 nt, Pseudomonas aeruginosa PA01
gccucgcgcaacgccuugcc

SEQ ID NO: 3397382 - RNA, 20 nt, Pseudomonas aeruginosa PA01
gccucgcgcaacugcggggc

SEQ ID NO: 3397383 - RNA, 14 nt, Pseudomonas aeruginosa PA01
gccucgcgccagag

SEQ ID NO: 3397384 - RNA, 20 nt, Pseudomonas aeruginosa PA01
gccucgcgccagagaucgcc

SEQ ID NO: 3397385 - RNA, 15 nt, Pseudomonas aeruginosa PA01
gccucgcgccgcgcc

SEQ ID NO: 3397386 - RNA, 18 nt, Pseudomonas aeruginosa PA01
gccucgcgccgcgccagc

SEQ ID NO: 3397387 - RNA, 22 nt, Pseudomonas aeruginosa PA01
gccucgcgccgcgccagcaggc

SEQ ID NO: 3397388 - RNA, 19 nt, Pseudomonas aeruginosa PA01
gccucgcgcguggccgcca

SEQ ID NO: 3397389 - RNA, 21 nt, Pseudomonas aeruginosa PA01
gccucgcgcguggccgccagg

SEQ ID NO: 3397390 - RNA, 16 nt, Pseudomonas aeruginosa PA01
gccucgcgcucggcgg

SEQ ID NO: 3397391 - RNA, 18 nt, Pseudomonas aeruginosa PA01
gccucgcgcucggcggcc

SEQ ID NO: 3397392 - RNA, 17 nt, Pseudomonas aeruginosa PA01
gccucgcggaccucggg

SEQ ID NO: 3397393 - RNA, 12 nt, Pseudomonas aeruginosa PA01
gccucgcggcgu

SEQ ID NO: 3397394 - RNA, 16 nt, Pseudomonas aeruginosa PA01
gccucgcggcguucgg

SEQ ID NO: 3397395 - RNA, 18 nt, Pseudomonas aeruginosa PA01
gccucgcgggucugcgcc

SEQ ID NO: 3397396 - RNA, 13 nt, Pseudomonas aeruginosa PA01
gccucgcgugcgc

SEQ ID NO: 3397397 - RNA, 17 nt, Pseudomonas aeruginosa PA01
gccucgcuagucuuccu

SEQ ID NO: 3397398 - RNA, 19 nt, Pseudomonas aeruginosa PA01
gccucgcuagucuuccugc

SEQ ID NO: 3397399 - RNA, 20 nt, Pseudomonas aeruginosa PA01
gccucgcuagucuuccugca

SEQ ID NO: 3397400 - RNA, 21 nt, Pseudomonas aeruginosa PA01
gccucgcuagucuuccugcac

SEQ ID NO: 3397401 - RNA, 13 nt, Pseudomonas aeruginosa PA01
gccucgcugagca

SEQ ID NO: 3397402 - RNA, 21 nt, Pseudomonas aeruginosa PA01
gccucgcugagcaccgggacg

SEQ ID NO: 3397403 - RNA, 12 nt, Pseudomonas aeruginosa PA01
gccucgcugccg

SEQ ID NO: 3397404 - RNA, 16 nt, Pseudomonas aeruginosa PA01
gccucgcugccgccgc

SEQ ID NO: 3397405 - RNA, 14 nt, Pseudomonas aeruginosa PA01
gccucgcugccugg

SEQ ID NO: 3397406 - RNA, 11 nt, Pseudomonas aeruginosa PA01
gccucgcugcg

SEQ ID NO: 3397407 - RNA, 13 nt, Pseudomonas aeruginosa PA01
gccucgcugcgca

SEQ ID NO: 3397408 - RNA, 15 nt, Pseudomonas aeruginosa PA01
gccucgcugcgcaga

SEQ ID NO: 3397409 - RNA, 18 nt, Pseudomonas aeruginosa PA01
gccucgcuggcguucucc

SEQ ID NO: 3397410 - RNA, 20 nt, Pseudomonas aeruginosa PA01
gccucgcuggcguucuccag

SEQ ID NO: 3397411 - RNA, 16 nt, Pseudomonas aeruginosa PA01
gccucgcugggcgggc

SEQ ID NO: 3397412 - RNA, 20 nt, Pseudomonas aeruginosa PA01
gccucggaaucggcgaucgg

SEQ ID NO: 3397413 - RNA, 16 nt, Pseudomonas aeruginosa PA01
gccucggagaacagca

SEQ ID NO: 3397414 - RNA, 22 nt, Pseudomonas aeruginosa PA01
gccucggagaacagcagcggca

SEQ ID NO: 3397415 - RNA, 23 nt, Pseudomonas aeruginosa PA01
gccucggagaacagcagcggcac

SEQ ID NO: 3397416 - RNA, 14 nt, Pseudomonas aeruginosa PA01
gccucggaggccuu

SEQ ID NO: 3397417 - RNA, 13 nt, Pseudomonas aeruginosa PA01
gccucggcagggc

SEQ ID NO: 3397418 - RNA, 16 nt, Pseudomonas aeruginosa PA01
gccucggcagggcgcc

SEQ ID NO: 3397419 - RNA, 18 nt, Pseudomonas aeruginosa PA01
gccucggcagggcgcccg

SEQ ID NO: 3397420 - RNA, 19 nt, Pseudomonas aeruginosa PA01
gccucggcagggcgcccgc

SEQ ID NO: 3397421 - RNA, 15 nt, Pseudomonas aeruginosa PA01
gccucggcauccucg

SEQ ID NO: 3397422 - RNA, 17 nt, Pseudomonas aeruginosa PA01
gccucggcauccucgcc

SEQ ID NO: 3397423 - RNA, 21 nt, Pseudomonas aeruginosa PA01
gccucggcauccucgccccgc

SEQ ID NO: 3397424 - RNA, 14 nt, Pseudomonas aeruginosa PA01
gccucggcaucgac

SEQ ID NO: 3397425 - RNA, 18 nt, Pseudomonas aeruginosa PA01
gccucggcaucgaccagg

SEQ ID NO: 3397426 - RNA, 19 nt, Pseudomonas aeruginosa PA01
gccucggcaucgaccaggg

SEQ ID NO: 3397427 - RNA, 15 nt, Pseudomonas aeruginosa PA01
gccucggccagcgcc

SEQ ID NO: 3397428 - RNA, 16 nt, Pseudomonas aeruginosa PA01
gccucggccaucgagc

SEQ ID NO: 3397429 - RNA, 22 nt, Pseudomonas aeruginosa PA01
gccucggccaucgagcgcucca

SEQ ID NO: 3397430 - RNA, 17 nt, Pseudomonas aeruginosa PA01
gccucggcccuggcggc

SEQ ID NO: 3397431 - RNA, 18 nt, Pseudomonas aeruginosa PA01
gccucggcccuggcggcg

SEQ ID NO: 3397432 - RNA, 15 nt, Pseudomonas aeruginosa PA01
gccucggccuggucg

SEQ ID NO: 3397433 - RNA, 11 nt, Pseudomonas aeruginosa PA01
gccucggcgaa

SEQ ID NO: 3397434 - RNA, 17 nt, Pseudomonas aeruginosa PA01
gccucggcgaagucgcc

SEQ ID NO: 3397435 - RNA, 21 nt, Pseudomonas aeruginosa PA01
gccucggcgaagucgccgucg

SEQ ID NO: 3397436 - RNA, 22 nt, Pseudomonas aeruginosa PA01
gccucggcgaagucgccgucgu

SEQ ID NO: 3397437 - RNA, 14 nt, Pseudomonas aeruginosa PA01
gccucggcgaucgc

SEQ ID NO: 3397438 - RNA, 19 nt, Pseudomonas aeruginosa PA01
gccucggcgaugccggaga

SEQ ID NO: 3397439 - RNA, 22 nt, Pseudomonas aeruginosa PA01
gccucggcgcaguagucgaccg

SEQ ID NO: 3397440 - RNA, 21 nt, Pseudomonas aeruginosa PA01
gccucggcgcgauccuccgcc

SEQ ID NO: 3397441 - RNA, 17 nt, Pseudomonas aeruginosa PA01
gccucggcgcgcgcccc

SEQ ID NO: 3397442 - RNA, 21 nt, Pseudomonas aeruginosa PA01
gccucggcggacagcccgcgc

SEQ ID NO: 3397443 - RNA, 12 nt, Pseudomonas aeruginosa PA01
gccucggcggcg

SEQ ID NO: 3397444 - RNA, 13 nt, Pseudomonas aeruginosa PA01
gccucggcggcgc

SEQ ID NO: 3397445 - RNA, 15 nt, Pseudomonas aeruginosa PA01
gccucggcggcggcc

SEQ ID NO: 3397446 - RNA, 16 nt, Pseudomonas aeruginosa PA01
gccucggcggcggccu

SEQ ID NO: 3397447 - RNA, 18 nt, Pseudomonas aeruginosa PA01
gccucggcggcggccugc

SEQ ID NO: 3397448 - RNA, 21 nt, Pseudomonas aeruginosa PA01
gccucggcggcggccugcucg

SEQ ID NO: 3397449 - RNA, 14 nt, Pseudomonas aeruginosa PA01
gccucggcgggaga

SEQ ID NO: 3397450 - RNA, 20 nt, Pseudomonas aeruginosa PA01
gccucggcgggagagggcgg

SEQ ID NO: 3397451 - RNA, 21 nt, Pseudomonas aeruginosa PA01
gccucggcgggagagggcggc

SEQ ID NO: 3397452 - RNA, 23 nt, Pseudomonas aeruginosa PA01
gccucggcguccuugggaucguc

SEQ ID NO: 3397453 - RNA, 18 nt, Pseudomonas aeruginosa PA01
gccucggcgucgcgcagg

SEQ ID NO: 3397454 - RNA, 19 nt, Pseudomonas aeruginosa PA01
gccucggcgucgcgcaggc

SEQ ID NO: 3397455 - RNA, 21 nt, Pseudomonas aeruginosa PA01
gccucgggccaugagcagggc

SEQ ID NO: 3397456 - RNA, 16 nt, Pseudomonas aeruginosa PA01
gccucgggccggagca

SEQ ID NO: 3397457 - RNA, 20 nt, Pseudomonas aeruginosa PA01
gccucgggccggagcaggcc

SEQ ID NO: 3397458 - RNA, 14 nt, Pseudomonas aeruginosa PA01
gccucgggcgagcg

SEQ ID NO: 3397459 - RNA, 19 nt, Pseudomonas aeruginosa PA01
gccucgggcgagcgcagac

SEQ ID NO: 3397460 - RNA, 15 nt, Pseudomonas aeruginosa PA01
gccucggggccgucc

SEQ ID NO: 3397461 - RNA, 17 nt, Pseudomonas aeruginosa PA01
gccucggggccguccgc

SEQ ID NO: 3397462 - RNA, 21 nt, Pseudomonas aeruginosa PA01
gccucggggccguccgccagg

SEQ ID NO: 3397463 - RNA, 23 nt, Pseudomonas aeruginosa PA01
gccucggggccguccgccagguc

SEQ ID NO: 3397464 - RNA, 14 nt, Pseudomonas aeruginosa PA01
gccucggucaggcg

SEQ ID NO: 3397465 - RNA, 16 nt, Pseudomonas aeruginosa PA01
gccucggucaggcgcu

SEQ ID NO: 3397466 - RNA, 21 nt, Pseudomonas aeruginosa PA01
gccucggucaggcgcugguga

SEQ ID NO: 3397467 - RNA, 22 nt, Pseudomonas aeruginosa PA01
gccucggucagguauucgccgg

SEQ ID NO: 3397468 - RNA, 23 nt, Pseudomonas aeruginosa PA01
gccucggucagguauucgccggc

SEQ ID NO: 3397469 - RNA, 16 nt, Pseudomonas aeruginosa PA01
gccucgguggcccacu

SEQ ID NO: 3397470 - RNA, 20 nt, Pseudomonas aeruginosa PA01
gccucgguggcccacuccag

SEQ ID NO: 3397471 - RNA, 18 nt, Pseudomonas aeruginosa PA01
gccucgguuuccggccag

SEQ ID NO: 3397472 - RNA, 21 nt, Pseudomonas aeruginosa PA01
gccucgguuuccggccaggcg

SEQ ID NO: 3397473 - RNA, 16 nt, Pseudomonas aeruginosa PA01
gccucguaggcggcgc

SEQ ID NO: 3397474 - RNA, 20 nt, Pseudomonas aeruginosa PA01
gccucgucgacgcccuggcg

SEQ ID NO: 3397475 - RNA, 19 nt, Pseudomonas aeruginosa PA01
gccucgucgacgcucagca

SEQ ID NO: 3397476 - RNA, 18 nt, Pseudomonas aeruginosa PA01
gccucgucgaucucgccg

SEQ ID NO: 3397477 - RNA, 19 nt, Pseudomonas aeruginosa PA01
gccucgucgaucucgccga

SEQ ID NO: 3397478 - RNA, 13 nt, Pseudomonas aeruginosa PA01
gccucgucgcccg

SEQ ID NO: 3397479 - RNA, 14 nt, Pseudomonas aeruginosa PA01
gccucgucgcgcca

SEQ ID NO: 3397480 - RNA, 17 nt, Pseudomonas aeruginosa PA01
gccucgucgcgccaggc

SEQ ID NO: 3397481 - RNA, 18 nt, Pseudomonas aeruginosa PA01
gccucgucgcgccaggcg

SEQ ID NO: 3397482 - RNA, 20 nt, Pseudomonas aeruginosa PA01
gccucgucgcgccaggcgaa

SEQ ID NO: 3397483 - RNA, 16 nt, Pseudomonas aeruginosa PA01
gccugcguuucgccgg

SEQ ID NO: 3397484 - RNA, 18 nt, Pseudomonas aeruginosa PA01
gccugcguuucgccgggc

SEQ ID NO: 3397485 - RNA, 11 nt, Pseudomonas aeruginosa PA01
gccugcucagc

SEQ ID NO: 3397486 - RNA, 17 nt, Pseudomonas aeruginosa PA01
gccugcuccagcggagc

SEQ ID NO: 3397487 - RNA, 13 nt, Pseudomonas aeruginosa PA01
gccugcuccucgg

SEQ ID NO: 3397488 - RNA, 14 nt, Pseudomonas aeruginosa PA01
gccugcuccucggc

SEQ ID NO: 3397489 - RNA, 15 nt, Pseudomonas aeruginosa PA01
gccugcuccucggca

SEQ ID NO: 3397490 - RNA, 16 nt, Pseudomonas aeruginosa PA01
gccugcuccucggcag

SEQ ID NO: 3397491 - RNA, 17 nt, Pseudomonas aeruginosa PA01
gccugcuccucggcagc

SEQ ID NO: 3397492 - RNA, 21 nt, Pseudomonas aeruginosa PA01
gccugcuccucggcagcgcug

SEQ ID NO: 3397493 - RNA, 16 nt, Pseudomonas aeruginosa PA01
gccugcucgaacggcg

SEQ ID NO: 3397494 - RNA, 18 nt, Pseudomonas aeruginosa PA01
gccugcucgaacggcgga

SEQ ID NO: 3397495 - RNA, 21 nt, Pseudomonas aeruginosa PA01
gccugcucgaacggcggaucg

SEQ ID NO: 3397496 - RNA, 23 nt, Pseudomonas aeruginosa PA01
gccugcucgaacggcggaucgau

SEQ ID NO: 3397497 - RNA, 13 nt, Pseudomonas aeruginosa PA01
gccugcucgccgc

SEQ ID NO: 3397498 - RNA, 15 nt, Pseudomonas aeruginosa PA01
gccugcucgccgcug

SEQ ID NO: 3397499 - RNA, 20 nt, Pseudomonas aeruginosa PA01
gccugcucgcgcagccaggc

SEQ ID NO: 3397500 - RNA, 21 nt, Pseudomonas aeruginosa PA01
gccugcucgcgcagccaggcg

SEQ ID NO: 3397501 - RNA, 19 nt, Pseudomonas aeruginosa PA01
gccugcucgcggcuggccg

SEQ ID NO: 3397502 - RNA, 20 nt, Pseudomonas aeruginosa PA01
gccugcucgcggcuggccgc

SEQ ID NO: 3397503 - RNA, 21 nt, Pseudomonas aeruginosa PA01
gccugcucgcggcuggccgcc

SEQ ID NO: 3397504 - RNA, 11 nt, Pseudomonas aeruginosa PA01
gccugcucggc

SEQ ID NO: 3397505 - RNA, 15 nt, Pseudomonas aeruginosa PA01
gccugcucggccugc

SEQ ID NO: 3397506 - RNA, 21 nt, Pseudomonas aeruginosa PA01
gccugcucggccugcugcgcc

SEQ ID NO: 3397507 - RNA, 14 nt, Pseudomonas aeruginosa PA01
gccugcucuucggc

SEQ ID NO: 3397508 - RNA, 21 nt, Pseudomonas aeruginosa PA01
gccugcucuucggcggccagc

SEQ ID NO: 3397509 - RNA, 15 nt, Pseudomonas aeruginosa PA01
gccugcugcgccggc

SEQ ID NO: 3397510 - RNA, 13 nt, Pseudomonas aeruginosa PA01
gccugcugcgcgg

SEQ ID NO: 3397511 - RNA, 16 nt, Pseudomonas aeruginosa PA01
gccugcugcgcgggug

SEQ ID NO: 3397512 - RNA, 16 nt, Pseudomonas aeruginosa PA01
gccugcugcgcgugua

SEQ ID NO: 3397513 - RNA, 12 nt, Pseudomonas aeruginosa PA01
gccugcugcggg

SEQ ID NO: 3397514 - RNA, 14 nt, Pseudomonas aeruginosa PA01
gccugcugcgggcg

SEQ ID NO: 3397515 - RNA, 20 nt, Pseudomonas aeruginosa PA01
gccugcugcgggucgcgggu

SEQ ID NO: 3397516 - RNA, 21 nt, Pseudomonas aeruginosa PA01
gccugcugcucgaccgccugc

SEQ ID NO: 3397517 - RNA, 22 nt, Pseudomonas aeruginosa PA01
gccugcugcucgaccgccugcu

SEQ ID NO: 3397518 - RNA, 17 nt, Pseudomonas aeruginosa PA01
gccugcuggccggugcc

SEQ ID NO: 3397519 - RNA, 12 nt, Pseudomonas aeruginosa PA01
gccugcuggccu

SEQ ID NO: 3397520 - RNA, 13 nt, Pseudomonas aeruginosa PA01
gccugcuggccug

SEQ ID NO: 3397521 - RNA, 15 nt, Pseudomonas aeruginosa PA01
gccugcuggccuggg

SEQ ID NO: 3397522 - RNA, 21 nt, Pseudomonas aeruginosa PA01
gccugcuggccugggacggcg

SEQ ID NO: 3397523 - RNA, 16 nt, Pseudomonas aeruginosa PA01
gccugcuggcugccca

SEQ ID NO: 3397524 - RNA, 23 nt, Pseudomonas aeruginosa PA01
gccugcuggcugcccaguugcgc

SEQ ID NO: 3397525 - RNA, 22 nt, Pseudomonas aeruginosa PA01
gccugcuucagcccggcaccag

SEQ ID NO: 3397526 - RNA, 13 nt, Pseudomonas aeruginosa PA01
gccugcuucaggu

SEQ ID NO: 3397527 - RNA, 22 nt, Pseudomonas aeruginosa PA01
gccugcuucaggucgucgggca

SEQ ID NO: 3397528 - RNA, 23 nt, Pseudomonas aeruginosa PA01
gccugcuucaggucgucgggcag

SEQ ID NO: 3397529 - RNA, 20 nt, Pseudomonas aeruginosa PA01
gccugcuugaaauggcggac

SEQ ID NO: 3397530 - RNA, 15 nt, Pseudomonas aeruginosa PA01
gccugcuuggcggcg

SEQ ID NO: 3397531 - RNA, 18 nt, Pseudomonas aeruginosa PA01
gccugcuuggcggcggug

SEQ ID NO: 3397532 - RNA, 18 nt, Pseudomonas aeruginosa PA01
gccugcuuucccugcugc

SEQ ID NO: 3397533 - RNA, 13 nt, Pseudomonas aeruginosa PA01
gccuggaacacca

SEQ ID NO: 3397534 - RNA, 16 nt, Pseudomonas aeruginosa PA01
gccuggaacaccaggc

SEQ ID NO: 3397535 - RNA, 19 nt, Pseudomonas aeruginosa PA01
gccuggaacaccaggccgc

SEQ ID NO: 3397536 - RNA, 21 nt, Pseudomonas aeruginosa PA01
gccuggaacaccaggccgcaa

SEQ ID NO: 3397537 - RNA, 13 nt, Pseudomonas aeruginosa PA01
gccuggaaccgcu

SEQ ID NO: 3397538 - RNA, 16 nt, Pseudomonas aeruginosa PA01
gccuggaacuggucgg

SEQ ID NO: 3397539 - RNA, 19 nt, Pseudomonas aeruginosa PA01
gccuggaacuggucggggc

SEQ ID NO: 3397540 - RNA, 16 nt, Pseudomonas aeruginosa PA01
gccuggaaggcgcugg

SEQ ID NO: 3397541 - RNA, 20 nt, Pseudomonas aeruginosa PA01
gccuggaaggcgcugggcgg

SEQ ID NO: 3397542 - RNA, 18 nt, Pseudomonas aeruginosa PA01
gccuggaauaccccgcgg

SEQ ID NO: 3397543 - RNA, 16 nt, Pseudomonas aeruginosa PA01
gccuggaccaggucga

SEQ ID NO: 3397544 - RNA, 20 nt, Pseudomonas aeruginosa PA01
gccuggagaaacucgcgggc

SEQ ID NO: 3397545 - RNA, 18 nt, Pseudomonas aeruginosa PA01
gccuggagcagaaccgcc

SEQ ID NO: 3397546 - RNA, 21 nt, Pseudomonas aeruginosa PA01
gccuggagcagaaccgccagc

SEQ ID NO: 3397547 - RNA, 15 nt, Pseudomonas aeruginosa PA01
gccuggagcgccucg

SEQ ID NO: 3397548 - RNA, 17 nt, Pseudomonas aeruginosa PA01
gccuggaguugugccag

SEQ ID NO: 3397549 - RNA, 17 nt, Pseudomonas aeruginosa PA01
gccuggaucagcgccuc

SEQ ID NO: 3397550 - RNA, 23 nt, Pseudomonas aeruginosa PA01
gccuggaucagcgccucgaccuc

SEQ ID NO: 3397551 - RNA, 18 nt, Pseudomonas aeruginosa PA01
gccuggaucucggcggcc

SEQ ID NO: 3397552 - RNA, 19 nt, Pseudomonas aeruginosa PA01
gccuggaucucggcggcca

SEQ ID NO: 3397553 - RNA, 16 nt, Pseudomonas aeruginosa PA01
gccuggaucucugcga

SEQ ID NO: 3397554 - RNA, 23 nt, Pseudomonas aeruginosa PA01
gccuggaugaucgcgugggccac

SEQ ID NO: 3397555 - RNA, 16 nt, Pseudomonas aeruginosa PA01
gccuggcaaccgucga

SEQ ID NO: 3397556 - RNA, 17 nt, Pseudomonas aeruginosa PA01
gccuggcagguccgacg

SEQ ID NO: 3397557 - RNA, 13 nt, Pseudomonas aeruginosa PA01
gccuggcaggucg

SEQ ID NO: 3397558 - RNA, 17 nt, Pseudomonas aeruginosa PA01
gccuggcaguugcagua

SEQ ID NO: 3397559 - RNA, 16 nt, Pseudomonas aeruginosa PA01
gccuggccacccuugu

SEQ ID NO: 3397560 - RNA, 18 nt, Pseudomonas aeruginosa PA01
gccuggccacccuugugg

SEQ ID NO: 3397561 - RNA, 14 nt, Pseudomonas aeruginosa PA01
gccuggccacgcca

SEQ ID NO: 3397562 - RNA, 17 nt, Pseudomonas aeruginosa PA01
gccuggccagcgucgcc

SEQ ID NO: 3397563 - RNA, 14 nt, Pseudomonas aeruginosa PA01
gccuggccaggcgc

SEQ ID NO: 3397564 - RNA, 17 nt, Pseudomonas aeruginosa PA01
gccuggccaggcgcucc

SEQ ID NO: 3397565 - RNA, 14 nt, Pseudomonas aeruginosa PA01
gccuggcccuggac

SEQ ID NO: 3397566 - RNA, 14 nt, Pseudomonas aeruginosa PA01
gccuggcccuggcg

SEQ ID NO: 3397567 - RNA, 22 nt, Pseudomonas aeruginosa PA01
gccuggcccuggcgcaggcggc

SEQ ID NO: 3397568 - RNA, 15 nt, Pseudomonas aeruginosa PA01
gccuggccgcccagg

SEQ ID NO: 3397569 - RNA, 13 nt, Pseudomonas aeruginosa PA01
gccuggccgcgca

SEQ ID NO: 3397570 - RNA, 16 nt, Pseudomonas aeruginosa PA01
gccuggccgcgcagga

SEQ ID NO: 3397571 - RNA, 13 nt, Pseudomonas aeruginosa PA01
gccuggccggcca

SEQ ID NO: 3397572 - RNA, 14 nt, Pseudomonas aeruginosa PA01
gccuggccggccag

SEQ ID NO: 3397573 - RNA, 16 nt, Pseudomonas aeruginosa PA01
gccuggccgucuucca

SEQ ID NO: 3397574 - RNA, 20 nt, Pseudomonas aeruginosa PA01
gccuggccgucuuccagggc

SEQ ID NO: 3397575 - RNA, 18 nt, Pseudomonas aeruginosa PA01
gccuggccuggaacuggu

SEQ ID NO: 3397576 - RNA, 14 nt, Pseudomonas aeruginosa PA01
gccuggcgcaacgc

SEQ ID NO: 3397577 - RNA, 18 nt, Pseudomonas aeruginosa PA01
gccuggcgcaacgccggc

SEQ ID NO: 3397578 - RNA, 19 nt, Pseudomonas aeruginosa PA01
gccuggcgcaacgccggca

SEQ ID NO: 3397579 - RNA, 17 nt, Pseudomonas aeruginosa PA01
gccuggcgcaaggugcc

SEQ ID NO: 3397580 - RNA, 21 nt, Pseudomonas aeruginosa PA01
gccuggcgcaaggugccgagg

SEQ ID NO: 3397581 - RNA, 16 nt, Pseudomonas aeruginosa PA01
gccuggcgcagcggca

SEQ ID NO: 3397582 - RNA, 17 nt, Pseudomonas aeruginosa PA01
gccuggcgcauggcgcu

SEQ ID NO: 3397583 - RNA, 19 nt, Pseudomonas aeruginosa PA01
gccuggcgcgacgaggcgc

SEQ ID NO: 3397584 - RNA, 22 nt, Pseudomonas aeruginosa PA01
gccuggcgcgacgaggcgcggc

SEQ ID NO: 3397585 - RNA, 13 nt, Pseudomonas aeruginosa PA01
gccuggcgcgcgc

SEQ ID NO: 3397586 - RNA, 23 nt, Pseudomonas aeruginosa PA01
gccuggcgcgcgcgccaggucga

SEQ ID NO: 3397587 - RNA, 12 nt, Pseudomonas aeruginosa PA01
gccuggcgcuca

SEQ ID NO: 3397588 - RNA, 16 nt, Pseudomonas aeruginosa PA01
gccuggcgcucagcgc

SEQ ID NO: 3397589 - RNA, 19 nt, Pseudomonas aeruginosa PA01
gccuggcgcucagcgccgc

SEQ ID NO: 3397590 - RNA, 12 nt, Pseudomonas aeruginosa PA01
gccuggcggcug

SEQ ID NO: 3397591 - RNA, 13 nt, Pseudomonas aeruginosa PA01
gccuggcggcugg

SEQ ID NO: 3397592 - RNA, 22 nt, Pseudomonas aeruginosa PA01
gccuggcgguugaugccgacgu

SEQ ID NO: 3397593 - RNA, 19 nt, Pseudomonas aeruginosa PA01
gccuggcgucccguugcgc

SEQ ID NO: 3397594 - RNA, 16 nt, Pseudomonas aeruginosa PA01
gccuggcgucgcacug

SEQ ID NO: 3397595 - RNA, 21 nt, Pseudomonas aeruginosa PA01
gccuggcgucgcacugcugcu

SEQ ID NO: 3397596 - RNA, 13 nt, Pseudomonas aeruginosa PA01
gccuggcgugccg

SEQ ID NO: 3397597 - RNA, 15 nt, Pseudomonas aeruginosa PA01
gccuggcgugccgcc

SEQ ID NO: 3397598 - RNA, 16 nt, Pseudomonas aeruginosa PA01
gccuggcgugccgcca

SEQ ID NO: 3397599 - RNA, 21 nt, Pseudomonas aeruginosa PA01
gccuggcuacgcuccguaggg

SEQ ID NO: 3397600 - RNA, 20 nt, Pseudomonas aeruginosa PA01
gccuggcucaugucguggac

SEQ ID NO: 3397601 - RNA, 17 nt, Pseudomonas aeruginosa PA01
gccuggcucgaucggca

SEQ ID NO: 3397602 - RNA, 20 nt, Pseudomonas aeruginosa PA01
gccuggcucgaucggcaggg

SEQ ID NO: 3397603 - RNA, 23 nt, Pseudomonas aeruginosa PA01
gccuggcucgaucggcagggcgc

SEQ ID NO: 3397604 - RNA, 16 nt, Pseudomonas aeruginosa PA01
gccuggcugccgagca

SEQ ID NO: 3397605 - RNA, 13 nt, Pseudomonas aeruginosa PA01
gccuggcuggcca

SEQ ID NO: 3397606 - RNA, 14 nt, Pseudomonas aeruginosa PA01
gccuggcuggccag

SEQ ID NO: 3397607 - RNA, 17 nt, Pseudomonas aeruginosa PA01
gccuggcuggccagcag

SEQ ID NO: 3397608 - RNA, 20 nt, Pseudomonas aeruginosa PA01
gccuggcuggccagcaggcu

SEQ ID NO: 3397609 - RNA, 22 nt, Pseudomonas aeruginosa PA01
gccugggacggaacgucggccu

SEQ ID NO: 3397610 - RNA, 15 nt, Pseudomonas aeruginosa PA01
gccugggcaagcugc

SEQ ID NO: 3397611 - RNA, 19 nt, Pseudomonas aeruginosa PA01
gccugggcaagcugcacgg

SEQ ID NO: 3397612 - RNA, 20 nt, Pseudomonas aeruginosa PA01
gccugggcaagcugcacggc

SEQ ID NO: 3397613 - RNA, 21 nt, Pseudomonas aeruginosa PA01
gccugggccgaaggccaggcc

SEQ ID NO: 3397614 - RNA, 13 nt, Pseudomonas aeruginosa PA01
gccugggccgcga

SEQ ID NO: 3397615 - RNA, 13 nt, Pseudomonas aeruginosa PA01
gccugggccgcgc

SEQ ID NO: 3397616 - RNA, 14 nt, Pseudomonas aeruginosa PA01
gccugggccgcgcu

SEQ ID NO: 3397617 - RNA, 21 nt, Pseudomonas aeruginosa PA01
gccugggccgcgcugucggcc

SEQ ID NO: 3397618 - RNA, 14 nt, Pseudomonas aeruginosa PA01
gccugggcgcaggc

SEQ ID NO: 3397619 - RNA, 16 nt, Pseudomonas aeruginosa PA01
gccugggcgcaggccg

SEQ ID NO: 3397620 - RNA, 17 nt, Pseudomonas aeruginosa PA01
gccugggcgcaggccga

SEQ ID NO: 3397621 - RNA, 12 nt, Pseudomonas aeruginosa PA01
gccugggcgccg

SEQ ID NO: 3397622 - RNA, 19 nt, Pseudomonas aeruginosa PA01
gccugggcguagaguucgc

SEQ ID NO: 3397623 - RNA, 19 nt, Pseudomonas aeruginosa PA01
gccuggggcucggcuucca

SEQ ID NO: 3397624 - RNA, 23 nt, Pseudomonas aeruginosa PA01
gccugggggucuacgugauccgu

SEQ ID NO: 3397625 - RNA, 19 nt, Pseudomonas aeruginosa PA01
gccugggguagccggccga

SEQ ID NO: 3397626 - RNA, 20 nt, Pseudomonas aeruginosa PA01
gccugggguagccggccgau

SEQ ID NO: 3397627 - RNA, 14 nt, Pseudomonas aeruginosa PA01
gccuggggugcagc

SEQ ID NO: 3397628 - RNA, 21 nt, Pseudomonas aeruginosa PA01
gccuggggugcagcagguucc

SEQ ID NO: 3397629 - RNA, 18 nt, Pseudomonas aeruginosa PA01
gccugggucaccagcacc

SEQ ID NO: 3397630 - RNA, 19 nt, Pseudomonas aeruginosa PA01
gccugggucaccagcacca

SEQ ID NO: 3397631 - RNA, 16 nt, Pseudomonas aeruginosa PA01
gccugggugaacagcg

SEQ ID NO: 3397632 - RNA, 19 nt, Pseudomonas aeruginosa PA01
gccugggugaacagcggcc

SEQ ID NO: 3397633 - RNA, 22 nt, Pseudomonas aeruginosa PA01
gccugggugaacagcggcccga

SEQ ID NO: 3397634 - RNA, 22 nt, Pseudomonas aeruginosa PA01
gccugggugauuucuucagccu

SEQ ID NO: 3397635 - RNA, 18 nt, Pseudomonas aeruginosa PA01
gccugguaggccucgaug

SEQ ID NO: 3397636 - RNA, 16 nt, Pseudomonas aeruginosa PA01
gccugguccagcaggu

SEQ ID NO: 3397637 - RNA, 19 nt, Pseudomonas aeruginosa PA01
gccugguccagcagguucu

SEQ ID NO: 3397638 - RNA, 14 nt, Pseudomonas aeruginosa PA01
gccuggucgaaagc

SEQ ID NO: 3397639 - RNA, 20 nt, Pseudomonas aeruginosa PA01
gccuggucgaaagccugccg

SEQ ID NO: 3397640 - RNA, 21 nt, Pseudomonas aeruginosa PA01
gccuggucgaaagccugccgg

SEQ ID NO: 3397641 - RNA, 16 nt, Pseudomonas aeruginosa PA01
gccuggucggcgcggc

SEQ ID NO: 3397642 - RNA, 17 nt, Pseudomonas aeruginosa PA01
gccuggucggcgcggcg

SEQ ID NO: 3397643 - RNA, 20 nt, Pseudomonas aeruginosa PA01
gccuggucggcgcggcgcuc

SEQ ID NO: 3397644 - RNA, 19 nt, Pseudomonas aeruginosa PA01
gccuggucggggccggcga

SEQ ID NO: 3397645 - RNA, 23 nt, Pseudomonas aeruginosa PA01
gccuggucgucguaguggccguc

SEQ ID NO: 3397646 - RNA, 17 nt, Pseudomonas aeruginosa PA01
gccuggugcaccuggcg

SEQ ID NO: 3397647 - RNA, 18 nt, Pseudomonas aeruginosa PA01
gccuggugcaccuggcga

SEQ ID NO: 3397648 - RNA, 16 nt, Pseudomonas aeruginosa PA01
gccuggugcacgccga

SEQ ID NO: 3397649 - RNA, 20 nt, Pseudomonas aeruginosa PA01
gccuggugcacgccgauggc

SEQ ID NO: 3397650 - RNA, 16 nt, Pseudomonas aeruginosa PA01
gccuggugcaggucgc

SEQ ID NO: 3397651 - RNA, 21 nt, Pseudomonas aeruginosa PA01
gccuggugcccgaugccgcgc

SEQ ID NO: 3397652 - RNA, 22 nt, Pseudomonas aeruginosa PA01
gccuggugcccgaugccgcgcc

SEQ ID NO: 3397653 - RNA, 15 nt, Pseudomonas aeruginosa PA01
gccuggugccgggcu

SEQ ID NO: 3397654 - RNA, 18 nt, Pseudomonas aeruginosa PA01
gccugguucccucaaccg

SEQ ID NO: 3397655 - RNA, 16 nt, Pseudomonas aeruginosa PA01
gccugguucugcuccg

SEQ ID NO: 3397656 - RNA, 20 nt, Pseudomonas aeruginosa PA01
gccugguuguaggcgccgcc

SEQ ID NO: 3397657 - RNA, 22 nt, Pseudomonas aeruginosa PA01
gccuguaccccguagcgcucgg

SEQ ID NO: 3397658 - RNA, 18 nt, Pseudomonas aeruginosa PA01
gccuguaccgcuuccugg

SEQ ID NO: 3397659 - RNA, 21 nt, Pseudomonas aeruginosa PA01
gccuguaccgcuuccugggcu

SEQ ID NO: 3397660 - RNA, 23 nt, Pseudomonas aeruginosa PA01
gccugucacucaggcaugcgggc

SEQ ID NO: 3397661 - RNA, 19 nt, Pseudomonas aeruginosa PA01
gccugucgauuucccccgg

SEQ ID NO: 3397662 - RNA, 16 nt, Pseudomonas aeruginosa PA01
gccugucgcagcgggc

SEQ ID NO: 3397663 - RNA, 19 nt, Pseudomonas aeruginosa PA01
gccugugcaccgaagggaa

SEQ ID NO: 3397664 - RNA, 19 nt, Pseudomonas aeruginosa PA01
gccuguggauagaaaagca

SEQ ID NO: 3397665 - RNA, 23 nt, Pseudomonas aeruginosa PA01
gccuguggauagaaaagcaagga

SEQ ID NO: 3397666 - RNA, 20 nt, Pseudomonas aeruginosa PA01
gccuguggcguuauucgccc

SEQ ID NO: 3397667 - RNA, 16 nt, Pseudomonas aeruginosa PA01
gccuguuccagggccu

SEQ ID NO: 3397668 - RNA, 19 nt, Pseudomonas aeruginosa PA01
gccuguuccagggccugcu

SEQ ID NO: 3397669 - RNA, 19 nt, Pseudomonas aeruginosa PA01
gccuguuccuccgccaggu

SEQ ID NO: 3397670 - RNA, 12 nt, Pseudomonas aeruginosa PA01
gccuguucgccc

SEQ ID NO: 3397671 - RNA, 17 nt, Pseudomonas aeruginosa PA01
gccuguucgcccaaggc

SEQ ID NO: 3397672 - RNA, 18 nt, Pseudomonas aeruginosa PA01
gccuguucgcccaaggcc

SEQ ID NO: 3397673 - RNA, 22 nt, Pseudomonas aeruginosa PA01
gccuguucgcccaaggccaggu

SEQ ID NO: 3397674 - RNA, 13 nt, Pseudomonas aeruginosa PA01
gccuguucggccu

SEQ ID NO: 3397675 - RNA, 16 nt, Pseudomonas aeruginosa PA01
gccuucaccgcgccgc

SEQ ID NO: 3397676 - RNA, 20 nt, Pseudomonas aeruginosa PA01
gccuucaccgcgccgcgcuu

SEQ ID NO: 3397677 - RNA, 20 nt, Pseudomonas aeruginosa PA01
gccuucaccguucccagcag

SEQ ID NO: 3397678 - RNA, 22 nt, Pseudomonas aeruginosa PA01
gccuucagccccagcacgccga

SEQ ID NO: 3397679 - RNA, 21 nt, Pseudomonas aeruginosa PA01
gccuucagcgccagcaggcga

SEQ ID NO: 3397680 - RNA, 19 nt, Pseudomonas aeruginosa PA01
gccuucagcgccgccaggc

SEQ ID NO: 3397681 - RNA, 16 nt, Pseudomonas aeruginosa PA01
gccuucagcgccucca

SEQ ID NO: 3397682 - RNA, 15 nt, Pseudomonas aeruginosa PA01
gccuucaggcgcucc

SEQ ID NO: 3397683 - RNA, 20 nt, Pseudomonas aeruginosa PA01
gccuucaggcgggcucuuug

SEQ ID NO: 3397684 - RNA, 20 nt, Pseudomonas aeruginosa PA01
gccuucaguucguugggccg

SEQ ID NO: 3397685 - RNA, 14 nt, Pseudomonas aeruginosa PA01
gccuuccaccacca

SEQ ID NO: 3397686 - RNA, 16 nt, Pseudomonas aeruginosa PA01
gccuuccaccaccagg

SEQ ID NO: 3397687 - RNA, 18 nt, Pseudomonas aeruginosa PA01
gccuuccaccaccagggu

SEQ ID NO: 3397688 - RNA, 20 nt, Pseudomonas aeruginosa PA01
gccuugcguaccagcgcgca

SEQ ID NO: 3397689 - RNA, 23 nt, Pseudomonas aeruginosa PA01
gccuugcguaccagcgcgcagcg

SEQ ID NO: 3397690 - RNA, 12 nt, Pseudomonas aeruginosa PA01
gccuugcucagg

SEQ ID NO: 3397691 - RNA, 17 nt, Pseudomonas aeruginosa PA01
gccuugcucaggucguc

SEQ ID NO: 3397692 - RNA, 15 nt, Pseudomonas aeruginosa PA01
gccuugcucgacccg

SEQ ID NO: 3397693 - RNA, 20 nt, Pseudomonas aeruginosa PA01
gccuugcugaucagguugcc

SEQ ID NO: 3397694 - RNA, 17 nt, Pseudomonas aeruginosa PA01
gccuugcugcggguuga

SEQ ID NO: 3397695 - RNA, 13 nt, Pseudomonas aeruginosa PA01
gccuugcuggcga

SEQ ID NO: 3397696 - RNA, 17 nt, Pseudomonas aeruginosa PA01
gccuuggcaucgccgcc

SEQ ID NO: 3397697 - RNA, 21 nt, Pseudomonas aeruginosa PA01
gccuuggcaucgccgcccagu

SEQ ID NO: 3397698 - RNA, 19 nt, Pseudomonas aeruginosa PA01
gccuuggcaugaccgagca

SEQ ID NO: 3397699 - RNA, 17 nt, Pseudomonas aeruginosa PA01
gccuuggccacgacccu

SEQ ID NO: 3397700 - RNA, 16 nt, Pseudomonas aeruginosa PA01
gccuuggccuccaccc

SEQ ID NO: 3397701 - RNA, 18 nt, Pseudomonas aeruginosa PA01
gccuuggccuccacccgc

SEQ ID NO: 3397702 - RNA, 23 nt, Pseudomonas aeruginosa PA01
gccuuggucucgcgggcgacgaa

SEQ ID NO: 3397703 - RNA, 22 nt, Pseudomonas aeruginosa PA01
gccuuguagaguuugccgaacu

SEQ ID NO: 3397704 - RNA, 16 nt, Pseudomonas aeruginosa PA01
gccuuguucagggugg

SEQ ID NO: 3397705 - RNA, 22 nt, Pseudomonas aeruginosa PA01
gccuuguucaggguggcgaccg

SEQ ID NO: 3397706 - RNA, 15 nt, Pseudomonas aeruginosa PA01
gccuuguuccaggcg

SEQ ID NO: 3397707 - RNA, 17 nt, Pseudomonas aeruginosa PA01
gccuuguuccaggcguu

SEQ ID NO: 3397708 - RNA, 17 nt, Pseudomonas aeruginosa PA01
gccuuguucgccagcac

SEQ ID NO: 3397709 - RNA, 17 nt, Pseudomonas aeruginosa PA01
gccuuucggggugcagg

SEQ ID NO: 3397710 - RNA, 19 nt, Pseudomonas aeruginosa PA01
gccuuucuucugcugugcg

SEQ ID NO: 3397711 - RNA, 21 nt, Pseudomonas aeruginosa PA01
gccuuucuuuucugccacccg

SEQ ID NO: 3397712 - RNA, 20 nt, Pseudomonas aeruginosa PA01
gccuuuucggcggccaggcg

SEQ ID NO: 3397713 - RNA, 23 nt, Pseudomonas aeruginosa PA01
gccuuuuucauggccuggcgcuc

SEQ ID NO: 3397714 - RNA, 23 nt, Pseudomonas aeruginosa PA01
gccuuuuuugugcccgccccuuu

SEQ ID NO: 3397715 - RNA, 21 nt, Pseudomonas aeruginosa PA01
gcgaaaaauacuccgcgacgu

SEQ ID NO: 3397716 - RNA, 22 nt, Pseudomonas aeruginosa PA01
gcgaaaagcccgccaccuggcg

SEQ ID NO: 3397717 - RNA, 16 nt, Pseudomonas aeruginosa PA01
gcgaaaaucgaagggu

SEQ ID NO: 3397718 - RNA, 19 nt, Pseudomonas aeruginosa PA01
gcgaaacgccccgucgacg

SEQ ID NO: 3397719 - RNA, 21 nt, Pseudomonas aeruginosa PA01
gcgaaacgccccgucgacgca

SEQ ID NO: 3397720 - RNA, 14 nt, Pseudomonas aeruginosa PA01
gcgaaacggcaggc

SEQ ID NO: 3397721 - RNA, 17 nt, Pseudomonas aeruginosa PA01
gcgaaacggcaggccag

SEQ ID NO: 3397722 - RNA, 21 nt, Pseudomonas aeruginosa PA01
gcgaaacggcaggccagcagg

SEQ ID NO: 3397723 - RNA, 21 nt, Pseudomonas aeruginosa PA01
gcgaaacggcgcugaacagcu

SEQ ID NO: 3397724 - RNA, 13 nt, Pseudomonas aeruginosa PA01
gcgaaacggcgga

SEQ ID NO: 3397725 - RNA, 13 nt, Pseudomonas aeruginosa PA01
gcgaaacucgugc

SEQ ID NO: 3397726 - RNA, 21 nt, Pseudomonas aeruginosa PA01
gcgaaacucgugcuccaccuc

SEQ ID NO: 3397727 - RNA, 16 nt, Pseudomonas aeruginosa PA01
gcgaaagcgccccggg

SEQ ID NO: 3397728 - RNA, 15 nt, Pseudomonas aeruginosa PA01
gcgaaagcgucagcg

SEQ ID NO: 3397729 - RNA, 17 nt, Pseudomonas aeruginosa PA01
gcgaaagcgucagcgcg

SEQ ID NO: 3397730 - RNA, 20 nt, Pseudomonas aeruginosa PA01
gcgaaagcgucagcgcgcca

SEQ ID NO: 3397731 - RNA, 22 nt, Pseudomonas aeruginosa PA01
gcgaaagcgucagcgcgccagc

SEQ ID NO: 3397732 - RNA, 18 nt, Pseudomonas aeruginosa PA01
gcgaaagucggcgcgacu

SEQ ID NO: 3397733 - RNA, 16 nt, Pseudomonas aeruginosa PA01
gcgaaauccucgcgca

SEQ ID NO: 3397734 - RNA, 13 nt, Pseudomonas aeruginosa PA01
gcgaaaucggcag

SEQ ID NO: 3397735 - RNA, 15 nt, Pseudomonas aeruginosa PA01
gcgaaaucggcaggc

SEQ ID NO: 3397736 - RNA, 15 nt, Pseudomonas aeruginosa PA01
gcgaaauggcagaac

SEQ ID NO: 3397737 - RNA, 23 nt, Pseudomonas aeruginosa PA01
gcgaaauggucaccaugaucauc

SEQ ID NO: 3397738 - RNA, 15 nt, Pseudomonas aeruginosa PA01
gcgaaauugccuccg

SEQ ID NO: 3397739 - RNA, 16 nt, Pseudomonas aeruginosa PA01
gcgaacaacgccgccg

SEQ ID NO: 3397740 - RNA, 17 nt, Pseudomonas aeruginosa PA01
gcgaacaacgccgccgg

SEQ ID NO: 3397741 - RNA, 23 nt, Pseudomonas aeruginosa PA01
gcgaacaaucggucgcccucggc

SEQ ID NO: 3397742 - RNA, 18 nt, Pseudomonas aeruginosa PA01
gcgaacacaccgaccgcg

SEQ ID NO: 3397743 - RNA, 14 nt, Pseudomonas aeruginosa PA01
gcgaacaccgggcc

SEQ ID NO: 3397744 - RNA, 18 nt, Pseudomonas aeruginosa PA01
gcgaacaccgggccgccg

SEQ ID NO: 3397745 - RNA, 21 nt, Pseudomonas aeruginosa PA01
gcgaacaccgggccgccggcg

SEQ ID NO: 3397746 - RNA, 23 nt, Pseudomonas aeruginosa PA01
gcgaacaccgggccgccggcgac

SEQ ID NO: 3397747 - RNA, 15 nt, Pseudomonas aeruginosa PA01
gcgaacacgucggcg

SEQ ID NO: 3397748 - RNA, 14 nt, Pseudomonas aeruginosa PA01
gcgaacagcaccuu

SEQ ID NO: 3397749 - RNA, 24 nt, Pseudomonas aeruginosa PA01
gcgaacagcagcgguaggcgcgug

SEQ ID NO: 3397750 - RNA, 17 nt, Pseudomonas aeruginosa PA01
gcgaacagcgagacccg

SEQ ID NO: 3397751 - RNA, 22 nt, Pseudomonas aeruginosa PA01
gcgaacaggcagcgggccaggc

SEQ ID NO: 3397752 - RNA, 23 nt, Pseudomonas aeruginosa PA01
gcgaacaggcagcgggccaggcg

SEQ ID NO: 3397753 - RNA, 21 nt, Pseudomonas aeruginosa PA01
gcgaacagggccaucagggcg

SEQ ID NO: 3397754 - RNA, 13 nt, Pseudomonas aeruginosa PA01
gcgaacagggugg

SEQ ID NO: 3397755 - RNA, 14 nt, Pseudomonas aeruginosa PA01
gcgaacagguagcc

SEQ ID NO: 3397756 - RNA, 19 nt, Pseudomonas aeruginosa PA01
gcgaacagguagccccggc

SEQ ID NO: 3397757 - RNA, 22 nt, Pseudomonas aeruginosa PA01
gcgaacaguuccgacugcgagc

SEQ ID NO: 3397758 - RNA, 17 nt, Pseudomonas aeruginosa PA01
gcgaacaugaagccgcg

SEQ ID NO: 3397759 - RNA, 18 nt, Pseudomonas aeruginosa PA01
gcgaacaugaagccgcgc

SEQ ID NO: 3397760 - RNA, 19 nt, Pseudomonas aeruginosa PA01
gcgaacaugaagccgcgcg

SEQ ID NO: 3397761 - RNA, 22 nt, Pseudomonas aeruginosa PA01
gcgaacaugaagccgcgcgccg

SEQ ID NO: 3397762 - RNA, 23 nt, Pseudomonas aeruginosa PA01
gcgaacaugaagccgcgcgccga

SEQ ID NO: 3397763 - RNA, 20 nt, Pseudomonas aeruginosa PA01
gcgaaccacaccaggucgcc

SEQ ID NO: 3397764 - RNA, 21 nt, Pseudomonas aeruginosa PA01
gcgaaccacaccaggucgccg

SEQ ID NO: 3397765 - RNA, 16 nt, Pseudomonas aeruginosa PA01
gcgaaccacucggcgc

SEQ ID NO: 3397766 - RNA, 21 nt, Pseudomonas aeruginosa PA01
gcgaaccaggcaauggccggc

SEQ ID NO: 3397767 - RNA, 16 nt, Pseudomonas aeruginosa PA01
gcgaaccaggcggccg

SEQ ID NO: 3397768 - RNA, 16 nt, Pseudomonas aeruginosa PA01
gcgaacccaggccgcg

SEQ ID NO: 3397769 - RNA, 21 nt, Pseudomonas aeruginosa PA01
gcgaacccggguugaccuugu

SEQ ID NO: 3397770 - RNA, 19 nt, Pseudomonas aeruginosa PA01
gcgaaccgccggccucgcu

SEQ ID NO: 3397771 - RNA, 14 nt, Pseudomonas aeruginosa PA01
gcgaaccggccuuu

SEQ ID NO: 3397772 - RNA, 22 nt, Pseudomonas aeruginosa PA01
gcgaaccgugguucucggucgg

SEQ ID NO: 3397773 - RNA, 16 nt, Pseudomonas aeruginosa PA01
gcgaaccucgguagcc

SEQ ID NO: 3397774 - RNA, 15 nt, Pseudomonas aeruginosa PA01
gcgaacgacagcacc

SEQ ID NO: 3397775 - RNA, 19 nt, Pseudomonas aeruginosa PA01
gcgaacgacagcgaaugcu

SEQ ID NO: 3397776 - RNA, 16 nt, Pseudomonas aeruginosa PA01
gcgaacgauggugguc

SEQ ID NO: 3397777 - RNA, 23 nt, Pseudomonas aeruginosa PA01
gcgaacgaugguggucggcagcu

SEQ ID NO: 3397778 - RNA, 13 nt, Pseudomonas aeruginosa PA01
gcgaacgcccggc

SEQ ID NO: 3397779 - RNA, 19 nt, Pseudomonas aeruginosa PA01
gcgaacgcccggcuuuccu

SEQ ID NO: 3397780 - RNA, 14 nt, Pseudomonas aeruginosa PA01
gcgaacgccgcagc

SEQ ID NO: 3397781 - RNA, 17 nt, Pseudomonas aeruginosa PA01
gcgaacgcucccagccg

SEQ ID NO: 3397782 - RNA, 19 nt, Pseudomonas aeruginosa PA01
gcgaacgcucccagccgac

SEQ ID NO: 3397783 - RNA, 21 nt, Pseudomonas aeruginosa PA01
gcgaacgcucccagccgacgu

SEQ ID NO: 3397784 - RNA, 20 nt, Pseudomonas aeruginosa PA01
gcgaacgcuugagccccggc

SEQ ID NO: 3397785 - RNA, 15 nt, Pseudomonas aeruginosa PA01
gcgaacggaccgacg

SEQ ID NO: 3397786 - RNA, 16 nt, Pseudomonas aeruginosa PA01
gcgaacggcagcgucu

SEQ ID NO: 3397787 - RNA, 15 nt, Pseudomonas aeruginosa PA01
gcgaacggcaggugg

SEQ ID NO: 3397788 - RNA, 13 nt, Pseudomonas aeruginosa PA01
gcgaacggcuggu

SEQ ID NO: 3397789 - RNA, 14 nt, Pseudomonas aeruginosa PA01
gcgaacggcugguc

SEQ ID NO: 3397790 - RNA, 17 nt, Pseudomonas aeruginosa PA01
gcgaaugcuugccggcg

SEQ ID NO: 3397791 - RNA, 19 nt, Pseudomonas aeruginosa PA01
gcgaauggacaggcgcccc

SEQ ID NO: 3397792 - RNA, 15 nt, Pseudomonas aeruginosa PA01
gcgaauggcagcagg

SEQ ID NO: 3397793 - RNA, 16 nt, Pseudomonas aeruginosa PA01
gcgaauggcagcaggc

SEQ ID NO: 3397794 - RNA, 17 nt, Pseudomonas aeruginosa PA01
gcgaauggcagcaggca

SEQ ID NO: 3397795 - RNA, 18 nt, Pseudomonas aeruginosa PA01
gcgaauggcagcaggcac

SEQ ID NO: 3397796 - RNA, 16 nt, Pseudomonas aeruginosa PA01
gcgaauguccggcgac

SEQ ID NO: 3397797 - RNA, 19 nt, Pseudomonas aeruginosa PA01
gcgaauuuccugcuggcga

SEQ ID NO: 3397798 - RNA, 22 nt, Pseudomonas aeruginosa PA01
gcgaauuuccugcuggcgagcg

SEQ ID NO: 3397799 - RNA, 15 nt, Pseudomonas aeruginosa PA01
gcgaauuugaacgcu

SEQ ID NO: 3397800 - RNA, 15 nt, Pseudomonas aeruginosa PA01
gcgacaaaucggcau

SEQ ID NO: 3397801 - RNA, 14 nt, Pseudomonas aeruginosa PA01
gcgacaacccuguc

SEQ ID NO: 3397802 - RNA, 16 nt, Pseudomonas aeruginosa PA01
gcgacaacccuguccc

SEQ ID NO: 3397803 - RNA, 13 nt, Pseudomonas aeruginosa PA01
gcgacaacggccg

SEQ ID NO: 3397804 - RNA, 22 nt, Pseudomonas aeruginosa PA01
gcgacaaggcugaggccgacga

SEQ ID NO: 3397805 - RNA, 18 nt, Pseudomonas aeruginosa PA01
gcgacacauggucggcca

SEQ ID NO: 3397806 - RNA, 19 nt, Pseudomonas aeruginosa PA01
gcgacacauggucggccag

SEQ ID NO: 3397807 - RNA, 20 nt, Pseudomonas aeruginosa PA01
gcgacacauggucggccagg

SEQ ID NO: 3397808 - RNA, 18 nt, Pseudomonas aeruginosa PA01
gcgacaccaugcuccgcc

SEQ ID NO: 3397809 - RNA, 14 nt, Pseudomonas aeruginosa PA01
gcgacaccgccagc

SEQ ID NO: 3397810 - RNA, 15 nt, Pseudomonas aeruginosa PA01
gcgacaccgccagca

SEQ ID NO: 3397811 - RNA, 16 nt, Pseudomonas aeruginosa PA01
gcgacaccgccagcac

SEQ ID NO: 3397812 - RNA, 15 nt, Pseudomonas aeruginosa PA01
gcgacaccgggccuu

SEQ ID NO: 3397813 - RNA, 18 nt, Pseudomonas aeruginosa PA01
gcgacacgugccccaggc

SEQ ID NO: 3397814 - RNA, 20 nt, Pseudomonas aeruginosa PA01
gcgacacgugccccaggccg

SEQ ID NO: 3397815 - RNA, 22 nt, Pseudomonas aeruginosa PA01
gcgacagauagcaggucacgcc

SEQ ID NO: 3397816 - RNA, 14 nt, Pseudomonas aeruginosa PA01
gcgacagccgggca

SEQ ID NO: 3397817 - RNA, 19 nt, Pseudomonas aeruginosa PA01
gcgacagcucguggcuggc

SEQ ID NO: 3397818 - RNA, 22 nt, Pseudomonas aeruginosa PA01
gcgacagcucguggcuggcgcc

SEQ ID NO: 3397819 - RNA, 23 nt, Pseudomonas aeruginosa PA01
gcgacagcucguggcuggcgccg

SEQ ID NO: 3397820 - RNA, 19 nt, Pseudomonas aeruginosa PA01
gcgacagcucuggggucag

SEQ ID NO: 3397821 - RNA, 20 nt, Pseudomonas aeruginosa PA01
gcgacagcucuggggucagu

SEQ ID NO: 3397822 - RNA, 21 nt, Pseudomonas aeruginosa PA01
gcgacagcuuccagugcuuga

SEQ ID NO: 3397823 - RNA, 14 nt, Pseudomonas aeruginosa PA01
gcgacaggauggac

SEQ ID NO: 3397824 - RNA, 19 nt, Pseudomonas aeruginosa PA01
gcgacaggcccuugaacag

SEQ ID NO: 3397825 - RNA, 23 nt, Pseudomonas aeruginosa PA01
gcgacaggcccuugaacaggcug

SEQ ID NO: 3397826 - RNA, 16 nt, Pseudomonas aeruginosa PA01
gcgacaggcgaucgac

SEQ ID NO: 3397827 - RNA, 17 nt, Pseudomonas aeruginosa PA01
gcgacaggcgaucgccg

SEQ ID NO: 3397828 - RNA, 21 nt, Pseudomonas aeruginosa PA01
gcgacagguucaggacgcucc

SEQ ID NO: 3397829 - RNA, 15 nt, Pseudomonas aeruginosa PA01
gcgacauagccggcg

SEQ ID NO: 3397830 - RNA, 16 nt, Pseudomonas aeruginosa PA01
gcgacauagccggcga

SEQ ID NO: 3397831 - RNA, 19 nt, Pseudomonas aeruginosa PA01
gcgacauagccggcgaacc

SEQ ID NO: 3397832 - RNA, 16 nt, Pseudomonas aeruginosa PA01
gcgacauagcggcugc

SEQ ID NO: 3397833 - RNA, 18 nt, Pseudomonas aeruginosa PA01
gcgacauagcggcugcug

SEQ ID NO: 3397834 - RNA, 15 nt, Pseudomonas aeruginosa PA01
gcgacauccuccacc

SEQ ID NO: 3397835 - RNA, 14 nt, Pseudomonas aeruginosa PA01
gcgacaucggcgau

SEQ ID NO: 3397836 - RNA, 16 nt, Pseudomonas aeruginosa PA01
gcgacaucggcgaugg

SEQ ID NO: 3397837 - RNA, 18 nt, Pseudomonas aeruginosa PA01
gcgacaucggcgauggcc

SEQ ID NO: 3397838 - RNA, 15 nt, Pseudomonas aeruginosa PA01
gcgacaucuccaggc

SEQ ID NO: 3397839 - RNA, 18 nt, Pseudomonas aeruginosa PA01
gcgacaucuccaggccgc

SEQ ID NO: 3397840 - RNA, 20 nt, Pseudomonas aeruginosa PA01
gcgacaugccgguucccgca

SEQ ID NO: 3397841 - RNA, 13 nt, Pseudomonas aeruginosa PA01
gcgaccacaggcg

SEQ ID NO: 3397842 - RNA, 19 nt, Pseudomonas aeruginosa PA01
gcgaccacaggcggcggaa

SEQ ID NO: 3397843 - RNA, 14 nt, Pseudomonas aeruginosa PA01
gcgaccaccaccag

SEQ ID NO: 3397844 - RNA, 20 nt, Pseudomonas aeruginosa PA01
gcgaccaccaccaggucggc

SEQ ID NO: 3397845 - RNA, 21 nt, Pseudomonas aeruginosa PA01
gcgaccaccaccaggucggcg

SEQ ID NO: 3397846 - RNA, 13 nt, Pseudomonas aeruginosa PA01
gcgaccaccacgu

SEQ ID NO: 3397847 - RNA, 18 nt, Pseudomonas aeruginosa PA01
gcgaccacccggcggucc

SEQ ID NO: 3397848 - RNA, 21 nt, Pseudomonas aeruginosa PA01
gcgaccacccggcgguccgcc

SEQ ID NO: 3397849 - RNA, 20 nt, Pseudomonas aeruginosa PA01
gcgaccaccgcgaauccgcg

SEQ ID NO: 3397850 - RNA, 22 nt, Pseudomonas aeruginosa PA01
gcgaccaccgcgaauccgcggc

SEQ ID NO: 3397851 - RNA, 19 nt, Pseudomonas aeruginosa PA01
gcgaccaccuucuacaccg

SEQ ID NO: 3397852 - RNA, 22 nt, Pseudomonas aeruginosa PA01
gcgaccaccuucuacaccguac

SEQ ID NO: 3397853 - RNA, 17 nt, Pseudomonas aeruginosa PA01
gcgaccagcccgcgcga

SEQ ID NO: 3397854 - RNA, 14 nt, Pseudomonas aeruginosa PA01
gcgaccagccgggg

SEQ ID NO: 3397855 - RNA, 13 nt, Pseudomonas aeruginosa PA01
gcgaccagcgcca

SEQ ID NO: 3397856 - RNA, 15 nt, Pseudomonas aeruginosa PA01
gcgaccagcgccagg

SEQ ID NO: 3397857 - RNA, 18 nt, Pseudomonas aeruginosa PA01
gcgaccagcgccaggcgc

SEQ ID NO: 3397858 - RNA, 20 nt, Pseudomonas aeruginosa PA01
gcgaccagcgucgcgcgugc

SEQ ID NO: 3397859 - RNA, 20 nt, Pseudomonas aeruginosa PA01
gcgaccagcucgaagccgcc

SEQ ID NO: 3397860 - RNA, 22 nt, Pseudomonas aeruginosa PA01
gcgaccagcucgaagccgccgu

SEQ ID NO: 3397861 - RNA, 21 nt, Pseudomonas aeruginosa PA01
gcgaccagguccggagggccc

SEQ ID NO: 3397862 - RNA, 16 nt, Pseudomonas aeruginosa PA01
gcgaccaguugcucgc

SEQ ID NO: 3397863 - RNA, 18 nt, Pseudomonas aeruginosa PA01
gcgaccaguugcucgcuc

SEQ ID NO: 3397864 - RNA, 21 nt, Pseudomonas aeruginosa PA01
gcgaccaguugcucgcuccga

SEQ ID NO: 3397865 - RNA, 16 nt, Pseudomonas aeruginosa PA01
gcgaccauccagccug

SEQ ID NO: 3397866 - RNA, 20 nt, Pseudomonas aeruginosa PA01
gcgaccauccagccugcgcu

SEQ ID NO: 3397867 - RNA, 20 nt, Pseudomonas aeruginosa PA01
gcgaccauguucaccagcgc

SEQ ID NO: 3397868 - RNA, 18 nt, Pseudomonas aeruginosa PA01
gcgacccagaccugccgc

SEQ ID NO: 3397869 - RNA, 23 nt, Pseudomonas aeruginosa PA01
gcgacccagaccugccgcccggc

SEQ ID NO: 3397870 - RNA, 13 nt, Pseudomonas aeruginosa PA01
gcgacccaggccg

SEQ ID NO: 3397871 - RNA, 19 nt, Pseudomonas aeruginosa PA01
gcgacccaggccgacagcg

SEQ ID NO: 3397872 - RNA, 14 nt, Pseudomonas aeruginosa PA01
gcgacccaucgccg

SEQ ID NO: 3397873 - RNA, 16 nt, Pseudomonas aeruginosa PA01
gcgacccaucgccgaa

SEQ ID NO: 3397874 - RNA, 21 nt, Pseudomonas aeruginosa PA01
gcgacccaucgccgaagacgc

SEQ ID NO: 3397875 - RNA, 22 nt, Pseudomonas aeruginosa PA01
gcgacccaucgccgaagacgcc

SEQ ID NO: 3397876 - RNA, 19 nt, Pseudomonas aeruginosa PA01
gcgacccgcacguugaggu

SEQ ID NO: 3397877 - RNA, 19 nt, Pseudomonas aeruginosa PA01
gcgacccgggucaggccga

SEQ ID NO: 3397878 - RNA, 20 nt, Pseudomonas aeruginosa PA01
gcgacccucagucgccccca

SEQ ID NO: 3397879 - RNA, 12 nt, Pseudomonas aeruginosa PA01
gcgacccuggcc

SEQ ID NO: 3397880 - RNA, 15 nt, Pseudomonas aeruginosa PA01
gcgacccuggccgcg

SEQ ID NO: 3397881 - RNA, 18 nt, Pseudomonas aeruginosa PA01
gcgacccuggccgcgcgg

SEQ ID NO: 3397882 - RNA, 19 nt, Pseudomonas aeruginosa PA01
gcgacccuggccgcgcggc

SEQ ID NO: 3397883 - RNA, 18 nt, Pseudomonas aeruginosa PA01
gcgacccuggggucgccg

SEQ ID NO: 3397884 - RNA, 14 nt, Pseudomonas aeruginosa PA01
gcgacccuucaacg

SEQ ID NO: 3397885 - RNA, 17 nt, Pseudomonas aeruginosa PA01
gcgacccuucaacggcg

SEQ ID NO: 3397886 - RNA, 18 nt, Pseudomonas aeruginosa PA01
gcgacccuucaacggcga

SEQ ID NO: 3397887 - RNA, 20 nt, Pseudomonas aeruginosa PA01
gcgacccuucaacggcgacc

SEQ ID NO: 3397888 - RNA, 22 nt, Pseudomonas aeruginosa PA01
gcgacccuucaacggcgaccgc

SEQ ID NO: 3397889 - RNA, 19 nt, Pseudomonas aeruginosa PA01
gcgaccgaacagcgcgcca

SEQ ID NO: 3397890 - RNA, 21 nt, Pseudomonas aeruginosa PA01
gcgaccgaacagcgcgccauc

SEQ ID NO: 3397891 - RNA, 14 nt, Pseudomonas aeruginosa PA01
gcgaccgaagccgc

SEQ ID NO: 3397892 - RNA, 16 nt, Pseudomonas aeruginosa PA01
gcgacgcgcuggacca

SEQ ID NO: 3397893 - RNA, 19 nt, Pseudomonas aeruginosa PA01
gcgacgcgcuggaccaugg

SEQ ID NO: 3397894 - RNA, 22 nt, Pseudomonas aeruginosa PA01
gcgacgcgcuggaccauggccg

SEQ ID NO: 3397895 - RNA, 21 nt, Pseudomonas aeruginosa PA01
gcgacgcggacagccugggcg

SEQ ID NO: 3397896 - RNA, 16 nt, Pseudomonas aeruginosa PA01
gcgacgcuacguucca

SEQ ID NO: 3397897 - RNA, 20 nt, Pseudomonas aeruginosa PA01
gcgacgcuacguuccagggc

SEQ ID NO: 3397898 - RNA, 21 nt, Pseudomonas aeruginosa PA01
gcgacgcuacguuccagggcc

SEQ ID NO: 3397899 - RNA, 23 nt, Pseudomonas aeruginosa PA01
gcgacgcuacguuccagggccug

SEQ ID NO: 3397900 - RNA, 14 nt, Pseudomonas aeruginosa PA01
gcgacgcuccagcg

SEQ ID NO: 3397901 - RNA, 15 nt, Pseudomonas aeruginosa PA01
gcgacgcuccagcgg

SEQ ID NO: 3397902 - RNA, 16 nt, Pseudomonas aeruginosa PA01
gcgacgcuccagcggc

SEQ ID NO: 3397903 - RNA, 17 nt, Pseudomonas aeruginosa PA01
gcgacgcuccagcggca

SEQ ID NO: 3397904 - RNA, 21 nt, Pseudomonas aeruginosa PA01
gcgacgcuccaggugcacggc

SEQ ID NO: 3397905 - RNA, 16 nt, Pseudomonas aeruginosa PA01
gcgacgcucuucagcg

SEQ ID NO: 3397906 - RNA, 19 nt, Pseudomonas aeruginosa PA01
gcgacgcucuucagcgguc

SEQ ID NO: 3397907 - RNA, 18 nt, Pseudomonas aeruginosa PA01
gcgacgcugaugccggcg

SEQ ID NO: 3397908 - RNA, 20 nt, Pseudomonas aeruginosa PA01
gcgacgcugaugccggcgaa

SEQ ID NO: 3397909 - RNA, 17 nt, Pseudomonas aeruginosa PA01
gcgacgcuggcggugcg

SEQ ID NO: 3397910 - RNA, 19 nt, Pseudomonas aeruginosa PA01
gcgacggaacaagccgccu

SEQ ID NO: 3397911 - RNA, 15 nt, Pseudomonas aeruginosa PA01
gcgacggaagcccuc

SEQ ID NO: 3397912 - RNA, 15 nt, Pseudomonas aeruginosa PA01
gcgacggaaggugcg

SEQ ID NO: 3397913 - RNA, 17 nt, Pseudomonas aeruginosa PA01
gcgacggaccgcgacaa

SEQ ID NO: 3397914 - RNA, 19 nt, Pseudomonas aeruginosa PA01
gcgacggcauuccuggucc

SEQ ID NO: 3397915 - RNA, 23 nt, Pseudomonas aeruginosa PA01
gcgacggcauuccugguccagcc

SEQ ID NO: 3397916 - RNA, 21 nt, Pseudomonas aeruginosa PA01
gcgacggcgcaagggcgccgc

SEQ ID NO: 3397917 - RNA, 16 nt, Pseudomonas aeruginosa PA01
gcgacggcugcuccgg

SEQ ID NO: 3397918 - RNA, 22 nt, Pseudomonas aeruginosa PA01
gcgacggcugcuccggaucgcg

SEQ ID NO: 3397919 - RNA, 23 nt, Pseudomonas aeruginosa PA01
gcgacggcugcuccggaucgcgc

SEQ ID NO: 3397920 - RNA, 21 nt, Pseudomonas aeruginosa PA01
gcgacgggaagcgaaccaggc

SEQ ID NO: 3397921 - RNA, 22 nt, Pseudomonas aeruginosa PA01
gcgacgggaagcgaaccaggca

SEQ ID NO: 3397922 - RNA, 23 nt, Pseudomonas aeruginosa PA01
gcgacgggaagcgaaccaggcaa

SEQ ID NO: 3397923 - RNA, 16 nt, Pseudomonas aeruginosa PA01
gcgacgggugcgucca

SEQ ID NO: 3397924 - RNA, 21 nt, Pseudomonas aeruginosa PA01
gcgacgggugcguccauccag

SEQ ID NO: 3397925 - RNA, 22 nt, Pseudomonas aeruginosa PA01
gcgacggucaggccgagcagcg

SEQ ID NO: 3397926 - RNA, 19 nt, Pseudomonas aeruginosa PA01
gcgacgguugauagcgcgg

SEQ ID NO: 3397927 - RNA, 20 nt, Pseudomonas aeruginosa PA01
gcgacgguugauagcgcggc

SEQ ID NO: 3397928 - RNA, 22 nt, Pseudomonas aeruginosa PA01
gcgacgguugauagcgcggccu

SEQ ID NO: 3397929 - RNA, 19 nt, Pseudomonas aeruginosa PA01
gcgacguccacugcguccu

SEQ ID NO: 3397930 - RNA, 19 nt, Pseudomonas aeruginosa PA01
gcgacgucccuuccccgau

SEQ ID NO: 3397931 - RNA, 18 nt, Pseudomonas aeruginosa PA01
gcgacguccugcggguca

SEQ ID NO: 3397932 - RNA, 12 nt, Pseudomonas aeruginosa PA01
gcgacgucgccc

SEQ ID NO: 3397933 - RNA, 22 nt, Pseudomonas aeruginosa PA01
gcgacgucgccccagccuugcu

SEQ ID NO: 3397934 - RNA, 13 nt, Pseudomonas aeruginosa PA01
gcgacguggcagg

SEQ ID NO: 3397935 - RNA, 23 nt, Pseudomonas aeruginosa PA01
gcgacgugggccugcuccucggc

SEQ ID NO: 3397936 - RNA, 14 nt, Pseudomonas aeruginosa PA01
gcgacguugcgcag

SEQ ID NO: 3397937 - RNA, 24 nt, Pseudomonas aeruginosa PA01
gcgacguugcgcaggggcgcggcg

SEQ ID NO: 3397938 - RNA, 16 nt, Pseudomonas aeruginosa PA01
gcgacguuuuucccgu

SEQ ID NO: 3397939 - RNA, 13 nt, Pseudomonas aeruginosa PA01
gcgacuaccaggu

SEQ ID NO: 3397940 - RNA, 16 nt, Pseudomonas aeruginosa PA01
gcgacuccagccaggc

SEQ ID NO: 3397941 - RNA, 17 nt, Pseudomonas aeruginosa PA01
gcgacuccagccaggcg

SEQ ID NO: 3397942 - RNA, 22 nt, Pseudomonas aeruginosa PA01
gcgacuccgccaguuccggggu

SEQ ID NO: 3397943 - RNA, 21 nt, Pseudomonas aeruginosa PA01
gcgacucgaagcucuucgcca

SEQ ID NO: 3397944 - RNA, 18 nt, Pseudomonas aeruginosa PA01
gcgacucgagcaccacca

SEQ ID NO: 3397945 - RNA, 19 nt, Pseudomonas aeruginosa PA01
gcgacucgagcaccaccac

SEQ ID NO: 3397946 - RNA, 16 nt, Pseudomonas aeruginosa PA01
gcgacucgaugcgcag

SEQ ID NO: 3397947 - RNA, 16 nt, Pseudomonas aeruginosa PA01
gcgacucgcugccggc

SEQ ID NO: 3397948 - RNA, 17 nt, Pseudomonas aeruginosa PA01
gcgacucgcugccggcg

SEQ ID NO: 3397949 - RNA, 16 nt, Pseudomonas aeruginosa PA01
gcgacucgcugggcgc

SEQ ID NO: 3397950 - RNA, 19 nt, Pseudomonas aeruginosa PA01
gcgacucgcugggcgccgg

SEQ ID NO: 3397951 - RNA, 21 nt, Pseudomonas aeruginosa PA01
gcgacucgcugggcgccggca

SEQ ID NO: 3397952 - RNA, 13 nt, Pseudomonas aeruginosa PA01
gcgacucggcugc

SEQ ID NO: 3397953 - RNA, 14 nt, Pseudomonas aeruginosa PA01
gcgacucggcugca

SEQ ID NO: 3397954 - RNA, 21 nt, Pseudomonas aeruginosa PA01
gcgacucggcugcaacgccgc

SEQ ID NO: 3397955 - RNA, 20 nt, Pseudomonas aeruginosa PA01
gcgacucggggcgccuccag

SEQ ID NO: 3397956 - RNA, 22 nt, Pseudomonas aeruginosa PA01
gcgacucguagggguagggguc

SEQ ID NO: 3397957 - RNA, 21 nt, Pseudomonas aeruginosa PA01
gcgacucguugcacgcaggcc

SEQ ID NO: 3397958 - RNA, 24 nt, Pseudomonas aeruginosa PA01
gcgacucguugcacgcaggccgcu

SEQ ID NO: 3397959 - RNA, 14 nt, Pseudomonas aeruginosa PA01
gcgacugaccacgc

SEQ ID NO: 3397960 - RNA, 15 nt, Pseudomonas aeruginosa PA01
gcgacugcgcuggcc

SEQ ID NO: 3397961 - RNA, 20 nt, Pseudomonas aeruginosa PA01
gcgacugcgcuggccgagcu

SEQ ID NO: 3397962 - RNA, 14 nt, Pseudomonas aeruginosa PA01
gcgacugcugcugc

SEQ ID NO: 3397963 - RNA, 18 nt, Pseudomonas aeruginosa PA01
gcgacugguggucgaggg

SEQ ID NO: 3397964 - RNA, 16 nt, Pseudomonas aeruginosa PA01
gcgacuguucucuacg

SEQ ID NO: 3397965 - RNA, 20 nt, Pseudomonas aeruginosa PA01
gcgacuguucucuacgccgu

SEQ ID NO: 3397966 - RNA, 22 nt, Pseudomonas aeruginosa PA01
gcgacuguucucuacgccguag

SEQ ID NO: 3397967 - RNA, 18 nt, Pseudomonas aeruginosa PA01
gcgacuuccuugcgcggg

SEQ ID NO: 3397968 - RNA, 21 nt, Pseudomonas aeruginosa PA01
gcgagaaaggcugcuucggca

SEQ ID NO: 3397969 - RNA, 18 nt, Pseudomonas aeruginosa PA01
gcgagaaagucgaucagc

SEQ ID NO: 3397970 - RNA, 22 nt, Pseudomonas aeruginosa PA01
gcgagaaagucgaucagcgcgc

SEQ ID NO: 3397971 - RNA, 17 nt, Pseudomonas aeruginosa PA01
gcgagaacuugccggcg

SEQ ID NO: 3397972 - RNA, 20 nt, Pseudomonas aeruginosa PA01
gcgagaacuugccggcgcca

SEQ ID NO: 3397973 - RNA, 16 nt, Pseudomonas aeruginosa PA01
gcgagaagccgcccac

SEQ ID NO: 3397974 - RNA, 15 nt, Pseudomonas aeruginosa PA01
gcgagaaucgccgag

SEQ ID NO: 3397975 - RNA, 20 nt, Pseudomonas aeruginosa PA01
gcgagaccaucuggaucagg

SEQ ID NO: 3397976 - RNA, 22 nt, Pseudomonas aeruginosa PA01
gcgagaccccggcggcgcguuc

SEQ ID NO: 3397977 - RNA, 15 nt, Pseudomonas aeruginosa PA01
gcgagaccggggauc

SEQ ID NO: 3397978 - RNA, 19 nt, Pseudomonas aeruginosa PA01
gcgagaccggggaucagcu

SEQ ID NO: 3397979 - RNA, 12 nt, Pseudomonas aeruginosa PA01
gcgagaccucgc

SEQ ID NO: 3397980 - RNA, 23 nt, Pseudomonas aeruginosa PA01
gcgagaccucgcccaucgccagg

SEQ ID NO: 3397981 - RNA, 12 nt, Pseudomonas aeruginosa PA01
gcgagacgccgc

SEQ ID NO: 3397982 - RNA, 13 nt, Pseudomonas aeruginosa PA01
gcgagacgccgcc

SEQ ID NO: 3397983 - RNA, 20 nt, Pseudomonas aeruginosa PA01
gcgagacgccgccccagccu

SEQ ID NO: 3397984 - RNA, 18 nt, Pseudomonas aeruginosa PA01
gcgagacgggcgacgccc

SEQ ID NO: 3397985 - RNA, 19 nt, Pseudomonas aeruginosa PA01
gcgagacgggcgacgccca

SEQ ID NO: 3397986 - RNA, 17 nt, Pseudomonas aeruginosa PA01
gcgagacgggcgaggcu

SEQ ID NO: 3397987 - RNA, 20 nt, Pseudomonas aeruginosa PA01
gcgagacuaccgaucggcug

SEQ ID NO: 3397988 - RNA, 22 nt, Pseudomonas aeruginosa PA01
gcgagacuaccgaucggcugcc

SEQ ID NO: 3397989 - RNA, 17 nt, Pseudomonas aeruginosa PA01
gcgagagacugaacucg

SEQ ID NO: 3397990 - RNA, 18 nt, Pseudomonas aeruginosa PA01
gcgagagcgccgaccagc

SEQ ID NO: 3397991 - RNA, 15 nt, Pseudomonas aeruginosa PA01
gcgagaggggcgcuc

SEQ ID NO: 3397992 - RNA, 22 nt, Pseudomonas aeruginosa PA01
gcgagaggggcgcucguugcgc

SEQ ID NO: 3397993 - RNA, 12 nt, Pseudomonas aeruginosa PA01
gcgaggccggcc

SEQ ID NO: 3397994 - RNA, 23 nt, Pseudomonas aeruginosa PA01
gcgaggccguaccagucgcccgc

SEQ ID NO: 3397995 - RNA, 15 nt, Pseudomonas aeruginosa PA01
gcgaggcgcccgccg

SEQ ID NO: 3397996 - RNA, 16 nt, Pseudomonas aeruginosa PA01
gcgaggcgcccgccgg

SEQ ID NO: 3397997 - RNA, 17 nt, Pseudomonas aeruginosa PA01
gcgaggcgcccgccggc

SEQ ID NO: 3397998 - RNA, 11 nt, Pseudomonas aeruginosa PA01
gcgaggcgcgc

SEQ ID NO: 3397999 - RNA, 14 nt, Pseudomonas aeruginosa PA01
gcgaggcgcgccug

SEQ ID NO: 3398000 - RNA, 13 nt, Pseudomonas aeruginosa PA01
gcgaggcgcucga

SEQ ID NO: 3398001 - RNA, 15 nt, Pseudomonas aeruginosa PA01
gcgaggcgcucgacg

SEQ ID NO: 3398002 - RNA, 22 nt, Pseudomonas aeruginosa PA01
gcgaggcgcucgacgaucaggu

SEQ ID NO: 3398003 - RNA, 23 nt, Pseudomonas aeruginosa PA01
gcgaggcgcucuucacuuccagc

SEQ ID NO: 3398004 - RNA, 13 nt, Pseudomonas aeruginosa PA01
gcgaggcgggcgc

SEQ ID NO: 3398005 - RNA, 16 nt, Pseudomonas aeruginosa PA01
gcgaggcgggcgcgga

SEQ ID NO: 3398006 - RNA, 17 nt, Pseudomonas aeruginosa PA01
gcgaggcgggcgcggau

SEQ ID NO: 3398007 - RNA, 18 nt, Pseudomonas aeruginosa PA01
gcgaggcgucgaucaucu

SEQ ID NO: 3398008 - RNA, 17 nt, Pseudomonas aeruginosa PA01
gcgaggcguuccaggug

SEQ ID NO: 3398009 - RNA, 18 nt, Pseudomonas aeruginosa PA01
gcgaggcguuccaggugg

SEQ ID NO: 3398010 - RNA, 21 nt, Pseudomonas aeruginosa PA01
gcgaggcguucgucgaccugc

SEQ ID NO: 3398011 - RNA, 16 nt, Pseudomonas aeruginosa PA01
gcgaggcuggccucgu

SEQ ID NO: 3398012 - RNA, 14 nt, Pseudomonas aeruginosa PA01
gcgagggcaccacg

SEQ ID NO: 3398013 - RNA, 14 nt, Pseudomonas aeruginosa PA01
gcgagggcgcgcac

SEQ ID NO: 3398014 - RNA, 13 nt, Pseudomonas aeruginosa PA01
gcgagggcggcga

SEQ ID NO: 3398015 - RNA, 20 nt, Pseudomonas aeruginosa PA01
gcgagggcggcgaccugggc

SEQ ID NO: 3398016 - RNA, 13 nt, Pseudomonas aeruginosa PA01
gcgagggcggcgg

SEQ ID NO: 3398017 - RNA, 14 nt, Pseudomonas aeruginosa PA01
gcgagggcggcggc

SEQ ID NO: 3398018 - RNA, 19 nt, Pseudomonas aeruginosa PA01
gcgagggcgucccgcugcg

SEQ ID NO: 3398019 - RNA, 15 nt, Pseudomonas aeruginosa PA01
gcgaggggcggagca

SEQ ID NO: 3398020 - RNA, 22 nt, Pseudomonas aeruginosa PA01
gcgagggggccucggccagcgc

SEQ ID NO: 3398021 - RNA, 17 nt, Pseudomonas aeruginosa PA01
gcgagggugaacuggcc

SEQ ID NO: 3398022 - RNA, 20 nt, Pseudomonas aeruginosa PA01
gcgagggugaacuggccguc

SEQ ID NO: 3398023 - RNA, 21 nt, Pseudomonas aeruginosa PA01
gcgagggugaacuggccgucg

SEQ ID NO: 3398024 - RNA, 16 nt, Pseudomonas aeruginosa PA01
gcgaggguggcgccca

SEQ ID NO: 3398025 - RNA, 19 nt, Pseudomonas aeruginosa PA01
gcgaggguggcgcccaugc

SEQ ID NO: 3398026 - RNA, 13 nt, Pseudomonas aeruginosa PA01
gcgagguccggcu

SEQ ID NO: 3398027 - RNA, 15 nt, Pseudomonas aeruginosa PA01
gcgaggucgccacgc

SEQ ID NO: 3398028 - RNA, 15 nt, Pseudomonas aeruginosa PA01
gcgaggucgccgggg

SEQ ID NO: 3398029 - RNA, 17 nt, Pseudomonas aeruginosa PA01
gcgaggucgccggggcc

SEQ ID NO: 3398030 - RNA, 15 nt, Pseudomonas aeruginosa PA01
gcgaggucucgaugg

SEQ ID NO: 3398031 - RNA, 13 nt, Pseudomonas aeruginosa PA01
gcgaggugaucga

SEQ ID NO: 3398032 - RNA, 16 nt, Pseudomonas aeruginosa PA01
gcgagguuccgcggcg

SEQ ID NO: 3398033 - RNA, 18 nt, Pseudomonas aeruginosa PA01
gcgaguaaccaccgcucu

SEQ ID NO: 3398034 - RNA, 15 nt, Pseudomonas aeruginosa PA01
gcgaguaagcgcggu

SEQ ID NO: 3398035 - RNA, 15 nt, Pseudomonas aeruginosa PA01
gcgaguaguaggucg

SEQ ID NO: 3398036 - RNA, 19 nt, Pseudomonas aeruginosa PA01
gcgagucaccccgaccagc

SEQ ID NO: 3398037 - RNA, 22 nt, Pseudomonas aeruginosa PA01
gcgagucaccccgaccagcgcg

SEQ ID NO: 3398038 - RNA, 20 nt, Pseudomonas aeruginosa PA01
gcgaguccgacccgcuccgg

SEQ ID NO: 3398039 - RNA, 15 nt, Pseudomonas aeruginosa PA01
gcgagucgacccagg

SEQ ID NO: 3398040 - RNA, 17 nt, Pseudomonas aeruginosa PA01
gcgagucgacccaggcc

SEQ ID NO: 3398041 - RNA, 18 nt, Pseudomonas aeruginosa PA01
gcgagucgacccaggccc

SEQ ID NO: 3398042 - RNA, 17 nt, Pseudomonas aeruginosa PA01
gcgagucgaucaggucg

SEQ ID NO: 3398043 - RNA, 20 nt, Pseudomonas aeruginosa PA01
gcgagugcagcgagucgccg

SEQ ID NO: 3398044 - RNA, 21 nt, Pseudomonas aeruginosa PA01
gcgagugcagcgagucgccgu

SEQ ID NO: 3398045 - RNA, 14 nt, Pseudomonas aeruginosa PA01
gcgagugcugaaca

SEQ ID NO: 3398046 - RNA, 14 nt, Pseudomonas aeruginosa PA01
gcgaguucgccggc

SEQ ID NO: 3398047 - RNA, 15 nt, Pseudomonas aeruginosa PA01
gcgaguucgccggcc

SEQ ID NO: 3398048 - RNA, 18 nt, Pseudomonas aeruginosa PA01
gcgaguucgccggccagg

SEQ ID NO: 3398049 - RNA, 19 nt, Pseudomonas aeruginosa PA01
gcgaguucgccggccaggu

SEQ ID NO: 3398050 - RNA, 14 nt, Pseudomonas aeruginosa PA01
gcgaguucggcgag

SEQ ID NO: 3398051 - RNA, 19 nt, Pseudomonas aeruginosa PA01
gcgaguucggcgagcaggu

SEQ ID NO: 3398052 - RNA, 20 nt, Pseudomonas aeruginosa PA01
gcgaguucggcgagcaggua

SEQ ID NO: 3398053 - RNA, 13 nt, Pseudomonas aeruginosa PA01
gcgaguucggcgu

SEQ ID NO: 3398054 - RNA, 22 nt, Pseudomonas aeruginosa PA01
gcgaguucggcguuguccaggc

SEQ ID NO: 3398055 - RNA, 23 nt, Pseudomonas aeruginosa PA01
gcgaguucggcguuguccaggcu

SEQ ID NO: 3398056 - RNA, 21 nt, Pseudomonas aeruginosa PA01
gcgaguugaucggcguggcgg

SEQ ID NO: 3398057 - RNA, 14 nt, Pseudomonas aeruginosa PA01
gcgaguugcgcgag

SEQ ID NO: 3398058 - RNA, 17 nt, Pseudomonas aeruginosa PA01
gcgaguugcgcgaggcg

SEQ ID NO: 3398059 - RNA, 18 nt, Pseudomonas aeruginosa PA01
gcgaguuuguugcgcgag

SEQ ID NO: 3398060 - RNA, 19 nt, Pseudomonas aeruginosa PA01
gcgaguuuguugcgcgagg

SEQ ID NO: 3398061 - RNA, 14 nt, Pseudomonas aeruginosa PA01
gcgauaaccgcguu

SEQ ID NO: 3398062 - RNA, 13 nt, Pseudomonas aeruginosa PA01
gcgauacaccugc

SEQ ID NO: 3398063 - RNA, 17 nt, Pseudomonas aeruginosa PA01
gcgauacccaggccguc

SEQ ID NO: 3398064 - RNA, 22 nt, Pseudomonas aeruginosa PA01
gcgauacccaggccgucgaggg

SEQ ID NO: 3398065 - RNA, 19 nt, Pseudomonas aeruginosa PA01
gcgauacucgugggccggu

SEQ ID NO: 3398066 - RNA, 14 nt, Pseudomonas aeruginosa PA01
gcgauagacgccgg

SEQ ID NO: 3398067 - RNA, 16 nt, Pseudomonas aeruginosa PA01
gcgauagacgccggcg

SEQ ID NO: 3398068 - RNA, 17 nt, Pseudomonas aeruginosa PA01
gcgauagacgccggcga

SEQ ID NO: 3398069 - RNA, 18 nt, Pseudomonas aeruginosa PA01
gcgauagacgccggcgac

SEQ ID NO: 3398070 - RNA, 14 nt, Pseudomonas aeruginosa PA01
gcgauagccgacca

SEQ ID NO: 3398071 - RNA, 14 nt, Pseudomonas aeruginosa PA01
gcgauaucccgccg

SEQ ID NO: 3398072 - RNA, 15 nt, Pseudomonas aeruginosa PA01
gcgauaucccgccgc

SEQ ID NO: 3398073 - RNA, 17 nt, Pseudomonas aeruginosa PA01
gcgauaucccgccgccg

SEQ ID NO: 3398074 - RNA, 20 nt, Pseudomonas aeruginosa PA01
gcgauaucccgccgccgcgc

SEQ ID NO: 3398075 - RNA, 12 nt, Pseudomonas aeruginosa PA01
gcgauauccgcc

SEQ ID NO: 3398076 - RNA, 13 nt, Pseudomonas aeruginosa PA01
gcgauauccgcca

SEQ ID NO: 3398077 - RNA, 16 nt, Pseudomonas aeruginosa PA01
gcgauauccgccaggc

SEQ ID NO: 3398078 - RNA, 16 nt, Pseudomonas aeruginosa PA01
gcgauaucgcaggcca

SEQ ID NO: 3398079 - RNA, 14 nt, Pseudomonas aeruginosa PA01
gcgauauucgcccu

SEQ ID NO: 3398080 - RNA, 18 nt, Pseudomonas aeruginosa PA01
gcgauauucgcccuacga

SEQ ID NO: 3398081 - RNA, 20 nt, Pseudomonas aeruginosa PA01
gcgaucacauagcuguagcg

SEQ ID NO: 3398082 - RNA, 20 nt, Pseudomonas aeruginosa PA01
gcgaucacccggcgaagcuc

SEQ ID NO: 3398083 - RNA, 14 nt, Pseudomonas aeruginosa PA01
gcgaucaccgcguc

SEQ ID NO: 3398084 - RNA, 21 nt, Pseudomonas aeruginosa PA01
gcgaucaccgcguccaucccc

SEQ ID NO: 3398085 - RNA, 15 nt, Pseudomonas aeruginosa PA01
gcgaucacggcgccc

SEQ ID NO: 3398086 - RNA, 16 nt, Pseudomonas aeruginosa PA01
gcgaucacggcgcccc

SEQ ID NO: 3398087 - RNA, 18 nt, Pseudomonas aeruginosa PA01
gcgaucacgucguacucg

SEQ ID NO: 3398088 - RNA, 22 nt, Pseudomonas aeruginosa PA01
gcgaucacgucguacucggcgg

SEQ ID NO: 3398089 - RNA, 23 nt, Pseudomonas aeruginosa PA01
gcgaucacgucguacucggcggg

SEQ ID NO: 3398090 - RNA, 19 nt, Pseudomonas aeruginosa PA01
gcgaucagcgaaaugguca

SEQ ID NO: 3398091 - RNA, 14 nt, Pseudomonas aeruginosa PA01
gcgaucagcgggcg

SEQ ID NO: 3398092 - RNA, 14 nt, Pseudomonas aeruginosa PA01
gcgaucagcucgcg

SEQ ID NO: 3398093 - RNA, 23 nt, Pseudomonas aeruginosa PA01
gcgaucagcucgcgguaggccag

SEQ ID NO: 3398094 - RNA, 16 nt, Pseudomonas aeruginosa PA01
gcgaucaggcagcgcg

SEQ ID NO: 3398095 - RNA, 17 nt, Pseudomonas aeruginosa PA01
gcgaucaggcagcgcgc

SEQ ID NO: 3398096 - RNA, 20 nt, Pseudomonas aeruginosa PA01
gcgaugcugucagcgcccgg

SEQ ID NO: 3398097 - RNA, 22 nt, Pseudomonas aeruginosa PA01
gcgaugcugucagcgcccggcu

SEQ ID NO: 3398098 - RNA, 22 nt, Pseudomonas aeruginosa PA01
gcgauggaaguugcgcacccgc

SEQ ID NO: 3398099 - RNA, 11 nt, Pseudomonas aeruginosa PA01
gcgauggacuc

SEQ ID NO: 3398100 - RNA, 16 nt, Pseudomonas aeruginosa PA01
gcgauggaguaggcgu

SEQ ID NO: 3398101 - RNA, 19 nt, Pseudomonas aeruginosa PA01
gcgauggaugcgcggcagg

SEQ ID NO: 3398102 - RNA, 14 nt, Pseudomonas aeruginosa PA01
gcgauggcccagau

SEQ ID NO: 3398103 - RNA, 19 nt, Pseudomonas aeruginosa PA01
gcgauggcccagaugauca

SEQ ID NO: 3398104 - RNA, 21 nt, Pseudomonas aeruginosa PA01
gcgauggcccagaugaucagg

SEQ ID NO: 3398105 - RNA, 13 nt, Pseudomonas aeruginosa PA01
gcgauggccgcca

SEQ ID NO: 3398106 - RNA, 17 nt, Pseudomonas aeruginosa PA01
gcgauggccgccagcag

SEQ ID NO: 3398107 - RNA, 18 nt, Pseudomonas aeruginosa PA01
gcgauggccgccagcagg

SEQ ID NO: 3398108 - RNA, 19 nt, Pseudomonas aeruginosa PA01
gcgauggccgccagcaggc

SEQ ID NO: 3398109 - RNA, 14 nt, Pseudomonas aeruginosa PA01
gcgauggccgccug

SEQ ID NO: 3398110 - RNA, 17 nt, Pseudomonas aeruginosa PA01
gcgauggccgccugcag

SEQ ID NO: 3398111 - RNA, 13 nt, Pseudomonas aeruginosa PA01
gcgauggccuggu

SEQ ID NO: 3398112 - RNA, 14 nt, Pseudomonas aeruginosa PA01
gcgauggcgcgcgg

SEQ ID NO: 3398113 - RNA, 17 nt, Pseudomonas aeruginosa PA01
gcgauggcguccaccgc

SEQ ID NO: 3398114 - RNA, 20 nt, Pseudomonas aeruginosa PA01
gcgauggcgugaaguagccg

SEQ ID NO: 3398115 - RNA, 14 nt, Pseudomonas aeruginosa PA01
gcgauggcucgcgg

SEQ ID NO: 3398116 - RNA, 15 nt, Pseudomonas aeruginosa PA01
gcgaugggugccgcg

SEQ ID NO: 3398117 - RNA, 18 nt, Pseudomonas aeruginosa PA01
gcgaugggugccgcgcag

SEQ ID NO: 3398118 - RNA, 23 nt, Pseudomonas aeruginosa PA01
gcgaugggugccgcgcagguuca

SEQ ID NO: 3398119 - RNA, 23 nt, Pseudomonas aeruginosa PA01
gcgaugguaguccgcugcgagca

SEQ ID NO: 3398120 - RNA, 15 nt, Pseudomonas aeruginosa PA01
gcgaugguauggcgg

SEQ ID NO: 3398121 - RNA, 16 nt, Pseudomonas aeruginosa PA01
gcgaugguauggcggu

SEQ ID NO: 3398122 - RNA, 22 nt, Pseudomonas aeruginosa PA01
gcgaugguccccggccccgcgg

SEQ ID NO: 3398123 - RNA, 18 nt, Pseudomonas aeruginosa PA01
gcgauggugcgcucgcgg

SEQ ID NO: 3398124 - RNA, 16 nt, Pseudomonas aeruginosa PA01
gcgaugguugccguac

SEQ ID NO: 3398125 - RNA, 16 nt, Pseudomonas aeruginosa PA01
gcgauguagcugccgg

SEQ ID NO: 3398126 - RNA, 18 nt, Pseudomonas aeruginosa PA01
gcgauguagcugccggcg

SEQ ID NO: 3398127 - RNA, 17 nt, Pseudomonas aeruginosa PA01
gcgauguccccggccag

SEQ ID NO: 3398128 - RNA, 20 nt, Pseudomonas aeruginosa PA01
gcgauguccccggccagcag

SEQ ID NO: 3398129 - RNA, 15 nt, Pseudomonas aeruginosa PA01
gcgaugucgcgggca

SEQ ID NO: 3398130 - RNA, 14 nt, Pseudomonas aeruginosa PA01
gcgaugucggccug

SEQ ID NO: 3398131 - RNA, 20 nt, Pseudomonas aeruginosa PA01
gcgaugucggccugcagccu

SEQ ID NO: 3398132 - RNA, 17 nt, Pseudomonas aeruginosa PA01
gcgauguucaccgcggc

SEQ ID NO: 3398133 - RNA, 22 nt, Pseudomonas aeruginosa PA01
gcgauguucaccgcggccuugg

SEQ ID NO: 3398134 - RNA, 19 nt, Pseudomonas aeruginosa PA01
gcgauguugcgcagggugc

SEQ ID NO: 3398135 - RNA, 14 nt, Pseudomonas aeruginosa PA01
gcgauucagaugcg

SEQ ID NO: 3398136 - RNA, 20 nt, Pseudomonas aeruginosa PA01
gcgauucgcggcgacagcac

SEQ ID NO: 3398137 - RNA, 17 nt, Pseudomonas aeruginosa PA01
gcgauucguucgagcag

SEQ ID NO: 3398138 - RNA, 20 nt, Pseudomonas aeruginosa PA01
gcgauucguucgagcagcuc

SEQ ID NO: 3398139 - RNA, 13 nt, Pseudomonas aeruginosa PA01
gcgauugaacucg

SEQ ID NO: 3398140 - RNA, 17 nt, Pseudomonas aeruginosa PA01
gcgauuggagaugcuca

SEQ ID NO: 3398141 - RNA, 17 nt, Pseudomonas aeruginosa PA01
gcgauuguccaccggcc

SEQ ID NO: 3398142 - RNA, 17 nt, Pseudomonas aeruginosa PA01
gcgauuuugggcucaga

SEQ ID NO: 3398143 - RNA, 14 nt, Pseudomonas aeruginosa PA01
gcgcaaaaaaaggg

SEQ ID NO: 3398144 - RNA, 15 nt, Pseudomonas aeruginosa PA01
gcgcaaaccggcagc

SEQ ID NO: 3398145 - RNA, 14 nt, Pseudomonas aeruginosa PA01
gcgcaacaggcgca

SEQ ID NO: 3398146 - RNA, 15 nt, Pseudomonas aeruginosa PA01
gcgcaacaggcgcau

SEQ ID NO: 3398147 - RNA, 17 nt, Pseudomonas aeruginosa PA01
gcgcaacaggcgcaugc

SEQ ID NO: 3398148 - RNA, 15 nt, Pseudomonas aeruginosa PA01
gcgcaaccagccgga

SEQ ID NO: 3398149 - RNA, 17 nt, Pseudomonas aeruginosa PA01
gcgcaaccagccggaga

SEQ ID NO: 3398150 - RNA, 14 nt, Pseudomonas aeruginosa PA01
gcgcaaccagcgcu

SEQ ID NO: 3398151 - RNA, 22 nt, Pseudomonas aeruginosa PA01
gcgcaaccgguuucccucgagc

SEQ ID NO: 3398152 - RNA, 18 nt, Pseudomonas aeruginosa PA01
gcgcaaccguuccagcgc

SEQ ID NO: 3398153 - RNA, 20 nt, Pseudomonas aeruginosa PA01
gcgcaaccguuccagcgccu

SEQ ID NO: 3398154 - RNA, 21 nt, Pseudomonas aeruginosa PA01
gcgcaaccguuccagcgccuc

SEQ ID NO: 3398155 - RNA, 19 nt, Pseudomonas aeruginosa PA01
gcgcaacgaaaagccgccc

SEQ ID NO: 3398156 - RNA, 14 nt, Pseudomonas aeruginosa PA01
gcgcaacgccgacg

SEQ ID NO: 3398157 - RNA, 14 nt, Pseudomonas aeruginosa PA01
gcgcaacgccggca

SEQ ID NO: 3398158 - RNA, 13 nt, Pseudomonas aeruginosa PA01
gcgcaacgcgcgc

SEQ ID NO: 3398159 - RNA, 16 nt, Pseudomonas aeruginosa PA01
gcgcaacgcgcgcagg

SEQ ID NO: 3398160 - RNA, 21 nt, Pseudomonas aeruginosa PA01
gcgcaacgcgguuauccgccg

SEQ ID NO: 3398161 - RNA, 18 nt, Pseudomonas aeruginosa PA01
gcgcaacgcuuccagcac

SEQ ID NO: 3398162 - RNA, 18 nt, Pseudomonas aeruginosa PA01
gcgcaacgggacgccagg

SEQ ID NO: 3398163 - RNA, 16 nt, Pseudomonas aeruginosa PA01
gcgcaacgggcggcgg

SEQ ID NO: 3398164 - RNA, 17 nt, Pseudomonas aeruginosa PA01
gcgcaacgggcggcggg

SEQ ID NO: 3398165 - RNA, 16 nt, Pseudomonas aeruginosa PA01
gcgcaacugccggucg

SEQ ID NO: 3398166 - RNA, 14 nt, Pseudomonas aeruginosa PA01
gcgcaacugcgcca

SEQ ID NO: 3398167 - RNA, 16 nt, Pseudomonas aeruginosa PA01
gcgcaacugcggggcg

SEQ ID NO: 3398168 - RNA, 15 nt, Pseudomonas aeruginosa PA01
gcgcaacugcucgaa

SEQ ID NO: 3398169 - RNA, 15 nt, Pseudomonas aeruginosa PA01
gcgcaacuggucgcg

SEQ ID NO: 3398170 - RNA, 16 nt, Pseudomonas aeruginosa PA01
gcgcaacuggucgcgg

SEQ ID NO: 3398171 - RNA, 20 nt, Pseudomonas aeruginosa PA01
gcgcaagccagccaugugcu

SEQ ID NO: 3398172 - RNA, 22 nt, Pseudomonas aeruginosa PA01
gcgcaagccagccaugugcucc

SEQ ID NO: 3398173 - RNA, 19 nt, Pseudomonas aeruginosa PA01
gcgcaagcccaagggcucc

SEQ ID NO: 3398174 - RNA, 18 nt, Pseudomonas aeruginosa PA01
gcgcaagcgcccggcgaa

SEQ ID NO: 3398175 - RNA, 13 nt, Pseudomonas aeruginosa PA01
gcgcaagcggcgg

SEQ ID NO: 3398176 - RNA, 14 nt, Pseudomonas aeruginosa PA01
gcgcaaggcagcgu

SEQ ID NO: 3398177 - RNA, 16 nt, Pseudomonas aeruginosa PA01
gcgcaaggccagcggc

SEQ ID NO: 3398178 - RNA, 14 nt, Pseudomonas aeruginosa PA01
gcgcaagggcgccg

SEQ ID NO: 3398179 - RNA, 17 nt, Pseudomonas aeruginosa PA01
gcgcaagggcgccgccg

SEQ ID NO: 3398180 - RNA, 14 nt, Pseudomonas aeruginosa PA01
gcgcaaggugccga

SEQ ID NO: 3398181 - RNA, 17 nt, Pseudomonas aeruginosa PA01
gcgcaaggugccgaggu

SEQ ID NO: 3398182 - RNA, 20 nt, Pseudomonas aeruginosa PA01
gcgcaaggugccgaggucgu

SEQ ID NO: 3398183 - RNA, 16 nt, Pseudomonas aeruginosa PA01
gcgcaagucggccugc

SEQ ID NO: 3398184 - RNA, 22 nt, Pseudomonas aeruginosa PA01
gcgcaagucggccugcaccagc

SEQ ID NO: 3398185 - RNA, 17 nt, Pseudomonas aeruginosa PA01
gcgcaauacaccgcugc

SEQ ID NO: 3398186 - RNA, 15 nt, Pseudomonas aeruginosa PA01
gcgcaaucagggcug

SEQ ID NO: 3398187 - RNA, 20 nt, Pseudomonas aeruginosa PA01
gcgcaaucagggcugggcgc

SEQ ID NO: 3398188 - RNA, 22 nt, Pseudomonas aeruginosa PA01
gcgcaaucagggcugggcgccc

SEQ ID NO: 3398189 - RNA, 16 nt, Pseudomonas aeruginosa PA01
gcgcacaaaaaagccc

SEQ ID NO: 3398190 - RNA, 19 nt, Pseudomonas aeruginosa PA01
gcgcacaaaaaagcccgcc

SEQ ID NO: 3398191 - RNA, 21 nt, Pseudomonas aeruginosa PA01
gcgcacaaaaaagcccgccag

SEQ ID NO: 3398192 - RNA, 22 nt, Pseudomonas aeruginosa PA01
gcgcacaaaaaagcccgccagg

SEQ ID NO: 3398193 - RNA, 18 nt, Pseudomonas aeruginosa PA01
gcgcacacggucgagacc

SEQ ID NO: 3398194 - RNA, 20 nt, Pseudomonas aeruginosa PA01
gcgcacacggucgagacccg

SEQ ID NO: 3398195 - RNA, 17 nt, Pseudomonas aeruginosa PA01
gcgcacaggcggaaggc

SEQ ID NO: 3398196 - RNA, 19 nt, Pseudomonas aeruginosa PA01
gcgcacaucacccgguucu

SEQ ID NO: 3398197 - RNA, 15 nt, Pseudomonas aeruginosa PA01
gcgcacaugccgagc

SEQ ID NO: 3398198 - RNA, 23 nt, Pseudomonas aeruginosa PA01
gcgcaccacccaucugccggcca

SEQ ID NO: 3398199 - RNA, 16 nt, Pseudomonas aeruginosa PA01
gcgcagaugcggggcg

SEQ ID NO: 3398200 - RNA, 20 nt, Pseudomonas aeruginosa PA01
gcgcagaugcggggcgacca

SEQ ID NO: 3398201 - RNA, 19 nt, Pseudomonas aeruginosa PA01
gcgcagcaacgcgacgauc

SEQ ID NO: 3398202 - RNA, 17 nt, Pseudomonas aeruginosa PA01
gcgcagcaacggcgcau

SEQ ID NO: 3398203 - RNA, 17 nt, Pseudomonas aeruginosa PA01
gcgcagcaacuggucgc

SEQ ID NO: 3398204 - RNA, 18 nt, Pseudomonas aeruginosa PA01
gcgcagcaacuggucgcc

SEQ ID NO: 3398205 - RNA, 16 nt, Pseudomonas aeruginosa PA01
gcgcagcaccacaugg

SEQ ID NO: 3398206 - RNA, 19 nt, Pseudomonas aeruginosa PA01
gcgcagcaccgagacgccc

SEQ ID NO: 3398207 - RNA, 12 nt, Pseudomonas aeruginosa PA01
gcgcagcaccgg

SEQ ID NO: 3398208 - RNA, 20 nt, Pseudomonas aeruginosa PA01
gcgcagcacgaugcacaggc

SEQ ID NO: 3398209 - RNA, 13 nt, Pseudomonas aeruginosa PA01
gcgcagcagcagg

SEQ ID NO: 3398210 - RNA, 11 nt, Pseudomonas aeruginosa PA01
gcgcagcagcg

SEQ ID NO: 3398211 - RNA, 15 nt, Pseudomonas aeruginosa PA01
gcgcagcagcgacuc

SEQ ID NO: 3398212 - RNA, 14 nt, Pseudomonas aeruginosa PA01
gcgcagcagcgcca

SEQ ID NO: 3398213 - RNA, 15 nt, Pseudomonas aeruginosa PA01
gcgcagcagcgccag

SEQ ID NO: 3398214 - RNA, 21 nt, Pseudomonas aeruginosa PA01
gcgcagcagcgucgcgucggc

SEQ ID NO: 3398215 - RNA, 12 nt, Pseudomonas aeruginosa PA01
gcgcagcaggau

SEQ ID NO: 3398216 - RNA, 14 nt, Pseudomonas aeruginosa PA01
gcgcagcaggcggc

SEQ ID NO: 3398217 - RNA, 17 nt, Pseudomonas aeruginosa PA01
gcgcagcagggcgucgg

SEQ ID NO: 3398218 - RNA, 18 nt, Pseudomonas aeruginosa PA01
gcgcagcagggcgucggc

SEQ ID NO: 3398219 - RNA, 16 nt, Pseudomonas aeruginosa PA01
gcgcagcagguagugc

SEQ ID NO: 3398220 - RNA, 14 nt, Pseudomonas aeruginosa PA01
gcgcagcaguaccu

SEQ ID NO: 3398221 - RNA, 21 nt, Pseudomonas aeruginosa PA01
gcgcagcaguaccuggcggua

SEQ ID NO: 3398222 - RNA, 17 nt, Pseudomonas aeruginosa PA01
gcgcagccacccgcucg

SEQ ID NO: 3398223 - RNA, 16 nt, Pseudomonas aeruginosa PA01
gcgcagccacuggcgg

SEQ ID NO: 3398224 - RNA, 13 nt, Pseudomonas aeruginosa PA01
gcgcagccagagc

SEQ ID NO: 3398225 - RNA, 14 nt, Pseudomonas aeruginosa PA01
gcgcagccagagcu

SEQ ID NO: 3398226 - RNA, 13 nt, Pseudomonas aeruginosa PA01
gcgcagccagcac

SEQ ID NO: 3398227 - RNA, 20 nt, Pseudomonas aeruginosa PA01
gcgcagccagcacaugcggu

SEQ ID NO: 3398228 - RNA, 21 nt, Pseudomonas aeruginosa PA01
gcgcagccagcacaugcggug

SEQ ID NO: 3398229 - RNA, 15 nt, Pseudomonas aeruginosa PA01
gcgcagccaggcgag

SEQ ID NO: 3398230 - RNA, 15 nt, Pseudomonas aeruginosa PA01
gcgcagccaggcgau

SEQ ID NO: 3398231 - RNA, 19 nt, Pseudomonas aeruginosa PA01
gcgcagccauucgccgcga

SEQ ID NO: 3398232 - RNA, 12 nt, Pseudomonas aeruginosa PA01
gcgcagcccagc

SEQ ID NO: 3398233 - RNA, 17 nt, Pseudomonas aeruginosa PA01
gcgcagcccuugcaacc

SEQ ID NO: 3398234 - RNA, 12 nt, Pseudomonas aeruginosa PA01
gcgcagccgcaa

SEQ ID NO: 3398235 - RNA, 16 nt, Pseudomonas aeruginosa PA01
gcgcagccgcaaggcc

SEQ ID NO: 3398236 - RNA, 13 nt, Pseudomonas aeruginosa PA01
gcgcagccgcucg

SEQ ID NO: 3398237 - RNA, 16 nt, Pseudomonas aeruginosa PA01
gcgcagccgcucggcc

SEQ ID NO: 3398238 - RNA, 19 nt, Pseudomonas aeruginosa PA01
gcgcagccgcucggccgcc

SEQ ID NO: 3398239 - RNA, 20 nt, Pseudomonas aeruginosa PA01
gcgcagccgcucggccgcca

SEQ ID NO: 3398240 - RNA, 12 nt, Pseudomonas aeruginosa PA01
gcgcagccgcug

SEQ ID NO: 3398241 - RNA, 13 nt, Pseudomonas aeruginosa PA01
gcgcagccgcugc

SEQ ID NO: 3398242 - RNA, 16 nt, Pseudomonas aeruginosa PA01
gcgcagccgcugggcc

SEQ ID NO: 3398243 - RNA, 17 nt, Pseudomonas aeruginosa PA01
gcgcagccguccaucug

SEQ ID NO: 3398244 - RNA, 16 nt, Pseudomonas aeruginosa PA01
gcgcagccucgcgcuc

SEQ ID NO: 3398245 - RNA, 18 nt, Pseudomonas aeruginosa PA01
gcgcagccucgcgcucgg

SEQ ID NO: 3398246 - RNA, 21 nt, Pseudomonas aeruginosa PA01
gcgcagccucgcgcucggcgg

SEQ ID NO: 3398247 - RNA, 17 nt, Pseudomonas aeruginosa PA01
gcgcagccugcuggccu

SEQ ID NO: 3398248 - RNA, 19 nt, Pseudomonas aeruginosa PA01
gcgcagccugcuggccugg

SEQ ID NO: 3398249 - RNA, 23 nt, Pseudomonas aeruginosa PA01
gcgcagccugcuggccugggacg

SEQ ID NO: 3398250 - RNA, 16 nt, Pseudomonas aeruginosa PA01
gcgcagcgaagaucuu

SEQ ID NO: 3398251 - RNA, 15 nt, Pseudomonas aeruginosa PA01
gcgcagcgccaccag

SEQ ID NO: 3398252 - RNA, 13 nt, Pseudomonas aeruginosa PA01
gcgcagcgcccga

SEQ ID NO: 3398253 - RNA, 17 nt, Pseudomonas aeruginosa PA01
gcgcagcgccgccgcgu

SEQ ID NO: 3398254 - RNA, 12 nt, Pseudomonas aeruginosa PA01
gcgcagcgccuc

SEQ ID NO: 3398255 - RNA, 24 nt, Pseudomonas aeruginosa PA01
gcgcagcgccuccagcgucugccg

SEQ ID NO: 3398256 - RNA, 12 nt, Pseudomonas aeruginosa PA01
gcgcagcgcggc

SEQ ID NO: 3398257 - RNA, 13 nt, Pseudomonas aeruginosa PA01
gcgcagcgcggcg

SEQ ID NO: 3398258 - RNA, 14 nt, Pseudomonas aeruginosa PA01
gcgcagcgcggcgc

SEQ ID NO: 3398259 - RNA, 15 nt, Pseudomonas aeruginosa PA01
gcgcagcgcggcgcu

SEQ ID NO: 3398260 - RNA, 15 nt, Pseudomonas aeruginosa PA01
gcgcagcgcgggggc

SEQ ID NO: 3398261 - RNA, 21 nt, Pseudomonas aeruginosa PA01
gcgcagcggaggauucagcag

SEQ ID NO: 3398262 - RNA, 23 nt, Pseudomonas aeruginosa PA01
gcgcagcggaggauucagcagga

SEQ ID NO: 3398263 - RNA, 13 nt, Pseudomonas aeruginosa PA01
gcgcagcggcagc

SEQ ID NO: 3398264 - RNA, 16 nt, Pseudomonas aeruginosa PA01
gcgcagcggcagcgcc

SEQ ID NO: 3398265 - RNA, 17 nt, Pseudomonas aeruginosa PA01
gcgcagcggcagcgcca

SEQ ID NO: 3398266 - RNA, 19 nt, Pseudomonas aeruginosa PA01
gcgcagcggcagcgccagg

SEQ ID NO: 3398267 - RNA, 16 nt, Pseudomonas aeruginosa PA01
gcgcagcggcaggcca

SEQ ID NO: 3398268 - RNA, 17 nt, Pseudomonas aeruginosa PA01
gcgcagcggcaggccac

SEQ ID NO: 3398269 - RNA, 11 nt, Pseudomonas aeruginosa PA01
gcgcagcggcg

SEQ ID NO: 3398270 - RNA, 12 nt, Pseudomonas aeruginosa PA01
gcgcagcggcgc

SEQ ID NO: 3398271 - RNA, 13 nt, Pseudomonas aeruginosa PA01
gcgcagcggcgcc

SEQ ID NO: 3398272 - RNA, 17 nt, Pseudomonas aeruginosa PA01
gcgcagcggcgccgagg

SEQ ID NO: 3398273 - RNA, 18 nt, Pseudomonas aeruginosa PA01
gcgcagcggcgccgaggg

SEQ ID NO: 3398274 - RNA, 16 nt, Pseudomonas aeruginosa PA01
gcgcagcggcgcgucg

SEQ ID NO: 3398275 - RNA, 12 nt, Pseudomonas aeruginosa PA01
gcgcagcggcuc

SEQ ID NO: 3398276 - RNA, 19 nt, Pseudomonas aeruginosa PA01
gcgcagcgguacaggcgga

SEQ ID NO: 3398277 - RNA, 20 nt, Pseudomonas aeruginosa PA01
gcgcagcgucaccgcgucgg

SEQ ID NO: 3398278 - RNA, 15 nt, Pseudomonas aeruginosa PA01
gcgcagcguccugcc

SEQ ID NO: 3398279 - RNA, 14 nt, Pseudomonas aeruginosa PA01
gcgcagcuaggcga

SEQ ID NO: 3398280 - RNA, 17 nt, Pseudomonas aeruginosa PA01
gcgcagcuaggcgagga

SEQ ID NO: 3398281 - RNA, 14 nt, Pseudomonas aeruginosa PA01
gcgcagcuccggca

SEQ ID NO: 3398282 - RNA, 15 nt, Pseudomonas aeruginosa PA01
gcgcagcuccggcag

SEQ ID NO: 3398283 - RNA, 16 nt, Pseudomonas aeruginosa PA01
gcgcagcuccggcagc

SEQ ID NO: 3398284 - RNA, 18 nt, Pseudomonas aeruginosa PA01
gcgcagcuccggcagcag

SEQ ID NO: 3398285 - RNA, 21 nt, Pseudomonas aeruginosa PA01
gcgcagcuccggcagcagggu

SEQ ID NO: 3398286 - RNA, 15 nt, Pseudomonas aeruginosa PA01
gcgcagcuccucggc

SEQ ID NO: 3398287 - RNA, 23 nt, Pseudomonas aeruginosa PA01
gcgcagcugguaggagccgucgc

SEQ ID NO: 3398288 - RNA, 20 nt, Pseudomonas aeruginosa PA01
gcgcagcuguucacaaaggc

SEQ ID NO: 3398289 - RNA, 19 nt, Pseudomonas aeruginosa PA01
gcgcagcuucuccaccgga

SEQ ID NO: 3398290 - RNA, 16 nt, Pseudomonas aeruginosa PA01
gcgcagcuugcucgau

SEQ ID NO: 3398291 - RNA, 20 nt, Pseudomonas aeruginosa PA01
gcgcaggaagaaggcgucca

SEQ ID NO: 3398292 - RNA, 20 nt, Pseudomonas aeruginosa PA01
gcgcaggaagcugcgcucgg

SEQ ID NO: 3398293 - RNA, 17 nt, Pseudomonas aeruginosa PA01
gcgcaggaccacgcugg

SEQ ID NO: 3398294 - RNA, 17 nt, Pseudomonas aeruginosa PA01
gcgcaggaccgccaugg

SEQ ID NO: 3398295 - RNA, 23 nt, Pseudomonas aeruginosa PA01
gcgcaggaccgccauggcgcuga

SEQ ID NO: 3398296 - RNA, 23 nt, Pseudomonas aeruginosa PA01
gcgcaggacggauaacggcagcc

SEQ ID NO: 3398297 - RNA, 23 nt, Pseudomonas aeruginosa PA01
gcgcaggccgagguuuccaguug

SEQ ID NO: 3398298 - RNA, 12 nt, Pseudomonas aeruginosa PA01
gcgcaggccgau

SEQ ID NO: 3398299 - RNA, 14 nt, Pseudomonas aeruginosa PA01
gcgcaggccgccgg

SEQ ID NO: 3398300 - RNA, 16 nt, Pseudomonas aeruginosa PA01
gcgcaggccgccggcg

SEQ ID NO: 3398301 - RNA, 19 nt, Pseudomonas aeruginosa PA01
gcgcaggccgccggcggcc

SEQ ID NO: 3398302 - RNA, 14 nt, Pseudomonas aeruginosa PA01
gcgcaggccgggcg

SEQ ID NO: 3398303 - RNA, 17 nt, Pseudomonas aeruginosa PA01
gcgcaguucagggcgua

SEQ ID NO: 3398304 - RNA, 21 nt, Pseudomonas aeruginosa PA01
gcgcaguucagggcguagcgg

SEQ ID NO: 3398305 - RNA, 15 nt, Pseudomonas aeruginosa PA01
gcgcaguucaucgag

SEQ ID NO: 3398306 - RNA, 13 nt, Pseudomonas aeruginosa PA01
gcgcaguucgccg

SEQ ID NO: 3398307 - RNA, 16 nt, Pseudomonas aeruginosa PA01
gcgcaguucgccgccg

SEQ ID NO: 3398308 - RNA, 18 nt, Pseudomonas aeruginosa PA01
gcgcaguucgccgccgag

SEQ ID NO: 3398309 - RNA, 20 nt, Pseudomonas aeruginosa PA01
gcgcaguucgccgccgagcg

SEQ ID NO: 3398310 - RNA, 17 nt, Pseudomonas aeruginosa PA01
gcgcaguucguccaucg

SEQ ID NO: 3398311 - RNA, 16 nt, Pseudomonas aeruginosa PA01
gcgcaguucgucgccc

SEQ ID NO: 3398312 - RNA, 17 nt, Pseudomonas aeruginosa PA01
gcgcaguucgucgccca

SEQ ID NO: 3398313 - RNA, 22 nt, Pseudomonas aeruginosa PA01
gcgcaguucgucuuccagcggc

SEQ ID NO: 3398314 - RNA, 12 nt, Pseudomonas aeruginosa PA01
gcgcaguugcca

SEQ ID NO: 3398315 - RNA, 15 nt, Pseudomonas aeruginosa PA01
gcgcaguugccagga

SEQ ID NO: 3398316 - RNA, 16 nt, Pseudomonas aeruginosa PA01
gcgcaguugccaggau

SEQ ID NO: 3398317 - RNA, 13 nt, Pseudomonas aeruginosa PA01
gcgcauaaccgcu

SEQ ID NO: 3398318 - RNA, 19 nt, Pseudomonas aeruginosa PA01
gcgcauaaccgcuugcggu

SEQ ID NO: 3398319 - RNA, 21 nt, Pseudomonas aeruginosa PA01
gcgcauacgaaaacggcccuc

SEQ ID NO: 3398320 - RNA, 15 nt, Pseudomonas aeruginosa PA01
gcgcauagcaggccu

SEQ ID NO: 3398321 - RNA, 22 nt, Pseudomonas aeruginosa PA01
gcgcauagcaggccuggagcgc

SEQ ID NO: 3398322 - RNA, 14 nt, Pseudomonas aeruginosa PA01
gcgcauagccaccg

SEQ ID NO: 3398323 - RNA, 14 nt, Pseudomonas aeruginosa PA01
gcgcauagcggcca

SEQ ID NO: 3398324 - RNA, 18 nt, Pseudomonas aeruginosa PA01
gcgcaucaccccgcaacc

SEQ ID NO: 3398325 - RNA, 13 nt, Pseudomonas aeruginosa PA01
gcgcaucagcgcc

SEQ ID NO: 3398326 - RNA, 14 nt, Pseudomonas aeruginosa PA01
gcgcaucagcgccg

SEQ ID NO: 3398327 - RNA, 21 nt, Pseudomonas aeruginosa PA01
gcgcaucaggccaaagccgca

SEQ ID NO: 3398328 - RNA, 14 nt, Pseudomonas aeruginosa PA01
gcgcaucaggucgg

SEQ ID NO: 3398329 - RNA, 22 nt, Pseudomonas aeruginosa PA01
gcgcauccguaaaauggcgcgc

SEQ ID NO: 3398330 - RNA, 17 nt, Pseudomonas aeruginosa PA01
gcgcauccucggcaucc

SEQ ID NO: 3398331 - RNA, 19 nt, Pseudomonas aeruginosa PA01
gcgcauccucggcauccag

SEQ ID NO: 3398332 - RNA, 16 nt, Pseudomonas aeruginosa PA01
gcgcaucgaggccggc

SEQ ID NO: 3398333 - RNA, 17 nt, Pseudomonas aeruginosa PA01
gcgcaucgaggccggca

SEQ ID NO: 3398334 - RNA, 22 nt, Pseudomonas aeruginosa PA01
gcgcaucgaugccuugcggccc

SEQ ID NO: 3398335 - RNA, 17 nt, Pseudomonas aeruginosa PA01
gcgcaucgccugggccg

SEQ ID NO: 3398336 - RNA, 19 nt, Pseudomonas aeruginosa PA01
gcgcaucgccugggccggc

SEQ ID NO: 3398337 - RNA, 21 nt, Pseudomonas aeruginosa PA01
gcgcaucgccugggccggcgu

SEQ ID NO: 3398338 - RNA, 15 nt, Pseudomonas aeruginosa PA01
gcgcaucggcgccuc

SEQ ID NO: 3398339 - RNA, 13 nt, Pseudomonas aeruginosa PA01
gcgcaucggcgga

SEQ ID NO: 3398340 - RNA, 17 nt, Pseudomonas aeruginosa PA01
gcgcaucggugccggca

SEQ ID NO: 3398341 - RNA, 22 nt, Pseudomonas aeruginosa PA01
gcgcaucgucgaaacgcuggcg

SEQ ID NO: 3398342 - RNA, 15 nt, Pseudomonas aeruginosa PA01
gcgcaucgugcagcc

SEQ ID NO: 3398343 - RNA, 18 nt, Pseudomonas aeruginosa PA01
gcgcaucuggcugcgcgc

SEQ ID NO: 3398344 - RNA, 16 nt, Pseudomonas aeruginosa PA01
gcgcaugaggccuggu

SEQ ID NO: 3398345 - RNA, 18 nt, Pseudomonas aeruginosa PA01
gcgcaugaggccuggucc

SEQ ID NO: 3398346 - RNA, 17 nt, Pseudomonas aeruginosa PA01
gcgcaugaggcuggcca

SEQ ID NO: 3398347 - RNA, 19 nt, Pseudomonas aeruginosa PA01
gcgcaugaggcuggccagc

SEQ ID NO: 3398348 - RNA, 15 nt, Pseudomonas aeruginosa PA01
gcgcaugaucgccuc

SEQ ID NO: 3398349 - RNA, 15 nt, Pseudomonas aeruginosa PA01
gcgcaugcagggcgu

SEQ ID NO: 3398350 - RNA, 13 nt, Pseudomonas aeruginosa PA01
gcgcaugcccagg

SEQ ID NO: 3398351 - RNA, 17 nt, Pseudomonas aeruginosa PA01
gcgcaugcccagggcca

SEQ ID NO: 3398352 - RNA, 18 nt, Pseudomonas aeruginosa PA01
gcgcaugcccagggccag

SEQ ID NO: 3398353 - RNA, 15 nt, Pseudomonas aeruginosa PA01
gcgcaugccgcagga

SEQ ID NO: 3398354 - RNA, 20 nt, Pseudomonas aeruginosa PA01
gcgcaugccguuggccgagc

SEQ ID NO: 3398355 - RNA, 14 nt, Pseudomonas aeruginosa PA01
gcgcaugcgccggc

SEQ ID NO: 3398356 - RNA, 15 nt, Pseudomonas aeruginosa PA01
gcgcaugcgccggcu

SEQ ID NO: 3398357 - RNA, 16 nt, Pseudomonas aeruginosa PA01
gcgcaugcgccggcuu

SEQ ID NO: 3398358 - RNA, 13 nt, Pseudomonas aeruginosa PA01
gcgcaugcggaag

SEQ ID NO: 3398359 - RNA, 21 nt, Pseudomonas aeruginosa PA01
gcgcaugcugggucuccgcuc

SEQ ID NO: 3398360 - RNA, 23 nt, Pseudomonas aeruginosa PA01
gcgcaugcugggucuccgcucgg

SEQ ID NO: 3398361 - RNA, 15 nt, Pseudomonas aeruginosa PA01
gcgcauggagacggc

SEQ ID NO: 3398362 - RNA, 21 nt, Pseudomonas aeruginosa PA01
gcgcauggagacggcccgccc

SEQ ID NO: 3398363 - RNA, 21 nt, Pseudomonas aeruginosa PA01
gcgcauggcgcucuucaccgu

SEQ ID NO: 3398364 - RNA, 18 nt, Pseudomonas aeruginosa PA01
gcgcauggcggcgaccgc

SEQ ID NO: 3398365 - RNA, 16 nt, Pseudomonas aeruginosa PA01
gcgcauggucgcgcug

SEQ ID NO: 3398366 - RNA, 23 nt, Pseudomonas aeruginosa PA01
gcgcauguccagccaguggcugg

SEQ ID NO: 3398367 - RNA, 18 nt, Pseudomonas aeruginosa PA01
gcgcaugucgcgauugga

SEQ ID NO: 3398368 - RNA, 13 nt, Pseudomonas aeruginosa PA01
gcgcaugucgucc

SEQ ID NO: 3398369 - RNA, 19 nt, Pseudomonas aeruginosa PA01
gcgcaugucguccaggcug

SEQ ID NO: 3398370 - RNA, 17 nt, Pseudomonas aeruginosa PA01
gcgcauuugcacgucgg

SEQ ID NO: 3398371 - RNA, 22 nt, Pseudomonas aeruginosa PA01
gcgcauuuucauugccucgagc

SEQ ID NO: 3398372 - RNA, 17 nt, Pseudomonas aeruginosa PA01
gcgcauuuugccggaga

SEQ ID NO: 3398373 - RNA, 22 nt, Pseudomonas aeruginosa PA01
gcgccaaaaagcaggacggcga

SEQ ID NO: 3398374 - RNA, 22 nt, Pseudomonas aeruginosa PA01
gcgccaaccaugguuuccgccg

SEQ ID NO: 3398375 - RNA, 17 nt, Pseudomonas aeruginosa PA01
gcgccaaccgggcagca

SEQ ID NO: 3398376 - RNA, 14 nt, Pseudomonas aeruginosa PA01
gcgccaacucggcc

SEQ ID NO: 3398377 - RNA, 15 nt, Pseudomonas aeruginosa PA01
gcgccaacuggcgca

SEQ ID NO: 3398378 - RNA, 13 nt, Pseudomonas aeruginosa PA01
gcgccaaggccgc

SEQ ID NO: 3398379 - RNA, 18 nt, Pseudomonas aeruginosa PA01
gcgccaaggccgccaggc

SEQ ID NO: 3398380 - RNA, 20 nt, Pseudomonas aeruginosa PA01
gcgccaaggccgccaggccu

SEQ ID NO: 3398381 - RNA, 13 nt, Pseudomonas aeruginosa PA01
gcgccaagguucc

SEQ ID NO: 3398382 - RNA, 19 nt, Pseudomonas aeruginosa PA01
gcgccaagguuccagcccc

SEQ ID NO: 3398383 - RNA, 20 nt, Pseudomonas aeruginosa PA01
gcgccaagguuccagccccg

SEQ ID NO: 3398384 - RNA, 21 nt, Pseudomonas aeruginosa PA01
gcgccaagguuccagccccgc

SEQ ID NO: 3398385 - RNA, 23 nt, Pseudomonas aeruginosa PA01
gcgccaaugccuuccgacgccgc

SEQ ID NO: 3398386 - RNA, 21 nt, Pseudomonas aeruginosa PA01
gcgccaccaccgucacggcga

SEQ ID NO: 3398387 - RNA, 12 nt, Pseudomonas aeruginosa PA01
gcgccaccagca

SEQ ID NO: 3398388 - RNA, 14 nt, Pseudomonas aeruginosa PA01
gcgccaccagcagg

SEQ ID NO: 3398389 - RNA, 16 nt, Pseudomonas aeruginosa PA01
gcgccaccagcagggc

SEQ ID NO: 3398390 - RNA, 21 nt, Pseudomonas aeruginosa PA01
gcgccaccagcagggccaggc

SEQ ID NO: 3398391 - RNA, 23 nt, Pseudomonas aeruginosa PA01
gcgccaccagcaugcccagcgug

SEQ ID NO: 3398392 - RNA, 14 nt, Pseudomonas aeruginosa PA01
gcgccaccagcgug

SEQ ID NO: 3398393 - RNA, 21 nt, Pseudomonas aeruginosa PA01
gcgccaccagcguggcgcgca

SEQ ID NO: 3398394 - RNA, 15 nt, Pseudomonas aeruginosa PA01
gcgccaccccgccgc

SEQ ID NO: 3398395 - RNA, 17 nt, Pseudomonas aeruginosa PA01
gcgccaccccgccgcgc

SEQ ID NO: 3398396 - RNA, 12 nt, Pseudomonas aeruginosa PA01
gcgccacccucg

SEQ ID NO: 3398397 - RNA, 15 nt, Pseudomonas aeruginosa PA01
gcgccacccucggcu

SEQ ID NO: 3398398 - RNA, 21 nt, Pseudomonas aeruginosa PA01
gcgccaccgauagcggcgcga

SEQ ID NO: 3398399 - RNA, 17 nt, Pseudomonas aeruginosa PA01
gcgccaccgauucgccg

SEQ ID NO: 3398400 - RNA, 22 nt, Pseudomonas aeruginosa PA01
gcgccaccgauucgccggccac

SEQ ID NO: 3398401 - RNA, 19 nt, Pseudomonas aeruginosa PA01
gcgccaccgcgacgcgcug

SEQ ID NO: 3398402 - RNA, 22 nt, Pseudomonas aeruginosa PA01
gcgccacgcaggaacagcuccu

SEQ ID NO: 3398403 - RNA, 19 nt, Pseudomonas aeruginosa PA01
gcgccacgccgcugucguc

SEQ ID NO: 3398404 - RNA, 21 nt, Pseudomonas aeruginosa PA01
gcgccacgcgagaagccgccc

SEQ ID NO: 3398405 - RNA, 20 nt, Pseudomonas aeruginosa PA01
gcgccagggcauguuccucc

SEQ ID NO: 3398406 - RNA, 13 nt, Pseudomonas aeruginosa PA01
gcgccagggccgg

SEQ ID NO: 3398407 - RNA, 14 nt, Pseudomonas aeruginosa PA01
gcgccagggccggg

SEQ ID NO: 3398408 - RNA, 13 nt, Pseudomonas aeruginosa PA01
gcgccagguagcc

SEQ ID NO: 3398409 - RNA, 17 nt, Pseudomonas aeruginosa PA01
gcgccagguagugccgc

SEQ ID NO: 3398410 - RNA, 19 nt, Pseudomonas aeruginosa PA01
gcgccagguagugccgccc

SEQ ID NO: 3398411 - RNA, 15 nt, Pseudomonas aeruginosa PA01
gcgccaggugcagga

SEQ ID NO: 3398412 - RNA, 24 nt, Pseudomonas aeruginosa PA01
gcgccaggugcaggaagcgccggg

SEQ ID NO: 3398413 - RNA, 19 nt, Pseudomonas aeruginosa PA01
gcgccagguuggccuggcc

SEQ ID NO: 3398414 - RNA, 19 nt, Pseudomonas aeruginosa PA01
gcgccaguacuccgagggc

SEQ ID NO: 3398415 - RNA, 20 nt, Pseudomonas aeruginosa PA01
gcgccaguacuccgagggcc

SEQ ID NO: 3398416 - RNA, 22 nt, Pseudomonas aeruginosa PA01
gcgccaguacuccgagggccgc

SEQ ID NO: 3398417 - RNA, 22 nt, Pseudomonas aeruginosa PA01
gcgccaguccacgacgaacggc

SEQ ID NO: 3398418 - RNA, 22 nt, Pseudomonas aeruginosa PA01
gcgccagucccgcaaagcccgc

SEQ ID NO: 3398419 - RNA, 14 nt, Pseudomonas aeruginosa PA01
gcgccagugccugc

SEQ ID NO: 3398420 - RNA, 12 nt, Pseudomonas aeruginosa PA01
gcgccaguucgc

SEQ ID NO: 3398421 - RNA, 16 nt, Pseudomonas aeruginosa PA01
gcgccaguucgccggu

SEQ ID NO: 3398422 - RNA, 20 nt, Pseudomonas aeruginosa PA01
gcgccaguucgccggugacg

SEQ ID NO: 3398423 - RNA, 17 nt, Pseudomonas aeruginosa PA01
gcgccaguuggacgcgg

SEQ ID NO: 3398424 - RNA, 20 nt, Pseudomonas aeruginosa PA01
gcgccaguuggacgcggccu

SEQ ID NO: 3398425 - RNA, 23 nt, Pseudomonas aeruginosa PA01
gcgccauaccggcaaggcggccu

SEQ ID NO: 3398426 - RNA, 15 nt, Pseudomonas aeruginosa PA01
gcgccauaggccagc

SEQ ID NO: 3398427 - RNA, 17 nt, Pseudomonas aeruginosa PA01
gcgccauaggccagcac

SEQ ID NO: 3398428 - RNA, 18 nt, Pseudomonas aeruginosa PA01
gcgccauaggccagcacc

SEQ ID NO: 3398429 - RNA, 19 nt, Pseudomonas aeruginosa PA01
gcgccauauuucgaagggu

SEQ ID NO: 3398430 - RNA, 13 nt, Pseudomonas aeruginosa PA01
gcgccaucaggcc

SEQ ID NO: 3398431 - RNA, 15 nt, Pseudomonas aeruginosa PA01
gcgccaucaggcccu

SEQ ID NO: 3398432 - RNA, 16 nt, Pseudomonas aeruginosa PA01
gcgccaucaguuccuc

SEQ ID NO: 3398433 - RNA, 18 nt, Pseudomonas aeruginosa PA01
gcgccaucaguuccucgc

SEQ ID NO: 3398434 - RNA, 16 nt, Pseudomonas aeruginosa PA01
gcgccauccuccagcg

SEQ ID NO: 3398435 - RNA, 19 nt, Pseudomonas aeruginosa PA01
gcgccauccuccagcgccg

SEQ ID NO: 3398436 - RNA, 20 nt, Pseudomonas aeruginosa PA01
gcgccauccuccagcgccgc

SEQ ID NO: 3398437 - RNA, 21 nt, Pseudomonas aeruginosa PA01
gcgccauccuccagcgccgca

SEQ ID NO: 3398438 - RNA, 18 nt, Pseudomonas aeruginosa PA01
gcgccaucgaucagcagc

SEQ ID NO: 3398439 - RNA, 19 nt, Pseudomonas aeruginosa PA01
gcgccaucgaucagcagcg

SEQ ID NO: 3398440 - RNA, 21 nt, Pseudomonas aeruginosa PA01
gcgccaucgaucagcagcgcc

SEQ ID NO: 3398441 - RNA, 22 nt, Pseudomonas aeruginosa PA01
gcgccaucgaucagcagcgcca

SEQ ID NO: 3398442 - RNA, 23 nt, Pseudomonas aeruginosa PA01
gcgccaucgaucagcagcgccac

SEQ ID NO: 3398443 - RNA, 20 nt, Pseudomonas aeruginosa PA01
gcgccaucgcuuuccuggcc

SEQ ID NO: 3398444 - RNA, 23 nt, Pseudomonas aeruginosa PA01
gcgccaucgcuuuccuggccgac

SEQ ID NO: 3398445 - RNA, 14 nt, Pseudomonas aeruginosa PA01
gcgccaucggcggu

SEQ ID NO: 3398446 - RNA, 21 nt, Pseudomonas aeruginosa PA01
gcgccaucggcgguacgcccu

SEQ ID NO: 3398447 - RNA, 17 nt, Pseudomonas aeruginosa PA01
gcgccaugacccgcggc

SEQ ID NO: 3398448 - RNA, 18 nt, Pseudomonas aeruginosa PA01
gcgccaugacccgcggca

SEQ ID NO: 3398449 - RNA, 13 nt, Pseudomonas aeruginosa PA01
gcgccaugccggc

SEQ ID NO: 3398450 - RNA, 14 nt, Pseudomonas aeruginosa PA01
gcgccaugccggcg

SEQ ID NO: 3398451 - RNA, 15 nt, Pseudomonas aeruginosa PA01
gcgccaugccggcgc

SEQ ID NO: 3398452 - RNA, 19 nt, Pseudomonas aeruginosa PA01
gcgccaugccguucaggcc

SEQ ID NO: 3398453 - RNA, 22 nt, Pseudomonas aeruginosa PA01
gcgccaugccguucaggccggc

SEQ ID NO: 3398454 - RNA, 17 nt, Pseudomonas aeruginosa PA01
gcgccaugcucuucagg

SEQ ID NO: 3398455 - RNA, 20 nt, Pseudomonas aeruginosa PA01
gcgccaugcucuucaggcug

SEQ ID NO: 3398456 - RNA, 12 nt, Pseudomonas aeruginosa PA01
gcgccaugcugu

SEQ ID NO: 3398457 - RNA, 16 nt, Pseudomonas aeruginosa PA01
gcgccauggccgcuga

SEQ ID NO: 3398458 - RNA, 12 nt, Pseudomonas aeruginosa PA01
gcgccaugggga

SEQ ID NO: 3398459 - RNA, 21 nt, Pseudomonas aeruginosa PA01
gcgccauguuccacaugcgcu

SEQ ID NO: 3398460 - RNA, 15 nt, Pseudomonas aeruginosa PA01
gcgccauuccgcggc

SEQ ID NO: 3398461 - RNA, 16 nt, Pseudomonas aeruginosa PA01
gcgccauuccgcggca

SEQ ID NO: 3398462 - RNA, 15 nt, Pseudomonas aeruginosa PA01
gcgccauugccgcca

SEQ ID NO: 3398463 - RNA, 17 nt, Pseudomonas aeruginosa PA01
gcgccauugccgccagg

SEQ ID NO: 3398464 - RNA, 18 nt, Pseudomonas aeruginosa PA01
gcgccauugccgccaggu

SEQ ID NO: 3398465 - RNA, 20 nt, Pseudomonas aeruginosa PA01
gcgccauugccgccaggugu

SEQ ID NO: 3398466 - RNA, 16 nt, Pseudomonas aeruginosa PA01
gcgccauugugcgcgc

SEQ ID NO: 3398467 - RNA, 20 nt, Pseudomonas aeruginosa PA01
gcgccauuucaaggcgacgc

SEQ ID NO: 3398468 - RNA, 23 nt, Pseudomonas aeruginosa PA01
gcgccauuucaaggcgacgcucu

SEQ ID NO: 3398469 - RNA, 21 nt, Pseudomonas aeruginosa PA01
gcgcccaacgucuucaggcgc

SEQ ID NO: 3398470 - RNA, 16 nt, Pseudomonas aeruginosa PA01
gcgcccacuccaacca

SEQ ID NO: 3398471 - RNA, 21 nt, Pseudomonas aeruginosa PA01
gcgcccacuccuccgccugca

SEQ ID NO: 3398472 - RNA, 15 nt, Pseudomonas aeruginosa PA01
gcgcccagaguucgc

SEQ ID NO: 3398473 - RNA, 20 nt, Pseudomonas aeruginosa PA01
gcgcccagaguucgcccagc

SEQ ID NO: 3398474 - RNA, 21 nt, Pseudomonas aeruginosa PA01
gcgcccagaguucgcccagcu

SEQ ID NO: 3398475 - RNA, 13 nt, Pseudomonas aeruginosa PA01
gcgcccagcacca

SEQ ID NO: 3398476 - RNA, 17 nt, Pseudomonas aeruginosa PA01
gcgcccagcagcaggcc

SEQ ID NO: 3398477 - RNA, 18 nt, Pseudomonas aeruginosa PA01
gcgcccagcagcaggccg

SEQ ID NO: 3398478 - RNA, 19 nt, Pseudomonas aeruginosa PA01
gcgcccagcagcaggccgg

SEQ ID NO: 3398479 - RNA, 21 nt, Pseudomonas aeruginosa PA01
gcgcccagcagcaggccggcg

SEQ ID NO: 3398480 - RNA, 17 nt, Pseudomonas aeruginosa PA01
gcgcccagccagagcgu

SEQ ID NO: 3398481 - RNA, 13 nt, Pseudomonas aeruginosa PA01
gcgcccaggcagc

SEQ ID NO: 3398482 - RNA, 15 nt, Pseudomonas aeruginosa PA01
gcgcccaggcagcag

SEQ ID NO: 3398483 - RNA, 17 nt, Pseudomonas aeruginosa PA01
gcgcccaggcagcagag

SEQ ID NO: 3398484 - RNA, 23 nt, Pseudomonas aeruginosa PA01
gcgcccaggcagcagagcgccac

SEQ ID NO: 3398485 - RNA, 13 nt, Pseudomonas aeruginosa PA01
gcgcccaggccca

SEQ ID NO: 3398486 - RNA, 14 nt, Pseudomonas aeruginosa PA01
gcgcccaggcccag

SEQ ID NO: 3398487 - RNA, 15 nt, Pseudomonas aeruginosa PA01
gcgcccaggcccagc

SEQ ID NO: 3398488 - RNA, 13 nt, Pseudomonas aeruginosa PA01
gcgcccaggccgg

SEQ ID NO: 3398489 - RNA, 14 nt, Pseudomonas aeruginosa PA01
gcgcccaggccggg

SEQ ID NO: 3398490 - RNA, 15 nt, Pseudomonas aeruginosa PA01
gcgcccaggccgggu

SEQ ID NO: 3398491 - RNA, 12 nt, Pseudomonas aeruginosa PA01
gcgcccaggcug

SEQ ID NO: 3398492 - RNA, 13 nt, Pseudomonas aeruginosa PA01
gcgcccaggcugc

SEQ ID NO: 3398493 - RNA, 14 nt, Pseudomonas aeruginosa PA01
gcgcccaggcugcc

SEQ ID NO: 3398494 - RNA, 16 nt, Pseudomonas aeruginosa PA01
gcgcccaggcugccgg

SEQ ID NO: 3398495 - RNA, 21 nt, Pseudomonas aeruginosa PA01
gcgcccaggcugccggccagg

SEQ ID NO: 3398496 - RNA, 20 nt, Pseudomonas aeruginosa PA01
gcgcccagggacgcgccggc

SEQ ID NO: 3398497 - RNA, 12 nt, Pseudomonas aeruginosa PA01
gcgcccagggcu

SEQ ID NO: 3398498 - RNA, 19 nt, Pseudomonas aeruginosa PA01
gcgcccagggcuucgcggu

SEQ ID NO: 3398499 - RNA, 13 nt, Pseudomonas aeruginosa PA01
gcgcccagguagg

SEQ ID NO: 3398500 - RNA, 22 nt, Pseudomonas aeruginosa PA01
gcgcccaguggaauucgaugaa

SEQ ID NO: 3398501 - RNA, 16 nt, Pseudomonas aeruginosa PA01
gcgcccaugccgcccg

SEQ ID NO: 3398502 - RNA, 21 nt, Pseudomonas aeruginosa PA01
gcgcccaugccgcccggccgc

SEQ ID NO: 3398503 - RNA, 15 nt, Pseudomonas aeruginosa PA01
gcgccccaccaggcu

SEQ ID NO: 3398504 - RNA, 19 nt, Pseudomonas aeruginosa PA01
gcgccccacggcgcggccg

SEQ ID NO: 3398505 - RNA, 13 nt, Pseudomonas aeruginosa PA01
gcgccccagcacc

SEQ ID NO: 3398506 - RNA, 12 nt, Pseudomonas aeruginosa PA01
gcgccccagcgc

SEQ ID NO: 3398507 - RNA, 13 nt, Pseudomonas aeruginosa PA01
gcgccccagcgcc

SEQ ID NO: 3398508 - RNA, 16 nt, Pseudomonas aeruginosa PA01
gcgccgaacagggcga

SEQ ID NO: 3398509 - RNA, 18 nt, Pseudomonas aeruginosa PA01
gcgccgaacagggcgagc

SEQ ID NO: 3398510 - RNA, 23 nt, Pseudomonas aeruginosa PA01
gcgccgaacagggcgagcagggc

SEQ ID NO: 3398511 - RNA, 21 nt, Pseudomonas aeruginosa PA01
gcgccgaacaggguugggcga

SEQ ID NO: 3398512 - RNA, 22 nt, Pseudomonas aeruginosa PA01
gcgccgaacucgaacgcgugaa

SEQ ID NO: 3398513 - RNA, 16 nt, Pseudomonas aeruginosa PA01
gcgccgaaggccagcu

SEQ ID NO: 3398514 - RNA, 14 nt, Pseudomonas aeruginosa PA01
gcgccgaaggcgau

SEQ ID NO: 3398515 - RNA, 15 nt, Pseudomonas aeruginosa PA01
gcgccgaaggcguca

SEQ ID NO: 3398516 - RNA, 20 nt, Pseudomonas aeruginosa PA01
gcgccgaaggcgucgggcag

SEQ ID NO: 3398517 - RNA, 15 nt, Pseudomonas aeruginosa PA01
gcgccgaauccaggc

SEQ ID NO: 3398518 - RNA, 20 nt, Pseudomonas aeruginosa PA01
gcgccgaauccaggccgacg

SEQ ID NO: 3398519 - RNA, 21 nt, Pseudomonas aeruginosa PA01
gcgccgaauccaggccgacga

SEQ ID NO: 3398520 - RNA, 15 nt, Pseudomonas aeruginosa PA01
gcgccgaccacgacc

SEQ ID NO: 3398521 - RNA, 22 nt, Pseudomonas aeruginosa PA01
gcgccgaccacgaccgcgucca

SEQ ID NO: 3398522 - RNA, 15 nt, Pseudomonas aeruginosa PA01
gcgccgaccagcaac

SEQ ID NO: 3398523 - RNA, 13 nt, Pseudomonas aeruginosa PA01
gcgccgaccagcc

SEQ ID NO: 3398524 - RNA, 14 nt, Pseudomonas aeruginosa PA01
gcgccgaccagccg

SEQ ID NO: 3398525 - RNA, 16 nt, Pseudomonas aeruginosa PA01
gcgccgaccagccgca

SEQ ID NO: 3398526 - RNA, 22 nt, Pseudomonas aeruginosa PA01
gcgccgaccagccgcaggcugc

SEQ ID NO: 3398527 - RNA, 15 nt, Pseudomonas aeruginosa PA01
gcgccgacccagagc

SEQ ID NO: 3398528 - RNA, 13 nt, Pseudomonas aeruginosa PA01
gcgccgaccgcgc

SEQ ID NO: 3398529 - RNA, 15 nt, Pseudomonas aeruginosa PA01
gcgccgaccgcgcgc

SEQ ID NO: 3398530 - RNA, 16 nt, Pseudomonas aeruginosa PA01
gcgccgaccgcgcgcc

SEQ ID NO: 3398531 - RNA, 17 nt, Pseudomonas aeruginosa PA01
gcgccgaccgcgcgccu

SEQ ID NO: 3398532 - RNA, 18 nt, Pseudomonas aeruginosa PA01
gcgccgaccgcgcgccug

SEQ ID NO: 3398533 - RNA, 22 nt, Pseudomonas aeruginosa PA01
gcgccgaccgcgcgccugcaac

SEQ ID NO: 3398534 - RNA, 13 nt, Pseudomonas aeruginosa PA01
gcgccgaccucca

SEQ ID NO: 3398535 - RNA, 16 nt, Pseudomonas aeruginosa PA01
gcgccgacgccaccag

SEQ ID NO: 3398536 - RNA, 17 nt, Pseudomonas aeruginosa PA01
gcgccgacgccaccagc

SEQ ID NO: 3398537 - RNA, 23 nt, Pseudomonas aeruginosa PA01
gcgccgacgccaccagccaggcg

SEQ ID NO: 3398538 - RNA, 17 nt, Pseudomonas aeruginosa PA01
gcgccgagcagcggcgc

SEQ ID NO: 3398539 - RNA, 22 nt, Pseudomonas aeruginosa PA01
gcgccgagcauuccgacaagga

SEQ ID NO: 3398540 - RNA, 14 nt, Pseudomonas aeruginosa PA01
gcgccgagccaggu

SEQ ID NO: 3398541 - RNA, 16 nt, Pseudomonas aeruginosa PA01
gcgccgagccagguac

SEQ ID NO: 3398542 - RNA, 16 nt, Pseudomonas aeruginosa PA01
gcgccgagcccccggc

SEQ ID NO: 3398543 - RNA, 14 nt, Pseudomonas aeruginosa PA01
gcgccgagccggcu

SEQ ID NO: 3398544 - RNA, 21 nt, Pseudomonas aeruginosa PA01
gcgccgagccggcugccgaag

SEQ ID NO: 3398545 - RNA, 14 nt, Pseudomonas aeruginosa PA01
gcgccgagcgcucg

SEQ ID NO: 3398546 - RNA, 20 nt, Pseudomonas aeruginosa PA01
gcgccgagcuggcgcgcguc

SEQ ID NO: 3398547 - RNA, 22 nt, Pseudomonas aeruginosa PA01
gcgccgagcuggcgcgcgucga

SEQ ID NO: 3398548 - RNA, 13 nt, Pseudomonas aeruginosa PA01
gcgccgaggcccu

SEQ ID NO: 3398549 - RNA, 22 nt, Pseudomonas aeruginosa PA01
gcgccgagggcuguaaucgccg

SEQ ID NO: 3398550 - RNA, 21 nt, Pseudomonas aeruginosa PA01
gcgccgagggguacagggcau

SEQ ID NO: 3398551 - RNA, 18 nt, Pseudomonas aeruginosa PA01
gcgccgaggucuuggcca

SEQ ID NO: 3398552 - RNA, 21 nt, Pseudomonas aeruginosa PA01
gcgccgaggucuuggccagcc

SEQ ID NO: 3398553 - RNA, 16 nt, Pseudomonas aeruginosa PA01
gcgccgaguuggccca

SEQ ID NO: 3398554 - RNA, 20 nt, Pseudomonas aeruginosa PA01
gcgccgaucaggcguaggcc

SEQ ID NO: 3398555 - RNA, 22 nt, Pseudomonas aeruginosa PA01
gcgccgaucaggcguaggccgu

SEQ ID NO: 3398556 - RNA, 14 nt, Pseudomonas aeruginosa PA01
gcgccgauccaggc

SEQ ID NO: 3398557 - RNA, 23 nt, Pseudomonas aeruginosa PA01
gcgccgauccaggcguggggcga

SEQ ID NO: 3398558 - RNA, 15 nt, Pseudomonas aeruginosa PA01
gcgccgaugcccagg

SEQ ID NO: 3398559 - RNA, 16 nt, Pseudomonas aeruginosa PA01
gcgccgaugcccaggc

SEQ ID NO: 3398560 - RNA, 18 nt, Pseudomonas aeruginosa PA01
gcgccgaugcccaggccg

SEQ ID NO: 3398561 - RNA, 19 nt, Pseudomonas aeruginosa PA01
gcgccgaugcccaggccga

SEQ ID NO: 3398562 - RNA, 21 nt, Pseudomonas aeruginosa PA01
gcgccgaugcccaggccgaug

SEQ ID NO: 3398563 - RNA, 12 nt, Pseudomonas aeruginosa PA01
gcgccgaugccg

SEQ ID NO: 3398564 - RNA, 17 nt, Pseudomonas aeruginosa PA01
gcgccgaugccggccgg

SEQ ID NO: 3398565 - RNA, 15 nt, Pseudomonas aeruginosa PA01
gcgccgauggcuguc

SEQ ID NO: 3398566 - RNA, 22 nt, Pseudomonas aeruginosa PA01
gcgccgauggcugucggcgccc

SEQ ID NO: 3398567 - RNA, 19 nt, Pseudomonas aeruginosa PA01
gcgccgauguacggcacca

SEQ ID NO: 3398568 - RNA, 21 nt, Pseudomonas aeruginosa PA01
gcgccgauguacggcaccacc

SEQ ID NO: 3398569 - RNA, 22 nt, Pseudomonas aeruginosa PA01
gcgccgauguacggcaccacca

SEQ ID NO: 3398570 - RNA, 12 nt, Pseudomonas aeruginosa PA01
gcgccgcaagcu

SEQ ID NO: 3398571 - RNA, 16 nt, Pseudomonas aeruginosa PA01
gcgccgcaaguggcgg

SEQ ID NO: 3398572 - RNA, 13 nt, Pseudomonas aeruginosa PA01
gcgccgcaccacg

SEQ ID NO: 3398573 - RNA, 20 nt, Pseudomonas aeruginosa PA01
gcgccgcaccacguagccgg

SEQ ID NO: 3398574 - RNA, 13 nt, Pseudomonas aeruginosa PA01
gcgccgcagcggc

SEQ ID NO: 3398575 - RNA, 14 nt, Pseudomonas aeruginosa PA01
gcgccgcagcggcc

SEQ ID NO: 3398576 - RNA, 14 nt, Pseudomonas aeruginosa PA01
gcgccgcaggcgcu

SEQ ID NO: 3398577 - RNA, 15 nt, Pseudomonas aeruginosa PA01
gcgccgcagggccca

SEQ ID NO: 3398578 - RNA, 15 nt, Pseudomonas aeruginosa PA01
gcgccgcagggugcg

SEQ ID NO: 3398579 - RNA, 12 nt, Pseudomonas aeruginosa PA01
gcgccgccaccg

SEQ ID NO: 3398580 - RNA, 22 nt, Pseudomonas aeruginosa PA01
gcgccgccaccgccaccgccgg

SEQ ID NO: 3398581 - RNA, 13 nt, Pseudomonas aeruginosa PA01
gcgccgccagcag

SEQ ID NO: 3398582 - RNA, 22 nt, Pseudomonas aeruginosa PA01
gcgccgccagcaggaucgacag

SEQ ID NO: 3398583 - RNA, 15 nt, Pseudomonas aeruginosa PA01
gcgccgccagcaggu

SEQ ID NO: 3398584 - RNA, 21 nt, Pseudomonas aeruginosa PA01
gcgccgccagcaggucggccu

SEQ ID NO: 3398585 - RNA, 24 nt, Pseudomonas aeruginosa PA01
gcgccgccagcaggucggccugcu

SEQ ID NO: 3398586 - RNA, 22 nt, Pseudomonas aeruginosa PA01
gcgccgccagccagagcagcgu

SEQ ID NO: 3398587 - RNA, 13 nt, Pseudomonas aeruginosa PA01
gcgccgccaggca

SEQ ID NO: 3398588 - RNA, 14 nt, Pseudomonas aeruginosa PA01
gcgccgccaggcag

SEQ ID NO: 3398589 - RNA, 21 nt, Pseudomonas aeruginosa PA01
gcgccgccaggcagaccaggc

SEQ ID NO: 3398590 - RNA, 23 nt, Pseudomonas aeruginosa PA01
gcgccgccaggcagaccaggccg

SEQ ID NO: 3398591 - RNA, 16 nt, Pseudomonas aeruginosa PA01
gcgccgccaggcaggc

SEQ ID NO: 3398592 - RNA, 23 nt, Pseudomonas aeruginosa PA01
gcgccgccaggcaggccgggcug

SEQ ID NO: 3398593 - RNA, 14 nt, Pseudomonas aeruginosa PA01
gcgccgccaggccc

SEQ ID NO: 3398594 - RNA, 15 nt, Pseudomonas aeruginosa PA01
gcgccgccaggcccu

SEQ ID NO: 3398595 - RNA, 18 nt, Pseudomonas aeruginosa PA01
gcgccgccaggcccuggg

SEQ ID NO: 3398596 - RNA, 22 nt, Pseudomonas aeruginosa PA01
gcgccgccaggcccugggcggc

SEQ ID NO: 3398597 - RNA, 13 nt, Pseudomonas aeruginosa PA01
gcgccgccaggcg

SEQ ID NO: 3398598 - RNA, 17 nt, Pseudomonas aeruginosa PA01
gcgccgccaggcgcguc

SEQ ID NO: 3398599 - RNA, 19 nt, Pseudomonas aeruginosa PA01
gcgccgccaggcgcgucuc

SEQ ID NO: 3398600 - RNA, 18 nt, Pseudomonas aeruginosa PA01
gcgccgccaguucgcgca

SEQ ID NO: 3398601 - RNA, 20 nt, Pseudomonas aeruginosa PA01
gcgccgccaugguuuaccag

SEQ ID NO: 3398602 - RNA, 20 nt, Pseudomonas aeruginosa PA01
gcgccgcccccggcccgggc

SEQ ID NO: 3398603 - RNA, 21 nt, Pseudomonas aeruginosa PA01
gcgccgcccccggcccgggcg

SEQ ID NO: 3398604 - RNA, 19 nt, Pseudomonas aeruginosa PA01
gcgccgccccguuggcgcg

SEQ ID NO: 3398605 - RNA, 13 nt, Pseudomonas aeruginosa PA01
gcgccgcccggcu

SEQ ID NO: 3398606 - RNA, 19 nt, Pseudomonas aeruginosa PA01
gcgccgcccggcucgccgc

SEQ ID NO: 3398607 - RNA, 21 nt, Pseudomonas aeruginosa PA01
gcgccgcccggcucgccgccg

SEQ ID NO: 3398608 - RNA, 22 nt, Pseudomonas aeruginosa PA01
gcgccgcccggcucgccgccgg

SEQ ID NO: 3398609 - RNA, 23 nt, Pseudomonas aeruginosa PA01
gcgccgcccggcucgccgccggg

SEQ ID NO: 3398610 - RNA, 21 nt, Pseudomonas aeruginosa PA01
gcgccggacaggccacccgcc

SEQ ID NO: 3398611 - RNA, 22 nt, Pseudomonas aeruginosa PA01
gcgccggacaggccacccgccu

SEQ ID NO: 3398612 - RNA, 21 nt, Pseudomonas aeruginosa PA01
gcgccggaccaacugcgaacc

SEQ ID NO: 3398613 - RNA, 13 nt, Pseudomonas aeruginosa PA01
gcgccggaccaga

SEQ ID NO: 3398614 - RNA, 21 nt, Pseudomonas aeruginosa PA01
gcgccggaccagaucggcgcg

SEQ ID NO: 3398615 - RNA, 22 nt, Pseudomonas aeruginosa PA01
gcgccggaccagaucggcgcgc

SEQ ID NO: 3398616 - RNA, 15 nt, Pseudomonas aeruginosa PA01
gcgccggaccagccg

SEQ ID NO: 3398617 - RNA, 15 nt, Pseudomonas aeruginosa PA01
gcgccggagcugguc

SEQ ID NO: 3398618 - RNA, 21 nt, Pseudomonas aeruginosa PA01
gcgccggaucgaaguagucgg

SEQ ID NO: 3398619 - RNA, 15 nt, Pseudomonas aeruginosa PA01
gcgccggaucggcug

SEQ ID NO: 3398620 - RNA, 21 nt, Pseudomonas aeruginosa PA01
gcgccggaucggcugaccggc

SEQ ID NO: 3398621 - RNA, 15 nt, Pseudomonas aeruginosa PA01
gcgccggaugggcga

SEQ ID NO: 3398622 - RNA, 15 nt, Pseudomonas aeruginosa PA01
gcgccggcaccgagg

SEQ ID NO: 3398623 - RNA, 15 nt, Pseudomonas aeruginosa PA01
gcgccggcagcucgg

SEQ ID NO: 3398624 - RNA, 16 nt, Pseudomonas aeruginosa PA01
gcgccggcagcucggc

SEQ ID NO: 3398625 - RNA, 18 nt, Pseudomonas aeruginosa PA01
gcgccggcagcucggccg

SEQ ID NO: 3398626 - RNA, 21 nt, Pseudomonas aeruginosa PA01
gcgccggcagcucggccgagg

SEQ ID NO: 3398627 - RNA, 23 nt, Pseudomonas aeruginosa PA01
gcgccggcaggaacgcccgcggc

SEQ ID NO: 3398628 - RNA, 15 nt, Pseudomonas aeruginosa PA01
gcgccggcaucgcca

SEQ ID NO: 3398629 - RNA, 18 nt, Pseudomonas aeruginosa PA01
gcgccggcaucgccaugg

SEQ ID NO: 3398630 - RNA, 19 nt, Pseudomonas aeruginosa PA01
gcgccggcaucgccauggc

SEQ ID NO: 3398631 - RNA, 17 nt, Pseudomonas aeruginosa PA01
gcgccggcauugccgac

SEQ ID NO: 3398632 - RNA, 19 nt, Pseudomonas aeruginosa PA01
gcgccggcauugccgacuu

SEQ ID NO: 3398633 - RNA, 14 nt, Pseudomonas aeruginosa PA01
gcgccggccagagc

SEQ ID NO: 3398634 - RNA, 17 nt, Pseudomonas aeruginosa PA01
gcgccggccauucgcug

SEQ ID NO: 3398635 - RNA, 13 nt, Pseudomonas aeruginosa PA01
gcgccggcccagc

SEQ ID NO: 3398636 - RNA, 14 nt, Pseudomonas aeruginosa PA01
gcgccggcccagca

SEQ ID NO: 3398637 - RNA, 17 nt, Pseudomonas aeruginosa PA01
gcgccggcccagcaggc

SEQ ID NO: 3398638 - RNA, 20 nt, Pseudomonas aeruginosa PA01
gcgccggcccagcaggccgg

SEQ ID NO: 3398639 - RNA, 14 nt, Pseudomonas aeruginosa PA01
gcgccggccguccc

SEQ ID NO: 3398640 - RNA, 15 nt, Pseudomonas aeruginosa PA01
gcgccggccuccagc

SEQ ID NO: 3398641 - RNA, 17 nt, Pseudomonas aeruginosa PA01
gcgccggccuccagcgc

SEQ ID NO: 3398642 - RNA, 20 nt, Pseudomonas aeruginosa PA01
gcgccggccuccagcgccug

SEQ ID NO: 3398643 - RNA, 23 nt, Pseudomonas aeruginosa PA01
gcgccggccuccagcgccuggcg

SEQ ID NO: 3398644 - RNA, 16 nt, Pseudomonas aeruginosa PA01
gcgccggcgaucgcca

SEQ ID NO: 3398645 - RNA, 21 nt, Pseudomonas aeruginosa PA01
gcgccggcgaucgccaggcga

SEQ ID NO: 3398646 - RNA, 15 nt, Pseudomonas aeruginosa PA01
gcgccggcgcgcggc

SEQ ID NO: 3398647 - RNA, 16 nt, Pseudomonas aeruginosa PA01
gcgccggcgcgcggcg

SEQ ID NO: 3398648 - RNA, 13 nt, Pseudomonas aeruginosa PA01
gcgccggcgcgcu

SEQ ID NO: 3398649 - RNA, 12 nt, Pseudomonas aeruginosa PA01
gcgccggcgcgu

SEQ ID NO: 3398650 - RNA, 14 nt, Pseudomonas aeruginosa PA01
gcgccggcgcugcg

SEQ ID NO: 3398651 - RNA, 15 nt, Pseudomonas aeruginosa PA01
gcgccggcgcugcga

SEQ ID NO: 3398652 - RNA, 17 nt, Pseudomonas aeruginosa PA01
gcgccggcgcugcgagc

SEQ ID NO: 3398653 - RNA, 14 nt, Pseudomonas aeruginosa PA01
gcgccggcggauca

SEQ ID NO: 3398654 - RNA, 17 nt, Pseudomonas aeruginosa PA01
gcgccggcggaucacag

SEQ ID NO: 3398655 - RNA, 19 nt, Pseudomonas aeruginosa PA01
gcgccggcggaucagcccg

SEQ ID NO: 3398656 - RNA, 15 nt, Pseudomonas aeruginosa PA01
gcgccggcggccggc

SEQ ID NO: 3398657 - RNA, 19 nt, Pseudomonas aeruginosa PA01
gcgccggcggccggcgcag

SEQ ID NO: 3398658 - RNA, 13 nt, Pseudomonas aeruginosa PA01
gcgccggcggccu

SEQ ID NO: 3398659 - RNA, 15 nt, Pseudomonas aeruginosa PA01
gcgccggcggccugc

SEQ ID NO: 3398660 - RNA, 12 nt, Pseudomonas aeruginosa PA01
gcgccggcggcg

SEQ ID NO: 3398661 - RNA, 13 nt, Pseudomonas aeruginosa PA01
gcgccggcggcgc

SEQ ID NO: 3398662 - RNA, 14 nt, Pseudomonas aeruginosa PA01
gcgccggcggcgcg

SEQ ID NO: 3398663 - RNA, 18 nt, Pseudomonas aeruginosa PA01
gcgccggcggugcggaag

SEQ ID NO: 3398664 - RNA, 16 nt, Pseudomonas aeruginosa PA01
gcgccggcucccugca

SEQ ID NO: 3398665 - RNA, 21 nt, Pseudomonas aeruginosa PA01
gcgccggcucgcccagcaggc

SEQ ID NO: 3398666 - RNA, 12 nt, Pseudomonas aeruginosa PA01
gcgccggcugcc

SEQ ID NO: 3398667 - RNA, 14 nt, Pseudomonas aeruginosa PA01
gcgccggcugccgc

SEQ ID NO: 3398668 - RNA, 17 nt, Pseudomonas aeruginosa PA01
gcgccggcugccgcgcg

SEQ ID NO: 3398669 - RNA, 12 nt, Pseudomonas aeruginosa PA01
gcgccgggauca

SEQ ID NO: 3398670 - RNA, 19 nt, Pseudomonas aeruginosa PA01
gcgccgggcauucgcagcg

SEQ ID NO: 3398671 - RNA, 17 nt, Pseudomonas aeruginosa PA01
gcgccgggccucggcaa

SEQ ID NO: 3398672 - RNA, 12 nt, Pseudomonas aeruginosa PA01
gcgccgggcgcg

SEQ ID NO: 3398673 - RNA, 17 nt, Pseudomonas aeruginosa PA01
gcgccgggcucagcgcg

SEQ ID NO: 3398674 - RNA, 18 nt, Pseudomonas aeruginosa PA01
gcgccgggcucagcgcgc

SEQ ID NO: 3398675 - RNA, 15 nt, Pseudomonas aeruginosa PA01
gcgccgggcugccga

SEQ ID NO: 3398676 - RNA, 13 nt, Pseudomonas aeruginosa PA01
gcgccgggcuggc

SEQ ID NO: 3398677 - RNA, 15 nt, Pseudomonas aeruginosa PA01
gcgccgggcuggccg

SEQ ID NO: 3398678 - RNA, 19 nt, Pseudomonas aeruginosa PA01
gcgccggggaucaggucgc

SEQ ID NO: 3398679 - RNA, 21 nt, Pseudomonas aeruginosa PA01
gcgccggggaucaggucgccg

SEQ ID NO: 3398680 - RNA, 13 nt, Pseudomonas aeruginosa PA01
gcgccggggcagc

SEQ ID NO: 3398681 - RNA, 16 nt, Pseudomonas aeruginosa PA01
gcgccggggcagcagg

SEQ ID NO: 3398682 - RNA, 17 nt, Pseudomonas aeruginosa PA01
gcgccggggcagcaggg

SEQ ID NO: 3398683 - RNA, 19 nt, Pseudomonas aeruginosa PA01
gcgccggggcagcagggcg

SEQ ID NO: 3398684 - RNA, 14 nt, Pseudomonas aeruginosa PA01
gcgccggguagcgu

SEQ ID NO: 3398685 - RNA, 14 nt, Pseudomonas aeruginosa PA01
gcgccgggucagac

SEQ ID NO: 3398686 - RNA, 22 nt, Pseudomonas aeruginosa PA01
gcgccgggucgaccuugccgac

SEQ ID NO: 3398687 - RNA, 20 nt, Pseudomonas aeruginosa PA01
gcgccgggucgaugggccgu

SEQ ID NO: 3398688 - RNA, 13 nt, Pseudomonas aeruginosa PA01
gcgccgggucgga

SEQ ID NO: 3398689 - RNA, 16 nt, Pseudomonas aeruginosa PA01
gcgccgggugccggug

SEQ ID NO: 3398690 - RNA, 16 nt, Pseudomonas aeruginosa PA01
gcgccgguagcggcgc

SEQ ID NO: 3398691 - RNA, 18 nt, Pseudomonas aeruginosa PA01
gcgccgguagcggcgcac

SEQ ID NO: 3398692 - RNA, 19 nt, Pseudomonas aeruginosa PA01
gcgccgguagcggcgcacc

SEQ ID NO: 3398693 - RNA, 20 nt, Pseudomonas aeruginosa PA01
gcgccgguagcggcgcaccg

SEQ ID NO: 3398694 - RNA, 15 nt, Pseudomonas aeruginosa PA01
gcgccgguaguucgc

SEQ ID NO: 3398695 - RNA, 16 nt, Pseudomonas aeruginosa PA01
gcgccggugaggcgca

SEQ ID NO: 3398696 - RNA, 17 nt, Pseudomonas aeruginosa PA01
gcgccggugaggcgcag

SEQ ID NO: 3398697 - RNA, 18 nt, Pseudomonas aeruginosa PA01
gcgccggugaggcgcagc

SEQ ID NO: 3398698 - RNA, 20 nt, Pseudomonas aeruginosa PA01
gcgccggugaggcgcagcag

SEQ ID NO: 3398699 - RNA, 22 nt, Pseudomonas aeruginosa PA01
gcgccggugaggcgcagcagcg

SEQ ID NO: 3398700 - RNA, 20 nt, Pseudomonas aeruginosa PA01
gcgccggugaucgagccgcc

SEQ ID NO: 3398701 - RNA, 22 nt, Pseudomonas aeruginosa PA01
gcgccggugaucgagccgccgg

SEQ ID NO: 3398702 - RNA, 16 nt, Pseudomonas aeruginosa PA01
gcgccggugcuggcga

SEQ ID NO: 3398703 - RNA, 18 nt, Pseudomonas aeruginosa PA01
gcgccggugcuggcgagc

SEQ ID NO: 3398704 - RNA, 22 nt, Pseudomonas aeruginosa PA01
gcgccgguugcgucucagcggu

SEQ ID NO: 3398705 - RNA, 22 nt, Pseudomonas aeruginosa PA01
gcgccgguugcugcugcggggc

SEQ ID NO: 3398706 - RNA, 19 nt, Pseudomonas aeruginosa PA01
gcgccgguuucgaccggcg

SEQ ID NO: 3398707 - RNA, 16 nt, Pseudomonas aeruginosa PA01
gcgccguacgcaccgc

SEQ ID NO: 3398708 - RNA, 17 nt, Pseudomonas aeruginosa PA01
gcgccguacgcaccgcg

SEQ ID NO: 3398709 - RNA, 20 nt, Pseudomonas aeruginosa PA01
gcgccguacgcaccgcguag

SEQ ID NO: 3398710 - RNA, 15 nt, Pseudomonas aeruginosa PA01
gcgccgucaccagca

SEQ ID NO: 3398711 - RNA, 17 nt, Pseudomonas aeruginosa PA01
gcgccgucaccagcagc

SEQ ID NO: 3398712 - RNA, 20 nt, Pseudomonas aeruginosa PA01
gcgccgucaccagcagcccc

SEQ ID NO: 3398713 - RNA, 23 nt, Pseudomonas aeruginosa PA01
gcgccuggaugaucgcgugggcc

SEQ ID NO: 3398714 - RNA, 15 nt, Pseudomonas aeruginosa PA01
gcgccuggccgcgca

SEQ ID NO: 3398715 - RNA, 13 nt, Pseudomonas aeruginosa PA01
gcgccuggccguc

SEQ ID NO: 3398716 - RNA, 14 nt, Pseudomonas aeruginosa PA01
gcgccuggccgucu

SEQ ID NO: 3398717 - RNA, 20 nt, Pseudomonas aeruginosa PA01
gcgccuggccgucuuccagg

SEQ ID NO: 3398718 - RNA, 14 nt, Pseudomonas aeruginosa PA01
gcgccuggccugga

SEQ ID NO: 3398719 - RNA, 23 nt, Pseudomonas aeruginosa PA01
gcgccuggccuggaacuggucgg

SEQ ID NO: 3398720 - RNA, 22 nt, Pseudomonas aeruginosa PA01
gcgccuggcgcaacgccggcag

SEQ ID NO: 3398721 - RNA, 14 nt, Pseudomonas aeruginosa PA01
gcgccuggcgcagu

SEQ ID NO: 3398722 - RNA, 12 nt, Pseudomonas aeruginosa PA01
gcgccuggcguc

SEQ ID NO: 3398723 - RNA, 22 nt, Pseudomonas aeruginosa PA01
gcgccuggcgucgaugccgaau

SEQ ID NO: 3398724 - RNA, 15 nt, Pseudomonas aeruginosa PA01
gcgccuggcuggcca

SEQ ID NO: 3398725 - RNA, 13 nt, Pseudomonas aeruginosa PA01
gcgccugggccgc

SEQ ID NO: 3398726 - RNA, 15 nt, Pseudomonas aeruginosa PA01
gcgccugggccgcga

SEQ ID NO: 3398727 - RNA, 17 nt, Pseudomonas aeruginosa PA01
gcgccugggccgcgagg

SEQ ID NO: 3398728 - RNA, 16 nt, Pseudomonas aeruginosa PA01
gcgccugggccgcgcu

SEQ ID NO: 3398729 - RNA, 17 nt, Pseudomonas aeruginosa PA01
gcgccugguauugcgcc

SEQ ID NO: 3398730 - RNA, 18 nt, Pseudomonas aeruginosa PA01
gcgccugguauugcgccc

SEQ ID NO: 3398731 - RNA, 18 nt, Pseudomonas aeruginosa PA01
gcgccuggucggcggccu

SEQ ID NO: 3398732 - RNA, 10 nt, Pseudomonas aeruginosa PA01
gcgccugguu

SEQ ID NO: 3398733 - RNA, 22 nt, Pseudomonas aeruginosa PA01
gcgccuguaccccguagcgcuc

SEQ ID NO: 3398734 - RNA, 23 nt, Pseudomonas aeruginosa PA01
gcgccuguaccccguagcgcucg

SEQ ID NO: 3398735 - RNA, 21 nt, Pseudomonas aeruginosa PA01
gcgccuguccgggaaugcuca

SEQ ID NO: 3398736 - RNA, 14 nt, Pseudomonas aeruginosa PA01
gcgccuguuccagg

SEQ ID NO: 3398737 - RNA, 20 nt, Pseudomonas aeruginosa PA01
gcgccuguuccagggccugc

SEQ ID NO: 3398738 - RNA, 23 nt, Pseudomonas aeruginosa PA01
gcgccuucaccguucccagcagc

SEQ ID NO: 3398739 - RNA, 17 nt, Pseudomonas aeruginosa PA01
gcgccuucagagcaggg

SEQ ID NO: 3398740 - RNA, 14 nt, Pseudomonas aeruginosa PA01
gcgccuucagcccc

SEQ ID NO: 3398741 - RNA, 18 nt, Pseudomonas aeruginosa PA01
gcgccuucagccccagca

SEQ ID NO: 3398742 - RNA, 19 nt, Pseudomonas aeruginosa PA01
gcgccuucagccccagcac

SEQ ID NO: 3398743 - RNA, 20 nt, Pseudomonas aeruginosa PA01
gcgccuucagccccagcacg

SEQ ID NO: 3398744 - RNA, 17 nt, Pseudomonas aeruginosa PA01
gcgccuucagcgccagc

SEQ ID NO: 3398745 - RNA, 19 nt, Pseudomonas aeruginosa PA01
gcgccuucagcgccagcag

SEQ ID NO: 3398746 - RNA, 21 nt, Pseudomonas aeruginosa PA01
gcgccuucagcgccagcaggc

SEQ ID NO: 3398747 - RNA, 22 nt, Pseudomonas aeruginosa PA01
gcgccuucagcgccagcaggcg

SEQ ID NO: 3398748 - RNA, 15 nt, Pseudomonas aeruginosa PA01
gcgccuucagcgccg

SEQ ID NO: 3398749 - RNA, 18 nt, Pseudomonas aeruginosa PA01
gcgccuucagcgccgcca

SEQ ID NO: 3398750 - RNA, 21 nt, Pseudomonas aeruginosa PA01
gcgccuucagcgccgccaggc

SEQ ID NO: 3398751 - RNA, 22 nt, Pseudomonas aeruginosa PA01
gcgccuucagcgccgccaggcc

SEQ ID NO: 3398752 - RNA, 15 nt, Pseudomonas aeruginosa PA01
gcgccuucagcgccu

SEQ ID NO: 3398753 - RNA, 16 nt, Pseudomonas aeruginosa PA01
gcgccuucagcgccuc

SEQ ID NO: 3398754 - RNA, 18 nt, Pseudomonas aeruginosa PA01
gcgccuucagcgccucca

SEQ ID NO: 3398755 - RNA, 18 nt, Pseudomonas aeruginosa PA01
gcgccuucaucgccaccu

SEQ ID NO: 3398756 - RNA, 11 nt, Pseudomonas aeruginosa PA01
gcgccuuccag

SEQ ID NO: 3398757 - RNA, 18 nt, Pseudomonas aeruginosa PA01
gcgccuuccagcccuucg

SEQ ID NO: 3398758 - RNA, 12 nt, Pseudomonas aeruginosa PA01
gcgccuuccagg

SEQ ID NO: 3398759 - RNA, 13 nt, Pseudomonas aeruginosa PA01
gcgccuuccaggc

SEQ ID NO: 3398760 - RNA, 14 nt, Pseudomonas aeruginosa PA01
gcgccuuccaggcg

SEQ ID NO: 3398761 - RNA, 15 nt, Pseudomonas aeruginosa PA01
gcgccuuccaggcgu

SEQ ID NO: 3398762 - RNA, 23 nt, Pseudomonas aeruginosa PA01
gcgccuucccagauaccggcguu

SEQ ID NO: 3398763 - RNA, 15 nt, Pseudomonas aeruginosa PA01
gcgccuucgggcgcc

SEQ ID NO: 3398764 - RNA, 21 nt, Pseudomonas aeruginosa PA01
gcgccuucgugaccauaggcu

SEQ ID NO: 3398765 - RNA, 15 nt, Pseudomonas aeruginosa PA01
gcgccuucugcaccu

SEQ ID NO: 3398766 - RNA, 19 nt, Pseudomonas aeruginosa PA01
gcgccuucugcaccuuggc

SEQ ID NO: 3398767 - RNA, 20 nt, Pseudomonas aeruginosa PA01
gcgccuucugcaccuuggcc

SEQ ID NO: 3398768 - RNA, 21 nt, Pseudomonas aeruginosa PA01
gcgccuugaaaccggcgaacc

SEQ ID NO: 3398769 - RNA, 22 nt, Pseudomonas aeruginosa PA01
gcgccuugaaaccggcgaacca

SEQ ID NO: 3398770 - RNA, 15 nt, Pseudomonas aeruginosa PA01
gcgccuugaccucga

SEQ ID NO: 3398771 - RNA, 19 nt, Pseudomonas aeruginosa PA01
gcgccuugaccucgacgcc

SEQ ID NO: 3398772 - RNA, 16 nt, Pseudomonas aeruginosa PA01
gcgccuugcgccaggc

SEQ ID NO: 3398773 - RNA, 21 nt, Pseudomonas aeruginosa PA01
gcgccuugcgguccagcgagc

SEQ ID NO: 3398774 - RNA, 12 nt, Pseudomonas aeruginosa PA01
gcgccuugcuca

SEQ ID NO: 3398775 - RNA, 14 nt, Pseudomonas aeruginosa PA01
gcgccuugcucagg

SEQ ID NO: 3398776 - RNA, 18 nt, Pseudomonas aeruginosa PA01
gcgccuugcucaggucgu

SEQ ID NO: 3398777 - RNA, 19 nt, Pseudomonas aeruginosa PA01
gcgccuuucgcucaggccu

SEQ ID NO: 3398778 - RNA, 19 nt, Pseudomonas aeruginosa PA01
gcgccuuuuucauggccug

SEQ ID NO: 3398779 - RNA, 20 nt, Pseudomonas aeruginosa PA01
gcgccuuuuucauggccugg

SEQ ID NO: 3398780 - RNA, 21 nt, Pseudomonas aeruginosa PA01
gcgccuuuuucauggccuggc

SEQ ID NO: 3398781 - RNA, 22 nt, Pseudomonas aeruginosa PA01
gcgccuuuuucauggccuggcg

SEQ ID NO: 3398782 - RNA, 18 nt, Pseudomonas aeruginosa PA01
gcgccuuuuucauuucgc

SEQ ID NO: 3398783 - RNA, 18 nt, Pseudomonas aeruginosa PA01
gcgccuuuuuucauccug

SEQ ID NO: 3398784 - RNA, 20 nt, Pseudomonas aeruginosa PA01
gcgccuuuuuucauccugcg

SEQ ID NO: 3398785 - RNA, 16 nt, Pseudomonas aeruginosa PA01
gcgcgaaagggucagg

SEQ ID NO: 3398786 - RNA, 14 nt, Pseudomonas aeruginosa PA01
gcgcgaacaguucc

SEQ ID NO: 3398787 - RNA, 19 nt, Pseudomonas aeruginosa PA01
gcgcgaacaguuccgacug

SEQ ID NO: 3398788 - RNA, 16 nt, Pseudomonas aeruginosa PA01
gcgcgaaccagcagca

SEQ ID NO: 3398789 - RNA, 23 nt, Pseudomonas aeruginosa PA01
gcgcgaacgcucccagccgacgu

SEQ ID NO: 3398790 - RNA, 14 nt, Pseudomonas aeruginosa PA01
gcgcgaagccagga

SEQ ID NO: 3398791 - RNA, 17 nt, Pseudomonas aeruginosa PA01
gcgcgaaggccacgccg

SEQ ID NO: 3398792 - RNA, 20 nt, Pseudomonas aeruginosa PA01
gcgcgaaggccacgccgacg

SEQ ID NO: 3398793 - RNA, 15 nt, Pseudomonas aeruginosa PA01
gcgcgaaggcgccuu

SEQ ID NO: 3398794 - RNA, 22 nt, Pseudomonas aeruginosa PA01
gcgcgaaggcgccuuccaggcg

SEQ ID NO: 3398795 - RNA, 23 nt, Pseudomonas aeruginosa PA01
gcgcgaaggucguuggcaaagcc

SEQ ID NO: 3398796 - RNA, 16 nt, Pseudomonas aeruginosa PA01
gcgcgaaucuucggcg

SEQ ID NO: 3398797 - RNA, 22 nt, Pseudomonas aeruginosa PA01
gcgcgaaucuucggcgcgccgg

SEQ ID NO: 3398798 - RNA, 16 nt, Pseudomonas aeruginosa PA01
gcgcgacacauggucg

SEQ ID NO: 3398799 - RNA, 18 nt, Pseudomonas aeruginosa PA01
gcgcgacacauggucggc

SEQ ID NO: 3398800 - RNA, 20 nt, Pseudomonas aeruginosa PA01
gcgcgacacauggucggcca

SEQ ID NO: 3398801 - RNA, 23 nt, Pseudomonas aeruginosa PA01
gcgcgacacauggucggccaggu

SEQ ID NO: 3398802 - RNA, 22 nt, Pseudomonas aeruginosa PA01
gcgcgacagcucguggcuggcg

SEQ ID NO: 3398803 - RNA, 14 nt, Pseudomonas aeruginosa PA01
gcgcgacaggcugg

SEQ ID NO: 3398804 - RNA, 15 nt, Pseudomonas aeruginosa PA01
gcgcgacaggcuggc

SEQ ID NO: 3398805 - RNA, 14 nt, Pseudomonas aeruginosa PA01
gcgcgacaucggcg

SEQ ID NO: 3398806 - RNA, 15 nt, Pseudomonas aeruginosa PA01
gcgcgacaucggcga

SEQ ID NO: 3398807 - RNA, 18 nt, Pseudomonas aeruginosa PA01
gcgcgacaucggcgaugg

SEQ ID NO: 3398808 - RNA, 14 nt, Pseudomonas aeruginosa PA01
gcgcgaccgcggcg

SEQ ID NO: 3398809 - RNA, 21 nt, Pseudomonas aeruginosa PA01
gcgcgaccgcggcgcucggca

SEQ ID NO: 3398810 - RNA, 22 nt, Pseudomonas aeruginosa PA01
gcgcgaccgcggcgcucggcau

SEQ ID NO: 3398811 - RNA, 12 nt, Pseudomonas aeruginosa PA01
gcgcgaccgucg

SEQ ID NO: 3398812 - RNA, 14 nt, Pseudomonas aeruginosa PA01
gcgcgaccgucggc

SEQ ID NO: 3398813 - RNA, 16 nt, Pseudomonas aeruginosa PA01
gcgcgaccgucggccg

SEQ ID NO: 3398814 - RNA, 17 nt, Pseudomonas aeruginosa PA01
gcgcgaccgucggccgg

SEQ ID NO: 3398815 - RNA, 13 nt, Pseudomonas aeruginosa PA01
gcgcgccagcaac

SEQ ID NO: 3398816 - RNA, 22 nt, Pseudomonas aeruginosa PA01
gcgcgccagcaacgccuucugc

SEQ ID NO: 3398817 - RNA, 12 nt, Pseudomonas aeruginosa PA01
gcgcgccagcac

SEQ ID NO: 3398818 - RNA, 13 nt, Pseudomonas aeruginosa PA01
gcgcgccagcacg

SEQ ID NO: 3398819 - RNA, 14 nt, Pseudomonas aeruginosa PA01
gcgcgccagcgcca

SEQ ID NO: 3398820 - RNA, 17 nt, Pseudomonas aeruginosa PA01
gcgcgccaggcccacgc

SEQ ID NO: 3398821 - RNA, 15 nt, Pseudomonas aeruginosa PA01
gcgcgccagggcggg

SEQ ID NO: 3398822 - RNA, 17 nt, Pseudomonas aeruginosa PA01
gcgcgccaguccacgac

SEQ ID NO: 3398823 - RNA, 13 nt, Pseudomonas aeruginosa PA01
gcgcgccaguccc

SEQ ID NO: 3398824 - RNA, 13 nt, Pseudomonas aeruginosa PA01
gcgcgccauggcc

SEQ ID NO: 3398825 - RNA, 18 nt, Pseudomonas aeruginosa PA01
gcgcgccauggccuggaa

SEQ ID NO: 3398826 - RNA, 22 nt, Pseudomonas aeruginosa PA01
gcgcgccauggcgguuccucca

SEQ ID NO: 3398827 - RNA, 13 nt, Pseudomonas aeruginosa PA01
gcgcgccauuccg

SEQ ID NO: 3398828 - RNA, 15 nt, Pseudomonas aeruginosa PA01
gcgcgccauuccgcg

SEQ ID NO: 3398829 - RNA, 13 nt, Pseudomonas aeruginosa PA01
gcgcgcccaggca

SEQ ID NO: 3398830 - RNA, 14 nt, Pseudomonas aeruginosa PA01
gcgcgcccaggcag

SEQ ID NO: 3398831 - RNA, 18 nt, Pseudomonas aeruginosa PA01
gcgcgcccagguccggcu

SEQ ID NO: 3398832 - RNA, 16 nt, Pseudomonas aeruginosa PA01
gcgcgcccccuggccg

SEQ ID NO: 3398833 - RNA, 16 nt, Pseudomonas aeruginosa PA01
gcgcgccccggcgagc

SEQ ID NO: 3398834 - RNA, 17 nt, Pseudomonas aeruginosa PA01
gcgcgccccggcgagcg

SEQ ID NO: 3398835 - RNA, 22 nt, Pseudomonas aeruginosa PA01
gcgcgccccggcgagcgagcgg

SEQ ID NO: 3398836 - RNA, 23 nt, Pseudomonas aeruginosa PA01
gcgcgcccgccaggucgagggca

SEQ ID NO: 3398837 - RNA, 21 nt, Pseudomonas aeruginosa PA01
gcgcgcccgccuggaaggcgc

SEQ ID NO: 3398838 - RNA, 16 nt, Pseudomonas aeruginosa PA01
gcgcgcccggcgcaga

SEQ ID NO: 3398839 - RNA, 16 nt, Pseudomonas aeruginosa PA01
gcgcgcccugcaggcc

SEQ ID NO: 3398840 - RNA, 18 nt, Pseudomonas aeruginosa PA01
gcgcgcccugcaggccga

SEQ ID NO: 3398841 - RNA, 23 nt, Pseudomonas aeruginosa PA01
gcgcgccgaacucgaacgcguga

SEQ ID NO: 3398842 - RNA, 14 nt, Pseudomonas aeruginosa PA01
gcgcgccgacagca

SEQ ID NO: 3398843 - RNA, 14 nt, Pseudomonas aeruginosa PA01
gcgcgccgagcaac

SEQ ID NO: 3398844 - RNA, 14 nt, Pseudomonas aeruginosa PA01
gcgcgccgaguugg

SEQ ID NO: 3398845 - RNA, 13 nt, Pseudomonas aeruginosa PA01
gcgcgccgcagua

SEQ ID NO: 3398846 - RNA, 19 nt, Pseudomonas aeruginosa PA01
gcgcgccgcaucgcugacc

SEQ ID NO: 3398847 - RNA, 12 nt, Pseudomonas aeruginosa PA01
gcgcgccgccga

SEQ ID NO: 3398848 - RNA, 13 nt, Pseudomonas aeruginosa PA01
gcgcgccgccgag

SEQ ID NO: 3398849 - RNA, 15 nt, Pseudomonas aeruginosa PA01
gcgcgccgccgaggu

SEQ ID NO: 3398850 - RNA, 14 nt, Pseudomonas aeruginosa PA01
gcgcgccgccgccg

SEQ ID NO: 3398851 - RNA, 12 nt, Pseudomonas aeruginosa PA01
gcgcgccgcgca

SEQ ID NO: 3398852 - RNA, 19 nt, Pseudomonas aeruginosa PA01
gcgcgccggacaggccacc

SEQ ID NO: 3398853 - RNA, 13 nt, Pseudomonas aeruginosa PA01
gcgcgccggcggg

SEQ ID NO: 3398854 - RNA, 14 nt, Pseudomonas aeruginosa PA01
gcgcgccggcuugg

SEQ ID NO: 3398855 - RNA, 16 nt, Pseudomonas aeruginosa PA01
gcgcgccggcuuggcu

SEQ ID NO: 3398856 - RNA, 20 nt, Pseudomonas aeruginosa PA01
gcgcgccgggucgacaugca

SEQ ID NO: 3398857 - RNA, 22 nt, Pseudomonas aeruginosa PA01
gcgcgccggguugcgccgcaag

SEQ ID NO: 3398858 - RNA, 15 nt, Pseudomonas aeruginosa PA01
gcgcgccggugaucg

SEQ ID NO: 3398859 - RNA, 23 nt, Pseudomonas aeruginosa PA01
gcgcgccggugaucgagccgccg

SEQ ID NO: 3398860 - RNA, 22 nt, Pseudomonas aeruginosa PA01
gcgcgccgguuucgaccggcgc

SEQ ID NO: 3398861 - RNA, 16 nt, Pseudomonas aeruginosa PA01
gcgcgccucagcggcu

SEQ ID NO: 3398862 - RNA, 19 nt, Pseudomonas aeruginosa PA01
gcgcgccucagcggcuggc

SEQ ID NO: 3398863 - RNA, 22 nt, Pseudomonas aeruginosa PA01
gcgcgccucagcggcuggcgau

SEQ ID NO: 3398864 - RNA, 13 nt, Pseudomonas aeruginosa PA01
gcgcgccucgccc

SEQ ID NO: 3398865 - RNA, 16 nt, Pseudomonas aeruginosa PA01
gcgcgccucgccccag

SEQ ID NO: 3398866 - RNA, 16 nt, Pseudomonas aeruginosa PA01
gcgcgccucgcggcgu

SEQ ID NO: 3398867 - RNA, 21 nt, Pseudomonas aeruginosa PA01
gcgcgccucuuccuggaccuc

SEQ ID NO: 3398868 - RNA, 19 nt, Pseudomonas aeruginosa PA01
gcgcgccucuucgcaggag

SEQ ID NO: 3398869 - RNA, 15 nt, Pseudomonas aeruginosa PA01
gcgcgccugaaacug

SEQ ID NO: 3398870 - RNA, 16 nt, Pseudomonas aeruginosa PA01
gcgcgccugagcuggc

SEQ ID NO: 3398871 - RNA, 13 nt, Pseudomonas aeruginosa PA01
gcgcgccugcaac

SEQ ID NO: 3398872 - RNA, 14 nt, Pseudomonas aeruginosa PA01
gcgcgccugcaacg

SEQ ID NO: 3398873 - RNA, 21 nt, Pseudomonas aeruginosa PA01
gcgcgccugcucuucggcggc

SEQ ID NO: 3398874 - RNA, 23 nt, Pseudomonas aeruginosa PA01
gcgcgccugcucuucggcggcca

SEQ ID NO: 3398875 - RNA, 20 nt, Pseudomonas aeruginosa PA01
gcgcgccuggaucagcgccu

SEQ ID NO: 3398876 - RNA, 21 nt, Pseudomonas aeruginosa PA01
gcgcgccuggaucagcgccuc

SEQ ID NO: 3398877 - RNA, 13 nt, Pseudomonas aeruginosa PA01
gcgcgccuggccc

SEQ ID NO: 3398878 - RNA, 17 nt, Pseudomonas aeruginosa PA01
gcgcgccuggcccuggc

SEQ ID NO: 3398879 - RNA, 14 nt, Pseudomonas aeruginosa PA01
gcgcgccuggcugg

SEQ ID NO: 3398880 - RNA, 15 nt, Pseudomonas aeruginosa PA01
gcgcgccuggcuggc

SEQ ID NO: 3398881 - RNA, 17 nt, Pseudomonas aeruginosa PA01
gcgcgccuggcuggcca

SEQ ID NO: 3398882 - RNA, 19 nt, Pseudomonas aeruginosa PA01
gcgcgccuggcuggccagc

SEQ ID NO: 3398883 - RNA, 20 nt, Pseudomonas aeruginosa PA01
gcgcgccuggcuggccagca

SEQ ID NO: 3398884 - RNA, 22 nt, Pseudomonas aeruginosa PA01
gcgcgccuggcuggccagcagg

SEQ ID NO: 3398885 - RNA, 23 nt, Pseudomonas aeruginosa PA01
gcgcgccuggcuggccagcaggc

SEQ ID NO: 3398886 - RNA, 21 nt, Pseudomonas aeruginosa PA01
gcgcgccuucagccccagcac

SEQ ID NO: 3398887 - RNA, 22 nt, Pseudomonas aeruginosa PA01
gcgcgccuucagccccagcacg

SEQ ID NO: 3398888 - RNA, 22 nt, Pseudomonas aeruginosa PA01
gcgcgcgacacauggucggcca

SEQ ID NO: 3398889 - RNA, 12 nt, Pseudomonas aeruginosa PA01
gcgcgcgcaagg

SEQ ID NO: 3398890 - RNA, 22 nt, Pseudomonas aeruginosa PA01
gcgcgcgcagauaaggcgugca

SEQ ID NO: 3398891 - RNA, 13 nt, Pseudomonas aeruginosa PA01
gcgcgcgccaggu

SEQ ID NO: 3398892 - RNA, 12 nt, Pseudomonas aeruginosa PA01
gcgcgcgccagu

SEQ ID NO: 3398893 - RNA, 17 nt, Pseudomonas aeruginosa PA01
gcgcgcgccagucccgc

SEQ ID NO: 3398894 - RNA, 19 nt, Pseudomonas aeruginosa PA01
gcgcgcgcccccuggccgu

SEQ ID NO: 3398895 - RNA, 14 nt, Pseudomonas aeruginosa PA01
gcgcgcgccgggcu

SEQ ID NO: 3398896 - RNA, 15 nt, Pseudomonas aeruginosa PA01
gcgcgcgcgcuccuc

SEQ ID NO: 3398897 - RNA, 14 nt, Pseudomonas aeruginosa PA01
gcgcgcgcugccag

SEQ ID NO: 3398898 - RNA, 15 nt, Pseudomonas aeruginosa PA01
gcgcgcgcuggcgca

SEQ ID NO: 3398899 - RNA, 13 nt, Pseudomonas aeruginosa PA01
gcgcgcgcugguc

SEQ ID NO: 3398900 - RNA, 15 nt, Pseudomonas aeruginosa PA01
gcgcgcggcagcacc

SEQ ID NO: 3398901 - RNA, 13 nt, Pseudomonas aeruginosa PA01
gcgcgcggccagc

SEQ ID NO: 3398902 - RNA, 21 nt, Pseudomonas aeruginosa PA01
gcgcgcggccagcgcggccgc

SEQ ID NO: 3398903 - RNA, 13 nt, Pseudomonas aeruginosa PA01
gcgcgcggccagu

SEQ ID NO: 3398904 - RNA, 16 nt, Pseudomonas aeruginosa PA01
gcgcgcggccuguucg

SEQ ID NO: 3398905 - RNA, 23 nt, Pseudomonas aeruginosa PA01
gcgcgcggcucggcgggcugccg

SEQ ID NO: 3398906 - RNA, 14 nt, Pseudomonas aeruginosa PA01
gcgcgcgggccuuc

SEQ ID NO: 3398907 - RNA, 15 nt, Pseudomonas aeruginosa PA01
gcgcgcgggccuucg

SEQ ID NO: 3398908 - RNA, 16 nt, Pseudomonas aeruginosa PA01
gcgcgcggggucuggc

SEQ ID NO: 3398909 - RNA, 22 nt, Pseudomonas aeruginosa PA01
gcgcgcggggucuggccggcga

SEQ ID NO: 3398910 - RNA, 23 nt, Pseudomonas aeruginosa PA01
gcgcgcggggucuggccggcgau

SEQ ID NO: 3398911 - RNA, 16 nt, Pseudomonas aeruginosa PA01
gcgcgcggucgagcag

SEQ ID NO: 3398912 - RNA, 21 nt, Pseudomonas aeruginosa PA01
gcgcgcggucgagcagcgccg

SEQ ID NO: 3398913 - RNA, 22 nt, Pseudomonas aeruginosa PA01
gcgcgcggucgagcagcgccgc

SEQ ID NO: 3398914 - RNA, 17 nt, Pseudomonas aeruginosa PA01
gcgcgcgguuucuucgc

SEQ ID NO: 3398915 - RNA, 23 nt, Pseudomonas aeruginosa PA01
gcgcgcgguuucuucgccuugcc

SEQ ID NO: 3398916 - RNA, 22 nt, Pseudomonas aeruginosa PA01
gcgcgcgucggcgaacccggcg

SEQ ID NO: 3398917 - RNA, 16 nt, Pseudomonas aeruginosa PA01
gcgcgcgucggcggca

SEQ ID NO: 3398918 - RNA, 20 nt, Pseudomonas aeruginosa PA01
gcgcggcgccccaggcgccc

SEQ ID NO: 3398919 - RNA, 21 nt, Pseudomonas aeruginosa PA01
gcgcggcgccccaggcgccca

SEQ ID NO: 3398920 - RNA, 14 nt, Pseudomonas aeruginosa PA01
gcgcggcgccugcu

SEQ ID NO: 3398921 - RNA, 17 nt, Pseudomonas aeruginosa PA01
gcgcggcgccuucagcg

SEQ ID NO: 3398922 - RNA, 22 nt, Pseudomonas aeruginosa PA01
gcgcggcgccuucagcgccgcc

SEQ ID NO: 3398923 - RNA, 20 nt, Pseudomonas aeruginosa PA01
gcgcggcgcggacauggcgc

SEQ ID NO: 3398924 - RNA, 15 nt, Pseudomonas aeruginosa PA01
gcgcggcgcuccagg

SEQ ID NO: 3398925 - RNA, 16 nt, Pseudomonas aeruginosa PA01
gcgcggcgcuccaggc

SEQ ID NO: 3398926 - RNA, 19 nt, Pseudomonas aeruginosa PA01
gcgcggcggacaggcagcc

SEQ ID NO: 3398927 - RNA, 12 nt, Pseudomonas aeruginosa PA01
gcgcggcggcgg

SEQ ID NO: 3398928 - RNA, 15 nt, Pseudomonas aeruginosa PA01
gcgcggcggcggcca

SEQ ID NO: 3398929 - RNA, 17 nt, Pseudomonas aeruginosa PA01
gcgcggcggcggccagc

SEQ ID NO: 3398930 - RNA, 15 nt, Pseudomonas aeruginosa PA01
gcgcggcggcggccg

SEQ ID NO: 3398931 - RNA, 14 nt, Pseudomonas aeruginosa PA01
gcgcggcggugcag

SEQ ID NO: 3398932 - RNA, 13 nt, Pseudomonas aeruginosa PA01
gcgcggcguacca

SEQ ID NO: 3398933 - RNA, 17 nt, Pseudomonas aeruginosa PA01
gcgcggcguaccagccg

SEQ ID NO: 3398934 - RNA, 23 nt, Pseudomonas aeruginosa PA01
gcgcggcguaccagccgcggucc

SEQ ID NO: 3398935 - RNA, 21 nt, Pseudomonas aeruginosa PA01
gcgcggcgucgaccacggccu

SEQ ID NO: 3398936 - RNA, 23 nt, Pseudomonas aeruginosa PA01
gcgcggcgucgaccacggccuuc

SEQ ID NO: 3398937 - RNA, 21 nt, Pseudomonas aeruginosa PA01
gcgcggcguggccggcgacca

SEQ ID NO: 3398938 - RNA, 13 nt, Pseudomonas aeruginosa PA01
gcgcggcguucau

SEQ ID NO: 3398939 - RNA, 20 nt, Pseudomonas aeruginosa PA01
gcgcggcuacccucucccca

SEQ ID NO: 3398940 - RNA, 22 nt, Pseudomonas aeruginosa PA01
gcgcggcuacccucuccccaac

SEQ ID NO: 3398941 - RNA, 15 nt, Pseudomonas aeruginosa PA01
gcgcggcucggcggg

SEQ ID NO: 3398942 - RNA, 21 nt, Pseudomonas aeruginosa PA01
gcgcggcucggcgggcugccg

SEQ ID NO: 3398943 - RNA, 19 nt, Pseudomonas aeruginosa PA01
gcgcggcucgggcggcaag

SEQ ID NO: 3398944 - RNA, 14 nt, Pseudomonas aeruginosa PA01
gcgcggcucgggga

SEQ ID NO: 3398945 - RNA, 13 nt, Pseudomonas aeruginosa PA01
gcgcggcugaucg

SEQ ID NO: 3398946 - RNA, 20 nt, Pseudomonas aeruginosa PA01
gcgcggcugaucggccgcca

SEQ ID NO: 3398947 - RNA, 21 nt, Pseudomonas aeruginosa PA01
gcgcggcugaucggccgccag

SEQ ID NO: 3398948 - RNA, 22 nt, Pseudomonas aeruginosa PA01
gcgcggcugaucggccgccagu

SEQ ID NO: 3398949 - RNA, 16 nt, Pseudomonas aeruginosa PA01
gcgcggcugcuugccg

SEQ ID NO: 3398950 - RNA, 15 nt, Pseudomonas aeruginosa PA01
gcgcggcuucagagc

SEQ ID NO: 3398951 - RNA, 22 nt, Pseudomonas aeruginosa PA01
gcgcggcuucagagcuggacga

SEQ ID NO: 3398952 - RNA, 14 nt, Pseudomonas aeruginosa PA01
gcgcggcuugccgg

SEQ ID NO: 3398953 - RNA, 15 nt, Pseudomonas aeruginosa PA01
gcgcggcuugccggc

SEQ ID NO: 3398954 - RNA, 17 nt, Pseudomonas aeruginosa PA01
gcgcggcuugccggcgc

SEQ ID NO: 3398955 - RNA, 18 nt, Pseudomonas aeruginosa PA01
gcgcggcuugccggcgcg

SEQ ID NO: 3398956 - RNA, 17 nt, Pseudomonas aeruginosa PA01
gcgcgggaauucuuccg

SEQ ID NO: 3398957 - RNA, 15 nt, Pseudomonas aeruginosa PA01
gcgcgggccgacggc

SEQ ID NO: 3398958 - RNA, 20 nt, Pseudomonas aeruginosa PA01
gcgcgggccgacggcccucc

SEQ ID NO: 3398959 - RNA, 18 nt, Pseudomonas aeruginosa PA01
gcgcgggccgaggucgcg

SEQ ID NO: 3398960 - RNA, 18 nt, Pseudomonas aeruginosa PA01
gcgcgggccuucaggcug

SEQ ID NO: 3398961 - RNA, 21 nt, Pseudomonas aeruginosa PA01
gcgcgggccuucaggcugcgc

SEQ ID NO: 3398962 - RNA, 17 nt, Pseudomonas aeruginosa PA01
gcgcgggccuucgccuu

SEQ ID NO: 3398963 - RNA, 22 nt, Pseudomonas aeruginosa PA01
gcgcgggccuucgccuucggcg

SEQ ID NO: 3398964 - RNA, 18 nt, Pseudomonas aeruginosa PA01
gcgcgggcgaagcgcagc

SEQ ID NO: 3398965 - RNA, 15 nt, Pseudomonas aeruginosa PA01
gcgcgggcgcgcgcc

SEQ ID NO: 3398966 - RNA, 18 nt, Pseudomonas aeruginosa PA01
gcgcgggcgcgcgccacc

SEQ ID NO: 3398967 - RNA, 15 nt, Pseudomonas aeruginosa PA01
gcgcgggcggccucg

SEQ ID NO: 3398968 - RNA, 13 nt, Pseudomonas aeruginosa PA01
gcgcgggcuggcc

SEQ ID NO: 3398969 - RNA, 14 nt, Pseudomonas aeruginosa PA01
gcgcgggcuggcca

SEQ ID NO: 3398970 - RNA, 22 nt, Pseudomonas aeruginosa PA01
gcgcggggcccggcuccagccg

SEQ ID NO: 3398971 - RNA, 14 nt, Pseudomonas aeruginosa PA01
gcgcggggcgcgcu

SEQ ID NO: 3398972 - RNA, 18 nt, Pseudomonas aeruginosa PA01
gcgcgggggcucggucga

SEQ ID NO: 3398973 - RNA, 22 nt, Pseudomonas aeruginosa PA01
gcgcgggguagggguggccagg

SEQ ID NO: 3398974 - RNA, 18 nt, Pseudomonas aeruginosa PA01
gcgcggggucuggccggc

SEQ ID NO: 3398975 - RNA, 23 nt, Pseudomonas aeruginosa PA01
gcgcggggucuggccggcgauca

SEQ ID NO: 3398976 - RNA, 18 nt, Pseudomonas aeruginosa PA01
gcgcgggguggccgugca

SEQ ID NO: 3398977 - RNA, 14 nt, Pseudomonas aeruginosa PA01
gcgcgggucgucga

SEQ ID NO: 3398978 - RNA, 15 nt, Pseudomonas aeruginosa PA01
gcgcgggucgucgau

SEQ ID NO: 3398979 - RNA, 15 nt, Pseudomonas aeruginosa PA01
gcgcgggucugcucg

SEQ ID NO: 3398980 - RNA, 16 nt, Pseudomonas aeruginosa PA01
gcgcgggucugcucgc

SEQ ID NO: 3398981 - RNA, 17 nt, Pseudomonas aeruginosa PA01
gcgcgggucugcucgcg

SEQ ID NO: 3398982 - RNA, 19 nt, Pseudomonas aeruginosa PA01
gcgcgggucuucaggccgc

SEQ ID NO: 3398983 - RNA, 15 nt, Pseudomonas aeruginosa PA01
gcgcgggucuugccg

SEQ ID NO: 3398984 - RNA, 17 nt, Pseudomonas aeruginosa PA01
gcgcgggucuugccggu

SEQ ID NO: 3398985 - RNA, 19 nt, Pseudomonas aeruginosa PA01
gcgcgggucuugccggucu

SEQ ID NO: 3398986 - RNA, 16 nt, Pseudomonas aeruginosa PA01
gcgcgggugcggcugg

SEQ ID NO: 3398987 - RNA, 17 nt, Pseudomonas aeruginosa PA01
gcgcgggugcggcuggc

SEQ ID NO: 3398988 - RNA, 18 nt, Pseudomonas aeruginosa PA01
gcgcgggugcggcuggcg

SEQ ID NO: 3398989 - RNA, 14 nt, Pseudomonas aeruginosa PA01
gcgcggguggcguc

SEQ ID NO: 3398990 - RNA, 16 nt, Pseudomonas aeruginosa PA01
gcgcggguggcgucga

SEQ ID NO: 3398991 - RNA, 20 nt, Pseudomonas aeruginosa PA01
gcgcggguguccucgaucau

SEQ ID NO: 3398992 - RNA, 16 nt, Pseudomonas aeruginosa PA01
gcgcggguucgugcca

SEQ ID NO: 3398993 - RNA, 19 nt, Pseudomonas aeruginosa PA01
gcgcggguucgugccaggc

SEQ ID NO: 3398994 - RNA, 20 nt, Pseudomonas aeruginosa PA01
gcgcggguucgugccaggcg

SEQ ID NO: 3398995 - RNA, 18 nt, Pseudomonas aeruginosa PA01
gcgcggguuuccgugcgc

SEQ ID NO: 3398996 - RNA, 22 nt, Pseudomonas aeruginosa PA01
gcgcgguaggugaugcggcccu

SEQ ID NO: 3398997 - RNA, 15 nt, Pseudomonas aeruginosa PA01
gcgcggucaccaggg

SEQ ID NO: 3398998 - RNA, 17 nt, Pseudomonas aeruginosa PA01
gcgcggucaccaggguc

SEQ ID NO: 3398999 - RNA, 22 nt, Pseudomonas aeruginosa PA01
gcgcggucaccagggucacgcc

SEQ ID NO: 3399000 - RNA, 23 nt, Pseudomonas aeruginosa PA01
gcgcggucacccauucgaugccg

SEQ ID NO: 3399001 - RNA, 19 nt, Pseudomonas aeruginosa PA01
gcgcgguccgcgguagcug

SEQ ID NO: 3399002 - RNA, 15 nt, Pseudomonas aeruginosa PA01
gcgcgguccgcgugg

SEQ ID NO: 3399003 - RNA, 22 nt, Pseudomonas aeruginosa PA01
gcgcgguccgcguggugagcac

SEQ ID NO: 3399004 - RNA, 20 nt, Pseudomonas aeruginosa PA01
gcgcggucgagcucggccag

SEQ ID NO: 3399005 - RNA, 21 nt, Pseudomonas aeruginosa PA01
gcgcggucgagcucggccagg

SEQ ID NO: 3399006 - RNA, 12 nt, Pseudomonas aeruginosa PA01
gcgcggucgggu

SEQ ID NO: 3399007 - RNA, 13 nt, Pseudomonas aeruginosa PA01
gcgcggucggguc

SEQ ID NO: 3399008 - RNA, 20 nt, Pseudomonas aeruginosa PA01
gcgcggucggguccgggccc

SEQ ID NO: 3399009 - RNA, 23 nt, Pseudomonas aeruginosa PA01
gcgcggucucuacgccauacugg

SEQ ID NO: 3399010 - RNA, 21 nt, Pseudomonas aeruginosa PA01
gcgcggucucuucgucgguca

SEQ ID NO: 3399011 - RNA, 13 nt, Pseudomonas aeruginosa PA01
gcgcggugagcag

SEQ ID NO: 3399012 - RNA, 14 nt, Pseudomonas aeruginosa PA01
gcgcggugagcagg

SEQ ID NO: 3399013 - RNA, 18 nt, Pseudomonas aeruginosa PA01
gcgcggugcgcgccauca

SEQ ID NO: 3399014 - RNA, 16 nt, Pseudomonas aeruginosa PA01
gcgcggugggccuuga

SEQ ID NO: 3399015 - RNA, 12 nt, Pseudomonas aeruginosa PA01
gcgcgguggugg

SEQ ID NO: 3399016 - RNA, 19 nt, Pseudomonas aeruginosa PA01
gcgcgguuauccgccggug

SEQ ID NO: 3399017 - RNA, 15 nt, Pseudomonas aeruginosa PA01
gcgcgguugccgcug

SEQ ID NO: 3399018 - RNA, 20 nt, Pseudomonas aeruginosa PA01
gcgcgguugccgcugcggcg

SEQ ID NO: 3399019 - RNA, 17 nt, Pseudomonas aeruginosa PA01
gcgcgguuucgcagcgc

SEQ ID NO: 3399020 - RNA, 19 nt, Pseudomonas aeruginosa PA01
gcgcuccaggcccggcagg

SEQ ID NO: 3399021 - RNA, 13 nt, Pseudomonas aeruginosa PA01
gcgcuccaggcgg

SEQ ID NO: 3399022 - RNA, 14 nt, Pseudomonas aeruginosa PA01
gcgcuccaggcggg

SEQ ID NO: 3399023 - RNA, 22 nt, Pseudomonas aeruginosa PA01
gcgcucccauucgcugucgucg

SEQ ID NO: 3399024 - RNA, 14 nt, Pseudomonas aeruginosa PA01
gcgcuccgccaggc

SEQ ID NO: 3399025 - RNA, 20 nt, Pseudomonas aeruginosa PA01
gcgcuccgccaggccgcgca

SEQ ID NO: 3399026 - RNA, 19 nt, Pseudomonas aeruginosa PA01
gcgcuccggaacgccugca

SEQ ID NO: 3399027 - RNA, 16 nt, Pseudomonas aeruginosa PA01
gcgcuccggcgcgcca

SEQ ID NO: 3399028 - RNA, 21 nt, Pseudomonas aeruginosa PA01
gcgcuccggcgcgccauggcg

SEQ ID NO: 3399029 - RNA, 14 nt, Pseudomonas aeruginosa PA01
gcgcuccgguggcg

SEQ ID NO: 3399030 - RNA, 17 nt, Pseudomonas aeruginosa PA01
gcgcuccuccagcgccg

SEQ ID NO: 3399031 - RNA, 22 nt, Pseudomonas aeruginosa PA01
gcgcuccuccagcgccgccagg

SEQ ID NO: 3399032 - RNA, 21 nt, Pseudomonas aeruginosa PA01
gcgcuccuggagguucggcag

SEQ ID NO: 3399033 - RNA, 22 nt, Pseudomonas aeruginosa PA01
gcgcuccuggagguucggcagg

SEQ ID NO: 3399034 - RNA, 13 nt, Pseudomonas aeruginosa PA01
gcgcuccuggugc

SEQ ID NO: 3399035 - RNA, 23 nt, Pseudomonas aeruginosa PA01
gcgcuccuggugcggcaccagcc

SEQ ID NO: 3399036 - RNA, 17 nt, Pseudomonas aeruginosa PA01
gcgcuccuguucgucgc

SEQ ID NO: 3399037 - RNA, 23 nt, Pseudomonas aeruginosa PA01
gcgcuccuucuccggggcccggc

SEQ ID NO: 3399038 - RNA, 16 nt, Pseudomonas aeruginosa PA01
gcgcuccuugcgccag

SEQ ID NO: 3399039 - RNA, 18 nt, Pseudomonas aeruginosa PA01
gcgcuccuugcgccaggc

SEQ ID NO: 3399040 - RNA, 13 nt, Pseudomonas aeruginosa PA01
gcgcuccuuggcu

SEQ ID NO: 3399041 - RNA, 16 nt, Pseudomonas aeruginosa PA01
gcgcuccuuggcuggc

SEQ ID NO: 3399042 - RNA, 23 nt, Pseudomonas aeruginosa PA01
gcgcuccuuggcuggccagcccu

SEQ ID NO: 3399043 - RNA, 15 nt, Pseudomonas aeruginosa PA01
gcgcuccuuucccag

SEQ ID NO: 3399044 - RNA, 15 nt, Pseudomonas aeruginosa PA01
gcgcucgaacgccgc

SEQ ID NO: 3399045 - RNA, 17 nt, Pseudomonas aeruginosa PA01
gcgcucgaagcuccagc

SEQ ID NO: 3399046 - RNA, 18 nt, Pseudomonas aeruginosa PA01
gcgcucgaagcuccagcg

SEQ ID NO: 3399047 - RNA, 20 nt, Pseudomonas aeruginosa PA01
gcgcucgaagcuccagcgug

SEQ ID NO: 3399048 - RNA, 21 nt, Pseudomonas aeruginosa PA01
gcgcucgacauacuccgccgc

SEQ ID NO: 3399049 - RNA, 22 nt, Pseudomonas aeruginosa PA01
gcgcucgacgaucaggugcagg

SEQ ID NO: 3399050 - RNA, 13 nt, Pseudomonas aeruginosa PA01
gcgcucgagccgg

SEQ ID NO: 3399051 - RNA, 14 nt, Pseudomonas aeruginosa PA01
gcgcucgagccggc

SEQ ID NO: 3399052 - RNA, 17 nt, Pseudomonas aeruginosa PA01
gcgcucgagccggcuga

SEQ ID NO: 3399053 - RNA, 20 nt, Pseudomonas aeruginosa PA01
gcgcucgagcuugaggucgg

SEQ ID NO: 3399054 - RNA, 18 nt, Pseudomonas aeruginosa PA01
gcgcucgaggggcgacgg

SEQ ID NO: 3399055 - RNA, 12 nt, Pseudomonas aeruginosa PA01
gcgcucgcgcag

SEQ ID NO: 3399056 - RNA, 15 nt, Pseudomonas aeruginosa PA01
gcgcucgcgcagcca

SEQ ID NO: 3399057 - RNA, 17 nt, Pseudomonas aeruginosa PA01
gcgcucgcgcaugaccu

SEQ ID NO: 3399058 - RNA, 17 nt, Pseudomonas aeruginosa PA01
gcgcucgcgcuuccggc

SEQ ID NO: 3399059 - RNA, 13 nt, Pseudomonas aeruginosa PA01
gcgcucgcggacc

SEQ ID NO: 3399060 - RNA, 13 nt, Pseudomonas aeruginosa PA01
gcgcucgcgggcc

SEQ ID NO: 3399061 - RNA, 12 nt, Pseudomonas aeruginosa PA01
gcgcucgcugcg

SEQ ID NO: 3399062 - RNA, 20 nt, Pseudomonas aeruginosa PA01
gcgcucgcugucaaucgcgc

SEQ ID NO: 3399063 - RNA, 15 nt, Pseudomonas aeruginosa PA01
gcgcucgcugucgcu

SEQ ID NO: 3399064 - RNA, 19 nt, Pseudomonas aeruginosa PA01
gcgcucgcugucgcucagc

SEQ ID NO: 3399065 - RNA, 23 nt, Pseudomonas aeruginosa PA01
gcgcucgcugucgcucagcgggc

SEQ ID NO: 3399066 - RNA, 19 nt, Pseudomonas aeruginosa PA01
gcgcucggauuccagcgcg

SEQ ID NO: 3399067 - RNA, 20 nt, Pseudomonas aeruginosa PA01
gcgcucggcaucgaccaugc

SEQ ID NO: 3399068 - RNA, 12 nt, Pseudomonas aeruginosa PA01
gcgcucggccac

SEQ ID NO: 3399069 - RNA, 14 nt, Pseudomonas aeruginosa PA01
gcgcucggccaggu

SEQ ID NO: 3399070 - RNA, 18 nt, Pseudomonas aeruginosa PA01
gcgcucggccaggucgcg

SEQ ID NO: 3399071 - RNA, 15 nt, Pseudomonas aeruginosa PA01
gcgcucggccgccug

SEQ ID NO: 3399072 - RNA, 18 nt, Pseudomonas aeruginosa PA01
gcgcucggccgccuggcg

SEQ ID NO: 3399073 - RNA, 13 nt, Pseudomonas aeruginosa PA01
gcgcucggccugg

SEQ ID NO: 3399074 - RNA, 15 nt, Pseudomonas aeruginosa PA01
gcgcucggccuggug

SEQ ID NO: 3399075 - RNA, 23 nt, Pseudomonas aeruginosa PA01
gcgcucggccuggugcaccuggc

SEQ ID NO: 3399076 - RNA, 22 nt, Pseudomonas aeruginosa PA01
gcgcucggcgaccuugcgcacc

SEQ ID NO: 3399077 - RNA, 19 nt, Pseudomonas aeruginosa PA01
gcgcucggcgacgcggaua

SEQ ID NO: 3399078 - RNA, 12 nt, Pseudomonas aeruginosa PA01
gcgcucggcgag

SEQ ID NO: 3399079 - RNA, 20 nt, Pseudomonas aeruginosa PA01
gcgcucggcgaggccggcga

SEQ ID NO: 3399080 - RNA, 22 nt, Pseudomonas aeruginosa PA01
gcgcucggcgaggccggcgauc

SEQ ID NO: 3399081 - RNA, 14 nt, Pseudomonas aeruginosa PA01
gcgcucggcggccu

SEQ ID NO: 3399082 - RNA, 17 nt, Pseudomonas aeruginosa PA01
gcgcucggcggccucgc

SEQ ID NO: 3399083 - RNA, 21 nt, Pseudomonas aeruginosa PA01
gcgcucggcggccucgcgggu

SEQ ID NO: 3399084 - RNA, 14 nt, Pseudomonas aeruginosa PA01
gcgcucggcggcgc

SEQ ID NO: 3399085 - RNA, 15 nt, Pseudomonas aeruginosa PA01
gcgcucggcggcgcg

SEQ ID NO: 3399086 - RNA, 17 nt, Pseudomonas aeruginosa PA01
gcgcucggcggcgcgca

SEQ ID NO: 3399087 - RNA, 15 nt, Pseudomonas aeruginosa PA01
gcgcucggcuccagc

SEQ ID NO: 3399088 - RNA, 20 nt, Pseudomonas aeruginosa PA01
gcgcucggcuccagccaggc

SEQ ID NO: 3399089 - RNA, 16 nt, Pseudomonas aeruginosa PA01
gcgcucgggauggccc

SEQ ID NO: 3399090 - RNA, 19 nt, Pseudomonas aeruginosa PA01
gcgcucggggauguccgcc

SEQ ID NO: 3399091 - RNA, 14 nt, Pseudomonas aeruginosa PA01
gcgcucggggucgu

SEQ ID NO: 3399092 - RNA, 16 nt, Pseudomonas aeruginosa PA01
gcgcucggucagcucc

SEQ ID NO: 3399093 - RNA, 17 nt, Pseudomonas aeruginosa PA01
gcgcucggucagcuccc

SEQ ID NO: 3399094 - RNA, 19 nt, Pseudomonas aeruginosa PA01
gcgcucgguccagaucgcc

SEQ ID NO: 3399095 - RNA, 13 nt, Pseudomonas aeruginosa PA01
gcgcucguagaac

SEQ ID NO: 3399096 - RNA, 16 nt, Pseudomonas aeruginosa PA01
gcgcucguagccggcg

SEQ ID NO: 3399097 - RNA, 17 nt, Pseudomonas aeruginosa PA01
gcgcucguagccggcgc

SEQ ID NO: 3399098 - RNA, 18 nt, Pseudomonas aeruginosa PA01
gcgcucguagccggcgcg

SEQ ID NO: 3399099 - RNA, 23 nt, Pseudomonas aeruginosa PA01
gcgcucguagccggcgcggcgca

SEQ ID NO: 3399100 - RNA, 20 nt, Pseudomonas aeruginosa PA01
gcgcucguagguuuccgggu

SEQ ID NO: 3399101 - RNA, 20 nt, Pseudomonas aeruginosa PA01
gcgcucguugauccgcgugg

SEQ ID NO: 3399102 - RNA, 22 nt, Pseudomonas aeruginosa PA01
gcgcucguugauccgcguggcg

SEQ ID NO: 3399103 - RNA, 16 nt, Pseudomonas aeruginosa PA01
gcgcucguugcgccgc

SEQ ID NO: 3399104 - RNA, 19 nt, Pseudomonas aeruginosa PA01
gcgcucguugcgccgcucc

SEQ ID NO: 3399105 - RNA, 23 nt, Pseudomonas aeruginosa PA01
gcgcucguugcgccgcuccuggc

SEQ ID NO: 3399106 - RNA, 22 nt, Pseudomonas aeruginosa PA01
gcgcucucgaacaccaggcgcc

SEQ ID NO: 3399107 - RNA, 13 nt, Pseudomonas aeruginosa PA01
gcgcucucgccgc

SEQ ID NO: 3399108 - RNA, 16 nt, Pseudomonas aeruginosa PA01
gcgcucucgccgccuu

SEQ ID NO: 3399109 - RNA, 14 nt, Pseudomonas aeruginosa PA01
gcgcucucgccggc

SEQ ID NO: 3399110 - RNA, 18 nt, Pseudomonas aeruginosa PA01
gcgcucucgccggccugg

SEQ ID NO: 3399111 - RNA, 16 nt, Pseudomonas aeruginosa PA01
gcgcucuggcccagcu

SEQ ID NO: 3399112 - RNA, 17 nt, Pseudomonas aeruginosa PA01
gcgcucuggccgcgcuc

SEQ ID NO: 3399113 - RNA, 13 nt, Pseudomonas aeruginosa PA01
gcgcucuggcgca

SEQ ID NO: 3399114 - RNA, 16 nt, Pseudomonas aeruginosa PA01
gcgcucuggcgcauag

SEQ ID NO: 3399115 - RNA, 18 nt, Pseudomonas aeruginosa PA01
gcgcucuucacuuccagc

SEQ ID NO: 3399116 - RNA, 18 nt, Pseudomonas aeruginosa PA01
gcgcucuucagcacgccc

SEQ ID NO: 3399117 - RNA, 16 nt, Pseudomonas aeruginosa PA01
gcgcucuucgccgcgg

SEQ ID NO: 3399118 - RNA, 17 nt, Pseudomonas aeruginosa PA01
gcgcucuucgccgcggc

SEQ ID NO: 3399119 - RNA, 16 nt, Pseudomonas aeruginosa PA01
gcgcugaacaagcccu

SEQ ID NO: 3399120 - RNA, 22 nt, Pseudomonas aeruginosa PA01
gcgcugaacagcuggcgcgucg

SEQ ID NO: 3399121 - RNA, 18 nt, Pseudomonas aeruginosa PA01
gcgcugaccgcucccagg

SEQ ID NO: 3399122 - RNA, 19 nt, Pseudomonas aeruginosa PA01
gcgcugaccgcucccaggc

SEQ ID NO: 3399123 - RNA, 18 nt, Pseudomonas aeruginosa PA01
gcgcugggcggcuggccg

SEQ ID NO: 3399124 - RNA, 16 nt, Pseudomonas aeruginosa PA01
gcgcugguaccugccg

SEQ ID NO: 3399125 - RNA, 15 nt, Pseudomonas aeruginosa PA01
gcgcugguccagcac

SEQ ID NO: 3399126 - RNA, 23 nt, Pseudomonas aeruginosa PA01
gcgcugguccagcacgcuggcga

SEQ ID NO: 3399127 - RNA, 20 nt, Pseudomonas aeruginosa PA01
gcgcugguccuucagcuggu

SEQ ID NO: 3399128 - RNA, 20 nt, Pseudomonas aeruginosa PA01
gcgcuggucgacguaggcgg

SEQ ID NO: 3399129 - RNA, 21 nt, Pseudomonas aeruginosa PA01
gcgcuggucgacguaggcggc

SEQ ID NO: 3399130 - RNA, 22 nt, Pseudomonas aeruginosa PA01
gcgcuggucgacguaggcggcg

SEQ ID NO: 3399131 - RNA, 15 nt, Pseudomonas aeruginosa PA01
gcgcuggucguaggc

SEQ ID NO: 3399132 - RNA, 17 nt, Pseudomonas aeruginosa PA01
gcgcuggucguaggcgc

SEQ ID NO: 3399133 - RNA, 22 nt, Pseudomonas aeruginosa PA01
gcgcuggucguucagugccagc

SEQ ID NO: 3399134 - RNA, 22 nt, Pseudomonas aeruginosa PA01
gcgcuggucguucucgcgcauc

SEQ ID NO: 3399135 - RNA, 22 nt, Pseudomonas aeruginosa PA01
gcgcuggucucuuccagcaugc

SEQ ID NO: 3399136 - RNA, 17 nt, Pseudomonas aeruginosa PA01
gcgcuggugcugcucca

SEQ ID NO: 3399137 - RNA, 16 nt, Pseudomonas aeruginosa PA01
gcgcugguugcccagg

SEQ ID NO: 3399138 - RNA, 21 nt, Pseudomonas aeruginosa PA01
gcgcugguuuagcucggcgau

SEQ ID NO: 3399139 - RNA, 14 nt, Pseudomonas aeruginosa PA01
gcgcuguagccggc

SEQ ID NO: 3399140 - RNA, 15 nt, Pseudomonas aeruginosa PA01
gcgcuguagccggcg

SEQ ID NO: 3399141 - RNA, 18 nt, Pseudomonas aeruginosa PA01
gcgcuguagccggcgccg

SEQ ID NO: 3399142 - RNA, 20 nt, Pseudomonas aeruginosa PA01
gcgcuguagccggcgccguc

SEQ ID NO: 3399143 - RNA, 22 nt, Pseudomonas aeruginosa PA01
gcgcuguagccggcgccgucga

SEQ ID NO: 3399144 - RNA, 14 nt, Pseudomonas aeruginosa PA01
gcgcuguaggcgag

SEQ ID NO: 3399145 - RNA, 18 nt, Pseudomonas aeruginosa PA01
gcgcuguaggcgagcagc

SEQ ID NO: 3399146 - RNA, 23 nt, Pseudomonas aeruginosa PA01
gcgcuguaggcgagcagcggcac

SEQ ID NO: 3399147 - RNA, 17 nt, Pseudomonas aeruginosa PA01
gcgcuguccuguggcgc

SEQ ID NO: 3399148 - RNA, 19 nt, Pseudomonas aeruginosa PA01
gcgcugucgcccgggcgcc

SEQ ID NO: 3399149 - RNA, 20 nt, Pseudomonas aeruginosa PA01
gcgcugucgcccgggcgcca

SEQ ID NO: 3399150 - RNA, 15 nt, Pseudomonas aeruginosa PA01
gcgcugucucgccag

SEQ ID NO: 3399151 - RNA, 22 nt, Pseudomonas aeruginosa PA01
gcgcugucucgccagcccggca

SEQ ID NO: 3399152 - RNA, 23 nt, Pseudomonas aeruginosa PA01
gcgcugucucgccagcccggcag

SEQ ID NO: 3399153 - RNA, 18 nt, Pseudomonas aeruginosa PA01
gcgcuguuccgccguggg

SEQ ID NO: 3399154 - RNA, 20 nt, Pseudomonas aeruginosa PA01
gcgcuguuccgccgugggaa

SEQ ID NO: 3399155 - RNA, 15 nt, Pseudomonas aeruginosa PA01
gcgcuguucgggucg

SEQ ID NO: 3399156 - RNA, 16 nt, Pseudomonas aeruginosa PA01
gcgcuguugccgcgcu

SEQ ID NO: 3399157 - RNA, 17 nt, Pseudomonas aeruginosa PA01
gcgcuguugccgcgcuu

SEQ ID NO: 3399158 - RNA, 16 nt, Pseudomonas aeruginosa PA01
gcgcuguuggccuggg

SEQ ID NO: 3399159 - RNA, 18 nt, Pseudomonas aeruginosa PA01
gcgcuguuugcggcgcag

SEQ ID NO: 3399160 - RNA, 19 nt, Pseudomonas aeruginosa PA01
gcgcuguuugcggcgcagg

SEQ ID NO: 3399161 - RNA, 21 nt, Pseudomonas aeruginosa PA01
gcgcuguuugcggcgcaggcg

SEQ ID NO: 3399162 - RNA, 13 nt, Pseudomonas aeruginosa PA01
gcgcuucaggcag

SEQ ID NO: 3399163 - RNA, 18 nt, Pseudomonas aeruginosa PA01
gcgcuucauccugcgcgc

SEQ ID NO: 3399164 - RNA, 13 nt, Pseudomonas aeruginosa PA01
gcgcuuccaccgc

SEQ ID NO: 3399165 - RNA, 18 nt, Pseudomonas aeruginosa PA01
gcgcuuccaccgccugcc

SEQ ID NO: 3399166 - RNA, 21 nt, Pseudomonas aeruginosa PA01
gcgcuuccaccgccugcccca

SEQ ID NO: 3399167 - RNA, 20 nt, Pseudomonas aeruginosa PA01
gcgcuuccaggguagcgccg

SEQ ID NO: 3399168 - RNA, 18 nt, Pseudomonas aeruginosa PA01
gcgcuuccgcaucggccg

SEQ ID NO: 3399169 - RNA, 15 nt, Pseudomonas aeruginosa PA01
gcgcuuccggcagcc

SEQ ID NO: 3399170 - RNA, 18 nt, Pseudomonas aeruginosa PA01
gcgcuuccggcagccagc

SEQ ID NO: 3399171 - RNA, 20 nt, Pseudomonas aeruginosa PA01
gcgcuuccugggaauugcgc

SEQ ID NO: 3399172 - RNA, 14 nt, Pseudomonas aeruginosa PA01
gcgcuucgcgcagc

SEQ ID NO: 3399173 - RNA, 14 nt, Pseudomonas aeruginosa PA01
gcgcuucgcgcagg

SEQ ID NO: 3399174 - RNA, 19 nt, Pseudomonas aeruginosa PA01
gcgcuucgcgcaggacgag

SEQ ID NO: 3399175 - RNA, 13 nt, Pseudomonas aeruginosa PA01
gcgcuucguugcu

SEQ ID NO: 3399176 - RNA, 20 nt, Pseudomonas aeruginosa PA01
gcgcuucucgacguaggcgg

SEQ ID NO: 3399177 - RNA, 14 nt, Pseudomonas aeruginosa PA01
gcgcuucucggcag

SEQ ID NO: 3399178 - RNA, 16 nt, Pseudomonas aeruginosa PA01
gcgcuucugcaggccg

SEQ ID NO: 3399179 - RNA, 17 nt, Pseudomonas aeruginosa PA01
gcgcuucugcaggccgu

SEQ ID NO: 3399180 - RNA, 14 nt, Pseudomonas aeruginosa PA01
gcgcuucugcgagc

SEQ ID NO: 3399181 - RNA, 20 nt, Pseudomonas aeruginosa PA01
gcgcuucugcucggccugga

SEQ ID NO: 3399182 - RNA, 24 nt, Pseudomonas aeruginosa PA01
gcgcuucugcucggccuggaucgc

SEQ ID NO: 3399183 - RNA, 16 nt, Pseudomonas aeruginosa PA01
gcgcuugaacgcgcgc

SEQ ID NO: 3399184 - RNA, 16 nt, Pseudomonas aeruginosa PA01
gcgcuugaagccggcg

SEQ ID NO: 3399185 - RNA, 12 nt, Pseudomonas aeruginosa PA01
gcgcuugagcag

SEQ ID NO: 3399186 - RNA, 19 nt, Pseudomonas aeruginosa PA01
gcgcuugagcagccaggcg

SEQ ID NO: 3399187 - RNA, 15 nt, Pseudomonas aeruginosa PA01
gcgcuugaguugcca

SEQ ID NO: 3399188 - RNA, 12 nt, Pseudomonas aeruginosa PA01
gcgcuugcccag

SEQ ID NO: 3399189 - RNA, 14 nt, Pseudomonas aeruginosa PA01
gcgcuugcccaggu

SEQ ID NO: 3399190 - RNA, 16 nt, Pseudomonas aeruginosa PA01
gcgcuugcccagguag

SEQ ID NO: 3399191 - RNA, 18 nt, Pseudomonas aeruginosa PA01
gcgcuugccgcgcccggc

SEQ ID NO: 3399192 - RNA, 17 nt, Pseudomonas aeruginosa PA01
gcgcuugcgggcgcgcc

SEQ ID NO: 3399193 - RNA, 18 nt, Pseudomonas aeruginosa PA01
gcgcuugcugccauggcg

SEQ ID NO: 3399194 - RNA, 22 nt, Pseudomonas aeruginosa PA01
gcgcuugcugccauggcggcgg

SEQ ID NO: 3399195 - RNA, 13 nt, Pseudomonas aeruginosa PA01
gcgcuugcuggcg

SEQ ID NO: 3399196 - RNA, 15 nt, Pseudomonas aeruginosa PA01
gcgcuugcuggcgcg

SEQ ID NO: 3399197 - RNA, 21 nt, Pseudomonas aeruginosa PA01
gcgcuuggacagcucgcggga

SEQ ID NO: 3399198 - RNA, 14 nt, Pseudomonas aeruginosa PA01
gcgcuuggccuugc

SEQ ID NO: 3399199 - RNA, 16 nt, Pseudomonas aeruginosa PA01
gcgcuuguagcagccg

SEQ ID NO: 3399200 - RNA, 17 nt, Pseudomonas aeruginosa PA01
gcgcuuguagcagccgc

SEQ ID NO: 3399201 - RNA, 13 nt, Pseudomonas aeruginosa PA01
gcgcuuguagccc

SEQ ID NO: 3399202 - RNA, 21 nt, Pseudomonas aeruginosa PA01
gcgcuuguagcccaggggcac

SEQ ID NO: 3399203 - RNA, 22 nt, Pseudomonas aeruginosa PA01
gcgcuuguagcccaggggcacg

SEQ ID NO: 3399204 - RNA, 19 nt, Pseudomonas aeruginosa PA01
gcgcuuguccgagaccggc

SEQ ID NO: 3399205 - RNA, 20 nt, Pseudomonas aeruginosa PA01
gcgcuuguccgagaccggca

SEQ ID NO: 3399206 - RNA, 21 nt, Pseudomonas aeruginosa PA01
gcgcuuguccgagaccggcag

SEQ ID NO: 3399207 - RNA, 19 nt, Pseudomonas aeruginosa PA01
gcgcuuguccuccagcugc

SEQ ID NO: 3399208 - RNA, 13 nt, Pseudomonas aeruginosa PA01
gcgcuuguugaug

SEQ ID NO: 3399209 - RNA, 15 nt, Pseudomonas aeruginosa PA01
gcgcuuucccgcuuc

SEQ ID NO: 3399210 - RNA, 15 nt, Pseudomonas aeruginosa PA01
gcgcuuuccggcgcg

SEQ ID NO: 3399211 - RNA, 20 nt, Pseudomonas aeruginosa PA01
gcgcuuuccggcgcggccug

SEQ ID NO: 3399212 - RNA, 19 nt, Pseudomonas aeruginosa PA01
gcgcuuucgagaaagcgca

SEQ ID NO: 3399213 - RNA, 22 nt, Pseudomonas aeruginosa PA01
gcgcuuucgagaaagcgcagga

SEQ ID NO: 3399214 - RNA, 17 nt, Pseudomonas aeruginosa PA01
gcgcuuuucaggauguu

SEQ ID NO: 3399215 - RNA, 19 nt, Pseudomonas aeruginosa PA01
gcgcuuuuccggcgccggc

SEQ ID NO: 3399216 - RNA, 20 nt, Pseudomonas aeruginosa PA01
gcgcuuuuccggcgccggca

SEQ ID NO: 3399217 - RNA, 21 nt, Pseudomonas aeruginosa PA01
gcgcuuuuccggcgccggcag

SEQ ID NO: 3399218 - RNA, 17 nt, Pseudomonas aeruginosa PA01
gcgcuuuuccucgaccc

SEQ ID NO: 3399219 - RNA, 18 nt, Pseudomonas aeruginosa PA01
gcgcuuuuccucgaccca

SEQ ID NO: 3399220 - RNA, 20 nt, Pseudomonas aeruginosa PA01
gcggaaacccgugguccgcc

SEQ ID NO: 3399221 - RNA, 22 nt, Pseudomonas aeruginosa PA01
gcggaaacccgugguccgccag

SEQ ID NO: 3399222 - RNA, 18 nt, Pseudomonas aeruginosa PA01
gcggaaacccuuccagcc

SEQ ID NO: 3399223 - RNA, 21 nt, Pseudomonas aeruginosa PA01
gcggaaacccuuccagccgcc

SEQ ID NO: 3399224 - RNA, 14 nt, Pseudomonas aeruginosa PA01
gcggaaaccgcggc

SEQ ID NO: 3399225 - RNA, 13 nt, Pseudomonas aeruginosa PA01
gcggaucgccgcc

SEQ ID NO: 3399226 - RNA, 14 nt, Pseudomonas aeruginosa PA01
gcggaucgccgccu

SEQ ID NO: 3399227 - RNA, 14 nt, Pseudomonas aeruginosa PA01
gcggaucgccuccg

SEQ ID NO: 3399228 - RNA, 16 nt, Pseudomonas aeruginosa PA01
gcggaucgcgccgucg

SEQ ID NO: 3399229 - RNA, 13 nt, Pseudomonas aeruginosa PA01
gcggaucggcggu

SEQ ID NO: 3399230 - RNA, 15 nt, Pseudomonas aeruginosa PA01
gcggaucgucgcggc

SEQ ID NO: 3399231 - RNA, 17 nt, Pseudomonas aeruginosa PA01
gcggaucgucgcggcgc

SEQ ID NO: 3399232 - RNA, 19 nt, Pseudomonas aeruginosa PA01
gcggaucgucgcggcgcga

SEQ ID NO: 3399233 - RNA, 22 nt, Pseudomonas aeruginosa PA01
gcggaucucaggaccuuccgcc

SEQ ID NO: 3399234 - RNA, 16 nt, Pseudomonas aeruginosa PA01
gcggaucugcuccugc

SEQ ID NO: 3399235 - RNA, 23 nt, Pseudomonas aeruginosa PA01
gcggaucugcuccugcaggcccu

SEQ ID NO: 3399236 - RNA, 23 nt, Pseudomonas aeruginosa PA01
gcggaucuggaauucgccgcgcg

SEQ ID NO: 3399237 - RNA, 13 nt, Pseudomonas aeruginosa PA01
gcggaucuggccc

SEQ ID NO: 3399238 - RNA, 14 nt, Pseudomonas aeruginosa PA01
gcggaucuggcccu

SEQ ID NO: 3399239 - RNA, 23 nt, Pseudomonas aeruginosa PA01
gcggaugaacucgacuucuucgc

SEQ ID NO: 3399240 - RNA, 15 nt, Pseudomonas aeruginosa PA01
gcggaugacgggcga

SEQ ID NO: 3399241 - RNA, 18 nt, Pseudomonas aeruginosa PA01
gcggaugacguucccguc

SEQ ID NO: 3399242 - RNA, 21 nt, Pseudomonas aeruginosa PA01
gcggaugacguucccguccgg

SEQ ID NO: 3399243 - RNA, 21 nt, Pseudomonas aeruginosa PA01
gcggaugcaguugagucgcgc

SEQ ID NO: 3399244 - RNA, 23 nt, Pseudomonas aeruginosa PA01
gcggaugcaguugagucgcgcgc

SEQ ID NO: 3399245 - RNA, 15 nt, Pseudomonas aeruginosa PA01
gcggaugccggcgcu

SEQ ID NO: 3399246 - RNA, 19 nt, Pseudomonas aeruginosa PA01
gcggaugccggcgcugucu

SEQ ID NO: 3399247 - RNA, 23 nt, Pseudomonas aeruginosa PA01
gcggaugcguugcucgcaccagg

SEQ ID NO: 3399248 - RNA, 19 nt, Pseudomonas aeruginosa PA01
gcggauggcaauggcggug

SEQ ID NO: 3399249 - RNA, 13 nt, Pseudomonas aeruginosa PA01
gcggauggcgauc

SEQ ID NO: 3399250 - RNA, 14 nt, Pseudomonas aeruginosa PA01
gcggauggcgcggg

SEQ ID NO: 3399251 - RNA, 21 nt, Pseudomonas aeruginosa PA01
gcggauguaguccagcgccgc

SEQ ID NO: 3399252 - RNA, 20 nt, Pseudomonas aeruginosa PA01
gcggaugucgggcucgacga

SEQ ID NO: 3399253 - RNA, 18 nt, Pseudomonas aeruginosa PA01
gcggauguucgccacgcu

SEQ ID NO: 3399254 - RNA, 16 nt, Pseudomonas aeruginosa PA01
gcggauuacuccgccg

SEQ ID NO: 3399255 - RNA, 19 nt, Pseudomonas aeruginosa PA01
gcggauuacuccgccggcg

SEQ ID NO: 3399256 - RNA, 18 nt, Pseudomonas aeruginosa PA01
gcggauucaucggcggca

SEQ ID NO: 3399257 - RNA, 19 nt, Pseudomonas aeruginosa PA01
gcggauugacgauggccag

SEQ ID NO: 3399258 - RNA, 23 nt, Pseudomonas aeruginosa PA01
gcggauugacgauggccagcccg

SEQ ID NO: 3399259 - RNA, 16 nt, Pseudomonas aeruginosa PA01
gcggauuggccgggcc

SEQ ID NO: 3399260 - RNA, 18 nt, Pseudomonas aeruginosa PA01
gcggauuggccgggccga

SEQ ID NO: 3399261 - RNA, 14 nt, Pseudomonas aeruginosa PA01
gcggauuugccgcc

SEQ ID NO: 3399262 - RNA, 16 nt, Pseudomonas aeruginosa PA01
gcggcaaagugcgguc

SEQ ID NO: 3399263 - RNA, 13 nt, Pseudomonas aeruginosa PA01
gcggcaacgucag

SEQ ID NO: 3399264 - RNA, 17 nt, Pseudomonas aeruginosa PA01
gcggcaacgucaggcug

SEQ ID NO: 3399265 - RNA, 18 nt, Pseudomonas aeruginosa PA01
gcggcaaggcacacgccc

SEQ ID NO: 3399266 - RNA, 23 nt, Pseudomonas aeruginosa PA01
gcggcaaggcacacgcccggcac

SEQ ID NO: 3399267 - RNA, 17 nt, Pseudomonas aeruginosa PA01
gcggcaaggccaagucg

SEQ ID NO: 3399268 - RNA, 22 nt, Pseudomonas aeruginosa PA01
gcggcaaggccaagucggccgc

SEQ ID NO: 3399269 - RNA, 16 nt, Pseudomonas aeruginosa PA01
gcggcaaggcgauccc

SEQ ID NO: 3399270 - RNA, 23 nt, Pseudomonas aeruginosa PA01
gcggcaagggcacgugcagcggc

SEQ ID NO: 3399271 - RNA, 16 nt, Pseudomonas aeruginosa PA01
gcggcaagggcgucug

SEQ ID NO: 3399272 - RNA, 17 nt, Pseudomonas aeruginosa PA01
gcggcaagggcgucugg

SEQ ID NO: 3399273 - RNA, 13 nt, Pseudomonas aeruginosa PA01
gcggcaaugcggc

SEQ ID NO: 3399274 - RNA, 15 nt, Pseudomonas aeruginosa PA01
gcggcaaugcggcga

SEQ ID NO: 3399275 - RNA, 16 nt, Pseudomonas aeruginosa PA01
gcggcaaugcggcgau

SEQ ID NO: 3399276 - RNA, 16 nt, Pseudomonas aeruginosa PA01
gcggcaauguccgagc

SEQ ID NO: 3399277 - RNA, 17 nt, Pseudomonas aeruginosa PA01
gcggcaauguccgagca

SEQ ID NO: 3399278 - RNA, 19 nt, Pseudomonas aeruginosa PA01
gcggcaauguccgagcagg

SEQ ID NO: 3399279 - RNA, 23 nt, Pseudomonas aeruginosa PA01
gcggcaauucuugauccaguagc

SEQ ID NO: 3399280 - RNA, 13 nt, Pseudomonas aeruginosa PA01
gcggcacagcgug

SEQ ID NO: 3399281 - RNA, 17 nt, Pseudomonas aeruginosa PA01
gcggcacagcguggcca

SEQ ID NO: 3399282 - RNA, 18 nt, Pseudomonas aeruginosa PA01
gcggcacagcguggccag

SEQ ID NO: 3399283 - RNA, 19 nt, Pseudomonas aeruginosa PA01
gcggcacagcguggccagc

SEQ ID NO: 3399284 - RNA, 22 nt, Pseudomonas aeruginosa PA01
gcggcacagcguggccagcgcc

SEQ ID NO: 3399285 - RNA, 16 nt, Pseudomonas aeruginosa PA01
gcggcacaggcggcug

SEQ ID NO: 3399286 - RNA, 17 nt, Pseudomonas aeruginosa PA01
gcggcacaggcggcugu

SEQ ID NO: 3399287 - RNA, 14 nt, Pseudomonas aeruginosa PA01
gcggcaccagcacg

SEQ ID NO: 3399288 - RNA, 14 nt, Pseudomonas aeruginosa PA01
gcggcaccagccag

SEQ ID NO: 3399289 - RNA, 15 nt, Pseudomonas aeruginosa PA01
gcggcaccagccagg

SEQ ID NO: 3399290 - RNA, 16 nt, Pseudomonas aeruginosa PA01
gcggcaccagccaggu

SEQ ID NO: 3399291 - RNA, 20 nt, Pseudomonas aeruginosa PA01
gcggcaccccuugcagccag

SEQ ID NO: 3399292 - RNA, 21 nt, Pseudomonas aeruginosa PA01
gcggcaccccuugcagccagc

SEQ ID NO: 3399293 - RNA, 15 nt, Pseudomonas aeruginosa PA01
gcggcacccggcugg

SEQ ID NO: 3399294 - RNA, 20 nt, Pseudomonas aeruginosa PA01
gcggcacccucuuccgcgcu

SEQ ID NO: 3399295 - RNA, 23 nt, Pseudomonas aeruginosa PA01
gcggcaccgagagcugcaaggcu

SEQ ID NO: 3399296 - RNA, 14 nt, Pseudomonas aeruginosa PA01
gcggcaccggcgac

SEQ ID NO: 3399297 - RNA, 19 nt, Pseudomonas aeruginosa PA01
gcggcaccucgauggcggc

SEQ ID NO: 3399298 - RNA, 22 nt, Pseudomonas aeruginosa PA01
gcggcacgaccacaucggccag

SEQ ID NO: 3399299 - RNA, 23 nt, Pseudomonas aeruginosa PA01
gcggcacgaccacaucggccagu

SEQ ID NO: 3399300 - RNA, 21 nt, Pseudomonas aeruginosa PA01
gcggcacgcuccagaucgccg

SEQ ID NO: 3399301 - RNA, 13 nt, Pseudomonas aeruginosa PA01
gcggcacgcucug

SEQ ID NO: 3399302 - RNA, 21 nt, Pseudomonas aeruginosa PA01
gcggcacgcucuggccguucu

SEQ ID NO: 3399303 - RNA, 17 nt, Pseudomonas aeruginosa PA01
gcggcacggucauggcc

SEQ ID NO: 3399304 - RNA, 20 nt, Pseudomonas aeruginosa PA01
gcggcacggucauggccagc

SEQ ID NO: 3399305 - RNA, 14 nt, Pseudomonas aeruginosa PA01
gcggcacgguggac

SEQ ID NO: 3399306 - RNA, 15 nt, Pseudomonas aeruginosa PA01
gcggcacuccaggaa

SEQ ID NO: 3399307 - RNA, 23 nt, Pseudomonas aeruginosa PA01
gcggcacuccggcauaccgcccg

SEQ ID NO: 3399308 - RNA, 17 nt, Pseudomonas aeruginosa PA01
gcggcacucggcgacca

SEQ ID NO: 3399309 - RNA, 21 nt, Pseudomonas aeruginosa PA01
gcggcacucggcgaccacccg

SEQ ID NO: 3399310 - RNA, 17 nt, Pseudomonas aeruginosa PA01
gcggcacuucccgcccc

SEQ ID NO: 3399311 - RNA, 11 nt, Pseudomonas aeruginosa PA01
gcggcagaagc

SEQ ID NO: 3399312 - RNA, 11 nt, Pseudomonas aeruginosa PA01
gcggcagaucc

SEQ ID NO: 3399313 - RNA, 22 nt, Pseudomonas aeruginosa PA01
gcggcagaucccaucgcccugc

SEQ ID NO: 3399314 - RNA, 21 nt, Pseudomonas aeruginosa PA01
gcggcagaucggugcgggcag

SEQ ID NO: 3399315 - RNA, 13 nt, Pseudomonas aeruginosa PA01
gcggcagcaccag

SEQ ID NO: 3399316 - RNA, 14 nt, Pseudomonas aeruginosa PA01
gcggcagcaccagg

SEQ ID NO: 3399317 - RNA, 17 nt, Pseudomonas aeruginosa PA01
gcggcagcaccaggcca

SEQ ID NO: 3399318 - RNA, 18 nt, Pseudomonas aeruginosa PA01
gcggcagcacgaugaggc

SEQ ID NO: 3399319 - RNA, 12 nt, Pseudomonas aeruginosa PA01
gcggcagcagcc

SEQ ID NO: 3399320 - RNA, 11 nt, Pseudomonas aeruginosa PA01
gcggcagcagg

SEQ ID NO: 3399321 - RNA, 14 nt, Pseudomonas aeruginosa PA01
gcggcagcaggcug

SEQ ID NO: 3399322 - RNA, 22 nt, Pseudomonas aeruginosa PA01
gcggcagcaggcuguacagcag

SEQ ID NO: 3399323 - RNA, 20 nt, Pseudomonas aeruginosa PA01
gcggcagcauccguaccagg

SEQ ID NO: 3399324 - RNA, 20 nt, Pseudomonas aeruginosa PA01
gcggcagccccuugcgcucu

SEQ ID NO: 3399325 - RNA, 16 nt, Pseudomonas aeruginosa PA01
gcggcagccgcggcug

SEQ ID NO: 3399326 - RNA, 14 nt, Pseudomonas aeruginosa PA01
gcggcagcgccagg

SEQ ID NO: 3399327 - RNA, 23 nt, Pseudomonas aeruginosa PA01
gcggccaguuguuccggcuggac

SEQ ID NO: 3399328 - RNA, 14 nt, Pseudomonas aeruginosa PA01
gcggccaucggcga

SEQ ID NO: 3399329 - RNA, 21 nt, Pseudomonas aeruginosa PA01
gcggccauugcccgguggccu

SEQ ID NO: 3399330 - RNA, 18 nt, Pseudomonas aeruginosa PA01
gcggccauugccgcgggc

SEQ ID NO: 3399331 - RNA, 16 nt, Pseudomonas aeruginosa PA01
gcggccauugucggcc

SEQ ID NO: 3399332 - RNA, 19 nt, Pseudomonas aeruginosa PA01
gcggccauugucggccucg

SEQ ID NO: 3399333 - RNA, 21 nt, Pseudomonas aeruginosa PA01
gcggccauugucggccucgau

SEQ ID NO: 3399334 - RNA, 15 nt, Pseudomonas aeruginosa PA01
gcggcccagcggcag

SEQ ID NO: 3399335 - RNA, 16 nt, Pseudomonas aeruginosa PA01
gcggcccagcggcagg

SEQ ID NO: 3399336 - RNA, 18 nt, Pseudomonas aeruginosa PA01
gcggcccaugcggaucgc

SEQ ID NO: 3399337 - RNA, 17 nt, Pseudomonas aeruginosa PA01
gcggccccaaggggccg

SEQ ID NO: 3399338 - RNA, 14 nt, Pseudomonas aeruginosa PA01
gcggccccagcacu

SEQ ID NO: 3399339 - RNA, 19 nt, Pseudomonas aeruginosa PA01
gcggccccgagcgggccga

SEQ ID NO: 3399340 - RNA, 14 nt, Pseudomonas aeruginosa PA01
gcggccccggcgcu

SEQ ID NO: 3399341 - RNA, 13 nt, Pseudomonas aeruginosa PA01
gcggccccggcgu

SEQ ID NO: 3399342 - RNA, 12 nt, Pseudomonas aeruginosa PA01
gcggcccgagca

SEQ ID NO: 3399343 - RNA, 19 nt, Pseudomonas aeruginosa PA01
gcggcccgagcaggcugcc

SEQ ID NO: 3399344 - RNA, 21 nt, Pseudomonas aeruginosa PA01
gcggcccgagcaggcugccga

SEQ ID NO: 3399345 - RNA, 16 nt, Pseudomonas aeruginosa PA01
gcggcccgagggcggc

SEQ ID NO: 3399346 - RNA, 14 nt, Pseudomonas aeruginosa PA01
gcggcccgcacagg

SEQ ID NO: 3399347 - RNA, 19 nt, Pseudomonas aeruginosa PA01
gcggcccgcacagguagag

SEQ ID NO: 3399348 - RNA, 22 nt, Pseudomonas aeruginosa PA01
gcggcccgccacagaucgccag

SEQ ID NO: 3399349 - RNA, 19 nt, Pseudomonas aeruginosa PA01
gcggcccgccgccggggcg

SEQ ID NO: 3399350 - RNA, 16 nt, Pseudomonas aeruginosa PA01
gcggcccgccggcgaa

SEQ ID NO: 3399351 - RNA, 17 nt, Pseudomonas aeruginosa PA01
gcggcccgccggcgaac

SEQ ID NO: 3399352 - RNA, 17 nt, Pseudomonas aeruginosa PA01
gcggcccgccucggcgg

SEQ ID NO: 3399353 - RNA, 18 nt, Pseudomonas aeruginosa PA01
gcggcccgccucggcggc

SEQ ID NO: 3399354 - RNA, 13 nt, Pseudomonas aeruginosa PA01
gcggcccggcagg

SEQ ID NO: 3399355 - RNA, 16 nt, Pseudomonas aeruginosa PA01
gcggcccggcaggcgc

SEQ ID NO: 3399356 - RNA, 13 nt, Pseudomonas aeruginosa PA01
gcggcccggcgcu

SEQ ID NO: 3399357 - RNA, 13 nt, Pseudomonas aeruginosa PA01
gcggcccggcgua

SEQ ID NO: 3399358 - RNA, 23 nt, Pseudomonas aeruginosa PA01
gcggcccggcguaaucgaagguc

SEQ ID NO: 3399359 - RNA, 15 nt, Pseudomonas aeruginosa PA01
gcggcccugcgccgc

SEQ ID NO: 3399360 - RNA, 17 nt, Pseudomonas aeruginosa PA01
gcggcccugcgccgcag

SEQ ID NO: 3399361 - RNA, 20 nt, Pseudomonas aeruginosa PA01
gcggcccugcgccgcagcgg

SEQ ID NO: 3399362 - RNA, 14 nt, Pseudomonas aeruginosa PA01
gcggcccugcucgc

SEQ ID NO: 3399363 - RNA, 13 nt, Pseudomonas aeruginosa PA01
gcggcccuugccc

SEQ ID NO: 3399364 - RNA, 17 nt, Pseudomonas aeruginosa PA01
gcggcccuugucgccgc

SEQ ID NO: 3399365 - RNA, 20 nt, Pseudomonas aeruginosa PA01
gcggcccuugucgccgcugg

SEQ ID NO: 3399366 - RNA, 15 nt, Pseudomonas aeruginosa PA01
gcggcccuuguucgc

SEQ ID NO: 3399367 - RNA, 21 nt, Pseudomonas aeruginosa PA01
gcggccgaacucuggcggcgu

SEQ ID NO: 3399368 - RNA, 16 nt, Pseudomonas aeruginosa PA01
gcggccgaacuggaug

SEQ ID NO: 3399369 - RNA, 16 nt, Pseudomonas aeruginosa PA01
gcggccgaauccucca

SEQ ID NO: 3399370 - RNA, 18 nt, Pseudomonas aeruginosa PA01
gcggccgaauccuccagc

SEQ ID NO: 3399371 - RNA, 19 nt, Pseudomonas aeruginosa PA01
gcggccgaauccuccagcc

SEQ ID NO: 3399372 - RNA, 23 nt, Pseudomonas aeruginosa PA01
gcggccgaauccuccagccggcg

SEQ ID NO: 3399373 - RNA, 13 nt, Pseudomonas aeruginosa PA01
gcggccgaccagg

SEQ ID NO: 3399374 - RNA, 19 nt, Pseudomonas aeruginosa PA01
gcggccgaccaggccguag

SEQ ID NO: 3399375 - RNA, 22 nt, Pseudomonas aeruginosa PA01
gcggccgaccaggccguaggcg

SEQ ID NO: 3399376 - RNA, 22 nt, Pseudomonas aeruginosa PA01
gcggccgacgugcacccgcugu

SEQ ID NO: 3399377 - RNA, 16 nt, Pseudomonas aeruginosa PA01
gcggccgagcaggcgc

SEQ ID NO: 3399378 - RNA, 18 nt, Pseudomonas aeruginosa PA01
gcggccgagcaggcgcgc

SEQ ID NO: 3399379 - RNA, 24 nt, Pseudomonas aeruginosa PA01
gcggccgagcauguaggcgcacca

SEQ ID NO: 3399380 - RNA, 23 nt, Pseudomonas aeruginosa PA01
gcggccgaggaacuccuccucgc

SEQ ID NO: 3399381 - RNA, 19 nt, Pseudomonas aeruginosa PA01
gcggccgaggaaggcgcug

SEQ ID NO: 3399382 - RNA, 22 nt, Pseudomonas aeruginosa PA01
gcggccgaggaaggcgcuggcg

SEQ ID NO: 3399383 - RNA, 23 nt, Pseudomonas aeruginosa PA01
gcggccgaggaaggcgcuggcgc

SEQ ID NO: 3399384 - RNA, 14 nt, Pseudomonas aeruginosa PA01
gcggccgagggcga

SEQ ID NO: 3399385 - RNA, 17 nt, Pseudomonas aeruginosa PA01
gcggccgaguucgcgca

SEQ ID NO: 3399386 - RNA, 23 nt, Pseudomonas aeruginosa PA01
gcggccgaguucgcgcaggcgcu

SEQ ID NO: 3399387 - RNA, 18 nt, Pseudomonas aeruginosa PA01
gcggccgcaaccagcccu

SEQ ID NO: 3399388 - RNA, 21 nt, Pseudomonas aeruginosa PA01
gcggccgcaaccagcccuggc

SEQ ID NO: 3399389 - RNA, 24 nt, Pseudomonas aeruginosa PA01
gcggccgcaaccagcccuggcgca

SEQ ID NO: 3399390 - RNA, 15 nt, Pseudomonas aeruginosa PA01
gcggccgcaugccgg

SEQ ID NO: 3399391 - RNA, 17 nt, Pseudomonas aeruginosa PA01
gcggccgcaugccgggg

SEQ ID NO: 3399392 - RNA, 20 nt, Pseudomonas aeruginosa PA01
gcggccgccauuccggaacu

SEQ ID NO: 3399393 - RNA, 14 nt, Pseudomonas aeruginosa PA01
gcggccgccgagca

SEQ ID NO: 3399394 - RNA, 16 nt, Pseudomonas aeruginosa PA01
gcggccgccgagcaac

SEQ ID NO: 3399395 - RNA, 17 nt, Pseudomonas aeruginosa PA01
gcggccgccgccgacag

SEQ ID NO: 3399396 - RNA, 13 nt, Pseudomonas aeruginosa PA01
gcggccgccgcgc

SEQ ID NO: 3399397 - RNA, 14 nt, Pseudomonas aeruginosa PA01
gcggccgccggcgc

SEQ ID NO: 3399398 - RNA, 13 nt, Pseudomonas aeruginosa PA01
gcggccgccuuga

SEQ ID NO: 3399399 - RNA, 13 nt, Pseudomonas aeruginosa PA01
gcggccgcgagcg

SEQ ID NO: 3399400 - RNA, 16 nt, Pseudomonas aeruginosa PA01
gcggccgcgagcgcgg

SEQ ID NO: 3399401 - RNA, 18 nt, Pseudomonas aeruginosa PA01
gcggccgcgagcgcggcc

SEQ ID NO: 3399402 - RNA, 20 nt, Pseudomonas aeruginosa PA01
gcggccgcgagcgcggccgg

SEQ ID NO: 3399403 - RNA, 16 nt, Pseudomonas aeruginosa PA01
gcggccgcguccgaga

SEQ ID NO: 3399404 - RNA, 14 nt, Pseudomonas aeruginosa PA01
gcggccgcuggcga

SEQ ID NO: 3399405 - RNA, 13 nt, Pseudomonas aeruginosa PA01
gcggccggauggc

SEQ ID NO: 3399406 - RNA, 23 nt, Pseudomonas aeruginosa PA01
gcggccggauggccgccguucuc

SEQ ID NO: 3399407 - RNA, 14 nt, Pseudomonas aeruginosa PA01
gcggccggcaggcc

SEQ ID NO: 3399408 - RNA, 20 nt, Pseudomonas aeruginosa PA01
gcggccggcaggccgauggc

SEQ ID NO: 3399409 - RNA, 13 nt, Pseudomonas aeruginosa PA01
gcggccggcgacc

SEQ ID NO: 3399410 - RNA, 12 nt, Pseudomonas aeruginosa PA01
gcggccggcgca

SEQ ID NO: 3399411 - RNA, 13 nt, Pseudomonas aeruginosa PA01
gcggccggcgccg

SEQ ID NO: 3399412 - RNA, 14 nt, Pseudomonas aeruginosa PA01
gcggccggcgccgc

SEQ ID NO: 3399413 - RNA, 16 nt, Pseudomonas aeruginosa PA01
gcggccggcgcggacg

SEQ ID NO: 3399414 - RNA, 20 nt, Pseudomonas aeruginosa PA01
gcggccggcgcggacggccu

SEQ ID NO: 3399415 - RNA, 22 nt, Pseudomonas aeruginosa PA01
gcggccggcgcggacggccugc

SEQ ID NO: 3399416 - RNA, 15 nt, Pseudomonas aeruginosa PA01
gcggccggcgcggcg

SEQ ID NO: 3399417 - RNA, 18 nt, Pseudomonas aeruginosa PA01
gcggccggcgcggcgcgu

SEQ ID NO: 3399418 - RNA, 15 nt, Pseudomonas aeruginosa PA01
gcggccggcuucagc

SEQ ID NO: 3399419 - RNA, 18 nt, Pseudomonas aeruginosa PA01
gcggccggcuucagcaac

SEQ ID NO: 3399420 - RNA, 22 nt, Pseudomonas aeruginosa PA01
gcggccggggaacagguucggc

SEQ ID NO: 3399421 - RNA, 15 nt, Pseudomonas aeruginosa PA01
gcggccguagccguc

SEQ ID NO: 3399422 - RNA, 15 nt, Pseudomonas aeruginosa PA01
gcggccguccucggg

SEQ ID NO: 3399423 - RNA, 21 nt, Pseudomonas aeruginosa PA01
gcggccgucgcuggcuuccug

SEQ ID NO: 3399424 - RNA, 13 nt, Pseudomonas aeruginosa PA01
gcggccgucggcc

SEQ ID NO: 3399425 - RNA, 14 nt, Pseudomonas aeruginosa PA01
gcggccgucggccu

SEQ ID NO: 3399426 - RNA, 16 nt, Pseudomonas aeruginosa PA01
gcggccgucggccugg

SEQ ID NO: 3399427 - RNA, 18 nt, Pseudomonas aeruginosa PA01
gcggccgugcaugccgac

SEQ ID NO: 3399428 - RNA, 23 nt, Pseudomonas aeruginosa PA01
gcggccgugcaugccgacgagca

SEQ ID NO: 3399429 - RNA, 14 nt, Pseudomonas aeruginosa PA01
gcggccguucaggg

SEQ ID NO: 3399430 - RNA, 15 nt, Pseudomonas aeruginosa PA01
gcggcgaggugaucg

SEQ ID NO: 3399431 - RNA, 17 nt, Pseudomonas aeruginosa PA01
gcggcgaguugcgcgag

SEQ ID NO: 3399432 - RNA, 22 nt, Pseudomonas aeruginosa PA01
gcggcgaguuuguugcgcgagg

SEQ ID NO: 3399433 - RNA, 16 nt, Pseudomonas aeruginosa PA01
gcggcgauaggcgcgc

SEQ ID NO: 3399434 - RNA, 18 nt, Pseudomonas aeruginosa PA01
gcggcgauaggcgcgcaa

SEQ ID NO: 3399435 - RNA, 15 nt, Pseudomonas aeruginosa PA01
gcggcgaucgccugg

SEQ ID NO: 3399436 - RNA, 17 nt, Pseudomonas aeruginosa PA01
gcggcgaucuucuccgc

SEQ ID NO: 3399437 - RNA, 19 nt, Pseudomonas aeruginosa PA01
gcggcgaucuucuccgccg

SEQ ID NO: 3399438 - RNA, 13 nt, Pseudomonas aeruginosa PA01
gcggcgaugaagc

SEQ ID NO: 3399439 - RNA, 18 nt, Pseudomonas aeruginosa PA01
gcggcgaugaucggcagc

SEQ ID NO: 3399440 - RNA, 16 nt, Pseudomonas aeruginosa PA01
gcggcgauggccgcca

SEQ ID NO: 3399441 - RNA, 17 nt, Pseudomonas aeruginosa PA01
gcggcgauggccgccag

SEQ ID NO: 3399442 - RNA, 19 nt, Pseudomonas aeruginosa PA01
gcggcgauggccgccagca

SEQ ID NO: 3399443 - RNA, 14 nt, Pseudomonas aeruginosa PA01
gcggcgaugucggc

SEQ ID NO: 3399444 - RNA, 16 nt, Pseudomonas aeruginosa PA01
gcggcgaugucggccu

SEQ ID NO: 3399445 - RNA, 19 nt, Pseudomonas aeruginosa PA01
gcggcgaugucggccugca

SEQ ID NO: 3399446 - RNA, 19 nt, Pseudomonas aeruginosa PA01
gcggcgcaaucagggcugg

SEQ ID NO: 3399447 - RNA, 21 nt, Pseudomonas aeruginosa PA01
gcggcgcaaucagggcugggc

SEQ ID NO: 3399448 - RNA, 22 nt, Pseudomonas aeruginosa PA01
gcggcgcaaucagggcugggcg

SEQ ID NO: 3399449 - RNA, 20 nt, Pseudomonas aeruginosa PA01
gcggcgcacugagggucagc

SEQ ID NO: 3399450 - RNA, 14 nt, Pseudomonas aeruginosa PA01
gcggcgcagcaacu

SEQ ID NO: 3399451 - RNA, 19 nt, Pseudomonas aeruginosa PA01
gcggcgcaggcgaugauca

SEQ ID NO: 3399452 - RNA, 17 nt, Pseudomonas aeruginosa PA01
gcggcgcaggcggaucg

SEQ ID NO: 3399453 - RNA, 21 nt, Pseudomonas aeruginosa PA01
gcggcgcaggcggaucgcccg

SEQ ID NO: 3399454 - RNA, 23 nt, Pseudomonas aeruginosa PA01
gcggcgcaggcggaucgcccggc

SEQ ID NO: 3399455 - RNA, 19 nt, Pseudomonas aeruginosa PA01
gcggcgcaggcugucggcc

SEQ ID NO: 3399456 - RNA, 23 nt, Pseudomonas aeruginosa PA01
gcggcgcauaacgccccucuucc

SEQ ID NO: 3399457 - RNA, 14 nt, Pseudomonas aeruginosa PA01
gcggcgcaucggcg

SEQ ID NO: 3399458 - RNA, 18 nt, Pseudomonas aeruginosa PA01
gcggcgcaucggcggaua

SEQ ID NO: 3399459 - RNA, 21 nt, Pseudomonas aeruginosa PA01
gcggcgccaacucggccugga

SEQ ID NO: 3399460 - RNA, 13 nt, Pseudomonas aeruginosa PA01
gcggcgccaccgc

SEQ ID NO: 3399461 - RNA, 16 nt, Pseudomonas aeruginosa PA01
gcggcgccaccgcgac

SEQ ID NO: 3399462 - RNA, 18 nt, Pseudomonas aeruginosa PA01
gcggcgccaccgcgacgc

SEQ ID NO: 3399463 - RNA, 13 nt, Pseudomonas aeruginosa PA01
gcggcgccagcgc

SEQ ID NO: 3399464 - RNA, 23 nt, Pseudomonas aeruginosa PA01
gcggcgccagcuccagcgcccag

SEQ ID NO: 3399465 - RNA, 12 nt, Pseudomonas aeruginosa PA01
gcggcgccaggc

SEQ ID NO: 3399466 - RNA, 13 nt, Pseudomonas aeruginosa PA01
gcggcgccaggcc

SEQ ID NO: 3399467 - RNA, 14 nt, Pseudomonas aeruginosa PA01
gcggcgccaggccg

SEQ ID NO: 3399468 - RNA, 17 nt, Pseudomonas aeruginosa PA01
gcggcgccaggccggcg

SEQ ID NO: 3399469 - RNA, 21 nt, Pseudomonas aeruginosa PA01
gcggcgccauagggcacccgg

SEQ ID NO: 3399470 - RNA, 22 nt, Pseudomonas aeruginosa PA01
gcggcgccccaggcgcccaggc

SEQ ID NO: 3399471 - RNA, 18 nt, Pseudomonas aeruginosa PA01
gcggcgcccucugccggu

SEQ ID NO: 3399472 - RNA, 19 nt, Pseudomonas aeruginosa PA01
gcggcgcccucugccgguc

SEQ ID NO: 3399473 - RNA, 13 nt, Pseudomonas aeruginosa PA01
gcggcgcccuggc

SEQ ID NO: 3399474 - RNA, 17 nt, Pseudomonas aeruginosa PA01
gcggcgccgaacagggc

SEQ ID NO: 3399475 - RNA, 12 nt, Pseudomonas aeruginosa PA01
gcggcgccgagg

SEQ ID NO: 3399476 - RNA, 14 nt, Pseudomonas aeruginosa PA01
gcggcgccggcagg

SEQ ID NO: 3399477 - RNA, 15 nt, Pseudomonas aeruginosa PA01
gcggcgccggcaggu

SEQ ID NO: 3399478 - RNA, 13 nt, Pseudomonas aeruginosa PA01
gcggcgccgguga

SEQ ID NO: 3399479 - RNA, 22 nt, Pseudomonas aeruginosa PA01
gcggcgccgguugcgucucagc

SEQ ID NO: 3399480 - RNA, 22 nt, Pseudomonas aeruginosa PA01
gcggcgccgguugcugcugcgg

SEQ ID NO: 3399481 - RNA, 20 nt, Pseudomonas aeruginosa PA01
gcggcgccgguugcugcugg

SEQ ID NO: 3399482 - RNA, 20 nt, Pseudomonas aeruginosa PA01
gcggcgccucgaagcggauc

SEQ ID NO: 3399483 - RNA, 12 nt, Pseudomonas aeruginosa PA01
gcggcgccugcu

SEQ ID NO: 3399484 - RNA, 13 nt, Pseudomonas aeruginosa PA01
gcggcgccugcug

SEQ ID NO: 3399485 - RNA, 21 nt, Pseudomonas aeruginosa PA01
gcggcgccugcugcgcgggug

SEQ ID NO: 3399486 - RNA, 11 nt, Pseudomonas aeruginosa PA01
gcggcgccugg

SEQ ID NO: 3399487 - RNA, 15 nt, Pseudomonas aeruginosa PA01
gcggcgccuggcgua

SEQ ID NO: 3399488 - RNA, 16 nt, Pseudomonas aeruginosa PA01
gcggcgccuucgccgg

SEQ ID NO: 3399489 - RNA, 16 nt, Pseudomonas aeruginosa PA01
gcggcgccuugcgguc

SEQ ID NO: 3399490 - RNA, 20 nt, Pseudomonas aeruginosa PA01
gcggcgccuugcgguccagc

SEQ ID NO: 3399491 - RNA, 23 nt, Pseudomonas aeruginosa PA01
gcggcgccuugcgguccagcgag

SEQ ID NO: 3399492 - RNA, 12 nt, Pseudomonas aeruginosa PA01
gcggcgcgaacc

SEQ ID NO: 3399493 - RNA, 18 nt, Pseudomonas aeruginosa PA01
gcggcgcgaaccagcagc

SEQ ID NO: 3399494 - RNA, 21 nt, Pseudomonas aeruginosa PA01
gcggcgcgaaccagcagcagg

SEQ ID NO: 3399495 - RNA, 15 nt, Pseudomonas aeruginosa PA01
gcggcgcgaggccgu

SEQ ID NO: 3399496 - RNA, 18 nt, Pseudomonas aeruginosa PA01
gcggcgcgauauccgcca

SEQ ID NO: 3399497 - RNA, 13 nt, Pseudomonas aeruginosa PA01
gcggcgcgaugcc

SEQ ID NO: 3399498 - RNA, 21 nt, Pseudomonas aeruginosa PA01
gcggcgcgccuucagcgccuc

SEQ ID NO: 3399499 - RNA, 13 nt, Pseudomonas aeruginosa PA01
gcggcgcgcugaa

SEQ ID NO: 3399500 - RNA, 23 nt, Pseudomonas aeruginosa PA01
gcggcgcggaauacguacucguc

SEQ ID NO: 3399501 - RNA, 22 nt, Pseudomonas aeruginosa PA01
gcggcgcggacauggcgcucga

SEQ ID NO: 3399502 - RNA, 22 nt, Pseudomonas aeruginosa PA01
gcggcgcggagauccccuccuc

SEQ ID NO: 3399503 - RNA, 16 nt, Pseudomonas aeruginosa PA01
gcggcgcggagcugca

SEQ ID NO: 3399504 - RNA, 21 nt, Pseudomonas aeruginosa PA01
gcggcgcggauguucgccacg

SEQ ID NO: 3399505 - RNA, 13 nt, Pseudomonas aeruginosa PA01
gcggcgcggcggg

SEQ ID NO: 3399506 - RNA, 15 nt, Pseudomonas aeruginosa PA01
gcggcgcgggcgcgc

SEQ ID NO: 3399507 - RNA, 16 nt, Pseudomonas aeruginosa PA01
gcggcgcgggcgcgcg

SEQ ID NO: 3399508 - RNA, 17 nt, Pseudomonas aeruginosa PA01
gcggcgcgggcgcgcgc

SEQ ID NO: 3399509 - RNA, 13 nt, Pseudomonas aeruginosa PA01
gcggcgcgggucu

SEQ ID NO: 3399510 - RNA, 16 nt, Pseudomonas aeruginosa PA01
gcggcgcgggucugcu

SEQ ID NO: 3399511 - RNA, 19 nt, Pseudomonas aeruginosa PA01
gcggcgcgggucugcucgc

SEQ ID NO: 3399512 - RNA, 19 nt, Pseudomonas aeruginosa PA01
gcggcgcguaggcgaacac

SEQ ID NO: 3399513 - RNA, 22 nt, Pseudomonas aeruginosa PA01
gcggcgcguccaccuggcggcu

SEQ ID NO: 3399514 - RNA, 17 nt, Pseudomonas aeruginosa PA01
gcggcgcguuccacguc

SEQ ID NO: 3399515 - RNA, 23 nt, Pseudomonas aeruginosa PA01
gcggcgcuacgaaggcgugccgc

SEQ ID NO: 3399516 - RNA, 22 nt, Pseudomonas aeruginosa PA01
gcggcgcucacccacauggcgg

SEQ ID NO: 3399517 - RNA, 13 nt, Pseudomonas aeruginosa PA01
gcggcgcuccagg

SEQ ID NO: 3399518 - RNA, 14 nt, Pseudomonas aeruginosa PA01
gcggcgcuccaggc

SEQ ID NO: 3399519 - RNA, 21 nt, Pseudomonas aeruginosa PA01
gcggcgcucgaggggcgacgg

SEQ ID NO: 3399520 - RNA, 12 nt, Pseudomonas aeruginosa PA01
gcggcgcucggc

SEQ ID NO: 3399521 - RNA, 16 nt, Pseudomonas aeruginosa PA01
gcggcgcugaggauca

SEQ ID NO: 3399522 - RNA, 18 nt, Pseudomonas aeruginosa PA01
gcggcgcugaggaucagc

SEQ ID NO: 3399523 - RNA, 20 nt, Pseudomonas aeruginosa PA01
gcggcgcugaggaucagcca

SEQ ID NO: 3399524 - RNA, 22 nt, Pseudomonas aeruginosa PA01
gcggcgcugaggaucagccagc

SEQ ID NO: 3399525 - RNA, 23 nt, Pseudomonas aeruginosa PA01
gcggcgcugaggaucagccagcc

SEQ ID NO: 3399526 - RNA, 22 nt, Pseudomonas aeruginosa PA01
gcggcgcuguuugcggcgcagg

SEQ ID NO: 3399527 - RNA, 19 nt, Pseudomonas aeruginosa PA01
gcggcgcuugcgggcgcgc

SEQ ID NO: 3399528 - RNA, 16 nt, Pseudomonas aeruginosa PA01
gcggcggaacuugucg

SEQ ID NO: 3399529 - RNA, 20 nt, Pseudomonas aeruginosa PA01
gcggcggaacuugucgccgc

SEQ ID NO: 3399530 - RNA, 22 nt, Pseudomonas aeruginosa PA01
gcggcggaacuugucgccgcug

SEQ ID NO: 3399531 - RNA, 24 nt, Pseudomonas aeruginosa PA01
gcggcggaacuugucgccgcugga

SEQ ID NO: 3399532 - RNA, 19 nt, Pseudomonas aeruginosa PA01
gcggcguucgccgcgggcg

SEQ ID NO: 3399533 - RNA, 16 nt, Pseudomonas aeruginosa PA01
gcggcguucggaccug

SEQ ID NO: 3399534 - RNA, 18 nt, Pseudomonas aeruginosa PA01
gcggcguugcgcggaauc

SEQ ID NO: 3399535 - RNA, 15 nt, Pseudomonas aeruginosa PA01
gcggcguugucggcc

SEQ ID NO: 3399536 - RNA, 17 nt, Pseudomonas aeruginosa PA01
gcggcguugucggccag

SEQ ID NO: 3399537 - RNA, 23 nt, Pseudomonas aeruginosa PA01
gcggcguuuuucauugggcagcc

SEQ ID NO: 3399538 - RNA, 23 nt, Pseudomonas aeruginosa PA01
gcggcuaccagcgcuucggcggc

SEQ ID NO: 3399539 - RNA, 14 nt, Pseudomonas aeruginosa PA01
gcggcuacccucuc

SEQ ID NO: 3399540 - RNA, 16 nt, Pseudomonas aeruginosa PA01
gcggcuacccucuccc

SEQ ID NO: 3399541 - RNA, 18 nt, Pseudomonas aeruginosa PA01
gcggcuacccucucccca

SEQ ID NO: 3399542 - RNA, 15 nt, Pseudomonas aeruginosa PA01
gcggcuacucgcccg

SEQ ID NO: 3399543 - RNA, 17 nt, Pseudomonas aeruginosa PA01
gcggcuacucgcccgac

SEQ ID NO: 3399544 - RNA, 17 nt, Pseudomonas aeruginosa PA01
gcggcuaucgaucacug

SEQ ID NO: 3399545 - RNA, 17 nt, Pseudomonas aeruginosa PA01
gcggcucaacgggaccg

SEQ ID NO: 3399546 - RNA, 14 nt, Pseudomonas aeruginosa PA01
gcggcucaggccgc

SEQ ID NO: 3399547 - RNA, 15 nt, Pseudomonas aeruginosa PA01
gcggcucaggccgcc

SEQ ID NO: 3399548 - RNA, 17 nt, Pseudomonas aeruginosa PA01
gcggcucaggccgccgc

SEQ ID NO: 3399549 - RNA, 15 nt, Pseudomonas aeruginosa PA01
gcggcuccagccgcu

SEQ ID NO: 3399550 - RNA, 18 nt, Pseudomonas aeruginosa PA01
gcggcuccagccgcugca

SEQ ID NO: 3399551 - RNA, 15 nt, Pseudomonas aeruginosa PA01
gcggcuccggcgcca

SEQ ID NO: 3399552 - RNA, 19 nt, Pseudomonas aeruginosa PA01
gcggcuccggcgccaggcc

SEQ ID NO: 3399553 - RNA, 20 nt, Pseudomonas aeruginosa PA01
gcggcuccggcgccaggccg

SEQ ID NO: 3399554 - RNA, 23 nt, Pseudomonas aeruginosa PA01
gcggcuccggcgccaggccggag

SEQ ID NO: 3399555 - RNA, 14 nt, Pseudomonas aeruginosa PA01
gcggcuccucggcc

SEQ ID NO: 3399556 - RNA, 15 nt, Pseudomonas aeruginosa PA01
gcggcuccucggccu

SEQ ID NO: 3399557 - RNA, 17 nt, Pseudomonas aeruginosa PA01
gcggcuccucggccugg

SEQ ID NO: 3399558 - RNA, 13 nt, Pseudomonas aeruginosa PA01
gcggcucgccgaa

SEQ ID NO: 3399559 - RNA, 14 nt, Pseudomonas aeruginosa PA01
gcggcucgccgaaa

SEQ ID NO: 3399560 - RNA, 12 nt, Pseudomonas aeruginosa PA01
gcggcucggcca

SEQ ID NO: 3399561 - RNA, 13 nt, Pseudomonas aeruginosa PA01
gcggcucggccag

SEQ ID NO: 3399562 - RNA, 19 nt, Pseudomonas aeruginosa PA01
gcggcucggccagggccgc

SEQ ID NO: 3399563 - RNA, 22 nt, Pseudomonas aeruginosa PA01
gcggcucggccagggccgcucg

SEQ ID NO: 3399564 - RNA, 13 nt, Pseudomonas aeruginosa PA01
gcggcucggcggg

SEQ ID NO: 3399565 - RNA, 18 nt, Pseudomonas aeruginosa PA01
gcggcucggcuccaggac

SEQ ID NO: 3399566 - RNA, 15 nt, Pseudomonas aeruginosa PA01
gcggcucggcugcuu

SEQ ID NO: 3399567 - RNA, 21 nt, Pseudomonas aeruginosa PA01
gcggcucggcugcuugccggu

SEQ ID NO: 3399568 - RNA, 15 nt, Pseudomonas aeruginosa PA01
gcggcucgggcggca

SEQ ID NO: 3399569 - RNA, 20 nt, Pseudomonas aeruginosa PA01
gcggcucgucaucguccagc

SEQ ID NO: 3399570 - RNA, 22 nt, Pseudomonas aeruginosa PA01
gcggcucgugucgacucagcgg

SEQ ID NO: 3399571 - RNA, 14 nt, Pseudomonas aeruginosa PA01
gcggcucuggcgca

SEQ ID NO: 3399572 - RNA, 16 nt, Pseudomonas aeruginosa PA01
gcggcucuggcgcagg

SEQ ID NO: 3399573 - RNA, 18 nt, Pseudomonas aeruginosa PA01
gcggcucuggcgcaggga

SEQ ID NO: 3399574 - RNA, 13 nt, Pseudomonas aeruginosa PA01
gcggcucugguca

SEQ ID NO: 3399575 - RNA, 19 nt, Pseudomonas aeruginosa PA01
gcggcucuuuccgggucau

SEQ ID NO: 3399576 - RNA, 21 nt, Pseudomonas aeruginosa PA01
gcggcugaagaagcugcccca

SEQ ID NO: 3399577 - RNA, 14 nt, Pseudomonas aeruginosa PA01
gcggcugaaggccg

SEQ ID NO: 3399578 - RNA, 17 nt, Pseudomonas aeruginosa PA01
gcggcugaaggccgaac

SEQ ID NO: 3399579 - RNA, 20 nt, Pseudomonas aeruginosa PA01
gcggcugagcuguuucagcc

SEQ ID NO: 3399580 - RNA, 15 nt, Pseudomonas aeruginosa PA01
gcggcugaucggccg

SEQ ID NO: 3399581 - RNA, 17 nt, Pseudomonas aeruginosa PA01
gcggcugcagggccagg

SEQ ID NO: 3399582 - RNA, 18 nt, Pseudomonas aeruginosa PA01
gcggcugcagggccaggg

SEQ ID NO: 3399583 - RNA, 19 nt, Pseudomonas aeruginosa PA01
gcggcugcagggccaggga

SEQ ID NO: 3399584 - RNA, 13 nt, Pseudomonas aeruginosa PA01
gcggcugccgagg

SEQ ID NO: 3399585 - RNA, 15 nt, Pseudomonas aeruginosa PA01
gcggcugccgaggcu

SEQ ID NO: 3399586 - RNA, 14 nt, Pseudomonas aeruginosa PA01
gcggcugccggugc

SEQ ID NO: 3399587 - RNA, 21 nt, Pseudomonas aeruginosa PA01
gcggcugccggugccaccguc

SEQ ID NO: 3399588 - RNA, 14 nt, Pseudomonas aeruginosa PA01
gcggcugcgcgccg

SEQ ID NO: 3399589 - RNA, 15 nt, Pseudomonas aeruginosa PA01
gcggcugcgcgccgg

SEQ ID NO: 3399590 - RNA, 17 nt, Pseudomonas aeruginosa PA01
gcggcugcgcgccgggu

SEQ ID NO: 3399591 - RNA, 12 nt, Pseudomonas aeruginosa PA01
gcggcugcugcg

SEQ ID NO: 3399592 - RNA, 15 nt, Pseudomonas aeruginosa PA01
gcggcugcugcgccu

SEQ ID NO: 3399593 - RNA, 18 nt, Pseudomonas aeruginosa PA01
gcggcugcugcgccuggc

SEQ ID NO: 3399594 - RNA, 21 nt, Pseudomonas aeruginosa PA01
gcggcugcugcgccuggccgc

SEQ ID NO: 3399595 - RNA, 23 nt, Pseudomonas aeruginosa PA01
gcggcugcugucguuccggcuca

SEQ ID NO: 3399596 - RNA, 18 nt, Pseudomonas aeruginosa PA01
gcggcugcuugccgcuca

SEQ ID NO: 3399597 - RNA, 21 nt, Pseudomonas aeruginosa PA01
gcggcuggaagucgcccugcc

SEQ ID NO: 3399598 - RNA, 13 nt, Pseudomonas aeruginosa PA01
gcggcuggcaggu

SEQ ID NO: 3399599 - RNA, 15 nt, Pseudomonas aeruginosa PA01
gcggcuggcaggugc

SEQ ID NO: 3399600 - RNA, 21 nt, Pseudomonas aeruginosa PA01
gcggcuggccauccgcccugc

SEQ ID NO: 3399601 - RNA, 15 nt, Pseudomonas aeruginosa PA01
gcggcuggccgagga

SEQ ID NO: 3399602 - RNA, 17 nt, Pseudomonas aeruginosa PA01
gcggcuggccgaggacc

SEQ ID NO: 3399603 - RNA, 12 nt, Pseudomonas aeruginosa PA01
gcggcuggccgc

SEQ ID NO: 3399604 - RNA, 14 nt, Pseudomonas aeruginosa PA01
gcggcuggccgccu

SEQ ID NO: 3399605 - RNA, 16 nt, Pseudomonas aeruginosa PA01
gcggcuggccgccucg

SEQ ID NO: 3399606 - RNA, 22 nt, Pseudomonas aeruginosa PA01
gcggcuggccgccucgcgccgc

SEQ ID NO: 3399607 - RNA, 15 nt, Pseudomonas aeruginosa PA01
gcggcuggccgccug

SEQ ID NO: 3399608 - RNA, 16 nt, Pseudomonas aeruginosa PA01
gcggcuggccgccugg

SEQ ID NO: 3399609 - RNA, 23 nt, Pseudomonas aeruginosa PA01
gcggcuggccgccuggccggcca

SEQ ID NO: 3399610 - RNA, 13 nt, Pseudomonas aeruginosa PA01
gcggcuggccgcg

SEQ ID NO: 3399611 - RNA, 14 nt, Pseudomonas aeruginosa PA01
gcggcuggccgucg

SEQ ID NO: 3399612 - RNA, 19 nt, Pseudomonas aeruginosa PA01
gcggcuggccgucgacccg

SEQ ID NO: 3399613 - RNA, 14 nt, Pseudomonas aeruginosa PA01
gcggcuggcgaacc

SEQ ID NO: 3399614 - RNA, 21 nt, Pseudomonas aeruginosa PA01
gcggcuggcgaaccaguccag

SEQ ID NO: 3399615 - RNA, 14 nt, Pseudomonas aeruginosa PA01
gcggcuggcgcagg

SEQ ID NO: 3399616 - RNA, 17 nt, Pseudomonas aeruginosa PA01
gcggcuggcgcaggacc

SEQ ID NO: 3399617 - RNA, 23 nt, Pseudomonas aeruginosa PA01
gcggcuggcgcaggaccgccaug

SEQ ID NO: 3399618 - RNA, 16 nt, Pseudomonas aeruginosa PA01
gcggcuggcgcgaucg

SEQ ID NO: 3399619 - RNA, 14 nt, Pseudomonas aeruginosa PA01
gcggcuggcgcuug

SEQ ID NO: 3399620 - RNA, 19 nt, Pseudomonas aeruginosa PA01
gcggcuggcgcuugccgcg

SEQ ID NO: 3399621 - RNA, 13 nt, Pseudomonas aeruginosa PA01
gcggcuggcgggc

SEQ ID NO: 3399622 - RNA, 15 nt, Pseudomonas aeruginosa PA01
gcggcuggcgggcga

SEQ ID NO: 3399623 - RNA, 18 nt, Pseudomonas aeruginosa PA01
gcggcuggcugaagccgg

SEQ ID NO: 3399624 - RNA, 19 nt, Pseudomonas aeruginosa PA01
gcggcuggcugaagccggg

SEQ ID NO: 3399625 - RNA, 14 nt, Pseudomonas aeruginosa PA01
gcggcugggcugcg

SEQ ID NO: 3399626 - RNA, 15 nt, Pseudomonas aeruginosa PA01
gcggcugggcugcgg

SEQ ID NO: 3399627 - RNA, 14 nt, Pseudomonas aeruginosa PA01
gcggcugggugucg

SEQ ID NO: 3399628 - RNA, 18 nt, Pseudomonas aeruginosa PA01
gcggcugggugucgaccu

SEQ ID NO: 3399629 - RNA, 22 nt, Pseudomonas aeruginosa PA01
gcggcugggugucgaccuccgc

SEQ ID NO: 3399630 - RNA, 20 nt, Pseudomonas aeruginosa PA01
gcggcuguagccacggcgag

SEQ ID NO: 3399631 - RNA, 22 nt, Pseudomonas aeruginosa PA01
gcggcuguagcggaucaggccc

SEQ ID NO: 3399632 - RNA, 23 nt, Pseudomonas aeruginosa PA01
gcggcuguagcggaucaggccca

SEQ ID NO: 3399633 - RNA, 19 nt, Pseudomonas aeruginosa PA01
gcggcugugcucgaggaag

SEQ ID NO: 3399634 - RNA, 17 nt, Pseudomonas aeruginosa PA01
gcggcuguugccguucu

SEQ ID NO: 3399635 - RNA, 19 nt, Pseudomonas aeruginosa PA01
gcgggccgcucgcgcggca

SEQ ID NO: 3399636 - RNA, 16 nt, Pseudomonas aeruginosa PA01
gcgggccggcgauggc

SEQ ID NO: 3399637 - RNA, 17 nt, Pseudomonas aeruginosa PA01
gcgggccggcguccagg

SEQ ID NO: 3399638 - RNA, 15 nt, Pseudomonas aeruginosa PA01
gcgggccggggaucg

SEQ ID NO: 3399639 - RNA, 19 nt, Pseudomonas aeruginosa PA01
gcgggccguagggcgaaca

SEQ ID NO: 3399640 - RNA, 15 nt, Pseudomonas aeruginosa PA01
gcgggccucggcggg

SEQ ID NO: 3399641 - RNA, 23 nt, Pseudomonas aeruginosa PA01
gcgggccucggcggguguggucc

SEQ ID NO: 3399642 - RNA, 11 nt, Pseudomonas aeruginosa PA01
gcgggccuggg

SEQ ID NO: 3399643 - RNA, 24 nt, Pseudomonas aeruginosa PA01
gcgggccuucaggcugcgcgcauc

SEQ ID NO: 3399644 - RNA, 16 nt, Pseudomonas aeruginosa PA01
gcgggccuucgccagc

SEQ ID NO: 3399645 - RNA, 23 nt, Pseudomonas aeruginosa PA01
gcgggccuucgccagcggccagg

SEQ ID NO: 3399646 - RNA, 23 nt, Pseudomonas aeruginosa PA01
gcgggccuucgccuucggcgugc

SEQ ID NO: 3399647 - RNA, 19 nt, Pseudomonas aeruginosa PA01
gcgggccuugaccaccgcc

SEQ ID NO: 3399648 - RNA, 20 nt, Pseudomonas aeruginosa PA01
gcgggccuugaccaccgcca

SEQ ID NO: 3399649 - RNA, 12 nt, Pseudomonas aeruginosa PA01
gcgggccuugcg

SEQ ID NO: 3399650 - RNA, 17 nt, Pseudomonas aeruginosa PA01
gcgggccuugcgaccag

SEQ ID NO: 3399651 - RNA, 18 nt, Pseudomonas aeruginosa PA01
gcgggccuugcgaccagg

SEQ ID NO: 3399652 - RNA, 19 nt, Pseudomonas aeruginosa PA01
gcgggccuugcgaccaggu

SEQ ID NO: 3399653 - RNA, 15 nt, Pseudomonas aeruginosa PA01
gcgggccuuggcgua

SEQ ID NO: 3399654 - RNA, 12 nt, Pseudomonas aeruginosa PA01
gcgggcgaacgg

SEQ ID NO: 3399655 - RNA, 15 nt, Pseudomonas aeruginosa PA01
gcgggcgaacggcag

SEQ ID NO: 3399656 - RNA, 20 nt, Pseudomonas aeruginosa PA01
gcgggcgaagcgcagcuccg

SEQ ID NO: 3399657 - RNA, 21 nt, Pseudomonas aeruginosa PA01
gcgggcgaagcgcagcuccgg

SEQ ID NO: 3399658 - RNA, 14 nt, Pseudomonas aeruginosa PA01
gcgggcgaaggccu

SEQ ID NO: 3399659 - RNA, 22 nt, Pseudomonas aeruginosa PA01
gcgggcgaaguagaagcgcgcg

SEQ ID NO: 3399660 - RNA, 22 nt, Pseudomonas aeruginosa PA01
gcgggcgaccggaugcuccagg

SEQ ID NO: 3399661 - RNA, 20 nt, Pseudomonas aeruginosa PA01
gcgggcgacgugggccugcu

SEQ ID NO: 3399662 - RNA, 16 nt, Pseudomonas aeruginosa PA01
gcgggcgagggcggcg

SEQ ID NO: 3399663 - RNA, 19 nt, Pseudomonas aeruginosa PA01
gcgggcgaucuccucgauc

SEQ ID NO: 3399664 - RNA, 22 nt, Pseudomonas aeruginosa PA01
gcgggcgaucuccucgauccgc

SEQ ID NO: 3399665 - RNA, 20 nt, Pseudomonas aeruginosa PA01
gcgggcgaugaggcugucca

SEQ ID NO: 3399666 - RNA, 21 nt, Pseudomonas aeruginosa PA01
gcgggcgaugaggcuguccag

SEQ ID NO: 3399667 - RNA, 23 nt, Pseudomonas aeruginosa PA01
gcgggcgaugaggcuguccagca

SEQ ID NO: 3399668 - RNA, 12 nt, Pseudomonas aeruginosa PA01
gcgggcgcccgc

SEQ ID NO: 3399669 - RNA, 18 nt, Pseudomonas aeruginosa PA01
gcgggcgcccgccaaggc

SEQ ID NO: 3399670 - RNA, 18 nt, Pseudomonas aeruginosa PA01
gcgggcgccgaugccggc

SEQ ID NO: 3399671 - RNA, 20 nt, Pseudomonas aeruginosa PA01
gcgggcgccgaugccggccg

SEQ ID NO: 3399672 - RNA, 12 nt, Pseudomonas aeruginosa PA01
gcgggcgccgcc

SEQ ID NO: 3399673 - RNA, 19 nt, Pseudomonas aeruginosa PA01
gcgggcgccgccgcuggcg

SEQ ID NO: 3399674 - RNA, 14 nt, Pseudomonas aeruginosa PA01
gcgggcgccggacc

SEQ ID NO: 3399675 - RNA, 18 nt, Pseudomonas aeruginosa PA01
gcgggcgccggaccagcc

SEQ ID NO: 3399676 - RNA, 21 nt, Pseudomonas aeruginosa PA01
gcgggcgccguggaucgcccg

SEQ ID NO: 3399677 - RNA, 22 nt, Pseudomonas aeruginosa PA01
gcgggcgccuuuuucauggccu

SEQ ID NO: 3399678 - RNA, 23 nt, Pseudomonas aeruginosa PA01
gcgggcgccuuuuucauggccug

SEQ ID NO: 3399679 - RNA, 14 nt, Pseudomonas aeruginosa PA01
gcgggcgcgcagca

SEQ ID NO: 3399680 - RNA, 15 nt, Pseudomonas aeruginosa PA01
gcgggcgcgcagcag

SEQ ID NO: 3399681 - RNA, 15 nt, Pseudomonas aeruginosa PA01
gcgggcgcgccugag

SEQ ID NO: 3399682 - RNA, 19 nt, Pseudomonas aeruginosa PA01
gcgggcgcggaucggcgug

SEQ ID NO: 3399683 - RNA, 13 nt, Pseudomonas aeruginosa PA01
gcgggcgcgggcg

SEQ ID NO: 3399684 - RNA, 12 nt, Pseudomonas aeruginosa PA01
gcgggcgcggua

SEQ ID NO: 3399685 - RNA, 22 nt, Pseudomonas aeruginosa PA01
gcgggcgcuaugcgccguuacg

SEQ ID NO: 3399686 - RNA, 19 nt, Pseudomonas aeruginosa PA01
gcgggcgcuugaagccggc

SEQ ID NO: 3399687 - RNA, 20 nt, Pseudomonas aeruginosa PA01
gcgggcgcuugaagccggcg

SEQ ID NO: 3399688 - RNA, 21 nt, Pseudomonas aeruginosa PA01
gcgggcgcuugaagccggcgu

SEQ ID NO: 3399689 - RNA, 17 nt, Pseudomonas aeruginosa PA01
gcgggcgcuuucgagaa

SEQ ID NO: 3399690 - RNA, 21 nt, Pseudomonas aeruginosa PA01
gcgggcggccccuucagcucc

SEQ ID NO: 3399691 - RNA, 20 nt, Pseudomonas aeruginosa PA01
gcgggcggccucgauggcgg

SEQ ID NO: 3399692 - RNA, 15 nt, Pseudomonas aeruginosa PA01
gcgggcggcgucgaa

SEQ ID NO: 3399693 - RNA, 20 nt, Pseudomonas aeruginosa PA01
gcgggcgguagcgggccagc

SEQ ID NO: 3399694 - RNA, 22 nt, Pseudomonas aeruginosa PA01
gcgggcgguagcgggccagcag

SEQ ID NO: 3399695 - RNA, 23 nt, Pseudomonas aeruginosa PA01
gcgggcgguagcgggccagcagc

SEQ ID NO: 3399696 - RNA, 18 nt, Pseudomonas aeruginosa PA01
gcgggcggucgaggcccu

SEQ ID NO: 3399697 - RNA, 19 nt, Pseudomonas aeruginosa PA01
gcgggcggucgucgccauc

SEQ ID NO: 3399698 - RNA, 22 nt, Pseudomonas aeruginosa PA01
gcgggcguagccuuccuucucg

SEQ ID NO: 3399699 - RNA, 15 nt, Pseudomonas aeruginosa PA01
gcgggcguagcgcgg

SEQ ID NO: 3399700 - RNA, 21 nt, Pseudomonas aeruginosa PA01
gcgggcguagcgcggcagcgc

SEQ ID NO: 3399701 - RNA, 22 nt, Pseudomonas aeruginosa PA01
gcgggcguagcgcggcagcgcc

SEQ ID NO: 3399702 - RNA, 23 nt, Pseudomonas aeruginosa PA01
gcgggcguagcgcggcagcgcca

SEQ ID NO: 3399703 - RNA, 14 nt, Pseudomonas aeruginosa PA01
gcgggcguccggcg

SEQ ID NO: 3399704 - RNA, 17 nt, Pseudomonas aeruginosa PA01
gcgggcguccggcgagc

SEQ ID NO: 3399705 - RNA, 22 nt, Pseudomonas aeruginosa PA01
gcgggcguccggcgagcacggc

SEQ ID NO: 3399706 - RNA, 23 nt, Pseudomonas aeruginosa PA01
gcgggcguccguaaugcaacccg

SEQ ID NO: 3399707 - RNA, 14 nt, Pseudomonas aeruginosa PA01
gcgggcgucggcgu

SEQ ID NO: 3399708 - RNA, 15 nt, Pseudomonas aeruginosa PA01
gcgggcgucggcguc

SEQ ID NO: 3399709 - RNA, 18 nt, Pseudomonas aeruginosa PA01
gcgggcgucggcgucggc

SEQ ID NO: 3399710 - RNA, 16 nt, Pseudomonas aeruginosa PA01
gcgggcgugcuccagc

SEQ ID NO: 3399711 - RNA, 22 nt, Pseudomonas aeruginosa PA01
gcgggcgugcuccagcaccgug

SEQ ID NO: 3399712 - RNA, 15 nt, Pseudomonas aeruginosa PA01
gcgggcguugcgcgc

SEQ ID NO: 3399713 - RNA, 17 nt, Pseudomonas aeruginosa PA01
gcgggcguugcgcgccu

SEQ ID NO: 3399714 - RNA, 18 nt, Pseudomonas aeruginosa PA01
gcgggcguuguccacgga

SEQ ID NO: 3399715 - RNA, 23 nt, Pseudomonas aeruginosa PA01
gcgggcguuuucguuggcggcca

SEQ ID NO: 3399716 - RNA, 16 nt, Pseudomonas aeruginosa PA01
gcgggcuaccaggaag

SEQ ID NO: 3399717 - RNA, 21 nt, Pseudomonas aeruginosa PA01
gcgggcuaccaggaagcucgg

SEQ ID NO: 3399718 - RNA, 21 nt, Pseudomonas aeruginosa PA01
gcgggcuauucccgccgcucc

SEQ ID NO: 3399719 - RNA, 15 nt, Pseudomonas aeruginosa PA01
gcgggcuccgccgcc

SEQ ID NO: 3399720 - RNA, 16 nt, Pseudomonas aeruginosa PA01
gcgggcuccgccgccg

SEQ ID NO: 3399721 - RNA, 21 nt, Pseudomonas aeruginosa PA01
gcgggcucgcaaucagcgcga

SEQ ID NO: 3399722 - RNA, 18 nt, Pseudomonas aeruginosa PA01
gcgggcugaagugggucg

SEQ ID NO: 3399723 - RNA, 22 nt, Pseudomonas aeruginosa PA01
gcgggcugccccucacaccacc

SEQ ID NO: 3399724 - RNA, 14 nt, Pseudomonas aeruginosa PA01
gcgggcugccgcgg

SEQ ID NO: 3399725 - RNA, 19 nt, Pseudomonas aeruginosa PA01
gcgggcugcgugccagcac

SEQ ID NO: 3399726 - RNA, 18 nt, Pseudomonas aeruginosa PA01
gcgggcuggaaaacgcca

SEQ ID NO: 3399727 - RNA, 15 nt, Pseudomonas aeruginosa PA01
gcgggcuggccaccg

SEQ ID NO: 3399728 - RNA, 19 nt, Pseudomonas aeruginosa PA01
gcgggcuucggacuuuucg

SEQ ID NO: 3399729 - RNA, 18 nt, Pseudomonas aeruginosa PA01
gcgggcuuuuucguuggc

SEQ ID NO: 3399730 - RNA, 21 nt, Pseudomonas aeruginosa PA01
gcgggcuuuuucguuggccag

SEQ ID NO: 3399731 - RNA, 20 nt, Pseudomonas aeruginosa PA01
gcggggaaagcuccucggcc

SEQ ID NO: 3399732 - RNA, 13 nt, Pseudomonas aeruginosa PA01
gcggggaacagca

SEQ ID NO: 3399733 - RNA, 15 nt, Pseudomonas aeruginosa PA01
gcggggaagccuucg

SEQ ID NO: 3399734 - RNA, 14 nt, Pseudomonas aeruginosa PA01
gcggggaaggcguc

SEQ ID NO: 3399735 - RNA, 19 nt, Pseudomonas aeruginosa PA01
gcggggaauuuccggcaac

SEQ ID NO: 3399736 - RNA, 21 nt, Pseudomonas aeruginosa PA01
gcggguucagcccgccgugcg

SEQ ID NO: 3399737 - RNA, 17 nt, Pseudomonas aeruginosa PA01
gcggguucagucggcca

SEQ ID NO: 3399738 - RNA, 19 nt, Pseudomonas aeruginosa PA01
gcggguucagucggccagg

SEQ ID NO: 3399739 - RNA, 23 nt, Pseudomonas aeruginosa PA01
gcggguucagucggccaggcgcc

SEQ ID NO: 3399740 - RNA, 16 nt, Pseudomonas aeruginosa PA01
gcggguucccugcgcc

SEQ ID NO: 3399741 - RNA, 23 nt, Pseudomonas aeruginosa PA01
gcggguucccugcgccucgaccu

SEQ ID NO: 3399742 - RNA, 18 nt, Pseudomonas aeruginosa PA01
gcggguucgagucccguc

SEQ ID NO: 3399743 - RNA, 15 nt, Pseudomonas aeruginosa PA01
gcggguucggcgaga

SEQ ID NO: 3399744 - RNA, 15 nt, Pseudomonas aeruginosa PA01
gcggguucgugccag

SEQ ID NO: 3399745 - RNA, 17 nt, Pseudomonas aeruginosa PA01
gcggguucgugccaggc

SEQ ID NO: 3399746 - RNA, 20 nt, Pseudomonas aeruginosa PA01
gcggguugaccccgaggucg

SEQ ID NO: 3399747 - RNA, 22 nt, Pseudomonas aeruginosa PA01
gcggguugaccccgaggucggc

SEQ ID NO: 3399748 - RNA, 15 nt, Pseudomonas aeruginosa PA01
gcggguuggcuucca

SEQ ID NO: 3399749 - RNA, 19 nt, Pseudomonas aeruginosa PA01
gcggguuggcuuccagcca

SEQ ID NO: 3399750 - RNA, 21 nt, Pseudomonas aeruginosa PA01
gcggguuggcuuccagccagc

SEQ ID NO: 3399751 - RNA, 16 nt, Pseudomonas aeruginosa PA01
gcggguuggucggcac

SEQ ID NO: 3399752 - RNA, 19 nt, Pseudomonas aeruginosa PA01
gcggguuuccgugcgcugc

SEQ ID NO: 3399753 - RNA, 18 nt, Pseudomonas aeruginosa PA01
gcgguacaccgccagggu

SEQ ID NO: 3399754 - RNA, 13 nt, Pseudomonas aeruginosa PA01
gcgguacagcccc

SEQ ID NO: 3399755 - RNA, 15 nt, Pseudomonas aeruginosa PA01
gcgguacagccccca

SEQ ID NO: 3399756 - RNA, 18 nt, Pseudomonas aeruginosa PA01
gcgguacagcccccaggc

SEQ ID NO: 3399757 - RNA, 21 nt, Pseudomonas aeruginosa PA01
gcgguacagcccccaggcacc

SEQ ID NO: 3399758 - RNA, 14 nt, Pseudomonas aeruginosa PA01
gcgguacagccggu

SEQ ID NO: 3399759 - RNA, 18 nt, Pseudomonas aeruginosa PA01
gcgguacagcucguccuu

SEQ ID NO: 3399760 - RNA, 14 nt, Pseudomonas aeruginosa PA01
gcgguacaggcgca

SEQ ID NO: 3399761 - RNA, 23 nt, Pseudomonas aeruginosa PA01
gcgguacaggcgcaccuggcggu

SEQ ID NO: 3399762 - RNA, 15 nt, Pseudomonas aeruginosa PA01
gcgguaccagcagcg

SEQ ID NO: 3399763 - RNA, 19 nt, Pseudomonas aeruginosa PA01
gcgguaccagcagcgccga

SEQ ID NO: 3399764 - RNA, 14 nt, Pseudomonas aeruginosa PA01
gcgguaccagcgca

SEQ ID NO: 3399765 - RNA, 19 nt, Pseudomonas aeruginosa PA01
gcgguaccagcgcaccagg

SEQ ID NO: 3399766 - RNA, 22 nt, Pseudomonas aeruginosa PA01
gcgguaccagcgcaccaggguc

SEQ ID NO: 3399767 - RNA, 15 nt, Pseudomonas aeruginosa PA01
gcgguacccagcuug

SEQ ID NO: 3399768 - RNA, 14 nt, Pseudomonas aeruginosa PA01
gcgguacccgccgg

SEQ ID NO: 3399769 - RNA, 19 nt, Pseudomonas aeruginosa PA01
gcgguacccgccggccaug

SEQ ID NO: 3399770 - RNA, 17 nt, Pseudomonas aeruginosa PA01
gcgguacgccgcgcugc

SEQ ID NO: 3399771 - RNA, 16 nt, Pseudomonas aeruginosa PA01
gcgguacgcugcaugu

SEQ ID NO: 3399772 - RNA, 16 nt, Pseudomonas aeruginosa PA01
gcgguacguagcgcgg

SEQ ID NO: 3399773 - RNA, 18 nt, Pseudomonas aeruginosa PA01
gcgguagacauucagcag

SEQ ID NO: 3399774 - RNA, 16 nt, Pseudomonas aeruginosa PA01
gcgguagacgcagggu

SEQ ID NO: 3399775 - RNA, 13 nt, Pseudomonas aeruginosa PA01
gcgguagcccggc

SEQ ID NO: 3399776 - RNA, 20 nt, Pseudomonas aeruginosa PA01
gcgguagcccggcagcuccc

SEQ ID NO: 3399777 - RNA, 20 nt, Pseudomonas aeruginosa PA01
gcgguagcgccgcgccaacu

SEQ ID NO: 3399778 - RNA, 13 nt, Pseudomonas aeruginosa PA01
gcgguagcgcgaa

SEQ ID NO: 3399779 - RNA, 20 nt, Pseudomonas aeruginosa PA01
gcgguagcgggccagcagcu

SEQ ID NO: 3399780 - RNA, 17 nt, Pseudomonas aeruginosa PA01
gcgguagcuccaggccg

SEQ ID NO: 3399781 - RNA, 21 nt, Pseudomonas aeruginosa PA01
gcgguagcuccaggccgaaga

SEQ ID NO: 3399782 - RNA, 15 nt, Pseudomonas aeruginosa PA01
gcgguagcugcgcag

SEQ ID NO: 3399783 - RNA, 21 nt, Pseudomonas aeruginosa PA01
gcgguagcugcgcagggcgcc

SEQ ID NO: 3399784 - RNA, 13 nt, Pseudomonas aeruginosa PA01
gcgguaggccagc

SEQ ID NO: 3399785 - RNA, 14 nt, Pseudomonas aeruginosa PA01
gcgguaggccagcu

SEQ ID NO: 3399786 - RNA, 13 nt, Pseudomonas aeruginosa PA01
gcgguaggucagc

SEQ ID NO: 3399787 - RNA, 16 nt, Pseudomonas aeruginosa PA01
gcgguaggugagcgac

SEQ ID NO: 3399788 - RNA, 20 nt, Pseudomonas aeruginosa PA01
gcgguaggugagcgacccgc

SEQ ID NO: 3399789 - RNA, 20 nt, Pseudomonas aeruginosa PA01
gcgguagguguacccagggu

SEQ ID NO: 3399790 - RNA, 23 nt, Pseudomonas aeruginosa PA01
gcgguaguaggguucgccgacgu

SEQ ID NO: 3399791 - RNA, 16 nt, Pseudomonas aeruginosa PA01
gcgguagucgcugcug

SEQ ID NO: 3399792 - RNA, 21 nt, Pseudomonas aeruginosa PA01
gcgguaguguugaagccgcca

SEQ ID NO: 3399793 - RNA, 12 nt, Pseudomonas aeruginosa PA01
gcgguaguucag

SEQ ID NO: 3399794 - RNA, 13 nt, Pseudomonas aeruginosa PA01
gcgguauagcuca

SEQ ID NO: 3399795 - RNA, 15 nt, Pseudomonas aeruginosa PA01
gcgguaugccgcagg

SEQ ID NO: 3399796 - RNA, 16 nt, Pseudomonas aeruginosa PA01
gcgguaugccgcaggc

SEQ ID NO: 3399797 - RNA, 17 nt, Pseudomonas aeruginosa PA01
gcgguaugccgcaggca

SEQ ID NO: 3399798 - RNA, 19 nt, Pseudomonas aeruginosa PA01
gcgguauucuccagcaggc

SEQ ID NO: 3399799 - RNA, 22 nt, Pseudomonas aeruginosa PA01
gcgguauucuccagcaggcucu

SEQ ID NO: 3399800 - RNA, 20 nt, Pseudomonas aeruginosa PA01
gcgguauugaagucgucguc

SEQ ID NO: 3399801 - RNA, 22 nt, Pseudomonas aeruginosa PA01
gcggucaccagggucacgccgc

SEQ ID NO: 3399802 - RNA, 24 nt, Pseudomonas aeruginosa PA01
gcggucacccauucgaugccgcgc

SEQ ID NO: 3399803 - RNA, 15 nt, Pseudomonas aeruginosa PA01
gcggucacucggccu

SEQ ID NO: 3399804 - RNA, 18 nt, Pseudomonas aeruginosa PA01
gcggucacucggccucgg

SEQ ID NO: 3399805 - RNA, 21 nt, Pseudomonas aeruginosa PA01
gcggucacucggccucggcgu

SEQ ID NO: 3399806 - RNA, 20 nt, Pseudomonas aeruginosa PA01
gcggucagcaguugccgggu

SEQ ID NO: 3399807 - RNA, 19 nt, Pseudomonas aeruginosa PA01
gcggucagcgacuggcccu

SEQ ID NO: 3399808 - RNA, 22 nt, Pseudomonas aeruginosa PA01
gcggucagcgacuggcccuggu

SEQ ID NO: 3399809 - RNA, 17 nt, Pseudomonas aeruginosa PA01
gcggucauccgcccugc

SEQ ID NO: 3399810 - RNA, 17 nt, Pseudomonas aeruginosa PA01
gcggucauccgccggcg

SEQ ID NO: 3399811 - RNA, 20 nt, Pseudomonas aeruginosa PA01
gcggucauccgccggcgcgu

SEQ ID NO: 3399812 - RNA, 22 nt, Pseudomonas aeruginosa PA01
gcggucauccgccggcgcguag

SEQ ID NO: 3399813 - RNA, 13 nt, Pseudomonas aeruginosa PA01
gcggucaucgccg

SEQ ID NO: 3399814 - RNA, 13 nt, Pseudomonas aeruginosa PA01
gcggucaucgcgc

SEQ ID NO: 3399815 - RNA, 14 nt, Pseudomonas aeruginosa PA01
gcggucaugcgccc

SEQ ID NO: 3399816 - RNA, 22 nt, Pseudomonas aeruginosa PA01
gcggucaugcgcccuacgccac

SEQ ID NO: 3399817 - RNA, 13 nt, Pseudomonas aeruginosa PA01
gcgguccagccag

SEQ ID NO: 3399818 - RNA, 15 nt, Pseudomonas aeruginosa PA01
gcgguccagcgagcg

SEQ ID NO: 3399819 - RNA, 16 nt, Pseudomonas aeruginosa PA01
gcgguccagcgagcgg

SEQ ID NO: 3399820 - RNA, 18 nt, Pseudomonas aeruginosa PA01
gcgguccagcgagcgggc

SEQ ID NO: 3399821 - RNA, 14 nt, Pseudomonas aeruginosa PA01
gcgguccaggggcc

SEQ ID NO: 3399822 - RNA, 19 nt, Pseudomonas aeruginosa PA01
gcgguccaggucaugcccu

SEQ ID NO: 3399823 - RNA, 17 nt, Pseudomonas aeruginosa PA01
gcggucccagaccagca

SEQ ID NO: 3399824 - RNA, 20 nt, Pseudomonas aeruginosa PA01
gcggucccagaccagcagcg

SEQ ID NO: 3399825 - RNA, 22 nt, Pseudomonas aeruginosa PA01
gcggucccagaccagcagcggc

SEQ ID NO: 3399826 - RNA, 23 nt, Pseudomonas aeruginosa PA01
gcggucccagaccagcagcggca

SEQ ID NO: 3399827 - RNA, 15 nt, Pseudomonas aeruginosa PA01
gcggucccaucagca

SEQ ID NO: 3399828 - RNA, 16 nt, Pseudomonas aeruginosa PA01
gcggucccaucagcag

SEQ ID NO: 3399829 - RNA, 16 nt, Pseudomonas aeruginosa PA01
gcggucccuggaucug

SEQ ID NO: 3399830 - RNA, 22 nt, Pseudomonas aeruginosa PA01
gcggucccuucgugggccugcu

SEQ ID NO: 3399831 - RNA, 22 nt, Pseudomonas aeruginosa PA01
gcgguccgccgcgggacgccgc

SEQ ID NO: 3399832 - RNA, 21 nt, Pseudomonas aeruginosa PA01
gcgguccgcgguagcugcgca

SEQ ID NO: 3399833 - RNA, 23 nt, Pseudomonas aeruginosa PA01
gcgguccgcgguagcugcgcagg

SEQ ID NO: 3399834 - RNA, 12 nt, Pseudomonas aeruginosa PA01
gcgguccggacu

SEQ ID NO: 3399835 - RNA, 20 nt, Pseudomonas aeruginosa PA01
gcgguccggcgaaguccggg

SEQ ID NO: 3399836 - RNA, 16 nt, Pseudomonas aeruginosa PA01
gcgguccucgggcacc

SEQ ID NO: 3399837 - RNA, 23 nt, Pseudomonas aeruginosa PA01
gcgguccucgggcaccagcacgg

SEQ ID NO: 3399838 - RNA, 21 nt, Pseudomonas aeruginosa PA01
gcgguugcgggucagcagugc

SEQ ID NO: 3399839 - RNA, 18 nt, Pseudomonas aeruginosa PA01
gcgguuggcccgcgccgu

SEQ ID NO: 3399840 - RNA, 15 nt, Pseudomonas aeruginosa PA01
gcgguuggcgccucg

SEQ ID NO: 3399841 - RNA, 22 nt, Pseudomonas aeruginosa PA01
gcgguuguugaugcccaccaac

SEQ ID NO: 3399842 - RNA, 23 nt, Pseudomonas aeruginosa PA01
gcgguuguugaugcccaccaacg

SEQ ID NO: 3399843 - RNA, 15 nt, Pseudomonas aeruginosa PA01
gcgguuucgcagcgc

SEQ ID NO: 3399844 - RNA, 14 nt, Pseudomonas aeruginosa PA01
gcgguuucgccgag

SEQ ID NO: 3399845 - RNA, 19 nt, Pseudomonas aeruginosa PA01
gcgguuucuucgccuugcc

SEQ ID NO: 3399846 - RNA, 17 nt, Pseudomonas aeruginosa PA01
gcgguuuuccugccccg

SEQ ID NO: 3399847 - RNA, 12 nt, Pseudomonas aeruginosa PA01
gcguaacggcuc

SEQ ID NO: 3399848 - RNA, 18 nt, Pseudomonas aeruginosa PA01
gcguaacggcucgccggg

SEQ ID NO: 3399849 - RNA, 12 nt, Pseudomonas aeruginosa PA01
gcguaacggcuu

SEQ ID NO: 3399850 - RNA, 13 nt, Pseudomonas aeruginosa PA01
gcguaagcggccu

SEQ ID NO: 3399851 - RNA, 20 nt, Pseudomonas aeruginosa PA01
gcguaauaggcgaagcggcu

SEQ ID NO: 3399852 - RNA, 17 nt, Pseudomonas aeruginosa PA01
gcguacagcgggccggg

SEQ ID NO: 3399853 - RNA, 13 nt, Pseudomonas aeruginosa PA01
gcguacaggcccc

SEQ ID NO: 3399854 - RNA, 18 nt, Pseudomonas aeruginosa PA01
gcguacaucccgccgaua

SEQ ID NO: 3399855 - RNA, 14 nt, Pseudomonas aeruginosa PA01
gcguaccagcgcgc

SEQ ID NO: 3399856 - RNA, 23 nt, Pseudomonas aeruginosa PA01
gcguaccagcuugucgccuuccu

SEQ ID NO: 3399857 - RNA, 16 nt, Pseudomonas aeruginosa PA01
gcguaccaggaugccc

SEQ ID NO: 3399858 - RNA, 19 nt, Pseudomonas aeruginosa PA01
gcguaccaggaugcccugc

SEQ ID NO: 3399859 - RNA, 21 nt, Pseudomonas aeruginosa PA01
gcguaccaggaugcccugcuc

SEQ ID NO: 3399860 - RNA, 20 nt, Pseudomonas aeruginosa PA01
gcguaccggcuacaggccgu

SEQ ID NO: 3399861 - RNA, 16 nt, Pseudomonas aeruginosa PA01
gcguacgcccagcagc

SEQ ID NO: 3399862 - RNA, 17 nt, Pseudomonas aeruginosa PA01
gcguacgcccagcagcg

SEQ ID NO: 3399863 - RNA, 21 nt, Pseudomonas aeruginosa PA01
gcguacgcccgcagccacggc

SEQ ID NO: 3399864 - RNA, 20 nt, Pseudomonas aeruginosa PA01
gcguacggucaugccgaacu

SEQ ID NO: 3399865 - RNA, 16 nt, Pseudomonas aeruginosa PA01
gcguacuucggcgcgg

SEQ ID NO: 3399866 - RNA, 16 nt, Pseudomonas aeruginosa PA01
gcguacuugccagggc

SEQ ID NO: 3399867 - RNA, 21 nt, Pseudomonas aeruginosa PA01
gcguacuugccagggcaggga

SEQ ID NO: 3399868 - RNA, 17 nt, Pseudomonas aeruginosa PA01
gcguacuuggcccggcg

SEQ ID NO: 3399869 - RNA, 19 nt, Pseudomonas aeruginosa PA01
gcguagaaacgcgccuccg

SEQ ID NO: 3399870 - RNA, 23 nt, Pseudomonas aeruginosa PA01
gcguagaccaccucgacggcgau

SEQ ID NO: 3399871 - RNA, 16 nt, Pseudomonas aeruginosa PA01
gcguagaccaucgccg

SEQ ID NO: 3399872 - RNA, 23 nt, Pseudomonas aeruginosa PA01
gcguagaccaucgccggcgagcc

SEQ ID NO: 3399873 - RNA, 22 nt, Pseudomonas aeruginosa PA01
gcguagaccuugcggccguucu

SEQ ID NO: 3399874 - RNA, 17 nt, Pseudomonas aeruginosa PA01
gcguagaggcucggcgg

SEQ ID NO: 3399875 - RNA, 16 nt, Pseudomonas aeruginosa PA01
gcguagccggccaggg

SEQ ID NO: 3399876 - RNA, 18 nt, Pseudomonas aeruginosa PA01
gcguagccggccagggcg

SEQ ID NO: 3399877 - RNA, 16 nt, Pseudomonas aeruginosa PA01
gcguagcgacaggccc

SEQ ID NO: 3399878 - RNA, 16 nt, Pseudomonas aeruginosa PA01
gcguagcgccaggccu

SEQ ID NO: 3399879 - RNA, 15 nt, Pseudomonas aeruginosa PA01
gcguagcggaagccg

SEQ ID NO: 3399880 - RNA, 20 nt, Pseudomonas aeruginosa PA01
gcguagcgguccucgggcac

SEQ ID NO: 3399881 - RNA, 15 nt, Pseudomonas aeruginosa PA01
gcguagcgugccgcc

SEQ ID NO: 3399882 - RNA, 14 nt, Pseudomonas aeruginosa PA01
gcguagcguugcgc

SEQ ID NO: 3399883 - RNA, 18 nt, Pseudomonas aeruginosa PA01
gcguagcguugcgcgagc

SEQ ID NO: 3399884 - RNA, 14 nt, Pseudomonas aeruginosa PA01
gcguagcugggcga

SEQ ID NO: 3399885 - RNA, 19 nt, Pseudomonas aeruginosa PA01
gcguagcugggcgaucacg

SEQ ID NO: 3399886 - RNA, 22 nt, Pseudomonas aeruginosa PA01
gcguagcugggcgaucacgccg

SEQ ID NO: 3399887 - RNA, 18 nt, Pseudomonas aeruginosa PA01
gcguaggccucggaguca

SEQ ID NO: 3399888 - RNA, 12 nt, Pseudomonas aeruginosa PA01
gcguaggcgcgc

SEQ ID NO: 3399889 - RNA, 14 nt, Pseudomonas aeruginosa PA01
gcguaggcgcgcca

SEQ ID NO: 3399890 - RNA, 21 nt, Pseudomonas aeruginosa PA01
gcguaggcgcgccaaggccgc

SEQ ID NO: 3399891 - RNA, 14 nt, Pseudomonas aeruginosa PA01
gcguaggcgucgcg

SEQ ID NO: 3399892 - RNA, 12 nt, Pseudomonas aeruginosa PA01
gcguagggcgaa

SEQ ID NO: 3399893 - RNA, 18 nt, Pseudomonas aeruginosa PA01
gcguagguggcgccgccg

SEQ ID NO: 3399894 - RNA, 20 nt, Pseudomonas aeruginosa PA01
gcguagguggcgccgccggc

SEQ ID NO: 3399895 - RNA, 22 nt, Pseudomonas aeruginosa PA01
gcguaguagccggacuccgacg

SEQ ID NO: 3399896 - RNA, 21 nt, Pseudomonas aeruginosa PA01
gcguaguaggcacaggacccu

SEQ ID NO: 3399897 - RNA, 22 nt, Pseudomonas aeruginosa PA01
gcguagugcaucagccuggcca

SEQ ID NO: 3399898 - RNA, 17 nt, Pseudomonas aeruginosa PA01
gcguagugcuccucguc

SEQ ID NO: 3399899 - RNA, 22 nt, Pseudomonas aeruginosa PA01
gcguagugcuggguggaggccc

SEQ ID NO: 3399900 - RNA, 17 nt, Pseudomonas aeruginosa PA01
gcguagugcugguaggg

SEQ ID NO: 3399901 - RNA, 13 nt, Pseudomonas aeruginosa PA01
gcguauaaccgcu

SEQ ID NO: 3399902 - RNA, 19 nt, Pseudomonas aeruginosa PA01
gcguauaaccgcucgcggu

SEQ ID NO: 3399903 - RNA, 14 nt, Pseudomonas aeruginosa PA01
gcguauagcccggg

SEQ ID NO: 3399904 - RNA, 17 nt, Pseudomonas aeruginosa PA01
gcguaucgaugcgcgcg

SEQ ID NO: 3399905 - RNA, 21 nt, Pseudomonas aeruginosa PA01
gcguaucgaugcgcgcggcga

SEQ ID NO: 3399906 - RNA, 22 nt, Pseudomonas aeruginosa PA01
gcguaucgaugcgcgcggcgag

SEQ ID NO: 3399907 - RNA, 14 nt, Pseudomonas aeruginosa PA01
gcguauucgccgaa

SEQ ID NO: 3399908 - RNA, 16 nt, Pseudomonas aeruginosa PA01
gcguauucggcgacca

SEQ ID NO: 3399909 - RNA, 19 nt, Pseudomonas aeruginosa PA01
gcgucaacgaagucgcgag

SEQ ID NO: 3399910 - RNA, 12 nt, Pseudomonas aeruginosa PA01
gcgucaacggug

SEQ ID NO: 3399911 - RNA, 15 nt, Pseudomonas aeruginosa PA01
gcgucaccgcgccga

SEQ ID NO: 3399912 - RNA, 19 nt, Pseudomonas aeruginosa PA01
gcgucacgccgaucccggc

SEQ ID NO: 3399913 - RNA, 17 nt, Pseudomonas aeruginosa PA01
gcgucacggacccgcuc

SEQ ID NO: 3399914 - RNA, 23 nt, Pseudomonas aeruginosa PA01
gcgucacggacccgcucggccuu

SEQ ID NO: 3399915 - RNA, 13 nt, Pseudomonas aeruginosa PA01
gcgucacucccag

SEQ ID NO: 3399916 - RNA, 19 nt, Pseudomonas aeruginosa PA01
gcgucacucgacaggccau

SEQ ID NO: 3399917 - RNA, 18 nt, Pseudomonas aeruginosa PA01
gcgucagccgcggccggg

SEQ ID NO: 3399918 - RNA, 18 nt, Pseudomonas aeruginosa PA01
gcgucagcgaggcgggcg

SEQ ID NO: 3399919 - RNA, 16 nt, Pseudomonas aeruginosa PA01
gcgucagcgcgccagc

SEQ ID NO: 3399920 - RNA, 17 nt, Pseudomonas aeruginosa PA01
gcgucagcgcgccagca

SEQ ID NO: 3399921 - RNA, 19 nt, Pseudomonas aeruginosa PA01
gcgucaguuccgcaucggc

SEQ ID NO: 3399922 - RNA, 19 nt, Pseudomonas aeruginosa PA01
gcgucaucaggcucaggcc

SEQ ID NO: 3399923 - RNA, 13 nt, Pseudomonas aeruginosa PA01
gcgucauccgccu

SEQ ID NO: 3399924 - RNA, 13 nt, Pseudomonas aeruginosa PA01
gcgucaugccgcc

SEQ ID NO: 3399925 - RNA, 17 nt, Pseudomonas aeruginosa PA01
gcgucaugccgccgucg

SEQ ID NO: 3399926 - RNA, 23 nt, Pseudomonas aeruginosa PA01
gcgucaugccgccgucgcggcca

SEQ ID NO: 3399927 - RNA, 19 nt, Pseudomonas aeruginosa PA01
gcguccaccauaaagccca

SEQ ID NO: 3399928 - RNA, 23 nt, Pseudomonas aeruginosa PA01
gcguccaccauaaagcccacacg

SEQ ID NO: 3399929 - RNA, 13 nt, Pseudomonas aeruginosa PA01
gcguccaccgcuu

SEQ ID NO: 3399930 - RNA, 14 nt, Pseudomonas aeruginosa PA01
gcguccaccuggcg

SEQ ID NO: 3399931 - RNA, 18 nt, Pseudomonas aeruginosa PA01
gcguccaccuggcggcug

SEQ ID NO: 3399932 - RNA, 19 nt, Pseudomonas aeruginosa PA01
gcguccaccuggcggcuga

SEQ ID NO: 3399933 - RNA, 14 nt, Pseudomonas aeruginosa PA01
gcguccacuccggc

SEQ ID NO: 3399934 - RNA, 17 nt, Pseudomonas aeruginosa PA01
gcguccacuccggcagc

SEQ ID NO: 3399935 - RNA, 17 nt, Pseudomonas aeruginosa PA01
gcguccagccgguaggg

SEQ ID NO: 3399936 - RNA, 13 nt, Pseudomonas aeruginosa PA01
gcguccagcucca

SEQ ID NO: 3399937 - RNA, 14 nt, Pseudomonas aeruginosa PA01
gcguccagcuccac

SEQ ID NO: 3399938 - RNA, 19 nt, Pseudomonas aeruginosa PA01
gcguccagggcuucgacau

SEQ ID NO: 3399939 - RNA, 18 nt, Pseudomonas aeruginosa PA01
gcguccaggugcggcugg

SEQ ID NO: 3399940 - RNA, 18 nt, Pseudomonas aeruginosa PA01
gcgucgccaggccguaga

SEQ ID NO: 3399941 - RNA, 14 nt, Pseudomonas aeruginosa PA01
gcgucgcccaggcc

SEQ ID NO: 3399942 - RNA, 16 nt, Pseudomonas aeruginosa PA01
gcgucgcccaggccgc

SEQ ID NO: 3399943 - RNA, 17 nt, Pseudomonas aeruginosa PA01
gcgucgcccaggccgcu

SEQ ID NO: 3399944 - RNA, 23 nt, Pseudomonas aeruginosa PA01
gcgucgcccaggccgcuggcggc

SEQ ID NO: 3399945 - RNA, 13 nt, Pseudomonas aeruginosa PA01
gcgucgccgaacg

SEQ ID NO: 3399946 - RNA, 23 nt, Pseudomonas aeruginosa PA01
gcgucgccgaacggcagcuggau

SEQ ID NO: 3399947 - RNA, 14 nt, Pseudomonas aeruginosa PA01
gcgucgccgccagc

SEQ ID NO: 3399948 - RNA, 12 nt, Pseudomonas aeruginosa PA01
gcgucgccgccg

SEQ ID NO: 3399949 - RNA, 17 nt, Pseudomonas aeruginosa PA01
gcgucgccgccgcgggc

SEQ ID NO: 3399950 - RNA, 13 nt, Pseudomonas aeruginosa PA01
gcgucgccggccg

SEQ ID NO: 3399951 - RNA, 15 nt, Pseudomonas aeruginosa PA01
gcgucgccggccgcu

SEQ ID NO: 3399952 - RNA, 23 nt, Pseudomonas aeruginosa PA01
gcgucgccgggaaacagggcgac

SEQ ID NO: 3399953 - RNA, 22 nt, Pseudomonas aeruginosa PA01
gcgucgccgggcguaacggcuu

SEQ ID NO: 3399954 - RNA, 16 nt, Pseudomonas aeruginosa PA01
gcgucgccugccaggc

SEQ ID NO: 3399955 - RNA, 17 nt, Pseudomonas aeruginosa PA01
gcgucgccugccaggcg

SEQ ID NO: 3399956 - RNA, 19 nt, Pseudomonas aeruginosa PA01
gcgucgccugccaggcggg

SEQ ID NO: 3399957 - RNA, 20 nt, Pseudomonas aeruginosa PA01
gcgucgccuucggagaacag

SEQ ID NO: 3399958 - RNA, 13 nt, Pseudomonas aeruginosa PA01
gcgucgcgccagc

SEQ ID NO: 3399959 - RNA, 14 nt, Pseudomonas aeruginosa PA01
gcgucgcgccagca

SEQ ID NO: 3399960 - RNA, 15 nt, Pseudomonas aeruginosa PA01
gcgucgcgccagcac

SEQ ID NO: 3399961 - RNA, 15 nt, Pseudomonas aeruginosa PA01
gcgucgcgcggccag

SEQ ID NO: 3399962 - RNA, 16 nt, Pseudomonas aeruginosa PA01
gcgucgcgcggccagc

SEQ ID NO: 3399963 - RNA, 16 nt, Pseudomonas aeruginosa PA01
gcgucgcgcguccagc

SEQ ID NO: 3399964 - RNA, 15 nt, Pseudomonas aeruginosa PA01
gcgucgcgcgugccc

SEQ ID NO: 3399965 - RNA, 17 nt, Pseudomonas aeruginosa PA01
gcgucgcgcuugccuuc

SEQ ID NO: 3399966 - RNA, 20 nt, Pseudomonas aeruginosa PA01
gcgucgcggagaauccgcuc

SEQ ID NO: 3399967 - RNA, 22 nt, Pseudomonas aeruginosa PA01
gcgucgcggagaauccgcucgg

SEQ ID NO: 3399968 - RNA, 24 nt, Pseudomonas aeruginosa PA01
gcgucgcggagaauccgcucggug

SEQ ID NO: 3399969 - RNA, 16 nt, Pseudomonas aeruginosa PA01
gcgucgcggccucuuc

SEQ ID NO: 3399970 - RNA, 16 nt, Pseudomonas aeruginosa PA01
gcgucgcugccgccgc

SEQ ID NO: 3399971 - RNA, 18 nt, Pseudomonas aeruginosa PA01
gcgucgcugccgccgcgc

SEQ ID NO: 3399972 - RNA, 15 nt, Pseudomonas aeruginosa PA01
gcgucgcugcgcaac

SEQ ID NO: 3399973 - RNA, 21 nt, Pseudomonas aeruginosa PA01
gcgucgcugcgcaacugccgg

SEQ ID NO: 3399974 - RNA, 13 nt, Pseudomonas aeruginosa PA01
gcgucgcuguagc

SEQ ID NO: 3399975 - RNA, 23 nt, Pseudomonas aeruginosa PA01
gcgucggaagcgucagccgcggc

SEQ ID NO: 3399976 - RNA, 15 nt, Pseudomonas aeruginosa PA01
gcgucggcacgccga

SEQ ID NO: 3399977 - RNA, 16 nt, Pseudomonas aeruginosa PA01
gcgucggcacgccgaa

SEQ ID NO: 3399978 - RNA, 22 nt, Pseudomonas aeruginosa PA01
gcgucggcccuugugaaagggc

SEQ ID NO: 3399979 - RNA, 16 nt, Pseudomonas aeruginosa PA01
gcgucggccuggcgca

SEQ ID NO: 3399980 - RNA, 18 nt, Pseudomonas aeruginosa PA01
gcgucggccuggcgcagc

SEQ ID NO: 3399981 - RNA, 22 nt, Pseudomonas aeruginosa PA01
gcgucggccuggcgcagcggca

SEQ ID NO: 3399982 - RNA, 23 nt, Pseudomonas aeruginosa PA01
gcgucggccuggcgcagcggcag

SEQ ID NO: 3399983 - RNA, 13 nt, Pseudomonas aeruginosa PA01
gcgucggcgaacc

SEQ ID NO: 3399984 - RNA, 19 nt, Pseudomonas aeruginosa PA01
gcgucggcgaacccggcgc

SEQ ID NO: 3399985 - RNA, 19 nt, Pseudomonas aeruginosa PA01
gcgucggcgaagccugcgg

SEQ ID NO: 3399986 - RNA, 15 nt, Pseudomonas aeruginosa PA01
gcgucggcgagcagg

SEQ ID NO: 3399987 - RNA, 13 nt, Pseudomonas aeruginosa PA01
gcgucggcgauca

SEQ ID NO: 3399988 - RNA, 19 nt, Pseudomonas aeruginosa PA01
gcgucggcgcuuugcugca

SEQ ID NO: 3399989 - RNA, 24 nt, Pseudomonas aeruginosa PA01
gcgucggcgcuuugcugcacgcug

SEQ ID NO: 3399990 - RNA, 21 nt, Pseudomonas aeruginosa PA01
gcgucggcggcacccucuucc

SEQ ID NO: 3399991 - RNA, 17 nt, Pseudomonas aeruginosa PA01
gcgucggcgucggcugc

SEQ ID NO: 3399992 - RNA, 18 nt, Pseudomonas aeruginosa PA01
gcgucggcgucggcugcg

SEQ ID NO: 3399993 - RNA, 20 nt, Pseudomonas aeruginosa PA01
gcgucggcgucggcugcgcu

SEQ ID NO: 3399994 - RNA, 15 nt, Pseudomonas aeruginosa PA01
gcgucggcugcgcug

SEQ ID NO: 3399995 - RNA, 16 nt, Pseudomonas aeruginosa PA01
gcgucggcugcgcugg

SEQ ID NO: 3399996 - RNA, 17 nt, Pseudomonas aeruginosa PA01
gcgucggcugcgcuggg

SEQ ID NO: 3399997 - RNA, 23 nt, Pseudomonas aeruginosa PA01
gcgucggcugcgcugggcgccga

SEQ ID NO: 3399998 - RNA, 15 nt, Pseudomonas aeruginosa PA01
gcgucggcuggucga

SEQ ID NO: 3399999 - RNA, 14 nt, Pseudomonas aeruginosa PA01
gcgucgggcagggc

SEQ ID NO: 3400000 - RNA, 16 nt, Pseudomonas aeruginosa PA01
gcgucgggcagggcau

SEQ ID NO: 3400001 - RNA, 20 nt, Pseudomonas aeruginosa PA01
gcgucgggcgaaacggcagg

SEQ ID NO: 3400002 - RNA, 23 nt, Pseudomonas aeruginosa PA01
gcgucgggcgggaucaggucgcc

SEQ ID NO: 3400003 - RNA, 22 nt, Pseudomonas aeruginosa PA01
gcgucgggcuucuucaccaggc

SEQ ID NO: 3400004 - RNA, 20 nt, Pseudomonas aeruginosa PA01
gcgucggucaggacagcgug

SEQ ID NO: 3400005 - RNA, 22 nt, Pseudomonas aeruginosa PA01
gcgucggucaggacagcgugcg

SEQ ID NO: 3400006 - RNA, 16 nt, Pseudomonas aeruginosa PA01
gcgucgguccagcucc

SEQ ID NO: 3400007 - RNA, 14 nt, Pseudomonas aeruginosa PA01
gcgucggugccgcc

SEQ ID NO: 3400008 - RNA, 18 nt, Pseudomonas aeruginosa PA01
gcgucggugccgcccggc

SEQ ID NO: 3400009 - RNA, 23 nt, Pseudomonas aeruginosa PA01
gcgucguagagcgugcggccgau

SEQ ID NO: 3400010 - RNA, 20 nt, Pseudomonas aeruginosa PA01
gcgucguagagguugccgug

SEQ ID NO: 3400011 - RNA, 18 nt, Pseudomonas aeruginosa PA01
gcgucguaguggcgcaac

SEQ ID NO: 3400012 - RNA, 17 nt, Pseudomonas aeruginosa PA01
gcgucguccagggcgcu

SEQ ID NO: 3400013 - RNA, 13 nt, Pseudomonas aeruginosa PA01
gcgucguccucga

SEQ ID NO: 3400014 - RNA, 16 nt, Pseudomonas aeruginosa PA01
gcgucguccugcgcgg

SEQ ID NO: 3400015 - RNA, 17 nt, Pseudomonas aeruginosa PA01
gcgucguccugcgcggc

SEQ ID NO: 3400016 - RNA, 18 nt, Pseudomonas aeruginosa PA01
gcgucguccugcgcggcg

SEQ ID NO: 3400017 - RNA, 19 nt, Pseudomonas aeruginosa PA01
gcgucguccugcgcggcga

SEQ ID NO: 3400018 - RNA, 22 nt, Pseudomonas aeruginosa PA01
gcgucguccugcgcggcgacga

SEQ ID NO: 3400019 - RNA, 17 nt, Pseudomonas aeruginosa PA01
gcgucgucgaggcuguc

SEQ ID NO: 3400020 - RNA, 20 nt, Pseudomonas aeruginosa PA01
gcgucgucgcggcgccuggc

SEQ ID NO: 3400021 - RNA, 14 nt, Pseudomonas aeruginosa PA01
gcgucgucgcugcg

SEQ ID NO: 3400022 - RNA, 18 nt, Pseudomonas aeruginosa PA01
gcgucgucggggugccgc

SEQ ID NO: 3400023 - RNA, 14 nt, Pseudomonas aeruginosa PA01
gcgucgugcgccgg

SEQ ID NO: 3400024 - RNA, 15 nt, Pseudomonas aeruginosa PA01
gcgucgugcgccggc

SEQ ID NO: 3400025 - RNA, 16 nt, Pseudomonas aeruginosa PA01
gcgucgugcgccggcc

SEQ ID NO: 3400026 - RNA, 20 nt, Pseudomonas aeruginosa PA01
gcgucguuggccggcugcuc

SEQ ID NO: 3400027 - RNA, 22 nt, Pseudomonas aeruginosa PA01
gcgucguuggccggcugcuccg

SEQ ID NO: 3400028 - RNA, 18 nt, Pseudomonas aeruginosa PA01
gcgucguuguugcgggcg

SEQ ID NO: 3400029 - RNA, 19 nt, Pseudomonas aeruginosa PA01
gcgucucagcccucggccc

SEQ ID NO: 3400030 - RNA, 21 nt, Pseudomonas aeruginosa PA01
gcgucucauggaacagcagcc

SEQ ID NO: 3400031 - RNA, 23 nt, Pseudomonas aeruginosa PA01
gcgucucauggaacagcagccag

SEQ ID NO: 3400032 - RNA, 13 nt, Pseudomonas aeruginosa PA01
gcgucuccugccg

SEQ ID NO: 3400033 - RNA, 17 nt, Pseudomonas aeruginosa PA01
gcgucuccugccgccga

SEQ ID NO: 3400034 - RNA, 17 nt, Pseudomonas aeruginosa PA01
gcgucucggagugaggc

SEQ ID NO: 3400035 - RNA, 18 nt, Pseudomonas aeruginosa PA01
gcgucucggagugaggcc

SEQ ID NO: 3400036 - RNA, 13 nt, Pseudomonas aeruginosa PA01
gcgucucggcugc

SEQ ID NO: 3400037 - RNA, 21 nt, Pseudomonas aeruginosa PA01
gcgucucggcugccgccagcu

SEQ ID NO: 3400038 - RNA, 22 nt, Pseudomonas aeruginosa PA01
gcgucugaacgaagaagccggc

SEQ ID NO: 3400039 - RNA, 16 nt, Pseudomonas aeruginosa PA01
gcgucugccgcuggcg

SEQ ID NO: 3400040 - RNA, 20 nt, Pseudomonas aeruginosa PA01
gcgucugcucauucggccag

SEQ ID NO: 3400041 - RNA, 20 nt, Pseudomonas aeruginosa PA01
gcgucugggacggcagccug

SEQ ID NO: 3400042 - RNA, 16 nt, Pseudomonas aeruginosa PA01
gcguggcuuggcccug

SEQ ID NO: 3400043 - RNA, 17 nt, Pseudomonas aeruginosa PA01
gcguggcuuggcccugc

SEQ ID NO: 3400044 - RNA, 18 nt, Pseudomonas aeruginosa PA01
gcguggcuuggcccugcg

SEQ ID NO: 3400045 - RNA, 16 nt, Pseudomonas aeruginosa PA01
gcgugggccaccauca

SEQ ID NO: 3400046 - RNA, 22 nt, Pseudomonas aeruginosa PA01
gcgugggccaccaucagguaga

SEQ ID NO: 3400047 - RNA, 15 nt, Pseudomonas aeruginosa PA01
gcgugggccagccca

SEQ ID NO: 3400048 - RNA, 17 nt, Pseudomonas aeruginosa PA01
gcgugggccagcccaga

SEQ ID NO: 3400049 - RNA, 18 nt, Pseudomonas aeruginosa PA01
gcgugggccagcccagaa

SEQ ID NO: 3400050 - RNA, 23 nt, Pseudomonas aeruginosa PA01
gcgugggccagcccagaacagca

SEQ ID NO: 3400051 - RNA, 13 nt, Pseudomonas aeruginosa PA01
gcgugggccaggg

SEQ ID NO: 3400052 - RNA, 15 nt, Pseudomonas aeruginosa PA01
gcgugggccagggau

SEQ ID NO: 3400053 - RNA, 12 nt, Pseudomonas aeruginosa PA01
gcgugggccggc

SEQ ID NO: 3400054 - RNA, 14 nt, Pseudomonas aeruginosa PA01
gcgugggcgccggc

SEQ ID NO: 3400055 - RNA, 15 nt, Pseudomonas aeruginosa PA01
gcgugggcgccggcg

SEQ ID NO: 3400056 - RNA, 13 nt, Pseudomonas aeruginosa PA01
gcgugggcggccg

SEQ ID NO: 3400057 - RNA, 14 nt, Pseudomonas aeruginosa PA01
gcgugggcggccgg

SEQ ID NO: 3400058 - RNA, 17 nt, Pseudomonas aeruginosa PA01
gcgugggcggccggcca

SEQ ID NO: 3400059 - RNA, 18 nt, Pseudomonas aeruginosa PA01
gcgugggcggccggccag

SEQ ID NO: 3400060 - RNA, 18 nt, Pseudomonas aeruginosa PA01
gcgugggcggucggcgag

SEQ ID NO: 3400061 - RNA, 21 nt, Pseudomonas aeruginosa PA01
gcgugggcggucggcgagggc

SEQ ID NO: 3400062 - RNA, 16 nt, Pseudomonas aeruginosa PA01
gcgugggcuucgccgc

SEQ ID NO: 3400063 - RNA, 18 nt, Pseudomonas aeruginosa PA01
gcgugggguagccgagaa

SEQ ID NO: 3400064 - RNA, 16 nt, Pseudomonas aeruginosa PA01
gcguggguagccgccc

SEQ ID NO: 3400065 - RNA, 23 nt, Pseudomonas aeruginosa PA01
gcguggguagccgcccaccgcgg

SEQ ID NO: 3400066 - RNA, 14 nt, Pseudomonas aeruginosa PA01
gcguggguccacgc

SEQ ID NO: 3400067 - RNA, 20 nt, Pseudomonas aeruginosa PA01
gcguggguccacgccgggca

SEQ ID NO: 3400068 - RNA, 17 nt, Pseudomonas aeruginosa PA01
gcguggucggcggccuc

SEQ ID NO: 3400069 - RNA, 19 nt, Pseudomonas aeruginosa PA01
gcguggucggcggccucgg

SEQ ID NO: 3400070 - RNA, 21 nt, Pseudomonas aeruginosa PA01
gcguggucuccgugcuggccg

SEQ ID NO: 3400071 - RNA, 13 nt, Pseudomonas aeruginosa PA01
gcguggucugccc

SEQ ID NO: 3400072 - RNA, 15 nt, Pseudomonas aeruginosa PA01
gcguggugcauccgc

SEQ ID NO: 3400073 - RNA, 16 nt, Pseudomonas aeruginosa PA01
gcguggugcauccgcc

SEQ ID NO: 3400074 - RNA, 20 nt, Pseudomonas aeruginosa PA01
gcguggugcauccgccgcag

SEQ ID NO: 3400075 - RNA, 16 nt, Pseudomonas aeruginosa PA01
gcguggugcugcaugu

SEQ ID NO: 3400076 - RNA, 22 nt, Pseudomonas aeruginosa PA01
gcgugguggcggggaacagcau

SEQ ID NO: 3400077 - RNA, 13 nt, Pseudomonas aeruginosa PA01
gcguguccagggu

SEQ ID NO: 3400078 - RNA, 19 nt, Pseudomonas aeruginosa PA01
gcgugucgaggaaggccag

SEQ ID NO: 3400079 - RNA, 20 nt, Pseudomonas aeruginosa PA01
gcgugucgaggaaggccagc

SEQ ID NO: 3400080 - RNA, 22 nt, Pseudomonas aeruginosa PA01
gcguguggcgaaacuccagcag

SEQ ID NO: 3400081 - RNA, 19 nt, Pseudomonas aeruginosa PA01
gcguguucauagaaacgca

SEQ ID NO: 3400082 - RNA, 23 nt, Pseudomonas aeruginosa PA01
gcguguucauagaaacgcagggc

SEQ ID NO: 3400083 - RNA, 15 nt, Pseudomonas aeruginosa PA01
gcguguucccuguac

SEQ ID NO: 3400084 - RNA, 15 nt, Pseudomonas aeruginosa PA01
gcguguucggcggcu

SEQ ID NO: 3400085 - RNA, 14 nt, Pseudomonas aeruginosa PA01
gcguguucgucgau

SEQ ID NO: 3400086 - RNA, 21 nt, Pseudomonas aeruginosa PA01
gcguguugcgccgcaccacgu

SEQ ID NO: 3400087 - RNA, 18 nt, Pseudomonas aeruginosa PA01
gcguuaccguccgcgccg

SEQ ID NO: 3400088 - RNA, 21 nt, Pseudomonas aeruginosa PA01
gcguuaccguccgcgccgcgc

SEQ ID NO: 3400089 - RNA, 19 nt, Pseudomonas aeruginosa PA01
gcguuauccgccccacccc

SEQ ID NO: 3400090 - RNA, 23 nt, Pseudomonas aeruginosa PA01
gcguuauccgccccaccccaggg

SEQ ID NO: 3400091 - RNA, 15 nt, Pseudomonas aeruginosa PA01
gcguuauccgccgau

SEQ ID NO: 3400092 - RNA, 18 nt, Pseudomonas aeruginosa PA01
gcguuauccgccgauacc

SEQ ID NO: 3400093 - RNA, 17 nt, Pseudomonas aeruginosa PA01
gcguuauccgccgccga

SEQ ID NO: 3400094 - RNA, 19 nt, Pseudomonas aeruginosa PA01
gcguuauccgccgcucacc

SEQ ID NO: 3400095 - RNA, 13 nt, Pseudomonas aeruginosa PA01
gcguuaugcgccc

SEQ ID NO: 3400096 - RNA, 18 nt, Pseudomonas aeruginosa PA01
gcguuaugcgcccuaccu

SEQ ID NO: 3400097 - RNA, 12 nt, Pseudomonas aeruginosa PA01
gcguuauucgcc

SEQ ID NO: 3400098 - RNA, 19 nt, Pseudomonas aeruginosa PA01
gcguuauucgcccuacagc

SEQ ID NO: 3400099 - RNA, 23 nt, Pseudomonas aeruginosa PA01
gcguuauucgcccuaccccaggg

SEQ ID NO: 3400100 - RNA, 18 nt, Pseudomonas aeruginosa PA01
gcguuauucgcccuacgc

SEQ ID NO: 3400101 - RNA, 14 nt, Pseudomonas aeruginosa PA01
gcguucaccgcgca

SEQ ID NO: 3400102 - RNA, 18 nt, Pseudomonas aeruginosa PA01
gcguucaccguggcgcug

SEQ ID NO: 3400103 - RNA, 20 nt, Pseudomonas aeruginosa PA01
gcguucaccguggcgcuggc

SEQ ID NO: 3400104 - RNA, 15 nt, Pseudomonas aeruginosa PA01
gcguucacgcgacca

SEQ ID NO: 3400105 - RNA, 20 nt, Pseudomonas aeruginosa PA01
gcguucagccacggacgcgc

SEQ ID NO: 3400106 - RNA, 19 nt, Pseudomonas aeruginosa PA01
gcguucagucccgcggcgc

SEQ ID NO: 3400107 - RNA, 19 nt, Pseudomonas aeruginosa PA01
gcguucaucgucggcagcc

SEQ ID NO: 3400108 - RNA, 21 nt, Pseudomonas aeruginosa PA01
gcguucaucgucggcagccau

SEQ ID NO: 3400109 - RNA, 17 nt, Pseudomonas aeruginosa PA01
gcguuccaccaggcguc

SEQ ID NO: 3400110 - RNA, 22 nt, Pseudomonas aeruginosa PA01
gcguuccacgaaaaagcccggc

SEQ ID NO: 3400111 - RNA, 19 nt, Pseudomonas aeruginosa PA01
gcguuccagcaacggcuug

SEQ ID NO: 3400112 - RNA, 21 nt, Pseudomonas aeruginosa PA01
gcguuccagcaccucgcggga

SEQ ID NO: 3400113 - RNA, 13 nt, Pseudomonas aeruginosa PA01
gcguuccagcgcu

SEQ ID NO: 3400114 - RNA, 15 nt, Pseudomonas aeruginosa PA01
gcguuccagcucggc

SEQ ID NO: 3400115 - RNA, 17 nt, Pseudomonas aeruginosa PA01
gcguuccaggcggcgga

SEQ ID NO: 3400116 - RNA, 19 nt, Pseudomonas aeruginosa PA01
gcguuccaggucgcugcug

SEQ ID NO: 3400117 - RNA, 21 nt, Pseudomonas aeruginosa PA01
gcguuccaugaacucuucccc

SEQ ID NO: 3400118 - RNA, 20 nt, Pseudomonas aeruginosa PA01
gcguucccacucgcgacugc

SEQ ID NO: 3400119 - RNA, 18 nt, Pseudomonas aeruginosa PA01
gcguucccccuuuuucgg

SEQ ID NO: 3400120 - RNA, 17 nt, Pseudomonas aeruginosa PA01
gcguuccgggcagcggc

SEQ ID NO: 3400121 - RNA, 20 nt, Pseudomonas aeruginosa PA01
gcguuccgggcagcggcgca

SEQ ID NO: 3400122 - RNA, 21 nt, Pseudomonas aeruginosa PA01
gcguuccgggcagcggcgcaa

SEQ ID NO: 3400123 - RNA, 19 nt, Pseudomonas aeruginosa PA01
gcguuccgggucgcugccc

SEQ ID NO: 3400124 - RNA, 23 nt, Pseudomonas aeruginosa PA01
gcguuccuggaagccgaucggca

SEQ ID NO: 3400125 - RNA, 16 nt, Pseudomonas aeruginosa PA01
gcguuccuggcgcgcg

SEQ ID NO: 3400126 - RNA, 20 nt, Pseudomonas aeruginosa PA01
gcguuccuggcgcgcggccg

SEQ ID NO: 3400127 - RNA, 14 nt, Pseudomonas aeruginosa PA01
gcguuccuguccau

SEQ ID NO: 3400128 - RNA, 18 nt, Pseudomonas aeruginosa PA01
gcguuccuguucgcugcc

SEQ ID NO: 3400129 - RNA, 20 nt, Pseudomonas aeruginosa PA01
gcguuccuucaacagcgaag

SEQ ID NO: 3400130 - RNA, 22 nt, Pseudomonas aeruginosa PA01
gcguucgaagucauaggucacg

SEQ ID NO: 3400131 - RNA, 18 nt, Pseudomonas aeruginosa PA01
gcguucgacgccuugccc

SEQ ID NO: 3400132 - RNA, 21 nt, Pseudomonas aeruginosa PA01
gcguucgacgccuugcccggc

SEQ ID NO: 3400133 - RNA, 23 nt, Pseudomonas aeruginosa PA01
gcguucgaggguacuccuggcau

SEQ ID NO: 3400134 - RNA, 24 nt, Pseudomonas aeruginosa PA01
gcguucgaucuccucgcgcagcgg

SEQ ID NO: 3400135 - RNA, 15 nt, Pseudomonas aeruginosa PA01
gcguucgcccugcgg

SEQ ID NO: 3400136 - RNA, 12 nt, Pseudomonas aeruginosa PA01
gcguucgccgcg

SEQ ID NO: 3400137 - RNA, 13 nt, Pseudomonas aeruginosa PA01
gcguucgccgggu

SEQ ID NO: 3400138 - RNA, 17 nt, Pseudomonas aeruginosa PA01
gcguucgccggguuuuu

SEQ ID NO: 3400139 - RNA, 16 nt, Pseudomonas aeruginosa PA01
gcguucgcgggcgccg

SEQ ID NO: 3400140 - RNA, 19 nt, Pseudomonas aeruginosa PA01
gcguucggaucggcccggc

SEQ ID NO: 3400141 - RNA, 21 nt, Pseudomonas aeruginosa PA01
gcguucggcgaugccgcgcca

SEQ ID NO: 3400142 - RNA, 20 nt, Pseudomonas aeruginosa PA01
gcguucggcgaugucgcggg

SEQ ID NO: 3400143 - RNA, 22 nt, Pseudomonas aeruginosa PA01
gcguucggcgaugucgcgggca

SEQ ID NO: 3400144 - RNA, 13 nt, Pseudomonas aeruginosa PA01
gcuaucgccgccg

SEQ ID NO: 3400145 - RNA, 24 nt, Pseudomonas aeruginosa PA01
gcuaucgccgccgcagccguggcg

SEQ ID NO: 3400146 - RNA, 14 nt, Pseudomonas aeruginosa PA01
gcuaucgcuggcgc

SEQ ID NO: 3400147 - RNA, 20 nt, Pseudomonas aeruginosa PA01
gcuaucgcuggcgcagccgc

SEQ ID NO: 3400148 - RNA, 21 nt, Pseudomonas aeruginosa PA01
gcuaucgcuggcgcagccgcu

SEQ ID NO: 3400149 - RNA, 15 nt, Pseudomonas aeruginosa PA01
gcuaucgcuuucagc

SEQ ID NO: 3400150 - RNA, 18 nt, Pseudomonas aeruginosa PA01
gcuaucggcccggggcuc

SEQ ID NO: 3400151 - RNA, 23 nt, Pseudomonas aeruginosa PA01
gcuaucgggcagggcagccgccg

SEQ ID NO: 3400152 - RNA, 21 nt, Pseudomonas aeruginosa PA01
gcuaugcaaaagugcccccgg

SEQ ID NO: 3400153 - RNA, 15 nt, Pseudomonas aeruginosa PA01
gcuaugcgccgggcc

SEQ ID NO: 3400154 - RNA, 16 nt, Pseudomonas aeruginosa PA01
gcuaugcgccguuacg

SEQ ID NO: 3400155 - RNA, 16 nt, Pseudomonas aeruginosa PA01
gcuaugggcaccgcgc

SEQ ID NO: 3400156 - RNA, 18 nt, Pseudomonas aeruginosa PA01
gcuaugggcaccgcgccg

SEQ ID NO: 3400157 - RNA, 17 nt, Pseudomonas aeruginosa PA01
gcuauguauucggcggu

SEQ ID NO: 3400158 - RNA, 20 nt, Pseudomonas aeruginosa PA01
gcuauucugauugcguaacg

SEQ ID NO: 3400159 - RNA, 22 nt, Pseudomonas aeruginosa PA01
gcucaaaccuguucggcagggg

SEQ ID NO: 3400160 - RNA, 18 nt, Pseudomonas aeruginosa PA01
gcucaaccgaacaggcga

SEQ ID NO: 3400161 - RNA, 19 nt, Pseudomonas aeruginosa PA01
gcucaaccgaacaggcgac

SEQ ID NO: 3400162 - RNA, 18 nt, Pseudomonas aeruginosa PA01
gcucaacgccucgcggcu

SEQ ID NO: 3400163 - RNA, 15 nt, Pseudomonas aeruginosa PA01
gcucaacggcgugcc

SEQ ID NO: 3400164 - RNA, 20 nt, Pseudomonas aeruginosa PA01
gcucaacggcgugccgggca

SEQ ID NO: 3400165 - RNA, 21 nt, Pseudomonas aeruginosa PA01
gcucaacgggaccguccaggu

SEQ ID NO: 3400166 - RNA, 20 nt, Pseudomonas aeruginosa PA01
gcucaacugguuggccgccu

SEQ ID NO: 3400167 - RNA, 22 nt, Pseudomonas aeruginosa PA01
gcucaacugguuggccgccugg

SEQ ID NO: 3400168 - RNA, 14 nt, Pseudomonas aeruginosa PA01
gcucaagggcuggc

SEQ ID NO: 3400169 - RNA, 16 nt, Pseudomonas aeruginosa PA01
gcucaagggcuggcag

SEQ ID NO: 3400170 - RNA, 15 nt, Pseudomonas aeruginosa PA01
gcucaauccggcugg

SEQ ID NO: 3400171 - RNA, 19 nt, Pseudomonas aeruginosa PA01
gcucacauuaauugcgagc

SEQ ID NO: 3400172 - RNA, 15 nt, Pseudomonas aeruginosa PA01
gcucaccaccaccgc

SEQ ID NO: 3400173 - RNA, 13 nt, Pseudomonas aeruginosa PA01
gcucaccagguga

SEQ ID NO: 3400174 - RNA, 19 nt, Pseudomonas aeruginosa PA01
gcucacccacauggcgguc

SEQ ID NO: 3400175 - RNA, 20 nt, Pseudomonas aeruginosa PA01
gcucacccacauggcggucc

SEQ ID NO: 3400176 - RNA, 22 nt, Pseudomonas aeruginosa PA01
gcucacccacauggcgguccag

SEQ ID NO: 3400177 - RNA, 23 nt, Pseudomonas aeruginosa PA01
gcucaccgagaaccaguacuuga

SEQ ID NO: 3400178 - RNA, 15 nt, Pseudomonas aeruginosa PA01
gcucaccgcgcuuga

SEQ ID NO: 3400179 - RNA, 17 nt, Pseudomonas aeruginosa PA01
gcucaccgguagagggg

SEQ ID NO: 3400180 - RNA, 19 nt, Pseudomonas aeruginosa PA01
gcucaccggucgagaggga

SEQ ID NO: 3400181 - RNA, 20 nt, Pseudomonas aeruginosa PA01
gcucacgcaccucgucgagc

SEQ ID NO: 3400182 - RNA, 16 nt, Pseudomonas aeruginosa PA01
gcucacgcaucccuuc

SEQ ID NO: 3400183 - RNA, 14 nt, Pseudomonas aeruginosa PA01
gcucacgccccagc

SEQ ID NO: 3400184 - RNA, 16 nt, Pseudomonas aeruginosa PA01
gcucacgcguucggcg

SEQ ID NO: 3400185 - RNA, 23 nt, Pseudomonas aeruginosa PA01
gcucacgcucgacauugcugccg

SEQ ID NO: 3400186 - RNA, 15 nt, Pseudomonas aeruginosa PA01
gcucacggccgaaca

SEQ ID NO: 3400187 - RNA, 17 nt, Pseudomonas aeruginosa PA01
gcucacguagcccccgc

SEQ ID NO: 3400188 - RNA, 21 nt, Pseudomonas aeruginosa PA01
gcucacguagcccccgccgcu

SEQ ID NO: 3400189 - RNA, 23 nt, Pseudomonas aeruginosa PA01
gcucacguagcccccgccgcuga

SEQ ID NO: 3400190 - RNA, 17 nt, Pseudomonas aeruginosa PA01
gcucacucccguccagc

SEQ ID NO: 3400191 - RNA, 20 nt, Pseudomonas aeruginosa PA01
gcucacucccguccagcgcu

SEQ ID NO: 3400192 - RNA, 13 nt, Pseudomonas aeruginosa PA01
gcucacugcgagc

SEQ ID NO: 3400193 - RNA, 22 nt, Pseudomonas aeruginosa PA01
gcucacugcgagcaccaugccg

SEQ ID NO: 3400194 - RNA, 16 nt, Pseudomonas aeruginosa PA01
gcucagaaauccaccu

SEQ ID NO: 3400195 - RNA, 21 nt, Pseudomonas aeruginosa PA01
gcucagaaauccaccuugccg

SEQ ID NO: 3400196 - RNA, 18 nt, Pseudomonas aeruginosa PA01
gcucagaacagcggcagc

SEQ ID NO: 3400197 - RNA, 18 nt, Pseudomonas aeruginosa PA01
gcucagaagucccagcga

SEQ ID NO: 3400198 - RNA, 17 nt, Pseudomonas aeruginosa PA01
gcucagcacccuggcca

SEQ ID NO: 3400199 - RNA, 19 nt, Pseudomonas aeruginosa PA01
gcucagcacccuggccacg

SEQ ID NO: 3400200 - RNA, 22 nt, Pseudomonas aeruginosa PA01
gcucagcaccuugugcugccug

SEQ ID NO: 3400201 - RNA, 23 nt, Pseudomonas aeruginosa PA01
gcucagcaccuugugcugccugc

SEQ ID NO: 3400202 - RNA, 18 nt, Pseudomonas aeruginosa PA01
gcucagcacggcgacggu

SEQ ID NO: 3400203 - RNA, 14 nt, Pseudomonas aeruginosa PA01
gcucagcaggucgc

SEQ ID NO: 3400204 - RNA, 15 nt, Pseudomonas aeruginosa PA01
gcucagcccaggcgc

SEQ ID NO: 3400205 - RNA, 17 nt, Pseudomonas aeruginosa PA01
gcucagcccaggcgccg

SEQ ID NO: 3400206 - RNA, 19 nt, Pseudomonas aeruginosa PA01
gcucagcccaggcgccgcu

SEQ ID NO: 3400207 - RNA, 20 nt, Pseudomonas aeruginosa PA01
gcucagcccaggcgccgcuc

SEQ ID NO: 3400208 - RNA, 13 nt, Pseudomonas aeruginosa PA01
gcucagccgacca

SEQ ID NO: 3400209 - RNA, 24 nt, Pseudomonas aeruginosa PA01
gcucagccgaccaccuucaggcug

SEQ ID NO: 3400210 - RNA, 20 nt, Pseudomonas aeruginosa PA01
gcucagccgaggucgccgcc

SEQ ID NO: 3400211 - RNA, 16 nt, Pseudomonas aeruginosa PA01
gcucagccgcuggcgu

SEQ ID NO: 3400212 - RNA, 17 nt, Pseudomonas aeruginosa PA01
gcucagccgcuggcguc

SEQ ID NO: 3400213 - RNA, 19 nt, Pseudomonas aeruginosa PA01
gcucagccgcuggcgucga

SEQ ID NO: 3400214 - RNA, 15 nt, Pseudomonas aeruginosa PA01
gcucagccguggcac

SEQ ID NO: 3400215 - RNA, 24 nt, Pseudomonas aeruginosa PA01
gcucagccguggcacccaggccac

SEQ ID NO: 3400216 - RNA, 13 nt, Pseudomonas aeruginosa PA01
gcucagcgcaugc

SEQ ID NO: 3400217 - RNA, 12 nt, Pseudomonas aeruginosa PA01
gcucagcgccgc

SEQ ID NO: 3400218 - RNA, 13 nt, Pseudomonas aeruginosa PA01
gcucagcgccgcu

SEQ ID NO: 3400219 - RNA, 13 nt, Pseudomonas aeruginosa PA01
gcucagcgccggc

SEQ ID NO: 3400220 - RNA, 14 nt, Pseudomonas aeruginosa PA01
gcucagcgccggcc

SEQ ID NO: 3400221 - RNA, 15 nt, Pseudomonas aeruginosa PA01
gcucagcgccggcca

SEQ ID NO: 3400222 - RNA, 17 nt, Pseudomonas aeruginosa PA01
gcucagcgccggccagg

SEQ ID NO: 3400223 - RNA, 14 nt, Pseudomonas aeruginosa PA01
gcucagcgcgccga

SEQ ID NO: 3400224 - RNA, 13 nt, Pseudomonas aeruginosa PA01
gcucagcgcgcuc

SEQ ID NO: 3400225 - RNA, 18 nt, Pseudomonas aeruginosa PA01
gcucagcgcggcggcggc

SEQ ID NO: 3400226 - RNA, 16 nt, Pseudomonas aeruginosa PA01
gcucagcgcuucucgg

SEQ ID NO: 3400227 - RNA, 17 nt, Pseudomonas aeruginosa PA01
gcucagcggcccagcgc

SEQ ID NO: 3400228 - RNA, 19 nt, Pseudomonas aeruginosa PA01
gcucagcggcccagcgccc

SEQ ID NO: 3400229 - RNA, 20 nt, Pseudomonas aeruginosa PA01
gcucagcggcccagcgcccc

SEQ ID NO: 3400230 - RNA, 22 nt, Pseudomonas aeruginosa PA01
gcucagcggcccagcgccccgc

SEQ ID NO: 3400231 - RNA, 14 nt, Pseudomonas aeruginosa PA01
gcucagcgggccga

SEQ ID NO: 3400232 - RNA, 17 nt, Pseudomonas aeruginosa PA01
gcucagcguccucagcc

SEQ ID NO: 3400233 - RNA, 20 nt, Pseudomonas aeruginosa PA01
gcucagcguccucagccuca

SEQ ID NO: 3400234 - RNA, 16 nt, Pseudomonas aeruginosa PA01
gcucagcuccaggccg

SEQ ID NO: 3400235 - RNA, 17 nt, Pseudomonas aeruginosa PA01
gcucagcuccaggccgc

SEQ ID NO: 3400236 - RNA, 18 nt, Pseudomonas aeruginosa PA01
gcucagcuccaggccgcg

SEQ ID NO: 3400237 - RNA, 20 nt, Pseudomonas aeruginosa PA01
gcucagcucggcgaugccgc

SEQ ID NO: 3400238 - RNA, 18 nt, Pseudomonas aeruginosa PA01
gcucagcucucccgaggc

SEQ ID NO: 3400239 - RNA, 21 nt, Pseudomonas aeruginosa PA01
gcucagcucucccgaggcgau

SEQ ID NO: 3400240 - RNA, 16 nt, Pseudomonas aeruginosa PA01
gcucagcuggauagag

SEQ ID NO: 3400241 - RNA, 19 nt, Pseudomonas aeruginosa PA01
gcucaggacguccuggccg

SEQ ID NO: 3400242 - RNA, 14 nt, Pseudomonas aeruginosa PA01
gcucaggcagcgau

SEQ ID NO: 3400243 - RNA, 21 nt, Pseudomonas aeruginosa PA01
gcucaggcagcgaucgccgcc

SEQ ID NO: 3400244 - RNA, 22 nt, Pseudomonas aeruginosa PA01
gcucaggcagcgaucgccgcca

SEQ ID NO: 3400245 - RNA, 14 nt, Pseudomonas aeruginosa PA01
gcucaggccaagca

SEQ ID NO: 3400246 - RNA, 19 nt, Pseudomonas aeruginosa PA01
gcuccagcgggaaggucgg

SEQ ID NO: 3400247 - RNA, 20 nt, Pseudomonas aeruginosa PA01
gcuccagcgggaaggucggc

SEQ ID NO: 3400248 - RNA, 23 nt, Pseudomonas aeruginosa PA01
gcuccagcgggaaggucggcagc

SEQ ID NO: 3400249 - RNA, 18 nt, Pseudomonas aeruginosa PA01
gcuccagcgugcccgcug

SEQ ID NO: 3400250 - RNA, 19 nt, Pseudomonas aeruginosa PA01
gcuccagcuccuccagcag

SEQ ID NO: 3400251 - RNA, 17 nt, Pseudomonas aeruginosa PA01
gcuccagcuugucgucg

SEQ ID NO: 3400252 - RNA, 22 nt, Pseudomonas aeruginosa PA01
gcuccagcuugucgucggccuu

SEQ ID NO: 3400253 - RNA, 16 nt, Pseudomonas aeruginosa PA01
gcuccaggaucgccuc

SEQ ID NO: 3400254 - RNA, 14 nt, Pseudomonas aeruginosa PA01
gcuccaggcccggc

SEQ ID NO: 3400255 - RNA, 15 nt, Pseudomonas aeruginosa PA01
gcuccaggcccggca

SEQ ID NO: 3400256 - RNA, 14 nt, Pseudomonas aeruginosa PA01
gcuccaggcgggug

SEQ ID NO: 3400257 - RNA, 18 nt, Pseudomonas aeruginosa PA01
gcuccagggagcgcucgc

SEQ ID NO: 3400258 - RNA, 23 nt, Pseudomonas aeruginosa PA01
gcuccagggagcgcucgcgcagc

SEQ ID NO: 3400259 - RNA, 23 nt, Pseudomonas aeruginosa PA01
gcuccagggcgaauaccagugcc

SEQ ID NO: 3400260 - RNA, 13 nt, Pseudomonas aeruginosa PA01
gcuccagggcgcu

SEQ ID NO: 3400261 - RNA, 18 nt, Pseudomonas aeruginosa PA01
gcuccagggcgcugacca

SEQ ID NO: 3400262 - RNA, 20 nt, Pseudomonas aeruginosa PA01
gcuccagggcgcugaccagg

SEQ ID NO: 3400263 - RNA, 15 nt, Pseudomonas aeruginosa PA01
gcuccagggcugcca

SEQ ID NO: 3400264 - RNA, 19 nt, Pseudomonas aeruginosa PA01
gcuccagggcugccaccga

SEQ ID NO: 3400265 - RNA, 16 nt, Pseudomonas aeruginosa PA01
gcuccaggugcacggc

SEQ ID NO: 3400266 - RNA, 18 nt, Pseudomonas aeruginosa PA01
gcuccaggugcacggcca

SEQ ID NO: 3400267 - RNA, 15 nt, Pseudomonas aeruginosa PA01
gcuccagguucggcg

SEQ ID NO: 3400268 - RNA, 18 nt, Pseudomonas aeruginosa PA01
gcuccagguucggcgcca

SEQ ID NO: 3400269 - RNA, 19 nt, Pseudomonas aeruginosa PA01
gcuccagguucggcgccag

SEQ ID NO: 3400270 - RNA, 20 nt, Pseudomonas aeruginosa PA01
gcuccagguucggcgccagc

SEQ ID NO: 3400271 - RNA, 21 nt, Pseudomonas aeruginosa PA01
gcuccagguucggcgccagcu

SEQ ID NO: 3400272 - RNA, 17 nt, Pseudomonas aeruginosa PA01
gcuccagucggggcagg

SEQ ID NO: 3400273 - RNA, 18 nt, Pseudomonas aeruginosa PA01
gcuccagucggggcaggc

SEQ ID NO: 3400274 - RNA, 20 nt, Pseudomonas aeruginosa PA01
gcuccagucggggcaggcgc

SEQ ID NO: 3400275 - RNA, 21 nt, Pseudomonas aeruginosa PA01
gcuccagucggggcaggcgca

SEQ ID NO: 3400276 - RNA, 23 nt, Pseudomonas aeruginosa PA01
gcuccagucggggcaggcgcagg

SEQ ID NO: 3400277 - RNA, 21 nt, Pseudomonas aeruginosa PA01
gcuccaguucguugaccacgc

SEQ ID NO: 3400278 - RNA, 17 nt, Pseudomonas aeruginosa PA01
gcuccaguugcagcacc

SEQ ID NO: 3400279 - RNA, 23 nt, Pseudomonas aeruginosa PA01
gcuccaguugcagcacccccagc

SEQ ID NO: 3400280 - RNA, 12 nt, Pseudomonas aeruginosa PA01
gcuccauccagu

SEQ ID NO: 3400281 - RNA, 20 nt, Pseudomonas aeruginosa PA01
gcuccauccagucggcgcug

SEQ ID NO: 3400282 - RNA, 20 nt, Pseudomonas aeruginosa PA01
gcucccaccgcuuucagcgc

SEQ ID NO: 3400283 - RNA, 21 nt, Pseudomonas aeruginosa PA01
gcucccaccgcuuucagcgcc

SEQ ID NO: 3400284 - RNA, 22 nt, Pseudomonas aeruginosa PA01
gcucccaccgcuuucagcgccg

SEQ ID NO: 3400285 - RNA, 23 nt, Pseudomonas aeruginosa PA01
gcucccaccgcuuucagcgccgc

SEQ ID NO: 3400286 - RNA, 15 nt, Pseudomonas aeruginosa PA01
gcucccagccgacgu

SEQ ID NO: 3400287 - RNA, 15 nt, Pseudomonas aeruginosa PA01
gcucccaggcgucgc

SEQ ID NO: 3400288 - RNA, 17 nt, Pseudomonas aeruginosa PA01
gcucccauucgcugucg

SEQ ID NO: 3400289 - RNA, 16 nt, Pseudomonas aeruginosa PA01
gcuccccacucggcca

SEQ ID NO: 3400290 - RNA, 19 nt, Pseudomonas aeruginosa PA01
gcuccccacucggccagca

SEQ ID NO: 3400291 - RNA, 20 nt, Pseudomonas aeruginosa PA01
gcucccccacguacuccagc

SEQ ID NO: 3400292 - RNA, 23 nt, Pseudomonas aeruginosa PA01
gcucccccacguacuccagcaac

SEQ ID NO: 3400293 - RNA, 16 nt, Pseudomonas aeruginosa PA01
gcuccccgcaccugcc

SEQ ID NO: 3400294 - RNA, 12 nt, Pseudomonas aeruginosa PA01
gcuccccgccgc

SEQ ID NO: 3400295 - RNA, 16 nt, Pseudomonas aeruginosa PA01
gcuccccgccgccagg

SEQ ID NO: 3400296 - RNA, 18 nt, Pseudomonas aeruginosa PA01
gcuccccgucccucaggu

SEQ ID NO: 3400297 - RNA, 16 nt, Pseudomonas aeruginosa PA01
gcuccccugccgaacc

SEQ ID NO: 3400298 - RNA, 21 nt, Pseudomonas aeruginosa PA01
gcuccccugccgaaccgccuc

SEQ ID NO: 3400299 - RNA, 19 nt, Pseudomonas aeruginosa PA01
gcuccccuggaaugccggc

SEQ ID NO: 3400300 - RNA, 14 nt, Pseudomonas aeruginosa PA01
gcucccgcaaccug

SEQ ID NO: 3400301 - RNA, 14 nt, Pseudomonas aeruginosa PA01
gcucccgccgcucc

SEQ ID NO: 3400302 - RNA, 13 nt, Pseudomonas aeruginosa PA01
gcucccgcggccc

SEQ ID NO: 3400303 - RNA, 17 nt, Pseudomonas aeruginosa PA01
gcucccgcggcccaagg

SEQ ID NO: 3400304 - RNA, 12 nt, Pseudomonas aeruginosa PA01
gcucccuggcgg

SEQ ID NO: 3400305 - RNA, 23 nt, Pseudomonas aeruginosa PA01
gcucccuggcggauaucgcgccg

SEQ ID NO: 3400306 - RNA, 15 nt, Pseudomonas aeruginosa PA01
gcucccuugccgccg

SEQ ID NO: 3400307 - RNA, 23 nt, Pseudomonas aeruginosa PA01
gcuccgaagggaacccgcggcgc

SEQ ID NO: 3400308 - RNA, 15 nt, Pseudomonas aeruginosa PA01
gcuccgacuccugca

SEQ ID NO: 3400309 - RNA, 19 nt, Pseudomonas aeruginosa PA01
gcuccgacuccugcaacag

SEQ ID NO: 3400310 - RNA, 13 nt, Pseudomonas aeruginosa PA01
gcuccgagcaggc

SEQ ID NO: 3400311 - RNA, 23 nt, Pseudomonas aeruginosa PA01
gcuccgagcaggccuugcagggc

SEQ ID NO: 3400312 - RNA, 20 nt, Pseudomonas aeruginosa PA01
gcuccgaugaagcaggcgga

SEQ ID NO: 3400313 - RNA, 14 nt, Pseudomonas aeruginosa PA01
gcuccgccaggccg

SEQ ID NO: 3400314 - RNA, 15 nt, Pseudomonas aeruginosa PA01
gcuccgccaggccgc

SEQ ID NO: 3400315 - RNA, 16 nt, Pseudomonas aeruginosa PA01
gcuccgccaggccgcg

SEQ ID NO: 3400316 - RNA, 17 nt, Pseudomonas aeruginosa PA01
gcuccgccaggccgcgc

SEQ ID NO: 3400317 - RNA, 18 nt, Pseudomonas aeruginosa PA01
gcuccgccaggccgcgca

SEQ ID NO: 3400318 - RNA, 23 nt, Pseudomonas aeruginosa PA01
gcuccgccaggccgcgcaguccc

SEQ ID NO: 3400319 - RNA, 16 nt, Pseudomonas aeruginosa PA01
gcuccgccgaacgcca

SEQ ID NO: 3400320 - RNA, 12 nt, Pseudomonas aeruginosa PA01
gcuccgccgccg

SEQ ID NO: 3400321 - RNA, 13 nt, Pseudomonas aeruginosa PA01
gcuccgccgccgu

SEQ ID NO: 3400322 - RNA, 12 nt, Pseudomonas aeruginosa PA01
gcuccgccgcga

SEQ ID NO: 3400323 - RNA, 16 nt, Pseudomonas aeruginosa PA01
gcuccgccgcgagcga

SEQ ID NO: 3400324 - RNA, 13 nt, Pseudomonas aeruginosa PA01
gcuccgccuggcg

SEQ ID NO: 3400325 - RNA, 14 nt, Pseudomonas aeruginosa PA01
gcuccgccuggcgg

SEQ ID NO: 3400326 - RNA, 15 nt, Pseudomonas aeruginosa PA01
gcuccgccuggcgga

SEQ ID NO: 3400327 - RNA, 19 nt, Pseudomonas aeruginosa PA01
gcuccgcgauguccccggc

SEQ ID NO: 3400328 - RNA, 21 nt, Pseudomonas aeruginosa PA01
gcuccgcgauguccccggcca

SEQ ID NO: 3400329 - RNA, 22 nt, Pseudomonas aeruginosa PA01
gcuccgcgauguccccggccag

SEQ ID NO: 3400330 - RNA, 22 nt, Pseudomonas aeruginosa PA01
gcuccgcgcacggaucgcgcug

SEQ ID NO: 3400331 - RNA, 14 nt, Pseudomonas aeruginosa PA01
gcuccgcggccggc

SEQ ID NO: 3400332 - RNA, 23 nt, Pseudomonas aeruginosa PA01
gcuccgcuaagcgucacucccag

SEQ ID NO: 3400333 - RNA, 14 nt, Pseudomonas aeruginosa PA01
gcuccgcugcucag

SEQ ID NO: 3400334 - RNA, 16 nt, Pseudomonas aeruginosa PA01
gcuccggaacgccugc

SEQ ID NO: 3400335 - RNA, 22 nt, Pseudomonas aeruginosa PA01
gcuccggacucgcuaucaggca

SEQ ID NO: 3400336 - RNA, 17 nt, Pseudomonas aeruginosa PA01
gcuccggacugccgaug

SEQ ID NO: 3400337 - RNA, 13 nt, Pseudomonas aeruginosa PA01
gcuccggauggcu

SEQ ID NO: 3400338 - RNA, 15 nt, Pseudomonas aeruginosa PA01
gcuccggcagcaggg

SEQ ID NO: 3400339 - RNA, 19 nt, Pseudomonas aeruginosa PA01
gcuccggcagcagggucag

SEQ ID NO: 3400340 - RNA, 20 nt, Pseudomonas aeruginosa PA01
gcuccggcagcagggucagc

SEQ ID NO: 3400341 - RNA, 14 nt, Pseudomonas aeruginosa PA01
gcuccggcgccagg

SEQ ID NO: 3400342 - RNA, 18 nt, Pseudomonas aeruginosa PA01
gcuccggcgccaggccgg

SEQ ID NO: 3400343 - RNA, 13 nt, Pseudomonas aeruginosa PA01
gcuccggcgccga

SEQ ID NO: 3400344 - RNA, 14 nt, Pseudomonas aeruginosa PA01
gcuccggcgccgag

SEQ ID NO: 3400345 - RNA, 15 nt, Pseudomonas aeruginosa PA01
gcuccggcgccgagg

SEQ ID NO: 3400346 - RNA, 17 nt, Pseudomonas aeruginosa PA01
gcuccggcgcgccaugg

SEQ ID NO: 3400347 - RNA, 19 nt, Pseudomonas aeruginosa PA01
gcuccggcgcgccauggcg

SEQ ID NO: 3400348 - RNA, 22 nt, Pseudomonas aeruginosa PA01
gcucgaggccaggaucgucggc

SEQ ID NO: 3400349 - RNA, 13 nt, Pseudomonas aeruginosa PA01
gcucgaggccgag

SEQ ID NO: 3400350 - RNA, 15 nt, Pseudomonas aeruginosa PA01
gcucgaggccgagcc

SEQ ID NO: 3400351 - RNA, 19 nt, Pseudomonas aeruginosa PA01
gcucgaggccgagccggca

SEQ ID NO: 3400352 - RNA, 15 nt, Pseudomonas aeruginosa PA01
gcucgagggcgaccg

SEQ ID NO: 3400353 - RNA, 21 nt, Pseudomonas aeruginosa PA01
gcucgagggcgaccgccaggc

SEQ ID NO: 3400354 - RNA, 17 nt, Pseudomonas aeruginosa PA01
gcucgaggggcgacgga

SEQ ID NO: 3400355 - RNA, 14 nt, Pseudomonas aeruginosa PA01
gcucgagggugucg

SEQ ID NO: 3400356 - RNA, 16 nt, Pseudomonas aeruginosa PA01
gcucgaucaccaccac

SEQ ID NO: 3400357 - RNA, 15 nt, Pseudomonas aeruginosa PA01
gcucgaucagcccgc

SEQ ID NO: 3400358 - RNA, 16 nt, Pseudomonas aeruginosa PA01
gcucgaucagcccgcc

SEQ ID NO: 3400359 - RNA, 13 nt, Pseudomonas aeruginosa PA01
gcucgaucagccg

SEQ ID NO: 3400360 - RNA, 21 nt, Pseudomonas aeruginosa PA01
gcucgaucagguaggcgccgu

SEQ ID NO: 3400361 - RNA, 16 nt, Pseudomonas aeruginosa PA01
gcucgauccagccggc

SEQ ID NO: 3400362 - RNA, 18 nt, Pseudomonas aeruginosa PA01
gcucgauccagccggcau

SEQ ID NO: 3400363 - RNA, 20 nt, Pseudomonas aeruginosa PA01
gcucgauccagccggcaucc

SEQ ID NO: 3400364 - RNA, 21 nt, Pseudomonas aeruginosa PA01
gcucgaucggcagggcgccga

SEQ ID NO: 3400365 - RNA, 24 nt, Pseudomonas aeruginosa PA01
gcucgaucggcagggcgccgacca

SEQ ID NO: 3400366 - RNA, 19 nt, Pseudomonas aeruginosa PA01
gcucgaucucauggucggg

SEQ ID NO: 3400367 - RNA, 15 nt, Pseudomonas aeruginosa PA01
gcucgaugaucacca

SEQ ID NO: 3400368 - RNA, 16 nt, Pseudomonas aeruginosa PA01
gcucgaugaucgacug

SEQ ID NO: 3400369 - RNA, 20 nt, Pseudomonas aeruginosa PA01
gcucgaugccaucgaggcca

SEQ ID NO: 3400370 - RNA, 14 nt, Pseudomonas aeruginosa PA01
gcucgaugcccgcc

SEQ ID NO: 3400371 - RNA, 17 nt, Pseudomonas aeruginosa PA01
gcucgaugcccgccagc

SEQ ID NO: 3400372 - RNA, 18 nt, Pseudomonas aeruginosa PA01
gcucgaugcccgccagca

SEQ ID NO: 3400373 - RNA, 22 nt, Pseudomonas aeruginosa PA01
gcucgaugcccgccagcaggcg

SEQ ID NO: 3400374 - RNA, 15 nt, Pseudomonas aeruginosa PA01
gcucgauggcgaagc

SEQ ID NO: 3400375 - RNA, 17 nt, Pseudomonas aeruginosa PA01
gcucgcaacgcuguccg

SEQ ID NO: 3400376 - RNA, 15 nt, Pseudomonas aeruginosa PA01
gcucgcaaucagcgc

SEQ ID NO: 3400377 - RNA, 13 nt, Pseudomonas aeruginosa PA01
gcucgcaccaggc

SEQ ID NO: 3400378 - RNA, 17 nt, Pseudomonas aeruginosa PA01
gcucgcaccaggccagg

SEQ ID NO: 3400379 - RNA, 18 nt, Pseudomonas aeruginosa PA01
gcucgcaccaggccaggu

SEQ ID NO: 3400380 - RNA, 16 nt, Pseudomonas aeruginosa PA01
gcucgcagagggcgau

SEQ ID NO: 3400381 - RNA, 21 nt, Pseudomonas aeruginosa PA01
gcucgcagagggcgaugcccu

SEQ ID NO: 3400382 - RNA, 13 nt, Pseudomonas aeruginosa PA01
gcucgccaccugu

SEQ ID NO: 3400383 - RNA, 22 nt, Pseudomonas aeruginosa PA01
gcucgccagaugacgauggccg

SEQ ID NO: 3400384 - RNA, 13 nt, Pseudomonas aeruginosa PA01
gcucgcccagcag

SEQ ID NO: 3400385 - RNA, 15 nt, Pseudomonas aeruginosa PA01
gcucgcccagcaggc

SEQ ID NO: 3400386 - RNA, 19 nt, Pseudomonas aeruginosa PA01
gcucgcccagcaggcgcgc

SEQ ID NO: 3400387 - RNA, 22 nt, Pseudomonas aeruginosa PA01
gcucgcccagcaggcgcgcccu

SEQ ID NO: 3400388 - RNA, 17 nt, Pseudomonas aeruginosa PA01
gcucgcccaugcgcggc

SEQ ID NO: 3400389 - RNA, 18 nt, Pseudomonas aeruginosa PA01
gcucgcccaugcgcggcg

SEQ ID NO: 3400390 - RNA, 12 nt, Pseudomonas aeruginosa PA01
gcucgccccggc

SEQ ID NO: 3400391 - RNA, 15 nt, Pseudomonas aeruginosa PA01
gcucgccccggcggc

SEQ ID NO: 3400392 - RNA, 16 nt, Pseudomonas aeruginosa PA01
gcucgccccggcggcg

SEQ ID NO: 3400393 - RNA, 15 nt, Pseudomonas aeruginosa PA01
gcucgcccgccucgg

SEQ ID NO: 3400394 - RNA, 15 nt, Pseudomonas aeruginosa PA01
gcucgcccuugcgcc

SEQ ID NO: 3400395 - RNA, 14 nt, Pseudomonas aeruginosa PA01
gcucgccgccagca

SEQ ID NO: 3400396 - RNA, 16 nt, Pseudomonas aeruginosa PA01
gcucgccgccagcagg

SEQ ID NO: 3400397 - RNA, 12 nt, Pseudomonas aeruginosa PA01
gcucgccgccgg

SEQ ID NO: 3400398 - RNA, 14 nt, Pseudomonas aeruginosa PA01
gcucgccgccggcg

SEQ ID NO: 3400399 - RNA, 14 nt, Pseudomonas aeruginosa PA01
gcucgccgccgggc

SEQ ID NO: 3400400 - RNA, 18 nt, Pseudomonas aeruginosa PA01
gcucgccgccgggcgcgc

SEQ ID NO: 3400401 - RNA, 19 nt, Pseudomonas aeruginosa PA01
gcucgccgccgggcgcgcg

SEQ ID NO: 3400402 - RNA, 20 nt, Pseudomonas aeruginosa PA01
gcucgccgccgggcgcgcgc

SEQ ID NO: 3400403 - RNA, 12 nt, Pseudomonas aeruginosa PA01
gcucgccgcucc

SEQ ID NO: 3400404 - RNA, 14 nt, Pseudomonas aeruginosa PA01
gcucgccgcugaag

SEQ ID NO: 3400405 - RNA, 23 nt, Pseudomonas aeruginosa PA01
gcucgccgcugaaguccuggccg

SEQ ID NO: 3400406 - RNA, 16 nt, Pseudomonas aeruginosa PA01
gcucgccggcgcgggc

SEQ ID NO: 3400407 - RNA, 18 nt, Pseudomonas aeruginosa PA01
gcucgccggcgcgggcgg

SEQ ID NO: 3400408 - RNA, 21 nt, Pseudomonas aeruginosa PA01
gcucgccggcguccuccucca

SEQ ID NO: 3400409 - RNA, 21 nt, Pseudomonas aeruginosa PA01
gcucgccgggaaucgccagca

SEQ ID NO: 3400410 - RNA, 15 nt, Pseudomonas aeruginosa PA01
gcucgccggguaggg

SEQ ID NO: 3400411 - RNA, 20 nt, Pseudomonas aeruginosa PA01
gcucgccgggucgccgcagc

SEQ ID NO: 3400412 - RNA, 21 nt, Pseudomonas aeruginosa PA01
gcucgccgggucgccgcagcc

SEQ ID NO: 3400413 - RNA, 22 nt, Pseudomonas aeruginosa PA01
gcucgccggguuguccaggcga

SEQ ID NO: 3400414 - RNA, 15 nt, Pseudomonas aeruginosa PA01
gcucgccgucaucga

SEQ ID NO: 3400415 - RNA, 19 nt, Pseudomonas aeruginosa PA01
gcucgccgucaucgagcag

SEQ ID NO: 3400416 - RNA, 17 nt, Pseudomonas aeruginosa PA01
gcucgccuaccggcgcc

SEQ ID NO: 3400417 - RNA, 19 nt, Pseudomonas aeruginosa PA01
gcucgccuaccggcgccgc

SEQ ID NO: 3400418 - RNA, 14 nt, Pseudomonas aeruginosa PA01
gcucgccucgggcc

SEQ ID NO: 3400419 - RNA, 15 nt, Pseudomonas aeruginosa PA01
gcucgccucgggcca

SEQ ID NO: 3400420 - RNA, 14 nt, Pseudomonas aeruginosa PA01
gcucgccugguagg

SEQ ID NO: 3400421 - RNA, 23 nt, Pseudomonas aeruginosa PA01
gcucgccugguaggcggcgacga

SEQ ID NO: 3400422 - RNA, 21 nt, Pseudomonas aeruginosa PA01
gcucgcgcaaccagccggaga

SEQ ID NO: 3400423 - RNA, 19 nt, Pseudomonas aeruginosa PA01
gcucgcgcaagcgcccggc

SEQ ID NO: 3400424 - RNA, 20 nt, Pseudomonas aeruginosa PA01
gcucgcgcaagcgcccggcg

SEQ ID NO: 3400425 - RNA, 22 nt, Pseudomonas aeruginosa PA01
gcucgcgcaagcgcccggcgaa

SEQ ID NO: 3400426 - RNA, 17 nt, Pseudomonas aeruginosa PA01
gcucgcgcaccgcggcc

SEQ ID NO: 3400427 - RNA, 16 nt, Pseudomonas aeruginosa PA01
gcucgcgcagccaggc

SEQ ID NO: 3400428 - RNA, 15 nt, Pseudomonas aeruginosa PA01
gcucgcgcagcggcg

SEQ ID NO: 3400429 - RNA, 16 nt, Pseudomonas aeruginosa PA01
gcucgcgcagcggcgc

SEQ ID NO: 3400430 - RNA, 22 nt, Pseudomonas aeruginosa PA01
gcucgcgcaugaucgccucggc

SEQ ID NO: 3400431 - RNA, 23 nt, Pseudomonas aeruginosa PA01
gcucgcgcaugaucgccucggcg

SEQ ID NO: 3400432 - RNA, 13 nt, Pseudomonas aeruginosa PA01
gcucgcgccagcc

SEQ ID NO: 3400433 - RNA, 15 nt, Pseudomonas aeruginosa PA01
gcucgcgccagcccc

SEQ ID NO: 3400434 - RNA, 17 nt, Pseudomonas aeruginosa PA01
gcucgcgccagccccag

SEQ ID NO: 3400435 - RNA, 19 nt, Pseudomonas aeruginosa PA01
gcucgcgccagccccaggc

SEQ ID NO: 3400436 - RNA, 20 nt, Pseudomonas aeruginosa PA01
gcucgcgccagccccaggcg

SEQ ID NO: 3400437 - RNA, 18 nt, Pseudomonas aeruginosa PA01
gcucgcgccggcgcguuc

SEQ ID NO: 3400438 - RNA, 14 nt, Pseudomonas aeruginosa PA01
gcucgcgcggcacc

SEQ ID NO: 3400439 - RNA, 14 nt, Pseudomonas aeruginosa PA01
gcucgcgcggggcg

SEQ ID NO: 3400440 - RNA, 13 nt, Pseudomonas aeruginosa PA01
gcucgcgcugcaa

SEQ ID NO: 3400441 - RNA, 16 nt, Pseudomonas aeruginosa PA01
gcucgcgcuucucgac

SEQ ID NO: 3400442 - RNA, 15 nt, Pseudomonas aeruginosa PA01
gcucgcggaccagcu

SEQ ID NO: 3400443 - RNA, 18 nt, Pseudomonas aeruginosa PA01
gcucgcggaccagcuccg

SEQ ID NO: 3400444 - RNA, 20 nt, Pseudomonas aeruginosa PA01
gcucgcggcaucccgcccgg

SEQ ID NO: 3400445 - RNA, 13 nt, Pseudomonas aeruginosa PA01
gcucgcggcgcuc

SEQ ID NO: 3400446 - RNA, 17 nt, Pseudomonas aeruginosa PA01
gcucgcggcguaggccu

SEQ ID NO: 3400447 - RNA, 12 nt, Pseudomonas aeruginosa PA01
gcucgcggcugg

SEQ ID NO: 3400448 - RNA, 13 nt, Pseudomonas aeruginosa PA01
gcucgcggcuggc

SEQ ID NO: 3400449 - RNA, 16 nt, Pseudomonas aeruginosa PA01
gcucgcggcuggccgc

SEQ ID NO: 3400450 - RNA, 22 nt, Pseudomonas aeruginosa PA01
gcucgcggcuggccgccucgcg

SEQ ID NO: 3400451 - RNA, 16 nt, Pseudomonas aeruginosa PA01
gcucggcggcgcgcag

SEQ ID NO: 3400452 - RNA, 16 nt, Pseudomonas aeruginosa PA01
gcucggcgggacggcg

SEQ ID NO: 3400453 - RNA, 18 nt, Pseudomonas aeruginosa PA01
gcucggcgggacggcgca

SEQ ID NO: 3400454 - RNA, 17 nt, Pseudomonas aeruginosa PA01
gcucggcgggcugccgc

SEQ ID NO: 3400455 - RNA, 18 nt, Pseudomonas aeruginosa PA01
gcucggcgggcugccgcg

SEQ ID NO: 3400456 - RNA, 20 nt, Pseudomonas aeruginosa PA01
gcucggcgggcugccgcgga

SEQ ID NO: 3400457 - RNA, 23 nt, Pseudomonas aeruginosa PA01
gcucggcggguauccgccgggcc

SEQ ID NO: 3400458 - RNA, 17 nt, Pseudomonas aeruginosa PA01
gcucggcggucaggcca

SEQ ID NO: 3400459 - RNA, 19 nt, Pseudomonas aeruginosa PA01
gcucggcggugaccggauc

SEQ ID NO: 3400460 - RNA, 16 nt, Pseudomonas aeruginosa PA01
gcucggcguagccggc

SEQ ID NO: 3400461 - RNA, 18 nt, Pseudomonas aeruginosa PA01
gcucggcguagccggcga

SEQ ID NO: 3400462 - RNA, 20 nt, Pseudomonas aeruginosa PA01
gcucggcguagccggcgauc

SEQ ID NO: 3400463 - RNA, 18 nt, Pseudomonas aeruginosa PA01
gcucggcguagcgcuggg

SEQ ID NO: 3400464 - RNA, 15 nt, Pseudomonas aeruginosa PA01
gcucggcgucgucga

SEQ ID NO: 3400465 - RNA, 16 nt, Pseudomonas aeruginosa PA01
gcucggcgucgucgau

SEQ ID NO: 3400466 - RNA, 17 nt, Pseudomonas aeruginosa PA01
gcucggcgucgucgauc

SEQ ID NO: 3400467 - RNA, 15 nt, Pseudomonas aeruginosa PA01
gcucggcuccagcca

SEQ ID NO: 3400468 - RNA, 20 nt, Pseudomonas aeruginosa PA01
gcucggcuccagccaggccc

SEQ ID NO: 3400469 - RNA, 22 nt, Pseudomonas aeruginosa PA01
gcucggcuccaggaccggcagg

SEQ ID NO: 3400470 - RNA, 15 nt, Pseudomonas aeruginosa PA01
gcucggcugcuugcc

SEQ ID NO: 3400471 - RNA, 16 nt, Pseudomonas aeruginosa PA01
gcucggcugcuugccg

SEQ ID NO: 3400472 - RNA, 19 nt, Pseudomonas aeruginosa PA01
gcucggcugcuugccggug

SEQ ID NO: 3400473 - RNA, 20 nt, Pseudomonas aeruginosa PA01
gcucggcugcuugccggugc

SEQ ID NO: 3400474 - RNA, 21 nt, Pseudomonas aeruginosa PA01
gcucggcugcuugccggugcc

SEQ ID NO: 3400475 - RNA, 13 nt, Pseudomonas aeruginosa PA01
gcucggcuucgcg

SEQ ID NO: 3400476 - RNA, 16 nt, Pseudomonas aeruginosa PA01
gcucggcuucgcguug

SEQ ID NO: 3400477 - RNA, 18 nt, Pseudomonas aeruginosa PA01
gcucggcuucgcguugca

SEQ ID NO: 3400478 - RNA, 13 nt, Pseudomonas aeruginosa PA01
gcucgggcgcgga

SEQ ID NO: 3400479 - RNA, 22 nt, Pseudomonas aeruginosa PA01
gcucgggcggcaagggcacgug

SEQ ID NO: 3400480 - RNA, 23 nt, Pseudomonas aeruginosa PA01
gcucgggcgucuccugccgccga

SEQ ID NO: 3400481 - RNA, 20 nt, Pseudomonas aeruginosa PA01
gcucggggaacacgcgcugg

SEQ ID NO: 3400482 - RNA, 17 nt, Pseudomonas aeruginosa PA01
gcucggggucgucgcug

SEQ ID NO: 3400483 - RNA, 17 nt, Pseudomonas aeruginosa PA01
gcucggggugcgcggcg

SEQ ID NO: 3400484 - RNA, 18 nt, Pseudomonas aeruginosa PA01
gcucggggugcgcggcga

SEQ ID NO: 3400485 - RNA, 19 nt, Pseudomonas aeruginosa PA01
gcucggggugcgcggcgaa

SEQ ID NO: 3400486 - RNA, 23 nt, Pseudomonas aeruginosa PA01
gcucgggguuuccucgaagcgcu

SEQ ID NO: 3400487 - RNA, 23 nt, Pseudomonas aeruginosa PA01
gcucggguaauccacgcugugcg

SEQ ID NO: 3400488 - RNA, 16 nt, Pseudomonas aeruginosa PA01
gcucgguauggcugcu

SEQ ID NO: 3400489 - RNA, 22 nt, Pseudomonas aeruginosa PA01
gcucggucagcucccugauccg

SEQ ID NO: 3400490 - RNA, 16 nt, Pseudomonas aeruginosa PA01
gcucgguccagaucgc

SEQ ID NO: 3400491 - RNA, 18 nt, Pseudomonas aeruginosa PA01
gcucgguccagaucgcca

SEQ ID NO: 3400492 - RNA, 19 nt, Pseudomonas aeruginosa PA01
gcucggucgcgcgggugcg

SEQ ID NO: 3400493 - RNA, 21 nt, Pseudomonas aeruginosa PA01
gcucggucucgaucggcccgg

SEQ ID NO: 3400494 - RNA, 23 nt, Pseudomonas aeruginosa PA01
gcucggucucgaucggcccgggc

SEQ ID NO: 3400495 - RNA, 18 nt, Pseudomonas aeruginosa PA01
gcucggugagcaggcgcc

SEQ ID NO: 3400496 - RNA, 21 nt, Pseudomonas aeruginosa PA01
gcucggugaggaacuugucga

SEQ ID NO: 3400497 - RNA, 19 nt, Pseudomonas aeruginosa PA01
gcucggugccuucccagcc

SEQ ID NO: 3400498 - RNA, 22 nt, Pseudomonas aeruginosa PA01
gcucgguggcaugguguccggc

SEQ ID NO: 3400499 - RNA, 20 nt, Pseudomonas aeruginosa PA01
gcucggugugaucaccagcc

SEQ ID NO: 3400500 - RNA, 13 nt, Pseudomonas aeruginosa PA01
gcucgguuccagc

SEQ ID NO: 3400501 - RNA, 14 nt, Pseudomonas aeruginosa PA01
gcucgguuccagcu

SEQ ID NO: 3400502 - RNA, 15 nt, Pseudomonas aeruginosa PA01
gcucgguuccagcuc

SEQ ID NO: 3400503 - RNA, 20 nt, Pseudomonas aeruginosa PA01
gcucgguuccagcucgucga

SEQ ID NO: 3400504 - RNA, 21 nt, Pseudomonas aeruginosa PA01
gcucgguuccagcucgucgau

SEQ ID NO: 3400505 - RNA, 20 nt, Pseudomonas aeruginosa PA01
gcucgguugccaggccggcg

SEQ ID NO: 3400506 - RNA, 22 nt, Pseudomonas aeruginosa PA01
gcucgguugccaggccggcgca

SEQ ID NO: 3400507 - RNA, 13 nt, Pseudomonas aeruginosa PA01
gcucguagccggc

SEQ ID NO: 3400508 - RNA, 15 nt, Pseudomonas aeruginosa PA01
gcucgucacccgcgc

SEQ ID NO: 3400509 - RNA, 21 nt, Pseudomonas aeruginosa PA01
gcucgucaucguccagcucgg

SEQ ID NO: 3400510 - RNA, 22 nt, Pseudomonas aeruginosa PA01
gcucgucaucguccagcucggc

SEQ ID NO: 3400511 - RNA, 21 nt, Pseudomonas aeruginosa PA01
gcucgucauggcgcacgccgc

SEQ ID NO: 3400512 - RNA, 14 nt, Pseudomonas aeruginosa PA01
gcucguccaggcaa

SEQ ID NO: 3400513 - RNA, 13 nt, Pseudomonas aeruginosa PA01
gcucguccaggcc

SEQ ID NO: 3400514 - RNA, 14 nt, Pseudomonas aeruginosa PA01
gcucguccaggccg

SEQ ID NO: 3400515 - RNA, 15 nt, Pseudomonas aeruginosa PA01
gcucguccaggccgc

SEQ ID NO: 3400516 - RNA, 18 nt, Pseudomonas aeruginosa PA01
gcucguccaggccgcagg

SEQ ID NO: 3400517 - RNA, 14 nt, Pseudomonas aeruginosa PA01
gcucguccaguucc

SEQ ID NO: 3400518 - RNA, 23 nt, Pseudomonas aeruginosa PA01
gcucguccaguuccagggucagc

SEQ ID NO: 3400519 - RNA, 21 nt, Pseudomonas aeruginosa PA01
gcucguccauguugcggccca

SEQ ID NO: 3400520 - RNA, 17 nt, Pseudomonas aeruginosa PA01
gcucgucgagcugcucg

SEQ ID NO: 3400521 - RNA, 18 nt, Pseudomonas aeruginosa PA01
gcucgucgagcugcucgg

SEQ ID NO: 3400522 - RNA, 14 nt, Pseudomonas aeruginosa PA01
gcucgucuuucagg

SEQ ID NO: 3400523 - RNA, 18 nt, Pseudomonas aeruginosa PA01
gcucgucuuucagguggg

SEQ ID NO: 3400524 - RNA, 20 nt, Pseudomonas aeruginosa PA01
gcucgugcagguagccgcgc

SEQ ID NO: 3400525 - RNA, 21 nt, Pseudomonas aeruginosa PA01
gcucgugcagguagccgcgcc

SEQ ID NO: 3400526 - RNA, 22 nt, Pseudomonas aeruginosa PA01
gcucgugcagguagccgcgccg

SEQ ID NO: 3400527 - RNA, 21 nt, Pseudomonas aeruginosa PA01
gcucguggaaaaagaagaaaa

SEQ ID NO: 3400528 - RNA, 17 nt, Pseudomonas aeruginosa PA01
gcucguucgcccagacc

SEQ ID NO: 3400529 - RNA, 14 nt, Pseudomonas aeruginosa PA01
gcucguucguucug

SEQ ID NO: 3400530 - RNA, 16 nt, Pseudomonas aeruginosa PA01
gcucguugauccgcgu

SEQ ID NO: 3400531 - RNA, 21 nt, Pseudomonas aeruginosa PA01
gcucguugcacagcgcccaga

SEQ ID NO: 3400532 - RNA, 15 nt, Pseudomonas aeruginosa PA01
gcucguugcccggcu

SEQ ID NO: 3400533 - RNA, 17 nt, Pseudomonas aeruginosa PA01
gcucguugcgccgcucc

SEQ ID NO: 3400534 - RNA, 14 nt, Pseudomonas aeruginosa PA01
gcucguuggcggcc

SEQ ID NO: 3400535 - RNA, 15 nt, Pseudomonas aeruginosa PA01
gcucguuggcggcca

SEQ ID NO: 3400536 - RNA, 19 nt, Pseudomonas aeruginosa PA01
gcucuaccgagaucaccuu

SEQ ID NO: 3400537 - RNA, 21 nt, Pseudomonas aeruginosa PA01
gcucuccccgcucccgcggcc

SEQ ID NO: 3400538 - RNA, 21 nt, Pseudomonas aeruginosa PA01
gcucuccgucaaugcggccug

SEQ ID NO: 3400539 - RNA, 22 nt, Pseudomonas aeruginosa PA01
gcucuccgucaaugcggccugc

SEQ ID NO: 3400540 - RNA, 15 nt, Pseudomonas aeruginosa PA01
gcucuccgucagggc

SEQ ID NO: 3400541 - RNA, 21 nt, Pseudomonas aeruginosa PA01
gcucucgaacaccaggcgcca

SEQ ID NO: 3400542 - RNA, 14 nt, Pseudomonas aeruginosa PA01
gcucucgaacaccg

SEQ ID NO: 3400543 - RNA, 16 nt, Pseudomonas aeruginosa PA01
gcucucgaacaccggc

SEQ ID NO: 3400544 - RNA, 18 nt, Pseudomonas aeruginosa PA01
gcucucgaacaccggcga

SEQ ID NO: 3400545 - RNA, 17 nt, Pseudomonas aeruginosa PA01
gcucucgaacagcagca

SEQ ID NO: 3400546 - RNA, 19 nt, Pseudomonas aeruginosa PA01
gcucucgaacagcagcaag

SEQ ID NO: 3400547 - RNA, 15 nt, Pseudomonas aeruginosa PA01
gcucucgagcaugcc

SEQ ID NO: 3400548 - RNA, 14 nt, Pseudomonas aeruginosa PA01
gcucucgaggacgu

SEQ ID NO: 3400549 - RNA, 13 nt, Pseudomonas aeruginosa PA01
gcucucgccgccu

SEQ ID NO: 3400550 - RNA, 19 nt, Pseudomonas aeruginosa PA01
gcucucgccgccuucggca

SEQ ID NO: 3400551 - RNA, 13 nt, Pseudomonas aeruginosa PA01
gcucucgcgcagc

SEQ ID NO: 3400552 - RNA, 14 nt, Pseudomonas aeruginosa PA01
gcucucgcuggugg

SEQ ID NO: 3400553 - RNA, 14 nt, Pseudomonas aeruginosa PA01
gcugaccggccgca

SEQ ID NO: 3400554 - RNA, 15 nt, Pseudomonas aeruginosa PA01
gcugaccggccgcag

SEQ ID NO: 3400555 - RNA, 17 nt, Pseudomonas aeruginosa PA01
gcugaccggccgcagca

SEQ ID NO: 3400556 - RNA, 20 nt, Pseudomonas aeruginosa PA01
gcugaccggccgcagcaggu

SEQ ID NO: 3400557 - RNA, 22 nt, Pseudomonas aeruginosa PA01
gcugaccgggcggaucgccaac

SEQ ID NO: 3400558 - RNA, 15 nt, Pseudomonas aeruginosa PA01
gcugaccucgagcug

SEQ ID NO: 3400559 - RNA, 23 nt, Pseudomonas aeruginosa PA01
gcugaccucgagcuggacgcgcu

SEQ ID NO: 3400560 - RNA, 15 nt, Pseudomonas aeruginosa PA01
gcugaccuucgccgu

SEQ ID NO: 3400561 - RNA, 19 nt, Pseudomonas aeruginosa PA01
gcugaccuucgccgucaga

SEQ ID NO: 3400562 - RNA, 21 nt, Pseudomonas aeruginosa PA01
gcugacgaacaucgccagcgc

SEQ ID NO: 3400563 - RNA, 23 nt, Pseudomonas aeruginosa PA01
gcugacgaacaucgccagcgcca

SEQ ID NO: 3400564 - RNA, 15 nt, Pseudomonas aeruginosa PA01
gcugacgaggacgcc

SEQ ID NO: 3400565 - RNA, 15 nt, Pseudomonas aeruginosa PA01
gcugacgccggcacc

SEQ ID NO: 3400566 - RNA, 13 nt, Pseudomonas aeruginosa PA01
gcugacgcuggcg

SEQ ID NO: 3400567 - RNA, 18 nt, Pseudomonas aeruginosa PA01
gcugacgcuggcgaaggc

SEQ ID NO: 3400568 - RNA, 20 nt, Pseudomonas aeruginosa PA01
gcugacggcaaggaccugcu

SEQ ID NO: 3400569 - RNA, 16 nt, Pseudomonas aeruginosa PA01
gcugacggcguggcgg

SEQ ID NO: 3400570 - RNA, 20 nt, Pseudomonas aeruginosa PA01
gcugacggucugccagcucu

SEQ ID NO: 3400571 - RNA, 22 nt, Pseudomonas aeruginosa PA01
gcugacgucgacgcagcgcgcg

SEQ ID NO: 3400572 - RNA, 24 nt, Pseudomonas aeruginosa PA01
gcugacgucgacgcagcgcgcguc

SEQ ID NO: 3400573 - RNA, 16 nt, Pseudomonas aeruginosa PA01
gcugacuuccaucagc

SEQ ID NO: 3400574 - RNA, 18 nt, Pseudomonas aeruginosa PA01
gcugagaccgauccagca

SEQ ID NO: 3400575 - RNA, 19 nt, Pseudomonas aeruginosa PA01
gcugagaccgauccagcag

SEQ ID NO: 3400576 - RNA, 18 nt, Pseudomonas aeruginosa PA01
gcugagaccuuccugcca

SEQ ID NO: 3400577 - RNA, 20 nt, Pseudomonas aeruginosa PA01
gcugagaccuuccugccagc

SEQ ID NO: 3400578 - RNA, 15 nt, Pseudomonas aeruginosa PA01
gcugagacgcugccg

SEQ ID NO: 3400579 - RNA, 13 nt, Pseudomonas aeruginosa PA01
gcugagcaggccg

SEQ ID NO: 3400580 - RNA, 18 nt, Pseudomonas aeruginosa PA01
gcugagcagucgccuggc

SEQ ID NO: 3400581 - RNA, 22 nt, Pseudomonas aeruginosa PA01
gcugagcagucgccuggcccug

SEQ ID NO: 3400582 - RNA, 22 nt, Pseudomonas aeruginosa PA01
gcugagcaguugcgggcgcagg

SEQ ID NO: 3400583 - RNA, 23 nt, Pseudomonas aeruginosa PA01
gcugagcaguugcgggcgcaggu

SEQ ID NO: 3400584 - RNA, 14 nt, Pseudomonas aeruginosa PA01
gcugagcgccaggc

SEQ ID NO: 3400585 - RNA, 15 nt, Pseudomonas aeruginosa PA01
gcugagcgccaggcg

SEQ ID NO: 3400586 - RNA, 17 nt, Pseudomonas aeruginosa PA01
gcugagcgccaggcgca

SEQ ID NO: 3400587 - RNA, 12 nt, Pseudomonas aeruginosa PA01
gcugagcgccuc

SEQ ID NO: 3400588 - RNA, 15 nt, Pseudomonas aeruginosa PA01
gcugagcgccucgau

SEQ ID NO: 3400589 - RNA, 16 nt, Pseudomonas aeruginosa PA01
gcugagcgccucgauc

SEQ ID NO: 3400590 - RNA, 17 nt, Pseudomonas aeruginosa PA01
gcugagcgccucgaucg

SEQ ID NO: 3400591 - RNA, 12 nt, Pseudomonas aeruginosa PA01
gcugagcgcggu

SEQ ID NO: 3400592 - RNA, 13 nt, Pseudomonas aeruginosa PA01
gcugagcgcgguc

SEQ ID NO: 3400593 - RNA, 18 nt, Pseudomonas aeruginosa PA01
gcugagcgcggucaccca

SEQ ID NO: 3400594 - RNA, 12 nt, Pseudomonas aeruginosa PA01
gcugagcggcug

SEQ ID NO: 3400595 - RNA, 15 nt, Pseudomonas aeruginosa PA01
gcugagcggcuggug

SEQ ID NO: 3400596 - RNA, 16 nt, Pseudomonas aeruginosa PA01
gcugagcggcuggugg

SEQ ID NO: 3400597 - RNA, 18 nt, Pseudomonas aeruginosa PA01
gcugagcggcugguggcc

SEQ ID NO: 3400598 - RNA, 18 nt, Pseudomonas aeruginosa PA01
gcugagcuguuucagccc

SEQ ID NO: 3400599 - RNA, 20 nt, Pseudomonas aeruginosa PA01
gcugaggaagagcagcgcgg

SEQ ID NO: 3400600 - RNA, 18 nt, Pseudomonas aeruginosa PA01
gcugaggacugccagggu

SEQ ID NO: 3400601 - RNA, 18 nt, Pseudomonas aeruginosa PA01
gcugaggaucacgauggc

SEQ ID NO: 3400602 - RNA, 23 nt, Pseudomonas aeruginosa PA01
gcugaggaucacgauggccggca

SEQ ID NO: 3400603 - RNA, 14 nt, Pseudomonas aeruginosa PA01
gcugaggaucagcc

SEQ ID NO: 3400604 - RNA, 22 nt, Pseudomonas aeruginosa PA01
gcugaggaucagccagccggcg

SEQ ID NO: 3400605 - RNA, 23 nt, Pseudomonas aeruginosa PA01
gcugaggauguagccggcuuccu

SEQ ID NO: 3400606 - RNA, 14 nt, Pseudomonas aeruginosa PA01
gcugaggccgacga

SEQ ID NO: 3400607 - RNA, 20 nt, Pseudomonas aeruginosa PA01
gcugaggccgacgaacagcc

SEQ ID NO: 3400608 - RNA, 23 nt, Pseudomonas aeruginosa PA01
gcugaggccgacgaacagccaga

SEQ ID NO: 3400609 - RNA, 19 nt, Pseudomonas aeruginosa PA01
gcugaggccgcccuggccg

SEQ ID NO: 3400610 - RNA, 23 nt, Pseudomonas aeruginosa PA01
gcugaggccgcccuggccgagcg

SEQ ID NO: 3400611 - RNA, 14 nt, Pseudomonas aeruginosa PA01
gcugaggccggugu

SEQ ID NO: 3400612 - RNA, 20 nt, Pseudomonas aeruginosa PA01
gcugaggccguagccgaacg

SEQ ID NO: 3400613 - RNA, 14 nt, Pseudomonas aeruginosa PA01
gcugaggcucgccg

SEQ ID NO: 3400614 - RNA, 14 nt, Pseudomonas aeruginosa PA01
gcugaggcuggcga

SEQ ID NO: 3400615 - RNA, 22 nt, Pseudomonas aeruginosa PA01
gcugaggguggaacccauggcg

SEQ ID NO: 3400616 - RNA, 16 nt, Pseudomonas aeruginosa PA01
gcugaggucgcgggcg

SEQ ID NO: 3400617 - RNA, 18 nt, Pseudomonas aeruginosa PA01
gcugaguuucacgucgag

SEQ ID NO: 3400618 - RNA, 17 nt, Pseudomonas aeruginosa PA01
gcugaguuugcccagcg

SEQ ID NO: 3400619 - RNA, 19 nt, Pseudomonas aeruginosa PA01
gcugaguuugcccagcgcc

SEQ ID NO: 3400620 - RNA, 19 nt, Pseudomonas aeruginosa PA01
gcugauaagcucggcuuga

SEQ ID NO: 3400621 - RNA, 19 nt, Pseudomonas aeruginosa PA01
gcugaucacccgcccgccg

SEQ ID NO: 3400622 - RNA, 22 nt, Pseudomonas aeruginosa PA01
gcugaucacccgcccgccgucg

SEQ ID NO: 3400623 - RNA, 20 nt, Pseudomonas aeruginosa PA01
gcugaucacguagaugccgg

SEQ ID NO: 3400624 - RNA, 12 nt, Pseudomonas aeruginosa PA01
gcugaucagccc

SEQ ID NO: 3400625 - RNA, 15 nt, Pseudomonas aeruginosa PA01
gcugaucagcccgcu

SEQ ID NO: 3400626 - RNA, 22 nt, Pseudomonas aeruginosa PA01
gcugaucagcuucuucagcagc

SEQ ID NO: 3400627 - RNA, 21 nt, Pseudomonas aeruginosa PA01
gcugaucaggaggaucgccag

SEQ ID NO: 3400628 - RNA, 23 nt, Pseudomonas aeruginosa PA01
gcugaucaggaggaucgccagga

SEQ ID NO: 3400629 - RNA, 13 nt, Pseudomonas aeruginosa PA01
gcugaucaggccg

SEQ ID NO: 3400630 - RNA, 20 nt, Pseudomonas aeruginosa PA01
gcugaucaguaccggcagcg

SEQ ID NO: 3400631 - RNA, 14 nt, Pseudomonas aeruginosa PA01
gcugaucaucagca

SEQ ID NO: 3400632 - RNA, 15 nt, Pseudomonas aeruginosa PA01
gcugaucaucagcag

SEQ ID NO: 3400633 - RNA, 16 nt, Pseudomonas aeruginosa PA01
gcugaucaucagcagg

SEQ ID NO: 3400634 - RNA, 21 nt, Pseudomonas aeruginosa PA01
gcugaucaucagcagggucag

SEQ ID NO: 3400635 - RNA, 14 nt, Pseudomonas aeruginosa PA01
gcugaucgcgcaga

SEQ ID NO: 3400636 - RNA, 22 nt, Pseudomonas aeruginosa PA01
gcugaucgcgcagaucgccgcg

SEQ ID NO: 3400637 - RNA, 20 nt, Pseudomonas aeruginosa PA01
gcugaucggccgccagugca

SEQ ID NO: 3400638 - RNA, 14 nt, Pseudomonas aeruginosa PA01
gcugaucucggcca

SEQ ID NO: 3400639 - RNA, 18 nt, Pseudomonas aeruginosa PA01
gcugaucucggccauggu

SEQ ID NO: 3400640 - RNA, 13 nt, Pseudomonas aeruginosa PA01
gcugaucugccgg

SEQ ID NO: 3400641 - RNA, 12 nt, Pseudomonas aeruginosa PA01
gcugaucuucug

SEQ ID NO: 3400642 - RNA, 19 nt, Pseudomonas aeruginosa PA01
gcugaucuugccgcuggug

SEQ ID NO: 3400643 - RNA, 19 nt, Pseudomonas aeruginosa PA01
gcugaugaugccgcggcga

SEQ ID NO: 3400644 - RNA, 15 nt, Pseudomonas aeruginosa PA01
gcugaugcccggguc

SEQ ID NO: 3400645 - RNA, 19 nt, Pseudomonas aeruginosa PA01
gcugaugcccgggucgucg

SEQ ID NO: 3400646 - RNA, 15 nt, Pseudomonas aeruginosa PA01
gcugaugccggcgaa

SEQ ID NO: 3400647 - RNA, 20 nt, Pseudomonas aeruginosa PA01
gcugaugccggcgucggcga

SEQ ID NO: 3400648 - RNA, 21 nt, Pseudomonas aeruginosa PA01
gcugaugccguucucccgcgc

SEQ ID NO: 3400649 - RNA, 14 nt, Pseudomonas aeruginosa PA01
gcugaugcgcuggu

SEQ ID NO: 3400650 - RNA, 14 nt, Pseudomonas aeruginosa PA01
gcugaugugccgca

SEQ ID NO: 3400651 - RNA, 21 nt, Pseudomonas aeruginosa PA01
gcugcaacauggcgucggcga

SEQ ID NO: 3400652 - RNA, 22 nt, Pseudomonas aeruginosa PA01
gcugcaaccgauauggcuggcg

SEQ ID NO: 3400653 - RNA, 13 nt, Pseudomonas aeruginosa PA01
gcugcaacgccgc

SEQ ID NO: 3400654 - RNA, 15 nt, Pseudomonas aeruginosa PA01
gcugcaacgccggcc

SEQ ID NO: 3400655 - RNA, 13 nt, Pseudomonas aeruginosa PA01
gcugccgccgccg

SEQ ID NO: 3400656 - RNA, 14 nt, Pseudomonas aeruginosa PA01
gcugccgccgccgu

SEQ ID NO: 3400657 - RNA, 18 nt, Pseudomonas aeruginosa PA01
gcugccgccgccgucgac

SEQ ID NO: 3400658 - RNA, 13 nt, Pseudomonas aeruginosa PA01
gcugccgccgcgc

SEQ ID NO: 3400659 - RNA, 14 nt, Pseudomonas aeruginosa PA01
gcugccgccgcgcc

SEQ ID NO: 3400660 - RNA, 23 nt, Pseudomonas aeruginosa PA01
gcugccgccgcgcccggcgccag

SEQ ID NO: 3400661 - RNA, 14 nt, Pseudomonas aeruginosa PA01
gcugccgccgcgcu

SEQ ID NO: 3400662 - RNA, 12 nt, Pseudomonas aeruginosa PA01
gcugccgccguc

SEQ ID NO: 3400663 - RNA, 20 nt, Pseudomonas aeruginosa PA01
gcugccgccuucgcgggcca

SEQ ID NO: 3400664 - RNA, 23 nt, Pseudomonas aeruginosa PA01
gcugccgccuucgcgggccaggc

SEQ ID NO: 3400665 - RNA, 23 nt, Pseudomonas aeruginosa PA01
gcugccgcgcguggcuucgucca

SEQ ID NO: 3400666 - RNA, 15 nt, Pseudomonas aeruginosa PA01
gcugccgcucuggcu

SEQ ID NO: 3400667 - RNA, 16 nt, Pseudomonas aeruginosa PA01
gcugccgcucuggcug

SEQ ID NO: 3400668 - RNA, 18 nt, Pseudomonas aeruginosa PA01
gcugccgcucuggcugcu

SEQ ID NO: 3400669 - RNA, 19 nt, Pseudomonas aeruginosa PA01
gcugccgcucuggcugcug

SEQ ID NO: 3400670 - RNA, 21 nt, Pseudomonas aeruginosa PA01
gcugccgcucuggcugcuggc

SEQ ID NO: 3400671 - RNA, 22 nt, Pseudomonas aeruginosa PA01
gcugccgcucuggcugcuggcg

SEQ ID NO: 3400672 - RNA, 23 nt, Pseudomonas aeruginosa PA01
gcugccgcugacggucugccagc

SEQ ID NO: 3400673 - RNA, 19 nt, Pseudomonas aeruginosa PA01
gcugccgcuucggcugcug

SEQ ID NO: 3400674 - RNA, 19 nt, Pseudomonas aeruginosa PA01
gcugccggcauugcccaau

SEQ ID NO: 3400675 - RNA, 13 nt, Pseudomonas aeruginosa PA01
gcugccggccagg

SEQ ID NO: 3400676 - RNA, 14 nt, Pseudomonas aeruginosa PA01
gcugccggccaggg

SEQ ID NO: 3400677 - RNA, 15 nt, Pseudomonas aeruginosa PA01
gcugccggccagggu

SEQ ID NO: 3400678 - RNA, 17 nt, Pseudomonas aeruginosa PA01
gcugccggccagggucg

SEQ ID NO: 3400679 - RNA, 12 nt, Pseudomonas aeruginosa PA01
gcugccggcccu

SEQ ID NO: 3400680 - RNA, 17 nt, Pseudomonas aeruginosa PA01
gcugccggcccucgcga

SEQ ID NO: 3400681 - RNA, 13 nt, Pseudomonas aeruginosa PA01
gcugccggcgcgc

SEQ ID NO: 3400682 - RNA, 14 nt, Pseudomonas aeruginosa PA01
gcugccggcgcgca

SEQ ID NO: 3400683 - RNA, 18 nt, Pseudomonas aeruginosa PA01
gcugccggcgcgcacgga

SEQ ID NO: 3400684 - RNA, 21 nt, Pseudomonas aeruginosa PA01
gcugccggcgucguccugcgc

SEQ ID NO: 3400685 - RNA, 18 nt, Pseudomonas aeruginosa PA01
gcugccggcuugcugcag

SEQ ID NO: 3400686 - RNA, 13 nt, Pseudomonas aeruginosa PA01
gcugccgggcgag

SEQ ID NO: 3400687 - RNA, 14 nt, Pseudomonas aeruginosa PA01
gcugccgggcgagc

SEQ ID NO: 3400688 - RNA, 19 nt, Pseudomonas aeruginosa PA01
gcugccgggcgagcugcac

SEQ ID NO: 3400689 - RNA, 18 nt, Pseudomonas aeruginosa PA01
gcugccgggcucugguag

SEQ ID NO: 3400690 - RNA, 13 nt, Pseudomonas aeruginosa PA01
gcugccggucagg

SEQ ID NO: 3400691 - RNA, 14 nt, Pseudomonas aeruginosa PA01
gcugccggucaggc

SEQ ID NO: 3400692 - RNA, 20 nt, Pseudomonas aeruginosa PA01
gcugccggucaggcuggugc

SEQ ID NO: 3400693 - RNA, 22 nt, Pseudomonas aeruginosa PA01
gcugccguacagcccccgccgg

SEQ ID NO: 3400694 - RNA, 20 nt, Pseudomonas aeruginosa PA01
gcugccguagaggucgccgu

SEQ ID NO: 3400695 - RNA, 21 nt, Pseudomonas aeruginosa PA01
gcugccguagugguugcgcac

SEQ ID NO: 3400696 - RNA, 14 nt, Pseudomonas aeruginosa PA01
gcugccguccaggc

SEQ ID NO: 3400697 - RNA, 22 nt, Pseudomonas aeruginosa PA01
gcugccguccaggcgcgaacgc

SEQ ID NO: 3400698 - RNA, 18 nt, Pseudomonas aeruginosa PA01
gcugccguucgcccgcgg

SEQ ID NO: 3400699 - RNA, 20 nt, Pseudomonas aeruginosa PA01
gcugccguucgcccgcggcg

SEQ ID NO: 3400700 - RNA, 19 nt, Pseudomonas aeruginosa PA01
gcugccguugcaggcccag

SEQ ID NO: 3400701 - RNA, 20 nt, Pseudomonas aeruginosa PA01
gcugccucgguuuccggcca

SEQ ID NO: 3400702 - RNA, 12 nt, Pseudomonas aeruginosa PA01
gcugccugcacc

SEQ ID NO: 3400703 - RNA, 17 nt, Pseudomonas aeruginosa PA01
gcugccugcaccgggcc

SEQ ID NO: 3400704 - RNA, 17 nt, Pseudomonas aeruginosa PA01
gcugccuggggacggca

SEQ ID NO: 3400705 - RNA, 18 nt, Pseudomonas aeruginosa PA01
gcugccuggggacggcag

SEQ ID NO: 3400706 - RNA, 22 nt, Pseudomonas aeruginosa PA01
gcugccuggggacggcaggccc

SEQ ID NO: 3400707 - RNA, 20 nt, Pseudomonas aeruginosa PA01
gcugccugucgcagcgggca

SEQ ID NO: 3400708 - RNA, 14 nt, Pseudomonas aeruginosa PA01
gcugccuuccagca

SEQ ID NO: 3400709 - RNA, 15 nt, Pseudomonas aeruginosa PA01
gcugccuuccagcag

SEQ ID NO: 3400710 - RNA, 15 nt, Pseudomonas aeruginosa PA01
gcugccuucgaagcc

SEQ ID NO: 3400711 - RNA, 18 nt, Pseudomonas aeruginosa PA01
gcugccuucgacguagac

SEQ ID NO: 3400712 - RNA, 19 nt, Pseudomonas aeruginosa PA01
gcugcgaaucgucgccgga

SEQ ID NO: 3400713 - RNA, 15 nt, Pseudomonas aeruginosa PA01
gcugcgaccuggcgc

SEQ ID NO: 3400714 - RNA, 18 nt, Pseudomonas aeruginosa PA01
gcugcgaccuggcgccga

SEQ ID NO: 3400715 - RNA, 19 nt, Pseudomonas aeruginosa PA01
gcugcgaccuggcgccgaa

SEQ ID NO: 3400716 - RNA, 20 nt, Pseudomonas aeruginosa PA01
gcugcgagaacaggcggauc

SEQ ID NO: 3400717 - RNA, 21 nt, Pseudomonas aeruginosa PA01
gcugcgagcgcuucauccugc

SEQ ID NO: 3400718 - RNA, 16 nt, Pseudomonas aeruginosa PA01
gcugcgcaacugccgg

SEQ ID NO: 3400719 - RNA, 16 nt, Pseudomonas aeruginosa PA01
gcugcgcaccucggcc

SEQ ID NO: 3400720 - RNA, 14 nt, Pseudomonas aeruginosa PA01
gcugcgcaggccga

SEQ ID NO: 3400721 - RNA, 15 nt, Pseudomonas aeruginosa PA01
gcugcgcaggccgag

SEQ ID NO: 3400722 - RNA, 16 nt, Pseudomonas aeruginosa PA01
gcugcgcaggccgaga

SEQ ID NO: 3400723 - RNA, 14 nt, Pseudomonas aeruginosa PA01
gcugcgcagggcgc

SEQ ID NO: 3400724 - RNA, 16 nt, Pseudomonas aeruginosa PA01
gcugcgcagggcgccg

SEQ ID NO: 3400725 - RNA, 17 nt, Pseudomonas aeruginosa PA01
gcugcgcaucaggucgg

SEQ ID NO: 3400726 - RNA, 19 nt, Pseudomonas aeruginosa PA01
gcugcgcaucgccugggcc

SEQ ID NO: 3400727 - RNA, 21 nt, Pseudomonas aeruginosa PA01
gcugcgcaucgccugggccgg

SEQ ID NO: 3400728 - RNA, 15 nt, Pseudomonas aeruginosa PA01
gcugcgccaggccgu

SEQ ID NO: 3400729 - RNA, 12 nt, Pseudomonas aeruginosa PA01
gcugcgcccgcu

SEQ ID NO: 3400730 - RNA, 17 nt, Pseudomonas aeruginosa PA01
gcugcgcccgcucgacc

SEQ ID NO: 3400731 - RNA, 15 nt, Pseudomonas aeruginosa PA01
gcugcgccgccgucu

SEQ ID NO: 3400732 - RNA, 17 nt, Pseudomonas aeruginosa PA01
gcugcgccgccuuucug

SEQ ID NO: 3400733 - RNA, 21 nt, Pseudomonas aeruginosa PA01
gcugcgccgcguucgccgagc

SEQ ID NO: 3400734 - RNA, 18 nt, Pseudomonas aeruginosa PA01
gcugcgccgcugcggcug

SEQ ID NO: 3400735 - RNA, 13 nt, Pseudomonas aeruginosa PA01
gcugcgccggcgc

SEQ ID NO: 3400736 - RNA, 19 nt, Pseudomonas aeruginosa PA01
gcugcgccggcgcugcgag

SEQ ID NO: 3400737 - RNA, 18 nt, Pseudomonas aeruginosa PA01
gcugcgccguuucgacga

SEQ ID NO: 3400738 - RNA, 14 nt, Pseudomonas aeruginosa PA01
gcugcgccuggccg

SEQ ID NO: 3400739 - RNA, 16 nt, Pseudomonas aeruginosa PA01
gcugcgccuggccgcg

SEQ ID NO: 3400740 - RNA, 18 nt, Pseudomonas aeruginosa PA01
gcugcgccuggccgcgca

SEQ ID NO: 3400741 - RNA, 19 nt, Pseudomonas aeruginosa PA01
gcugcgccuggccgcgcag

SEQ ID NO: 3400742 - RNA, 12 nt, Pseudomonas aeruginosa PA01
gcugcgcgccgc

SEQ ID NO: 3400743 - RNA, 13 nt, Pseudomonas aeruginosa PA01
gcugcgcgccgca

SEQ ID NO: 3400744 - RNA, 14 nt, Pseudomonas aeruginosa PA01
gcugcgcgccgcaa

SEQ ID NO: 3400745 - RNA, 16 nt, Pseudomonas aeruginosa PA01
gcugcgcgccgggucg

SEQ ID NO: 3400746 - RNA, 14 nt, Pseudomonas aeruginosa PA01
gcugcgcggccugc

SEQ ID NO: 3400747 - RNA, 18 nt, Pseudomonas aeruginosa PA01
gcugcgcggcgucggcga

SEQ ID NO: 3400748 - RNA, 13 nt, Pseudomonas aeruginosa PA01
gcugcgcgggucg

SEQ ID NO: 3400749 - RNA, 22 nt, Pseudomonas aeruginosa PA01
gcugcgcgggucguccuccacc

SEQ ID NO: 3400750 - RNA, 20 nt, Pseudomonas aeruginosa PA01
gcugcgcgggugucgcgacg

SEQ ID NO: 3400751 - RNA, 18 nt, Pseudomonas aeruginosa PA01
gcugcgcguacaucccgc

SEQ ID NO: 3400752 - RNA, 22 nt, Pseudomonas aeruginosa PA01
gcugcgcguacaucccgccgau

SEQ ID NO: 3400753 - RNA, 14 nt, Pseudomonas aeruginosa PA01
gcugcgcuccaggc

SEQ ID NO: 3400754 - RNA, 21 nt, Pseudomonas aeruginosa PA01
gcugcgcugccagcgccgccg

SEQ ID NO: 3400755 - RNA, 16 nt, Pseudomonas aeruginosa PA01
gcugcgcugggcgccg

SEQ ID NO: 3400756 - RNA, 17 nt, Pseudomonas aeruginosa PA01
gcugcgcugggcgccga

SEQ ID NO: 3400757 - RNA, 13 nt, Pseudomonas aeruginosa PA01
gcugcgcuugcug

SEQ ID NO: 3400758 - RNA, 15 nt, Pseudomonas aeruginosa PA01
gcuggaacggccagg

SEQ ID NO: 3400759 - RNA, 16 nt, Pseudomonas aeruginosa PA01
gcuggaacggccaggu

SEQ ID NO: 3400760 - RNA, 15 nt, Pseudomonas aeruginosa PA01
gcuggaagccgcgcu

SEQ ID NO: 3400761 - RNA, 20 nt, Pseudomonas aeruginosa PA01
gcuggaagccgcgcucgcgg

SEQ ID NO: 3400762 - RNA, 17 nt, Pseudomonas aeruginosa PA01
gcuggaagucgcccugc

SEQ ID NO: 3400763 - RNA, 17 nt, Pseudomonas aeruginosa PA01
gcuggaagucguccagc

SEQ ID NO: 3400764 - RNA, 18 nt, Pseudomonas aeruginosa PA01
gcuggaagucguccagca

SEQ ID NO: 3400765 - RNA, 22 nt, Pseudomonas aeruginosa PA01
gcuggaaguuguacagcgaggc

SEQ ID NO: 3400766 - RNA, 21 nt, Pseudomonas aeruginosa PA01
gcuggacaagguuugcgccgc

SEQ ID NO: 3400767 - RNA, 23 nt, Pseudomonas aeruginosa PA01
gcuggacaagguuugcgccgccg

SEQ ID NO: 3400768 - RNA, 17 nt, Pseudomonas aeruginosa PA01
gcuggacacgguccagg

SEQ ID NO: 3400769 - RNA, 20 nt, Pseudomonas aeruginosa PA01
gcuggacacgguccaggauc

SEQ ID NO: 3400770 - RNA, 15 nt, Pseudomonas aeruginosa PA01
gcuggacaggcgcag

SEQ ID NO: 3400771 - RNA, 20 nt, Pseudomonas aeruginosa PA01
gcuggacaggcgcaggggcg

SEQ ID NO: 3400772 - RNA, 21 nt, Pseudomonas aeruginosa PA01
gcuggacaggcgcaggggcga

SEQ ID NO: 3400773 - RNA, 16 nt, Pseudomonas aeruginosa PA01
gcuggaccaccguggc

SEQ ID NO: 3400774 - RNA, 19 nt, Pseudomonas aeruginosa PA01
gcuggaccaccguggcgcc

SEQ ID NO: 3400775 - RNA, 20 nt, Pseudomonas aeruginosa PA01
gcuggaccaccguggcgccg

SEQ ID NO: 3400776 - RNA, 21 nt, Pseudomonas aeruginosa PA01
gcuggaccaccguggcgccgg

SEQ ID NO: 3400777 - RNA, 22 nt, Pseudomonas aeruginosa PA01
gcuggaccaccguggcgccggc

SEQ ID NO: 3400778 - RNA, 15 nt, Pseudomonas aeruginosa PA01
gcuggaccaggcggc

SEQ ID NO: 3400779 - RNA, 18 nt, Pseudomonas aeruginosa PA01
gcuggaccaggcggccgg

SEQ ID NO: 3400780 - RNA, 19 nt, Pseudomonas aeruginosa PA01
gcuggaccaggcggccggu

SEQ ID NO: 3400781 - RNA, 22 nt, Pseudomonas aeruginosa PA01
gcuggaccaguucagcgcgcuc

SEQ ID NO: 3400782 - RNA, 20 nt, Pseudomonas aeruginosa PA01
gcuggaccauggccggcgug

SEQ ID NO: 3400783 - RNA, 18 nt, Pseudomonas aeruginosa PA01
gcuggacccgcaccugga

SEQ ID NO: 3400784 - RNA, 17 nt, Pseudomonas aeruginosa PA01
gcuggaccuccuggcgc

SEQ ID NO: 3400785 - RNA, 18 nt, Pseudomonas aeruginosa PA01
gcuggaccuccuggcgcg

SEQ ID NO: 3400786 - RNA, 15 nt, Pseudomonas aeruginosa PA01
gcuggacgacgcugg

SEQ ID NO: 3400787 - RNA, 18 nt, Pseudomonas aeruginosa PA01
gcuggacgacgcuggccu

SEQ ID NO: 3400788 - RNA, 22 nt, Pseudomonas aeruginosa PA01
gcuggacgacgcuggccugccg

SEQ ID NO: 3400789 - RNA, 22 nt, Pseudomonas aeruginosa PA01
gcuggacgugcaggaucaccug

SEQ ID NO: 3400790 - RNA, 15 nt, Pseudomonas aeruginosa PA01
gcuggacucgcgcca

SEQ ID NO: 3400791 - RNA, 17 nt, Pseudomonas aeruginosa PA01
gcuggacucgcgccagu

SEQ ID NO: 3400792 - RNA, 12 nt, Pseudomonas aeruginosa PA01
gcuggacuuccc

SEQ ID NO: 3400793 - RNA, 13 nt, Pseudomonas aeruginosa PA01
gcuggacuucccg

SEQ ID NO: 3400794 - RNA, 19 nt, Pseudomonas aeruginosa PA01
gcuggacuucggucucguc

SEQ ID NO: 3400795 - RNA, 12 nt, Pseudomonas aeruginosa PA01
gcuggagcagca

SEQ ID NO: 3400796 - RNA, 14 nt, Pseudomonas aeruginosa PA01
gcuggagcagcagc

SEQ ID NO: 3400797 - RNA, 17 nt, Pseudomonas aeruginosa PA01
gcuggagcagcagcgcc

SEQ ID NO: 3400798 - RNA, 19 nt, Pseudomonas aeruginosa PA01
gcuggagcagcagcgccgc

SEQ ID NO: 3400799 - RNA, 13 nt, Pseudomonas aeruginosa PA01
gcuggagcgcugc

SEQ ID NO: 3400800 - RNA, 15 nt, Pseudomonas aeruginosa PA01
gcuggagcgcugcgg

SEQ ID NO: 3400801 - RNA, 19 nt, Pseudomonas aeruginosa PA01
gcuggagcgcugcggaaga

SEQ ID NO: 3400802 - RNA, 15 nt, Pseudomonas aeruginosa PA01
gcuggagcugcgcgc

SEQ ID NO: 3400803 - RNA, 17 nt, Pseudomonas aeruginosa PA01
gcuggagcugcgcgcga

SEQ ID NO: 3400804 - RNA, 19 nt, Pseudomonas aeruginosa PA01
gcuggagcugcgcgcgauc

SEQ ID NO: 3400805 - RNA, 19 nt, Pseudomonas aeruginosa PA01
gcuggaggcuggggacgga

SEQ ID NO: 3400806 - RNA, 16 nt, Pseudomonas aeruginosa PA01
gcuggaguagcugaag

SEQ ID NO: 3400807 - RNA, 21 nt, Pseudomonas aeruginosa PA01
gcuggaguagcugaagcuguc

SEQ ID NO: 3400808 - RNA, 18 nt, Pseudomonas aeruginosa PA01
gcuggaguaucgcccugg

SEQ ID NO: 3400809 - RNA, 21 nt, Pseudomonas aeruginosa PA01
gcuggaguaucgcccuggccu

SEQ ID NO: 3400810 - RNA, 12 nt, Pseudomonas aeruginosa PA01
gcuggauagagu

SEQ ID NO: 3400811 - RNA, 20 nt, Pseudomonas aeruginosa PA01
gcuggauagaguacucggcu

SEQ ID NO: 3400812 - RNA, 18 nt, Pseudomonas aeruginosa PA01
gcuggauccgugccaggc

SEQ ID NO: 3400813 - RNA, 19 nt, Pseudomonas aeruginosa PA01
gcuggauccgugccaggcg

SEQ ID NO: 3400814 - RNA, 20 nt, Pseudomonas aeruginosa PA01
gcuggauccgugccaggcgc

SEQ ID NO: 3400815 - RNA, 22 nt, Pseudomonas aeruginosa PA01
gcuggauccucgccucgcgcca

SEQ ID NO: 3400816 - RNA, 23 nt, Pseudomonas aeruginosa PA01
gcuggauccucgccucgcgccag

SEQ ID NO: 3400817 - RNA, 15 nt, Pseudomonas aeruginosa PA01
gcuggauccuggaag

SEQ ID NO: 3400818 - RNA, 14 nt, Pseudomonas aeruginosa PA01
gcuggaucggcagg

SEQ ID NO: 3400819 - RNA, 16 nt, Pseudomonas aeruginosa PA01
gcuggaucggcaggcu

SEQ ID NO: 3400820 - RNA, 15 nt, Pseudomonas aeruginosa PA01
gcuggaucuggugga

SEQ ID NO: 3400821 - RNA, 21 nt, Pseudomonas aeruginosa PA01
gcuggaucugguggaacagca

SEQ ID NO: 3400822 - RNA, 22 nt, Pseudomonas aeruginosa PA01
gcuggaugcccuccugggccug

SEQ ID NO: 3400823 - RNA, 15 nt, Pseudomonas aeruginosa PA01
gcuggaugccgacca

SEQ ID NO: 3400824 - RNA, 16 nt, Pseudomonas aeruginosa PA01
gcuggauggggcugau

SEQ ID NO: 3400825 - RNA, 18 nt, Pseudomonas aeruginosa PA01
gcuggauuucgccgagug

SEQ ID NO: 3400826 - RNA, 14 nt, Pseudomonas aeruginosa PA01
gcuggcacaggucc

SEQ ID NO: 3400827 - RNA, 17 nt, Pseudomonas aeruginosa PA01
gcuggcaccggccaggc

SEQ ID NO: 3400828 - RNA, 20 nt, Pseudomonas aeruginosa PA01
gcuggcaccggccaggcgcu

SEQ ID NO: 3400829 - RNA, 16 nt, Pseudomonas aeruginosa PA01
gcuggcagggcgcguc

SEQ ID NO: 3400830 - RNA, 12 nt, Pseudomonas aeruginosa PA01
gcuggcaggugc

SEQ ID NO: 3400831 - RNA, 23 nt, Pseudomonas aeruginosa PA01
gcuggcagguugauccugggcgc

SEQ ID NO: 3400832 - RNA, 20 nt, Pseudomonas aeruginosa PA01
gcuggcagguugugcggggu

SEQ ID NO: 3400833 - RNA, 14 nt, Pseudomonas aeruginosa PA01
gcuggcauaaccgg

SEQ ID NO: 3400834 - RNA, 18 nt, Pseudomonas aeruginosa PA01
gcuggcauacacaugcag

SEQ ID NO: 3400835 - RNA, 24 nt, Pseudomonas aeruginosa PA01
gcuggcauacacaugcaggcucga

SEQ ID NO: 3400836 - RNA, 17 nt, Pseudomonas aeruginosa PA01
gcuggccaccagcaccu

SEQ ID NO: 3400837 - RNA, 19 nt, Pseudomonas aeruginosa PA01
gcuggccaccagcaccugc

SEQ ID NO: 3400838 - RNA, 21 nt, Pseudomonas aeruginosa PA01
gcuggccaccagcaccugcgg

SEQ ID NO: 3400839 - RNA, 23 nt, Pseudomonas aeruginosa PA01
gcuggccacccuugcgcccggcu

SEQ ID NO: 3400840 - RNA, 16 nt, Pseudomonas aeruginosa PA01
gcuggccaccgccagg

SEQ ID NO: 3400841 - RNA, 17 nt, Pseudomonas aeruginosa PA01
gcuggccaccgccagga

SEQ ID NO: 3400842 - RNA, 14 nt, Pseudomonas aeruginosa PA01
gcuggccaccgcgg

SEQ ID NO: 3400843 - RNA, 21 nt, Pseudomonas aeruginosa PA01
gcuggccaccgcggcguccgc

SEQ ID NO: 3400844 - RNA, 23 nt, Pseudomonas aeruginosa PA01
gcuggccaccgcggcguccgcgu

SEQ ID NO: 3400845 - RNA, 17 nt, Pseudomonas aeruginosa PA01
gcuggccaccgggauca

SEQ ID NO: 3400846 - RNA, 22 nt, Pseudomonas aeruginosa PA01
gcuggccaccgggaucagcggc

SEQ ID NO: 3400847 - RNA, 18 nt, Pseudomonas aeruginosa PA01
gcuggccacgaacaggcu

SEQ ID NO: 3400848 - RNA, 20 nt, Pseudomonas aeruginosa PA01
gcuggccagaauuccagcag

SEQ ID NO: 3400849 - RNA, 21 nt, Pseudomonas aeruginosa PA01
gcuggccagaauuccagcagg

SEQ ID NO: 3400850 - RNA, 13 nt, Pseudomonas aeruginosa PA01
gcuggccagcaau

SEQ ID NO: 3400851 - RNA, 13 nt, Pseudomonas aeruginosa PA01
gcuggccagcagg

SEQ ID NO: 3400852 - RNA, 18 nt, Pseudomonas aeruginosa PA01
gcuggccagcaggcuggc

SEQ ID NO: 3400853 - RNA, 20 nt, Pseudomonas aeruginosa PA01
gcuggccagcaggcuggcgg

SEQ ID NO: 3400854 - RNA, 12 nt, Pseudomonas aeruginosa PA01
gcuggccagccc

SEQ ID NO: 3400855 - RNA, 16 nt, Pseudomonas aeruginosa PA01
gcuggccagcccuggu

SEQ ID NO: 3400856 - RNA, 18 nt, Pseudomonas aeruginosa PA01
gcuggccagcccugguag

SEQ ID NO: 3400857 - RNA, 19 nt, Pseudomonas aeruginosa PA01
gcuggccagguaggggucg

SEQ ID NO: 3400858 - RNA, 21 nt, Pseudomonas aeruginosa PA01
gcuggccauccauaucggcca

SEQ ID NO: 3400859 - RNA, 18 nt, Pseudomonas aeruginosa PA01
gcuggccauccgcccugc

SEQ ID NO: 3400860 - RNA, 14 nt, Pseudomonas aeruginosa PA01
gcuggcgcugaccg

SEQ ID NO: 3400861 - RNA, 18 nt, Pseudomonas aeruginosa PA01
gcuggcgcuugccgcgcc

SEQ ID NO: 3400862 - RNA, 19 nt, Pseudomonas aeruginosa PA01
gcuggcgcuugccgcgccc

SEQ ID NO: 3400863 - RNA, 20 nt, Pseudomonas aeruginosa PA01
gcuggcgcuugccgcgcccg

SEQ ID NO: 3400864 - RNA, 21 nt, Pseudomonas aeruginosa PA01
gcuggcgcuugccgcgcccgg

SEQ ID NO: 3400865 - RNA, 20 nt, Pseudomonas aeruginosa PA01
gcuggcggaaggugccuucg

SEQ ID NO: 3400866 - RNA, 21 nt, Pseudomonas aeruginosa PA01
gcuggcggauguaguccagcg

SEQ ID NO: 3400867 - RNA, 16 nt, Pseudomonas aeruginosa PA01
gcuggcggcaucggcg

SEQ ID NO: 3400868 - RNA, 17 nt, Pseudomonas aeruginosa PA01
gcuggcggcaucggcgc

SEQ ID NO: 3400869 - RNA, 19 nt, Pseudomonas aeruginosa PA01
gcuggcggcaucggcgccg

SEQ ID NO: 3400870 - RNA, 20 nt, Pseudomonas aeruginosa PA01
gcuggcggcaucggcgccgc

SEQ ID NO: 3400871 - RNA, 12 nt, Pseudomonas aeruginosa PA01
gcuggcggcaug

SEQ ID NO: 3400872 - RNA, 15 nt, Pseudomonas aeruginosa PA01
gcuggcggccagggc

SEQ ID NO: 3400873 - RNA, 16 nt, Pseudomonas aeruginosa PA01
gcuggcggccagggca

SEQ ID NO: 3400874 - RNA, 18 nt, Pseudomonas aeruginosa PA01
gcuggcggccgaguucgc

SEQ ID NO: 3400875 - RNA, 14 nt, Pseudomonas aeruginosa PA01
gcuggcggccuucg

SEQ ID NO: 3400876 - RNA, 15 nt, Pseudomonas aeruginosa PA01
gcuggcggccuucgg

SEQ ID NO: 3400877 - RNA, 21 nt, Pseudomonas aeruginosa PA01
gcuggcggccuucggcgucga

SEQ ID NO: 3400878 - RNA, 14 nt, Pseudomonas aeruginosa PA01
gcuggcggcgacga

SEQ ID NO: 3400879 - RNA, 14 nt, Pseudomonas aeruginosa PA01
gcuggcggcucggc

SEQ ID NO: 3400880 - RNA, 15 nt, Pseudomonas aeruginosa PA01
gcuggcggcucggcu

SEQ ID NO: 3400881 - RNA, 16 nt, Pseudomonas aeruginosa PA01
gcuggcggcucggcug

SEQ ID NO: 3400882 - RNA, 24 nt, Pseudomonas aeruginosa PA01
gcuggcggcucggcugcuugccgg

SEQ ID NO: 3400883 - RNA, 18 nt, Pseudomonas aeruginosa PA01
gcuggcggggucgcgccg

SEQ ID NO: 3400884 - RNA, 13 nt, Pseudomonas aeruginosa PA01
gcuggcguaccuc

SEQ ID NO: 3400885 - RNA, 20 nt, Pseudomonas aeruginosa PA01
gcuggcguaccucgccaggc

SEQ ID NO: 3400886 - RNA, 23 nt, Pseudomonas aeruginosa PA01
gcuggcguacuugggcaucagcu

SEQ ID NO: 3400887 - RNA, 14 nt, Pseudomonas aeruginosa PA01
gcuggcgucgaccg

SEQ ID NO: 3400888 - RNA, 16 nt, Pseudomonas aeruginosa PA01
gcuggcgucgaccgcc

SEQ ID NO: 3400889 - RNA, 17 nt, Pseudomonas aeruginosa PA01
gcuggcgucgaccgccu

SEQ ID NO: 3400890 - RNA, 20 nt, Pseudomonas aeruginosa PA01
gcuggcgucgaccgccugcc

SEQ ID NO: 3400891 - RNA, 12 nt, Pseudomonas aeruginosa PA01
gcuggcgucggg

SEQ ID NO: 3400892 - RNA, 19 nt, Pseudomonas aeruginosa PA01
gcuggcguucucggccagg

SEQ ID NO: 3400893 - RNA, 22 nt, Pseudomonas aeruginosa PA01
gcuggcguucucggccagguac

SEQ ID NO: 3400894 - RNA, 23 nt, Pseudomonas aeruginosa PA01
gcuggcguugacugccugcaggu

SEQ ID NO: 3400895 - RNA, 15 nt, Pseudomonas aeruginosa PA01
gcuggcuaucuuuua

SEQ ID NO: 3400896 - RNA, 16 nt, Pseudomonas aeruginosa PA01
gcuggcuauucgccca

SEQ ID NO: 3400897 - RNA, 17 nt, Pseudomonas aeruginosa PA01
gcuggcuauucgcccag

SEQ ID NO: 3400898 - RNA, 19 nt, Pseudomonas aeruginosa PA01
gcuggcugacagcuugucg

SEQ ID NO: 3400899 - RNA, 24 nt, Pseudomonas aeruginosa PA01
gcuggcugcccaguugcgcggcga

SEQ ID NO: 3400900 - RNA, 18 nt, Pseudomonas aeruginosa PA01
gcuggcugcccucgacga

SEQ ID NO: 3400901 - RNA, 13 nt, Pseudomonas aeruginosa PA01
gcuggcugguaac

SEQ ID NO: 3400902 - RNA, 19 nt, Pseudomonas aeruginosa PA01
gcuggcugguaacgggcga

SEQ ID NO: 3400903 - RNA, 20 nt, Pseudomonas aeruginosa PA01
gcuggcugguaacgggcgaa

SEQ ID NO: 3400904 - RNA, 16 nt, Pseudomonas aeruginosa PA01
gcuggcuguaggugcc

SEQ ID NO: 3400905 - RNA, 22 nt, Pseudomonas aeruginosa PA01
gcuggcuuccugcuugucgaug

SEQ ID NO: 3400906 - RNA, 16 nt, Pseudomonas aeruginosa PA01
gcugggacggcggcug

SEQ ID NO: 3400907 - RNA, 17 nt, Pseudomonas aeruginosa PA01
gcugggacggcggcugg

SEQ ID NO: 3400908 - RNA, 13 nt, Pseudomonas aeruginosa PA01
gcugggcagcgcc

SEQ ID NO: 3400909 - RNA, 16 nt, Pseudomonas aeruginosa PA01
gcugggcagcgccgcc

SEQ ID NO: 3400910 - RNA, 17 nt, Pseudomonas aeruginosa PA01
gcugggcagcgccgccg

SEQ ID NO: 3400911 - RNA, 14 nt, Pseudomonas aeruginosa PA01
gcugggccagcgcc

SEQ ID NO: 3400912 - RNA, 16 nt, Pseudomonas aeruginosa PA01
gcugggccagcgccgu

SEQ ID NO: 3400913 - RNA, 18 nt, Pseudomonas aeruginosa PA01
gcugggccgaaccggggc

SEQ ID NO: 3400914 - RNA, 17 nt, Pseudomonas aeruginosa PA01
gcugggccuugagcagg

SEQ ID NO: 3400915 - RNA, 22 nt, Pseudomonas aeruginosa PA01
gcugggccuugagcaggcguuc

SEQ ID NO: 3400916 - RNA, 19 nt, Pseudomonas aeruginosa PA01
gcugggccuuguucagggu

SEQ ID NO: 3400917 - RNA, 23 nt, Pseudomonas aeruginosa PA01
gcugggccuuguucaggguggcg

SEQ ID NO: 3400918 - RNA, 18 nt, Pseudomonas aeruginosa PA01
gcugggcgaccuucagcg

SEQ ID NO: 3400919 - RNA, 12 nt, Pseudomonas aeruginosa PA01
gcugggcgcccu

SEQ ID NO: 3400920 - RNA, 20 nt, Pseudomonas aeruginosa PA01
gcugggcgcccuucagcgcc

SEQ ID NO: 3400921 - RNA, 13 nt, Pseudomonas aeruginosa PA01
gcugggcgccgau

SEQ ID NO: 3400922 - RNA, 14 nt, Pseudomonas aeruginosa PA01
gcugggcgccggca

SEQ ID NO: 3400923 - RNA, 17 nt, Pseudomonas aeruginosa PA01
gcugggcgccucgucga

SEQ ID NO: 3400924 - RNA, 23 nt, Pseudomonas aeruginosa PA01
gcugggcgucgaacaccggcgcc

SEQ ID NO: 3400925 - RNA, 16 nt, Pseudomonas aeruginosa PA01
gcugggcugggucggc

SEQ ID NO: 3400926 - RNA, 19 nt, Pseudomonas aeruginosa PA01
gcuggggaacugggcgagc

SEQ ID NO: 3400927 - RNA, 17 nt, Pseudomonas aeruginosa PA01
gcuggggaccgcaccug

SEQ ID NO: 3400928 - RNA, 16 nt, Pseudomonas aeruginosa PA01
gcuggggacggaagca

SEQ ID NO: 3400929 - RNA, 20 nt, Pseudomonas aeruginosa PA01
gcuggggacggaagcauggc

SEQ ID NO: 3400930 - RNA, 23 nt, Pseudomonas aeruginosa PA01
gcuggggacggaagcauggccgg

SEQ ID NO: 3400931 - RNA, 14 nt, Pseudomonas aeruginosa PA01
gcuggggccggccu

SEQ ID NO: 3400932 - RNA, 18 nt, Pseudomonas aeruginosa PA01
gcuggggcuguugcuggg

SEQ ID NO: 3400933 - RNA, 21 nt, Pseudomonas aeruginosa PA01
gcuggggcuguugcugggcua

SEQ ID NO: 3400934 - RNA, 23 nt, Pseudomonas aeruginosa PA01
gcuggggugcagauggucgccgg

SEQ ID NO: 3400935 - RNA, 17 nt, Pseudomonas aeruginosa PA01
gcugggguugcggcgcc

SEQ ID NO: 3400936 - RNA, 18 nt, Pseudomonas aeruginosa PA01
gcugggguugcggcgccc

SEQ ID NO: 3400937 - RNA, 21 nt, Pseudomonas aeruginosa PA01
gcuggguacgguuggccagcg

SEQ ID NO: 3400938 - RNA, 15 nt, Pseudomonas aeruginosa PA01
gcugggucacgucca

SEQ ID NO: 3400939 - RNA, 23 nt, Pseudomonas aeruginosa PA01
gcugggucaucgaggccaucccc

SEQ ID NO: 3400940 - RNA, 18 nt, Pseudomonas aeruginosa PA01
gcugggugcggugggcga

SEQ ID NO: 3400941 - RNA, 20 nt, Pseudomonas aeruginosa PA01
gcugggugucgaccuccgcc

SEQ ID NO: 3400942 - RNA, 16 nt, Pseudomonas aeruginosa PA01
gcuggguuggcgcgag

SEQ ID NO: 3400943 - RNA, 13 nt, Pseudomonas aeruginosa PA01
gcuggguuuccug

SEQ ID NO: 3400944 - RNA, 23 nt, Pseudomonas aeruginosa PA01
gcugguaacgggcgaacccgaau

SEQ ID NO: 3400945 - RNA, 21 nt, Pseudomonas aeruginosa PA01
gcugguaccugccggcacgcu

SEQ ID NO: 3400946 - RNA, 14 nt, Pseudomonas aeruginosa PA01
gcugguagcccagg

SEQ ID NO: 3400947 - RNA, 17 nt, Pseudomonas aeruginosa PA01
gcugguagcccaggccg

SEQ ID NO: 3400948 - RNA, 18 nt, Pseudomonas aeruginosa PA01
gcugguagcccaggccga

SEQ ID NO: 3400949 - RNA, 20 nt, Pseudomonas aeruginosa PA01
gcugguagcccaggccgaag

SEQ ID NO: 3400950 - RNA, 21 nt, Pseudomonas aeruginosa PA01
gcugguagcuaccgucggccu

SEQ ID NO: 3400951 - RNA, 14 nt, Pseudomonas aeruginosa PA01
gcugguaugcagca

SEQ ID NO: 3400952 - RNA, 14 nt, Pseudomonas aeruginosa PA01
gcuggucaggcuga

SEQ ID NO: 3400953 - RNA, 18 nt, Pseudomonas aeruginosa PA01
gcuggucaguucggccca

SEQ ID NO: 3400954 - RNA, 13 nt, Pseudomonas aeruginosa PA01
gcugguccagcac

SEQ ID NO: 3400955 - RNA, 14 nt, Pseudomonas aeruginosa PA01
gcugguccagcacg

SEQ ID NO: 3400956 - RNA, 15 nt, Pseudomonas aeruginosa PA01
gcugguccagcacgc

SEQ ID NO: 3400957 - RNA, 19 nt, Pseudomonas aeruginosa PA01
gcugguccagcacgcuggc

SEQ ID NO: 3400958 - RNA, 20 nt, Pseudomonas aeruginosa PA01
gcugguccagcacgcuggcg

SEQ ID NO: 3400959 - RNA, 18 nt, Pseudomonas aeruginosa PA01
gcugguccagcuggcgca

SEQ ID NO: 3400960 - RNA, 20 nt, Pseudomonas aeruginosa PA01
gcugguccagcuggcgcagc

SEQ ID NO: 3400961 - RNA, 14 nt, Pseudomonas aeruginosa PA01
gcugguccuggcgc

SEQ ID NO: 3400962 - RNA, 16 nt, Pseudomonas aeruginosa PA01
gcugugcaucugcgac

SEQ ID NO: 3400963 - RNA, 20 nt, Pseudomonas aeruginosa PA01
gcugugccauuccugggccc

SEQ ID NO: 3400964 - RNA, 13 nt, Pseudomonas aeruginosa PA01
gcugugccccagg

SEQ ID NO: 3400965 - RNA, 16 nt, Pseudomonas aeruginosa PA01
gcugugcgccaggccg

SEQ ID NO: 3400966 - RNA, 24 nt, Pseudomonas aeruginosa PA01
gcugugcguuucguugcggaacgc

SEQ ID NO: 3400967 - RNA, 17 nt, Pseudomonas aeruginosa PA01
gcugugcucgaggaagc

SEQ ID NO: 3400968 - RNA, 16 nt, Pseudomonas aeruginosa PA01
gcugugcugcaccagc

SEQ ID NO: 3400969 - RNA, 14 nt, Pseudomonas aeruginosa PA01
gcugugcuggccac

SEQ ID NO: 3400970 - RNA, 19 nt, Pseudomonas aeruginosa PA01
gcugugcuggccacccuug

SEQ ID NO: 3400971 - RNA, 17 nt, Pseudomonas aeruginosa PA01
gcuguggaaguacggcg

SEQ ID NO: 3400972 - RNA, 18 nt, Pseudomonas aeruginosa PA01
gcugugguuguggguaug

SEQ ID NO: 3400973 - RNA, 13 nt, Pseudomonas aeruginosa PA01
gcuguguccggcg

SEQ ID NO: 3400974 - RNA, 15 nt, Pseudomonas aeruginosa PA01
gcuguguccggcgga

SEQ ID NO: 3400975 - RNA, 15 nt, Pseudomonas aeruginosa PA01
gcugugugccucuga

SEQ ID NO: 3400976 - RNA, 20 nt, Pseudomonas aeruginosa PA01
gcugugugccucugaccgcg

SEQ ID NO: 3400977 - RNA, 14 nt, Pseudomonas aeruginosa PA01
gcuguucagcagga

SEQ ID NO: 3400978 - RNA, 17 nt, Pseudomonas aeruginosa PA01
gcuguucagcgggugcc

SEQ ID NO: 3400979 - RNA, 13 nt, Pseudomonas aeruginosa PA01
gcuguuccucguc

SEQ ID NO: 3400980 - RNA, 15 nt, Pseudomonas aeruginosa PA01
gcuguuccucgucga

SEQ ID NO: 3400981 - RNA, 22 nt, Pseudomonas aeruginosa PA01
gcuguucgggucgcguucgucg

SEQ ID NO: 3400982 - RNA, 18 nt, Pseudomonas aeruginosa PA01
gcuguucuugauccgcuc

SEQ ID NO: 3400983 - RNA, 15 nt, Pseudomonas aeruginosa PA01
gcuguugccagggau

SEQ ID NO: 3400984 - RNA, 16 nt, Pseudomonas aeruginosa PA01
gcuguugcccugggcc

SEQ ID NO: 3400985 - RNA, 20 nt, Pseudomonas aeruginosa PA01
gcuguugcccugggccggcg

SEQ ID NO: 3400986 - RNA, 13 nt, Pseudomonas aeruginosa PA01
gcuguugccgcug

SEQ ID NO: 3400987 - RNA, 15 nt, Pseudomonas aeruginosa PA01
gcuguugccgcugca

SEQ ID NO: 3400988 - RNA, 19 nt, Pseudomonas aeruginosa PA01
gcuguugccgcugcaggcc

SEQ ID NO: 3400989 - RNA, 19 nt, Pseudomonas aeruginosa PA01
gcuguugccguggcggcgc

SEQ ID NO: 3400990 - RNA, 21 nt, Pseudomonas aeruginosa PA01
gcuguugccguggcggcgcgc

SEQ ID NO: 3400991 - RNA, 22 nt, Pseudomonas aeruginosa PA01
gcuguugccguggcggcgcgcg

SEQ ID NO: 3400992 - RNA, 22 nt, Pseudomonas aeruginosa PA01
gcuguugccguucugugcggcg

SEQ ID NO: 3400993 - RNA, 17 nt, Pseudomonas aeruginosa PA01
gcuguuucagcccacgc

SEQ ID NO: 3400994 - RNA, 22 nt, Pseudomonas aeruginosa PA01
gcuguuucagcccacgcgccug

SEQ ID NO: 3400995 - RNA, 14 nt, Pseudomonas aeruginosa PA01
gcuguuucaggccg

SEQ ID NO: 3400996 - RNA, 16 nt, Pseudomonas aeruginosa PA01
gcuguuucaggccggc

SEQ ID NO: 3400997 - RNA, 18 nt, Pseudomonas aeruginosa PA01
gcuguuucaggccggcgu

SEQ ID NO: 3400998 - RNA, 15 nt, Pseudomonas aeruginosa PA01
gcuguuugcggcgca

SEQ ID NO: 3400999 - RNA, 18 nt, Pseudomonas aeruginosa PA01
gcuguuugcggcgcaggc

SEQ ID NO: 3401000 - RNA, 19 nt, Pseudomonas aeruginosa PA01
gcuguuugcggcgcaggcg

SEQ ID NO: 3401001 - RNA, 14 nt, Pseudomonas aeruginosa PA01
gcuuacccgcgacc

SEQ ID NO: 3401002 - RNA, 15 nt, Pseudomonas aeruginosa PA01
gcuuacccgcgacca

SEQ ID NO: 3401003 - RNA, 21 nt, Pseudomonas aeruginosa PA01
gcuuacccgcgaccacaggcg

SEQ ID NO: 3401004 - RNA, 22 nt, Pseudomonas aeruginosa PA01
gcuuacggagaagggcgcgccc

SEQ ID NO: 3401005 - RNA, 12 nt, Pseudomonas aeruginosa PA01
gcuuagcccggg

SEQ ID NO: 3401006 - RNA, 15 nt, Pseudomonas aeruginosa PA01
gcuuagcccgggauc

SEQ ID NO: 3401007 - RNA, 15 nt, Pseudomonas aeruginosa PA01
gcuucaaccguggcu

SEQ ID NO: 3401008 - RNA, 18 nt, Pseudomonas aeruginosa PA01
gcuucaaccguggcucga

SEQ ID NO: 3401009 - RNA, 19 nt, Pseudomonas aeruginosa PA01
gcuucaacgcgacgguuga

SEQ ID NO: 3401010 - RNA, 18 nt, Pseudomonas aeruginosa PA01
gcuucacucauccucgcc

SEQ ID NO: 3401011 - RNA, 12 nt, Pseudomonas aeruginosa PA01
gcuucagagcug

SEQ ID NO: 3401012 - RNA, 21 nt, Pseudomonas aeruginosa PA01
gcuucagccagaccggcagcg

SEQ ID NO: 3401013 - RNA, 17 nt, Pseudomonas aeruginosa PA01
gcuucagcccggcacca

SEQ ID NO: 3401014 - RNA, 14 nt, Pseudomonas aeruginosa PA01
gcuucagccgaccg

SEQ ID NO: 3401015 - RNA, 17 nt, Pseudomonas aeruginosa PA01
gcuucagcgccaggccg

SEQ ID NO: 3401016 - RNA, 21 nt, Pseudomonas aeruginosa PA01
gcuucagcgccgggucgaccu

SEQ ID NO: 3401017 - RNA, 15 nt, Pseudomonas aeruginosa PA01
gcuucagcgcgccga

SEQ ID NO: 3401018 - RNA, 21 nt, Pseudomonas aeruginosa PA01
gcuucagcgcgccgagccagg

SEQ ID NO: 3401019 - RNA, 22 nt, Pseudomonas aeruginosa PA01
gcuucagcgcgccgagccaggu

SEQ ID NO: 3401020 - RNA, 16 nt, Pseudomonas aeruginosa PA01
gcuucagcuccgagcc

SEQ ID NO: 3401021 - RNA, 12 nt, Pseudomonas aeruginosa PA01
gcuucagcuucu

SEQ ID NO: 3401022 - RNA, 21 nt, Pseudomonas aeruginosa PA01
gcuucagcuucuacuucggcu

SEQ ID NO: 3401023 - RNA, 13 nt, Pseudomonas aeruginosa PA01
gcuucaggcgcgc

SEQ ID NO: 3401024 - RNA, 17 nt, Pseudomonas aeruginosa PA01
gcuucaggguggcgcug

SEQ ID NO: 3401025 - RNA, 23 nt, Pseudomonas aeruginosa PA01
gcuucaggguggcgcugccuucg

SEQ ID NO: 3401026 - RNA, 12 nt, Pseudomonas aeruginosa PA01
gcuucagguagc

SEQ ID NO: 3401027 - RNA, 22 nt, Pseudomonas aeruginosa PA01
gcuucagguagcucaucggcga

SEQ ID NO: 3401028 - RNA, 22 nt, Pseudomonas aeruginosa PA01
gcuucagguagugcaacaccug

SEQ ID NO: 3401029 - RNA, 17 nt, Pseudomonas aeruginosa PA01
gcuucaggucgugcugg

SEQ ID NO: 3401030 - RNA, 15 nt, Pseudomonas aeruginosa PA01
gcuucaucaggcugc

SEQ ID NO: 3401031 - RNA, 14 nt, Pseudomonas aeruginosa PA01
gcuucauccugcgc

SEQ ID NO: 3401032 - RNA, 18 nt, Pseudomonas aeruginosa PA01
gcuucauccugcgcgccu

SEQ ID NO: 3401033 - RNA, 17 nt, Pseudomonas aeruginosa PA01
gcuucaucuccugcugg

SEQ ID NO: 3401034 - RNA, 16 nt, Pseudomonas aeruginosa PA01
gcuuccaccagacgca

SEQ ID NO: 3401035 - RNA, 19 nt, Pseudomonas aeruginosa PA01
gcuuccaccagacgcagca

SEQ ID NO: 3401036 - RNA, 20 nt, Pseudomonas aeruginosa PA01
gcuuccaccagacgcagcau

SEQ ID NO: 3401037 - RNA, 15 nt, Pseudomonas aeruginosa PA01
gcuuccaccgccugc

SEQ ID NO: 3401038 - RNA, 16 nt, Pseudomonas aeruginosa PA01
gcuuccaccgccugcc

SEQ ID NO: 3401039 - RNA, 17 nt, Pseudomonas aeruginosa PA01
gcuuccaccgccugccc

SEQ ID NO: 3401040 - RNA, 12 nt, Pseudomonas aeruginosa PA01
gcuuccagcacc

SEQ ID NO: 3401041 - RNA, 12 nt, Pseudomonas aeruginosa PA01
gcuuccagccag

SEQ ID NO: 3401042 - RNA, 13 nt, Pseudomonas aeruginosa PA01
gcuuccagccagc

SEQ ID NO: 3401043 - RNA, 18 nt, Pseudomonas aeruginosa PA01
gcuuccagccagcccucg

SEQ ID NO: 3401044 - RNA, 23 nt, Pseudomonas aeruginosa PA01
gcuuccagccagcccucggggaa

SEQ ID NO: 3401045 - RNA, 12 nt, Pseudomonas aeruginosa PA01
gcuuccaggcac

SEQ ID NO: 3401046 - RNA, 16 nt, Pseudomonas aeruginosa PA01
gcuuccaggcacgaau

SEQ ID NO: 3401047 - RNA, 20 nt, Pseudomonas aeruginosa PA01
gcuuccaggcgcgcuggaug

SEQ ID NO: 3401048 - RNA, 19 nt, Pseudomonas aeruginosa PA01
gcuuccaggguagcgccgc

SEQ ID NO: 3401049 - RNA, 15 nt, Pseudomonas aeruginosa PA01
gcuuccagugcuuga

SEQ ID NO: 3401050 - RNA, 12 nt, Pseudomonas aeruginosa PA01
gcuucccaggcc

SEQ ID NO: 3401051 - RNA, 13 nt, Pseudomonas aeruginosa PA01
gcuucccaggcca

SEQ ID NO: 3401052 - RNA, 17 nt, Pseudomonas aeruginosa PA01
gcuucccaggccagcgg

SEQ ID NO: 3401053 - RNA, 21 nt, Pseudomonas aeruginosa PA01
gcuucccaggccagcgggcug

SEQ ID NO: 3401054 - RNA, 16 nt, Pseudomonas aeruginosa PA01
gcuucccgcggcucca

SEQ ID NO: 3401055 - RNA, 19 nt, Pseudomonas aeruginosa PA01
gcuucccgcggcuccagcc

SEQ ID NO: 3401056 - RNA, 21 nt, Pseudomonas aeruginosa PA01
gcuuccgacucuccgcgccgc

SEQ ID NO: 3401057 - RNA, 22 nt, Pseudomonas aeruginosa PA01
gcuuccgacucuccgcgccgcg

SEQ ID NO: 3401058 - RNA, 14 nt, Pseudomonas aeruginosa PA01
gcuuccgccaggcg

SEQ ID NO: 3401059 - RNA, 22 nt, Pseudomonas aeruginosa PA01
gcuuccgccaggcgcagccagc

SEQ ID NO: 3401060 - RNA, 23 nt, Pseudomonas aeruginosa PA01
gcuuccgccaggcgcagccagca

SEQ ID NO: 3401061 - RNA, 14 nt, Pseudomonas aeruginosa PA01
gcuuccgccggcgc

SEQ ID NO: 3401062 - RNA, 15 nt, Pseudomonas aeruginosa PA01
gcuuccgccggcgcc

SEQ ID NO: 3401063 - RNA, 16 nt, Pseudomonas aeruginosa PA01
gcuuccgccggcgccg

SEQ ID NO: 3401064 - RNA, 17 nt, Pseudomonas aeruginosa PA01
gcuuccgccggcgccgc

SEQ ID NO: 3401065 - RNA, 18 nt, Pseudomonas aeruginosa PA01
gcuugaccgccgccgccu

SEQ ID NO: 3401066 - RNA, 15 nt, Pseudomonas aeruginosa PA01
gcuugaccgccgccu

SEQ ID NO: 3401067 - RNA, 21 nt, Pseudomonas aeruginosa PA01
gcuugaccuugccgccggucu

SEQ ID NO: 3401068 - RNA, 17 nt, Pseudomonas aeruginosa PA01
gcuugacgaaggcggca

SEQ ID NO: 3401069 - RNA, 20 nt, Pseudomonas aeruginosa PA01
gcuugacgacugcacgcaga

SEQ ID NO: 3401070 - RNA, 20 nt, Pseudomonas aeruginosa PA01
gcuugacgaugccguucagg

SEQ ID NO: 3401071 - RNA, 18 nt, Pseudomonas aeruginosa PA01
gcuugagaccuucgcggg

SEQ ID NO: 3401072 - RNA, 16 nt, Pseudomonas aeruginosa PA01
gcuugagcagccaggc

SEQ ID NO: 3401073 - RNA, 18 nt, Pseudomonas aeruginosa PA01
gcuugagcagccaggcga

SEQ ID NO: 3401074 - RNA, 21 nt, Pseudomonas aeruginosa PA01
gcuugagccauucggcuuccu

SEQ ID NO: 3401075 - RNA, 14 nt, Pseudomonas aeruginosa PA01
gcuugagccccggc

SEQ ID NO: 3401076 - RNA, 20 nt, Pseudomonas aeruginosa PA01
gcuugaggaaguagugcagc

SEQ ID NO: 3401077 - RNA, 19 nt, Pseudomonas aeruginosa PA01
gcuugaggaaguggccggu

SEQ ID NO: 3401078 - RNA, 17 nt, Pseudomonas aeruginosa PA01
gcuugagguaggccagc

SEQ ID NO: 3401079 - RNA, 21 nt, Pseudomonas aeruginosa PA01
gcuugagguaggccagcccca

SEQ ID NO: 3401080 - RNA, 23 nt, Pseudomonas aeruginosa PA01
gcuugagguaggccagccccaga

SEQ ID NO: 3401081 - RNA, 16 nt, Pseudomonas aeruginosa PA01
gcuugagucgcaggcu

SEQ ID NO: 3401082 - RNA, 15 nt, Pseudomonas aeruginosa PA01
gcuugaucacgccga

SEQ ID NO: 3401083 - RNA, 22 nt, Pseudomonas aeruginosa PA01
gcuugaucacgccgaagcccgu

SEQ ID NO: 3401084 - RNA, 15 nt, Pseudomonas aeruginosa PA01
gcuugaucgccagcc

SEQ ID NO: 3401085 - RNA, 14 nt, Pseudomonas aeruginosa PA01
gcuugaugcuuucg

SEQ ID NO: 3401086 - RNA, 23 nt, Pseudomonas aeruginosa PA01
gcuugcaauccgugcgccgggcu

SEQ ID NO: 3401087 - RNA, 16 nt, Pseudomonas aeruginosa PA01
gcuugcacaccugguc

SEQ ID NO: 3401088 - RNA, 17 nt, Pseudomonas aeruginosa PA01
gcuugccacugcgcgcc

SEQ ID NO: 3401089 - RNA, 16 nt, Pseudomonas aeruginosa PA01
gcuugccagccgcuuc

SEQ ID NO: 3401090 - RNA, 21 nt, Pseudomonas aeruginosa PA01
gcuugcccaucuucagcauca

SEQ ID NO: 3401091 - RNA, 22 nt, Pseudomonas aeruginosa PA01
gcuugcccaucuucagcaucag

SEQ ID NO: 3401092 - RNA, 14 nt, Pseudomonas aeruginosa PA01
gcuugcccucaggg

SEQ ID NO: 3401093 - RNA, 15 nt, Pseudomonas aeruginosa PA01
gcuugccgagcuggg

SEQ ID NO: 3401094 - RNA, 17 nt, Pseudomonas aeruginosa PA01
gcuugccgagcugggcg

SEQ ID NO: 3401095 - RNA, 18 nt, Pseudomonas aeruginosa PA01
gcuugccgagcugggcgu

SEQ ID NO: 3401096 - RNA, 15 nt, Pseudomonas aeruginosa PA01
gcuugccgaugucgc

SEQ ID NO: 3401097 - RNA, 19 nt, Pseudomonas aeruginosa PA01
gcuugccgaugucgccggc

SEQ ID NO: 3401098 - RNA, 15 nt, Pseudomonas aeruginosa PA01
gcuugccgcucaggc

SEQ ID NO: 3401099 - RNA, 14 nt, Pseudomonas aeruginosa PA01
gcuugccgcugcgc

SEQ ID NO: 3401100 - RNA, 15 nt, Pseudomonas aeruginosa PA01
gcuugccgcugcgca

SEQ ID NO: 3401101 - RNA, 16 nt, Pseudomonas aeruginosa PA01
gcuugccggcagcgac

SEQ ID NO: 3401102 - RNA, 22 nt, Pseudomonas aeruginosa PA01
gcuugccggcagcgaccaccac

SEQ ID NO: 3401103 - RNA, 15 nt, Pseudomonas aeruginosa PA01
gcuugccggccgcca

SEQ ID NO: 3401104 - RNA, 19 nt, Pseudomonas aeruginosa PA01
gcuugccggccgccagcag

SEQ ID NO: 3401105 - RNA, 12 nt, Pseudomonas aeruginosa PA01
gcuugccggcga

SEQ ID NO: 3401106 - RNA, 15 nt, Pseudomonas aeruginosa PA01
gcuugccggcgacgc

SEQ ID NO: 3401107 - RNA, 14 nt, Pseudomonas aeruginosa PA01
gcuugccggcgccu

SEQ ID NO: 3401108 - RNA, 18 nt, Pseudomonas aeruginosa PA01
gcuugccggcgcgcgguu

SEQ ID NO: 3401109 - RNA, 12 nt, Pseudomonas aeruginosa PA01
gcuugccggcgg

SEQ ID NO: 3401110 - RNA, 17 nt, Pseudomonas aeruginosa PA01
gcuugccggcggcgcug

SEQ ID NO: 3401111 - RNA, 15 nt, Pseudomonas aeruginosa PA01
gcuugccgggugcua

SEQ ID NO: 3401112 - RNA, 15 nt, Pseudomonas aeruginosa PA01
gcuugccguccagcg

SEQ ID NO: 3401113 - RNA, 16 nt, Pseudomonas aeruginosa PA01
gcuugccguccagcga

SEQ ID NO: 3401114 - RNA, 18 nt, Pseudomonas aeruginosa PA01
gcuugccguuggcgucgc

SEQ ID NO: 3401115 - RNA, 18 nt, Pseudomonas aeruginosa PA01
gcuugccuuccaggcugu

SEQ ID NO: 3401116 - RNA, 18 nt, Pseudomonas aeruginosa PA01
gcuugccuuccugggcgu

SEQ ID NO: 3401117 - RNA, 23 nt, Pseudomonas aeruginosa PA01
gcuugcgaccgagaugcugccga

SEQ ID NO: 3401118 - RNA, 13 nt, Pseudomonas aeruginosa PA01
gcuugcgccgccu

SEQ ID NO: 3401119 - RNA, 17 nt, Pseudomonas aeruginosa PA01
gcuugcgcgccaccagc

SEQ ID NO: 3401120 - RNA, 19 nt, Pseudomonas aeruginosa PA01
gcuugcgcgccaccagcgu

SEQ ID NO: 3401121 - RNA, 22 nt, Pseudomonas aeruginosa PA01
gcuugcgcgccaccagcguggc

SEQ ID NO: 3401122 - RNA, 15 nt, Pseudomonas aeruginosa PA01
gcuugcgcgccaggg

SEQ ID NO: 3401123 - RNA, 13 nt, Pseudomonas aeruginosa PA01
gcuugcgcgcggc

SEQ ID NO: 3401124 - RNA, 14 nt, Pseudomonas aeruginosa PA01
gcuugcgcuggccg

SEQ ID NO: 3401125 - RNA, 15 nt, Pseudomonas aeruginosa PA01
gcuugcgcuggccgg

SEQ ID NO: 3401126 - RNA, 14 nt, Pseudomonas aeruginosa PA01
gcuugcgggcgcgc

SEQ ID NO: 3401127 - RNA, 20 nt, Pseudomonas aeruginosa PA01
gcuugcgggcgcgccugagc

SEQ ID NO: 3401128 - RNA, 12 nt, Pseudomonas aeruginosa PA01
gcuugcgguagu

SEQ ID NO: 3401129 - RNA, 19 nt, Pseudomonas aeruginosa PA01
gcuugcggucauccgccgg

SEQ ID NO: 3401130 - RNA, 18 nt, Pseudomonas aeruginosa PA01
gcuugcgguuauccgccg

SEQ ID NO: 3401131 - RNA, 19 nt, Pseudomonas aeruginosa PA01
gcuugcgguuauccgccgu

SEQ ID NO: 3401132 - RNA, 19 nt, Pseudomonas aeruginosa PA01
gcuugcguuccuccucguc

SEQ ID NO: 3401133 - RNA, 14 nt, Pseudomonas aeruginosa PA01
gcuugcguucgcuc

SEQ ID NO: 3401134 - RNA, 14 nt, Pseudomonas aeruginosa PA01
gcuugcucgaugcc

SEQ ID NO: 3401135 - RNA, 22 nt, Pseudomonas aeruginosa PA01
gcuugcucuccacuaccgccga

SEQ ID NO: 3401136 - RNA, 15 nt, Pseudomonas aeruginosa PA01
gcuugcugaagcccc

SEQ ID NO: 3401137 - RNA, 22 nt, Pseudomonas aeruginosa PA01
gcuugcuggcgcgauccgcgcg

SEQ ID NO: 3401138 - RNA, 23 nt, Pseudomonas aeruginosa PA01
gcuugcuggcguucucggccagg

SEQ ID NO: 3401139 - RNA, 17 nt, Pseudomonas aeruginosa PA01
gcuuggacagcucgcgg

SEQ ID NO: 3401140 - RNA, 14 nt, Pseudomonas aeruginosa PA01
gcuuggcaccgcgc

SEQ ID NO: 3401141 - RNA, 16 nt, Pseudomonas aeruginosa PA01
gcuuggcaccgcgcag

SEQ ID NO: 3401142 - RNA, 12 nt, Pseudomonas aeruginosa PA01
gcuuggccaggc

SEQ ID NO: 3401143 - RNA, 15 nt, Pseudomonas aeruginosa PA01
gcuuggccaggcgcu

SEQ ID NO: 3401144 - RNA, 17 nt, Pseudomonas aeruginosa PA01
gcuuggccaggcgcuug

SEQ ID NO: 3401145 - RNA, 15 nt, Pseudomonas aeruginosa PA01
gcuuggccaggucgu

SEQ ID NO: 3401146 - RNA, 22 nt, Pseudomonas aeruginosa PA01
gcuuggccauggcgcuugcgca

SEQ ID NO: 3401147 - RNA, 11 nt, Pseudomonas aeruginosa PA01
gcuuggcccug

SEQ ID NO: 3401148 - RNA, 14 nt, Pseudomonas aeruginosa PA01
gcuuggcccugcgc

SEQ ID NO: 3401149 - RNA, 15 nt, Pseudomonas aeruginosa PA01
gcuuggcccugcgcg

SEQ ID NO: 3401150 - RNA, 20 nt, Pseudomonas aeruginosa PA01
gcuuggccuugccguccagc

SEQ ID NO: 3401151 - RNA, 22 nt, Pseudomonas aeruginosa PA01
gcuuggcgaaaucgagcugcuc

SEQ ID NO: 3401152 - RNA, 16 nt, Pseudomonas aeruginosa PA01
gcuuggcgaacuccac

SEQ ID NO: 3401153 - RNA, 17 nt, Pseudomonas aeruginosa PA01
gcuuggcgaauagccgg

SEQ ID NO: 3401154 - RNA, 16 nt, Pseudomonas aeruginosa PA01
gcuuggcgaggcgcgc

SEQ ID NO: 3401155 - RNA, 16 nt, Pseudomonas aeruginosa PA01
gcuuggcgaucacggc

SEQ ID NO: 3401156 - RNA, 19 nt, Pseudomonas aeruginosa PA01
gcuuggcgaucacggcgcc

SEQ ID NO: 3401157 - RNA, 13 nt, Pseudomonas aeruginosa PA01
gcuuggcgcgcug

SEQ ID NO: 3401158 - RNA, 16 nt, Pseudomonas aeruginosa PA01
gcuuggcgcgcuggca

SEQ ID NO: 3401159 - RNA, 15 nt, Pseudomonas aeruginosa PA01
gcuuggcggucagcg

SEQ ID NO: 3401160 - RNA, 18 nt, Pseudomonas aeruginosa PA01
gcuuggcggucagcgacu

SEQ ID NO: 3401161 - RNA, 16 nt, Pseudomonas aeruginosa PA01
gcuugggauggccagc

SEQ ID NO: 3401162 - RNA, 22 nt, Pseudomonas aeruginosa PA01
gcuugggcacgcggaucuggcc

SEQ ID NO: 3401163 - RNA, 15 nt, Pseudomonas aeruginosa PA01
gcuugggcgccucgc

SEQ ID NO: 3401164 - RNA, 17 nt, Pseudomonas aeruginosa PA01
gcuugggcgccucgccg

SEQ ID NO: 3401165 - RNA, 18 nt, Pseudomonas aeruginosa PA01
gcuugggcgccucgccgc

SEQ ID NO: 3401166 - RNA, 16 nt, Pseudomonas aeruginosa PA01
gcuugggcgcggagaa

SEQ ID NO: 3401167 - RNA, 14 nt, Pseudomonas aeruginosa PA01
gcuuggucgggcgc

SEQ ID NO: 3401168 - RNA, 21 nt, Pseudomonas aeruginosa PA01
ggaaaccuucgguggcgacca

SEQ ID NO: 3401169 - RNA, 22 nt, Pseudomonas aeruginosa PA01
ggaaacgcauccauucggugga

SEQ ID NO: 3401170 - RNA, 20 nt, Pseudomonas aeruginosa PA01
ggaaacgcgcgcucucgccg

SEQ ID NO: 3401171 - RNA, 16 nt, Pseudomonas aeruginosa PA01
ggaaagaaacggugga

SEQ ID NO: 3401172 - RNA, 23 nt, Pseudomonas aeruginosa PA01
ggaaagaccgaacaucagcagca

SEQ ID NO: 3401173 - RNA, 20 nt, Pseudomonas aeruginosa PA01
ggaaagccccgcuucggcgg

SEQ ID NO: 3401174 - RNA, 20 nt, Pseudomonas aeruginosa PA01
ggaaagcuccucggccuugc

SEQ ID NO: 3401175 - RNA, 19 nt, Pseudomonas aeruginosa PA01
ggaaaggccgccacggcgg

SEQ ID NO: 3401176 - RNA, 14 nt, Pseudomonas aeruginosa PA01
ggaaaggccucggc

SEQ ID NO: 3401177 - RNA, 15 nt, Pseudomonas aeruginosa PA01
ggaaaggccucggcg

SEQ ID NO: 3401178 - RNA, 21 nt, Pseudomonas aeruginosa PA01
ggaaaggcgucguugccgauc

SEQ ID NO: 3401179 - RNA, 15 nt, Pseudomonas aeruginosa PA01
ggaaauaggcgucgu

SEQ ID NO: 3401180 - RNA, 20 nt, Pseudomonas aeruginosa PA01
ggaaauccuugagcacccgg

SEQ ID NO: 3401181 - RNA, 17 nt, Pseudomonas aeruginosa PA01
ggaaaucgagcgccagg

SEQ ID NO: 3401182 - RNA, 18 nt, Pseudomonas aeruginosa PA01
ggaaaucgagcgccagga

SEQ ID NO: 3401183 - RNA, 19 nt, Pseudomonas aeruginosa PA01
ggaaaucgguugccgcgcc

SEQ ID NO: 3401184 - RNA, 19 nt, Pseudomonas aeruginosa PA01
ggaaaugcucgccguccgc

SEQ ID NO: 3401185 - RNA, 19 nt, Pseudomonas aeruginosa PA01
ggaacacacgcuucugcug

SEQ ID NO: 3401186 - RNA, 14 nt, Pseudomonas aeruginosa PA01
ggaacaccaggccg

SEQ ID NO: 3401187 - RNA, 17 nt, Pseudomonas aeruginosa PA01
ggaacaccaggccgcaa

SEQ ID NO: 3401188 - RNA, 12 nt, Pseudomonas aeruginosa PA01
ggaacagcagcc

SEQ ID NO: 3401189 - RNA, 14 nt, Pseudomonas aeruginosa PA01
ggaacagcagccag

SEQ ID NO: 3401190 - RNA, 15 nt, Pseudomonas aeruginosa PA01
ggaacagcagccagg

SEQ ID NO: 3401191 - RNA, 12 nt, Pseudomonas aeruginosa PA01
ggaacagcauca

SEQ ID NO: 3401192 - RNA, 18 nt, Pseudomonas aeruginosa PA01
ggaacagccaguaguccu

SEQ ID NO: 3401193 - RNA, 21 nt, Pseudomonas aeruginosa PA01
ggaacagcccgucgcgcgccg

SEQ ID NO: 3401194 - RNA, 18 nt, Pseudomonas aeruginosa PA01
ggaacagccgcagcggca

SEQ ID NO: 3401195 - RNA, 14 nt, Pseudomonas aeruginosa PA01
ggaacagcgccagc

SEQ ID NO: 3401196 - RNA, 12 nt, Pseudomonas aeruginosa PA01
ggaacagcgccu

SEQ ID NO: 3401197 - RNA, 18 nt, Pseudomonas aeruginosa PA01
ggaacagcuccuccagcg

SEQ ID NO: 3401198 - RNA, 13 nt, Pseudomonas aeruginosa PA01
ggaacaggucgac

SEQ ID NO: 3401199 - RNA, 17 nt, Pseudomonas aeruginosa PA01
ggaacauccgcggcccc

SEQ ID NO: 3401200 - RNA, 22 nt, Pseudomonas aeruginosa PA01
ggaacauggucgagaaggcugc

SEQ ID NO: 3401201 - RNA, 21 nt, Pseudomonas aeruginosa PA01
ggaaccacaggagcacggccg

SEQ ID NO: 3401202 - RNA, 11 nt, Pseudomonas aeruginosa PA01
ggaaccaccgg

SEQ ID NO: 3401203 - RNA, 23 nt, Pseudomonas aeruginosa PA01
ggaaccacgacgaagcgccggcg

SEQ ID NO: 3401204 - RNA, 17 nt, Pseudomonas aeruginosa PA01
ggaaccaguugccgagc

SEQ ID NO: 3401205 - RNA, 15 nt, Pseudomonas aeruginosa PA01
ggaacccgcggcgcg

SEQ ID NO: 3401206 - RNA, 16 nt, Pseudomonas aeruginosa PA01
ggaacccgcggcgcgc

SEQ ID NO: 3401207 - RNA, 16 nt, Pseudomonas aeruginosa PA01
ggaaccgacgcgcagg

SEQ ID NO: 3401208 - RNA, 16 nt, Pseudomonas aeruginosa PA01
ggaaccgauggccagg

SEQ ID NO: 3401209 - RNA, 17 nt, Pseudomonas aeruginosa PA01
ggaaccgcggcgcccuc

SEQ ID NO: 3401210 - RNA, 13 nt, Pseudomonas aeruginosa PA01
ggaaccggccggc

SEQ ID NO: 3401211 - RNA, 15 nt, Pseudomonas aeruginosa PA01
ggaaccggccggcag

SEQ ID NO: 3401212 - RNA, 19 nt, Pseudomonas aeruginosa PA01
ggaacgaaagaaggggagc

SEQ ID NO: 3401213 - RNA, 19 nt, Pseudomonas aeruginosa PA01
ggaacgaagaaccccggcc

SEQ ID NO: 3401214 - RNA, 13 nt, Pseudomonas aeruginosa PA01
ggaacgaggcgac

SEQ ID NO: 3401215 - RNA, 16 nt, Pseudomonas aeruginosa PA01
ggaacgaugccgcagg

SEQ ID NO: 3401216 - RNA, 21 nt, Pseudomonas aeruginosa PA01
ggaacgcaggggcaccggcgg

SEQ ID NO: 3401217 - RNA, 15 nt, Pseudomonas aeruginosa PA01
ggaacgcccgcggca

SEQ ID NO: 3401218 - RNA, 16 nt, Pseudomonas aeruginosa PA01
ggaacgcccgcggcag

SEQ ID NO: 3401219 - RNA, 15 nt, Pseudomonas aeruginosa PA01
ggaacgcccuuguag

SEQ ID NO: 3401220 - RNA, 20 nt, Pseudomonas aeruginosa PA01
ggaacgccgacaggccggug

SEQ ID NO: 3401221 - RNA, 22 nt, Pseudomonas aeruginosa PA01
ggaacgccgggcaacgccaggc

SEQ ID NO: 3401222 - RNA, 12 nt, Pseudomonas aeruginosa PA01
ggaacgcgagga

SEQ ID NO: 3401223 - RNA, 20 nt, Pseudomonas aeruginosa PA01
ggaacgcgaggagaucggcg

SEQ ID NO: 3401224 - RNA, 22 nt, Pseudomonas aeruginosa PA01
ggaacggcguaccaggaugccc

SEQ ID NO: 3401225 - RNA, 15 nt, Pseudomonas aeruginosa PA01
ggaacggcucgcggg

SEQ ID NO: 3401226 - RNA, 22 nt, Pseudomonas aeruginosa PA01
ggaacgguugucgaugcgcccg

SEQ ID NO: 3401227 - RNA, 15 nt, Pseudomonas aeruginosa PA01
ggaacgucuggccag

SEQ ID NO: 3401228 - RNA, 23 nt, Pseudomonas aeruginosa PA01
ggaacguucaguucugggcggcc

SEQ ID NO: 3401229 - RNA, 21 nt, Pseudomonas aeruginosa PA01
ggaacuagcccucgaccuggc

SEQ ID NO: 3401230 - RNA, 20 nt, Pseudomonas aeruginosa PA01
ggaacucauucaucucgccg

SEQ ID NO: 3401231 - RNA, 17 nt, Pseudomonas aeruginosa PA01
ggaacucgaucagcgcg

SEQ ID NO: 3401232 - RNA, 23 nt, Pseudomonas aeruginosa PA01
ggaacucgaugaaaccggccucg

SEQ ID NO: 3401233 - RNA, 14 nt, Pseudomonas aeruginosa PA01
ggaacucuguucgu

SEQ ID NO: 3401234 - RNA, 14 nt, Pseudomonas aeruginosa PA01
ggaacugcagggca

SEQ ID NO: 3401235 - RNA, 17 nt, Pseudomonas aeruginosa PA01
ggaacugcagggcaucg

SEQ ID NO: 3401236 - RNA, 13 nt, Pseudomonas aeruginosa PA01
ggaacuggcguug

SEQ ID NO: 3401237 - RNA, 22 nt, Pseudomonas aeruginosa PA01
ggaacuggcguugcugaucacg

SEQ ID NO: 3401238 - RNA, 14 nt, Pseudomonas aeruginosa PA01
ggaacuggucgauc

SEQ ID NO: 3401239 - RNA, 16 nt, Pseudomonas aeruginosa PA01
ggaacuggucgauccg

SEQ ID NO: 3401240 - RNA, 20 nt, Pseudomonas aeruginosa PA01
ggaacuguuggggcugccca

SEQ ID NO: 3401241 - RNA, 21 nt, Pseudomonas aeruginosa PA01
ggaacuucaugaugcgcccgg

SEQ ID NO: 3401242 - RNA, 20 nt, Pseudomonas aeruginosa PA01
ggaacuugcgccgaccgcgc

SEQ ID NO: 3401243 - RNA, 15 nt, Pseudomonas aeruginosa PA01
ggaacuuggcgcgca

SEQ ID NO: 3401244 - RNA, 18 nt, Pseudomonas aeruginosa PA01
ggaagaaaagaaggcgga

SEQ ID NO: 3401245 - RNA, 15 nt, Pseudomonas aeruginosa PA01
ggaagaacaggcgcu

SEQ ID NO: 3401246 - RNA, 23 nt, Pseudomonas aeruginosa PA01
ggaagaagcccuuguucgggucg

SEQ ID NO: 3401247 - RNA, 17 nt, Pseudomonas aeruginosa PA01
ggaagaauaccgccagc

SEQ ID NO: 3401248 - RNA, 19 nt, Pseudomonas aeruginosa PA01
ggaagaaucgcagccauga

SEQ ID NO: 3401249 - RNA, 16 nt, Pseudomonas aeruginosa PA01
ggaagaauggcguggc

SEQ ID NO: 3401250 - RNA, 17 nt, Pseudomonas aeruginosa PA01
ggaagagcaucucgccg

SEQ ID NO: 3401251 - RNA, 20 nt, Pseudomonas aeruginosa PA01
ggaagagcaucucgccggca

SEQ ID NO: 3401252 - RNA, 22 nt, Pseudomonas aeruginosa PA01
ggaagagcaucucgccggcacu

SEQ ID NO: 3401253 - RNA, 17 nt, Pseudomonas aeruginosa PA01
ggaagagcccgccacgc

SEQ ID NO: 3401254 - RNA, 20 nt, Pseudomonas aeruginosa PA01
ggaagagcccgccacgcuug

SEQ ID NO: 3401255 - RNA, 13 nt, Pseudomonas aeruginosa PA01
ggaagagcgccgc

SEQ ID NO: 3401256 - RNA, 14 nt, Pseudomonas aeruginosa PA01
ggaagagcgccgcg

SEQ ID NO: 3401257 - RNA, 22 nt, Pseudomonas aeruginosa PA01
ggaagauguucgccgccgccag

SEQ ID NO: 3401258 - RNA, 19 nt, Pseudomonas aeruginosa PA01
ggaagcaccgacucgcccu

SEQ ID NO: 3401259 - RNA, 16 nt, Pseudomonas aeruginosa PA01
ggaagcacggcucggc

SEQ ID NO: 3401260 - RNA, 20 nt, Pseudomonas aeruginosa PA01
ggaagcacggcucggcgagg

SEQ ID NO: 3401261 - RNA, 15 nt, Pseudomonas aeruginosa PA01
ggaagcauggccggc

SEQ ID NO: 3401262 - RNA, 17 nt, Pseudomonas aeruginosa PA01
ggaagcccagcaggucg

SEQ ID NO: 3401263 - RNA, 20 nt, Pseudomonas aeruginosa PA01
ggaagccccagaagaucgcc

SEQ ID NO: 3401264 - RNA, 18 nt, Pseudomonas aeruginosa PA01
ggaagcccugcuggcgca

SEQ ID NO: 3401265 - RNA, 16 nt, Pseudomonas aeruginosa PA01
ggaagccgaccacucg

SEQ ID NO: 3401266 - RNA, 20 nt, Pseudomonas aeruginosa PA01
ggaagccgaccggcgccggg

SEQ ID NO: 3401267 - RNA, 20 nt, Pseudomonas aeruginosa PA01
ggaagccgcgccccagcggc

SEQ ID NO: 3401268 - RNA, 22 nt, Pseudomonas aeruginosa PA01
ggaagccgcgccccagcggcag

SEQ ID NO: 3401269 - RNA, 15 nt, Pseudomonas aeruginosa PA01
ggaagccgcgcucgc

SEQ ID NO: 3401270 - RNA, 17 nt, Pseudomonas aeruginosa PA01
ggacaggccacccgccu

SEQ ID NO: 3401271 - RNA, 19 nt, Pseudomonas aeruginosa PA01
ggacaggcgucccuggagc

SEQ ID NO: 3401272 - RNA, 20 nt, Pseudomonas aeruginosa PA01
ggacaggcgucccuggagca

SEQ ID NO: 3401273 - RNA, 14 nt, Pseudomonas aeruginosa PA01
ggacagggccaggc

SEQ ID NO: 3401274 - RNA, 15 nt, Pseudomonas aeruginosa PA01
ggacagggccaggcc

SEQ ID NO: 3401275 - RNA, 17 nt, Pseudomonas aeruginosa PA01
ggacagggccaggccga

SEQ ID NO: 3401276 - RNA, 21 nt, Pseudomonas aeruginosa PA01
ggacagggcggcagcgugcuc

SEQ ID NO: 3401277 - RNA, 12 nt, Pseudomonas aeruginosa PA01
ggacaggucgcg

SEQ ID NO: 3401278 - RNA, 14 nt, Pseudomonas aeruginosa PA01
ggacaggucgcgga

SEQ ID NO: 3401279 - RNA, 18 nt, Pseudomonas aeruginosa PA01
ggacauacaggcgcgccu

SEQ ID NO: 3401280 - RNA, 19 nt, Pseudomonas aeruginosa PA01
ggacauacaggcgcgccug

SEQ ID NO: 3401281 - RNA, 21 nt, Pseudomonas aeruginosa PA01
ggacauacaggcgcgccuggc

SEQ ID NO: 3401282 - RNA, 17 nt, Pseudomonas aeruginosa PA01
ggacauggagaccuggc

SEQ ID NO: 3401283 - RNA, 20 nt, Pseudomonas aeruginosa PA01
ggacaugucgagggccgggu

SEQ ID NO: 3401284 - RNA, 19 nt, Pseudomonas aeruginosa PA01
ggacauguugcagggucgc

SEQ ID NO: 3401285 - RNA, 16 nt, Pseudomonas aeruginosa PA01
ggaccaacagccggcg

SEQ ID NO: 3401286 - RNA, 15 nt, Pseudomonas aeruginosa PA01
ggaccaacgggcugc

SEQ ID NO: 3401287 - RNA, 21 nt, Pseudomonas aeruginosa PA01
ggaccaacgggcugccagcau

SEQ ID NO: 3401288 - RNA, 12 nt, Pseudomonas aeruginosa PA01
ggaccaccccgg

SEQ ID NO: 3401289 - RNA, 17 nt, Pseudomonas aeruginosa PA01
ggaccacgcuggucacc

SEQ ID NO: 3401290 - RNA, 22 nt, Pseudomonas aeruginosa PA01
ggaccagaacgaaaaaggcgcg

SEQ ID NO: 3401291 - RNA, 20 nt, Pseudomonas aeruginosa PA01
ggaccagccggucccgggcu

SEQ ID NO: 3401292 - RNA, 11 nt, Pseudomonas aeruginosa PA01
ggaccagcgcc

SEQ ID NO: 3401293 - RNA, 12 nt, Pseudomonas aeruginosa PA01
ggaccagcgccg

SEQ ID NO: 3401294 - RNA, 18 nt, Pseudomonas aeruginosa PA01
ggaccagcgccgccaacc

SEQ ID NO: 3401295 - RNA, 18 nt, Pseudomonas aeruginosa PA01
ggaccagcgccugcugcg

SEQ ID NO: 3401296 - RNA, 19 nt, Pseudomonas aeruginosa PA01
ggaccaggaucgaccccgc

SEQ ID NO: 3401297 - RNA, 15 nt, Pseudomonas aeruginosa PA01
ggaccagggcgccgg

SEQ ID NO: 3401298 - RNA, 13 nt, Pseudomonas aeruginosa PA01
ggaccagggcggg

SEQ ID NO: 3401299 - RNA, 18 nt, Pseudomonas aeruginosa PA01
ggaccaguucagcgcgcu

SEQ ID NO: 3401300 - RNA, 20 nt, Pseudomonas aeruginosa PA01
ggaccaucaccaccucgugc

SEQ ID NO: 3401301 - RNA, 20 nt, Pseudomonas aeruginosa PA01
ggaccauuugcgccucgucg

SEQ ID NO: 3401302 - RNA, 23 nt, Pseudomonas aeruginosa PA01
ggacccagaaaccgaucagcacc

SEQ ID NO: 3401303 - RNA, 16 nt, Pseudomonas aeruginosa PA01
ggacccagacaggccu

SEQ ID NO: 3401304 - RNA, 13 nt, Pseudomonas aeruginosa PA01
ggacccagaugau

SEQ ID NO: 3401305 - RNA, 22 nt, Pseudomonas aeruginosa PA01
ggacccagccauugagcgcgcc

SEQ ID NO: 3401306 - RNA, 15 nt, Pseudomonas aeruginosa PA01
ggaccccggccucca

SEQ ID NO: 3401307 - RNA, 15 nt, Pseudomonas aeruginosa PA01
ggacccgcgccggca

SEQ ID NO: 3401308 - RNA, 18 nt, Pseudomonas aeruginosa PA01
ggacccgcgccggcagcu

SEQ ID NO: 3401309 - RNA, 15 nt, Pseudomonas aeruginosa PA01
ggacccgcucggccu

SEQ ID NO: 3401310 - RNA, 21 nt, Pseudomonas aeruginosa PA01
ggacccguugccgaccgagca

SEQ ID NO: 3401311 - RNA, 16 nt, Pseudomonas aeruginosa PA01
ggaccgagaccgacgc

SEQ ID NO: 3401312 - RNA, 14 nt, Pseudomonas aeruginosa PA01
ggaccgcaccuggu

SEQ ID NO: 3401313 - RNA, 20 nt, Pseudomonas aeruginosa PA01
ggaccgcagaaccagacgcu

SEQ ID NO: 3401314 - RNA, 16 nt, Pseudomonas aeruginosa PA01
ggaccgccauggcgcu

SEQ ID NO: 3401315 - RNA, 22 nt, Pseudomonas aeruginosa PA01
ggaccgccucgaccaucggcgg

SEQ ID NO: 3401316 - RNA, 16 nt, Pseudomonas aeruginosa PA01
ggaccggcucgucggc

SEQ ID NO: 3401317 - RNA, 20 nt, Pseudomonas aeruginosa PA01
ggaccggcucgucggcguug

SEQ ID NO: 3401318 - RNA, 20 nt, Pseudomonas aeruginosa PA01
ggaccggcucucuucggccg

SEQ ID NO: 3401319 - RNA, 18 nt, Pseudomonas aeruginosa PA01
ggaccgggcgccucgucg

SEQ ID NO: 3401320 - RNA, 13 nt, Pseudomonas aeruginosa PA01
ggaccgggcggcg

SEQ ID NO: 3401321 - RNA, 15 nt, Pseudomonas aeruginosa PA01
ggaccgggcggcgcg

SEQ ID NO: 3401322 - RNA, 17 nt, Pseudomonas aeruginosa PA01
ggaccgggcggcgcggc

SEQ ID NO: 3401323 - RNA, 18 nt, Pseudomonas aeruginosa PA01
ggaccgggcggcgcggcg

SEQ ID NO: 3401324 - RNA, 20 nt, Pseudomonas aeruginosa PA01
ggaccgggcggcgcggcgca

SEQ ID NO: 3401325 - RNA, 15 nt, Pseudomonas aeruginosa PA01
ggaccggugccccgc

SEQ ID NO: 3401326 - RNA, 22 nt, Pseudomonas aeruginosa PA01
ggaccggugccccgcuggccca

SEQ ID NO: 3401327 - RNA, 20 nt, Pseudomonas aeruginosa PA01
ggaccuccagccggccaucc

SEQ ID NO: 3401328 - RNA, 12 nt, Pseudomonas aeruginosa PA01
ggaccuccgcca

SEQ ID NO: 3401329 - RNA, 17 nt, Pseudomonas aeruginosa PA01
ggaccuccgccaggacc

SEQ ID NO: 3401330 - RNA, 19 nt, Pseudomonas aeruginosa PA01
ggaccuccgccaggucgau

SEQ ID NO: 3401331 - RNA, 14 nt, Pseudomonas aeruginosa PA01
ggaccuccugcaca

SEQ ID NO: 3401332 - RNA, 19 nt, Pseudomonas aeruginosa PA01
ggaccucgaagcuggccag

SEQ ID NO: 3401333 - RNA, 20 nt, Pseudomonas aeruginosa PA01
ggaccucgaagcuggccagu

SEQ ID NO: 3401334 - RNA, 15 nt, Pseudomonas aeruginosa PA01
ggaccucgggcagcu

SEQ ID NO: 3401335 - RNA, 22 nt, Pseudomonas aeruginosa PA01
ggaccucgggcgagaaucgccg

SEQ ID NO: 3401336 - RNA, 23 nt, Pseudomonas aeruginosa PA01
ggaccucgggcgagaaucgccga

SEQ ID NO: 3401337 - RNA, 16 nt, Pseudomonas aeruginosa PA01
ggaccucucucgcugc

SEQ ID NO: 3401338 - RNA, 19 nt, Pseudomonas aeruginosa PA01
ggaccucucucgcugcgcg

SEQ ID NO: 3401339 - RNA, 21 nt, Pseudomonas aeruginosa PA01
ggaccugagaucagcgcccgg

SEQ ID NO: 3401340 - RNA, 12 nt, Pseudomonas aeruginosa PA01
ggaccuggccgc

SEQ ID NO: 3401341 - RNA, 13 nt, Pseudomonas aeruginosa PA01
ggaccuggccgcg

SEQ ID NO: 3401342 - RNA, 21 nt, Pseudomonas aeruginosa PA01
ggaccuggccgcguucgccga

SEQ ID NO: 3401343 - RNA, 13 nt, Pseudomonas aeruginosa PA01
ggaccuggccggc

SEQ ID NO: 3401344 - RNA, 14 nt, Pseudomonas aeruginosa PA01
ggaccuggccggcg

SEQ ID NO: 3401345 - RNA, 12 nt, Pseudomonas aeruginosa PA01
ggaccuggccgu

SEQ ID NO: 3401346 - RNA, 21 nt, Pseudomonas aeruginosa PA01
ggaccuggccguuggcgaaca

SEQ ID NO: 3401347 - RNA, 11 nt, Pseudomonas aeruginosa PA01
ggaccuguccc

SEQ ID NO: 3401348 - RNA, 22 nt, Pseudomonas aeruginosa PA01
ggaccugucggcucgcgccggc

SEQ ID NO: 3401349 - RNA, 23 nt, Pseudomonas aeruginosa PA01
ggaccuucagauacuccagcagc

SEQ ID NO: 3401350 - RNA, 14 nt, Pseudomonas aeruginosa PA01
ggaccuuccgccag

SEQ ID NO: 3401351 - RNA, 15 nt, Pseudomonas aeruginosa PA01
ggaccuuccgccagc

SEQ ID NO: 3401352 - RNA, 17 nt, Pseudomonas aeruginosa PA01
ggaccuucgacggcagg

SEQ ID NO: 3401353 - RNA, 20 nt, Pseudomonas aeruginosa PA01
ggaccuucgacggcaggugg

SEQ ID NO: 3401354 - RNA, 18 nt, Pseudomonas aeruginosa PA01
ggaccuugucgccgguga

SEQ ID NO: 3401355 - RNA, 15 nt, Pseudomonas aeruginosa PA01
ggacgaaaaccgcag

SEQ ID NO: 3401356 - RNA, 16 nt, Pseudomonas aeruginosa PA01
ggacgaaaaccgcaga

SEQ ID NO: 3401357 - RNA, 22 nt, Pseudomonas aeruginosa PA01
ggacgaaacgguagcccgcggc

SEQ ID NO: 3401358 - RNA, 21 nt, Pseudomonas aeruginosa PA01
ggacgaacgagaagccgauca

SEQ ID NO: 3401359 - RNA, 19 nt, Pseudomonas aeruginosa PA01
ggacgaaggccuccucgua

SEQ ID NO: 3401360 - RNA, 15 nt, Pseudomonas aeruginosa PA01
ggacgaagucgccgg

SEQ ID NO: 3401361 - RNA, 17 nt, Pseudomonas aeruginosa PA01
ggacgaagucgccggca

SEQ ID NO: 3401362 - RNA, 18 nt, Pseudomonas aeruginosa PA01
ggacgaagucgccggcau

SEQ ID NO: 3401363 - RNA, 15 nt, Pseudomonas aeruginosa PA01
ggacgacaucucguc

SEQ ID NO: 3401364 - RNA, 21 nt, Pseudomonas aeruginosa PA01
ggacgaccucagaccacgccc

SEQ ID NO: 3401365 - RNA, 20 nt, Pseudomonas aeruginosa PA01
ggacgacgaaagaagccgca

SEQ ID NO: 3401366 - RNA, 14 nt, Pseudomonas aeruginosa PA01
ggacgacgcuggcc

SEQ ID NO: 3401367 - RNA, 19 nt, Pseudomonas aeruginosa PA01
ggacgacgcuggccugccg

SEQ ID NO: 3401368 - RNA, 15 nt, Pseudomonas aeruginosa PA01
ggacgagcguccgcc

SEQ ID NO: 3401369 - RNA, 22 nt, Pseudomonas aeruginosa PA01
ggacgagcuuuccugcugagca

SEQ ID NO: 3401370 - RNA, 17 nt, Pseudomonas aeruginosa PA01
ggacgaggaaggcgcgc

SEQ ID NO: 3401371 - RNA, 21 nt, Pseudomonas aeruginosa PA01
ggacgaggaaggcgcgcacca

SEQ ID NO: 3401372 - RNA, 14 nt, Pseudomonas aeruginosa PA01
ggagaggucgccga

SEQ ID NO: 3401373 - RNA, 15 nt, Pseudomonas aeruginosa PA01
ggagagguggccgag

SEQ ID NO: 3401374 - RNA, 11 nt, Pseudomonas aeruginosa PA01
ggagagucgga

SEQ ID NO: 3401375 - RNA, 22 nt, Pseudomonas aeruginosa PA01
ggagaucggcguuuacgcgcca

SEQ ID NO: 3401376 - RNA, 17 nt, Pseudomonas aeruginosa PA01
ggagaugccgaacaccu

SEQ ID NO: 3401377 - RNA, 21 nt, Pseudomonas aeruginosa PA01
ggagauguagucgacgccggu

SEQ ID NO: 3401378 - RNA, 20 nt, Pseudomonas aeruginosa PA01
ggagauguccaucagccgcg

SEQ ID NO: 3401379 - RNA, 14 nt, Pseudomonas aeruginosa PA01
ggagauugcggcga

SEQ ID NO: 3401380 - RNA, 20 nt, Pseudomonas aeruginosa PA01
ggagcacagccauuucugcu

SEQ ID NO: 3401381 - RNA, 14 nt, Pseudomonas aeruginosa PA01
ggagcaccgcgccu

SEQ ID NO: 3401382 - RNA, 23 nt, Pseudomonas aeruginosa PA01
ggagcaccgcgccuuccagcccu

SEQ ID NO: 3401383 - RNA, 21 nt, Pseudomonas aeruginosa PA01
ggagcacggcauagccacggc

SEQ ID NO: 3401384 - RNA, 16 nt, Pseudomonas aeruginosa PA01
ggagcacugggaaucg

SEQ ID NO: 3401385 - RNA, 18 nt, Pseudomonas aeruginosa PA01
ggagcagaaccgccagca

SEQ ID NO: 3401386 - RNA, 21 nt, Pseudomonas aeruginosa PA01
ggagcagaaccgccagcagug

SEQ ID NO: 3401387 - RNA, 13 nt, Pseudomonas aeruginosa PA01
ggagcagcagcgc

SEQ ID NO: 3401388 - RNA, 13 nt, Pseudomonas aeruginosa PA01
ggagcagggcgca

SEQ ID NO: 3401389 - RNA, 14 nt, Pseudomonas aeruginosa PA01
ggagcaucuggccc

SEQ ID NO: 3401390 - RNA, 15 nt, Pseudomonas aeruginosa PA01
ggagccaacgcccgg

SEQ ID NO: 3401391 - RNA, 11 nt, Pseudomonas aeruginosa PA01
ggagccaggcg

SEQ ID NO: 3401392 - RNA, 17 nt, Pseudomonas aeruginosa PA01
ggagccccguuuuuccu

SEQ ID NO: 3401393 - RNA, 23 nt, Pseudomonas aeruginosa PA01
ggagccggauagaucaggccggc

SEQ ID NO: 3401394 - RNA, 14 nt, Pseudomonas aeruginosa PA01
ggagccggccaggc

SEQ ID NO: 3401395 - RNA, 15 nt, Pseudomonas aeruginosa PA01
ggagccggccaggcg

SEQ ID NO: 3401396 - RNA, 15 nt, Pseudomonas aeruginosa PA01
ggagccggugccggc

SEQ ID NO: 3401397 - RNA, 16 nt, Pseudomonas aeruginosa PA01
ggagccggugccggcg

SEQ ID NO: 3401398 - RNA, 17 nt, Pseudomonas aeruginosa PA01
ggagccggugccggcgg

SEQ ID NO: 3401399 - RNA, 16 nt, Pseudomonas aeruginosa PA01
ggagccguagggcgca

SEQ ID NO: 3401400 - RNA, 16 nt, Pseudomonas aeruginosa PA01
ggagccgucgccggcg

SEQ ID NO: 3401401 - RNA, 14 nt, Pseudomonas aeruginosa PA01
ggagccuacggagg

SEQ ID NO: 3401402 - RNA, 23 nt, Pseudomonas aeruginosa PA01
ggagcgacaccaugcuccgccug

SEQ ID NO: 3401403 - RNA, 19 nt, Pseudomonas aeruginosa PA01
ggagcgaccggauggcuca

SEQ ID NO: 3401404 - RNA, 14 nt, Pseudomonas aeruginosa PA01
ggagcgccagcacc

SEQ ID NO: 3401405 - RNA, 15 nt, Pseudomonas aeruginosa PA01
ggagcgccagcacca

SEQ ID NO: 3401406 - RNA, 20 nt, Pseudomonas aeruginosa PA01
ggagcgccaucagcgaccag

SEQ ID NO: 3401407 - RNA, 12 nt, Pseudomonas aeruginosa PA01
ggagcgccgcgc

SEQ ID NO: 3401408 - RNA, 23 nt, Pseudomonas aeruginosa PA01
ggagcgccgcgcagcgcggcgcu

SEQ ID NO: 3401409 - RNA, 15 nt, Pseudomonas aeruginosa PA01
ggagcgccggcgcgg

SEQ ID NO: 3401410 - RNA, 20 nt, Pseudomonas aeruginosa PA01
ggagcgccucgaaggccucg

SEQ ID NO: 3401411 - RNA, 15 nt, Pseudomonas aeruginosa PA01
ggagcgcgagcggca

SEQ ID NO: 3401412 - RNA, 19 nt, Pseudomonas aeruginosa PA01
ggagcgcgaggcgcaggca

SEQ ID NO: 3401413 - RNA, 17 nt, Pseudomonas aeruginosa PA01
ggagcgcucgcgcagcc

SEQ ID NO: 3401414 - RNA, 13 nt, Pseudomonas aeruginosa PA01
ggagcggccgugc

SEQ ID NO: 3401415 - RNA, 19 nt, Pseudomonas aeruginosa PA01
ggagcggccugagcugccg

SEQ ID NO: 3401416 - RNA, 13 nt, Pseudomonas aeruginosa PA01
ggagcggcugccg

SEQ ID NO: 3401417 - RNA, 13 nt, Pseudomonas aeruginosa PA01
ggagcgggcgccg

SEQ ID NO: 3401418 - RNA, 19 nt, Pseudomonas aeruginosa PA01
ggagcguccaccagcgccc

SEQ ID NO: 3401419 - RNA, 14 nt, Pseudomonas aeruginosa PA01
ggagcgucggaagc

SEQ ID NO: 3401420 - RNA, 17 nt, Pseudomonas aeruginosa PA01
ggagcguuguucuucga

SEQ ID NO: 3401421 - RNA, 13 nt, Pseudomonas aeruginosa PA01
ggagcuggucauc

SEQ ID NO: 3401422 - RNA, 16 nt, Pseudomonas aeruginosa PA01
ggagcuuugcagggcg

SEQ ID NO: 3401423 - RNA, 20 nt, Pseudomonas aeruginosa PA01
ggagcuuugcagggcgaucc

SEQ ID NO: 3401424 - RNA, 21 nt, Pseudomonas aeruginosa PA01
ggaggaaacccaugcccgccc

SEQ ID NO: 3401425 - RNA, 22 nt, Pseudomonas aeruginosa PA01
ggaggaaacccaugcccgcccc

SEQ ID NO: 3401426 - RNA, 17 nt, Pseudomonas aeruginosa PA01
ggaggaaauacagcacc

SEQ ID NO: 3401427 - RNA, 18 nt, Pseudomonas aeruginosa PA01
ggaggaaauacagcaccc

SEQ ID NO: 3401428 - RNA, 23 nt, Pseudomonas aeruginosa PA01
ggaggaauaaagaaaaggccgcg

SEQ ID NO: 3401429 - RNA, 15 nt, Pseudomonas aeruginosa PA01
ggaggaggcgccggg

SEQ ID NO: 3401430 - RNA, 13 nt, Pseudomonas aeruginosa PA01
ggaggaucgccag

SEQ ID NO: 3401431 - RNA, 15 nt, Pseudomonas aeruginosa PA01
ggaggaucgccagga

SEQ ID NO: 3401432 - RNA, 17 nt, Pseudomonas aeruginosa PA01
ggaggaucgccaggacg

SEQ ID NO: 3401433 - RNA, 21 nt, Pseudomonas aeruginosa PA01
ggaggaucgccaggacgcucg

SEQ ID NO: 3401434 - RNA, 16 nt, Pseudomonas aeruginosa PA01
ggaggaucuccaacug

SEQ ID NO: 3401435 - RNA, 21 nt, Pseudomonas aeruginosa PA01
ggaggaucuccaacuggcggc

SEQ ID NO: 3401436 - RNA, 18 nt, Pseudomonas aeruginosa PA01
ggaggaugccgaucaccg

SEQ ID NO: 3401437 - RNA, 16 nt, Pseudomonas aeruginosa PA01
ggaggauucagcagga

SEQ ID NO: 3401438 - RNA, 16 nt, Pseudomonas aeruginosa PA01
ggaggauucgccagcc

SEQ ID NO: 3401439 - RNA, 23 nt, Pseudomonas aeruginosa PA01
ggaggcauugcacaacgggugcu

SEQ ID NO: 3401440 - RNA, 13 nt, Pseudomonas aeruginosa PA01
ggaggccagcagc

SEQ ID NO: 3401441 - RNA, 19 nt, Pseudomonas aeruginosa PA01
ggaggcccacgggcggccg

SEQ ID NO: 3401442 - RNA, 14 nt, Pseudomonas aeruginosa PA01
ggaggcccagauca

SEQ ID NO: 3401443 - RNA, 12 nt, Pseudomonas aeruginosa PA01
ggaggccgccuc

SEQ ID NO: 3401444 - RNA, 18 nt, Pseudomonas aeruginosa PA01
ggaggcgcacaucacccg

SEQ ID NO: 3401445 - RNA, 13 nt, Pseudomonas aeruginosa PA01
ggaggcgccgcgc

SEQ ID NO: 3401446 - RNA, 15 nt, Pseudomonas aeruginosa PA01
ggaggcgcuggccag

SEQ ID NO: 3401447 - RNA, 18 nt, Pseudomonas aeruginosa PA01
ggaggcgcuuucccgcuu

SEQ ID NO: 3401448 - RNA, 12 nt, Pseudomonas aeruginosa PA01
ggaggcggcggu

SEQ ID NO: 3401449 - RNA, 19 nt, Pseudomonas aeruginosa PA01
ggagggcugcuguccagcg

SEQ ID NO: 3401450 - RNA, 18 nt, Pseudomonas aeruginosa PA01
ggagguagcugcgccgcc

SEQ ID NO: 3401451 - RNA, 18 nt, Pseudomonas aeruginosa PA01
ggaggucgcacgcagcgc

SEQ ID NO: 3401452 - RNA, 16 nt, Pseudomonas aeruginosa PA01
ggagguucgaauccuc

SEQ ID NO: 3401453 - RNA, 16 nt, Pseudomonas aeruginosa PA01
ggaguagccggcggcg

SEQ ID NO: 3401454 - RNA, 17 nt, Pseudomonas aeruginosa PA01
ggaguccaggcgggcca

SEQ ID NO: 3401455 - RNA, 22 nt, Pseudomonas aeruginosa PA01
ggaguccaggcgggccagcugg

SEQ ID NO: 3401456 - RNA, 22 nt, Pseudomonas aeruginosa PA01
ggagucgaucucggugggcuug

SEQ ID NO: 3401457 - RNA, 20 nt, Pseudomonas aeruginosa PA01
ggagucguagcgcgcggcga

SEQ ID NO: 3401458 - RNA, 21 nt, Pseudomonas aeruginosa PA01
ggagucguagcgcgcggcgag

SEQ ID NO: 3401459 - RNA, 19 nt, Pseudomonas aeruginosa PA01
ggagugaggccgagccgac

SEQ ID NO: 3401460 - RNA, 16 nt, Pseudomonas aeruginosa PA01
ggagugcaugccgggg

SEQ ID NO: 3401461 - RNA, 12 nt, Pseudomonas aeruginosa PA01
ggaguuccagcg

SEQ ID NO: 3401462 - RNA, 16 nt, Pseudomonas aeruginosa PA01
ggaguuccgcgcaacc

SEQ ID NO: 3401463 - RNA, 15 nt, Pseudomonas aeruginosa PA01
ggaguucgacccaug

SEQ ID NO: 3401464 - RNA, 18 nt, Pseudomonas aeruginosa PA01
ggaguuucaucucggcgc

SEQ ID NO: 3401465 - RNA, 13 nt, Pseudomonas aeruginosa PA01
ggauaaacggcau

SEQ ID NO: 3401466 - RNA, 13 nt, Pseudomonas aeruginosa PA01
ggauaaccgcguu

SEQ ID NO: 3401467 - RNA, 17 nt, Pseudomonas aeruginosa PA01
ggauaacgcccgcggcg

SEQ ID NO: 3401468 - RNA, 17 nt, Pseudomonas aeruginosa PA01
ggauaacgccgguggcg

SEQ ID NO: 3401469 - RNA, 12 nt, Pseudomonas aeruginosa PA01
ggauaagccgcg

SEQ ID NO: 3401470 - RNA, 13 nt, Pseudomonas aeruginosa PA01
ggauaagccgcgc

SEQ ID NO: 3401471 - RNA, 13 nt, Pseudomonas aeruginosa PA01
ggauacagcagcc

SEQ ID NO: 3401472 - RNA, 17 nt, Pseudomonas aeruginosa PA01
ggauacaugcugcucag

SEQ ID NO: 3401473 - RNA, 12 nt, Pseudomonas aeruginosa PA01
ggauaccacccg

SEQ ID NO: 3401474 - RNA, 17 nt, Pseudomonas aeruginosa PA01
ggauaccacccgcagcc

SEQ ID NO: 3401475 - RNA, 19 nt, Pseudomonas aeruginosa PA01
ggaucgcgaagaacacgcc

SEQ ID NO: 3401476 - RNA, 19 nt, Pseudomonas aeruginosa PA01
ggaucgcgcaaugccgcgu

SEQ ID NO: 3401477 - RNA, 12 nt, Pseudomonas aeruginosa PA01
ggaucgcgccgu

SEQ ID NO: 3401478 - RNA, 17 nt, Pseudomonas aeruginosa PA01
ggaucgcgccgucgcug

SEQ ID NO: 3401479 - RNA, 22 nt, Pseudomonas aeruginosa PA01
ggaucgcgccgucgcuggcgau

SEQ ID NO: 3401480 - RNA, 16 nt, Pseudomonas aeruginosa PA01
ggaucgcgcuggccag

SEQ ID NO: 3401481 - RNA, 20 nt, Pseudomonas aeruginosa PA01
ggaucgcggcguaggcgcgc

SEQ ID NO: 3401482 - RNA, 16 nt, Pseudomonas aeruginosa PA01
ggaucgcuaccgacag

SEQ ID NO: 3401483 - RNA, 15 nt, Pseudomonas aeruginosa PA01
ggaucgcucccaggc

SEQ ID NO: 3401484 - RNA, 18 nt, Pseudomonas aeruginosa PA01
ggaucgcucccaggcuca

SEQ ID NO: 3401485 - RNA, 18 nt, Pseudomonas aeruginosa PA01
ggaucgcucucgcgcuug

SEQ ID NO: 3401486 - RNA, 23 nt, Pseudomonas aeruginosa PA01
ggaucggagagacccgccagcgg

SEQ ID NO: 3401487 - RNA, 19 nt, Pseudomonas aeruginosa PA01
ggaucggauagccgugcag

SEQ ID NO: 3401488 - RNA, 15 nt, Pseudomonas aeruginosa PA01
ggaucggcagcucgc

SEQ ID NO: 3401489 - RNA, 17 nt, Pseudomonas aeruginosa PA01
ggaucggcauggccacg

SEQ ID NO: 3401490 - RNA, 18 nt, Pseudomonas aeruginosa PA01
ggaucggccaacugagcg

SEQ ID NO: 3401491 - RNA, 22 nt, Pseudomonas aeruginosa PA01
ggaucggccaacugagcggcgg

SEQ ID NO: 3401492 - RNA, 13 nt, Pseudomonas aeruginosa PA01
ggaucggccccac

SEQ ID NO: 3401493 - RNA, 15 nt, Pseudomonas aeruginosa PA01
ggaucggccccaccu

SEQ ID NO: 3401494 - RNA, 14 nt, Pseudomonas aeruginosa PA01
ggaucggccucgcg

SEQ ID NO: 3401495 - RNA, 17 nt, Pseudomonas aeruginosa PA01
ggaucggccucgcggcg

SEQ ID NO: 3401496 - RNA, 19 nt, Pseudomonas aeruginosa PA01
ggaucggccucgcggcgcu

SEQ ID NO: 3401497 - RNA, 20 nt, Pseudomonas aeruginosa PA01
ggaucggccucgcggcgcuc

SEQ ID NO: 3401498 - RNA, 24 nt, Pseudomonas aeruginosa PA01
ggaucggcgcccagcaccacagca

SEQ ID NO: 3401499 - RNA, 13 nt, Pseudomonas aeruginosa PA01
ggaucggcggugc

SEQ ID NO: 3401500 - RNA, 21 nt, Pseudomonas aeruginosa PA01
ggaucggcguguucaggugcu

SEQ ID NO: 3401501 - RNA, 18 nt, Pseudomonas aeruginosa PA01
ggaucggcugaccggcau

SEQ ID NO: 3401502 - RNA, 15 nt, Pseudomonas aeruginosa PA01
ggaucguaggcgcgc

SEQ ID NO: 3401503 - RNA, 14 nt, Pseudomonas aeruginosa PA01
ggaucguccgggcg

SEQ ID NO: 3401504 - RNA, 13 nt, Pseudomonas aeruginosa PA01
ggaucgucgcggc

SEQ ID NO: 3401505 - RNA, 18 nt, Pseudomonas aeruginosa PA01
ggaucgucgcggcgcgag

SEQ ID NO: 3401506 - RNA, 24 nt, Pseudomonas aeruginosa PA01
ggaucucaggaccuuccgccagca

SEQ ID NO: 3401507 - RNA, 19 nt, Pseudomonas aeruginosa PA01
ggaucucccguaccagcgc

SEQ ID NO: 3401508 - RNA, 20 nt, Pseudomonas aeruginosa PA01
ggaucucccguaccagcgcg

SEQ ID NO: 3401509 - RNA, 21 nt, Pseudomonas aeruginosa PA01
ggaucucccguaccagcgcga

SEQ ID NO: 3401510 - RNA, 15 nt, Pseudomonas aeruginosa PA01
ggaucuccucggcca

SEQ ID NO: 3401511 - RNA, 21 nt, Pseudomonas aeruginosa PA01
ggaucuccucggccaacggcc

SEQ ID NO: 3401512 - RNA, 12 nt, Pseudomonas aeruginosa PA01
ggaucucgccac

SEQ ID NO: 3401513 - RNA, 15 nt, Pseudomonas aeruginosa PA01
ggaucucggcggcca

SEQ ID NO: 3401514 - RNA, 16 nt, Pseudomonas aeruginosa PA01
ggaucucggcggccag

SEQ ID NO: 3401515 - RNA, 15 nt, Pseudomonas aeruginosa PA01
ggaucugcuccugca

SEQ ID NO: 3401516 - RNA, 16 nt, Pseudomonas aeruginosa PA01
ggaucugcuccugcag

SEQ ID NO: 3401517 - RNA, 15 nt, Pseudomonas aeruginosa PA01
ggaucugcucgacgu

SEQ ID NO: 3401518 - RNA, 18 nt, Pseudomonas aeruginosa PA01
ggaucuguuucaacuccc

SEQ ID NO: 3401519 - RNA, 19 nt, Pseudomonas aeruginosa PA01
ggaucuucuaccuggcgcu

SEQ ID NO: 3401520 - RNA, 15 nt, Pseudomonas aeruginosa PA01
ggaucuugcgcccgg

SEQ ID NO: 3401521 - RNA, 14 nt, Pseudomonas aeruginosa PA01
ggaugaacagcgga

SEQ ID NO: 3401522 - RNA, 20 nt, Pseudomonas aeruginosa PA01
ggaugaacgacuccagcuuc

SEQ ID NO: 3401523 - RNA, 18 nt, Pseudomonas aeruginosa PA01
ggaugaagaucaucuggg

SEQ ID NO: 3401524 - RNA, 14 nt, Pseudomonas aeruginosa PA01
ggaugaaguacugg

SEQ ID NO: 3401525 - RNA, 19 nt, Pseudomonas aeruginosa PA01
ggaugaaguacuggucgcg

SEQ ID NO: 3401526 - RNA, 16 nt, Pseudomonas aeruginosa PA01
ggaugaccacgucgcg

SEQ ID NO: 3401527 - RNA, 15 nt, Pseudomonas aeruginosa PA01
ggaugaccaggcuga

SEQ ID NO: 3401528 - RNA, 15 nt, Pseudomonas aeruginosa PA01
ggaugacccgcucgc

SEQ ID NO: 3401529 - RNA, 18 nt, Pseudomonas aeruginosa PA01
ggaugacccgcucgccgg

SEQ ID NO: 3401530 - RNA, 23 nt, Pseudomonas aeruginosa PA01
ggaugaucgcgugggccaccauc

SEQ ID NO: 3401531 - RNA, 22 nt, Pseudomonas aeruginosa PA01
ggaugcagauccagcggcaggu

SEQ ID NO: 3401532 - RNA, 16 nt, Pseudomonas aeruginosa PA01
ggaugcagccggggcu

SEQ ID NO: 3401533 - RNA, 12 nt, Pseudomonas aeruginosa PA01
ggaugcagcgcu

SEQ ID NO: 3401534 - RNA, 24 nt, Pseudomonas aeruginosa PA01
ggaugcagcgcuuguagcagccgc

SEQ ID NO: 3401535 - RNA, 17 nt, Pseudomonas aeruginosa PA01
ggaugcagucccgccag

SEQ ID NO: 3401536 - RNA, 21 nt, Pseudomonas aeruginosa PA01
ggaugcagucccgccaggcgc

SEQ ID NO: 3401537 - RNA, 18 nt, Pseudomonas aeruginosa PA01
ggaugcaguugagucgcg

SEQ ID NO: 3401538 - RNA, 22 nt, Pseudomonas aeruginosa PA01
ggaugcaguugagucgcgcgcg

SEQ ID NO: 3401539 - RNA, 17 nt, Pseudomonas aeruginosa PA01
ggaugcccgucaggccu

SEQ ID NO: 3401540 - RNA, 17 nt, Pseudomonas aeruginosa PA01
ggaugcccuccugggcc

SEQ ID NO: 3401541 - RNA, 17 nt, Pseudomonas aeruginosa PA01
ggaugcccugcucuucc

SEQ ID NO: 3401542 - RNA, 14 nt, Pseudomonas aeruginosa PA01
ggaugcccuggucg

SEQ ID NO: 3401543 - RNA, 16 nt, Pseudomonas aeruginosa PA01
ggaugcccuggucggc

SEQ ID NO: 3401544 - RNA, 17 nt, Pseudomonas aeruginosa PA01
ggaugcccuggucggcg

SEQ ID NO: 3401545 - RNA, 19 nt, Pseudomonas aeruginosa PA01
ggaugccgcacaggcuggc

SEQ ID NO: 3401546 - RNA, 16 nt, Pseudomonas aeruginosa PA01
ggaugccgcgagccag

SEQ ID NO: 3401547 - RNA, 10 nt, Pseudomonas aeruginosa PA01
ggaugccggc

SEQ ID NO: 3401548 - RNA, 14 nt, Pseudomonas aeruginosa PA01
ggaugccggcgcug

SEQ ID NO: 3401549 - RNA, 16 nt, Pseudomonas aeruginosa PA01
ggaugccggcggcauc

SEQ ID NO: 3401550 - RNA, 13 nt, Pseudomonas aeruginosa PA01
ggaugccgggcga

SEQ ID NO: 3401551 - RNA, 14 nt, Pseudomonas aeruginosa PA01
ggaugccgguggcg

SEQ ID NO: 3401552 - RNA, 19 nt, Pseudomonas aeruginosa PA01
ggaugccgguggcgcccag

SEQ ID NO: 3401553 - RNA, 22 nt, Pseudomonas aeruginosa PA01
ggaugccgguggcgcccagcca

SEQ ID NO: 3401554 - RNA, 21 nt, Pseudomonas aeruginosa PA01
ggaugcgaugcugucagcgcc

SEQ ID NO: 3401555 - RNA, 21 nt, Pseudomonas aeruginosa PA01
ggaugcgccagcggcccggca

SEQ ID NO: 3401556 - RNA, 19 nt, Pseudomonas aeruginosa PA01
ggaugcuccagguucggcg

SEQ ID NO: 3401557 - RNA, 14 nt, Pseudomonas aeruginosa PA01
ggaugcuccgcgcc

SEQ ID NO: 3401558 - RNA, 22 nt, Pseudomonas aeruginosa PA01
ggaugcucgccugguaggcggc

SEQ ID NO: 3401559 - RNA, 12 nt, Pseudomonas aeruginosa PA01
ggaugcuggcgg

SEQ ID NO: 3401560 - RNA, 12 nt, Pseudomonas aeruginosa PA01
ggaugcuguccc

SEQ ID NO: 3401561 - RNA, 14 nt, Pseudomonas aeruginosa PA01
ggauggacagcuug

SEQ ID NO: 3401562 - RNA, 22 nt, Pseudomonas aeruginosa PA01
ggauggacagcuuggccagcag

SEQ ID NO: 3401563 - RNA, 16 nt, Pseudomonas aeruginosa PA01
ggauggcaauggcggu

SEQ ID NO: 3401564 - RNA, 11 nt, Pseudomonas aeruginosa PA01
ggauggccagc

SEQ ID NO: 3401565 - RNA, 12 nt, Pseudomonas aeruginosa PA01
ggauggccagcc

SEQ ID NO: 3401566 - RNA, 22 nt, Pseudomonas aeruginosa PA01
ggauggcccccacggaggccuu

SEQ ID NO: 3401567 - RNA, 19 nt, Pseudomonas aeruginosa PA01
ggauggccguccaggcugc

SEQ ID NO: 3401568 - RNA, 15 nt, Pseudomonas aeruginosa PA01
ggauggcgaucgagc

SEQ ID NO: 3401569 - RNA, 22 nt, Pseudomonas aeruginosa PA01
ggauggcguuugcgucauccgc

SEQ ID NO: 3401570 - RNA, 21 nt, Pseudomonas aeruginosa PA01
ggaugggaacgaguugggcga

SEQ ID NO: 3401571 - RNA, 12 nt, Pseudomonas aeruginosa PA01
ggauggucaggc

SEQ ID NO: 3401572 - RNA, 15 nt, Pseudomonas aeruginosa PA01
ggauggucaggccgg

SEQ ID NO: 3401573 - RNA, 16 nt, Pseudomonas aeruginosa PA01
ggauggucgagggcgc

SEQ ID NO: 3401574 - RNA, 13 nt, Pseudomonas aeruginosa PA01
ggauguaguagac

SEQ ID NO: 3401575 - RNA, 17 nt, Pseudomonas aeruginosa PA01
ggauguaguccagcgcc

SEQ ID NO: 3401576 - RNA, 19 nt, Pseudomonas aeruginosa PA01
ggauguaguccagcgccgc

SEQ ID NO: 3401577 - RNA, 15 nt, Pseudomonas aeruginosa PA01
ggauguccgccgccc

SEQ ID NO: 3401578 - RNA, 20 nt, Pseudomonas aeruginosa PA01
ggaugucgcuggccagcuug

SEQ ID NO: 3401579 - RNA, 17 nt, Pseudomonas aeruginosa PA01
ggauguuccaggcccgc

SEQ ID NO: 3401580 - RNA, 19 nt, Pseudomonas aeruginosa PA01
ggauguuccaggcccgccg

SEQ ID NO: 3401581 - RNA, 18 nt, Pseudomonas aeruginosa PA01
ggauguucgaaggccagu

SEQ ID NO: 3401582 - RNA, 21 nt, Pseudomonas aeruginosa PA01
ggauguucgccgaggggcggg

SEQ ID NO: 3401583 - RNA, 15 nt, Pseudomonas aeruginosa PA01
ggauguucgccgcca

SEQ ID NO: 3401584 - RNA, 22 nt, Pseudomonas aeruginosa PA01
ggauguugccgccgccgaggag

SEQ ID NO: 3401585 - RNA, 19 nt, Pseudomonas aeruginosa PA01
ggauucaucggcggcaggc

SEQ ID NO: 3401586 - RNA, 21 nt, Pseudomonas aeruginosa PA01
ggauucaucggcggcaggccg

SEQ ID NO: 3401587 - RNA, 20 nt, Pseudomonas aeruginosa PA01
ggauuccacccgcuccgcgg

SEQ ID NO: 3401588 - RNA, 16 nt, Pseudomonas aeruginosa PA01
ggauuccgggucgagg

SEQ ID NO: 3401589 - RNA, 15 nt, Pseudomonas aeruginosa PA01
ggauuccuacgaagg

SEQ ID NO: 3401590 - RNA, 20 nt, Pseudomonas aeruginosa PA01
ggauucgaaccacugcgcca

SEQ ID NO: 3401591 - RNA, 20 nt, Pseudomonas aeruginosa PA01
ggauucgccagccucggcga

SEQ ID NO: 3401592 - RNA, 18 nt, Pseudomonas aeruginosa PA01
ggauugacgauggccagc

SEQ ID NO: 3401593 - RNA, 22 nt, Pseudomonas aeruginosa PA01
ggauugccgcgggucucgauca

SEQ ID NO: 3401594 - RNA, 23 nt, Pseudomonas aeruginosa PA01
ggauugguggucaccagcguggg

SEQ ID NO: 3401595 - RNA, 13 nt, Pseudomonas aeruginosa PA01
ggauugucgccgc

SEQ ID NO: 3401596 - RNA, 16 nt, Pseudomonas aeruginosa PA01
ggauuucagcaggccg

SEQ ID NO: 3401597 - RNA, 15 nt, Pseudomonas aeruginosa PA01
ggauuuccgcggccg

SEQ ID NO: 3401598 - RNA, 16 nt, Pseudomonas aeruginosa PA01
ggauuuccgcggccgg

SEQ ID NO: 3401599 - RNA, 18 nt, Pseudomonas aeruginosa PA01
ggauuuccuucggcaccc

SEQ ID NO: 3401600 - RNA, 20 nt, Pseudomonas aeruginosa PA01
ggauuucgccgaguggccgc

SEQ ID NO: 3401601 - RNA, 12 nt, Pseudomonas aeruginosa PA01
ggcaaagcccgc

SEQ ID NO: 3401602 - RNA, 13 nt, Pseudomonas aeruginosa PA01
ggcaaagcgcggg

SEQ ID NO: 3401603 - RNA, 19 nt, Pseudomonas aeruginosa PA01
ggcaaaggcccggcgcggu

SEQ ID NO: 3401604 - RNA, 13 nt, Pseudomonas aeruginosa PA01
ggcaaaggcgcgc

SEQ ID NO: 3401605 - RNA, 14 nt, Pseudomonas aeruginosa PA01
ggcaaaggcgcgca

SEQ ID NO: 3401606 - RNA, 19 nt, Pseudomonas aeruginosa PA01
ggcaacacccucccuaucu

SEQ ID NO: 3401607 - RNA, 14 nt, Pseudomonas aeruginosa PA01
ggcaacccagggcg

SEQ ID NO: 3401608 - RNA, 16 nt, Pseudomonas aeruginosa PA01
ggcaaccgcggcggcc

SEQ ID NO: 3401609 - RNA, 17 nt, Pseudomonas aeruginosa PA01
ggcaaccgcggcggccu

SEQ ID NO: 3401610 - RNA, 15 nt, Pseudomonas aeruginosa PA01
ggcaaccgggcggga

SEQ ID NO: 3401611 - RNA, 22 nt, Pseudomonas aeruginosa PA01
ggcaaccgggcgggacucgccg

SEQ ID NO: 3401612 - RNA, 22 nt, Pseudomonas aeruginosa PA01
ggcaaccggguaccugcucgcg

SEQ ID NO: 3401613 - RNA, 19 nt, Pseudomonas aeruginosa PA01
ggcaacgaacuucagggcu

SEQ ID NO: 3401614 - RNA, 19 nt, Pseudomonas aeruginosa PA01
ggcaacgacgaggccugga

SEQ ID NO: 3401615 - RNA, 23 nt, Pseudomonas aeruginosa PA01
ggcaacgagcaggacugcccgcg

SEQ ID NO: 3401616 - RNA, 18 nt, Pseudomonas aeruginosa PA01
ggcaacgauaccgccgcc

SEQ ID NO: 3401617 - RNA, 22 nt, Pseudomonas aeruginosa PA01
ggcaacgauucgacgcagcgcg

SEQ ID NO: 3401618 - RNA, 17 nt, Pseudomonas aeruginosa PA01
ggcaacgccaggccgcu

SEQ ID NO: 3401619 - RNA, 16 nt, Pseudomonas aeruginosa PA01
ggcaacgcgcagaggc

SEQ ID NO: 3401620 - RNA, 22 nt, Pseudomonas aeruginosa PA01
ggcaacgcgcccacuccuccgc

SEQ ID NO: 3401621 - RNA, 14 nt, Pseudomonas aeruginosa PA01
ggcaacggagcugg

SEQ ID NO: 3401622 - RNA, 19 nt, Pseudomonas aeruginosa PA01
ggcaacggagcugguacgc

SEQ ID NO: 3401623 - RNA, 14 nt, Pseudomonas aeruginosa PA01
ggcaacggcugggu

SEQ ID NO: 3401624 - RNA, 14 nt, Pseudomonas aeruginosa PA01
ggcaacgucaggcu

SEQ ID NO: 3401625 - RNA, 17 nt, Pseudomonas aeruginosa PA01
ggcaacgucaggcugua

SEQ ID NO: 3401626 - RNA, 15 nt, Pseudomonas aeruginosa PA01
ggcaacugaucagcc

SEQ ID NO: 3401627 - RNA, 17 nt, Pseudomonas aeruginosa PA01
ggcaacugaucagccgg

SEQ ID NO: 3401628 - RNA, 20 nt, Pseudomonas aeruginosa PA01
ggcaacugaucagccgggcg

SEQ ID NO: 3401629 - RNA, 18 nt, Pseudomonas aeruginosa PA01
ggcaacugccgauggucu

SEQ ID NO: 3401630 - RNA, 18 nt, Pseudomonas aeruginosa PA01
ggcaacugccgcccgcuc

SEQ ID NO: 3401631 - RNA, 20 nt, Pseudomonas aeruginosa PA01
ggcaagacgaaagagcccgg

SEQ ID NO: 3401632 - RNA, 22 nt, Pseudomonas aeruginosa PA01
ggcaagacgaaagagcccggca

SEQ ID NO: 3401633 - RNA, 14 nt, Pseudomonas aeruginosa PA01
ggcaagcaggccgc

SEQ ID NO: 3401634 - RNA, 18 nt, Pseudomonas aeruginosa PA01
ggcaagcaggccgcggua

SEQ ID NO: 3401635 - RNA, 21 nt, Pseudomonas aeruginosa PA01
ggcaagccucgcguucgcggu

SEQ ID NO: 3401636 - RNA, 23 nt, Pseudomonas aeruginosa PA01
ggcaagccuggcgcgcugcggca

SEQ ID NO: 3401637 - RNA, 14 nt, Pseudomonas aeruginosa PA01
ggcaagcgccggca

SEQ ID NO: 3401638 - RNA, 16 nt, Pseudomonas aeruginosa PA01
ggcaagcucgacgagc

SEQ ID NO: 3401639 - RNA, 18 nt, Pseudomonas aeruginosa PA01
ggcaagcugaagcgccgc

SEQ ID NO: 3401640 - RNA, 21 nt, Pseudomonas aeruginosa PA01
ggcaagcugaagcgccgcggc

SEQ ID NO: 3401641 - RNA, 22 nt, Pseudomonas aeruginosa PA01
ggcaagcugaagcgccgcggcc

SEQ ID NO: 3401642 - RNA, 19 nt, Pseudomonas aeruginosa PA01
ggcaagcugcacggcgacc

SEQ ID NO: 3401643 - RNA, 13 nt, Pseudomonas aeruginosa PA01
ggcaaggaccugc

SEQ ID NO: 3401644 - RNA, 16 nt, Pseudomonas aeruginosa PA01
ggcaaggaccugcugc

SEQ ID NO: 3401645 - RNA, 20 nt, Pseudomonas aeruginosa PA01
ggcaaggaccugcugcccgg

SEQ ID NO: 3401646 - RNA, 22 nt, Pseudomonas aeruginosa PA01
ggcaaggccaagucggccgccc

SEQ ID NO: 3401647 - RNA, 13 nt, Pseudomonas aeruginosa PA01
ggcaaggcggccu

SEQ ID NO: 3401648 - RNA, 14 nt, Pseudomonas aeruginosa PA01
ggcaaggcggccuc

SEQ ID NO: 3401649 - RNA, 21 nt, Pseudomonas aeruginosa PA01
ggcaagggcacgugcagcggc

SEQ ID NO: 3401650 - RNA, 16 nt, Pseudomonas aeruginosa PA01
ggcaagggccugcuca

SEQ ID NO: 3401651 - RNA, 19 nt, Pseudomonas aeruginosa PA01
ggcaagggccugcucagcg

SEQ ID NO: 3401652 - RNA, 22 nt, Pseudomonas aeruginosa PA01
ggcaagguaguccaucaccgcg

SEQ ID NO: 3401653 - RNA, 23 nt, Pseudomonas aeruginosa PA01
ggcaagguaguccaucaccgcgg

SEQ ID NO: 3401654 - RNA, 19 nt, Pseudomonas aeruginosa PA01
ggcaaggucgucucagacc

SEQ ID NO: 3401655 - RNA, 22 nt, Pseudomonas aeruginosa PA01
ggcaaguaaugccgaaggcguc

SEQ ID NO: 3401656 - RNA, 17 nt, Pseudomonas aeruginosa PA01
ggcaagugggucacggu

SEQ ID NO: 3401657 - RNA, 21 nt, Pseudomonas aeruginosa PA01
ggcaaguucgcauaggcggcc

SEQ ID NO: 3401658 - RNA, 15 nt, Pseudomonas aeruginosa PA01
ggcaauagccgggcu

SEQ ID NO: 3401659 - RNA, 14 nt, Pseudomonas aeruginosa PA01
ggcaaucaggcgcg

SEQ ID NO: 3401660 - RNA, 20 nt, Pseudomonas aeruginosa PA01
ggcaaucaggcgcgaucgcg

SEQ ID NO: 3401661 - RNA, 19 nt, Pseudomonas aeruginosa PA01
ggcaaucaucgcgucgccg

SEQ ID NO: 3401662 - RNA, 20 nt, Pseudomonas aeruginosa PA01
ggcaaucaucgcgucgccga

SEQ ID NO: 3401663 - RNA, 21 nt, Pseudomonas aeruginosa PA01
ggcaaucaucgcgucgccgaa

SEQ ID NO: 3401664 - RNA, 15 nt, Pseudomonas aeruginosa PA01
ggcaaucgcggggug

SEQ ID NO: 3401665 - RNA, 19 nt, Pseudomonas aeruginosa PA01
ggcaaucucccccucuucg

SEQ ID NO: 3401666 - RNA, 16 nt, Pseudomonas aeruginosa PA01
ggcaaucugcccggca

SEQ ID NO: 3401667 - RNA, 14 nt, Pseudomonas aeruginosa PA01
ggcaauggccggcg

SEQ ID NO: 3401668 - RNA, 15 nt, Pseudomonas aeruginosa PA01
ggcaauggccggcgg

SEQ ID NO: 3401669 - RNA, 17 nt, Pseudomonas aeruginosa PA01
ggcaauggccggcgggc

SEQ ID NO: 3401670 - RNA, 19 nt, Pseudomonas aeruginosa PA01
ggcaauggccggcgggcgc

SEQ ID NO: 3401671 - RNA, 14 nt, Pseudomonas aeruginosa PA01
ggcaauggcggugu

SEQ ID NO: 3401672 - RNA, 19 nt, Pseudomonas aeruginosa PA01
ggcaauguccgagcagguc

SEQ ID NO: 3401673 - RNA, 23 nt, Pseudomonas aeruginosa PA01
ggcaauguccgagcaggucgcgg

SEQ ID NO: 3401674 - RNA, 22 nt, Pseudomonas aeruginosa PA01
ggcacacgcccggcacucgccg

SEQ ID NO: 3401675 - RNA, 15 nt, Pseudomonas aeruginosa PA01
ggcacacgucggcau

SEQ ID NO: 3401676 - RNA, 20 nt, Pseudomonas aeruginosa PA01
ggcacagccauagugcuggg

SEQ ID NO: 3401677 - RNA, 17 nt, Pseudomonas aeruginosa PA01
ggcacagcguggccagc

SEQ ID NO: 3401678 - RNA, 18 nt, Pseudomonas aeruginosa PA01
ggcacagcguggccagcg

SEQ ID NO: 3401679 - RNA, 19 nt, Pseudomonas aeruginosa PA01
ggcacagcguggccagcgc

SEQ ID NO: 3401680 - RNA, 23 nt, Pseudomonas aeruginosa PA01
ggcagaguggcgcggcugaucgg

SEQ ID NO: 3401681 - RNA, 21 nt, Pseudomonas aeruginosa PA01
ggcagaguuucucggucgccg

SEQ ID NO: 3401682 - RNA, 23 nt, Pseudomonas aeruginosa PA01
ggcagaguuucucggucgccgcc

SEQ ID NO: 3401683 - RNA, 13 nt, Pseudomonas aeruginosa PA01
ggcagauccgccg

SEQ ID NO: 3401684 - RNA, 15 nt, Pseudomonas aeruginosa PA01
ggcagauccgccgug

SEQ ID NO: 3401685 - RNA, 12 nt, Pseudomonas aeruginosa PA01
ggcagaucgcgc

SEQ ID NO: 3401686 - RNA, 16 nt, Pseudomonas aeruginosa PA01
ggcagaucgcgccgag

SEQ ID NO: 3401687 - RNA, 19 nt, Pseudomonas aeruginosa PA01
ggcagauguccaggcaggc

SEQ ID NO: 3401688 - RNA, 19 nt, Pseudomonas aeruginosa PA01
ggcagcacaugccacgcac

SEQ ID NO: 3401689 - RNA, 13 nt, Pseudomonas aeruginosa PA01
ggcagcaccaggc

SEQ ID NO: 3401690 - RNA, 13 nt, Pseudomonas aeruginosa PA01
ggcagcacgcugg

SEQ ID NO: 3401691 - RNA, 20 nt, Pseudomonas aeruginosa PA01
ggcagcacgucuugcaggcu

SEQ ID NO: 3401692 - RNA, 21 nt, Pseudomonas aeruginosa PA01
ggcagcacgucuugcaggcuc

SEQ ID NO: 3401693 - RNA, 12 nt, Pseudomonas aeruginosa PA01
ggcagcagagcg

SEQ ID NO: 3401694 - RNA, 16 nt, Pseudomonas aeruginosa PA01
ggcagcagagcgccac

SEQ ID NO: 3401695 - RNA, 18 nt, Pseudomonas aeruginosa PA01
ggcagcagcgaacgccgc

SEQ ID NO: 3401696 - RNA, 21 nt, Pseudomonas aeruginosa PA01
ggcagcagcgccaggaagccg

SEQ ID NO: 3401697 - RNA, 15 nt, Pseudomonas aeruginosa PA01
ggcagcagcuugccg

SEQ ID NO: 3401698 - RNA, 12 nt, Pseudomonas aeruginosa PA01
ggcagcaggccg

SEQ ID NO: 3401699 - RNA, 14 nt, Pseudomonas aeruginosa PA01
ggcagcaggccgcc

SEQ ID NO: 3401700 - RNA, 15 nt, Pseudomonas aeruginosa PA01
ggcagcaggccgccg

SEQ ID NO: 3401701 - RNA, 16 nt, Pseudomonas aeruginosa PA01
ggcagcaggccgccgc

SEQ ID NO: 3401702 - RNA, 16 nt, Pseudomonas aeruginosa PA01
ggcagcaggcgggcga

SEQ ID NO: 3401703 - RNA, 13 nt, Pseudomonas aeruginosa PA01
ggcagcaggguca

SEQ ID NO: 3401704 - RNA, 15 nt, Pseudomonas aeruginosa PA01
ggcagcagggucagc

SEQ ID NO: 3401705 - RNA, 18 nt, Pseudomonas aeruginosa PA01
ggcagcagggucagcagc

SEQ ID NO: 3401706 - RNA, 15 nt, Pseudomonas aeruginosa PA01
ggcagcaggucgcgc

SEQ ID NO: 3401707 - RNA, 18 nt, Pseudomonas aeruginosa PA01
ggcagcaggucgcgcagu

SEQ ID NO: 3401708 - RNA, 19 nt, Pseudomonas aeruginosa PA01
ggcagcagucgcagcucgg

SEQ ID NO: 3401709 - RNA, 14 nt, Pseudomonas aeruginosa PA01
ggcagcaucagccg

SEQ ID NO: 3401710 - RNA, 18 nt, Pseudomonas aeruginosa PA01
ggcagcaucucggucgca

SEQ ID NO: 3401711 - RNA, 13 nt, Pseudomonas aeruginosa PA01
ggcagccaccagg

SEQ ID NO: 3401712 - RNA, 16 nt, Pseudomonas aeruginosa PA01
ggcagccacucggcca

SEQ ID NO: 3401713 - RNA, 19 nt, Pseudomonas aeruginosa PA01
ggcagccacucggccaggc

SEQ ID NO: 3401714 - RNA, 21 nt, Pseudomonas aeruginosa PA01
ggcagccacucggccaggcgc

SEQ ID NO: 3401715 - RNA, 14 nt, Pseudomonas aeruginosa PA01
ggcagccagccgcc

SEQ ID NO: 3401716 - RNA, 18 nt, Pseudomonas aeruginosa PA01
ggcagccccuugagcgcg

SEQ ID NO: 3401717 - RNA, 15 nt, Pseudomonas aeruginosa PA01
ggcagccgccgcggc

SEQ ID NO: 3401718 - RNA, 16 nt, Pseudomonas aeruginosa PA01
ggcagccgccgcggca

SEQ ID NO: 3401719 - RNA, 18 nt, Pseudomonas aeruginosa PA01
ggcagccgccgcggcacc

SEQ ID NO: 3401720 - RNA, 16 nt, Pseudomonas aeruginosa PA01
ggcagccgcguugucc

SEQ ID NO: 3401721 - RNA, 18 nt, Pseudomonas aeruginosa PA01
ggcagccggccaugcugg

SEQ ID NO: 3401722 - RNA, 22 nt, Pseudomonas aeruginosa PA01
ggcagccggccaugcuggcgcu

SEQ ID NO: 3401723 - RNA, 13 nt, Pseudomonas aeruginosa PA01
ggcagccguccgc

SEQ ID NO: 3401724 - RNA, 12 nt, Pseudomonas aeruginosa PA01
ggcagccgucgg

SEQ ID NO: 3401725 - RNA, 15 nt, Pseudomonas aeruginosa PA01
ggcagccgucgguga

SEQ ID NO: 3401726 - RNA, 14 nt, Pseudomonas aeruginosa PA01
ggcagccguuggcg

SEQ ID NO: 3401727 - RNA, 13 nt, Pseudomonas aeruginosa PA01
ggcagccuuggcc

SEQ ID NO: 3401728 - RNA, 16 nt, Pseudomonas aeruginosa PA01
ggcagccuuggccacg

SEQ ID NO: 3401729 - RNA, 17 nt, Pseudomonas aeruginosa PA01
ggcagccuuggccacgg

SEQ ID NO: 3401730 - RNA, 19 nt, Pseudomonas aeruginosa PA01
ggcagccuuggccacggca

SEQ ID NO: 3401731 - RNA, 19 nt, Pseudomonas aeruginosa PA01
ggcagcgaccaccaccagg

SEQ ID NO: 3401732 - RNA, 13 nt, Pseudomonas aeruginosa PA01
ggcagcgagcggg

SEQ ID NO: 3401733 - RNA, 16 nt, Pseudomonas aeruginosa PA01
ggcagcgagcggguca

SEQ ID NO: 3401734 - RNA, 22 nt, Pseudomonas aeruginosa PA01
ggcagcgauaaccgcguugcgg

SEQ ID NO: 3401735 - RNA, 13 nt, Pseudomonas aeruginosa PA01
ggcagcgaucgcc

SEQ ID NO: 3401736 - RNA, 22 nt, Pseudomonas aeruginosa PA01
ggcagcgccagguaguccagcg

SEQ ID NO: 3401737 - RNA, 19 nt, Pseudomonas aeruginosa PA01
ggcagcgccaucaggcccu

SEQ ID NO: 3401738 - RNA, 14 nt, Pseudomonas aeruginosa PA01
ggcagcgccgaggu

SEQ ID NO: 3401739 - RNA, 22 nt, Pseudomonas aeruginosa PA01
ggcagcgccgaggucuuggcca

SEQ ID NO: 3401740 - RNA, 12 nt, Pseudomonas aeruginosa PA01
ggcagcgccgcc

SEQ ID NO: 3401741 - RNA, 16 nt, Pseudomonas aeruginosa PA01
ggcagcgccgccagca

SEQ ID NO: 3401742 - RNA, 20 nt, Pseudomonas aeruginosa PA01
ggcagcgccgccagcaggau

SEQ ID NO: 3401743 - RNA, 13 nt, Pseudomonas aeruginosa PA01
ggcagcgccgccc

SEQ ID NO: 3401744 - RNA, 14 nt, Pseudomonas aeruginosa PA01
ggcagcgccgccgg

SEQ ID NO: 3401745 - RNA, 17 nt, Pseudomonas aeruginosa PA01
ggcagcgccgccgggcg

SEQ ID NO: 3401746 - RNA, 18 nt, Pseudomonas aeruginosa PA01
ggcagcgccgccgggcgu

SEQ ID NO: 3401747 - RNA, 13 nt, Pseudomonas aeruginosa PA01
ggcagcgccgcgc

SEQ ID NO: 3401748 - RNA, 14 nt, Pseudomonas aeruginosa PA01
ggcagcgccgcgcg

SEQ ID NO: 3401749 - RNA, 17 nt, Pseudomonas aeruginosa PA01
ggcagcgccgcgcggca

SEQ ID NO: 3401750 - RNA, 18 nt, Pseudomonas aeruginosa PA01
ggcagcgccucggcggcg

SEQ ID NO: 3401751 - RNA, 20 nt, Pseudomonas aeruginosa PA01
ggcagcgccucggcggcguu

SEQ ID NO: 3401752 - RNA, 20 nt, Pseudomonas aeruginosa PA01
ggcagcgcgauaucgcaggc

SEQ ID NO: 3401753 - RNA, 22 nt, Pseudomonas aeruginosa PA01
ggcagcgcgauaucgcaggcca

SEQ ID NO: 3401754 - RNA, 17 nt, Pseudomonas aeruginosa PA01
ggcagcgcuacgcaggc

SEQ ID NO: 3401755 - RNA, 20 nt, Pseudomonas aeruginosa PA01
ggcagcgcuacgcaggcccu

SEQ ID NO: 3401756 - RNA, 14 nt, Pseudomonas aeruginosa PA01
ggcagcgcuggcga

SEQ ID NO: 3401757 - RNA, 23 nt, Pseudomonas aeruginosa PA01
ggcagcgcuucguugcuccugcg

SEQ ID NO: 3401758 - RNA, 13 nt, Pseudomonas aeruginosa PA01
ggcagcggcgagu

SEQ ID NO: 3401759 - RNA, 15 nt, Pseudomonas aeruginosa PA01
ggcagcggcucguca

SEQ ID NO: 3401760 - RNA, 21 nt, Pseudomonas aeruginosa PA01
ggcagcggcuggccgucgacc

SEQ ID NO: 3401761 - RNA, 13 nt, Pseudomonas aeruginosa PA01
ggcagcgggccag

SEQ ID NO: 3401762 - RNA, 14 nt, Pseudomonas aeruginosa PA01
ggcagcgggccagg

SEQ ID NO: 3401763 - RNA, 17 nt, Pseudomonas aeruginosa PA01
ggcagcgggccaggcgg

SEQ ID NO: 3401764 - RNA, 15 nt, Pseudomonas aeruginosa PA01
ggcagcggucgccgg

SEQ ID NO: 3401765 - RNA, 17 nt, Pseudomonas aeruginosa PA01
ggcagcggucgccgguc

SEQ ID NO: 3401766 - RNA, 20 nt, Pseudomonas aeruginosa PA01
ggcagcgguucgcccgcggg

SEQ ID NO: 3401767 - RNA, 22 nt, Pseudomonas aeruginosa PA01
ggcagcgguucgcccgcgggca

SEQ ID NO: 3401768 - RNA, 17 nt, Pseudomonas aeruginosa PA01
ggcagcguccgaacgcg

SEQ ID NO: 3401769 - RNA, 18 nt, Pseudomonas aeruginosa PA01
ggcagcguccgaacgcgc

SEQ ID NO: 3401770 - RNA, 20 nt, Pseudomonas aeruginosa PA01
ggcagcguccgaacgcgcug

SEQ ID NO: 3401771 - RNA, 23 nt, Pseudomonas aeruginosa PA01
ggcagcguccgaacgcgcugacg

SEQ ID NO: 3401772 - RNA, 20 nt, Pseudomonas aeruginosa PA01
ggcagcgucgagcuggcgca

SEQ ID NO: 3401773 - RNA, 14 nt, Pseudomonas aeruginosa PA01
ggcagcgucgccgg

SEQ ID NO: 3401774 - RNA, 17 nt, Pseudomonas aeruginosa PA01
ggcagcgucgccgggcg

SEQ ID NO: 3401775 - RNA, 19 nt, Pseudomonas aeruginosa PA01
ggcagcgucgccgggcgua

SEQ ID NO: 3401776 - RNA, 16 nt, Pseudomonas aeruginosa PA01
ggcagcgucucagccc

SEQ ID NO: 3401777 - RNA, 19 nt, Pseudomonas aeruginosa PA01
ggcagcgucucagcccucg

SEQ ID NO: 3401778 - RNA, 19 nt, Pseudomonas aeruginosa PA01
ggcagcgucucggcugccg

SEQ ID NO: 3401779 - RNA, 17 nt, Pseudomonas aeruginosa PA01
ggcagcgugcaccagca

SEQ ID NO: 3401780 - RNA, 21 nt, Pseudomonas aeruginosa PA01
ggcagcucauaggucagguac

SEQ ID NO: 3401781 - RNA, 19 nt, Pseudomonas aeruginosa PA01
ggcagcucccuugccgccg

SEQ ID NO: 3401782 - RNA, 22 nt, Pseudomonas aeruginosa PA01
ggcagcucgcuaugcagcaggu

SEQ ID NO: 3401783 - RNA, 16 nt, Pseudomonas aeruginosa PA01
ggcagguugugguugg

SEQ ID NO: 3401784 - RNA, 23 nt, Pseudomonas aeruginosa PA01
ggcagguugugguugggcaggcg

SEQ ID NO: 3401785 - RNA, 21 nt, Pseudomonas aeruginosa PA01
ggcagguuguucgccgcagcg

SEQ ID NO: 3401786 - RNA, 16 nt, Pseudomonas aeruginosa PA01
ggcagguuucgcgaua

SEQ ID NO: 3401787 - RNA, 21 nt, Pseudomonas aeruginosa PA01
ggcaguacucaugaccgccgc

SEQ ID NO: 3401788 - RNA, 16 nt, Pseudomonas aeruginosa PA01
ggcagucccagaaggc

SEQ ID NO: 3401789 - RNA, 14 nt, Pseudomonas aeruginosa PA01
ggcaguccucgccg

SEQ ID NO: 3401790 - RNA, 20 nt, Pseudomonas aeruginosa PA01
ggcaguccuugagcgccagc

SEQ ID NO: 3401791 - RNA, 22 nt, Pseudomonas aeruginosa PA01
ggcaguccuugagcgccagcag

SEQ ID NO: 3401792 - RNA, 23 nt, Pseudomonas aeruginosa PA01
ggcaguccuugagcgccagcagg

SEQ ID NO: 3401793 - RNA, 12 nt, Pseudomonas aeruginosa PA01
ggcagucgccgc

SEQ ID NO: 3401794 - RNA, 17 nt, Pseudomonas aeruginosa PA01
ggcagucgccgcaccgg

SEQ ID NO: 3401795 - RNA, 22 nt, Pseudomonas aeruginosa PA01
ggcagucgguagaaauccuccg

SEQ ID NO: 3401796 - RNA, 15 nt, Pseudomonas aeruginosa PA01
ggcagucgucgcagc

SEQ ID NO: 3401797 - RNA, 15 nt, Pseudomonas aeruginosa PA01
ggcagugcgccggca

SEQ ID NO: 3401798 - RNA, 21 nt, Pseudomonas aeruginosa PA01
ggcagugcgccggcaucgcca

SEQ ID NO: 3401799 - RNA, 18 nt, Pseudomonas aeruginosa PA01
ggcagugcucgaucaggc

SEQ ID NO: 3401800 - RNA, 20 nt, Pseudomonas aeruginosa PA01
ggcagugcucgaucaggcug

SEQ ID NO: 3401801 - RNA, 16 nt, Pseudomonas aeruginosa PA01
ggcaguggcgccagcc

SEQ ID NO: 3401802 - RNA, 19 nt, Pseudomonas aeruginosa PA01
ggcaguggcgccagccagc

SEQ ID NO: 3401803 - RNA, 19 nt, Pseudomonas aeruginosa PA01
ggcaguggugauccgcacc

SEQ ID NO: 3401804 - RNA, 13 nt, Pseudomonas aeruginosa PA01
ggcaguuccaggc

SEQ ID NO: 3401805 - RNA, 14 nt, Pseudomonas aeruginosa PA01
ggcaguuccgccag

SEQ ID NO: 3401806 - RNA, 13 nt, Pseudomonas aeruginosa PA01
ggcauaccgcccg

SEQ ID NO: 3401807 - RNA, 17 nt, Pseudomonas aeruginosa PA01
ggcauagaugccgcccu

SEQ ID NO: 3401808 - RNA, 22 nt, Pseudomonas aeruginosa PA01
ggcauagccgaacuccgccagc

SEQ ID NO: 3401809 - RNA, 13 nt, Pseudomonas aeruginosa PA01
ggcauagcgcagc

SEQ ID NO: 3401810 - RNA, 17 nt, Pseudomonas aeruginosa PA01
ggcauagcgcagccgcu

SEQ ID NO: 3401811 - RNA, 19 nt, Pseudomonas aeruginosa PA01
ggcauaggcccggcgugcc

SEQ ID NO: 3401812 - RNA, 15 nt, Pseudomonas aeruginosa PA01
ggcauaggcgccagc

SEQ ID NO: 3401813 - RNA, 16 nt, Pseudomonas aeruginosa PA01
ggcauaggcgccagcc

SEQ ID NO: 3401814 - RNA, 22 nt, Pseudomonas aeruginosa PA01
ggcauauggaucggccucgcgg

SEQ ID NO: 3401815 - RNA, 23 nt, Pseudomonas aeruginosa PA01
ggcauauggaucggccucgcggc

SEQ ID NO: 3401816 - RNA, 24 nt, Pseudomonas aeruginosa PA01
ggcauauggaucggccucgcggcg

SEQ ID NO: 3401817 - RNA, 19 nt, Pseudomonas aeruginosa PA01
ggcaucaccggcgggaugu

SEQ ID NO: 3401818 - RNA, 11 nt, Pseudomonas aeruginosa PA01
ggcaucagccc

SEQ ID NO: 3401819 - RNA, 17 nt, Pseudomonas aeruginosa PA01
ggcaucaguagcgggca

SEQ ID NO: 3401820 - RNA, 16 nt, Pseudomonas aeruginosa PA01
ggcauccagcggacgc

SEQ ID NO: 3401821 - RNA, 20 nt, Pseudomonas aeruginosa PA01
ggcauccccggaccagggcg

SEQ ID NO: 3401822 - RNA, 17 nt, Pseudomonas aeruginosa PA01
ggcauccccuuuuuuca

SEQ ID NO: 3401823 - RNA, 23 nt, Pseudomonas aeruginosa PA01
ggcauccccuuuuuucagccugu

SEQ ID NO: 3401824 - RNA, 19 nt, Pseudomonas aeruginosa PA01
ggcauccccuuuuuuugcg

SEQ ID NO: 3401825 - RNA, 13 nt, Pseudomonas aeruginosa PA01
ggcaucccgcccg

SEQ ID NO: 3401826 - RNA, 14 nt, Pseudomonas aeruginosa PA01
ggcaucccgcccgg

SEQ ID NO: 3401827 - RNA, 20 nt, Pseudomonas aeruginosa PA01
ggcaucccgcccggucucag

SEQ ID NO: 3401828 - RNA, 24 nt, Pseudomonas aeruginosa PA01
ggcaucccgcccggucucagccgg

SEQ ID NO: 3401829 - RNA, 15 nt, Pseudomonas aeruginosa PA01
ggcaucccuuuuuca

SEQ ID NO: 3401830 - RNA, 16 nt, Pseudomonas aeruginosa PA01
ggcauccgccgcuggg

SEQ ID NO: 3401831 - RNA, 14 nt, Pseudomonas aeruginosa PA01
ggcauccugccgcc

SEQ ID NO: 3401832 - RNA, 16 nt, Pseudomonas aeruginosa PA01
ggcauccugccgccug

SEQ ID NO: 3401833 - RNA, 15 nt, Pseudomonas aeruginosa PA01
ggcauccuggcgguu

SEQ ID NO: 3401834 - RNA, 17 nt, Pseudomonas aeruginosa PA01
ggcauccuguggcugca

SEQ ID NO: 3401835 - RNA, 14 nt, Pseudomonas aeruginosa PA01
ggcaucgaccagca

SEQ ID NO: 3401836 - RNA, 16 nt, Pseudomonas aeruginosa PA01
ggcaucgaccagcagc

SEQ ID NO: 3401837 - RNA, 20 nt, Pseudomonas aeruginosa PA01
ggcaucgaccagcagcggcu

SEQ ID NO: 3401838 - RNA, 22 nt, Pseudomonas aeruginosa PA01
ggcaucgacgauguacugcucg

SEQ ID NO: 3401839 - RNA, 23 nt, Pseudomonas aeruginosa PA01
ggcaucgacgauguacugcucgg

SEQ ID NO: 3401840 - RNA, 15 nt, Pseudomonas aeruginosa PA01
ggcaucgacgccagc

SEQ ID NO: 3401841 - RNA, 20 nt, Pseudomonas aeruginosa PA01
ggcaucgacgccagcggcga

SEQ ID NO: 3401842 - RNA, 14 nt, Pseudomonas aeruginosa PA01
ggcaucgauccgca

SEQ ID NO: 3401843 - RNA, 16 nt, Pseudomonas aeruginosa PA01
ggcaucgauccgcacc

SEQ ID NO: 3401844 - RNA, 16 nt, Pseudomonas aeruginosa PA01
ggcaucgaucuugccc

SEQ ID NO: 3401845 - RNA, 15 nt, Pseudomonas aeruginosa PA01
ggcaucgccauggcg

SEQ ID NO: 3401846 - RNA, 16 nt, Pseudomonas aeruginosa PA01
ggcaucgccgaccacu

SEQ ID NO: 3401847 - RNA, 12 nt, Pseudomonas aeruginosa PA01
ggcaucgccgcc

SEQ ID NO: 3401848 - RNA, 20 nt, Pseudomonas aeruginosa PA01
ggcaucgcgaaaacucccgg

SEQ ID NO: 3401849 - RNA, 22 nt, Pseudomonas aeruginosa PA01
ggcaucgcgaaaacucccggcc

SEQ ID NO: 3401850 - RNA, 18 nt, Pseudomonas aeruginosa PA01
ggcaucggagaccacggu

SEQ ID NO: 3401851 - RNA, 13 nt, Pseudomonas aeruginosa PA01
ggcaucggccugg

SEQ ID NO: 3401852 - RNA, 14 nt, Pseudomonas aeruginosa PA01
ggcaucggccuggu

SEQ ID NO: 3401853 - RNA, 13 nt, Pseudomonas aeruginosa PA01
ggcaucggcgccg

SEQ ID NO: 3401854 - RNA, 14 nt, Pseudomonas aeruginosa PA01
ggcaucggcgccgc

SEQ ID NO: 3401855 - RNA, 17 nt, Pseudomonas aeruginosa PA01
ggcaucggcgccgcgca

SEQ ID NO: 3401856 - RNA, 16 nt, Pseudomonas aeruginosa PA01
ggcaucgucgaagggc

SEQ ID NO: 3401857 - RNA, 13 nt, Pseudomonas aeruginosa PA01
ggcaucguggcca

SEQ ID NO: 3401858 - RNA, 13 nt, Pseudomonas aeruginosa PA01
ggcaucucgaugg

SEQ ID NO: 3401859 - RNA, 13 nt, Pseudomonas aeruginosa PA01
ggcaucucggcca

SEQ ID NO: 3401860 - RNA, 14 nt, Pseudomonas aeruginosa PA01
ggcaucucggccac

SEQ ID NO: 3401861 - RNA, 12 nt, Pseudomonas aeruginosa PA01
ggcaucugccgg

SEQ ID NO: 3401862 - RNA, 19 nt, Pseudomonas aeruginosa PA01
ggcaucuuguguaccacca

SEQ ID NO: 3401863 - RNA, 20 nt, Pseudomonas aeruginosa PA01
ggcaugaacgaaaacgccgc

SEQ ID NO: 3401864 - RNA, 21 nt, Pseudomonas aeruginosa PA01
ggcaugaacgaaaacgccgcu

SEQ ID NO: 3401865 - RNA, 18 nt, Pseudomonas aeruginosa PA01
ggcaugaccgauggcgcc

SEQ ID NO: 3401866 - RNA, 19 nt, Pseudomonas aeruginosa PA01
ggcaugaccgauggcgccg

SEQ ID NO: 3401867 - RNA, 20 nt, Pseudomonas aeruginosa PA01
ggcaugaccgauggcgccgc

SEQ ID NO: 3401868 - RNA, 20 nt, Pseudomonas aeruginosa PA01
ggcaugaggggaaucgccgu

SEQ ID NO: 3401869 - RNA, 21 nt, Pseudomonas aeruginosa PA01
ggcaugaugcgcccguccucc

SEQ ID NO: 3401870 - RNA, 16 nt, Pseudomonas aeruginosa PA01
ggcaugcaagaggucg

SEQ ID NO: 3401871 - RNA, 20 nt, Pseudomonas aeruginosa PA01
ggcaugcaagaggucgacgg

SEQ ID NO: 3401872 - RNA, 13 nt, Pseudomonas aeruginosa PA01
ggcaugcccaggc

SEQ ID NO: 3401873 - RNA, 14 nt, Pseudomonas aeruginosa PA01
ggcaugcccaggcu

SEQ ID NO: 3401874 - RNA, 19 nt, Pseudomonas aeruginosa PA01
ggcaugccgugggcgccgc

SEQ ID NO: 3401875 - RNA, 16 nt, Pseudomonas aeruginosa PA01
ggcaugccguugggcc

SEQ ID NO: 3401876 - RNA, 24 nt, Pseudomonas aeruginosa PA01
ggcaugccguugggccagggccuu

SEQ ID NO: 3401877 - RNA, 12 nt, Pseudomonas aeruginosa PA01
ggcaugcggccc

SEQ ID NO: 3401878 - RNA, 16 nt, Pseudomonas aeruginosa PA01
ggcaugcggccccggc

SEQ ID NO: 3401879 - RNA, 20 nt, Pseudomonas aeruginosa PA01
ggcaugcucagccgcgccgg

SEQ ID NO: 3401880 - RNA, 17 nt, Pseudomonas aeruginosa PA01
ggcaugcucggccaggu

SEQ ID NO: 3401881 - RNA, 14 nt, Pseudomonas aeruginosa PA01
ggcaugcugcucgg

SEQ ID NO: 3401882 - RNA, 15 nt, Pseudomonas aeruginosa PA01
ggcaugcugcucggc

SEQ ID NO: 3401883 - RNA, 16 nt, Pseudomonas aeruginosa PA01
ggcaugcugcucggca

SEQ ID NO: 3401884 - RNA, 17 nt, Pseudomonas aeruginosa PA01
ggcaugcugcucggcau

SEQ ID NO: 3401885 - RNA, 14 nt, Pseudomonas aeruginosa PA01
ggcauggccacgcu

SEQ ID NO: 3401886 - RNA, 13 nt, Pseudomonas aeruginosa PA01
ggccacuccagcc

SEQ ID NO: 3401887 - RNA, 17 nt, Pseudomonas aeruginosa PA01
ggccacuccagccccgc

SEQ ID NO: 3401888 - RNA, 14 nt, Pseudomonas aeruginosa PA01
ggccacuccgggcu

SEQ ID NO: 3401889 - RNA, 16 nt, Pseudomonas aeruginosa PA01
ggccacuccgggcugg

SEQ ID NO: 3401890 - RNA, 13 nt, Pseudomonas aeruginosa PA01
ggccacucgcagc

SEQ ID NO: 3401891 - RNA, 17 nt, Pseudomonas aeruginosa PA01
ggccacucgcagccgcg

SEQ ID NO: 3401892 - RNA, 21 nt, Pseudomonas aeruginosa PA01
ggccacucgcagccgcgcucg

SEQ ID NO: 3401893 - RNA, 20 nt, Pseudomonas aeruginosa PA01
ggccacuucguccggccgcc

SEQ ID NO: 3401894 - RNA, 13 nt, Pseudomonas aeruginosa PA01
ggccagaagcgcu

SEQ ID NO: 3401895 - RNA, 16 nt, Pseudomonas aeruginosa PA01
ggccagcaaugcccgc

SEQ ID NO: 3401896 - RNA, 17 nt, Pseudomonas aeruginosa PA01
ggccagcaaugcccgcg

SEQ ID NO: 3401897 - RNA, 16 nt, Pseudomonas aeruginosa PA01
ggccagcaccaguccc

SEQ ID NO: 3401898 - RNA, 11 nt, Pseudomonas aeruginosa PA01
ggccagcaccu

SEQ ID NO: 3401899 - RNA, 21 nt, Pseudomonas aeruginosa PA01
ggccagcaccucgacgcccgc

SEQ ID NO: 3401900 - RNA, 11 nt, Pseudomonas aeruginosa PA01
ggccagcagca

SEQ ID NO: 3401901 - RNA, 14 nt, Pseudomonas aeruginosa PA01
ggccagcagcacgc

SEQ ID NO: 3401902 - RNA, 19 nt, Pseudomonas aeruginosa PA01
ggccagcagcacggcgacg

SEQ ID NO: 3401903 - RNA, 24 nt, Pseudomonas aeruginosa PA01
ggccagcagcacggcgacgaaggc

SEQ ID NO: 3401904 - RNA, 15 nt, Pseudomonas aeruginosa PA01
ggccagcagcagaag

SEQ ID NO: 3401905 - RNA, 21 nt, Pseudomonas aeruginosa PA01
ggccagcagcaugggauggcg

SEQ ID NO: 3401906 - RNA, 16 nt, Pseudomonas aeruginosa PA01
ggccagcagcgccucc

SEQ ID NO: 3401907 - RNA, 17 nt, Pseudomonas aeruginosa PA01
ggccagcagcgccuccu

SEQ ID NO: 3401908 - RNA, 18 nt, Pseudomonas aeruginosa PA01
ggccagcagcgccuccuc

SEQ ID NO: 3401909 - RNA, 22 nt, Pseudomonas aeruginosa PA01
ggccagcagcgccuccucuacc

SEQ ID NO: 3401910 - RNA, 23 nt, Pseudomonas aeruginosa PA01
ggccagcagcgccuccucuacca

SEQ ID NO: 3401911 - RNA, 13 nt, Pseudomonas aeruginosa PA01
ggccagcagcgcu

SEQ ID NO: 3401912 - RNA, 13 nt, Pseudomonas aeruginosa PA01
ggccagcagcggc

SEQ ID NO: 3401913 - RNA, 14 nt, Pseudomonas aeruginosa PA01
ggccagcagcggcg

SEQ ID NO: 3401914 - RNA, 16 nt, Pseudomonas aeruginosa PA01
ggccagcagcggcggc

SEQ ID NO: 3401915 - RNA, 17 nt, Pseudomonas aeruginosa PA01
ggccagcagcggcggcg

SEQ ID NO: 3401916 - RNA, 22 nt, Pseudomonas aeruginosa PA01
ggccagcagcggcggcgccggc

SEQ ID NO: 3401917 - RNA, 13 nt, Pseudomonas aeruginosa PA01
ggccagcagcucc

SEQ ID NO: 3401918 - RNA, 16 nt, Pseudomonas aeruginosa PA01
ggccagcagcuccggg

SEQ ID NO: 3401919 - RNA, 20 nt, Pseudomonas aeruginosa PA01
ggccagcagcuccgggcugg

SEQ ID NO: 3401920 - RNA, 23 nt, Pseudomonas aeruginosa PA01
ggccagcagcuccgggcuggcca

SEQ ID NO: 3401921 - RNA, 12 nt, Pseudomonas aeruginosa PA01
ggccagcaggau

SEQ ID NO: 3401922 - RNA, 17 nt, Pseudomonas aeruginosa PA01
ggccagcaggccgagcg

SEQ ID NO: 3401923 - RNA, 16 nt, Pseudomonas aeruginosa PA01
ggccagcaggccgauc

SEQ ID NO: 3401924 - RNA, 17 nt, Pseudomonas aeruginosa PA01
ggccagcaggccgauca

SEQ ID NO: 3401925 - RNA, 18 nt, Pseudomonas aeruginosa PA01
ggccagcaggccgaucag

SEQ ID NO: 3401926 - RNA, 21 nt, Pseudomonas aeruginosa PA01
ggccagcaggccgaucagcgg

SEQ ID NO: 3401927 - RNA, 23 nt, Pseudomonas aeruginosa PA01
ggccagcaggccgugggccggcg

SEQ ID NO: 3401928 - RNA, 21 nt, Pseudomonas aeruginosa PA01
ggccagcaggcgcucggcgac

SEQ ID NO: 3401929 - RNA, 13 nt, Pseudomonas aeruginosa PA01
ggccagcaggcug

SEQ ID NO: 3401930 - RNA, 14 nt, Pseudomonas aeruginosa PA01
ggccagcaggcugg

SEQ ID NO: 3401931 - RNA, 16 nt, Pseudomonas aeruginosa PA01
ggccagcaggcuggcg

SEQ ID NO: 3401932 - RNA, 18 nt, Pseudomonas aeruginosa PA01
ggccagcaggcuggcggc

SEQ ID NO: 3401933 - RNA, 19 nt, Pseudomonas aeruginosa PA01
ggccagcaggcuggcggca

SEQ ID NO: 3401934 - RNA, 15 nt, Pseudomonas aeruginosa PA01
ggccagcagggccgc

SEQ ID NO: 3401935 - RNA, 16 nt, Pseudomonas aeruginosa PA01
ggccagcagggccgcc

SEQ ID NO: 3401936 - RNA, 19 nt, Pseudomonas aeruginosa PA01
ggccagcaggguggccagg

SEQ ID NO: 3401937 - RNA, 23 nt, Pseudomonas aeruginosa PA01
ggccagcaggguggccagggucc

SEQ ID NO: 3401938 - RNA, 22 nt, Pseudomonas aeruginosa PA01
ggccagccaacugcuucaggcg

SEQ ID NO: 3401939 - RNA, 13 nt, Pseudomonas aeruginosa PA01
ggccagccagagc

SEQ ID NO: 3401940 - RNA, 16 nt, Pseudomonas aeruginosa PA01
ggccagccagagccag

SEQ ID NO: 3401941 - RNA, 18 nt, Pseudomonas aeruginosa PA01
ggccagccagagccaguc

SEQ ID NO: 3401942 - RNA, 13 nt, Pseudomonas aeruginosa PA01
ggccagccagggc

SEQ ID NO: 3401943 - RNA, 15 nt, Pseudomonas aeruginosa PA01
ggccagccagggcag

SEQ ID NO: 3401944 - RNA, 18 nt, Pseudomonas aeruginosa PA01
ggccagccagggcagcag

SEQ ID NO: 3401945 - RNA, 19 nt, Pseudomonas aeruginosa PA01
ggccagccagggcagcagg

SEQ ID NO: 3401946 - RNA, 13 nt, Pseudomonas aeruginosa PA01
ggccagccccugc

SEQ ID NO: 3401947 - RNA, 16 nt, Pseudomonas aeruginosa PA01
ggccagccccugcgga

SEQ ID NO: 3401948 - RNA, 21 nt, Pseudomonas aeruginosa PA01
ggccagccccugcggaccgca

SEQ ID NO: 3401949 - RNA, 14 nt, Pseudomonas aeruginosa PA01
ggccagcccggagc

SEQ ID NO: 3401950 - RNA, 16 nt, Pseudomonas aeruginosa PA01
ggccagcccggagccg

SEQ ID NO: 3401951 - RNA, 13 nt, Pseudomonas aeruginosa PA01
ggccagcccggcc

SEQ ID NO: 3401952 - RNA, 16 nt, Pseudomonas aeruginosa PA01
ggccagcccggccucg

SEQ ID NO: 3401953 - RNA, 17 nt, Pseudomonas aeruginosa PA01
ggccagcccugguaggu

SEQ ID NO: 3401954 - RNA, 22 nt, Pseudomonas aeruginosa PA01
ggccagcccuuucagcggcugc

SEQ ID NO: 3401955 - RNA, 16 nt, Pseudomonas aeruginosa PA01
ggccagccgcgccagu

SEQ ID NO: 3401956 - RNA, 17 nt, Pseudomonas aeruginosa PA01
ggccagccgcgccagug

SEQ ID NO: 3401957 - RNA, 15 nt, Pseudomonas aeruginosa PA01
ggccagccgcgcggc

SEQ ID NO: 3401958 - RNA, 16 nt, Pseudomonas aeruginosa PA01
ggccagccgcgcggca

SEQ ID NO: 3401959 - RNA, 14 nt, Pseudomonas aeruginosa PA01
ggccagccgcuagc

SEQ ID NO: 3401960 - RNA, 13 nt, Pseudomonas aeruginosa PA01
ggccagccggcgc

SEQ ID NO: 3401961 - RNA, 14 nt, Pseudomonas aeruginosa PA01
ggccagccggcgcc

SEQ ID NO: 3401962 - RNA, 15 nt, Pseudomonas aeruginosa PA01
ggccagccggcgccg

SEQ ID NO: 3401963 - RNA, 16 nt, Pseudomonas aeruginosa PA01
ggccagccggcgccgc

SEQ ID NO: 3401964 - RNA, 19 nt, Pseudomonas aeruginosa PA01
ggccagccuggccagcgcu

SEQ ID NO: 3401965 - RNA, 19 nt, Pseudomonas aeruginosa PA01
ggccagccuucccggcgcu

SEQ ID NO: 3401966 - RNA, 13 nt, Pseudomonas aeruginosa PA01
ggccagccuuccu

SEQ ID NO: 3401967 - RNA, 21 nt, Pseudomonas aeruginosa PA01
ggccagcgaacccaggccgcg

SEQ ID NO: 3401968 - RNA, 21 nt, Pseudomonas aeruginosa PA01
ggccagcgaccgucgaaccag

SEQ ID NO: 3401969 - RNA, 13 nt, Pseudomonas aeruginosa PA01
ggccagcgccacc

SEQ ID NO: 3401970 - RNA, 17 nt, Pseudomonas aeruginosa PA01
ggccagcgccaccagca

SEQ ID NO: 3401971 - RNA, 19 nt, Pseudomonas aeruginosa PA01
ggccagcgccaccagcagg

SEQ ID NO: 3401972 - RNA, 20 nt, Pseudomonas aeruginosa PA01
ggccagcgccaccagcaggg

SEQ ID NO: 3401973 - RNA, 14 nt, Pseudomonas aeruginosa PA01
ggccagcgccaggu

SEQ ID NO: 3401974 - RNA, 22 nt, Pseudomonas aeruginosa PA01
ggccagcgccagguuggccugg

SEQ ID NO: 3401975 - RNA, 20 nt, Pseudomonas aeruginosa PA01
ggccagcgcccaggccgggu

SEQ ID NO: 3401976 - RNA, 22 nt, Pseudomonas aeruginosa PA01
ggccagcgcccaggccgggucg

SEQ ID NO: 3401977 - RNA, 13 nt, Pseudomonas aeruginosa PA01
ggccagcgccgcc

SEQ ID NO: 3401978 - RNA, 19 nt, Pseudomonas aeruginosa PA01
ggccagcgccgccgcugcg

SEQ ID NO: 3401979 - RNA, 22 nt, Pseudomonas aeruginosa PA01
ggccagcgccgccgcugcgucg

SEQ ID NO: 3401980 - RNA, 16 nt, Pseudomonas aeruginosa PA01
ggccagcgccguacgc

SEQ ID NO: 3401981 - RNA, 21 nt, Pseudomonas aeruginosa PA01
ggccagcgccguacgcaccgc

SEQ ID NO: 3401982 - RNA, 15 nt, Pseudomonas aeruginosa PA01
ggccagcgccuggcg

SEQ ID NO: 3401983 - RNA, 17 nt, Pseudomonas aeruginosa PA01
ggccagcgccuggcgca

SEQ ID NO: 3401984 - RNA, 12 nt, Pseudomonas aeruginosa PA01
ggccagcgcggc

SEQ ID NO: 3401985 - RNA, 13 nt, Pseudomonas aeruginosa PA01
ggccagcgcggcg

SEQ ID NO: 3401986 - RNA, 15 nt, Pseudomonas aeruginosa PA01
ggccagcgcggcgcg

SEQ ID NO: 3401987 - RNA, 16 nt, Pseudomonas aeruginosa PA01
ggccagcgcggcgcgg

SEQ ID NO: 3401988 - RNA, 19 nt, Pseudomonas aeruginosa PA01
ggccagcgcggcgcggaca

SEQ ID NO: 3401989 - RNA, 20 nt, Pseudomonas aeruginosa PA01
ggccagggaaaagcccaggu

SEQ ID NO: 3401990 - RNA, 21 nt, Pseudomonas aeruginosa PA01
ggccagggaaaagcccaggug

SEQ ID NO: 3401991 - RNA, 13 nt, Pseudomonas aeruginosa PA01
ggccagggaggcg

SEQ ID NO: 3401992 - RNA, 18 nt, Pseudomonas aeruginosa PA01
ggccagggaggcgcuggc

SEQ ID NO: 3401993 - RNA, 20 nt, Pseudomonas aeruginosa PA01
ggccagggaggcgcuggcca

SEQ ID NO: 3401994 - RNA, 23 nt, Pseudomonas aeruginosa PA01
ggccagggaggcgcuggccagcg

SEQ ID NO: 3401995 - RNA, 11 nt, Pseudomonas aeruginosa PA01
ggccagggagu

SEQ ID NO: 3401996 - RNA, 23 nt, Pseudomonas aeruginosa PA01
ggccagggcaugggucagcgcca

SEQ ID NO: 3401997 - RNA, 19 nt, Pseudomonas aeruginosa PA01
ggccagggcgaggaucacg

SEQ ID NO: 3401998 - RNA, 20 nt, Pseudomonas aeruginosa PA01
ggccagggcgaggaucacgc

SEQ ID NO: 3401999 - RNA, 24 nt, Pseudomonas aeruginosa PA01
ggccagggcgaggaucacgcagca

SEQ ID NO: 3402000 - RNA, 14 nt, Pseudomonas aeruginosa PA01
ggccagggcgaggc

SEQ ID NO: 3402001 - RNA, 12 nt, Pseudomonas aeruginosa PA01
ggccagggcgcg

SEQ ID NO: 3402002 - RNA, 14 nt, Pseudomonas aeruginosa PA01
ggccagggcgcggu

SEQ ID NO: 3402003 - RNA, 12 nt, Pseudomonas aeruginosa PA01
ggccagggcggc

SEQ ID NO: 3402004 - RNA, 15 nt, Pseudomonas aeruginosa PA01
ggccagggcggcgcc

SEQ ID NO: 3402005 - RNA, 16 nt, Pseudomonas aeruginosa PA01
ggccagggcggcgccg

SEQ ID NO: 3402006 - RNA, 14 nt, Pseudomonas aeruginosa PA01
ggccagggcgguga

SEQ ID NO: 3402007 - RNA, 20 nt, Pseudomonas aeruginosa PA01
ggccagggcggugagguugc

SEQ ID NO: 3402008 - RNA, 17 nt, Pseudomonas aeruginosa PA01
ggccagggcguugcucg

SEQ ID NO: 3402009 - RNA, 18 nt, Pseudomonas aeruginosa PA01
ggccaggggagcgccggc

SEQ ID NO: 3402010 - RNA, 22 nt, Pseudomonas aeruginosa PA01
ggccaggggagcgccggcgcgg

SEQ ID NO: 3402011 - RNA, 23 nt, Pseudomonas aeruginosa PA01
ggccaggggagcgccggcgcggu

SEQ ID NO: 3402012 - RNA, 15 nt, Pseudomonas aeruginosa PA01
ggccagggggccugg

SEQ ID NO: 3402013 - RNA, 16 nt, Pseudomonas aeruginosa PA01
ggccagggggccuggc

SEQ ID NO: 3402014 - RNA, 17 nt, Pseudomonas aeruginosa PA01
ggccagggggccuggcu

SEQ ID NO: 3402015 - RNA, 19 nt, Pseudomonas aeruginosa PA01
ggccagggucgccagcagg

SEQ ID NO: 3402016 - RNA, 20 nt, Pseudomonas aeruginosa PA01
ggccagggucgccagcaggu

SEQ ID NO: 3402017 - RNA, 21 nt, Pseudomonas aeruginosa PA01
ggccagguaccggccaggcgg

SEQ ID NO: 3402018 - RNA, 22 nt, Pseudomonas aeruginosa PA01
ggccagguaccggccaggcggu

SEQ ID NO: 3402019 - RNA, 23 nt, Pseudomonas aeruginosa PA01
ggccagguacuuggccacgccuu

SEQ ID NO: 3402020 - RNA, 20 nt, Pseudomonas aeruginosa PA01
ggccagguauucgcgcucgg

SEQ ID NO: 3402021 - RNA, 14 nt, Pseudomonas aeruginosa PA01
ggccaggucgccca

SEQ ID NO: 3402022 - RNA, 16 nt, Pseudomonas aeruginosa PA01
ggccaggucgcccacc

SEQ ID NO: 3402023 - RNA, 17 nt, Pseudomonas aeruginosa PA01
ggccaggucgcccaccu

SEQ ID NO: 3402024 - RNA, 13 nt, Pseudomonas aeruginosa PA01
ggccaggucgcgg

SEQ ID NO: 3402025 - RNA, 17 nt, Pseudomonas aeruginosa PA01
ggccaggucgcggguga

SEQ ID NO: 3402026 - RNA, 11 nt, Pseudomonas aeruginosa PA01
ggccaggucgg

SEQ ID NO: 3402027 - RNA, 23 nt, Pseudomonas aeruginosa PA01
ggccaggucgguccgccgaugcg

SEQ ID NO: 3402028 - RNA, 20 nt, Pseudomonas aeruginosa PA01
ggccaggucguugcgccggc

SEQ ID NO: 3402029 - RNA, 15 nt, Pseudomonas aeruginosa PA01
ggccagguugaccag

SEQ ID NO: 3402030 - RNA, 15 nt, Pseudomonas aeruginosa PA01
ggccagucaucgcgg

SEQ ID NO: 3402031 - RNA, 19 nt, Pseudomonas aeruginosa PA01
ggccaguccggcaccgcuc

SEQ ID NO: 3402032 - RNA, 20 nt, Pseudomonas aeruginosa PA01
ggccaguccggucagcagca

SEQ ID NO: 3402033 - RNA, 22 nt, Pseudomonas aeruginosa PA01
ggccaguccggucagcagcagg

SEQ ID NO: 3402034 - RNA, 17 nt, Pseudomonas aeruginosa PA01
ggccagucgcguuggcc

SEQ ID NO: 3402035 - RNA, 23 nt, Pseudomonas aeruginosa PA01
ggccaguuccaugucgcuggccu

SEQ ID NO: 3402036 - RNA, 15 nt, Pseudomonas aeruginosa PA01
ggccaguucgcggcg

SEQ ID NO: 3402037 - RNA, 16 nt, Pseudomonas aeruginosa PA01
ggccaguucgcggcgc

SEQ ID NO: 3402038 - RNA, 18 nt, Pseudomonas aeruginosa PA01
ggccaguucgcggcgcag

SEQ ID NO: 3402039 - RNA, 20 nt, Pseudomonas aeruginosa PA01
ggccaguucgcugacccagc

SEQ ID NO: 3402040 - RNA, 22 nt, Pseudomonas aeruginosa PA01
ggccaguucgcugacccagcgc

SEQ ID NO: 3402041 - RNA, 22 nt, Pseudomonas aeruginosa PA01
ggccaguucggggucggccugc

SEQ ID NO: 3402042 - RNA, 14 nt, Pseudomonas aeruginosa PA01
ggccaguucgucga

SEQ ID NO: 3402043 - RNA, 15 nt, Pseudomonas aeruginosa PA01
ggccaguugcaccgc

SEQ ID NO: 3402044 - RNA, 16 nt, Pseudomonas aeruginosa PA01
ggccaguugcaccgca

SEQ ID NO: 3402045 - RNA, 22 nt, Pseudomonas aeruginosa PA01
ggccaguugcgcuccgguggcg

SEQ ID NO: 3402046 - RNA, 16 nt, Pseudomonas aeruginosa PA01
ggccauaauggccgcu

SEQ ID NO: 3402047 - RNA, 19 nt, Pseudomonas aeruginosa PA01
ggccauaccuccagccagc

SEQ ID NO: 3402048 - RNA, 22 nt, Pseudomonas aeruginosa PA01
ggccauaccuccagccagcagc

SEQ ID NO: 3402049 - RNA, 16 nt, Pseudomonas aeruginosa PA01
ggccauagagccgcug

SEQ ID NO: 3402050 - RNA, 13 nt, Pseudomonas aeruginosa PA01
ggccauagcgcgc

SEQ ID NO: 3402051 - RNA, 15 nt, Pseudomonas aeruginosa PA01
ggccauagcgcgccg

SEQ ID NO: 3402052 - RNA, 17 nt, Pseudomonas aeruginosa PA01
ggccauagcgcgccggg

SEQ ID NO: 3402053 - RNA, 18 nt, Pseudomonas aeruginosa PA01
ggccauagcgcgccgggu

SEQ ID NO: 3402054 - RNA, 14 nt, Pseudomonas aeruginosa PA01
ggccaucagcacgu

SEQ ID NO: 3402055 - RNA, 21 nt, Pseudomonas aeruginosa PA01
ggccaucagcacgucguccag

SEQ ID NO: 3402056 - RNA, 12 nt, Pseudomonas aeruginosa PA01
ggccaucagcgc

SEQ ID NO: 3402057 - RNA, 14 nt, Pseudomonas aeruginosa PA01
ggccaucagcgcca

SEQ ID NO: 3402058 - RNA, 15 nt, Pseudomonas aeruginosa PA01
ggccaucagcgccag

SEQ ID NO: 3402059 - RNA, 17 nt, Pseudomonas aeruginosa PA01
ggccaucagcgccaggg

SEQ ID NO: 3402060 - RNA, 15 nt, Pseudomonas aeruginosa PA01
ggccaucagcgccgc

SEQ ID NO: 3402061 - RNA, 17 nt, Pseudomonas aeruginosa PA01
ggccaucagcgccgccu

SEQ ID NO: 3402062 - RNA, 18 nt, Pseudomonas aeruginosa PA01
ggccaucagcgccgccuc

SEQ ID NO: 3402063 - RNA, 19 nt, Pseudomonas aeruginosa PA01
ggccaucagggucggcccg

SEQ ID NO: 3402064 - RNA, 19 nt, Pseudomonas aeruginosa PA01
ggccaucagugccugcacg

SEQ ID NO: 3402065 - RNA, 17 nt, Pseudomonas aeruginosa PA01
ggccauccagccaggcg

SEQ ID NO: 3402066 - RNA, 18 nt, Pseudomonas aeruginosa PA01
ggccauccagccaggcgc

SEQ ID NO: 3402067 - RNA, 21 nt, Pseudomonas aeruginosa PA01
ggccauccagccaggcgcucu

SEQ ID NO: 3402068 - RNA, 21 nt, Pseudomonas aeruginosa PA01
ggccauccauaucggccaccg

SEQ ID NO: 3402069 - RNA, 19 nt, Pseudomonas aeruginosa PA01
ggccauccccgaggcgacg

SEQ ID NO: 3402070 - RNA, 21 nt, Pseudomonas aeruginosa PA01
ggccauccccgaggcgacgcc

SEQ ID NO: 3402071 - RNA, 18 nt, Pseudomonas aeruginosa PA01
ggccauccuggccggucg

SEQ ID NO: 3402072 - RNA, 18 nt, Pseudomonas aeruginosa PA01
ggccaucgaaaucgccca

SEQ ID NO: 3402073 - RNA, 19 nt, Pseudomonas aeruginosa PA01
ggccaucgaaaucgcccac

SEQ ID NO: 3402074 - RNA, 21 nt, Pseudomonas aeruginosa PA01
ggccaucgaaaucgcccacca

SEQ ID NO: 3402075 - RNA, 24 nt, Pseudomonas aeruginosa PA01
ggccaucgaaaucgcccaccaggu

SEQ ID NO: 3402076 - RNA, 20 nt, Pseudomonas aeruginosa PA01
ggccaucgagcgcuccaccg

SEQ ID NO: 3402077 - RNA, 12 nt, Pseudomonas aeruginosa PA01
ggccaucgccgg

SEQ ID NO: 3402078 - RNA, 13 nt, Pseudomonas aeruginosa PA01
ggccaucgccggc

SEQ ID NO: 3402079 - RNA, 19 nt, Pseudomonas aeruginosa PA01
ggccaucgccggcccgcgc

SEQ ID NO: 3402080 - RNA, 21 nt, Pseudomonas aeruginosa PA01
ggccaucgccggcccgcgcgg

SEQ ID NO: 3402081 - RNA, 16 nt, Pseudomonas aeruginosa PA01
ggccaucgccgucucg

SEQ ID NO: 3402082 - RNA, 12 nt, Pseudomonas aeruginosa PA01
ggccaucgcgga

SEQ ID NO: 3402083 - RNA, 18 nt, Pseudomonas aeruginosa PA01
ggccaucgucaacauccu

SEQ ID NO: 3402084 - RNA, 13 nt, Pseudomonas aeruginosa PA01
ggccaucuucucg

SEQ ID NO: 3402085 - RNA, 22 nt, Pseudomonas aeruginosa PA01
ggccaucuucucgaagcgcgcc

SEQ ID NO: 3402086 - RNA, 18 nt, Pseudomonas aeruginosa PA01
ggccaugaccucggccag

SEQ ID NO: 3402087 - RNA, 19 nt, Pseudomonas aeruginosa PA01
ggccaugagcagggcggau

SEQ ID NO: 3402088 - RNA, 15 nt, Pseudomonas aeruginosa PA01
ggccaugaucaucgc

SEQ ID NO: 3402089 - RNA, 19 nt, Pseudomonas aeruginosa PA01
ggccaugaucaucgccugc

SEQ ID NO: 3402090 - RNA, 22 nt, Pseudomonas aeruginosa PA01
ggccaugaucaucgccugcugg

SEQ ID NO: 3402091 - RNA, 15 nt, Pseudomonas aeruginosa PA01
ggcccgaaggccccu

SEQ ID NO: 3402092 - RNA, 16 nt, Pseudomonas aeruginosa PA01
ggcccgaaggccccuu

SEQ ID NO: 3402093 - RNA, 21 nt, Pseudomonas aeruginosa PA01
ggcccgacccacuugaacacc

SEQ ID NO: 3402094 - RNA, 18 nt, Pseudomonas aeruginosa PA01
ggcccgacgccgcccggc

SEQ ID NO: 3402095 - RNA, 15 nt, Pseudomonas aeruginosa PA01
ggcccgacggugcgg

SEQ ID NO: 3402096 - RNA, 17 nt, Pseudomonas aeruginosa PA01
ggcccgacggugcggcc

SEQ ID NO: 3402097 - RNA, 19 nt, Pseudomonas aeruginosa PA01
ggcccgagcaggcugccga

SEQ ID NO: 3402098 - RNA, 21 nt, Pseudomonas aeruginosa PA01
ggcccgagcaggcugccgaag

SEQ ID NO: 3402099 - RNA, 17 nt, Pseudomonas aeruginosa PA01
ggcccgagggucgccuu

SEQ ID NO: 3402100 - RNA, 20 nt, Pseudomonas aeruginosa PA01
ggcccgcaaucagcgggccu

SEQ ID NO: 3402101 - RNA, 21 nt, Pseudomonas aeruginosa PA01
ggcccgcaaucagcgggccuu

SEQ ID NO: 3402102 - RNA, 13 nt, Pseudomonas aeruginosa PA01
ggcccgcacaggu

SEQ ID NO: 3402103 - RNA, 14 nt, Pseudomonas aeruginosa PA01
ggcccgccacagau

SEQ ID NO: 3402104 - RNA, 21 nt, Pseudomonas aeruginosa PA01
ggcccgccacagaucgccagc

SEQ ID NO: 3402105 - RNA, 12 nt, Pseudomonas aeruginosa PA01
ggcccgccccgc

SEQ ID NO: 3402106 - RNA, 20 nt, Pseudomonas aeruginosa PA01
ggcccgccgccggggcgggc

SEQ ID NO: 3402107 - RNA, 12 nt, Pseudomonas aeruginosa PA01
ggcccgccgcgg

SEQ ID NO: 3402108 - RNA, 18 nt, Pseudomonas aeruginosa PA01
ggcccgccgcggcgagca

SEQ ID NO: 3402109 - RNA, 19 nt, Pseudomonas aeruginosa PA01
ggcccgccguugccagcau

SEQ ID NO: 3402110 - RNA, 20 nt, Pseudomonas aeruginosa PA01
ggcccgccguugccagcauc

SEQ ID NO: 3402111 - RNA, 15 nt, Pseudomonas aeruginosa PA01
ggcccgccucggcgg

SEQ ID NO: 3402112 - RNA, 17 nt, Pseudomonas aeruginosa PA01
ggcccgccucggcggcu

SEQ ID NO: 3402113 - RNA, 14 nt, Pseudomonas aeruginosa PA01
ggcccgcgagccgc

SEQ ID NO: 3402114 - RNA, 16 nt, Pseudomonas aeruginosa PA01
ggcccgcgagccgcgc

SEQ ID NO: 3402115 - RNA, 12 nt, Pseudomonas aeruginosa PA01
ggcccgcgccgc

SEQ ID NO: 3402116 - RNA, 15 nt, Pseudomonas aeruginosa PA01
ggcccgcgccgccuc

SEQ ID NO: 3402117 - RNA, 22 nt, Pseudomonas aeruginosa PA01
ggcccgcgccgccucgauggcg

SEQ ID NO: 3402118 - RNA, 16 nt, Pseudomonas aeruginosa PA01
ggcccgcggaucgcgc

SEQ ID NO: 3402119 - RNA, 21 nt, Pseudomonas aeruginosa PA01
ggcccgcggucacucggccuc

SEQ ID NO: 3402120 - RNA, 22 nt, Pseudomonas aeruginosa PA01
ggcccgcggucacucggccucg

SEQ ID NO: 3402121 - RNA, 12 nt, Pseudomonas aeruginosa PA01
ggcccgcucuug

SEQ ID NO: 3402122 - RNA, 22 nt, Pseudomonas aeruginosa PA01
ggcccgcucuugauacccaccg

SEQ ID NO: 3402123 - RNA, 23 nt, Pseudomonas aeruginosa PA01
ggcccggaaugcaaaaagcccac

SEQ ID NO: 3402124 - RNA, 21 nt, Pseudomonas aeruginosa PA01
ggcccggagaccgugccgccg

SEQ ID NO: 3402125 - RNA, 17 nt, Pseudomonas aeruginosa PA01
ggcccggagaucgccgc

SEQ ID NO: 3402126 - RNA, 18 nt, Pseudomonas aeruginosa PA01
ggcccggagaucgccgcg

SEQ ID NO: 3402127 - RNA, 20 nt, Pseudomonas aeruginosa PA01
ggcccggagccaacgcccgg

SEQ ID NO: 3402128 - RNA, 22 nt, Pseudomonas aeruginosa PA01
ggcccggagugugucggggccg

SEQ ID NO: 3402129 - RNA, 15 nt, Pseudomonas aeruginosa PA01
ggcccggcaggcagu

SEQ ID NO: 3402130 - RNA, 21 nt, Pseudomonas aeruginosa PA01
ggcccggcaggcagugccggg

SEQ ID NO: 3402131 - RNA, 15 nt, Pseudomonas aeruginosa PA01
ggcccggcaggcgca

SEQ ID NO: 3402132 - RNA, 12 nt, Pseudomonas aeruginosa PA01
ggcccggccagg

SEQ ID NO: 3402133 - RNA, 13 nt, Pseudomonas aeruginosa PA01
ggcccggccaggc

SEQ ID NO: 3402134 - RNA, 14 nt, Pseudomonas aeruginosa PA01
ggcccggccaggcg

SEQ ID NO: 3402135 - RNA, 16 nt, Pseudomonas aeruginosa PA01
ggcccggccaggcgau

SEQ ID NO: 3402136 - RNA, 13 nt, Pseudomonas aeruginosa PA01
ggcccggccaggu

SEQ ID NO: 3402137 - RNA, 16 nt, Pseudomonas aeruginosa PA01
ggcccggccagguagg

SEQ ID NO: 3402138 - RNA, 21 nt, Pseudomonas aeruginosa PA01
ggcccggccagguaggcgacg

SEQ ID NO: 3402139 - RNA, 13 nt, Pseudomonas aeruginosa PA01
ggcccggccaucc

SEQ ID NO: 3402140 - RNA, 19 nt, Pseudomonas aeruginosa PA01
ggcccggccauccuggccg

SEQ ID NO: 3402141 - RNA, 13 nt, Pseudomonas aeruginosa PA01
ggcccggccgccu

SEQ ID NO: 3402142 - RNA, 14 nt, Pseudomonas aeruginosa PA01
ggcccggccgccug

SEQ ID NO: 3402143 - RNA, 14 nt, Pseudomonas aeruginosa PA01
ggcccggcgcacug

SEQ ID NO: 3402144 - RNA, 13 nt, Pseudomonas aeruginosa PA01
ggcccggcgcggc

SEQ ID NO: 3402145 - RNA, 14 nt, Pseudomonas aeruginosa PA01
ggcccggcgcggcg

SEQ ID NO: 3402146 - RNA, 15 nt, Pseudomonas aeruginosa PA01
ggcccggcgcggcgg

SEQ ID NO: 3402147 - RNA, 16 nt, Pseudomonas aeruginosa PA01
ggcccggcgcggcggc

SEQ ID NO: 3402148 - RNA, 19 nt, Pseudomonas aeruginosa PA01
ggcccggcgcggcggccgc

SEQ ID NO: 3402149 - RNA, 22 nt, Pseudomonas aeruginosa PA01
ggcccggcgcggcggccgccuc

SEQ ID NO: 3402150 - RNA, 17 nt, Pseudomonas aeruginosa PA01
ggcccggcguccucgcg

SEQ ID NO: 3402151 - RNA, 13 nt, Pseudomonas aeruginosa PA01
ggcccggcgugag

SEQ ID NO: 3402152 - RNA, 18 nt, Pseudomonas aeruginosa PA01
ggcccggcguuucgccgg

SEQ ID NO: 3402153 - RNA, 23 nt, Pseudomonas aeruginosa PA01
ggcccggcuccagccgggcuccg

SEQ ID NO: 3402154 - RNA, 14 nt, Pseudomonas aeruginosa PA01
ggcccgggccuggu

SEQ ID NO: 3402155 - RNA, 17 nt, Pseudomonas aeruginosa PA01
ggcccgggccuggugca

SEQ ID NO: 3402156 - RNA, 20 nt, Pseudomonas aeruginosa PA01
ggcccgggcgccaccgcguu

SEQ ID NO: 3402157 - RNA, 19 nt, Pseudomonas aeruginosa PA01
ggcccgggucacggucagc

SEQ ID NO: 3402158 - RNA, 12 nt, Pseudomonas aeruginosa PA01
ggcccggucagc

SEQ ID NO: 3402159 - RNA, 19 nt, Pseudomonas aeruginosa PA01
ggcccggucagcuucgccg

SEQ ID NO: 3402160 - RNA, 16 nt, Pseudomonas aeruginosa PA01
ggcccggucuagccgg

SEQ ID NO: 3402161 - RNA, 19 nt, Pseudomonas aeruginosa PA01
ggcccggucuagccgggcc

SEQ ID NO: 3402162 - RNA, 21 nt, Pseudomonas aeruginosa PA01
ggcccgguugagauccuggcc

SEQ ID NO: 3402163 - RNA, 22 nt, Pseudomonas aeruginosa PA01
ggcccgguugagauccuggccg

SEQ ID NO: 3402164 - RNA, 16 nt, Pseudomonas aeruginosa PA01
ggcccgguuggccagg

SEQ ID NO: 3402165 - RNA, 20 nt, Pseudomonas aeruginosa PA01
ggcccgguuggccaggacca

SEQ ID NO: 3402166 - RNA, 19 nt, Pseudomonas aeruginosa PA01
ggcccgguuuuccgcuucc

SEQ ID NO: 3402167 - RNA, 18 nt, Pseudomonas aeruginosa PA01
ggcccguauggcgggccu

SEQ ID NO: 3402168 - RNA, 19 nt, Pseudomonas aeruginosa PA01
ggcccguauggcgggccuu

SEQ ID NO: 3402169 - RNA, 21 nt, Pseudomonas aeruginosa PA01
ggcccguauggcgggccuugc

SEQ ID NO: 3402170 - RNA, 12 nt, Pseudomonas aeruginosa PA01
ggcccguccgcg

SEQ ID NO: 3402171 - RNA, 15 nt, Pseudomonas aeruginosa PA01
ggcccguccgcgcca

SEQ ID NO: 3402172 - RNA, 14 nt, Pseudomonas aeruginosa PA01
ggcccgugcggcac

SEQ ID NO: 3402173 - RNA, 16 nt, Pseudomonas aeruginosa PA01
ggcccguuccaccgcc

SEQ ID NO: 3402174 - RNA, 17 nt, Pseudomonas aeruginosa PA01
ggcccguuccaccgccu

SEQ ID NO: 3402175 - RNA, 19 nt, Pseudomonas aeruginosa PA01
ggcccguuccaccgccugg

SEQ ID NO: 3402176 - RNA, 23 nt, Pseudomonas aeruginosa PA01
ggcccguuccaccgccuggacca

SEQ ID NO: 3402177 - RNA, 14 nt, Pseudomonas aeruginosa PA01
ggcccucagagcau

SEQ ID NO: 3402178 - RNA, 19 nt, Pseudomonas aeruginosa PA01
ggcccucagcggcggugcg

SEQ ID NO: 3402179 - RNA, 13 nt, Pseudomonas aeruginosa PA01
ggcccuccaggcg

SEQ ID NO: 3402180 - RNA, 15 nt, Pseudomonas aeruginosa PA01
ggcccuccaggcgaa

SEQ ID NO: 3402181 - RNA, 13 nt, Pseudomonas aeruginosa PA01
ggcccuccaucca

SEQ ID NO: 3402182 - RNA, 21 nt, Pseudomonas aeruginosa PA01
ggcccuccauccagucuucgc

SEQ ID NO: 3402183 - RNA, 16 nt, Pseudomonas aeruginosa PA01
ggcccuccccuggccc

SEQ ID NO: 3402184 - RNA, 14 nt, Pseudomonas aeruginosa PA01
ggcccucggcgacc

SEQ ID NO: 3402185 - RNA, 17 nt, Pseudomonas aeruginosa PA01
ggcccucggcgaccaac

SEQ ID NO: 3402186 - RNA, 13 nt, Pseudomonas aeruginosa PA01
ggcccucggcggc

SEQ ID NO: 3402187 - RNA, 19 nt, Pseudomonas aeruginosa PA01
ggcccucggcggcgagcgg

SEQ ID NO: 3402188 - RNA, 15 nt, Pseudomonas aeruginosa PA01
ggcccucucucgccu

SEQ ID NO: 3402189 - RNA, 14 nt, Pseudomonas aeruginosa PA01
ggcccugcaacagg

SEQ ID NO: 3402190 - RNA, 15 nt, Pseudomonas aeruginosa PA01
ggcccugcagcgcca

SEQ ID NO: 3402191 - RNA, 14 nt, Pseudomonas aeruginosa PA01
ggcccugccacuug

SEQ ID NO: 3402192 - RNA, 22 nt, Pseudomonas aeruginosa PA01
ggcccugccacuugcgggugcg

SEQ ID NO: 3402193 - RNA, 23 nt, Pseudomonas aeruginosa PA01
ggcccugccagaggaucggccaa

SEQ ID NO: 3402194 - RNA, 15 nt, Pseudomonas aeruginosa PA01
ggccgaccuugucca

SEQ ID NO: 3402195 - RNA, 16 nt, Pseudomonas aeruginosa PA01
ggccgacgaagaccuu

SEQ ID NO: 3402196 - RNA, 13 nt, Pseudomonas aeruginosa PA01
ggccgacgaaggc

SEQ ID NO: 3402197 - RNA, 14 nt, Pseudomonas aeruginosa PA01
ggccgacgaaggcc

SEQ ID NO: 3402198 - RNA, 16 nt, Pseudomonas aeruginosa PA01
ggccgacgaaggccgc

SEQ ID NO: 3402199 - RNA, 20 nt, Pseudomonas aeruginosa PA01
ggccgacgaaggccgcgguc

SEQ ID NO: 3402200 - RNA, 15 nt, Pseudomonas aeruginosa PA01
ggccgacgccgcugg

SEQ ID NO: 3402201 - RNA, 12 nt, Pseudomonas aeruginosa PA01
ggccgacgcgcu

SEQ ID NO: 3402202 - RNA, 14 nt, Pseudomonas aeruginosa PA01
ggccgacgcgcugc

SEQ ID NO: 3402203 - RNA, 15 nt, Pseudomonas aeruginosa PA01
ggccgacgcgcugcc

SEQ ID NO: 3402204 - RNA, 16 nt, Pseudomonas aeruginosa PA01
ggccgacgcuuccucg

SEQ ID NO: 3402205 - RNA, 13 nt, Pseudomonas aeruginosa PA01
ggccgacggcgcg

SEQ ID NO: 3402206 - RNA, 14 nt, Pseudomonas aeruginosa PA01
ggccgacggcgcgc

SEQ ID NO: 3402207 - RNA, 16 nt, Pseudomonas aeruginosa PA01
ggccgacggcgcgcug

SEQ ID NO: 3402208 - RNA, 18 nt, Pseudomonas aeruginosa PA01
ggccgacggcgcgcugcg

SEQ ID NO: 3402209 - RNA, 22 nt, Pseudomonas aeruginosa PA01
ggccgacggcgcgcugcgugcg

SEQ ID NO: 3402210 - RNA, 17 nt, Pseudomonas aeruginosa PA01
ggccgacguccaucagc

SEQ ID NO: 3402211 - RNA, 18 nt, Pseudomonas aeruginosa PA01
ggccgacgugcacccgcu

SEQ ID NO: 3402212 - RNA, 13 nt, Pseudomonas aeruginosa PA01
ggccgacucgcga

SEQ ID NO: 3402213 - RNA, 22 nt, Pseudomonas aeruginosa PA01
ggccgacucgcgaucgaucggc

SEQ ID NO: 3402214 - RNA, 18 nt, Pseudomonas aeruginosa PA01
ggccgagaaaccgccauc

SEQ ID NO: 3402215 - RNA, 23 nt, Pseudomonas aeruginosa PA01
ggccgagaagguucucggccacc

SEQ ID NO: 3402216 - RNA, 15 nt, Pseudomonas aeruginosa PA01
ggccgagaccgcagc

SEQ ID NO: 3402217 - RNA, 18 nt, Pseudomonas aeruginosa PA01
ggccgagcaauccggcgc

SEQ ID NO: 3402218 - RNA, 22 nt, Pseudomonas aeruginosa PA01
ggccgagcaauccggcgcugcc

SEQ ID NO: 3402219 - RNA, 17 nt, Pseudomonas aeruginosa PA01
ggccgagcaccacgcgc

SEQ ID NO: 3402220 - RNA, 20 nt, Pseudomonas aeruginosa PA01
ggccgagcaccggcaggacg

SEQ ID NO: 3402221 - RNA, 13 nt, Pseudomonas aeruginosa PA01
ggccgagcagcgc

SEQ ID NO: 3402222 - RNA, 15 nt, Pseudomonas aeruginosa PA01
ggccgagcagcgcca

SEQ ID NO: 3402223 - RNA, 19 nt, Pseudomonas aeruginosa PA01
ggccgagcagcgccagcca

SEQ ID NO: 3402224 - RNA, 17 nt, Pseudomonas aeruginosa PA01
ggccgagcaggcgcgcc

SEQ ID NO: 3402225 - RNA, 21 nt, Pseudomonas aeruginosa PA01
ggccgagcaggcgcgccaggc

SEQ ID NO: 3402226 - RNA, 15 nt, Pseudomonas aeruginosa PA01
ggccgagcaucagca

SEQ ID NO: 3402227 - RNA, 22 nt, Pseudomonas aeruginosa PA01
ggccgagcauguaggcgcacca

SEQ ID NO: 3402228 - RNA, 17 nt, Pseudomonas aeruginosa PA01
ggccgagcccagcggca

SEQ ID NO: 3402229 - RNA, 14 nt, Pseudomonas aeruginosa PA01
ggccgagccgacau

SEQ ID NO: 3402230 - RNA, 13 nt, Pseudomonas aeruginosa PA01
ggccgagccggca

SEQ ID NO: 3402231 - RNA, 18 nt, Pseudomonas aeruginosa PA01
ggccgagccggcauccug

SEQ ID NO: 3402232 - RNA, 13 nt, Pseudomonas aeruginosa PA01
ggccgagcgacuc

SEQ ID NO: 3402233 - RNA, 13 nt, Pseudomonas aeruginosa PA01
ggccgagcgcagc

SEQ ID NO: 3402234 - RNA, 15 nt, Pseudomonas aeruginosa PA01
ggccgagcgcagcgc

SEQ ID NO: 3402235 - RNA, 17 nt, Pseudomonas aeruginosa PA01
ggccgagcgcagcgcca

SEQ ID NO: 3402236 - RNA, 22 nt, Pseudomonas aeruginosa PA01
ggccgagcgcagcgccaccagg

SEQ ID NO: 3402237 - RNA, 13 nt, Pseudomonas aeruginosa PA01
ggccgagcgccgc

SEQ ID NO: 3402238 - RNA, 18 nt, Pseudomonas aeruginosa PA01
ggccgagcgccgccuggg

SEQ ID NO: 3402239 - RNA, 13 nt, Pseudomonas aeruginosa PA01
ggccgagcgcgag

SEQ ID NO: 3402240 - RNA, 12 nt, Pseudomonas aeruginosa PA01
ggccgagcgcgc

SEQ ID NO: 3402241 - RNA, 13 nt, Pseudomonas aeruginosa PA01
ggccgagcgcgcc

SEQ ID NO: 3402242 - RNA, 16 nt, Pseudomonas aeruginosa PA01
ggccgagcgcgccgcc

SEQ ID NO: 3402243 - RNA, 21 nt, Pseudomonas aeruginosa PA01
ggccgagcgugcgcaugcccg

SEQ ID NO: 3402244 - RNA, 22 nt, Pseudomonas aeruginosa PA01
ggccgagcgugcgcaugcccgc

SEQ ID NO: 3402245 - RNA, 14 nt, Pseudomonas aeruginosa PA01
ggccgagcugccgc

SEQ ID NO: 3402246 - RNA, 14 nt, Pseudomonas aeruginosa PA01
ggccgagcugcucg

SEQ ID NO: 3402247 - RNA, 13 nt, Pseudomonas aeruginosa PA01
ggccgaggaacuc

SEQ ID NO: 3402248 - RNA, 18 nt, Pseudomonas aeruginosa PA01
ggccgaggaaggcgcugg

SEQ ID NO: 3402249 - RNA, 17 nt, Pseudomonas aeruginosa PA01
ggccgaggaggccagca

SEQ ID NO: 3402250 - RNA, 21 nt, Pseudomonas aeruginosa PA01
ggccgaggaggccagcagcag

SEQ ID NO: 3402251 - RNA, 15 nt, Pseudomonas aeruginosa PA01
ggccgaggccggcga

SEQ ID NO: 3402252 - RNA, 17 nt, Pseudomonas aeruginosa PA01
ggccgaggccggcgaag

SEQ ID NO: 3402253 - RNA, 18 nt, Pseudomonas aeruginosa PA01
ggccgaggccggcgaagu

SEQ ID NO: 3402254 - RNA, 21 nt, Pseudomonas aeruginosa PA01
ggccgaggcgcuucugcucgg

SEQ ID NO: 3402255 - RNA, 17 nt, Pseudomonas aeruginosa PA01
ggccgaggcuuccucga

SEQ ID NO: 3402256 - RNA, 23 nt, Pseudomonas aeruginosa PA01
ggccgagggcagccucagcgaca

SEQ ID NO: 3402257 - RNA, 22 nt, Pseudomonas aeruginosa PA01
ggccgagggcgaguucggcgag

SEQ ID NO: 3402258 - RNA, 14 nt, Pseudomonas aeruginosa PA01
ggccgagggcgcgc

SEQ ID NO: 3402259 - RNA, 17 nt, Pseudomonas aeruginosa PA01
ggccgagggcgcgcagu

SEQ ID NO: 3402260 - RNA, 16 nt, Pseudomonas aeruginosa PA01
ggccgagggcugagac

SEQ ID NO: 3402261 - RNA, 13 nt, Pseudomonas aeruginosa PA01
ggccgagggcugc

SEQ ID NO: 3402262 - RNA, 16 nt, Pseudomonas aeruginosa PA01
ggccgagggcugccgc

SEQ ID NO: 3402263 - RNA, 17 nt, Pseudomonas aeruginosa PA01
ggccgagggcugccgcc

SEQ ID NO: 3402264 - RNA, 19 nt, Pseudomonas aeruginosa PA01
ggccgagggcugccgcccg

SEQ ID NO: 3402265 - RNA, 20 nt, Pseudomonas aeruginosa PA01
ggccgagggcugccgcccgg

SEQ ID NO: 3402266 - RNA, 21 nt, Pseudomonas aeruginosa PA01
ggccgagggcugccgcccggu

SEQ ID NO: 3402267 - RNA, 13 nt, Pseudomonas aeruginosa PA01
ggccgagggugau

SEQ ID NO: 3402268 - RNA, 22 nt, Pseudomonas aeruginosa PA01
ggccgagggugaucagccgagg

SEQ ID NO: 3402269 - RNA, 23 nt, Pseudomonas aeruginosa PA01
ggccgagggugaucagccgaggu

SEQ ID NO: 3402270 - RNA, 13 nt, Pseudomonas aeruginosa PA01
ggccgaggucgag

SEQ ID NO: 3402271 - RNA, 14 nt, Pseudomonas aeruginosa PA01
ggccgaggucgagg

SEQ ID NO: 3402272 - RNA, 15 nt, Pseudomonas aeruginosa PA01
ggccgaggucggcgg

SEQ ID NO: 3402273 - RNA, 16 nt, Pseudomonas aeruginosa PA01
ggccgaggucggcggc

SEQ ID NO: 3402274 - RNA, 17 nt, Pseudomonas aeruginosa PA01
ggccgaggucggcggcg

SEQ ID NO: 3402275 - RNA, 18 nt, Pseudomonas aeruginosa PA01
ggccgaggucggcggcgg

SEQ ID NO: 3402276 - RNA, 14 nt, Pseudomonas aeruginosa PA01
ggccgagguuucca

SEQ ID NO: 3402277 - RNA, 16 nt, Pseudomonas aeruginosa PA01
ggccgaguccgcgcgc

SEQ ID NO: 3402278 - RNA, 14 nt, Pseudomonas aeruginosa PA01
ggccgaguucgcgc

SEQ ID NO: 3402279 - RNA, 15 nt, Pseudomonas aeruginosa PA01
ggccgaguucgcgca

SEQ ID NO: 3402280 - RNA, 16 nt, Pseudomonas aeruginosa PA01
ggccgaguucgcgcag

SEQ ID NO: 3402281 - RNA, 18 nt, Pseudomonas aeruginosa PA01
ggccgaguucgcgcaggc

SEQ ID NO: 3402282 - RNA, 20 nt, Pseudomonas aeruginosa PA01
ggccgaguucgcgcaggcgc

SEQ ID NO: 3402283 - RNA, 21 nt, Pseudomonas aeruginosa PA01
ggccgaguucgcgcaggcgcu

SEQ ID NO: 3402284 - RNA, 24 nt, Pseudomonas aeruginosa PA01
ggccgaguucgcgcaggcgcuggc

SEQ ID NO: 3402285 - RNA, 14 nt, Pseudomonas aeruginosa PA01
ggccgaucaccacc

SEQ ID NO: 3402286 - RNA, 15 nt, Pseudomonas aeruginosa PA01
ggccgaucaccacca

SEQ ID NO: 3402287 - RNA, 16 nt, Pseudomonas aeruginosa PA01
ggccgaucaccaccag

SEQ ID NO: 3402288 - RNA, 17 nt, Pseudomonas aeruginosa PA01
ggccgaucaccaccagc

SEQ ID NO: 3402289 - RNA, 20 nt, Pseudomonas aeruginosa PA01
ggccgaucaccaccagcgcc

SEQ ID NO: 3402290 - RNA, 21 nt, Pseudomonas aeruginosa PA01
ggccgaucaccaccagcgccg

SEQ ID NO: 3402291 - RNA, 19 nt, Pseudomonas aeruginosa PA01
ggccgaucaccaccuggau

SEQ ID NO: 3402292 - RNA, 21 nt, Pseudomonas aeruginosa PA01
ggccgaucaccagcgccaggc

SEQ ID NO: 3402293 - RNA, 16 nt, Pseudomonas aeruginosa PA01
ggccgaucaccuggcc

SEQ ID NO: 3402294 - RNA, 21 nt, Pseudomonas aeruginosa PA01
ggccgaucaccuucaccggca

SEQ ID NO: 3402295 - RNA, 22 nt, Pseudomonas aeruginosa PA01
ggccgaucaccuucaccggcac

SEQ ID NO: 3402296 - RNA, 13 nt, Pseudomonas aeruginosa PA01
ggccgaucagcgc

SEQ ID NO: 3402297 - RNA, 14 nt, Pseudomonas aeruginosa PA01
ggccgccggcgccc

SEQ ID NO: 3402298 - RNA, 17 nt, Pseudomonas aeruginosa PA01
ggccgccggcgcccugc

SEQ ID NO: 3402299 - RNA, 21 nt, Pseudomonas aeruginosa PA01
ggccgccggcggccagggcgu

SEQ ID NO: 3402300 - RNA, 14 nt, Pseudomonas aeruginosa PA01
ggccgccuauggcg

SEQ ID NO: 3402301 - RNA, 16 nt, Pseudomonas aeruginosa PA01
ggccgccuauggcgga

SEQ ID NO: 3402302 - RNA, 16 nt, Pseudomonas aeruginosa PA01
ggccgccucgcgccgc

SEQ ID NO: 3402303 - RNA, 18 nt, Pseudomonas aeruginosa PA01
ggccgccucgcgccgcgc

SEQ ID NO: 3402304 - RNA, 22 nt, Pseudomonas aeruginosa PA01
ggccgccucgcgccgcgccagc

SEQ ID NO: 3402305 - RNA, 16 nt, Pseudomonas aeruginosa PA01
ggccgccugccuuccu

SEQ ID NO: 3402306 - RNA, 21 nt, Pseudomonas aeruginosa PA01
ggccgccugccuuccuugacc

SEQ ID NO: 3402307 - RNA, 14 nt, Pseudomonas aeruginosa PA01
ggccgccugcucgg

SEQ ID NO: 3402308 - RNA, 19 nt, Pseudomonas aeruginosa PA01
ggccgccugcucggccugc

SEQ ID NO: 3402309 - RNA, 20 nt, Pseudomonas aeruginosa PA01
ggccgccugcucggccugcu

SEQ ID NO: 3402310 - RNA, 12 nt, Pseudomonas aeruginosa PA01
ggccgccuggcc

SEQ ID NO: 3402311 - RNA, 14 nt, Pseudomonas aeruginosa PA01
ggccgccuggccgg

SEQ ID NO: 3402312 - RNA, 22 nt, Pseudomonas aeruginosa PA01
ggccgccuggccggccagccag

SEQ ID NO: 3402313 - RNA, 14 nt, Pseudomonas aeruginosa PA01
ggccgccuggcgca

SEQ ID NO: 3402314 - RNA, 19 nt, Pseudomonas aeruginosa PA01
ggccgccuggcgcauggcg

SEQ ID NO: 3402315 - RNA, 16 nt, Pseudomonas aeruginosa PA01
ggccgccuggcgugcc

SEQ ID NO: 3402316 - RNA, 14 nt, Pseudomonas aeruginosa PA01
ggccgccuggucgg

SEQ ID NO: 3402317 - RNA, 18 nt, Pseudomonas aeruginosa PA01
ggccgccuggucggggcc

SEQ ID NO: 3402318 - RNA, 22 nt, Pseudomonas aeruginosa PA01
ggccgccuggucggggccggcg

SEQ ID NO: 3402319 - RNA, 15 nt, Pseudomonas aeruginosa PA01
ggccgccuuccucgg

SEQ ID NO: 3402320 - RNA, 18 nt, Pseudomonas aeruginosa PA01
ggccgccuuccucggccg

SEQ ID NO: 3402321 - RNA, 20 nt, Pseudomonas aeruginosa PA01
ggccgccuuccucggccgcc

SEQ ID NO: 3402322 - RNA, 20 nt, Pseudomonas aeruginosa PA01
ggccgccuugaccugcuggg

SEQ ID NO: 3402323 - RNA, 15 nt, Pseudomonas aeruginosa PA01
ggccgcgagcgcggc

SEQ ID NO: 3402324 - RNA, 17 nt, Pseudomonas aeruginosa PA01
ggccgcgagcgcggccg

SEQ ID NO: 3402325 - RNA, 18 nt, Pseudomonas aeruginosa PA01
ggccgcgagcgcggccgg

SEQ ID NO: 3402326 - RNA, 19 nt, Pseudomonas aeruginosa PA01
ggccgcgagcgcggccggc

SEQ ID NO: 3402327 - RNA, 22 nt, Pseudomonas aeruginosa PA01
ggccgcgagguccggcuccggc

SEQ ID NO: 3402328 - RNA, 13 nt, Pseudomonas aeruginosa PA01
ggccgcgcagauc

SEQ ID NO: 3402329 - RNA, 21 nt, Pseudomonas aeruginosa PA01
ggccgcgcagaucgcguccag

SEQ ID NO: 3402330 - RNA, 14 nt, Pseudomonas aeruginosa PA01
ggccgcgcaggaag

SEQ ID NO: 3402331 - RNA, 22 nt, Pseudomonas aeruginosa PA01
ggccgcgcaggaagaaggcguc

SEQ ID NO: 3402332 - RNA, 21 nt, Pseudomonas aeruginosa PA01
ggccgcgcagucccgcgcggc

SEQ ID NO: 3402333 - RNA, 22 nt, Pseudomonas aeruginosa PA01
ggccgcgcagucccgcgcggcc

SEQ ID NO: 3402334 - RNA, 23 nt, Pseudomonas aeruginosa PA01
ggccgcgcagucccgcgcggccc

SEQ ID NO: 3402335 - RNA, 16 nt, Pseudomonas aeruginosa PA01
ggccgcgccccacggc

SEQ ID NO: 3402336 - RNA, 21 nt, Pseudomonas aeruginosa PA01
ggccgcgccccacggcgcggc

SEQ ID NO: 3402337 - RNA, 15 nt, Pseudomonas aeruginosa PA01
ggccgcgccgaaggc

SEQ ID NO: 3402338 - RNA, 12 nt, Pseudomonas aeruginosa PA01
ggccgcgccgac

SEQ ID NO: 3402339 - RNA, 13 nt, Pseudomonas aeruginosa PA01
ggccgcgccgacc

SEQ ID NO: 3402340 - RNA, 17 nt, Pseudomonas aeruginosa PA01
ggccgcgccgacccaga

SEQ ID NO: 3402341 - RNA, 23 nt, Pseudomonas aeruginosa PA01
ggccgcgccgacccagagcgcgc

SEQ ID NO: 3402342 - RNA, 13 nt, Pseudomonas aeruginosa PA01
ggccgcgccgagc

SEQ ID NO: 3402343 - RNA, 14 nt, Pseudomonas aeruginosa PA01
ggccgcgccgagcc

SEQ ID NO: 3402344 - RNA, 12 nt, Pseudomonas aeruginosa PA01
ggccgcgccgca

SEQ ID NO: 3402345 - RNA, 21 nt, Pseudomonas aeruginosa PA01
ggccgcgccgcaagggcgucg

SEQ ID NO: 3402346 - RNA, 18 nt, Pseudomonas aeruginosa PA01
ggccgcgccgcccuggcc

SEQ ID NO: 3402347 - RNA, 14 nt, Pseudomonas aeruginosa PA01
ggccgcgccggauc

SEQ ID NO: 3402348 - RNA, 12 nt, Pseudomonas aeruginosa PA01
ggccgcgccggc

SEQ ID NO: 3402349 - RNA, 15 nt, Pseudomonas aeruginosa PA01
ggccgcgccggcucc

SEQ ID NO: 3402350 - RNA, 20 nt, Pseudomonas aeruginosa PA01
ggccgcgccggcucccugca

SEQ ID NO: 3402351 - RNA, 17 nt, Pseudomonas aeruginosa PA01
ggccgcgccuucagcgc

SEQ ID NO: 3402352 - RNA, 22 nt, Pseudomonas aeruginosa PA01
ggccgcgccuucagcgccagca

SEQ ID NO: 3402353 - RNA, 23 nt, Pseudomonas aeruginosa PA01
ggccgcgccuuucgcucaggccu

SEQ ID NO: 3402354 - RNA, 20 nt, Pseudomonas aeruginosa PA01
ggccgcgcgaccgcggcgcu

SEQ ID NO: 3402355 - RNA, 14 nt, Pseudomonas aeruginosa PA01
ggccgcgcgauggc

SEQ ID NO: 3402356 - RNA, 16 nt, Pseudomonas aeruginosa PA01
ggccgcgcgauggccg

SEQ ID NO: 3402357 - RNA, 17 nt, Pseudomonas aeruginosa PA01
ggccgcgcgauggccgg

SEQ ID NO: 3402358 - RNA, 15 nt, Pseudomonas aeruginosa PA01
ggccgcgcuccaaca

SEQ ID NO: 3402359 - RNA, 19 nt, Pseudomonas aeruginosa PA01
ggccgcgcucgacggucag

SEQ ID NO: 3402360 - RNA, 23 nt, Pseudomonas aeruginosa PA01
ggccgcgcugcugccauccgcgc

SEQ ID NO: 3402361 - RNA, 14 nt, Pseudomonas aeruginosa PA01
ggccgcgcugucgg

SEQ ID NO: 3402362 - RNA, 19 nt, Pseudomonas aeruginosa PA01
ggccgcgcugucggccucg

SEQ ID NO: 3402363 - RNA, 16 nt, Pseudomonas aeruginosa PA01
ggccgcggagcaccgc

SEQ ID NO: 3402364 - RNA, 20 nt, Pseudomonas aeruginosa PA01
ggccgcggagcaccgcgccu

SEQ ID NO: 3402365 - RNA, 23 nt, Pseudomonas aeruginosa PA01
ggccgcggcccugcgccgcagcg

SEQ ID NO: 3402366 - RNA, 17 nt, Pseudomonas aeruginosa PA01
ggccgcggcguugucgg

SEQ ID NO: 3402367 - RNA, 21 nt, Pseudomonas aeruginosa PA01
ggccgcggcguugucggccag

SEQ ID NO: 3402368 - RNA, 23 nt, Pseudomonas aeruginosa PA01
ggccgcggcguugucggccagca

SEQ ID NO: 3402369 - RNA, 12 nt, Pseudomonas aeruginosa PA01
ggccgcggcugg

SEQ ID NO: 3402370 - RNA, 20 nt, Pseudomonas aeruginosa PA01
ggccgcggcuggcaggugcc

SEQ ID NO: 3402371 - RNA, 20 nt, Pseudomonas aeruginosa PA01
ggccgcgggaggccgccucg

SEQ ID NO: 3402372 - RNA, 16 nt, Pseudomonas aeruginosa PA01
ggccgcggggaggaag

SEQ ID NO: 3402373 - RNA, 20 nt, Pseudomonas aeruginosa PA01
ggccgcgggucuugcgcagg

SEQ ID NO: 3402374 - RNA, 22 nt, Pseudomonas aeruginosa PA01
ggccgcgggucuugcgcagggc

SEQ ID NO: 3402375 - RNA, 19 nt, Pseudomonas aeruginosa PA01
ggccgcggugggcuccagc

SEQ ID NO: 3402376 - RNA, 15 nt, Pseudomonas aeruginosa PA01
ggccgcguaagcggc

SEQ ID NO: 3402377 - RNA, 16 nt, Pseudomonas aeruginosa PA01
ggccgcguaagcggcc

SEQ ID NO: 3402378 - RNA, 17 nt, Pseudomonas aeruginosa PA01
ggccgcguaagcggccu

SEQ ID NO: 3402379 - RNA, 18 nt, Pseudomonas aeruginosa PA01
ggccgcguaagcggccuu

SEQ ID NO: 3402380 - RNA, 17 nt, Pseudomonas aeruginosa PA01
ggccgcgucgcccaggc

SEQ ID NO: 3402381 - RNA, 21 nt, Pseudomonas aeruginosa PA01
ggccgcgucgcccaggccgcu

SEQ ID NO: 3402382 - RNA, 22 nt, Pseudomonas aeruginosa PA01
ggccgcgucgcccaggccgcug

SEQ ID NO: 3402383 - RNA, 15 nt, Pseudomonas aeruginosa PA01
ggccgcguucgccga

SEQ ID NO: 3402384 - RNA, 19 nt, Pseudomonas aeruginosa PA01
ggccgcguucgccgaggcg

SEQ ID NO: 3402385 - RNA, 17 nt, Pseudomonas aeruginosa PA01
ggccgcuacgcggcggg

SEQ ID NO: 3402386 - RNA, 18 nt, Pseudomonas aeruginosa PA01
ggccgcuacgcggcggga

SEQ ID NO: 3402387 - RNA, 14 nt, Pseudomonas aeruginosa PA01
ggccgcucaccgcc

SEQ ID NO: 3402388 - RNA, 18 nt, Pseudomonas aeruginosa PA01
ggccgcucaccgccaccc

SEQ ID NO: 3402389 - RNA, 16 nt, Pseudomonas aeruginosa PA01
ggccgcucccaccgcu

SEQ ID NO: 3402390 - RNA, 20 nt, Pseudomonas aeruginosa PA01
ggccgcucgagggcgaccgc

SEQ ID NO: 3402391 - RNA, 21 nt, Pseudomonas aeruginosa PA01
ggccgcucgagggcgaccgcc

SEQ ID NO: 3402392 - RNA, 15 nt, Pseudomonas aeruginosa PA01
ggccgcucgcgcggc

SEQ ID NO: 3402393 - RNA, 12 nt, Pseudomonas aeruginosa PA01
ggccgcucuucu

SEQ ID NO: 3402394 - RNA, 20 nt, Pseudomonas aeruginosa PA01
ggccgcucuucugguaggcc

SEQ ID NO: 3402395 - RNA, 22 nt, Pseudomonas aeruginosa PA01
ggccgcucuucugguaggccag

SEQ ID NO: 3402396 - RNA, 19 nt, Pseudomonas aeruginosa PA01
ggccgcucuuuccucaucu

SEQ ID NO: 3402397 - RNA, 20 nt, Pseudomonas aeruginosa PA01
ggccgcugagcagcaggugg

SEQ ID NO: 3402398 - RNA, 21 nt, Pseudomonas aeruginosa PA01
ggccgcugccgccgcgcaggc

SEQ ID NO: 3402399 - RNA, 21 nt, Pseudomonas aeruginosa PA01
ggccggcggccugagccggcc

SEQ ID NO: 3402400 - RNA, 23 nt, Pseudomonas aeruginosa PA01
ggccggcggugagggcgacggcg

SEQ ID NO: 3402401 - RNA, 20 nt, Pseudomonas aeruginosa PA01
ggccggcguacuucggcgcg

SEQ ID NO: 3402402 - RNA, 23 nt, Pseudomonas aeruginosa PA01
ggccggcguacuucggcgcggug

SEQ ID NO: 3402403 - RNA, 19 nt, Pseudomonas aeruginosa PA01
ggccggcgugcccauccgc

SEQ ID NO: 3402404 - RNA, 15 nt, Pseudomonas aeruginosa PA01
ggccggcucagcgcu

SEQ ID NO: 3402405 - RNA, 16 nt, Pseudomonas aeruginosa PA01
ggccggcuucagcaac

SEQ ID NO: 3402406 - RNA, 22 nt, Pseudomonas aeruginosa PA01
ggccggcuucuacgccuugcgg

SEQ ID NO: 3402407 - RNA, 17 nt, Pseudomonas aeruginosa PA01
ggccgggaaccagcaug

SEQ ID NO: 3402408 - RNA, 21 nt, Pseudomonas aeruginosa PA01
ggccgggaaccagcauguccu

SEQ ID NO: 3402409 - RNA, 21 nt, Pseudomonas aeruginosa PA01
ggccgggaauggagaugccga

SEQ ID NO: 3402410 - RNA, 23 nt, Pseudomonas aeruginosa PA01
ggccgggaauggagaugccgaac

SEQ ID NO: 3402411 - RNA, 15 nt, Pseudomonas aeruginosa PA01
ggccgggagcuacag

SEQ ID NO: 3402412 - RNA, 17 nt, Pseudomonas aeruginosa PA01
ggccgggauacagcagc

SEQ ID NO: 3402413 - RNA, 18 nt, Pseudomonas aeruginosa PA01
ggccgggauauccagguu

SEQ ID NO: 3402414 - RNA, 17 nt, Pseudomonas aeruginosa PA01
ggccgggcaccccgagc

SEQ ID NO: 3402415 - RNA, 20 nt, Pseudomonas aeruginosa PA01
ggccgggcaccccgagcggc

SEQ ID NO: 3402416 - RNA, 23 nt, Pseudomonas aeruginosa PA01
ggccgggcaccccgagcggcgcg

SEQ ID NO: 3402417 - RNA, 16 nt, Pseudomonas aeruginosa PA01
ggccgggcagacuucg

SEQ ID NO: 3402418 - RNA, 14 nt, Pseudomonas aeruginosa PA01
ggccgggcaggccg

SEQ ID NO: 3402419 - RNA, 20 nt, Pseudomonas aeruginosa PA01
ggccgggcaggccgaggccg

SEQ ID NO: 3402420 - RNA, 22 nt, Pseudomonas aeruginosa PA01
ggccgggcaggccgaggccggc

SEQ ID NO: 3402421 - RNA, 13 nt, Pseudomonas aeruginosa PA01
ggccgggcccugg

SEQ ID NO: 3402422 - RNA, 16 nt, Pseudomonas aeruginosa PA01
ggccgggcccugggcc

SEQ ID NO: 3402423 - RNA, 21 nt, Pseudomonas aeruginosa PA01
ggccgggcccugggccccggc

SEQ ID NO: 3402424 - RNA, 13 nt, Pseudomonas aeruginosa PA01
ggccgggccgauc

SEQ ID NO: 3402425 - RNA, 21 nt, Pseudomonas aeruginosa PA01
ggccgggcggacgcugggcug

SEQ ID NO: 3402426 - RNA, 12 nt, Pseudomonas aeruginosa PA01
ggccgggcggcg

SEQ ID NO: 3402427 - RNA, 14 nt, Pseudomonas aeruginosa PA01
ggccgggcggcggc

SEQ ID NO: 3402428 - RNA, 15 nt, Pseudomonas aeruginosa PA01
ggccgggcggcggcg

SEQ ID NO: 3402429 - RNA, 15 nt, Pseudomonas aeruginosa PA01
ggccgggcuggccac

SEQ ID NO: 3402430 - RNA, 19 nt, Pseudomonas aeruginosa PA01
ggccgggcuggccaccgcc

SEQ ID NO: 3402431 - RNA, 13 nt, Pseudomonas aeruginosa PA01
ggccggggccggc

SEQ ID NO: 3402432 - RNA, 14 nt, Pseudomonas aeruginosa PA01
ggccggggccggca

SEQ ID NO: 3402433 - RNA, 16 nt, Pseudomonas aeruginosa PA01
ggccggggccggcacc

SEQ ID NO: 3402434 - RNA, 14 nt, Pseudomonas aeruginosa PA01
ggccggggcgcgcc

SEQ ID NO: 3402435 - RNA, 14 nt, Pseudomonas aeruginosa PA01
ggccgggggcggcg

SEQ ID NO: 3402436 - RNA, 17 nt, Pseudomonas aeruginosa PA01
ggccgggggcggcgccu

SEQ ID NO: 3402437 - RNA, 16 nt, Pseudomonas aeruginosa PA01
ggccgggggucgcggc

SEQ ID NO: 3402438 - RNA, 17 nt, Pseudomonas aeruginosa PA01
ggccgggggucgcggcg

SEQ ID NO: 3402439 - RNA, 18 nt, Pseudomonas aeruginosa PA01
ggccgggguauccgggca

SEQ ID NO: 3402440 - RNA, 21 nt, Pseudomonas aeruginosa PA01
ggccggggucaggccgaggcg

SEQ ID NO: 3402441 - RNA, 23 nt, Pseudomonas aeruginosa PA01
ggccggggucaggccgaggcgcu

SEQ ID NO: 3402442 - RNA, 18 nt, Pseudomonas aeruginosa PA01
ggccgggucaucaccggc

SEQ ID NO: 3402443 - RNA, 20 nt, Pseudomonas aeruginosa PA01
ggccgggucaucaccggcag

SEQ ID NO: 3402444 - RNA, 22 nt, Pseudomonas aeruginosa PA01
ggccggguugcgccuccgggcg

SEQ ID NO: 3402445 - RNA, 23 nt, Pseudomonas aeruginosa PA01
ggccggugaucucgcggcgcggc

SEQ ID NO: 3402446 - RNA, 21 nt, Pseudomonas aeruginosa PA01
ggccggugccauacagcgccc

SEQ ID NO: 3402447 - RNA, 12 nt, Pseudomonas aeruginosa PA01
ggccggugccgc

SEQ ID NO: 3402448 - RNA, 16 nt, Pseudomonas aeruginosa PA01
ggccggugccgcccug

SEQ ID NO: 3402449 - RNA, 14 nt, Pseudomonas aeruginosa PA01
ggccggugccgccg

SEQ ID NO: 3402450 - RNA, 16 nt, Pseudomonas aeruginosa PA01
ggccggugccgccggc

SEQ ID NO: 3402451 - RNA, 14 nt, Pseudomonas aeruginosa PA01
ggccggugccuucg

SEQ ID NO: 3402452 - RNA, 19 nt, Pseudomonas aeruginosa PA01
ggccggugccuucggcggc

SEQ ID NO: 3402453 - RNA, 20 nt, Pseudomonas aeruginosa PA01
ggccggugccuucggcggcg

SEQ ID NO: 3402454 - RNA, 14 nt, Pseudomonas aeruginosa PA01
ggccggugcgaacc

SEQ ID NO: 3402455 - RNA, 21 nt, Pseudomonas aeruginosa PA01
ggccggugugcgacuggggca

SEQ ID NO: 3402456 - RNA, 21 nt, Pseudomonas aeruginosa PA01
ggccgguuccgaaucgccuac

SEQ ID NO: 3402457 - RNA, 14 nt, Pseudomonas aeruginosa PA01
ggccgguugcgacc

SEQ ID NO: 3402458 - RNA, 18 nt, Pseudomonas aeruginosa PA01
ggccgguugcgaccggcc

SEQ ID NO: 3402459 - RNA, 15 nt, Pseudomonas aeruginosa PA01
ggccgguugcggcgc

SEQ ID NO: 3402460 - RNA, 16 nt, Pseudomonas aeruginosa PA01
ggccgguugcggcgcc

SEQ ID NO: 3402461 - RNA, 20 nt, Pseudomonas aeruginosa PA01
ggccgguugcggcgccgguu

SEQ ID NO: 3402462 - RNA, 23 nt, Pseudomonas aeruginosa PA01
ggccgguuuuuuauugccagcga

SEQ ID NO: 3402463 - RNA, 19 nt, Pseudomonas aeruginosa PA01
ggccguaccagucgcccgc

SEQ ID NO: 3402464 - RNA, 14 nt, Pseudomonas aeruginosa PA01
ggccguagaccacc

SEQ ID NO: 3402465 - RNA, 16 nt, Pseudomonas aeruginosa PA01
ggccguagaccaccag

SEQ ID NO: 3402466 - RNA, 17 nt, Pseudomonas aeruginosa PA01
ggccguagaccaccagc

SEQ ID NO: 3402467 - RNA, 21 nt, Pseudomonas aeruginosa PA01
ggccguagaccaccagcagca

SEQ ID NO: 3402468 - RNA, 22 nt, Pseudomonas aeruginosa PA01
ggccguagaccaccagcagcag

SEQ ID NO: 3402469 - RNA, 14 nt, Pseudomonas aeruginosa PA01
ggccguagccgaac

SEQ ID NO: 3402470 - RNA, 14 nt, Pseudomonas aeruginosa PA01
ggccguagccgucg

SEQ ID NO: 3402471 - RNA, 20 nt, Pseudomonas aeruginosa PA01
ggccguagcgcucgauagcg

SEQ ID NO: 3402472 - RNA, 18 nt, Pseudomonas aeruginosa PA01
ggccguagcugcgcgccu

SEQ ID NO: 3402473 - RNA, 15 nt, Pseudomonas aeruginosa PA01
ggccguaggcgaugg

SEQ ID NO: 3402474 - RNA, 21 nt, Pseudomonas aeruginosa PA01
ggccguaggugaccgcccagg

SEQ ID NO: 3402475 - RNA, 13 nt, Pseudomonas aeruginosa PA01
ggccgucacggcc

SEQ ID NO: 3402476 - RNA, 15 nt, Pseudomonas aeruginosa PA01
ggccgucacggccuc

SEQ ID NO: 3402477 - RNA, 23 nt, Pseudomonas aeruginosa PA01
ggccgucacggccuccgguggcg

SEQ ID NO: 3402478 - RNA, 16 nt, Pseudomonas aeruginosa PA01
ggccguccaggcugcc

SEQ ID NO: 3402479 - RNA, 18 nt, Pseudomonas aeruginosa PA01
ggccguccaggcugccgc

SEQ ID NO: 3402480 - RNA, 13 nt, Pseudomonas aeruginosa PA01
ggccgucccaggu

SEQ ID NO: 3402481 - RNA, 18 nt, Pseudomonas aeruginosa PA01
ggccgucccugaccagca

SEQ ID NO: 3402482 - RNA, 20 nt, Pseudomonas aeruginosa PA01
ggccgucccugaccagcagg

SEQ ID NO: 3402483 - RNA, 15 nt, Pseudomonas aeruginosa PA01
ggccguccgccaggu

SEQ ID NO: 3402484 - RNA, 14 nt, Pseudomonas aeruginosa PA01
ggccguccucggga

SEQ ID NO: 3402485 - RNA, 14 nt, Pseudomonas aeruginosa PA01
ggccguccucgucg

SEQ ID NO: 3402486 - RNA, 19 nt, Pseudomonas aeruginosa PA01
ggccguccugcuugaccuu

SEQ ID NO: 3402487 - RNA, 22 nt, Pseudomonas aeruginosa PA01
ggccguccuugaguagcuggcg

SEQ ID NO: 3402488 - RNA, 14 nt, Pseudomonas aeruginosa PA01
ggccgucgaagggc

SEQ ID NO: 3402489 - RNA, 19 nt, Pseudomonas aeruginosa PA01
ggccgucgaagggcacgcc

SEQ ID NO: 3402490 - RNA, 20 nt, Pseudomonas aeruginosa PA01
ggccgucgaagggcacgccg

SEQ ID NO: 3402491 - RNA, 23 nt, Pseudomonas aeruginosa PA01
ggccgucgaagggcacgccgcuc

SEQ ID NO: 3402492 - RNA, 14 nt, Pseudomonas aeruginosa PA01
ggccgucgacccgc

SEQ ID NO: 3402493 - RNA, 17 nt, Pseudomonas aeruginosa PA01
ggccgucgacccgccuc

SEQ ID NO: 3402494 - RNA, 23 nt, Pseudomonas aeruginosa PA01
ggccgucgagggcaaaggcgcgc

SEQ ID NO: 3402495 - RNA, 15 nt, Pseudomonas aeruginosa PA01
ggccgucgaggucgg

SEQ ID NO: 3402496 - RNA, 20 nt, Pseudomonas aeruginosa PA01
ggccgucgaggucggcgauc

SEQ ID NO: 3402497 - RNA, 14 nt, Pseudomonas aeruginosa PA01
ggccgucgcgcacc

SEQ ID NO: 3402498 - RNA, 18 nt, Pseudomonas aeruginosa PA01
ggccgucgcugccgagcu

SEQ ID NO: 3402499 - RNA, 15 nt, Pseudomonas aeruginosa PA01
ggccgucggccugcu

SEQ ID NO: 3402500 - RNA, 14 nt, Pseudomonas aeruginosa PA01
ggccgucggccugg

SEQ ID NO: 3402501 - RNA, 13 nt, Pseudomonas aeruginosa PA01
ggccucgucgauc

SEQ ID NO: 3402502 - RNA, 14 nt, Pseudomonas aeruginosa PA01
ggccucgucgaucu

SEQ ID NO: 3402503 - RNA, 20 nt, Pseudomonas aeruginosa PA01
ggccucgucgaucucgccga

SEQ ID NO: 3402504 - RNA, 22 nt, Pseudomonas aeruginosa PA01
ggccucgucguucagcccaccc

SEQ ID NO: 3402505 - RNA, 18 nt, Pseudomonas aeruginosa PA01
ggccucuccgagacgcug

SEQ ID NO: 3402506 - RNA, 20 nt, Pseudomonas aeruginosa PA01
ggccucuccgagacgcugca

SEQ ID NO: 3402507 - RNA, 19 nt, Pseudomonas aeruginosa PA01
ggccucugccucgacgcuc

SEQ ID NO: 3402508 - RNA, 17 nt, Pseudomonas aeruginosa PA01
ggccucuucgcaacggc

SEQ ID NO: 3402509 - RNA, 19 nt, Pseudomonas aeruginosa PA01
ggccucuucgcaacggccg

SEQ ID NO: 3402510 - RNA, 14 nt, Pseudomonas aeruginosa PA01
ggccucuucgucgg

SEQ ID NO: 3402511 - RNA, 20 nt, Pseudomonas aeruginosa PA01
ggccucuugaaaacugucgg

SEQ ID NO: 3402512 - RNA, 19 nt, Pseudomonas aeruginosa PA01
ggccugacgcaagcgcucg

SEQ ID NO: 3402513 - RNA, 22 nt, Pseudomonas aeruginosa PA01
ggccugacgcaagcgcucggcc

SEQ ID NO: 3402514 - RNA, 13 nt, Pseudomonas aeruginosa PA01
ggccugagccggc

SEQ ID NO: 3402515 - RNA, 15 nt, Pseudomonas aeruginosa PA01
ggccugagccggccg

SEQ ID NO: 3402516 - RNA, 18 nt, Pseudomonas aeruginosa PA01
ggccugagccggccggag

SEQ ID NO: 3402517 - RNA, 15 nt, Pseudomonas aeruginosa PA01
ggccugagcugccgc

SEQ ID NO: 3402518 - RNA, 19 nt, Pseudomonas aeruginosa PA01
ggccugagcugccgcuucg

SEQ ID NO: 3402519 - RNA, 16 nt, Pseudomonas aeruginosa PA01
ggccugcaacacccag

SEQ ID NO: 3402520 - RNA, 18 nt, Pseudomonas aeruginosa PA01
ggccugcaacacccaggc

SEQ ID NO: 3402521 - RNA, 20 nt, Pseudomonas aeruginosa PA01
ggccugcaacacccaggccu

SEQ ID NO: 3402522 - RNA, 15 nt, Pseudomonas aeruginosa PA01
ggccugcaacgccgc

SEQ ID NO: 3402523 - RNA, 13 nt, Pseudomonas aeruginosa PA01
ggccugcaccagc

SEQ ID NO: 3402524 - RNA, 14 nt, Pseudomonas aeruginosa PA01
ggccugcaccagcc

SEQ ID NO: 3402525 - RNA, 15 nt, Pseudomonas aeruginosa PA01
ggccugcaccagcca

SEQ ID NO: 3402526 - RNA, 23 nt, Pseudomonas aeruginosa PA01
ggccugcaccagccaguccggca

SEQ ID NO: 3402527 - RNA, 17 nt, Pseudomonas aeruginosa PA01
ggccugcagcaggucga

SEQ ID NO: 3402528 - RNA, 13 nt, Pseudomonas aeruginosa PA01
ggccugcagccug

SEQ ID NO: 3402529 - RNA, 14 nt, Pseudomonas aeruginosa PA01
ggccugcagccugg

SEQ ID NO: 3402530 - RNA, 15 nt, Pseudomonas aeruginosa PA01
ggccugcagccuggc

SEQ ID NO: 3402531 - RNA, 17 nt, Pseudomonas aeruginosa PA01
ggccugcagccuggcgu

SEQ ID NO: 3402532 - RNA, 19 nt, Pseudomonas aeruginosa PA01
ggccugcagccuggcgucg

SEQ ID NO: 3402533 - RNA, 17 nt, Pseudomonas aeruginosa PA01
ggccugcagguccgggu

SEQ ID NO: 3402534 - RNA, 22 nt, Pseudomonas aeruginosa PA01
ggccugcagguuguccagggca

SEQ ID NO: 3402535 - RNA, 16 nt, Pseudomonas aeruginosa PA01
ggccugccccgccggc

SEQ ID NO: 3402536 - RNA, 12 nt, Pseudomonas aeruginosa PA01
ggccugccguug

SEQ ID NO: 3402537 - RNA, 18 nt, Pseudomonas aeruginosa PA01
ggccugcgcccuagucga

SEQ ID NO: 3402538 - RNA, 20 nt, Pseudomonas aeruginosa PA01
ggccugcgcgcaccaggccu

SEQ ID NO: 3402539 - RNA, 21 nt, Pseudomonas aeruginosa PA01
ggccugcgcgcaccaggccuc

SEQ ID NO: 3402540 - RNA, 16 nt, Pseudomonas aeruginosa PA01
ggccugcgcuuccggc

SEQ ID NO: 3402541 - RNA, 19 nt, Pseudomonas aeruginosa PA01
ggccugcgcuuccggcagc

SEQ ID NO: 3402542 - RNA, 21 nt, Pseudomonas aeruginosa PA01
ggccugcggguucggcgagag

SEQ ID NO: 3402543 - RNA, 16 nt, Pseudomonas aeruginosa PA01
ggccugcgguucgccu

SEQ ID NO: 3402544 - RNA, 16 nt, Pseudomonas aeruginosa PA01
ggccugcucagcgucc

SEQ ID NO: 3402545 - RNA, 20 nt, Pseudomonas aeruginosa PA01
ggccugcucagcguccucag

SEQ ID NO: 3402546 - RNA, 14 nt, Pseudomonas aeruginosa PA01
ggccugcuccagcg

SEQ ID NO: 3402547 - RNA, 23 nt, Pseudomonas aeruginosa PA01
ggccugcuccagcggagcgaccg

SEQ ID NO: 3402548 - RNA, 12 nt, Pseudomonas aeruginosa PA01
ggccugcuccuc

SEQ ID NO: 3402549 - RNA, 14 nt, Pseudomonas aeruginosa PA01
ggccugcuccucgg

SEQ ID NO: 3402550 - RNA, 20 nt, Pseudomonas aeruginosa PA01
ggccugcuccucggcagcgc

SEQ ID NO: 3402551 - RNA, 21 nt, Pseudomonas aeruginosa PA01
ggccugcuccucggcagcgcu

SEQ ID NO: 3402552 - RNA, 16 nt, Pseudomonas aeruginosa PA01
ggccugcucgaacggc

SEQ ID NO: 3402553 - RNA, 17 nt, Pseudomonas aeruginosa PA01
ggccugcucgcgcagcc

SEQ ID NO: 3402554 - RNA, 21 nt, Pseudomonas aeruginosa PA01
ggccugcucgcgcagccaggc

SEQ ID NO: 3402555 - RNA, 13 nt, Pseudomonas aeruginosa PA01
ggccugcucggag

SEQ ID NO: 3402556 - RNA, 14 nt, Pseudomonas aeruginosa PA01
ggccugcucggcuc

SEQ ID NO: 3402557 - RNA, 17 nt, Pseudomonas aeruginosa PA01
ggccugcucggcucgcg

SEQ ID NO: 3402558 - RNA, 16 nt, Pseudomonas aeruginosa PA01
ggccugcugcgccggc

SEQ ID NO: 3402559 - RNA, 18 nt, Pseudomonas aeruginosa PA01
ggccugcugcgccggcac

SEQ ID NO: 3402560 - RNA, 20 nt, Pseudomonas aeruginosa PA01
ggccugcugcgggcgcugca

SEQ ID NO: 3402561 - RNA, 17 nt, Pseudomonas aeruginosa PA01
ggccugcugcucgaccg

SEQ ID NO: 3402562 - RNA, 14 nt, Pseudomonas aeruginosa PA01
ggccuggaacacca

SEQ ID NO: 3402563 - RNA, 17 nt, Pseudomonas aeruginosa PA01
ggccuggaacaccaggc

SEQ ID NO: 3402564 - RNA, 20 nt, Pseudomonas aeruginosa PA01
ggccuggaacaccaggccgc

SEQ ID NO: 3402565 - RNA, 22 nt, Pseudomonas aeruginosa PA01
ggccuggaacaccaggccgcaa

SEQ ID NO: 3402566 - RNA, 17 nt, Pseudomonas aeruginosa PA01
ggccuggaacuggucgg

SEQ ID NO: 3402567 - RNA, 19 nt, Pseudomonas aeruginosa PA01
ggccuggaauaccccgcgg

SEQ ID NO: 3402568 - RNA, 19 nt, Pseudomonas aeruginosa PA01
ggccuggagaaacucgcgg

SEQ ID NO: 3402569 - RNA, 21 nt, Pseudomonas aeruginosa PA01
ggccuggagaaacucgcgggc

SEQ ID NO: 3402570 - RNA, 21 nt, Pseudomonas aeruginosa PA01
ggccuggaucgccuugcgcgu

SEQ ID NO: 3402571 - RNA, 13 nt, Pseudomonas aeruginosa PA01
ggccuggccaccc

SEQ ID NO: 3402572 - RNA, 20 nt, Pseudomonas aeruginosa PA01
ggccuggcccggcgcacugc

SEQ ID NO: 3402573 - RNA, 19 nt, Pseudomonas aeruginosa PA01
ggccuggcccucggugcgg

SEQ ID NO: 3402574 - RNA, 18 nt, Pseudomonas aeruginosa PA01
ggccuggcccuggcgcag

SEQ ID NO: 3402575 - RNA, 22 nt, Pseudomonas aeruginosa PA01
ggccuggcccuggcgcaggcgg

SEQ ID NO: 3402576 - RNA, 23 nt, Pseudomonas aeruginosa PA01
ggccuggcccuggcgcaggcggc

SEQ ID NO: 3402577 - RNA, 11 nt, Pseudomonas aeruginosa PA01
ggccuggccgc

SEQ ID NO: 3402578 - RNA, 20 nt, Pseudomonas aeruginosa PA01
ggccuggcgcaacaggcgca

SEQ ID NO: 3402579 - RNA, 15 nt, Pseudomonas aeruginosa PA01
ggccuggcgcacggc

SEQ ID NO: 3402580 - RNA, 16 nt, Pseudomonas aeruginosa PA01
ggccuggcgcacggcc

SEQ ID NO: 3402581 - RNA, 16 nt, Pseudomonas aeruginosa PA01
ggccuggcgcagcggc

SEQ ID NO: 3402582 - RNA, 17 nt, Pseudomonas aeruginosa PA01
ggccuggcgcagcggca

SEQ ID NO: 3402583 - RNA, 12 nt, Pseudomonas aeruginosa PA01
ggccuggcgccg

SEQ ID NO: 3402584 - RNA, 11 nt, Pseudomonas aeruginosa PA01
ggccuggcgcu

SEQ ID NO: 3402585 - RNA, 17 nt, Pseudomonas aeruginosa PA01
ggccuggcgcucagcgc

SEQ ID NO: 3402586 - RNA, 19 nt, Pseudomonas aeruginosa PA01
ggccuggcgcucagcgccg

SEQ ID NO: 3402587 - RNA, 23 nt, Pseudomonas aeruginosa PA01
ggccuggcgguugaugccgacgu

SEQ ID NO: 3402588 - RNA, 16 nt, Pseudomonas aeruginosa PA01
ggccuggcgucccggg

SEQ ID NO: 3402589 - RNA, 14 nt, Pseudomonas aeruginosa PA01
ggccuggcucaugu

SEQ ID NO: 3402590 - RNA, 17 nt, Pseudomonas aeruginosa PA01
ggccuggcugccgagca

SEQ ID NO: 3402591 - RNA, 14 nt, Pseudomonas aeruginosa PA01
ggccuggcuggccu

SEQ ID NO: 3402592 - RNA, 14 nt, Pseudomonas aeruginosa PA01
ggccugggacggcg

SEQ ID NO: 3402593 - RNA, 21 nt, Pseudomonas aeruginosa PA01
ggccugggcaagcugcacggc

SEQ ID NO: 3402594 - RNA, 20 nt, Pseudomonas aeruginosa PA01
ggccugggccgaaggccagg

SEQ ID NO: 3402595 - RNA, 14 nt, Pseudomonas aeruginosa PA01
ggccugggccgggu

SEQ ID NO: 3402596 - RNA, 16 nt, Pseudomonas aeruginosa PA01
ggccugggcgaagucg

SEQ ID NO: 3402597 - RNA, 20 nt, Pseudomonas aeruginosa PA01
ggccugggcgaagucgacga

SEQ ID NO: 3402598 - RNA, 13 nt, Pseudomonas aeruginosa PA01
ggccugggcgcag

SEQ ID NO: 3402599 - RNA, 14 nt, Pseudomonas aeruginosa PA01
ggccugggcgcagg

SEQ ID NO: 3402600 - RNA, 17 nt, Pseudomonas aeruginosa PA01
ggccugggcgcaggccg

SEQ ID NO: 3402601 - RNA, 18 nt, Pseudomonas aeruginosa PA01
ggccugggcgcaggccga

SEQ ID NO: 3402602 - RNA, 19 nt, Pseudomonas aeruginosa PA01
ggccugggcguacaggccc

SEQ ID NO: 3402603 - RNA, 20 nt, Pseudomonas aeruginosa PA01
ggccuggggcucggcuucca

SEQ ID NO: 3402604 - RNA, 20 nt, Pseudomonas aeruginosa PA01
ggcgaacagcgccgcggcug

SEQ ID NO: 3402605 - RNA, 15 nt, Pseudomonas aeruginosa PA01
ggcgaacaggcagcg

SEQ ID NO: 3402606 - RNA, 22 nt, Pseudomonas aeruginosa PA01
ggcgaacaggcagcgggccagg

SEQ ID NO: 3402607 - RNA, 22 nt, Pseudomonas aeruginosa PA01
ggcgaacagggccaucagggcg

SEQ ID NO: 3402608 - RNA, 14 nt, Pseudomonas aeruginosa PA01
ggcgaacagggugg

SEQ ID NO: 3402609 - RNA, 19 nt, Pseudomonas aeruginosa PA01
ggcgaacagguagccccgg

SEQ ID NO: 3402610 - RNA, 20 nt, Pseudomonas aeruginosa PA01
ggcgaacaucauccacagcg

SEQ ID NO: 3402611 - RNA, 21 nt, Pseudomonas aeruginosa PA01
ggcgaacaucauccacagcgu

SEQ ID NO: 3402612 - RNA, 17 nt, Pseudomonas aeruginosa PA01
ggcgaaccacaccaggu

SEQ ID NO: 3402613 - RNA, 14 nt, Pseudomonas aeruginosa PA01
ggcgaaccacucgg

SEQ ID NO: 3402614 - RNA, 17 nt, Pseudomonas aeruginosa PA01
ggcgaaccacucggcgc

SEQ ID NO: 3402615 - RNA, 16 nt, Pseudomonas aeruginosa PA01
ggcgaaccaggcggcc

SEQ ID NO: 3402616 - RNA, 19 nt, Pseudomonas aeruginosa PA01
ggcgaaccaguccagcacg

SEQ ID NO: 3402617 - RNA, 20 nt, Pseudomonas aeruginosa PA01
ggcgaaccagugcaccgccg

SEQ ID NO: 3402618 - RNA, 18 nt, Pseudomonas aeruginosa PA01
ggcgaacccggcgcggcg

SEQ ID NO: 3402619 - RNA, 16 nt, Pseudomonas aeruginosa PA01
ggcgaacccucggugc

SEQ ID NO: 3402620 - RNA, 24 nt, Pseudomonas aeruginosa PA01
ggcgaacccucggugcggccgagg

SEQ ID NO: 3402621 - RNA, 18 nt, Pseudomonas aeruginosa PA01
ggcgaacgaugguggucg

SEQ ID NO: 3402622 - RNA, 20 nt, Pseudomonas aeruginosa PA01
ggcgaacgaugguggucggc

SEQ ID NO: 3402623 - RNA, 21 nt, Pseudomonas aeruginosa PA01
ggcgaacgaugguggucggca

SEQ ID NO: 3402624 - RNA, 20 nt, Pseudomonas aeruginosa PA01
ggcgaacgcccggcuuuccu

SEQ ID NO: 3402625 - RNA, 19 nt, Pseudomonas aeruginosa PA01
ggcgaacgcuugagccccg

SEQ ID NO: 3402626 - RNA, 20 nt, Pseudomonas aeruginosa PA01
ggcgaacgcuugagccccgg

SEQ ID NO: 3402627 - RNA, 15 nt, Pseudomonas aeruginosa PA01
ggcgaacggcagcgu

SEQ ID NO: 3402628 - RNA, 16 nt, Pseudomonas aeruginosa PA01
ggcgaacggcagcguc

SEQ ID NO: 3402629 - RNA, 17 nt, Pseudomonas aeruginosa PA01
ggcgaacggcagcgucu

SEQ ID NO: 3402630 - RNA, 22 nt, Pseudomonas aeruginosa PA01
ggcgaacggcuggucggcuucc

SEQ ID NO: 3402631 - RNA, 17 nt, Pseudomonas aeruginosa PA01
ggcgaacuccgccagcu

SEQ ID NO: 3402632 - RNA, 19 nt, Pseudomonas aeruginosa PA01
ggcgaacuccgccagcuug

SEQ ID NO: 3402633 - RNA, 20 nt, Pseudomonas aeruginosa PA01
ggcgaacucguagacgaaua

SEQ ID NO: 3402634 - RNA, 15 nt, Pseudomonas aeruginosa PA01
ggcgaacugccgacg

SEQ ID NO: 3402635 - RNA, 16 nt, Pseudomonas aeruginosa PA01
ggcgaacugccgacgg

SEQ ID NO: 3402636 - RNA, 23 nt, Pseudomonas aeruginosa PA01
ggcgaacugccgacggcggcggc

SEQ ID NO: 3402637 - RNA, 23 nt, Pseudomonas aeruginosa PA01
ggcgaacuggccaccgucggaug

SEQ ID NO: 3402638 - RNA, 15 nt, Pseudomonas aeruginosa PA01
ggcgaacuucaggcc

SEQ ID NO: 3402639 - RNA, 17 nt, Pseudomonas aeruginosa PA01
ggcgaacuucaggccgg

SEQ ID NO: 3402640 - RNA, 18 nt, Pseudomonas aeruginosa PA01
ggcgaacuucaggccggc

SEQ ID NO: 3402641 - RNA, 23 nt, Pseudomonas aeruginosa PA01
ggcgaacuucaggccggcgccga

SEQ ID NO: 3402642 - RNA, 16 nt, Pseudomonas aeruginosa PA01
ggcgaagaacagcggg

SEQ ID NO: 3402643 - RNA, 23 nt, Pseudomonas aeruginosa PA01
ggcgaagaacagcgggucgcggc

SEQ ID NO: 3402644 - RNA, 23 nt, Pseudomonas aeruginosa PA01
ggcgaagacgaaguuggcggccg

SEQ ID NO: 3402645 - RNA, 15 nt, Pseudomonas aeruginosa PA01
ggcgaagccagcacg

SEQ ID NO: 3402646 - RNA, 13 nt, Pseudomonas aeruginosa PA01
ggcgaagcccagc

SEQ ID NO: 3402647 - RNA, 19 nt, Pseudomonas aeruginosa PA01
ggcgaagcccagcgagccg

SEQ ID NO: 3402648 - RNA, 16 nt, Pseudomonas aeruginosa PA01
ggcgaagccgcgcccg

SEQ ID NO: 3402649 - RNA, 17 nt, Pseudomonas aeruginosa PA01
ggcgaagccgcgcccgg

SEQ ID NO: 3402650 - RNA, 22 nt, Pseudomonas aeruginosa PA01
ggcgaagccgcgcccggccucc

SEQ ID NO: 3402651 - RNA, 13 nt, Pseudomonas aeruginosa PA01
ggcgaagccggcg

SEQ ID NO: 3402652 - RNA, 15 nt, Pseudomonas aeruginosa PA01
ggcgaagccggcggc

SEQ ID NO: 3402653 - RNA, 16 nt, Pseudomonas aeruginosa PA01
ggcgaagccggcggcg

SEQ ID NO: 3402654 - RNA, 15 nt, Pseudomonas aeruginosa PA01
ggcgaagcgauucca

SEQ ID NO: 3402655 - RNA, 13 nt, Pseudomonas aeruginosa PA01
ggcgaagcgcagc

SEQ ID NO: 3402656 - RNA, 18 nt, Pseudomonas aeruginosa PA01
ggcgaagcgcagcuccgg

SEQ ID NO: 3402657 - RNA, 22 nt, Pseudomonas aeruginosa PA01
ggcgaagcgcagcuccggcagc

SEQ ID NO: 3402658 - RNA, 19 nt, Pseudomonas aeruginosa PA01
ggcgaagcgcuugcccagg

SEQ ID NO: 3402659 - RNA, 17 nt, Pseudomonas aeruginosa PA01
ggcgaagcggaagcgca

SEQ ID NO: 3402660 - RNA, 20 nt, Pseudomonas aeruginosa PA01
ggcgaagcggaagcgcagcc

SEQ ID NO: 3402661 - RNA, 19 nt, Pseudomonas aeruginosa PA01
ggcgaagcggcccuugucg

SEQ ID NO: 3402662 - RNA, 22 nt, Pseudomonas aeruginosa PA01
ggcgaagcggcccuugucgccg

SEQ ID NO: 3402663 - RNA, 15 nt, Pseudomonas aeruginosa PA01
ggcgaagcggcucgg

SEQ ID NO: 3402664 - RNA, 20 nt, Pseudomonas aeruginosa PA01
ggcgaagcggcucggccagg

SEQ ID NO: 3402665 - RNA, 22 nt, Pseudomonas aeruginosa PA01
ggcgaagcggcucggccagggc

SEQ ID NO: 3402666 - RNA, 13 nt, Pseudomonas aeruginosa PA01
ggcgaagcggcug

SEQ ID NO: 3402667 - RNA, 16 nt, Pseudomonas aeruginosa PA01
ggcgaagcggcuggcc

SEQ ID NO: 3402668 - RNA, 17 nt, Pseudomonas aeruginosa PA01
ggcgaagcggcuggccg

SEQ ID NO: 3402669 - RNA, 19 nt, Pseudomonas aeruginosa PA01
ggcgaagcggcuggccgcg

SEQ ID NO: 3402670 - RNA, 22 nt, Pseudomonas aeruginosa PA01
ggcgaagcggcuggccgcggug

SEQ ID NO: 3402671 - RNA, 20 nt, Pseudomonas aeruginosa PA01
ggcgaagcguugcagcgucu

SEQ ID NO: 3402672 - RNA, 20 nt, Pseudomonas aeruginosa PA01
ggcgaagcuggggcuguugc

SEQ ID NO: 3402673 - RNA, 19 nt, Pseudomonas aeruginosa PA01
ggcgaaggcaaugccgccc

SEQ ID NO: 3402674 - RNA, 22 nt, Pseudomonas aeruginosa PA01
ggcgaaggccgcuuggccaugg

SEQ ID NO: 3402675 - RNA, 18 nt, Pseudomonas aeruginosa PA01
ggcgaaggccucgucgau

SEQ ID NO: 3402676 - RNA, 13 nt, Pseudomonas aeruginosa PA01
ggcgaaggcgaug

SEQ ID NO: 3402677 - RNA, 16 nt, Pseudomonas aeruginosa PA01
ggcgaagggcaggccg

SEQ ID NO: 3402678 - RNA, 17 nt, Pseudomonas aeruginosa PA01
ggcgaagggcaggccga

SEQ ID NO: 3402679 - RNA, 18 nt, Pseudomonas aeruginosa PA01
ggcgaagggcaggccgau

SEQ ID NO: 3402680 - RNA, 22 nt, Pseudomonas aeruginosa PA01
ggcgaaggucgaaggcgcggcg

SEQ ID NO: 3402681 - RNA, 17 nt, Pseudomonas aeruginosa PA01
ggcgaaggucugccccg

SEQ ID NO: 3402682 - RNA, 17 nt, Pseudomonas aeruginosa PA01
ggcgaaguagaagcgcg

SEQ ID NO: 3402683 - RNA, 18 nt, Pseudomonas aeruginosa PA01
ggcgaaguagaagcgcgc

SEQ ID NO: 3402684 - RNA, 17 nt, Pseudomonas aeruginosa PA01
ggcgaaguaggaguagg

SEQ ID NO: 3402685 - RNA, 16 nt, Pseudomonas aeruginosa PA01
ggcgaaguccaccagg

SEQ ID NO: 3402686 - RNA, 21 nt, Pseudomonas aeruginosa PA01
ggcgaaguccaccaggcgccg

SEQ ID NO: 3402687 - RNA, 15 nt, Pseudomonas aeruginosa PA01
ggcgaagucgccguc

SEQ ID NO: 3402688 - RNA, 18 nt, Pseudomonas aeruginosa PA01
ggcgaagucgccgucguc

SEQ ID NO: 3402689 - RNA, 17 nt, Pseudomonas aeruginosa PA01
ggcgaagucggcgcgcc

SEQ ID NO: 3402690 - RNA, 19 nt, Pseudomonas aeruginosa PA01
ggcgaagucggcgcgccag

SEQ ID NO: 3402691 - RNA, 20 nt, Pseudomonas aeruginosa PA01
ggcgaaguucccgccgcucu

SEQ ID NO: 3402692 - RNA, 16 nt, Pseudomonas aeruginosa PA01
ggcgaaguugccgccg

SEQ ID NO: 3402693 - RNA, 17 nt, Pseudomonas aeruginosa PA01
ggcgaaguugccgccgc

SEQ ID NO: 3402694 - RNA, 20 nt, Pseudomonas aeruginosa PA01
ggcgaaguugccgccgcugg

SEQ ID NO: 3402695 - RNA, 21 nt, Pseudomonas aeruginosa PA01
ggcgaauaaccauugcgcggg

SEQ ID NO: 3402696 - RNA, 17 nt, Pseudomonas aeruginosa PA01
ggcgaauaaccgcaucg

SEQ ID NO: 3402697 - RNA, 20 nt, Pseudomonas aeruginosa PA01
ggcgaauaaccgcaucgcgg

SEQ ID NO: 3402698 - RNA, 17 nt, Pseudomonas aeruginosa PA01
ggcgaauaacgccacag

SEQ ID NO: 3402699 - RNA, 20 nt, Pseudomonas aeruginosa PA01
ggcgaauaacgccacaggcg

SEQ ID NO: 3402700 - RNA, 18 nt, Pseudomonas aeruginosa PA01
ggcgaauaacgccaccgg

SEQ ID NO: 3402701 - RNA, 20 nt, Pseudomonas aeruginosa PA01
ggcgaauaacgccaccggcg

SEQ ID NO: 3402702 - RNA, 17 nt, Pseudomonas aeruginosa PA01
ggcgaauaacgccgcag

SEQ ID NO: 3402703 - RNA, 20 nt, Pseudomonas aeruginosa PA01
ggcgaauaacgccgcaggcg

SEQ ID NO: 3402704 - RNA, 17 nt, Pseudomonas aeruginosa PA01
ggcgaauaccagugccg

SEQ ID NO: 3402705 - RNA, 17 nt, Pseudomonas aeruginosa PA01
ggcgacgauguucucca

SEQ ID NO: 3402706 - RNA, 14 nt, Pseudomonas aeruginosa PA01
ggcgacgcagcacg

SEQ ID NO: 3402707 - RNA, 15 nt, Pseudomonas aeruginosa PA01
ggcgacgcagcacgg

SEQ ID NO: 3402708 - RNA, 17 nt, Pseudomonas aeruginosa PA01
ggcgacgcagcacggcg

SEQ ID NO: 3402709 - RNA, 14 nt, Pseudomonas aeruginosa PA01
ggcgacgcauggau

SEQ ID NO: 3402710 - RNA, 12 nt, Pseudomonas aeruginosa PA01
ggcgacgcccga

SEQ ID NO: 3402711 - RNA, 16 nt, Pseudomonas aeruginosa PA01
ggcgacgcccgaggcg

SEQ ID NO: 3402712 - RNA, 14 nt, Pseudomonas aeruginosa PA01
ggcgacgccgaugc

SEQ ID NO: 3402713 - RNA, 18 nt, Pseudomonas aeruginosa PA01
ggcgacgccgaugcucgg

SEQ ID NO: 3402714 - RNA, 11 nt, Pseudomonas aeruginosa PA01
ggcgacgccgg

SEQ ID NO: 3402715 - RNA, 14 nt, Pseudomonas aeruginosa PA01
ggcgacgccggucg

SEQ ID NO: 3402716 - RNA, 19 nt, Pseudomonas aeruginosa PA01
ggcgacgccggucgggcac

SEQ ID NO: 3402717 - RNA, 14 nt, Pseudomonas aeruginosa PA01
ggcgacgccguccc

SEQ ID NO: 3402718 - RNA, 15 nt, Pseudomonas aeruginosa PA01
ggcgacgccguccca

SEQ ID NO: 3402719 - RNA, 13 nt, Pseudomonas aeruginosa PA01
ggcgacgcgcagg

SEQ ID NO: 3402720 - RNA, 15 nt, Pseudomonas aeruginosa PA01
ggcgacgcgcaggcc

SEQ ID NO: 3402721 - RNA, 17 nt, Pseudomonas aeruginosa PA01
ggcgacgcgcaggccgg

SEQ ID NO: 3402722 - RNA, 19 nt, Pseudomonas aeruginosa PA01
ggcgacgcgcaggccggug

SEQ ID NO: 3402723 - RNA, 20 nt, Pseudomonas aeruginosa PA01
ggcgacgcucuucagcgguc

SEQ ID NO: 3402724 - RNA, 22 nt, Pseudomonas aeruginosa PA01
ggcgacgcugaugaugccgcgg

SEQ ID NO: 3402725 - RNA, 22 nt, Pseudomonas aeruginosa PA01
ggcgacgcugaugccggcgaac

SEQ ID NO: 3402726 - RNA, 11 nt, Pseudomonas aeruginosa PA01
ggcgacgcugg

SEQ ID NO: 3402727 - RNA, 23 nt, Pseudomonas aeruginosa PA01
ggcgacggaaacgacaggcugga

SEQ ID NO: 3402728 - RNA, 17 nt, Pseudomonas aeruginosa PA01
ggcgacggcggugcgca

SEQ ID NO: 3402729 - RNA, 20 nt, Pseudomonas aeruginosa PA01
ggcgacgggaagcgaaccag

SEQ ID NO: 3402730 - RNA, 17 nt, Pseudomonas aeruginosa PA01
ggcgacgguaccaggga

SEQ ID NO: 3402731 - RNA, 21 nt, Pseudomonas aeruginosa PA01
ggcgacgguaccagggaagcg

SEQ ID NO: 3402732 - RNA, 20 nt, Pseudomonas aeruginosa PA01
ggcgacggucagcaggcccg

SEQ ID NO: 3402733 - RNA, 22 nt, Pseudomonas aeruginosa PA01
ggcgacggucaggccgagcagc

SEQ ID NO: 3402734 - RNA, 16 nt, Pseudomonas aeruginosa PA01
ggcgacggugccgguc

SEQ ID NO: 3402735 - RNA, 19 nt, Pseudomonas aeruginosa PA01
ggcgacgucccuuccccga

SEQ ID NO: 3402736 - RNA, 18 nt, Pseudomonas aeruginosa PA01
ggcgacgucgccccagcc

SEQ ID NO: 3402737 - RNA, 17 nt, Pseudomonas aeruginosa PA01
ggcgacgugggccugcu

SEQ ID NO: 3402738 - RNA, 18 nt, Pseudomonas aeruginosa PA01
ggcgacguucugcucgcu

SEQ ID NO: 3402739 - RNA, 19 nt, Pseudomonas aeruginosa PA01
ggcgacguucugcucgcug

SEQ ID NO: 3402740 - RNA, 20 nt, Pseudomonas aeruginosa PA01
ggcgacguucugcucgcugc

SEQ ID NO: 3402741 - RNA, 22 nt, Pseudomonas aeruginosa PA01
ggcgacuucgcauuccaccuug

SEQ ID NO: 3402742 - RNA, 19 nt, Pseudomonas aeruginosa PA01
ggcgagaacucguccgguc

SEQ ID NO: 3402743 - RNA, 14 nt, Pseudomonas aeruginosa PA01
ggcgagaaucgccg

SEQ ID NO: 3402744 - RNA, 15 nt, Pseudomonas aeruginosa PA01
ggcgagaaucgccga

SEQ ID NO: 3402745 - RNA, 20 nt, Pseudomonas aeruginosa PA01
ggcgagaccggggaucagcu

SEQ ID NO: 3402746 - RNA, 21 nt, Pseudomonas aeruginosa PA01
ggcgagacuaccgaucggcug

SEQ ID NO: 3402747 - RNA, 12 nt, Pseudomonas aeruginosa PA01
ggcgagagcgcc

SEQ ID NO: 3402748 - RNA, 13 nt, Pseudomonas aeruginosa PA01
ggcgagagcgccg

SEQ ID NO: 3402749 - RNA, 14 nt, Pseudomonas aeruginosa PA01
ggcgagagcgccga

SEQ ID NO: 3402750 - RNA, 15 nt, Pseudomonas aeruginosa PA01
ggcgagagcgccgac

SEQ ID NO: 3402751 - RNA, 14 nt, Pseudomonas aeruginosa PA01
ggcgagagcguccg

SEQ ID NO: 3402752 - RNA, 17 nt, Pseudomonas aeruginosa PA01
ggcgagagcguccggca

SEQ ID NO: 3402753 - RNA, 17 nt, Pseudomonas aeruginosa PA01
ggcgagaggucggcgcg

SEQ ID NO: 3402754 - RNA, 18 nt, Pseudomonas aeruginosa PA01
ggcgagaggucggcgcgc

SEQ ID NO: 3402755 - RNA, 15 nt, Pseudomonas aeruginosa PA01
ggcgagcagcggcgc

SEQ ID NO: 3402756 - RNA, 16 nt, Pseudomonas aeruginosa PA01
ggcgagcagcggcgcu

SEQ ID NO: 3402757 - RNA, 23 nt, Pseudomonas aeruginosa PA01
ggcgagcaggcgaacagggccau

SEQ ID NO: 3402758 - RNA, 18 nt, Pseudomonas aeruginosa PA01
ggcgagcagggcgcugag

SEQ ID NO: 3402759 - RNA, 23 nt, Pseudomonas aeruginosa PA01
ggcgagcagggcgcugagcgcgg

SEQ ID NO: 3402760 - RNA, 13 nt, Pseudomonas aeruginosa PA01
ggcgagcaggguc

SEQ ID NO: 3402761 - RNA, 19 nt, Pseudomonas aeruginosa PA01
ggcgagcaucucggccagg

SEQ ID NO: 3402762 - RNA, 22 nt, Pseudomonas aeruginosa PA01
ggcgagcaucucggccaggccc

SEQ ID NO: 3402763 - RNA, 23 nt, Pseudomonas aeruginosa PA01
ggcgagccagguuuccggcagca

SEQ ID NO: 3402764 - RNA, 13 nt, Pseudomonas aeruginosa PA01
ggcgagccgcagc

SEQ ID NO: 3402765 - RNA, 14 nt, Pseudomonas aeruginosa PA01
ggcgagccgcagcg

SEQ ID NO: 3402766 - RNA, 17 nt, Pseudomonas aeruginosa PA01
ggcgagccgcagcggcu

SEQ ID NO: 3402767 - RNA, 19 nt, Pseudomonas aeruginosa PA01
ggcgagccgcagcggcucg

SEQ ID NO: 3402768 - RNA, 15 nt, Pseudomonas aeruginosa PA01
ggcgagccgccgggc

SEQ ID NO: 3402769 - RNA, 13 nt, Pseudomonas aeruginosa PA01
ggcgagccgcugg

SEQ ID NO: 3402770 - RNA, 21 nt, Pseudomonas aeruginosa PA01
ggcgagccggcgcaucagcgc

SEQ ID NO: 3402771 - RNA, 21 nt, Pseudomonas aeruginosa PA01
ggcgagcgacggugauagagc

SEQ ID NO: 3402772 - RNA, 12 nt, Pseudomonas aeruginosa PA01
ggcgagcgagcg

SEQ ID NO: 3402773 - RNA, 13 nt, Pseudomonas aeruginosa PA01
ggcgagcgcagac

SEQ ID NO: 3402774 - RNA, 21 nt, Pseudomonas aeruginosa PA01
ggcgagcgcagacgggugcug

SEQ ID NO: 3402775 - RNA, 12 nt, Pseudomonas aeruginosa PA01
ggcgagcgccgc

SEQ ID NO: 3402776 - RNA, 13 nt, Pseudomonas aeruginosa PA01
ggcgagcgccgcg

SEQ ID NO: 3402777 - RNA, 15 nt, Pseudomonas aeruginosa PA01
ggcgagcgccgcggc

SEQ ID NO: 3402778 - RNA, 16 nt, Pseudomonas aeruginosa PA01
ggcgagcgccgcggcg

SEQ ID NO: 3402779 - RNA, 20 nt, Pseudomonas aeruginosa PA01
ggcgagcgccgcggcgaaca

SEQ ID NO: 3402780 - RNA, 13 nt, Pseudomonas aeruginosa PA01
ggcgagcgccugg

SEQ ID NO: 3402781 - RNA, 12 nt, Pseudomonas aeruginosa PA01
ggcgagcgcgau

SEQ ID NO: 3402782 - RNA, 13 nt, Pseudomonas aeruginosa PA01
ggcgagcgcgauc

SEQ ID NO: 3402783 - RNA, 19 nt, Pseudomonas aeruginosa PA01
ggcgagcgggucgauggcu

SEQ ID NO: 3402784 - RNA, 22 nt, Pseudomonas aeruginosa PA01
ggcgagcguucggaucggcccg

SEQ ID NO: 3402785 - RNA, 20 nt, Pseudomonas aeruginosa PA01
ggcgagcuggaucggcaggc

SEQ ID NO: 3402786 - RNA, 20 nt, Pseudomonas aeruginosa PA01
ggcgaggaaaaggaucgccg

SEQ ID NO: 3402787 - RNA, 22 nt, Pseudomonas aeruginosa PA01
ggcgaggaaaaggaucgccgcg

SEQ ID NO: 3402788 - RNA, 15 nt, Pseudomonas aeruginosa PA01
ggcgaggaacaccca

SEQ ID NO: 3402789 - RNA, 17 nt, Pseudomonas aeruginosa PA01
ggcgaggaacagcacca

SEQ ID NO: 3402790 - RNA, 20 nt, Pseudomonas aeruginosa PA01
ggcgaggaacagcaccagca

SEQ ID NO: 3402791 - RNA, 15 nt, Pseudomonas aeruginosa PA01
ggcgaggaacagcga

SEQ ID NO: 3402792 - RNA, 16 nt, Pseudomonas aeruginosa PA01
ggcgaggacgccgggc

SEQ ID NO: 3402793 - RNA, 23 nt, Pseudomonas aeruginosa PA01
ggcgaggagguuggucugcucgg

SEQ ID NO: 3402794 - RNA, 18 nt, Pseudomonas aeruginosa PA01
ggcgaggaucacgcagca

SEQ ID NO: 3402795 - RNA, 19 nt, Pseudomonas aeruginosa PA01
ggcgaggaucacgcagcag

SEQ ID NO: 3402796 - RNA, 20 nt, Pseudomonas aeruginosa PA01
ggcgaggaucacgcagcagg

SEQ ID NO: 3402797 - RNA, 21 nt, Pseudomonas aeruginosa PA01
ggcgaggaucacgcagcaggc

SEQ ID NO: 3402798 - RNA, 17 nt, Pseudomonas aeruginosa PA01
ggcgaggaucgccagca

SEQ ID NO: 3402799 - RNA, 16 nt, Pseudomonas aeruginosa PA01
ggcgaggaucgcgcug

SEQ ID NO: 3402800 - RNA, 19 nt, Pseudomonas aeruginosa PA01
ggcgaggaugaucagggca

SEQ ID NO: 3402801 - RNA, 20 nt, Pseudomonas aeruginosa PA01
ggcgaggaugaucagggcac

SEQ ID NO: 3402802 - RNA, 22 nt, Pseudomonas aeruginosa PA01
ggcgaggauuuccggcuugccg

SEQ ID NO: 3402803 - RNA, 16 nt, Pseudomonas aeruginosa PA01
ggcgaggauuuccucg

SEQ ID NO: 3402804 - RNA, 18 nt, Pseudomonas aeruginosa PA01
ggcgaggauuuccucgcg

SEQ ID NO: 3402805 - RNA, 13 nt, Pseudomonas aeruginosa PA01
ggcgaggccgacc

SEQ ID NO: 3402806 - RNA, 14 nt, Pseudomonas aeruginosa PA01
ggcgaggccgcucu

SEQ ID NO: 3402807 - RNA, 13 nt, Pseudomonas aeruginosa PA01
ggcgaggcgcgcc

SEQ ID NO: 3402808 - RNA, 17 nt, Pseudomonas aeruginosa PA01
ggcgaucuucuccgccg

SEQ ID NO: 3402809 - RNA, 22 nt, Pseudomonas aeruginosa PA01
ggcgaucuugaucgccagcggu

SEQ ID NO: 3402810 - RNA, 14 nt, Pseudomonas aeruginosa PA01
ggcgaugaacaccg

SEQ ID NO: 3402811 - RNA, 12 nt, Pseudomonas aeruginosa PA01
ggcgaugaccag

SEQ ID NO: 3402812 - RNA, 17 nt, Pseudomonas aeruginosa PA01
ggcgaugaccagcucgg

SEQ ID NO: 3402813 - RNA, 22 nt, Pseudomonas aeruginosa PA01
ggcgaugaccagcucggcggga

SEQ ID NO: 3402814 - RNA, 22 nt, Pseudomonas aeruginosa PA01
ggcgaugaccaggguggcggcg

SEQ ID NO: 3402815 - RNA, 19 nt, Pseudomonas aeruginosa PA01
ggcgaugaccgccccggca

SEQ ID NO: 3402816 - RNA, 22 nt, Pseudomonas aeruginosa PA01
ggcgaugaccgccccggcagcc

SEQ ID NO: 3402817 - RNA, 14 nt, Pseudomonas aeruginosa PA01
ggcgaugaucagcc

SEQ ID NO: 3402818 - RNA, 15 nt, Pseudomonas aeruginosa PA01
ggcgaugaucagccc

SEQ ID NO: 3402819 - RNA, 16 nt, Pseudomonas aeruginosa PA01
ggcgaugaucagcccu

SEQ ID NO: 3402820 - RNA, 23 nt, Pseudomonas aeruginosa PA01
ggcgaugaucggcagccguccgc

SEQ ID NO: 3402821 - RNA, 15 nt, Pseudomonas aeruginosa PA01
ggcgaugaucuggcc

SEQ ID NO: 3402822 - RNA, 16 nt, Pseudomonas aeruginosa PA01
ggcgaugaucuggcca

SEQ ID NO: 3402823 - RNA, 17 nt, Pseudomonas aeruginosa PA01
ggcgaugaucuggccac

SEQ ID NO: 3402824 - RNA, 17 nt, Pseudomonas aeruginosa PA01
ggcgaugcccaggccgc

SEQ ID NO: 3402825 - RNA, 18 nt, Pseudomonas aeruginosa PA01
ggcgaugcccaggccgcc

SEQ ID NO: 3402826 - RNA, 14 nt, Pseudomonas aeruginosa PA01
ggcgaugcccuggc

SEQ ID NO: 3402827 - RNA, 20 nt, Pseudomonas aeruginosa PA01
ggcgaugcccuggccgcugc

SEQ ID NO: 3402828 - RNA, 23 nt, Pseudomonas aeruginosa PA01
ggcgaugcccuggccgcugccgc

SEQ ID NO: 3402829 - RNA, 17 nt, Pseudomonas aeruginosa PA01
ggcgaugcccuuggcca

SEQ ID NO: 3402830 - RNA, 22 nt, Pseudomonas aeruginosa PA01
ggcgaugcccuuggccagcgcg

SEQ ID NO: 3402831 - RNA, 13 nt, Pseudomonas aeruginosa PA01
ggcgaugccgagg

SEQ ID NO: 3402832 - RNA, 16 nt, Pseudomonas aeruginosa PA01
ggcgaugccgaggagg

SEQ ID NO: 3402833 - RNA, 12 nt, Pseudomonas aeruginosa PA01
ggcgaugccgau

SEQ ID NO: 3402834 - RNA, 16 nt, Pseudomonas aeruginosa PA01
ggcgaugccgauggcg

SEQ ID NO: 3402835 - RNA, 19 nt, Pseudomonas aeruginosa PA01
ggcgaugccgauggcgccg

SEQ ID NO: 3402836 - RNA, 14 nt, Pseudomonas aeruginosa PA01
ggcgaugccgccca

SEQ ID NO: 3402837 - RNA, 15 nt, Pseudomonas aeruginosa PA01
ggcgaugccgcccag

SEQ ID NO: 3402838 - RNA, 18 nt, Pseudomonas aeruginosa PA01
ggcgaugccgcccagcac

SEQ ID NO: 3402839 - RNA, 19 nt, Pseudomonas aeruginosa PA01
ggcgaugccgcccagcacc

SEQ ID NO: 3402840 - RNA, 13 nt, Pseudomonas aeruginosa PA01
ggcgaugccgccg

SEQ ID NO: 3402841 - RNA, 18 nt, Pseudomonas aeruginosa PA01
ggcgaugccgcgccaggc

SEQ ID NO: 3402842 - RNA, 17 nt, Pseudomonas aeruginosa PA01
ggcgaugcgcaggccgg

SEQ ID NO: 3402843 - RNA, 22 nt, Pseudomonas aeruginosa PA01
ggcgaugcgccggaucggcuga

SEQ ID NO: 3402844 - RNA, 14 nt, Pseudomonas aeruginosa PA01
ggcgaugcgccggu

SEQ ID NO: 3402845 - RNA, 17 nt, Pseudomonas aeruginosa PA01
ggcgaugcgcgugguau

SEQ ID NO: 3402846 - RNA, 19 nt, Pseudomonas aeruginosa PA01
ggcgaugcgcgugguaucg

SEQ ID NO: 3402847 - RNA, 12 nt, Pseudomonas aeruginosa PA01
ggcgaugcgguc

SEQ ID NO: 3402848 - RNA, 21 nt, Pseudomonas aeruginosa PA01
ggcgaugcguuugucgaccug

SEQ ID NO: 3402849 - RNA, 22 nt, Pseudomonas aeruginosa PA01
ggcgaugcguuugucgaccugc

SEQ ID NO: 3402850 - RNA, 13 nt, Pseudomonas aeruginosa PA01
ggcgaugcucagc

SEQ ID NO: 3402851 - RNA, 16 nt, Pseudomonas aeruginosa PA01
ggcgaugcucagcgcc

SEQ ID NO: 3402852 - RNA, 17 nt, Pseudomonas aeruginosa PA01
ggcgaugcucagcgccg

SEQ ID NO: 3402853 - RNA, 18 nt, Pseudomonas aeruginosa PA01
ggcgaugcucagcgccgg

SEQ ID NO: 3402854 - RNA, 21 nt, Pseudomonas aeruginosa PA01
ggcgaugcucagcgccggcca

SEQ ID NO: 3402855 - RNA, 15 nt, Pseudomonas aeruginosa PA01
ggcgaugcugaccca

SEQ ID NO: 3402856 - RNA, 19 nt, Pseudomonas aeruginosa PA01
ggcgaugcugcugaucagg

SEQ ID NO: 3402857 - RNA, 22 nt, Pseudomonas aeruginosa PA01
ggcgaugcugcugaucaggagg

SEQ ID NO: 3402858 - RNA, 16 nt, Pseudomonas aeruginosa PA01
ggcgauggacucgauc

SEQ ID NO: 3402859 - RNA, 23 nt, Pseudomonas aeruginosa PA01
ggcgauggaugacccgcucgccg

SEQ ID NO: 3402860 - RNA, 15 nt, Pseudomonas aeruginosa PA01
ggcgauggccagcgc

SEQ ID NO: 3402861 - RNA, 13 nt, Pseudomonas aeruginosa PA01
ggcgauggccgcc

SEQ ID NO: 3402862 - RNA, 15 nt, Pseudomonas aeruginosa PA01
ggcgauggccgccag

SEQ ID NO: 3402863 - RNA, 16 nt, Pseudomonas aeruginosa PA01
ggcgauggccgccagc

SEQ ID NO: 3402864 - RNA, 17 nt, Pseudomonas aeruginosa PA01
ggcgauggccgccagca

SEQ ID NO: 3402865 - RNA, 20 nt, Pseudomonas aeruginosa PA01
ggcgauggccgccagcaggc

SEQ ID NO: 3402866 - RNA, 22 nt, Pseudomonas aeruginosa PA01
ggcgauggccgccagcaggccg

SEQ ID NO: 3402867 - RNA, 16 nt, Pseudomonas aeruginosa PA01
ggcgauggccgccugc

SEQ ID NO: 3402868 - RNA, 22 nt, Pseudomonas aeruginosa PA01
ggcgauggccgccugcagggcg

SEQ ID NO: 3402869 - RNA, 20 nt, Pseudomonas aeruginosa PA01
ggcgauggccuggucggcgc

SEQ ID NO: 3402870 - RNA, 21 nt, Pseudomonas aeruginosa PA01
ggcgauggccuggucggcgcg

SEQ ID NO: 3402871 - RNA, 16 nt, Pseudomonas aeruginosa PA01
ggcgauggcgcgcggg

SEQ ID NO: 3402872 - RNA, 13 nt, Pseudomonas aeruginosa PA01
ggcgauggcggug

SEQ ID NO: 3402873 - RNA, 23 nt, Pseudomonas aeruginosa PA01
ggcgauggcguagaggcucggcg

SEQ ID NO: 3402874 - RNA, 16 nt, Pseudomonas aeruginosa PA01
ggcgauggcguccacc

SEQ ID NO: 3402875 - RNA, 19 nt, Pseudomonas aeruginosa PA01
ggcgauggcguccaccgcu

SEQ ID NO: 3402876 - RNA, 20 nt, Pseudomonas aeruginosa PA01
ggcgaugggucgcguggggu

SEQ ID NO: 3402877 - RNA, 22 nt, Pseudomonas aeruginosa PA01
ggcgauggucaggacgcuacgc

SEQ ID NO: 3402878 - RNA, 17 nt, Pseudomonas aeruginosa PA01
ggcgauguagcugccgg

SEQ ID NO: 3402879 - RNA, 19 nt, Pseudomonas aeruginosa PA01
ggcgauguagcugccggcg

SEQ ID NO: 3402880 - RNA, 20 nt, Pseudomonas aeruginosa PA01
ggcgauguagcugccggcgu

SEQ ID NO: 3402881 - RNA, 22 nt, Pseudomonas aeruginosa PA01
ggcgauguagcugccggcgucg

SEQ ID NO: 3402882 - RNA, 21 nt, Pseudomonas aeruginosa PA01
ggcgauguaggucaccgcgcc

SEQ ID NO: 3402883 - RNA, 22 nt, Pseudomonas aeruginosa PA01
ggcgauguaggucaccgcgccg

SEQ ID NO: 3402884 - RNA, 16 nt, Pseudomonas aeruginosa PA01
ggcgaugucggccugc

SEQ ID NO: 3402885 - RNA, 20 nt, Pseudomonas aeruginosa PA01
ggcgauguucaccgcggccu

SEQ ID NO: 3402886 - RNA, 18 nt, Pseudomonas aeruginosa PA01
ggcgauguucgcccccuu

SEQ ID NO: 3402887 - RNA, 16 nt, Pseudomonas aeruginosa PA01
ggcgauguugcgcagg

SEQ ID NO: 3402888 - RNA, 18 nt, Pseudomonas aeruginosa PA01
ggcgauuccacgggccug

SEQ ID NO: 3402889 - RNA, 17 nt, Pseudomonas aeruginosa PA01
ggcgauucguucgagca

SEQ ID NO: 3402890 - RNA, 18 nt, Pseudomonas aeruginosa PA01
ggcgauucguucgagcag

SEQ ID NO: 3402891 - RNA, 20 nt, Pseudomonas aeruginosa PA01
ggcgauucuccugggcgguc

SEQ ID NO: 3402892 - RNA, 15 nt, Pseudomonas aeruginosa PA01
ggcgcaacaccuugc

SEQ ID NO: 3402893 - RNA, 23 nt, Pseudomonas aeruginosa PA01
ggcgcaacaccuugcgcaccgcc

SEQ ID NO: 3402894 - RNA, 22 nt, Pseudomonas aeruginosa PA01
ggcgcaacagaucuuccucgga

SEQ ID NO: 3402895 - RNA, 13 nt, Pseudomonas aeruginosa PA01
ggcgcaacaggcg

SEQ ID NO: 3402896 - RNA, 14 nt, Pseudomonas aeruginosa PA01
ggcgcaacaggcgc

SEQ ID NO: 3402897 - RNA, 17 nt, Pseudomonas aeruginosa PA01
ggcgcaaccagaccagc

SEQ ID NO: 3402898 - RNA, 14 nt, Pseudomonas aeruginosa PA01
ggcgcaacccugcc

SEQ ID NO: 3402899 - RNA, 16 nt, Pseudomonas aeruginosa PA01
ggcgcaaccugguuca

SEQ ID NO: 3402900 - RNA, 17 nt, Pseudomonas aeruginosa PA01
ggcgcaacgccggcagg

SEQ ID NO: 3402901 - RNA, 15 nt, Pseudomonas aeruginosa PA01
ggcgcaacugcacgu

SEQ ID NO: 3402902 - RNA, 14 nt, Pseudomonas aeruginosa PA01
ggcgcaacugcgcc

SEQ ID NO: 3402903 - RNA, 17 nt, Pseudomonas aeruginosa PA01
ggcgcaacugcgccagc

SEQ ID NO: 3402904 - RNA, 18 nt, Pseudomonas aeruginosa PA01
ggcgcaacugcgccagcc

SEQ ID NO: 3402905 - RNA, 20 nt, Pseudomonas aeruginosa PA01
ggcgcaaggccagcggcauc

SEQ ID NO: 3402906 - RNA, 17 nt, Pseudomonas aeruginosa PA01
ggcgcaagggcgccgcc

SEQ ID NO: 3402907 - RNA, 18 nt, Pseudomonas aeruginosa PA01
ggcgcaagggcgccgccg

SEQ ID NO: 3402908 - RNA, 18 nt, Pseudomonas aeruginosa PA01
ggcgcaaggugccgaggu

SEQ ID NO: 3402909 - RNA, 23 nt, Pseudomonas aeruginosa PA01
ggcgcaaggugccgaggucgucg

SEQ ID NO: 3402910 - RNA, 15 nt, Pseudomonas aeruginosa PA01
ggcgcauagcggcca

SEQ ID NO: 3402911 - RNA, 16 nt, Pseudomonas aeruginosa PA01
ggcgcauagcggccau

SEQ ID NO: 3402912 - RNA, 23 nt, Pseudomonas aeruginosa PA01
ggcgcauauccaccaugaaacag

SEQ ID NO: 3402913 - RNA, 12 nt, Pseudomonas aeruginosa PA01
ggcgcaucagcg

SEQ ID NO: 3402914 - RNA, 15 nt, Pseudomonas aeruginosa PA01
ggcgcaucagcgccg

SEQ ID NO: 3402915 - RNA, 12 nt, Pseudomonas aeruginosa PA01
ggcgcaucaggc

SEQ ID NO: 3402916 - RNA, 15 nt, Pseudomonas aeruginosa PA01
ggcgcaucaggccaa

SEQ ID NO: 3402917 - RNA, 16 nt, Pseudomonas aeruginosa PA01
ggcgcaucaggccaaa

SEQ ID NO: 3402918 - RNA, 20 nt, Pseudomonas aeruginosa PA01
ggcgcauccgcccgaucgcc

SEQ ID NO: 3402919 - RNA, 13 nt, Pseudomonas aeruginosa PA01
ggcgcaucgucga

SEQ ID NO: 3402920 - RNA, 21 nt, Pseudomonas aeruginosa PA01
ggcgcaucgucgaaacgcugg

SEQ ID NO: 3402921 - RNA, 14 nt, Pseudomonas aeruginosa PA01
ggcgcaugcccagg

SEQ ID NO: 3402922 - RNA, 15 nt, Pseudomonas aeruginosa PA01
ggcgcaugcccaggg

SEQ ID NO: 3402923 - RNA, 16 nt, Pseudomonas aeruginosa PA01
ggcgcaugcccagggc

SEQ ID NO: 3402924 - RNA, 19 nt, Pseudomonas aeruginosa PA01
ggcgcaugcccagggccag

SEQ ID NO: 3402925 - RNA, 15 nt, Pseudomonas aeruginosa PA01
ggcgcaugccgcagg

SEQ ID NO: 3402926 - RNA, 23 nt, Pseudomonas aeruginosa PA01
ggcgcauggacaggucgacggcc

SEQ ID NO: 3402927 - RNA, 11 nt, Pseudomonas aeruginosa PA01
ggcgccaacca

SEQ ID NO: 3402928 - RNA, 18 nt, Pseudomonas aeruginosa PA01
ggcgccaacugcuugccg

SEQ ID NO: 3402929 - RNA, 21 nt, Pseudomonas aeruginosa PA01
ggcgccaacugcuugccgagc

SEQ ID NO: 3402930 - RNA, 15 nt, Pseudomonas aeruginosa PA01
ggcgccaccccgccg

SEQ ID NO: 3402931 - RNA, 19 nt, Pseudomonas aeruginosa PA01
ggcgccaccgauagcggcg

SEQ ID NO: 3402932 - RNA, 17 nt, Pseudomonas aeruginosa PA01
ggcgccaccgcgacgcg

SEQ ID NO: 3402933 - RNA, 23 nt, Pseudomonas aeruginosa PA01
ggcgccaccgcgacgcgcuggac

SEQ ID NO: 3402934 - RNA, 13 nt, Pseudomonas aeruginosa PA01
ggcgccaccgcgu

SEQ ID NO: 3402935 - RNA, 18 nt, Pseudomonas aeruginosa PA01
ggcgccacucggcgugcc

SEQ ID NO: 3402936 - RNA, 15 nt, Pseudomonas aeruginosa PA01
ggcgccagagcgcgc

SEQ ID NO: 3402937 - RNA, 18 nt, Pseudomonas aeruginosa PA01
ggcgccagagcgcgcuac

SEQ ID NO: 3402938 - RNA, 12 nt, Pseudomonas aeruginosa PA01
ggcgccagcagg

SEQ ID NO: 3402939 - RNA, 14 nt, Pseudomonas aeruginosa PA01
ggcgccagccagcc

SEQ ID NO: 3402940 - RNA, 18 nt, Pseudomonas aeruginosa PA01
ggcgccagccagcccggc

SEQ ID NO: 3402941 - RNA, 19 nt, Pseudomonas aeruginosa PA01
ggcgccagccagcccggcg

SEQ ID NO: 3402942 - RNA, 23 nt, Pseudomonas aeruginosa PA01
ggcgccagccgccaucaccagcg

SEQ ID NO: 3402943 - RNA, 13 nt, Pseudomonas aeruginosa PA01
ggcgccagccuac

SEQ ID NO: 3402944 - RNA, 13 nt, Pseudomonas aeruginosa PA01
ggcgccagcgccc

SEQ ID NO: 3402945 - RNA, 20 nt, Pseudomonas aeruginosa PA01
ggcgccagcgccccaccagg

SEQ ID NO: 3402946 - RNA, 14 nt, Pseudomonas aeruginosa PA01
ggcgccagcgguuc

SEQ ID NO: 3402947 - RNA, 15 nt, Pseudomonas aeruginosa PA01
ggcgccagcuccagc

SEQ ID NO: 3402948 - RNA, 18 nt, Pseudomonas aeruginosa PA01
ggcgccagcuccagcgcc

SEQ ID NO: 3402949 - RNA, 19 nt, Pseudomonas aeruginosa PA01
ggcgccagcuccagcgccc

SEQ ID NO: 3402950 - RNA, 22 nt, Pseudomonas aeruginosa PA01
ggcgccagcuccagcgcccagg

SEQ ID NO: 3402951 - RNA, 17 nt, Pseudomonas aeruginosa PA01
ggcgccagcucggacaa

SEQ ID NO: 3402952 - RNA, 19 nt, Pseudomonas aeruginosa PA01
ggcgccaggacucgccauc

SEQ ID NO: 3402953 - RNA, 11 nt, Pseudomonas aeruginosa PA01
ggcgccaggcc

SEQ ID NO: 3402954 - RNA, 15 nt, Pseudomonas aeruginosa PA01
ggcgccaggcccucg

SEQ ID NO: 3402955 - RNA, 19 nt, Pseudomonas aeruginosa PA01
ggcgccaggcccucggcga

SEQ ID NO: 3402956 - RNA, 21 nt, Pseudomonas aeruginosa PA01
ggcgccaggcccucggcgacc

SEQ ID NO: 3402957 - RNA, 17 nt, Pseudomonas aeruginosa PA01
ggcgccaggccgcgucg

SEQ ID NO: 3402958 - RNA, 13 nt, Pseudomonas aeruginosa PA01
ggcgccaggccgg

SEQ ID NO: 3402959 - RNA, 14 nt, Pseudomonas aeruginosa PA01
ggcgccaggccgga

SEQ ID NO: 3402960 - RNA, 15 nt, Pseudomonas aeruginosa PA01
ggcgccaggccggag

SEQ ID NO: 3402961 - RNA, 16 nt, Pseudomonas aeruginosa PA01
ggcgccaggccggcga

SEQ ID NO: 3402962 - RNA, 18 nt, Pseudomonas aeruginosa PA01
ggcgccaggccggcgagg

SEQ ID NO: 3402963 - RNA, 12 nt, Pseudomonas aeruginosa PA01
ggcgccaggccu

SEQ ID NO: 3402964 - RNA, 22 nt, Pseudomonas aeruginosa PA01
ggcgccaggcguuccagcucgg

SEQ ID NO: 3402965 - RNA, 18 nt, Pseudomonas aeruginosa PA01
ggcgccaggcugaccgcg

SEQ ID NO: 3402966 - RNA, 19 nt, Pseudomonas aeruginosa PA01
ggcgccaggcugaccgcgu

SEQ ID NO: 3402967 - RNA, 23 nt, Pseudomonas aeruginosa PA01
ggcgccagggacgcgcagcggcg

SEQ ID NO: 3402968 - RNA, 20 nt, Pseudomonas aeruginosa PA01
ggcgccaggggugccuugcc

SEQ ID NO: 3402969 - RNA, 19 nt, Pseudomonas aeruginosa PA01
ggcgccagguagugccgcc

SEQ ID NO: 3402970 - RNA, 21 nt, Pseudomonas aeruginosa PA01
ggcgccagucauugcgcuccg

SEQ ID NO: 3402971 - RNA, 23 nt, Pseudomonas aeruginosa PA01
ggcgccagucauugcgcuccgac

SEQ ID NO: 3402972 - RNA, 18 nt, Pseudomonas aeruginosa PA01
ggcgccaguucgccggug

SEQ ID NO: 3402973 - RNA, 18 nt, Pseudomonas aeruginosa PA01
ggcgccauaccggcaagg

SEQ ID NO: 3402974 - RNA, 19 nt, Pseudomonas aeruginosa PA01
ggcgccauaggccagcacc

SEQ ID NO: 3402975 - RNA, 20 nt, Pseudomonas aeruginosa PA01
ggcgccauaggccagcaccu

SEQ ID NO: 3402976 - RNA, 16 nt, Pseudomonas aeruginosa PA01
ggcgccauccuccagc

SEQ ID NO: 3402977 - RNA, 20 nt, Pseudomonas aeruginosa PA01
ggcgccauccuccagcgccg

SEQ ID NO: 3402978 - RNA, 21 nt, Pseudomonas aeruginosa PA01
ggcgccauccuccagcgccgc

SEQ ID NO: 3402979 - RNA, 22 nt, Pseudomonas aeruginosa PA01
ggcgccaucgcuuuccuggccg

SEQ ID NO: 3402980 - RNA, 23 nt, Pseudomonas aeruginosa PA01
ggcgccaucgcuuuccuggccga

SEQ ID NO: 3402981 - RNA, 20 nt, Pseudomonas aeruginosa PA01
ggcgccauugugcgcgcgca

SEQ ID NO: 3402982 - RNA, 23 nt, Pseudomonas aeruginosa PA01
ggcgcccaacgucuucaggcgcu

SEQ ID NO: 3402983 - RNA, 20 nt, Pseudomonas aeruginosa PA01
ggcgcccaaugcaucggccg

SEQ ID NO: 3402984 - RNA, 21 nt, Pseudomonas aeruginosa PA01
ggcgcccaaugcaucggccgg

SEQ ID NO: 3402985 - RNA, 22 nt, Pseudomonas aeruginosa PA01
ggcgcccaaugcaucggccggg

SEQ ID NO: 3402986 - RNA, 22 nt, Pseudomonas aeruginosa PA01
ggcgcccacaaccugccgaucg

SEQ ID NO: 3402987 - RNA, 15 nt, Pseudomonas aeruginosa PA01
ggcgcccaggcagca

SEQ ID NO: 3402988 - RNA, 18 nt, Pseudomonas aeruginosa PA01
ggcgcccaggcagcagag

SEQ ID NO: 3402989 - RNA, 11 nt, Pseudomonas aeruginosa PA01
ggcgcccaggg

SEQ ID NO: 3402990 - RNA, 15 nt, Pseudomonas aeruginosa PA01
ggcgcccagggcuuc

SEQ ID NO: 3402991 - RNA, 17 nt, Pseudomonas aeruginosa PA01
ggcgcccaugccgcccg

SEQ ID NO: 3402992 - RNA, 23 nt, Pseudomonas aeruginosa PA01
ggcgccccagaucgccagcgcca

SEQ ID NO: 3402993 - RNA, 20 nt, Pseudomonas aeruginosa PA01
ggcgccccaggcgcccaggc

SEQ ID NO: 3402994 - RNA, 15 nt, Pseudomonas aeruginosa PA01
ggcgccccaggcggg

SEQ ID NO: 3402995 - RNA, 17 nt, Pseudomonas aeruginosa PA01
ggcgccccaggcgggca

SEQ ID NO: 3402996 - RNA, 16 nt, Pseudomonas aeruginosa PA01
ggcgccccggcccagc

SEQ ID NO: 3402997 - RNA, 20 nt, Pseudomonas aeruginosa PA01
ggcgccccggcccagccgcg

SEQ ID NO: 3402998 - RNA, 16 nt, Pseudomonas aeruginosa PA01
ggcgccccgggucggc

SEQ ID NO: 3402999 - RNA, 15 nt, Pseudomonas aeruginosa PA01
ggcgccccugcggcg

SEQ ID NO: 3403000 - RNA, 17 nt, Pseudomonas aeruginosa PA01
ggcgccccugcggcgcc

SEQ ID NO: 3403001 - RNA, 21 nt, Pseudomonas aeruginosa PA01
ggcgccccugcggcgccgguu

SEQ ID NO: 3403002 - RNA, 15 nt, Pseudomonas aeruginosa PA01
ggcgcccgagggcgc

SEQ ID NO: 3403003 - RNA, 21 nt, Pseudomonas aeruginosa PA01
ggcgcccgcccggcaccaccg

SEQ ID NO: 3403004 - RNA, 18 nt, Pseudomonas aeruginosa PA01
ggcgcccgccuuguucgc

SEQ ID NO: 3403005 - RNA, 22 nt, Pseudomonas aeruginosa PA01
ggcgcccgccuuguucgccagc

SEQ ID NO: 3403006 - RNA, 13 nt, Pseudomonas aeruginosa PA01
ggcgcccgcgggc

SEQ ID NO: 3403007 - RNA, 16 nt, Pseudomonas aeruginosa PA01
ggcgcccgcgggcgcc

SEQ ID NO: 3403008 - RNA, 13 nt, Pseudomonas aeruginosa PA01
ggcgcccggccgg

SEQ ID NO: 3403009 - RNA, 14 nt, Pseudomonas aeruginosa PA01
ggcgcccggccgga

SEQ ID NO: 3403010 - RNA, 19 nt, Pseudomonas aeruginosa PA01
ggcgcccggccggauuggc

SEQ ID NO: 3403011 - RNA, 13 nt, Pseudomonas aeruginosa PA01
ggcgcccggcgca

SEQ ID NO: 3403012 - RNA, 17 nt, Pseudomonas aeruginosa PA01
ggcgccugagcagcgcu

SEQ ID NO: 3403013 - RNA, 21 nt, Pseudomonas aeruginosa PA01
ggcgccugcugcgcggguguc

SEQ ID NO: 3403014 - RNA, 16 nt, Pseudomonas aeruginosa PA01
ggcgccuggcguagcg

SEQ ID NO: 3403015 - RNA, 17 nt, Pseudomonas aeruginosa PA01
ggcgccuucagcgccgc

SEQ ID NO: 3403016 - RNA, 21 nt, Pseudomonas aeruginosa PA01
ggcgccuucagcgccgccagg

SEQ ID NO: 3403017 - RNA, 18 nt, Pseudomonas aeruginosa PA01
ggcgccuucaucgccacc

SEQ ID NO: 3403018 - RNA, 16 nt, Pseudomonas aeruginosa PA01
ggcgccuuccaggcgu

SEQ ID NO: 3403019 - RNA, 18 nt, Pseudomonas aeruginosa PA01
ggcgccuuccaggcgugc

SEQ ID NO: 3403020 - RNA, 20 nt, Pseudomonas aeruginosa PA01
ggcgccuuccaggcgugccu

SEQ ID NO: 3403021 - RNA, 13 nt, Pseudomonas aeruginosa PA01
ggcgccuugcgcc

SEQ ID NO: 3403022 - RNA, 23 nt, Pseudomonas aeruginosa PA01
ggcgccuuuuucauggccuggcg

SEQ ID NO: 3403023 - RNA, 19 nt, Pseudomonas aeruginosa PA01
ggcgcgaaguagcgggaga

SEQ ID NO: 3403024 - RNA, 17 nt, Pseudomonas aeruginosa PA01
ggcgcgaaucuucggcg

SEQ ID NO: 3403025 - RNA, 21 nt, Pseudomonas aeruginosa PA01
ggcgcgaaucuucggcgcgcc

SEQ ID NO: 3403026 - RNA, 22 nt, Pseudomonas aeruginosa PA01
ggcgcgaaucuucggcgcgccg

SEQ ID NO: 3403027 - RNA, 16 nt, Pseudomonas aeruginosa PA01
ggcgcgaauggcauuc

SEQ ID NO: 3403028 - RNA, 17 nt, Pseudomonas aeruginosa PA01
ggcgcgacagcucgugg

SEQ ID NO: 3403029 - RNA, 22 nt, Pseudomonas aeruginosa PA01
ggcgcgacagcucguggcuggc

SEQ ID NO: 3403030 - RNA, 23 nt, Pseudomonas aeruginosa PA01
ggcgcgacagcucguggcuggcg

SEQ ID NO: 3403031 - RNA, 12 nt, Pseudomonas aeruginosa PA01
ggcgcgaccgcc

SEQ ID NO: 3403032 - RNA, 15 nt, Pseudomonas aeruginosa PA01
ggcgcgaccgcccgc

SEQ ID NO: 3403033 - RNA, 17 nt, Pseudomonas aeruginosa PA01
ggcgcgaccgcccgccu

SEQ ID NO: 3403034 - RNA, 18 nt, Pseudomonas aeruginosa PA01
ggcgcgaccgucggccgg

SEQ ID NO: 3403035 - RNA, 14 nt, Pseudomonas aeruginosa PA01
ggcgcgacgcucca

SEQ ID NO: 3403036 - RNA, 14 nt, Pseudomonas aeruginosa PA01
ggcgcgacugucga

SEQ ID NO: 3403037 - RNA, 15 nt, Pseudomonas aeruginosa PA01
ggcgcgacuguucuc

SEQ ID NO: 3403038 - RNA, 17 nt, Pseudomonas aeruginosa PA01
ggcgcgagaagccagcc

SEQ ID NO: 3403039 - RNA, 20 nt, Pseudomonas aeruginosa PA01
ggcgcgagaugaagcgccgc

SEQ ID NO: 3403040 - RNA, 16 nt, Pseudomonas aeruginosa PA01
ggcgcgaggcgcccgc

SEQ ID NO: 3403041 - RNA, 17 nt, Pseudomonas aeruginosa PA01
ggcgcgaggcgcccgcc

SEQ ID NO: 3403042 - RNA, 18 nt, Pseudomonas aeruginosa PA01
ggcgcgaggcgcccgccg

SEQ ID NO: 3403043 - RNA, 18 nt, Pseudomonas aeruginosa PA01
ggcgcgauauccgccagg

SEQ ID NO: 3403044 - RNA, 20 nt, Pseudomonas aeruginosa PA01
ggcgcgauauccgccaggga

SEQ ID NO: 3403045 - RNA, 12 nt, Pseudomonas aeruginosa PA01
ggcgcgauccgc

SEQ ID NO: 3403046 - RNA, 17 nt, Pseudomonas aeruginosa PA01
ggcgcgauccgcgcggc

SEQ ID NO: 3403047 - RNA, 21 nt, Pseudomonas aeruginosa PA01
ggcgcgauccgcgcggcaacc

SEQ ID NO: 3403048 - RNA, 17 nt, Pseudomonas aeruginosa PA01
ggcgcgauccuccgcca

SEQ ID NO: 3403049 - RNA, 23 nt, Pseudomonas aeruginosa PA01
ggcgcgaucgcguuccagcaacg

SEQ ID NO: 3403050 - RNA, 20 nt, Pseudomonas aeruginosa PA01
ggcgcgaucggggcagaaca

SEQ ID NO: 3403051 - RNA, 19 nt, Pseudomonas aeruginosa PA01
ggcgcgaugccgaugccgc

SEQ ID NO: 3403052 - RNA, 21 nt, Pseudomonas aeruginosa PA01
ggcgcgaugccgaugccgccg

SEQ ID NO: 3403053 - RNA, 21 nt, Pseudomonas aeruginosa PA01
ggcgcgauggaguaggcgucg

SEQ ID NO: 3403054 - RNA, 23 nt, Pseudomonas aeruginosa PA01
ggcgcgcaacgcuuccagcaccu

SEQ ID NO: 3403055 - RNA, 18 nt, Pseudomonas aeruginosa PA01
ggcgcgcaccagcggguc

SEQ ID NO: 3403056 - RNA, 21 nt, Pseudomonas aeruginosa PA01
ggcgcgcaccagcgggucguc

SEQ ID NO: 3403057 - RNA, 14 nt, Pseudomonas aeruginosa PA01
ggcgcgcaccugcg

SEQ ID NO: 3403058 - RNA, 17 nt, Pseudomonas aeruginosa PA01
ggcgcgcacggaggcgc

SEQ ID NO: 3403059 - RNA, 16 nt, Pseudomonas aeruginosa PA01
ggcgcgcacuuccucg

SEQ ID NO: 3403060 - RNA, 18 nt, Pseudomonas aeruginosa PA01
ggcgcgcacuuccucggc

SEQ ID NO: 3403061 - RNA, 17 nt, Pseudomonas aeruginosa PA01
ggcgcgcagcagguagu

SEQ ID NO: 3403062 - RNA, 13 nt, Pseudomonas aeruginosa PA01
ggcgcgcagggca

SEQ ID NO: 3403063 - RNA, 14 nt, Pseudomonas aeruginosa PA01
ggcgcgcagggcau

SEQ ID NO: 3403064 - RNA, 15 nt, Pseudomonas aeruginosa PA01
ggcgcgcagggccag

SEQ ID NO: 3403065 - RNA, 16 nt, Pseudomonas aeruginosa PA01
ggcgcgcagggccagc

SEQ ID NO: 3403066 - RNA, 17 nt, Pseudomonas aeruginosa PA01
ggcgcgcagggccgcgg

SEQ ID NO: 3403067 - RNA, 19 nt, Pseudomonas aeruginosa PA01
ggcgcgcaguagcuggauc

SEQ ID NO: 3403068 - RNA, 20 nt, Pseudomonas aeruginosa PA01
ggcgcgcaucggugccggca

SEQ ID NO: 3403069 - RNA, 23 nt, Pseudomonas aeruginosa PA01
ggcgcgcaucggugccggcaggc

SEQ ID NO: 3403070 - RNA, 15 nt, Pseudomonas aeruginosa PA01
ggcgcgccaaggccg

SEQ ID NO: 3403071 - RNA, 16 nt, Pseudomonas aeruginosa PA01
ggcgcgccaaggccgc

SEQ ID NO: 3403072 - RNA, 21 nt, Pseudomonas aeruginosa PA01
ggcgcgccaaggccgccaggc

SEQ ID NO: 3403073 - RNA, 22 nt, Pseudomonas aeruginosa PA01
ggcgcgccaaggccgccaggcc

SEQ ID NO: 3403074 - RNA, 23 nt, Pseudomonas aeruginosa PA01
ggcgcgccaaggccgccaggccu

SEQ ID NO: 3403075 - RNA, 14 nt, Pseudomonas aeruginosa PA01
ggcgcgccagaagc

SEQ ID NO: 3403076 - RNA, 18 nt, Pseudomonas aeruginosa PA01
ggcgcgccagaagcggcc

SEQ ID NO: 3403077 - RNA, 19 nt, Pseudomonas aeruginosa PA01
ggcgcgccagaagcggccg

SEQ ID NO: 3403078 - RNA, 20 nt, Pseudomonas aeruginosa PA01
ggcgcgccagaagcggccga

SEQ ID NO: 3403079 - RNA, 22 nt, Pseudomonas aeruginosa PA01
ggcgcgccagaagcggccgacc

SEQ ID NO: 3403080 - RNA, 23 nt, Pseudomonas aeruginosa PA01
ggcgcgccagaagcggccgacca

SEQ ID NO: 3403081 - RNA, 12 nt, Pseudomonas aeruginosa PA01
ggcgcgccaggc

SEQ ID NO: 3403082 - RNA, 13 nt, Pseudomonas aeruginosa PA01
ggcgcgcccaggc

SEQ ID NO: 3403083 - RNA, 17 nt, Pseudomonas aeruginosa PA01
ggcgcgcccaggcccag

SEQ ID NO: 3403084 - RNA, 21 nt, Pseudomonas aeruginosa PA01
ggcgcgcccaggcccagcgcg

SEQ ID NO: 3403085 - RNA, 22 nt, Pseudomonas aeruginosa PA01
ggcgcgcccaggcccagcgcgg

SEQ ID NO: 3403086 - RNA, 23 nt, Pseudomonas aeruginosa PA01
ggcgcgcccaggcccagcgcggc

SEQ ID NO: 3403087 - RNA, 21 nt, Pseudomonas aeruginosa PA01
ggcgcgccccgucccuaccag

SEQ ID NO: 3403088 - RNA, 21 nt, Pseudomonas aeruginosa PA01
ggcgcgcccgccaggucgagg

SEQ ID NO: 3403089 - RNA, 15 nt, Pseudomonas aeruginosa PA01
ggcgcgcccggcgca

SEQ ID NO: 3403090 - RNA, 17 nt, Pseudomonas aeruginosa PA01
ggcgcgcccggcgcaga

SEQ ID NO: 3403091 - RNA, 15 nt, Pseudomonas aeruginosa PA01
ggcgcgcccggcgcc

SEQ ID NO: 3403092 - RNA, 14 nt, Pseudomonas aeruginosa PA01
ggcgcgccgaaggc

SEQ ID NO: 3403093 - RNA, 17 nt, Pseudomonas aeruginosa PA01
ggcgcgccgacagcacg

SEQ ID NO: 3403094 - RNA, 18 nt, Pseudomonas aeruginosa PA01
ggcgcgccgacagcacga

SEQ ID NO: 3403095 - RNA, 15 nt, Pseudomonas aeruginosa PA01
ggcgcgccggacagg

SEQ ID NO: 3403096 - RNA, 17 nt, Pseudomonas aeruginosa PA01
ggcgcgccggcccgggu

SEQ ID NO: 3403097 - RNA, 20 nt, Pseudomonas aeruginosa PA01
ggcgcgccgguuucgaccgg

SEQ ID NO: 3403098 - RNA, 21 nt, Pseudomonas aeruginosa PA01
ggcgcgccgguuucgaccggc

SEQ ID NO: 3403099 - RNA, 16 nt, Pseudomonas aeruginosa PA01
ggcgcgccgugcggcg

SEQ ID NO: 3403100 - RNA, 17 nt, Pseudomonas aeruginosa PA01
ggcgcgccuccugcgga

SEQ ID NO: 3403101 - RNA, 18 nt, Pseudomonas aeruginosa PA01
ggcgcgccucugagacgc

SEQ ID NO: 3403102 - RNA, 23 nt, Pseudomonas aeruginosa PA01
ggcgcgccuggaucagcgccucg

SEQ ID NO: 3403103 - RNA, 13 nt, Pseudomonas aeruginosa PA01
ggcgcgccuggcc

SEQ ID NO: 3403104 - RNA, 20 nt, Pseudomonas aeruginosa PA01
ggcgcgccuggcccuggcgg

SEQ ID NO: 3403105 - RNA, 19 nt, Pseudomonas aeruginosa PA01
ggcgcgccuucagcgccuc

SEQ ID NO: 3403106 - RNA, 23 nt, Pseudomonas aeruginosa PA01
ggcgcgccuucagcgccuccagc

SEQ ID NO: 3403107 - RNA, 15 nt, Pseudomonas aeruginosa PA01
ggcgcgcgccaccgc

SEQ ID NO: 3403108 - RNA, 17 nt, Pseudomonas aeruginosa PA01
ggcgcgcgccaccgccu

SEQ ID NO: 3403109 - RNA, 19 nt, Pseudomonas aeruginosa PA01
ggcgcgcgcccccuggccg

SEQ ID NO: 3403110 - RNA, 11 nt, Pseudomonas aeruginosa PA01
ggcgcgcgccg

SEQ ID NO: 3403111 - RNA, 13 nt, Pseudomonas aeruginosa PA01
ggcgcgcgccgaa

SEQ ID NO: 3403112 - RNA, 16 nt, Pseudomonas aeruginosa PA01
ggcgcgcgccgaacuc

SEQ ID NO: 3403113 - RNA, 12 nt, Pseudomonas aeruginosa PA01
ggcgcgcgccgg

SEQ ID NO: 3403114 - RNA, 20 nt, Pseudomonas aeruginosa PA01
ggcgcgucccugggcgcagg

SEQ ID NO: 3403115 - RNA, 20 nt, Pseudomonas aeruginosa PA01
ggcgcguccggagugaugcc

SEQ ID NO: 3403116 - RNA, 20 nt, Pseudomonas aeruginosa PA01
ggcgcgucgcggccucuucg

SEQ ID NO: 3403117 - RNA, 23 nt, Pseudomonas aeruginosa PA01
ggcgcgucgcggccucuucgucg

SEQ ID NO: 3403118 - RNA, 18 nt, Pseudomonas aeruginosa PA01
ggcgcgucgcucauccgc

SEQ ID NO: 3403119 - RNA, 16 nt, Pseudomonas aeruginosa PA01
ggcgcgucgcugccgc

SEQ ID NO: 3403120 - RNA, 17 nt, Pseudomonas aeruginosa PA01
ggcgcgucgcugccgcc

SEQ ID NO: 3403121 - RNA, 18 nt, Pseudomonas aeruginosa PA01
ggcgcgucgcugccgccg

SEQ ID NO: 3403122 - RNA, 19 nt, Pseudomonas aeruginosa PA01
ggcgcgucgcugccgccgc

SEQ ID NO: 3403123 - RNA, 14 nt, Pseudomonas aeruginosa PA01
ggcgcgucgcugcg

SEQ ID NO: 3403124 - RNA, 16 nt, Pseudomonas aeruginosa PA01
ggcgcgucgcugcgca

SEQ ID NO: 3403125 - RNA, 20 nt, Pseudomonas aeruginosa PA01
ggcgcgucgcugcgcaacug

SEQ ID NO: 3403126 - RNA, 17 nt, Pseudomonas aeruginosa PA01
ggcgcgucggccgcucg

SEQ ID NO: 3403127 - RNA, 14 nt, Pseudomonas aeruginosa PA01
ggcgcgucggcggu

SEQ ID NO: 3403128 - RNA, 15 nt, Pseudomonas aeruginosa PA01
ggcgcgucggcggug

SEQ ID NO: 3403129 - RNA, 19 nt, Pseudomonas aeruginosa PA01
ggcgcgucggcggugucgg

SEQ ID NO: 3403130 - RNA, 22 nt, Pseudomonas aeruginosa PA01
ggcgcgucggcggugucgguau

SEQ ID NO: 3403131 - RNA, 17 nt, Pseudomonas aeruginosa PA01
ggcgcgucggugccgcc

SEQ ID NO: 3403132 - RNA, 14 nt, Pseudomonas aeruginosa PA01
ggcgcgucgguggc

SEQ ID NO: 3403133 - RNA, 12 nt, Pseudomonas aeruginosa PA01
ggcgcgucucca

SEQ ID NO: 3403134 - RNA, 13 nt, Pseudomonas aeruginosa PA01
ggcgcgucuccag

SEQ ID NO: 3403135 - RNA, 15 nt, Pseudomonas aeruginosa PA01
ggcgcgucuccagcu

SEQ ID NO: 3403136 - RNA, 16 nt, Pseudomonas aeruginosa PA01
ggcgcgucuccagcuc

SEQ ID NO: 3403137 - RNA, 20 nt, Pseudomonas aeruginosa PA01
ggcgcgucuccagcucggcg

SEQ ID NO: 3403138 - RNA, 22 nt, Pseudomonas aeruginosa PA01
ggcgcguucacuccacgaggau

SEQ ID NO: 3403139 - RNA, 18 nt, Pseudomonas aeruginosa PA01
ggcgcguucucugucgga

SEQ ID NO: 3403140 - RNA, 17 nt, Pseudomonas aeruginosa PA01
ggcgcguugcccagccc

SEQ ID NO: 3403141 - RNA, 19 nt, Pseudomonas aeruginosa PA01
ggcgcguugcuuccaggca

SEQ ID NO: 3403142 - RNA, 16 nt, Pseudomonas aeruginosa PA01
ggcgcguugugccgcc

SEQ ID NO: 3403143 - RNA, 19 nt, Pseudomonas aeruginosa PA01
ggcgcuacgaaggcgugcc

SEQ ID NO: 3403144 - RNA, 14 nt, Pseudomonas aeruginosa PA01
ggcgcuacgcucgc

SEQ ID NO: 3403145 - RNA, 23 nt, Pseudomonas aeruginosa PA01
ggcgcuacgcucgccgacggcuu

SEQ ID NO: 3403146 - RNA, 13 nt, Pseudomonas aeruginosa PA01
ggcgcuauccgcc

SEQ ID NO: 3403147 - RNA, 15 nt, Pseudomonas aeruginosa PA01
ggcgcuauccgccgu

SEQ ID NO: 3403148 - RNA, 22 nt, Pseudomonas aeruginosa PA01
ggcgcuauccgccguuacgccg

SEQ ID NO: 3403149 - RNA, 14 nt, Pseudomonas aeruginosa PA01
ggcgcuaugcgccg

SEQ ID NO: 3403150 - RNA, 22 nt, Pseudomonas aeruginosa PA01
ggcgcuaugcgccguuacgccg

SEQ ID NO: 3403151 - RNA, 20 nt, Pseudomonas aeruginosa PA01
ggcgcucaacgccucgcggc

SEQ ID NO: 3403152 - RNA, 14 nt, Pseudomonas aeruginosa PA01
ggcgcucacccaca

SEQ ID NO: 3403153 - RNA, 17 nt, Pseudomonas aeruginosa PA01
ggcgcucaccgaggcga

SEQ ID NO: 3403154 - RNA, 23 nt, Pseudomonas aeruginosa PA01
ggcgcucagcaucagcgacagca

SEQ ID NO: 3403155 - RNA, 14 nt, Pseudomonas aeruginosa PA01
ggcgcucagcgccg

SEQ ID NO: 3403156 - RNA, 15 nt, Pseudomonas aeruginosa PA01
ggcgcucagcgccgc

SEQ ID NO: 3403157 - RNA, 16 nt, Pseudomonas aeruginosa PA01
ggcgcuccaacagcag

SEQ ID NO: 3403158 - RNA, 13 nt, Pseudomonas aeruginosa PA01
ggcgcuccacagc

SEQ ID NO: 3403159 - RNA, 17 nt, Pseudomonas aeruginosa PA01
ggcgcuccacagcugcc

SEQ ID NO: 3403160 - RNA, 15 nt, Pseudomonas aeruginosa PA01
ggcgcuccaccaggg

SEQ ID NO: 3403161 - RNA, 13 nt, Pseudomonas aeruginosa PA01
ggcgcuccaccgc

SEQ ID NO: 3403162 - RNA, 19 nt, Pseudomonas aeruginosa PA01
ggcgcuccagacucuccag

SEQ ID NO: 3403163 - RNA, 14 nt, Pseudomonas aeruginosa PA01
ggcgcuccagggcg

SEQ ID NO: 3403164 - RNA, 15 nt, Pseudomonas aeruginosa PA01
ggcgcuccgccgaac

SEQ ID NO: 3403165 - RNA, 21 nt, Pseudomonas aeruginosa PA01
ggcgcuccgggcuccaccagu

SEQ ID NO: 3403166 - RNA, 13 nt, Pseudomonas aeruginosa PA01
ggcgcuccuccag

SEQ ID NO: 3403167 - RNA, 15 nt, Pseudomonas aeruginosa PA01
ggcgcuccuccagcg

SEQ ID NO: 3403168 - RNA, 16 nt, Pseudomonas aeruginosa PA01
ggcgcuccuccagcgc

SEQ ID NO: 3403169 - RNA, 19 nt, Pseudomonas aeruginosa PA01
ggcgcuccuccagcgccgc

SEQ ID NO: 3403170 - RNA, 16 nt, Pseudomonas aeruginosa PA01
ggcgcuccuggugcgg

SEQ ID NO: 3403171 - RNA, 19 nt, Pseudomonas aeruginosa PA01
ggcgcuccuggugcggcac

SEQ ID NO: 3403172 - RNA, 24 nt, Pseudomonas aeruginosa PA01
ggcgcuccuggugcggcaccagcc

SEQ ID NO: 3403173 - RNA, 20 nt, Pseudomonas aeruginosa PA01
ggcgcuccuugagcagcucg

SEQ ID NO: 3403174 - RNA, 18 nt, Pseudomonas aeruginosa PA01
ggcgcucgaagcuccagc

SEQ ID NO: 3403175 - RNA, 21 nt, Pseudomonas aeruginosa PA01
ggcgcucgaagcuccagcgug

SEQ ID NO: 3403176 - RNA, 16 nt, Pseudomonas aeruginosa PA01
ggcgcucgacgaucag

SEQ ID NO: 3403177 - RNA, 12 nt, Pseudomonas aeruginosa PA01
ggcgcucgaggg

SEQ ID NO: 3403178 - RNA, 23 nt, Pseudomonas aeruginosa PA01
ggcgcucgcccuugcgccgcggu

SEQ ID NO: 3403179 - RNA, 12 nt, Pseudomonas aeruginosa PA01
ggcgcucgcgcu

SEQ ID NO: 3403180 - RNA, 15 nt, Pseudomonas aeruginosa PA01
ggcgcucgcgcugca

SEQ ID NO: 3403181 - RNA, 13 nt, Pseudomonas aeruginosa PA01
ggcgcucgcgggc

SEQ ID NO: 3403182 - RNA, 14 nt, Pseudomonas aeruginosa PA01
ggcgcucgcgggcc

SEQ ID NO: 3403183 - RNA, 16 nt, Pseudomonas aeruginosa PA01
ggcgcucgcgggccgc

SEQ ID NO: 3403184 - RNA, 20 nt, Pseudomonas aeruginosa PA01
ggcgcucgcgggccgccugg

SEQ ID NO: 3403185 - RNA, 20 nt, Pseudomonas aeruginosa PA01
ggcgcucggcaucgaccaug

SEQ ID NO: 3403186 - RNA, 12 nt, Pseudomonas aeruginosa PA01
ggcgcucggcca

SEQ ID NO: 3403187 - RNA, 18 nt, Pseudomonas aeruginosa PA01
ggcgcucggccaggucgc

SEQ ID NO: 3403188 - RNA, 14 nt, Pseudomonas aeruginosa PA01
ggcgcucggcgacg

SEQ ID NO: 3403189 - RNA, 15 nt, Pseudomonas aeruginosa PA01
ggcgcucggcggcgc

SEQ ID NO: 3403190 - RNA, 18 nt, Pseudomonas aeruginosa PA01
ggcgcucggcggcgcgca

SEQ ID NO: 3403191 - RNA, 13 nt, Pseudomonas aeruginosa PA01
ggcgcucggcucc

SEQ ID NO: 3403192 - RNA, 17 nt, Pseudomonas aeruginosa PA01
ggcgcucggcuccagcc

SEQ ID NO: 3403193 - RNA, 22 nt, Pseudomonas aeruginosa PA01
ggcgcucggcuccagccaggcc

SEQ ID NO: 3403194 - RNA, 23 nt, Pseudomonas aeruginosa PA01
ggcgcucggggauguccgccgcc

SEQ ID NO: 3403195 - RNA, 12 nt, Pseudomonas aeruginosa PA01
ggcgcucgucga

SEQ ID NO: 3403196 - RNA, 18 nt, Pseudomonas aeruginosa PA01
ggcgcucguugcgccgcu

SEQ ID NO: 3403197 - RNA, 19 nt, Pseudomonas aeruginosa PA01
ggcgcucguugcgccgcuc

SEQ ID NO: 3403198 - RNA, 21 nt, Pseudomonas aeruginosa PA01
ggcgcucguugcgccgcuccu

SEQ ID NO: 3403199 - RNA, 24 nt, Pseudomonas aeruginosa PA01
ggcgcucguugcgccgcuccuggc

SEQ ID NO: 3403200 - RNA, 13 nt, Pseudomonas aeruginosa PA01
ggcgcucucgccg

SEQ ID NO: 3403201 - RNA, 18 nt, Pseudomonas aeruginosa PA01
ggcgcucugcaguguggc

SEQ ID NO: 3403202 - RNA, 18 nt, Pseudomonas aeruginosa PA01
ggcgcucuucaccgucga

SEQ ID NO: 3403203 - RNA, 21 nt, Pseudomonas aeruginosa PA01
ggcgcucuucacuuccagcug

SEQ ID NO: 3403204 - RNA, 16 nt, Pseudomonas aeruginosa PA01
ggcgcugaacagcugg

SEQ ID NO: 3403205 - RNA, 15 nt, Pseudomonas aeruginosa PA01
ggcgcugaagcggcc

SEQ ID NO: 3403206 - RNA, 18 nt, Pseudomonas aeruginosa PA01
ggcgcugaagcggccgag

SEQ ID NO: 3403207 - RNA, 17 nt, Pseudomonas aeruginosa PA01
ggcgcugaccucgaugg

SEQ ID NO: 3403208 - RNA, 14 nt, Pseudomonas aeruginosa PA01
ggcgcugagcgccu

SEQ ID NO: 3403209 - RNA, 22 nt, Pseudomonas aeruginosa PA01
ggcgcugagcgccucgaucgcc

SEQ ID NO: 3403210 - RNA, 14 nt, Pseudomonas aeruginosa PA01
ggcgcugagcgcgg

SEQ ID NO: 3403211 - RNA, 16 nt, Pseudomonas aeruginosa PA01
ggcgcugagcgcgguc

SEQ ID NO: 3403212 - RNA, 22 nt, Pseudomonas aeruginosa PA01
ggcgcugaggaagagcagcgcg

SEQ ID NO: 3403213 - RNA, 17 nt, Pseudomonas aeruginosa PA01
ggcgcugaggaucagcc

SEQ ID NO: 3403214 - RNA, 18 nt, Pseudomonas aeruginosa PA01
ggcgcugaggaucagcca

SEQ ID NO: 3403215 - RNA, 20 nt, Pseudomonas aeruginosa PA01
ggcgcugaggaucagccagc

SEQ ID NO: 3403216 - RNA, 21 nt, Pseudomonas aeruginosa PA01
ggcgcugaggaucagccagcc

SEQ ID NO: 3403217 - RNA, 24 nt, Pseudomonas aeruginosa PA01
ggcggacaacccggcgcuggccgc

SEQ ID NO: 3403218 - RNA, 15 nt, Pseudomonas aeruginosa PA01
ggcggacacgcaggc

SEQ ID NO: 3403219 - RNA, 14 nt, Pseudomonas aeruginosa PA01
ggcggacagcccgc

SEQ ID NO: 3403220 - RNA, 16 nt, Pseudomonas aeruginosa PA01
ggcggacagcccgcgc

SEQ ID NO: 3403221 - RNA, 17 nt, Pseudomonas aeruginosa PA01
ggcggacagcccgcgcu

SEQ ID NO: 3403222 - RNA, 23 nt, Pseudomonas aeruginosa PA01
ggcggacagcccgcgcucggccg

SEQ ID NO: 3403223 - RNA, 21 nt, Pseudomonas aeruginosa PA01
ggcggacauguugcagggucg

SEQ ID NO: 3403224 - RNA, 16 nt, Pseudomonas aeruginosa PA01
ggcggaccgccucgac

SEQ ID NO: 3403225 - RNA, 13 nt, Pseudomonas aeruginosa PA01
ggcggaccuccgc

SEQ ID NO: 3403226 - RNA, 16 nt, Pseudomonas aeruginosa PA01
ggcggaccuccgccag

SEQ ID NO: 3403227 - RNA, 17 nt, Pseudomonas aeruginosa PA01
ggcggaccuccgccagg

SEQ ID NO: 3403228 - RNA, 18 nt, Pseudomonas aeruginosa PA01
ggcggaccuccgccaggu

SEQ ID NO: 3403229 - RNA, 23 nt, Pseudomonas aeruginosa PA01
ggcggaccuccgccaggucgauc

SEQ ID NO: 3403230 - RNA, 13 nt, Pseudomonas aeruginosa PA01
ggcggacgaucac

SEQ ID NO: 3403231 - RNA, 14 nt, Pseudomonas aeruginosa PA01
ggcggacgaucacu

SEQ ID NO: 3403232 - RNA, 13 nt, Pseudomonas aeruginosa PA01
ggcggacgcaggc

SEQ ID NO: 3403233 - RNA, 15 nt, Pseudomonas aeruginosa PA01
ggcggacgcaggccg

SEQ ID NO: 3403234 - RNA, 13 nt, Pseudomonas aeruginosa PA01
ggcggacgcuggg

SEQ ID NO: 3403235 - RNA, 16 nt, Pseudomonas aeruginosa PA01
ggcggacugcucgccg

SEQ ID NO: 3403236 - RNA, 18 nt, Pseudomonas aeruginosa PA01
ggcggacugcucgccgcc

SEQ ID NO: 3403237 - RNA, 19 nt, Pseudomonas aeruginosa PA01
ggcggacugcucgccgccg

SEQ ID NO: 3403238 - RNA, 23 nt, Pseudomonas aeruginosa PA01
ggcggagaaacuuucuucgccau

SEQ ID NO: 3403239 - RNA, 14 nt, Pseudomonas aeruginosa PA01
ggcggagaagccgc

SEQ ID NO: 3403240 - RNA, 16 nt, Pseudomonas aeruginosa PA01
ggcggagauugcggcg

SEQ ID NO: 3403241 - RNA, 12 nt, Pseudomonas aeruginosa PA01
ggcggagcagcc

SEQ ID NO: 3403242 - RNA, 13 nt, Pseudomonas aeruginosa PA01
ggcggagccgucg

SEQ ID NO: 3403243 - RNA, 15 nt, Pseudomonas aeruginosa PA01
ggcggagccgucggc

SEQ ID NO: 3403244 - RNA, 21 nt, Pseudomonas aeruginosa PA01
ggcggagccgucggcuccgcu

SEQ ID NO: 3403245 - RNA, 11 nt, Pseudomonas aeruginosa PA01
ggcggaggcga

SEQ ID NO: 3403246 - RNA, 16 nt, Pseudomonas aeruginosa PA01
ggcggaguagccggcg

SEQ ID NO: 3403247 - RNA, 17 nt, Pseudomonas aeruginosa PA01
ggcggaguagccggcgg

SEQ ID NO: 3403248 - RNA, 22 nt, Pseudomonas aeruginosa PA01
ggcggaguagccggcggcgaac

SEQ ID NO: 3403249 - RNA, 18 nt, Pseudomonas aeruginosa PA01
ggcggauaaacggcaugc

SEQ ID NO: 3403250 - RNA, 20 nt, Pseudomonas aeruginosa PA01
ggcggauaacaccguuggcg

SEQ ID NO: 3403251 - RNA, 16 nt, Pseudomonas aeruginosa PA01
ggcggauaaccgcgag

SEQ ID NO: 3403252 - RNA, 17 nt, Pseudomonas aeruginosa PA01
ggcggauaaccgcgagc

SEQ ID NO: 3403253 - RNA, 18 nt, Pseudomonas aeruginosa PA01
ggcggauaaccgcgagcg

SEQ ID NO: 3403254 - RNA, 17 nt, Pseudomonas aeruginosa PA01
ggcggauaacgccacag

SEQ ID NO: 3403255 - RNA, 14 nt, Pseudomonas aeruginosa PA01
ggcggauaacgccg

SEQ ID NO: 3403256 - RNA, 17 nt, Pseudomonas aeruginosa PA01
ggcggauaacgccgaug

SEQ ID NO: 3403257 - RNA, 20 nt, Pseudomonas aeruginosa PA01
ggcggauaacgccgauggcg

SEQ ID NO: 3403258 - RNA, 22 nt, Pseudomonas aeruginosa PA01
ggcggauaacgccgauggcguu

SEQ ID NO: 3403259 - RNA, 16 nt, Pseudomonas aeruginosa PA01
ggcggauaacgccgcu

SEQ ID NO: 3403260 - RNA, 21 nt, Pseudomonas aeruginosa PA01
ggcggauaacgccgcuggcgu

SEQ ID NO: 3403261 - RNA, 17 nt, Pseudomonas aeruginosa PA01
ggcggauaacgccggug

SEQ ID NO: 3403262 - RNA, 22 nt, Pseudomonas aeruginosa PA01
ggcggauaacgccuauggcguu

SEQ ID NO: 3403263 - RNA, 20 nt, Pseudomonas aeruginosa PA01
ggcggauaaucgcagcgcgg

SEQ ID NO: 3403264 - RNA, 15 nt, Pseudomonas aeruginosa PA01
ggcggauacaggcgc

SEQ ID NO: 3403265 - RNA, 18 nt, Pseudomonas aeruginosa PA01
ggcggauacaggcgcagc

SEQ ID NO: 3403266 - RNA, 22 nt, Pseudomonas aeruginosa PA01
ggcggauacaggcgcagcagca

SEQ ID NO: 3403267 - RNA, 16 nt, Pseudomonas aeruginosa PA01
ggcggauaucgcgccg

SEQ ID NO: 3403268 - RNA, 15 nt, Pseudomonas aeruginosa PA01
ggcggauaucgcgug

SEQ ID NO: 3403269 - RNA, 15 nt, Pseudomonas aeruginosa PA01
ggcggaucaccggcu

SEQ ID NO: 3403270 - RNA, 18 nt, Pseudomonas aeruginosa PA01
ggcggaucaccggcuggc

SEQ ID NO: 3403271 - RNA, 19 nt, Pseudomonas aeruginosa PA01
ggcggaucagcccgcugac

SEQ ID NO: 3403272 - RNA, 21 nt, Pseudomonas aeruginosa PA01
ggcggaucagcccgcugaccg

SEQ ID NO: 3403273 - RNA, 14 nt, Pseudomonas aeruginosa PA01
ggcggaucagcucg

SEQ ID NO: 3403274 - RNA, 22 nt, Pseudomonas aeruginosa PA01
ggcggaucagcucgaucagccc

SEQ ID NO: 3403275 - RNA, 17 nt, Pseudomonas aeruginosa PA01
ggcggaucgagcagcgg

SEQ ID NO: 3403276 - RNA, 15 nt, Pseudomonas aeruginosa PA01
ggcggaucgaucagc

SEQ ID NO: 3403277 - RNA, 20 nt, Pseudomonas aeruginosa PA01
ggcggaucgaucagcagcac

SEQ ID NO: 3403278 - RNA, 18 nt, Pseudomonas aeruginosa PA01
ggcggaucgaucgaucag

SEQ ID NO: 3403279 - RNA, 12 nt, Pseudomonas aeruginosa PA01
ggcggaucgcca

SEQ ID NO: 3403280 - RNA, 21 nt, Pseudomonas aeruginosa PA01
ggcggaucgcccggcgcucca

SEQ ID NO: 3403281 - RNA, 13 nt, Pseudomonas aeruginosa PA01
ggcggaucgccgc

SEQ ID NO: 3403282 - RNA, 17 nt, Pseudomonas aeruginosa PA01
ggcggaugaccugucca

SEQ ID NO: 3403283 - RNA, 15 nt, Pseudomonas aeruginosa PA01
ggcggaugagccgcu

SEQ ID NO: 3403284 - RNA, 19 nt, Pseudomonas aeruginosa PA01
ggcggauguaguccagcgc

SEQ ID NO: 3403285 - RNA, 15 nt, Pseudomonas aeruginosa PA01
ggcggauugccagca

SEQ ID NO: 3403286 - RNA, 18 nt, Pseudomonas aeruginosa PA01
ggcggauuuccugcggca

SEQ ID NO: 3403287 - RNA, 22 nt, Pseudomonas aeruginosa PA01
ggcggauuuccugcggcacgaa

SEQ ID NO: 3403288 - RNA, 16 nt, Pseudomonas aeruginosa PA01
ggcggauuugccgccg

SEQ ID NO: 3403289 - RNA, 22 nt, Pseudomonas aeruginosa PA01
ggcggcaagggcacgugcagcg

SEQ ID NO: 3403290 - RNA, 16 nt, Pseudomonas aeruginosa PA01
ggcggcacccucuucc

SEQ ID NO: 3403291 - RNA, 21 nt, Pseudomonas aeruginosa PA01
ggcggcacccucuuccgcgcu

SEQ ID NO: 3403292 - RNA, 12 nt, Pseudomonas aeruginosa PA01
ggcggcacgacc

SEQ ID NO: 3403293 - RNA, 15 nt, Pseudomonas aeruginosa PA01
ggcggcacgaccaca

SEQ ID NO: 3403294 - RNA, 23 nt, Pseudomonas aeruginosa PA01
ggcggcacgcuccagaucgccgu

SEQ ID NO: 3403295 - RNA, 17 nt, Pseudomonas aeruginosa PA01
ggcggcacuccaggaac

SEQ ID NO: 3403296 - RNA, 18 nt, Pseudomonas aeruginosa PA01
ggcggcacucggcgacca

SEQ ID NO: 3403297 - RNA, 20 nt, Pseudomonas aeruginosa PA01
ggcggcacucggcgaccacc

SEQ ID NO: 3403298 - RNA, 12 nt, Pseudomonas aeruginosa PA01
ggcggcagcacg

SEQ ID NO: 3403299 - RNA, 14 nt, Pseudomonas aeruginosa PA01
ggcggcagccgcgg

SEQ ID NO: 3403300 - RNA, 15 nt, Pseudomonas aeruginosa PA01
ggcggcagccgcggc

SEQ ID NO: 3403301 - RNA, 22 nt, Pseudomonas aeruginosa PA01
ggcggcagcugcggcggcacca

SEQ ID NO: 3403302 - RNA, 12 nt, Pseudomonas aeruginosa PA01
ggcggcaggcca

SEQ ID NO: 3403303 - RNA, 14 nt, Pseudomonas aeruginosa PA01
ggcggcaggccagc

SEQ ID NO: 3403304 - RNA, 12 nt, Pseudomonas aeruginosa PA01
ggcggcaggcgc

SEQ ID NO: 3403305 - RNA, 13 nt, Pseudomonas aeruginosa PA01
ggcggcaggcgcc

SEQ ID NO: 3403306 - RNA, 16 nt, Pseudomonas aeruginosa PA01
ggcggcaggcgccggc

SEQ ID NO: 3403307 - RNA, 12 nt, Pseudomonas aeruginosa PA01
ggcggcaggcug

SEQ ID NO: 3403308 - RNA, 14 nt, Pseudomonas aeruginosa PA01
ggcggcaggcugcg

SEQ ID NO: 3403309 - RNA, 17 nt, Pseudomonas aeruginosa PA01
ggcggcaggcugcgccg

SEQ ID NO: 3403310 - RNA, 18 nt, Pseudomonas aeruginosa PA01
ggcggcauaggcccggcg

SEQ ID NO: 3403311 - RNA, 16 nt, Pseudomonas aeruginosa PA01
ggcggcaucaguagcg

SEQ ID NO: 3403312 - RNA, 17 nt, Pseudomonas aeruginosa PA01
ggcggcaucgcguaggg

SEQ ID NO: 3403313 - RNA, 15 nt, Pseudomonas aeruginosa PA01
ggcggcaugccguug

SEQ ID NO: 3403314 - RNA, 19 nt, Pseudomonas aeruginosa PA01
ggcggcauugagcgccagc

SEQ ID NO: 3403315 - RNA, 20 nt, Pseudomonas aeruginosa PA01
ggcggcauugagggcgagga

SEQ ID NO: 3403316 - RNA, 23 nt, Pseudomonas aeruginosa PA01
ggcggccaaccucuccccagacc

SEQ ID NO: 3403317 - RNA, 12 nt, Pseudomonas aeruginosa PA01
ggcggccaccac

SEQ ID NO: 3403318 - RNA, 24 nt, Pseudomonas aeruginosa PA01
ggcggccacccgaagguguccgcc

SEQ ID NO: 3403319 - RNA, 14 nt, Pseudomonas aeruginosa PA01
ggcggccagcagca

SEQ ID NO: 3403320 - RNA, 18 nt, Pseudomonas aeruginosa PA01
ggcggcgcucagucgagc

SEQ ID NO: 3403321 - RNA, 15 nt, Pseudomonas aeruginosa PA01
ggcggcgcugugggu

SEQ ID NO: 3403322 - RNA, 20 nt, Pseudomonas aeruginosa PA01
ggcggcgcuguuugcggcgc

SEQ ID NO: 3403323 - RNA, 22 nt, Pseudomonas aeruginosa PA01
ggcggcgcuguuugcggcgcag

SEQ ID NO: 3403324 - RNA, 13 nt, Pseudomonas aeruginosa PA01
ggcggcggaagaa

SEQ ID NO: 3403325 - RNA, 19 nt, Pseudomonas aeruginosa PA01
ggcggcggaagaagcccuu

SEQ ID NO: 3403326 - RNA, 18 nt, Pseudomonas aeruginosa PA01
ggcggcggaccuccgcca

SEQ ID NO: 3403327 - RNA, 15 nt, Pseudomonas aeruginosa PA01
ggcggcggacgacga

SEQ ID NO: 3403328 - RNA, 18 nt, Pseudomonas aeruginosa PA01
ggcggcggacgcaggccg

SEQ ID NO: 3403329 - RNA, 20 nt, Pseudomonas aeruginosa PA01
ggcggcggauaaccgcgagc

SEQ ID NO: 3403330 - RNA, 18 nt, Pseudomonas aeruginosa PA01
ggcggcggauaacgccug

SEQ ID NO: 3403331 - RNA, 12 nt, Pseudomonas aeruginosa PA01
ggcggcggcacc

SEQ ID NO: 3403332 - RNA, 11 nt, Pseudomonas aeruginosa PA01
ggcggcggccc

SEQ ID NO: 3403333 - RNA, 13 nt, Pseudomonas aeruginosa PA01
ggcggcggccgca

SEQ ID NO: 3403334 - RNA, 14 nt, Pseudomonas aeruginosa PA01
ggcggcggccgcau

SEQ ID NO: 3403335 - RNA, 14 nt, Pseudomonas aeruginosa PA01
ggcggcggccugcu

SEQ ID NO: 3403336 - RNA, 16 nt, Pseudomonas aeruginosa PA01
ggcggcggccugcucg

SEQ ID NO: 3403337 - RNA, 13 nt, Pseudomonas aeruginosa PA01
ggcggcggcgagu

SEQ ID NO: 3403338 - RNA, 13 nt, Pseudomonas aeruginosa PA01
ggcggcggcgauc

SEQ ID NO: 3403339 - RNA, 14 nt, Pseudomonas aeruginosa PA01
ggcggcggcgcggg

SEQ ID NO: 3403340 - RNA, 17 nt, Pseudomonas aeruginosa PA01
ggcggcggcggaccucc

SEQ ID NO: 3403341 - RNA, 16 nt, Pseudomonas aeruginosa PA01
ggcggcggcguuggcc

SEQ ID NO: 3403342 - RNA, 15 nt, Pseudomonas aeruginosa PA01
ggcggcggcucaggc

SEQ ID NO: 3403343 - RNA, 18 nt, Pseudomonas aeruginosa PA01
ggcggcggcucaggccgc

SEQ ID NO: 3403344 - RNA, 13 nt, Pseudomonas aeruginosa PA01
ggcggcgggacug

SEQ ID NO: 3403345 - RNA, 15 nt, Pseudomonas aeruginosa PA01
ggcggcgggccggcg

SEQ ID NO: 3403346 - RNA, 21 nt, Pseudomonas aeruginosa PA01
ggcggcgggccggcguccagg

SEQ ID NO: 3403347 - RNA, 17 nt, Pseudomonas aeruginosa PA01
ggcggcggggaaggcgu

SEQ ID NO: 3403348 - RNA, 17 nt, Pseudomonas aeruginosa PA01
ggcggcgguagccgagg

SEQ ID NO: 3403349 - RNA, 17 nt, Pseudomonas aeruginosa PA01
ggcggcggucaucgcgc

SEQ ID NO: 3403350 - RNA, 17 nt, Pseudomonas aeruginosa PA01
ggcggcguauucgccga

SEQ ID NO: 3403351 - RNA, 18 nt, Pseudomonas aeruginosa PA01
ggcggcgucccggcgccg

SEQ ID NO: 3403352 - RNA, 21 nt, Pseudomonas aeruginosa PA01
ggcggcgucccggcgccgccc

SEQ ID NO: 3403353 - RNA, 16 nt, Pseudomonas aeruginosa PA01
ggcggcgugcaggccg

SEQ ID NO: 3403354 - RNA, 18 nt, Pseudomonas aeruginosa PA01
ggcggcgugcaggccgau

SEQ ID NO: 3403355 - RNA, 16 nt, Pseudomonas aeruginosa PA01
ggcggcgugcagggua

SEQ ID NO: 3403356 - RNA, 20 nt, Pseudomonas aeruginosa PA01
ggcggcguggcucgaucagc

SEQ ID NO: 3403357 - RNA, 14 nt, Pseudomonas aeruginosa PA01
ggcggcguuggccg

SEQ ID NO: 3403358 - RNA, 16 nt, Pseudomonas aeruginosa PA01
ggcggcguuggccgag

SEQ ID NO: 3403359 - RNA, 17 nt, Pseudomonas aeruginosa PA01
ggcggcguuggccgagg

SEQ ID NO: 3403360 - RNA, 18 nt, Pseudomonas aeruginosa PA01
ggcggcguuggccgagga

SEQ ID NO: 3403361 - RNA, 16 nt, Pseudomonas aeruginosa PA01
ggcggcuaccagcgcu

SEQ ID NO: 3403362 - RNA, 17 nt, Pseudomonas aeruginosa PA01
ggcggcucaacgggacc

SEQ ID NO: 3403363 - RNA, 15 nt, Pseudomonas aeruginosa PA01
ggcggcucaggccgc

SEQ ID NO: 3403364 - RNA, 16 nt, Pseudomonas aeruginosa PA01
ggcggcuccggcgcca

SEQ ID NO: 3403365 - RNA, 19 nt, Pseudomonas aeruginosa PA01
ggcggcuccggcgccaggc

SEQ ID NO: 3403366 - RNA, 21 nt, Pseudomonas aeruginosa PA01
ggcggcuccggcgccaggccg

SEQ ID NO: 3403367 - RNA, 16 nt, Pseudomonas aeruginosa PA01
ggcggcugcugcgccu

SEQ ID NO: 3403368 - RNA, 18 nt, Pseudomonas aeruginosa PA01
ggcggcugcugcgccugg

SEQ ID NO: 3403369 - RNA, 15 nt, Pseudomonas aeruginosa PA01
ggcggcuggccgagg

SEQ ID NO: 3403370 - RNA, 18 nt, Pseudomonas aeruginosa PA01
ggcggcuggccgaggacc

SEQ ID NO: 3403371 - RNA, 14 nt, Pseudomonas aeruginosa PA01
ggcggcuggcgcga

SEQ ID NO: 3403372 - RNA, 23 nt, Pseudomonas aeruginosa PA01
ggcggcugguucugguccaccag

SEQ ID NO: 3403373 - RNA, 17 nt, Pseudomonas aeruginosa PA01
ggcggcuucagccagac

SEQ ID NO: 3403374 - RNA, 22 nt, Pseudomonas aeruginosa PA01
ggcggcuucagccagaccggca

SEQ ID NO: 3403375 - RNA, 20 nt, Pseudomonas aeruginosa PA01
ggcggcuuccuccaucgccu

SEQ ID NO: 3403376 - RNA, 13 nt, Pseudomonas aeruginosa PA01
ggcggcuucgcgc

SEQ ID NO: 3403377 - RNA, 15 nt, Pseudomonas aeruginosa PA01
ggcgggaaacgcagc

SEQ ID NO: 3403378 - RNA, 15 nt, Pseudomonas aeruginosa PA01
ggcgggacgcgcaug

SEQ ID NO: 3403379 - RNA, 14 nt, Pseudomonas aeruginosa PA01
ggcgggacggcgca

SEQ ID NO: 3403380 - RNA, 13 nt, Pseudomonas aeruginosa PA01
ggcgggagcggcc

SEQ ID NO: 3403381 - RNA, 15 nt, Pseudomonas aeruginosa PA01
ggcgggagcggccug

SEQ ID NO: 3403382 - RNA, 18 nt, Pseudomonas aeruginosa PA01
ggcgggaggcuacagccu

SEQ ID NO: 3403383 - RNA, 16 nt, Pseudomonas aeruginosa PA01
ggcgggaucaggucgc

SEQ ID NO: 3403384 - RNA, 21 nt, Pseudomonas aeruginosa PA01
ggcgggaucaggucgccagcg

SEQ ID NO: 3403385 - RNA, 16 nt, Pseudomonas aeruginosa PA01
ggcgggaucgacgccg

SEQ ID NO: 3403386 - RNA, 17 nt, Pseudomonas aeruginosa PA01
ggcgggaucgacgccgc

SEQ ID NO: 3403387 - RNA, 22 nt, Pseudomonas aeruginosa PA01
ggcgggaucgacgccgcuggcg

SEQ ID NO: 3403388 - RNA, 18 nt, Pseudomonas aeruginosa PA01
ggcgggaucuccgcgcca

SEQ ID NO: 3403389 - RNA, 16 nt, Pseudomonas aeruginosa PA01
ggcgggauugucgccg

SEQ ID NO: 3403390 - RNA, 16 nt, Pseudomonas aeruginosa PA01
ggcgggcaccgccagc

SEQ ID NO: 3403391 - RNA, 20 nt, Pseudomonas aeruginosa PA01
ggcgggcaccgccagcccgc

SEQ ID NO: 3403392 - RNA, 13 nt, Pseudomonas aeruginosa PA01
ggcgggccagcag

SEQ ID NO: 3403393 - RNA, 16 nt, Pseudomonas aeruginosa PA01
ggcgggccagcaggcg

SEQ ID NO: 3403394 - RNA, 21 nt, Pseudomonas aeruginosa PA01
ggcgggccagcaggcgcucgg

SEQ ID NO: 3403395 - RNA, 15 nt, Pseudomonas aeruginosa PA01
ggcgggccagcaggg

SEQ ID NO: 3403396 - RNA, 18 nt, Pseudomonas aeruginosa PA01
ggcgggccagcagggugg

SEQ ID NO: 3403397 - RNA, 14 nt, Pseudomonas aeruginosa PA01
ggcgggccagcugg

SEQ ID NO: 3403398 - RNA, 12 nt, Pseudomonas aeruginosa PA01
ggcgggccaugc

SEQ ID NO: 3403399 - RNA, 17 nt, Pseudomonas aeruginosa PA01
ggcgggccaugcgcucg

SEQ ID NO: 3403400 - RNA, 15 nt, Pseudomonas aeruginosa PA01
ggcgggccauugcag

SEQ ID NO: 3403401 - RNA, 15 nt, Pseudomonas aeruginosa PA01
ggcgggccgcgccuu

SEQ ID NO: 3403402 - RNA, 15 nt, Pseudomonas aeruginosa PA01
ggcgggccgcucgcg

SEQ ID NO: 3403403 - RNA, 22 nt, Pseudomonas aeruginosa PA01
ggcgggccgcucgcgcggcacc

SEQ ID NO: 3403404 - RNA, 15 nt, Pseudomonas aeruginosa PA01
ggcgggccggcgucc

SEQ ID NO: 3403405 - RNA, 16 nt, Pseudomonas aeruginosa PA01
ggcgggccggcgucca

SEQ ID NO: 3403406 - RNA, 21 nt, Pseudomonas aeruginosa PA01
ggcgggccuggugagcggaac

SEQ ID NO: 3403407 - RNA, 12 nt, Pseudomonas aeruginosa PA01
ggcgggccuugc

SEQ ID NO: 3403408 - RNA, 16 nt, Pseudomonas aeruginosa PA01
ggcgggccuugcgacc

SEQ ID NO: 3403409 - RNA, 18 nt, Pseudomonas aeruginosa PA01
ggcgggccuugcgaccag

SEQ ID NO: 3403410 - RNA, 20 nt, Pseudomonas aeruginosa PA01
ggcgggcgaaguagaagcgc

SEQ ID NO: 3403411 - RNA, 16 nt, Pseudomonas aeruginosa PA01
ggcgggcgaccggaug

SEQ ID NO: 3403412 - RNA, 16 nt, Pseudomonas aeruginosa PA01
ggcgggcgccaucgcu

SEQ ID NO: 3403413 - RNA, 19 nt, Pseudomonas aeruginosa PA01
ggcgggcgguagcgggcca

SEQ ID NO: 3403414 - RNA, 16 nt, Pseudomonas aeruginosa PA01
ggcgggcgucgucggg

SEQ ID NO: 3403415 - RNA, 20 nt, Pseudomonas aeruginosa PA01
ggcgggcguuuucguuggcg

SEQ ID NO: 3403416 - RNA, 14 nt, Pseudomonas aeruginosa PA01
ggcgggcuccgccg

SEQ ID NO: 3403417 - RNA, 16 nt, Pseudomonas aeruginosa PA01
ggcgggcuccgccgcc

SEQ ID NO: 3403418 - RNA, 12 nt, Pseudomonas aeruginosa PA01
ggcgggcugccg

SEQ ID NO: 3403419 - RNA, 13 nt, Pseudomonas aeruginosa PA01
ggcgggcugccgc

SEQ ID NO: 3403420 - RNA, 14 nt, Pseudomonas aeruginosa PA01
ggcgggcugccgcg

SEQ ID NO: 3403421 - RNA, 17 nt, Pseudomonas aeruginosa PA01
ggcgggcugccgcggaa

SEQ ID NO: 3403422 - RNA, 19 nt, Pseudomonas aeruginosa PA01
ggcgggcuggaaaacgcca

SEQ ID NO: 3403423 - RNA, 14 nt, Pseudomonas aeruginosa PA01
ggcggggaacagca

SEQ ID NO: 3403424 - RNA, 13 nt, Pseudomonas aeruginosa PA01
ggcguaccagccg

SEQ ID NO: 3403425 - RNA, 15 nt, Pseudomonas aeruginosa PA01
ggcguaccagccgcg

SEQ ID NO: 3403426 - RNA, 18 nt, Pseudomonas aeruginosa PA01
ggcguaccagccgcgguc

SEQ ID NO: 3403427 - RNA, 20 nt, Pseudomonas aeruginosa PA01
ggcguaccagccgcggucca

SEQ ID NO: 3403428 - RNA, 14 nt, Pseudomonas aeruginosa PA01
ggcguaccagcuug

SEQ ID NO: 3403429 - RNA, 16 nt, Pseudomonas aeruginosa PA01
ggcguaccucgccagg

SEQ ID NO: 3403430 - RNA, 21 nt, Pseudomonas aeruginosa PA01
ggcguacgaaccccgggccgc

SEQ ID NO: 3403431 - RNA, 19 nt, Pseudomonas aeruginosa PA01
ggcguacuucggcgcggug

SEQ ID NO: 3403432 - RNA, 23 nt, Pseudomonas aeruginosa PA01
ggcguagaaacgcgccuccggca

SEQ ID NO: 3403433 - RNA, 20 nt, Pseudomonas aeruginosa PA01
ggcguagaccuugcggccgu

SEQ ID NO: 3403434 - RNA, 14 nt, Pseudomonas aeruginosa PA01
ggcguagagccugg

SEQ ID NO: 3403435 - RNA, 20 nt, Pseudomonas aeruginosa PA01
ggcguagccggccagggcgc

SEQ ID NO: 3403436 - RNA, 16 nt, Pseudomonas aeruginosa PA01
ggcguagccggcgauc

SEQ ID NO: 3403437 - RNA, 23 nt, Pseudomonas aeruginosa PA01
ggcguagccggcgauccgcugca

SEQ ID NO: 3403438 - RNA, 14 nt, Pseudomonas aeruginosa PA01
ggcguagccuuccu

SEQ ID NO: 3403439 - RNA, 23 nt, Pseudomonas aeruginosa PA01
ggcguagccuuccuucucgaagc

SEQ ID NO: 3403440 - RNA, 16 nt, Pseudomonas aeruginosa PA01
ggcguagcgcaggguc

SEQ ID NO: 3403441 - RNA, 20 nt, Pseudomonas aeruginosa PA01
ggcguagcgcggcagcgcca

SEQ ID NO: 3403442 - RNA, 21 nt, Pseudomonas aeruginosa PA01
ggcguagcggaagccgucggc

SEQ ID NO: 3403443 - RNA, 13 nt, Pseudomonas aeruginosa PA01
ggcguaggagucg

SEQ ID NO: 3403444 - RNA, 20 nt, Pseudomonas aeruginosa PA01
ggcguaggccgucgcugccg

SEQ ID NO: 3403445 - RNA, 12 nt, Pseudomonas aeruginosa PA01
ggcguaggccuc

SEQ ID NO: 3403446 - RNA, 20 nt, Pseudomonas aeruginosa PA01
ggcguaggccucggagucag

SEQ ID NO: 3403447 - RNA, 22 nt, Pseudomonas aeruginosa PA01
ggcguaggcgcgccaaggccgc

SEQ ID NO: 3403448 - RNA, 14 nt, Pseudomonas aeruginosa PA01
ggcguaggcgucgc

SEQ ID NO: 3403449 - RNA, 20 nt, Pseudomonas aeruginosa PA01
ggcguaguagggacggugca

SEQ ID NO: 3403450 - RNA, 15 nt, Pseudomonas aeruginosa PA01
ggcguagugcaucag

SEQ ID NO: 3403451 - RNA, 18 nt, Pseudomonas aeruginosa PA01
ggcguagugcaucagccu

SEQ ID NO: 3403452 - RNA, 19 nt, Pseudomonas aeruginosa PA01
ggcguagugcuccucgucg

SEQ ID NO: 3403453 - RNA, 20 nt, Pseudomonas aeruginosa PA01
ggcguagugcuccucgucgu

SEQ ID NO: 3403454 - RNA, 21 nt, Pseudomonas aeruginosa PA01
ggcguagugcuggguggaggc

SEQ ID NO: 3403455 - RNA, 18 nt, Pseudomonas aeruginosa PA01
ggcguauaaccgcucgcg

SEQ ID NO: 3403456 - RNA, 14 nt, Pseudomonas aeruginosa PA01
ggcguauccucggc

SEQ ID NO: 3403457 - RNA, 14 nt, Pseudomonas aeruginosa PA01
ggcguauucggcga

SEQ ID NO: 3403458 - RNA, 15 nt, Pseudomonas aeruginosa PA01
ggcguauucggcgac

SEQ ID NO: 3403459 - RNA, 13 nt, Pseudomonas aeruginosa PA01
ggcgucaacgaag

SEQ ID NO: 3403460 - RNA, 15 nt, Pseudomonas aeruginosa PA01
ggcgucacgccgauc

SEQ ID NO: 3403461 - RNA, 13 nt, Pseudomonas aeruginosa PA01
ggcgucaguuccg

SEQ ID NO: 3403462 - RNA, 23 nt, Pseudomonas aeruginosa PA01
ggcgucaguuccgcaucggccac

SEQ ID NO: 3403463 - RNA, 18 nt, Pseudomonas aeruginosa PA01
ggcgucauagcagcgccg

SEQ ID NO: 3403464 - RNA, 15 nt, Pseudomonas aeruginosa PA01
ggcguccaccgcuuc

SEQ ID NO: 3403465 - RNA, 19 nt, Pseudomonas aeruginosa PA01
ggcguccaccggcgcccac

SEQ ID NO: 3403466 - RNA, 20 nt, Pseudomonas aeruginosa PA01
ggcguccacuccggcagcac

SEQ ID NO: 3403467 - RNA, 12 nt, Pseudomonas aeruginosa PA01
ggcguccagcag

SEQ ID NO: 3403468 - RNA, 13 nt, Pseudomonas aeruginosa PA01
ggcguccagggcu

SEQ ID NO: 3403469 - RNA, 19 nt, Pseudomonas aeruginosa PA01
ggcguccaguagcgccugg

SEQ ID NO: 3403470 - RNA, 16 nt, Pseudomonas aeruginosa PA01
ggcguccauggcggcg

SEQ ID NO: 3403471 - RNA, 19 nt, Pseudomonas aeruginosa PA01
ggcgucccauggcgccacg

SEQ ID NO: 3403472 - RNA, 20 nt, Pseudomonas aeruginosa PA01
ggcgucccauggcgccacgc

SEQ ID NO: 3403473 - RNA, 21 nt, Pseudomonas aeruginosa PA01
ggcguccccaugcccggccug

SEQ ID NO: 3403474 - RNA, 22 nt, Pseudomonas aeruginosa PA01
ggcguccccaugcccggccugg

SEQ ID NO: 3403475 - RNA, 24 nt, Pseudomonas aeruginosa PA01
ggcguccccaugcccggccuggcg

SEQ ID NO: 3403476 - RNA, 15 nt, Pseudomonas aeruginosa PA01
ggcguccccuuccuc

SEQ ID NO: 3403477 - RNA, 14 nt, Pseudomonas aeruginosa PA01
ggcgucccgcagua

SEQ ID NO: 3403478 - RNA, 23 nt, Pseudomonas aeruginosa PA01
ggcgucccgcaguagcucgccga

SEQ ID NO: 3403479 - RNA, 20 nt, Pseudomonas aeruginosa PA01
ggcgucccggcgccgcccuu

SEQ ID NO: 3403480 - RNA, 15 nt, Pseudomonas aeruginosa PA01
ggcgucccuggagca

SEQ ID NO: 3403481 - RNA, 16 nt, Pseudomonas aeruginosa PA01
ggcgucccuggagcag

SEQ ID NO: 3403482 - RNA, 17 nt, Pseudomonas aeruginosa PA01
ggcguccgccucgcuga

SEQ ID NO: 3403483 - RNA, 15 nt, Pseudomonas aeruginosa PA01
ggcguccgcggccug

SEQ ID NO: 3403484 - RNA, 19 nt, Pseudomonas aeruginosa PA01
ggcguccgcggccugcucg

SEQ ID NO: 3403485 - RNA, 15 nt, Pseudomonas aeruginosa PA01
ggcguccggcgagca

SEQ ID NO: 3403486 - RNA, 15 nt, Pseudomonas aeruginosa PA01
ggcguccgggugccc

SEQ ID NO: 3403487 - RNA, 22 nt, Pseudomonas aeruginosa PA01
ggcguccgguugcuggcacagg

SEQ ID NO: 3403488 - RNA, 14 nt, Pseudomonas aeruginosa PA01
ggcguccucggaga

SEQ ID NO: 3403489 - RNA, 14 nt, Pseudomonas aeruginosa PA01
ggcguccuggucga

SEQ ID NO: 3403490 - RNA, 16 nt, Pseudomonas aeruginosa PA01
ggcguccuugcccggc

SEQ ID NO: 3403491 - RNA, 20 nt, Pseudomonas aeruginosa PA01
ggcguccuugcccggcgcca

SEQ ID NO: 3403492 - RNA, 16 nt, Pseudomonas aeruginosa PA01
ggcguccuugccgagg

SEQ ID NO: 3403493 - RNA, 18 nt, Pseudomonas aeruginosa PA01
ggcguccuugccgaggaa

SEQ ID NO: 3403494 - RNA, 20 nt, Pseudomonas aeruginosa PA01
ggcgucgaaacgggcgcucu

SEQ ID NO: 3403495 - RNA, 20 nt, Pseudomonas aeruginosa PA01
ggcgucgaaaugcucgugca

SEQ ID NO: 3403496 - RNA, 14 nt, Pseudomonas aeruginosa PA01
ggcgucgaacaccg

SEQ ID NO: 3403497 - RNA, 19 nt, Pseudomonas aeruginosa PA01
ggcgucgaacaccggcgcc

SEQ ID NO: 3403498 - RNA, 21 nt, Pseudomonas aeruginosa PA01
ggcgucgaacaccggcgccgc

SEQ ID NO: 3403499 - RNA, 15 nt, Pseudomonas aeruginosa PA01
ggcgucgaacagcga

SEQ ID NO: 3403500 - RNA, 15 nt, Pseudomonas aeruginosa PA01
ggcgucgaaggcggc

SEQ ID NO: 3403501 - RNA, 17 nt, Pseudomonas aeruginosa PA01
ggcgucgaaggcggcgc

SEQ ID NO: 3403502 - RNA, 17 nt, Pseudomonas aeruginosa PA01
ggcgucgaccacggccu

SEQ ID NO: 3403503 - RNA, 18 nt, Pseudomonas aeruginosa PA01
ggcgucgaccacggccuu

SEQ ID NO: 3403504 - RNA, 16 nt, Pseudomonas aeruginosa PA01
ggcgucgaccgccugc

SEQ ID NO: 3403505 - RNA, 20 nt, Pseudomonas aeruginosa PA01
ggcgucgaggugcggcugcc

SEQ ID NO: 3403506 - RNA, 21 nt, Pseudomonas aeruginosa PA01
ggcgucgaucccgaucgccaa

SEQ ID NO: 3403507 - RNA, 22 nt, Pseudomonas aeruginosa PA01
ggcgucgaucccgaucgccaau

SEQ ID NO: 3403508 - RNA, 22 nt, Pseudomonas aeruginosa PA01
ggcgucgaugucgaacaacccg

SEQ ID NO: 3403509 - RNA, 16 nt, Pseudomonas aeruginosa PA01
ggcgucgcacugcugc

SEQ ID NO: 3403510 - RNA, 18 nt, Pseudomonas aeruginosa PA01
ggcgucgcacugcugcuu

SEQ ID NO: 3403511 - RNA, 13 nt, Pseudomonas aeruginosa PA01
ggcgucgcccucg

SEQ ID NO: 3403512 - RNA, 16 nt, Pseudomonas aeruginosa PA01
ggcgucgcccucggcg

SEQ ID NO: 3403513 - RNA, 18 nt, Pseudomonas aeruginosa PA01
ggcgucgcccucggcgcu

SEQ ID NO: 3403514 - RNA, 12 nt, Pseudomonas aeruginosa PA01
ggcgucgccgac

SEQ ID NO: 3403515 - RNA, 11 nt, Pseudomonas aeruginosa PA01
ggcgucgccgg

SEQ ID NO: 3403516 - RNA, 15 nt, Pseudomonas aeruginosa PA01
ggcgucgccgucguc

SEQ ID NO: 3403517 - RNA, 13 nt, Pseudomonas aeruginosa PA01
ggcgucgcgcagg

SEQ ID NO: 3403518 - RNA, 15 nt, Pseudomonas aeruginosa PA01
ggcgucgcgccagca

SEQ ID NO: 3403519 - RNA, 22 nt, Pseudomonas aeruginosa PA01
ggcgucgcgccagcaccguggu

SEQ ID NO: 3403520 - RNA, 16 nt, Pseudomonas aeruginosa PA01
ggcgucgcgcuugccu

SEQ ID NO: 3403521 - RNA, 19 nt, Pseudomonas aeruginosa PA01
ggcgucgcugccgcugacg

SEQ ID NO: 3403522 - RNA, 21 nt, Pseudomonas aeruginosa PA01
ggcgucgcuguagcggcucgc

SEQ ID NO: 3403523 - RNA, 23 nt, Pseudomonas aeruginosa PA01
ggcgucggagagauagucgccgu

SEQ ID NO: 3403524 - RNA, 13 nt, Pseudomonas aeruginosa PA01
ggcgucggcaugg

SEQ ID NO: 3403525 - RNA, 13 nt, Pseudomonas aeruginosa PA01
ggcgucggcgauc

SEQ ID NO: 3403526 - RNA, 17 nt, Pseudomonas aeruginosa PA01
ggcguuauccgccgccg

SEQ ID NO: 3403527 - RNA, 20 nt, Pseudomonas aeruginosa PA01
ggcguuauccgccgccgacg

SEQ ID NO: 3403528 - RNA, 21 nt, Pseudomonas aeruginosa PA01
ggcguuauccgccgccgacgu

SEQ ID NO: 3403529 - RNA, 15 nt, Pseudomonas aeruginosa PA01
ggcguucaccgcgca

SEQ ID NO: 3403530 - RNA, 14 nt, Pseudomonas aeruginosa PA01
ggcguuccaccagg

SEQ ID NO: 3403531 - RNA, 19 nt, Pseudomonas aeruginosa PA01
ggcguuccaccaggcgucg

SEQ ID NO: 3403532 - RNA, 20 nt, Pseudomonas aeruginosa PA01
ggcguuccaccaggcgucgc

SEQ ID NO: 3403533 - RNA, 18 nt, Pseudomonas aeruginosa PA01
ggcguuccagcucggcga

SEQ ID NO: 3403534 - RNA, 20 nt, Pseudomonas aeruginosa PA01
ggcguuccagcucggcgagg

SEQ ID NO: 3403535 - RNA, 15 nt, Pseudomonas aeruginosa PA01
ggcguuccaggcggc

SEQ ID NO: 3403536 - RNA, 17 nt, Pseudomonas aeruginosa PA01
ggcguuccaggcggcgg

SEQ ID NO: 3403537 - RNA, 19 nt, Pseudomonas aeruginosa PA01
ggcguuccaguucggccgc

SEQ ID NO: 3403538 - RNA, 20 nt, Pseudomonas aeruginosa PA01
ggcguuccuuuuccucgauc

SEQ ID NO: 3403539 - RNA, 13 nt, Pseudomonas aeruginosa PA01
ggcguucgccgag

SEQ ID NO: 3403540 - RNA, 14 nt, Pseudomonas aeruginosa PA01
ggcguucgccgagc

SEQ ID NO: 3403541 - RNA, 15 nt, Pseudomonas aeruginosa PA01
ggcguucgccgagca

SEQ ID NO: 3403542 - RNA, 17 nt, Pseudomonas aeruginosa PA01
ggcguucgccgcgggcg

SEQ ID NO: 3403543 - RNA, 20 nt, Pseudomonas aeruginosa PA01
ggcguucgccuugcggggcg

SEQ ID NO: 3403544 - RNA, 14 nt, Pseudomonas aeruginosa PA01
ggcguucucggcca

SEQ ID NO: 3403545 - RNA, 16 nt, Pseudomonas aeruginosa PA01
ggcguucucggccagg

SEQ ID NO: 3403546 - RNA, 20 nt, Pseudomonas aeruginosa PA01
ggcguucucguccucggcgu

SEQ ID NO: 3403547 - RNA, 20 nt, Pseudomonas aeruginosa PA01
ggcguucugcuucucggcua

SEQ ID NO: 3403548 - RNA, 23 nt, Pseudomonas aeruginosa PA01
ggcguucuucacccgcagcggca

SEQ ID NO: 3403549 - RNA, 20 nt, Pseudomonas aeruginosa PA01
ggcguugaacugcccgcagg

SEQ ID NO: 3403550 - RNA, 22 nt, Pseudomonas aeruginosa PA01
ggcguugcagugcgccgcagcg

SEQ ID NO: 3403551 - RNA, 15 nt, Pseudomonas aeruginosa PA01
ggcguugcccaugau

SEQ ID NO: 3403552 - RNA, 14 nt, Pseudomonas aeruginosa PA01
ggcguugccggcau

SEQ ID NO: 3403553 - RNA, 14 nt, Pseudomonas aeruginosa PA01
ggcguugcgcgccu

SEQ ID NO: 3403554 - RNA, 13 nt, Pseudomonas aeruginosa PA01
ggcguuggccagc

SEQ ID NO: 3403555 - RNA, 16 nt, Pseudomonas aeruginosa PA01
ggcguuggccagcgcc

SEQ ID NO: 3403556 - RNA, 19 nt, Pseudomonas aeruginosa PA01
ggcguuggcgucgcugccg

SEQ ID NO: 3403557 - RNA, 19 nt, Pseudomonas aeruginosa PA01
ggcguuggcuccgggccga

SEQ ID NO: 3403558 - RNA, 19 nt, Pseudomonas aeruginosa PA01
ggcguugguacagcucgcg

SEQ ID NO: 3403559 - RNA, 17 nt, Pseudomonas aeruginosa PA01
ggcguuguccaggcugu

SEQ ID NO: 3403560 - RNA, 20 nt, Pseudomonas aeruginosa PA01
ggcguugucggcaaccgggc

SEQ ID NO: 3403561 - RNA, 21 nt, Pseudomonas aeruginosa PA01
ggcguugucggcaaccgggcg

SEQ ID NO: 3403562 - RNA, 20 nt, Pseudomonas aeruginosa PA01
ggcguugucggccagcagca

SEQ ID NO: 3403563 - RNA, 16 nt, Pseudomonas aeruginosa PA01
ggcguuguugccgccg

SEQ ID NO: 3403564 - RNA, 16 nt, Pseudomonas aeruginosa PA01
ggcguuucgccgggcc

SEQ ID NO: 3403565 - RNA, 19 nt, Pseudomonas aeruginosa PA01
ggcguuugcgucauccgcc

SEQ ID NO: 3403566 - RNA, 22 nt, Pseudomonas aeruginosa PA01
ggcguuuucguugccgcgcucg

SEQ ID NO: 3403567 - RNA, 19 nt, Pseudomonas aeruginosa PA01
ggcguuuucguuggcgcga

SEQ ID NO: 3403568 - RNA, 23 nt, Pseudomonas aeruginosa PA01
ggcguuuucguuggcgcgaccgc

SEQ ID NO: 3403569 - RNA, 19 nt, Pseudomonas aeruginosa PA01
ggcguuuucguuggcggcc

SEQ ID NO: 3403570 - RNA, 20 nt, Pseudomonas aeruginosa PA01
ggcguuuucguuggcggcca

SEQ ID NO: 3403571 - RNA, 22 nt, Pseudomonas aeruginosa PA01
ggcguuuuucauugggcagcca

SEQ ID NO: 3403572 - RNA, 22 nt, Pseudomonas aeruginosa PA01
ggcguuuuuucuuuccagcgcc

SEQ ID NO: 3403573 - RNA, 13 nt, Pseudomonas aeruginosa PA01
ggcuaaccgccuu

SEQ ID NO: 3403574 - RNA, 17 nt, Pseudomonas aeruginosa PA01
ggcuaaccgcgaagcgg

SEQ ID NO: 3403575 - RNA, 14 nt, Pseudomonas aeruginosa PA01
ggcuaacuguucgg

SEQ ID NO: 3403576 - RNA, 13 nt, Pseudomonas aeruginosa PA01
ggcuacaggccgu

SEQ ID NO: 3403577 - RNA, 21 nt, Pseudomonas aeruginosa PA01
ggcuacaucgucugcgcggcg

SEQ ID NO: 3403578 - RNA, 20 nt, Pseudomonas aeruginosa PA01
ggcuaccaggaagcucggca

SEQ ID NO: 3403579 - RNA, 22 nt, Pseudomonas aeruginosa PA01
ggcuaccaggaagcucggcagc

SEQ ID NO: 3403580 - RNA, 17 nt, Pseudomonas aeruginosa PA01
ggcuacccgcagggcuc

SEQ ID NO: 3403581 - RNA, 15 nt, Pseudomonas aeruginosa PA01
ggcuacccgcgccuu

SEQ ID NO: 3403582 - RNA, 18 nt, Pseudomonas aeruginosa PA01
ggcuacgcuccguagggc

SEQ ID NO: 3403583 - RNA, 16 nt, Pseudomonas aeruginosa PA01
ggcuagguuuccccgu

SEQ ID NO: 3403584 - RNA, 17 nt, Pseudomonas aeruginosa PA01
ggcuagucgcgcagcgc

SEQ ID NO: 3403585 - RNA, 19 nt, Pseudomonas aeruginosa PA01
ggcuagucgcgcagcgccu

SEQ ID NO: 3403586 - RNA, 19 nt, Pseudomonas aeruginosa PA01
ggcuaucaggugagggcga

SEQ ID NO: 3403587 - RNA, 18 nt, Pseudomonas aeruginosa PA01
ggcuaucccccggccgau

SEQ ID NO: 3403588 - RNA, 18 nt, Pseudomonas aeruginosa PA01
ggcuauccuccaggccgc

SEQ ID NO: 3403589 - RNA, 20 nt, Pseudomonas aeruginosa PA01
ggcuauccuccaggccgccg

SEQ ID NO: 3403590 - RNA, 24 nt, Pseudomonas aeruginosa PA01
ggcuauccuccaggccgccggcga

SEQ ID NO: 3403591 - RNA, 14 nt, Pseudomonas aeruginosa PA01
ggcuauucccgccg

SEQ ID NO: 3403592 - RNA, 22 nt, Pseudomonas aeruginosa PA01
ggcuauucccgccgcuccggcu

SEQ ID NO: 3403593 - RNA, 18 nt, Pseudomonas aeruginosa PA01
ggcucaacugguccugag

SEQ ID NO: 3403594 - RNA, 19 nt, Pseudomonas aeruginosa PA01
ggcucaacugguccugagg

SEQ ID NO: 3403595 - RNA, 20 nt, Pseudomonas aeruginosa PA01
ggcucaacugguuggccgcc

SEQ ID NO: 3403596 - RNA, 22 nt, Pseudomonas aeruginosa PA01
ggcucaacugguuggccgccug

SEQ ID NO: 3403597 - RNA, 15 nt, Pseudomonas aeruginosa PA01
ggcucaauccggcug

SEQ ID NO: 3403598 - RNA, 15 nt, Pseudomonas aeruginosa PA01
ggcucacacgccgug

SEQ ID NO: 3403599 - RNA, 17 nt, Pseudomonas aeruginosa PA01
ggcucaccgagaaccag

SEQ ID NO: 3403600 - RNA, 21 nt, Pseudomonas aeruginosa PA01
ggcucaccgcguaauaggcga

SEQ ID NO: 3403601 - RNA, 17 nt, Pseudomonas aeruginosa PA01
ggcucagaaauccaccu

SEQ ID NO: 3403602 - RNA, 19 nt, Pseudomonas aeruginosa PA01
ggcucagaacagcggcagc

SEQ ID NO: 3403603 - RNA, 14 nt, Pseudomonas aeruginosa PA01
ggcucagaaguccc

SEQ ID NO: 3403604 - RNA, 21 nt, Pseudomonas aeruginosa PA01
ggcucagaagucccagcgagu

SEQ ID NO: 3403605 - RNA, 15 nt, Pseudomonas aeruginosa PA01
ggcucagcccaggcg

SEQ ID NO: 3403606 - RNA, 23 nt, Pseudomonas aeruginosa PA01
ggcucagccgaccaccuucaggc

SEQ ID NO: 3403607 - RNA, 12 nt, Pseudomonas aeruginosa PA01
ggcucagccgcu

SEQ ID NO: 3403608 - RNA, 13 nt, Pseudomonas aeruginosa PA01
ggcucagccgcug

SEQ ID NO: 3403609 - RNA, 22 nt, Pseudomonas aeruginosa PA01
ggcucagcgcaugcggaaggcu

SEQ ID NO: 3403610 - RNA, 19 nt, Pseudomonas aeruginosa PA01
ggcucagcgcggcggcggc

SEQ ID NO: 3403611 - RNA, 14 nt, Pseudomonas aeruginosa PA01
ggcucagcgcuucg

SEQ ID NO: 3403612 - RNA, 23 nt, Pseudomonas aeruginosa PA01
ggcucagcgcuucggcuccagca

SEQ ID NO: 3403613 - RNA, 16 nt, Pseudomonas aeruginosa PA01
ggcucagcucggcgau

SEQ ID NO: 3403614 - RNA, 18 nt, Pseudomonas aeruginosa PA01
ggcucaggcacucgauga

SEQ ID NO: 3403615 - RNA, 15 nt, Pseudomonas aeruginosa PA01
ggcucaggccgccgc

SEQ ID NO: 3403616 - RNA, 14 nt, Pseudomonas aeruginosa PA01
ggcucaggccgggc

SEQ ID NO: 3403617 - RNA, 16 nt, Pseudomonas aeruginosa PA01
ggcucaggccgggcac

SEQ ID NO: 3403618 - RNA, 15 nt, Pseudomonas aeruginosa PA01
ggcucaggcucuuug

SEQ ID NO: 3403619 - RNA, 16 nt, Pseudomonas aeruginosa PA01
ggcucaguucggccag

SEQ ID NO: 3403620 - RNA, 17 nt, Pseudomonas aeruginosa PA01
ggcucaguucggccagc

SEQ ID NO: 3403621 - RNA, 21 nt, Pseudomonas aeruginosa PA01
ggcucaguucggccagcggca

SEQ ID NO: 3403622 - RNA, 22 nt, Pseudomonas aeruginosa PA01
ggcucaguucggccagcggcag

SEQ ID NO: 3403623 - RNA, 13 nt, Pseudomonas aeruginosa PA01
ggcucaguugcug

SEQ ID NO: 3403624 - RNA, 23 nt, Pseudomonas aeruginosa PA01
ggcucaguugcugaucaggccga

SEQ ID NO: 3403625 - RNA, 13 nt, Pseudomonas aeruginosa PA01
ggcucaucgcccg

SEQ ID NO: 3403626 - RNA, 14 nt, Pseudomonas aeruginosa PA01
ggcucaucgcccgc

SEQ ID NO: 3403627 - RNA, 19 nt, Pseudomonas aeruginosa PA01
ggcucaucgcccgcccucg

SEQ ID NO: 3403628 - RNA, 15 nt, Pseudomonas aeruginosa PA01
ggcucugcuccagca

SEQ ID NO: 3403629 - RNA, 19 nt, Pseudomonas aeruginosa PA01
ggcucugguagccgcaguc

SEQ ID NO: 3403630 - RNA, 15 nt, Pseudomonas aeruginosa PA01
ggcucuguuccucgg

SEQ ID NO: 3403631 - RNA, 17 nt, Pseudomonas aeruginosa PA01
ggcucuguuccucggcg

SEQ ID NO: 3403632 - RNA, 20 nt, Pseudomonas aeruginosa PA01
ggcucuguuccucggcggcg

SEQ ID NO: 3403633 - RNA, 21 nt, Pseudomonas aeruginosa PA01
ggcucuguuccucggcggcgg

SEQ ID NO: 3403634 - RNA, 22 nt, Pseudomonas aeruginosa PA01
ggcucuguuccucggcggcggu

SEQ ID NO: 3403635 - RNA, 21 nt, Pseudomonas aeruginosa PA01
ggcucuucuucgaaccgcaga

SEQ ID NO: 3403636 - RNA, 19 nt, Pseudomonas aeruginosa PA01
ggcucuuuccgggucauug

SEQ ID NO: 3403637 - RNA, 20 nt, Pseudomonas aeruginosa PA01
ggcucuuuccgggucauugg

SEQ ID NO: 3403638 - RNA, 15 nt, Pseudomonas aeruginosa PA01
ggcugaacagcgcca

SEQ ID NO: 3403639 - RNA, 16 nt, Pseudomonas aeruginosa PA01
ggcugaacagcgccac

SEQ ID NO: 3403640 - RNA, 19 nt, Pseudomonas aeruginosa PA01
ggcugaagaagcugcccca

SEQ ID NO: 3403641 - RNA, 16 nt, Pseudomonas aeruginosa PA01
ggcugaagacccugca

SEQ ID NO: 3403642 - RNA, 17 nt, Pseudomonas aeruginosa PA01
ggcugaagcggccgccg

SEQ ID NO: 3403643 - RNA, 16 nt, Pseudomonas aeruginosa PA01
ggcugaaggccgaacg

SEQ ID NO: 3403644 - RNA, 19 nt, Pseudomonas aeruginosa PA01
ggcugaagugggucgccgu

SEQ ID NO: 3403645 - RNA, 22 nt, Pseudomonas aeruginosa PA01
ggcugaauaccacguggccggc

SEQ ID NO: 3403646 - RNA, 17 nt, Pseudomonas aeruginosa PA01
ggcugacccgcugcugg

SEQ ID NO: 3403647 - RNA, 16 nt, Pseudomonas aeruginosa PA01
ggcugacccgcugucc

SEQ ID NO: 3403648 - RNA, 18 nt, Pseudomonas aeruginosa PA01
ggcugacccgcuguccgc

SEQ ID NO: 3403649 - RNA, 17 nt, Pseudomonas aeruginosa PA01
ggcugacccggucgcug

SEQ ID NO: 3403650 - RNA, 13 nt, Pseudomonas aeruginosa PA01
ggcugaccgcgug

SEQ ID NO: 3403651 - RNA, 15 nt, Pseudomonas aeruginosa PA01
ggcugaccgcguggg

SEQ ID NO: 3403652 - RNA, 20 nt, Pseudomonas aeruginosa PA01
ggcugaccgcgugggccggc

SEQ ID NO: 3403653 - RNA, 14 nt, Pseudomonas aeruginosa PA01
ggcugacgcuggcg

SEQ ID NO: 3403654 - RNA, 15 nt, Pseudomonas aeruginosa PA01
ggcugacgcuggcga

SEQ ID NO: 3403655 - RNA, 22 nt, Pseudomonas aeruginosa PA01
ggcugacgcuggcgaaggcgcu

SEQ ID NO: 3403656 - RNA, 13 nt, Pseudomonas aeruginosa PA01
ggcugacgucgac

SEQ ID NO: 3403657 - RNA, 14 nt, Pseudomonas aeruginosa PA01
ggcugacgucgacg

SEQ ID NO: 3403658 - RNA, 17 nt, Pseudomonas aeruginosa PA01
ggcugacgucgacgcag

SEQ ID NO: 3403659 - RNA, 21 nt, Pseudomonas aeruginosa PA01
ggcugagacgcugccguucgc

SEQ ID NO: 3403660 - RNA, 14 nt, Pseudomonas aeruginosa PA01
ggcugagcgccagg

SEQ ID NO: 3403661 - RNA, 18 nt, Pseudomonas aeruginosa PA01
ggcugagcgccaggcgca

SEQ ID NO: 3403662 - RNA, 19 nt, Pseudomonas aeruginosa PA01
ggcugagcgccaggcgcaa

SEQ ID NO: 3403663 - RNA, 19 nt, Pseudomonas aeruginosa PA01
ggcugagcuguuucagccc

SEQ ID NO: 3403664 - RNA, 20 nt, Pseudomonas aeruginosa PA01
ggcugagcuguuucagccca

SEQ ID NO: 3403665 - RNA, 20 nt, Pseudomonas aeruginosa PA01
ggcugaggcguuccaguucg

SEQ ID NO: 3403666 - RNA, 17 nt, Pseudomonas aeruginosa PA01
ggcugaggcuggcgacc

SEQ ID NO: 3403667 - RNA, 23 nt, Pseudomonas aeruginosa PA01
ggcugaggucgcgggcgauggcc

SEQ ID NO: 3403668 - RNA, 15 nt, Pseudomonas aeruginosa PA01
ggcugaguucgucga

SEQ ID NO: 3403669 - RNA, 20 nt, Pseudomonas aeruginosa PA01
ggcugaguucgucgagcaug

SEQ ID NO: 3403670 - RNA, 13 nt, Pseudomonas aeruginosa PA01
ggcugaucagccc

SEQ ID NO: 3403671 - RNA, 18 nt, Pseudomonas aeruginosa PA01
ggcugaucagcccgcuga

SEQ ID NO: 3403672 - RNA, 16 nt, Pseudomonas aeruginosa PA01
ggcugaucggccgcca

SEQ ID NO: 3403673 - RNA, 17 nt, Pseudomonas aeruginosa PA01
ggcugaucggccgccag

SEQ ID NO: 3403674 - RNA, 21 nt, Pseudomonas aeruginosa PA01
ggcugaucggccgccagugca

SEQ ID NO: 3403675 - RNA, 14 nt, Pseudomonas aeruginosa PA01
ggcugaucugccgg

SEQ ID NO: 3403676 - RNA, 14 nt, Pseudomonas aeruginosa PA01
ggcugaucuugccg

SEQ ID NO: 3403677 - RNA, 21 nt, Pseudomonas aeruginosa PA01
ggcugaugcccgggucgucgg

SEQ ID NO: 3403678 - RNA, 13 nt, Pseudomonas aeruginosa PA01
ggcugaugccgcg

SEQ ID NO: 3403679 - RNA, 16 nt, Pseudomonas aeruginosa PA01
ggcugcaacgccgcgg

SEQ ID NO: 3403680 - RNA, 22 nt, Pseudomonas aeruginosa PA01
ggcugcaacuuccacucgccga

SEQ ID NO: 3403681 - RNA, 17 nt, Pseudomonas aeruginosa PA01
ggcugcagggccaggga

SEQ ID NO: 3403682 - RNA, 23 nt, Pseudomonas aeruginosa PA01
ggcugcagggccagggaggcgcu

SEQ ID NO: 3403683 - RNA, 14 nt, Pseudomonas aeruginosa PA01
ggcugcaucggcuc

SEQ ID NO: 3403684 - RNA, 17 nt, Pseudomonas aeruginosa PA01
ggcugccaccgagggca

SEQ ID NO: 3403685 - RNA, 22 nt, Pseudomonas aeruginosa PA01
ggcugccaccgagggcaggaac

SEQ ID NO: 3403686 - RNA, 24 nt, Pseudomonas aeruginosa PA01
ggcugccaccgagggcaggaacca

SEQ ID NO: 3403687 - RNA, 13 nt, Pseudomonas aeruginosa PA01
ggcugccagcaua

SEQ ID NO: 3403688 - RNA, 17 nt, Pseudomonas aeruginosa PA01
ggcugcccaagggccug

SEQ ID NO: 3403689 - RNA, 18 nt, Pseudomonas aeruginosa PA01
ggcugcccaagggccugg

SEQ ID NO: 3403690 - RNA, 14 nt, Pseudomonas aeruginosa PA01
ggcugcccaccacc

SEQ ID NO: 3403691 - RNA, 15 nt, Pseudomonas aeruginosa PA01
ggcugcccaccacca

SEQ ID NO: 3403692 - RNA, 16 nt, Pseudomonas aeruginosa PA01
ggcugcccaggcugag

SEQ ID NO: 3403693 - RNA, 20 nt, Pseudomonas aeruginosa PA01
ggcugcccagguagccggcg

SEQ ID NO: 3403694 - RNA, 20 nt, Pseudomonas aeruginosa PA01
ggcugcccaguugcgcggcg

SEQ ID NO: 3403695 - RNA, 23 nt, Pseudomonas aeruginosa PA01
ggcugcccaguugcgcggcgagu

SEQ ID NO: 3403696 - RNA, 17 nt, Pseudomonas aeruginosa PA01
ggcugccgaacaggcgu

SEQ ID NO: 3403697 - RNA, 21 nt, Pseudomonas aeruginosa PA01
ggcugccgaagccuucgucga

SEQ ID NO: 3403698 - RNA, 12 nt, Pseudomonas aeruginosa PA01
ggcugccgagca

SEQ ID NO: 3403699 - RNA, 18 nt, Pseudomonas aeruginosa PA01
ggcugccgagcaggguca

SEQ ID NO: 3403700 - RNA, 13 nt, Pseudomonas aeruginosa PA01
ggcugccgccagc

SEQ ID NO: 3403701 - RNA, 19 nt, Pseudomonas aeruginosa PA01
ggcugccgccgccgucgac

SEQ ID NO: 3403702 - RNA, 22 nt, Pseudomonas aeruginosa PA01
ggcugccgccgccgucgacacc

SEQ ID NO: 3403703 - RNA, 21 nt, Pseudomonas aeruginosa PA01
ggcugccgcgcguggcuucgu

SEQ ID NO: 3403704 - RNA, 19 nt, Pseudomonas aeruginosa PA01
ggcugccggagucucggga

SEQ ID NO: 3403705 - RNA, 15 nt, Pseudomonas aeruginosa PA01
ggcugccggccaggu

SEQ ID NO: 3403706 - RNA, 18 nt, Pseudomonas aeruginosa PA01
ggcugccggcccucgcga

SEQ ID NO: 3403707 - RNA, 12 nt, Pseudomonas aeruginosa PA01
ggcugccgguac

SEQ ID NO: 3403708 - RNA, 17 nt, Pseudomonas aeruginosa PA01
ggcugccguccaggcgc

SEQ ID NO: 3403709 - RNA, 17 nt, Pseudomonas aeruginosa PA01
ggcugccguugcggccc

SEQ ID NO: 3403710 - RNA, 16 nt, Pseudomonas aeruginosa PA01
ggcugcgauauggccg

SEQ ID NO: 3403711 - RNA, 19 nt, Pseudomonas aeruginosa PA01
ggcugcgauauggccgauc

SEQ ID NO: 3403712 - RNA, 16 nt, Pseudomonas aeruginosa PA01
ggcugcgcaccucggc

SEQ ID NO: 3403713 - RNA, 18 nt, Pseudomonas aeruginosa PA01
ggcugcgcaucgccuggg

SEQ ID NO: 3403714 - RNA, 20 nt, Pseudomonas aeruginosa PA01
ggcugcgcaucgccugggcc

SEQ ID NO: 3403715 - RNA, 13 nt, Pseudomonas aeruginosa PA01
ggcugcgccgcug

SEQ ID NO: 3403716 - RNA, 20 nt, Pseudomonas aeruginosa PA01
ggcugcgccgcugcggcugc

SEQ ID NO: 3403717 - RNA, 21 nt, Pseudomonas aeruginosa PA01
ggcugcgccgcugcggcugca

SEQ ID NO: 3403718 - RNA, 19 nt, Pseudomonas aeruginosa PA01
ggcugcgcgccaccaccgu

SEQ ID NO: 3403719 - RNA, 13 nt, Pseudomonas aeruginosa PA01
ggcugcgcgccgg

SEQ ID NO: 3403720 - RNA, 14 nt, Pseudomonas aeruginosa PA01
ggcugcgcgccggg

SEQ ID NO: 3403721 - RNA, 12 nt, Pseudomonas aeruginosa PA01
ggcugcgcucca

SEQ ID NO: 3403722 - RNA, 14 nt, Pseudomonas aeruginosa PA01
ggcugcgcuccagg

SEQ ID NO: 3403723 - RNA, 15 nt, Pseudomonas aeruginosa PA01
ggcugcgcuccaggc

SEQ ID NO: 3403724 - RNA, 17 nt, Pseudomonas aeruginosa PA01
ggcugcgcuccaggcgg

SEQ ID NO: 3403725 - RNA, 13 nt, Pseudomonas aeruginosa PA01
ggcugcgcucggc

SEQ ID NO: 3403726 - RNA, 18 nt, Pseudomonas aeruginosa PA01
ggcugcgcucggcgcucg

SEQ ID NO: 3403727 - RNA, 19 nt, Pseudomonas aeruginosa PA01
ggcugcgcucggcgcucgg

SEQ ID NO: 3403728 - RNA, 12 nt, Pseudomonas aeruginosa PA01
ggcugcggcgga

SEQ ID NO: 3403729 - RNA, 19 nt, Pseudomonas aeruginosa PA01
ggcugcggcggaaggcggc

SEQ ID NO: 3403730 - RNA, 20 nt, Pseudomonas aeruginosa PA01
ggcugcgucguuggccggcu

SEQ ID NO: 3403731 - RNA, 18 nt, Pseudomonas aeruginosa PA01
ggcuguaggugcccggcg

SEQ ID NO: 3403732 - RNA, 14 nt, Pseudomonas aeruginosa PA01
ggcugucagggcgc

SEQ ID NO: 3403733 - RNA, 15 nt, Pseudomonas aeruginosa PA01
ggcuguccagcaggc

SEQ ID NO: 3403734 - RNA, 17 nt, Pseudomonas aeruginosa PA01
ggcuguccagcaggcgu

SEQ ID NO: 3403735 - RNA, 18 nt, Pseudomonas aeruginosa PA01
ggcuguccagcaggcguu

SEQ ID NO: 3403736 - RNA, 16 nt, Pseudomonas aeruginosa PA01
ggcugucgcggacccg

SEQ ID NO: 3403737 - RNA, 13 nt, Pseudomonas aeruginosa PA01
ggcugucggccag

SEQ ID NO: 3403738 - RNA, 16 nt, Pseudomonas aeruginosa PA01
ggcugucgucgagggu

SEQ ID NO: 3403739 - RNA, 12 nt, Pseudomonas aeruginosa PA01
ggcugugcagga

SEQ ID NO: 3403740 - RNA, 19 nt, Pseudomonas aeruginosa PA01
ggcugugcaggaaggcgac

SEQ ID NO: 3403741 - RNA, 13 nt, Pseudomonas aeruginosa PA01
ggcugugcagggc

SEQ ID NO: 3403742 - RNA, 16 nt, Pseudomonas aeruginosa PA01
ggcugugcagggcagc

SEQ ID NO: 3403743 - RNA, 17 nt, Pseudomonas aeruginosa PA01
ggcugugccccaggcac

SEQ ID NO: 3403744 - RNA, 16 nt, Pseudomonas aeruginosa PA01
ggcugugcgccaggcc

SEQ ID NO: 3403745 - RNA, 18 nt, Pseudomonas aeruginosa PA01
ggcugugcgccaggccgg

SEQ ID NO: 3403746 - RNA, 22 nt, Pseudomonas aeruginosa PA01
ggcugugcgccaggccggugca

SEQ ID NO: 3403747 - RNA, 22 nt, Pseudomonas aeruginosa PA01
ggcugugcucgacgggcgcuuc

SEQ ID NO: 3403748 - RNA, 15 nt, Pseudomonas aeruginosa PA01
ggcugugcucgagga

SEQ ID NO: 3403749 - RNA, 14 nt, Pseudomonas aeruginosa PA01
ggcugugcuggcca

SEQ ID NO: 3403750 - RNA, 23 nt, Pseudomonas aeruginosa PA01
ggcugugggucgggucggcgaag

SEQ ID NO: 3403751 - RNA, 12 nt, Pseudomonas aeruginosa PA01
ggcuguugccgg

SEQ ID NO: 3403752 - RNA, 15 nt, Pseudomonas aeruginosa PA01
ggcuguugucgaaca

SEQ ID NO: 3403753 - RNA, 16 nt, Pseudomonas aeruginosa PA01
ggcuguuucaggccgg

SEQ ID NO: 3403754 - RNA, 14 nt, Pseudomonas aeruginosa PA01
ggcuucagagcugg

SEQ ID NO: 3403755 - RNA, 15 nt, Pseudomonas aeruginosa PA01
ggcuucagagcugga

SEQ ID NO: 3403756 - RNA, 15 nt, Pseudomonas aeruginosa PA01
ggcuucagcgccggg

SEQ ID NO: 3403757 - RNA, 18 nt, Pseudomonas aeruginosa PA01
ggcuuccagccagcccuc

SEQ ID NO: 3403758 - RNA, 15 nt, Pseudomonas aeruginosa PA01
ggcuucccaggccag

SEQ ID NO: 3403759 - RNA, 16 nt, Pseudomonas aeruginosa PA01
ggcuucccaggccagc

SEQ ID NO: 3403760 - RNA, 17 nt, Pseudomonas aeruginosa PA01
ggcuucccaggccagcg

SEQ ID NO: 3403761 - RNA, 18 nt, Pseudomonas aeruginosa PA01
ggcuucccaggccagcgg

SEQ ID NO: 3403762 - RNA, 19 nt, Pseudomonas aeruginosa PA01
ggcuuccgagcaguugcag

SEQ ID NO: 3403763 - RNA, 13 nt, Pseudomonas aeruginosa PA01
ggcuuccggcucc

SEQ ID NO: 3403764 - RNA, 16 nt, Pseudomonas aeruginosa PA01
ggcuuccggcuccagu

SEQ ID NO: 3403765 - RNA, 16 nt, Pseudomonas aeruginosa PA01
ggcuuccuccaucgcc

SEQ ID NO: 3403766 - RNA, 16 nt, Pseudomonas aeruginosa PA01
ggcuuccuggaagcga

SEQ ID NO: 3403767 - RNA, 15 nt, Pseudomonas aeruginosa PA01
ggcuuccuggccggg

SEQ ID NO: 3403768 - RNA, 19 nt, Pseudomonas aeruginosa PA01
ggcuuccuggcgccgguaa

SEQ ID NO: 3403769 - RNA, 14 nt, Pseudomonas aeruginosa PA01
ggcuuccugggcga

SEQ ID NO: 3403770 - RNA, 15 nt, Pseudomonas aeruginosa PA01
ggcuuccugggcgaa

SEQ ID NO: 3403771 - RNA, 13 nt, Pseudomonas aeruginosa PA01
ggcuuccuggugg

SEQ ID NO: 3403772 - RNA, 14 nt, Pseudomonas aeruginosa PA01
ggcuucgaccacga

SEQ ID NO: 3403773 - RNA, 16 nt, Pseudomonas aeruginosa PA01
ggcuucgaggcgggcg

SEQ ID NO: 3403774 - RNA, 20 nt, Pseudomonas aeruginosa PA01
ggcuucgaugcuuagcccgg

SEQ ID NO: 3403775 - RNA, 21 nt, Pseudomonas aeruginosa PA01
ggcuucgaugcuuagcccggg

SEQ ID NO: 3403776 - RNA, 18 nt, Pseudomonas aeruginosa PA01
ggcuucgcccuacgcggc

SEQ ID NO: 3403777 - RNA, 13 nt, Pseudomonas aeruginosa PA01
ggcuucgccgccg

SEQ ID NO: 3403778 - RNA, 15 nt, Pseudomonas aeruginosa PA01
ggcuucgccgccgcg

SEQ ID NO: 3403779 - RNA, 16 nt, Pseudomonas aeruginosa PA01
ggcuucgccgccgcgc

SEQ ID NO: 3403780 - RNA, 22 nt, Pseudomonas aeruginosa PA01
ggcuucgcgugccagacgcucg

SEQ ID NO: 3403781 - RNA, 23 nt, Pseudomonas aeruginosa PA01
ggcuucgcuggugcucaugccuu

SEQ ID NO: 3403782 - RNA, 16 nt, Pseudomonas aeruginosa PA01
ggcuucggcgcgcugg

SEQ ID NO: 3403783 - RNA, 17 nt, Pseudomonas aeruginosa PA01
ggcuucggcgcgcuggu

SEQ ID NO: 3403784 - RNA, 22 nt, Pseudomonas aeruginosa PA01
ggcuucguccagcgaggcgugg

SEQ ID NO: 3403785 - RNA, 17 nt, Pseudomonas aeruginosa PA01
ggcuucguccgccuggg

SEQ ID NO: 3403786 - RNA, 19 nt, Pseudomonas aeruginosa PA01
ggcuucguccugcugcugg

SEQ ID NO: 3403787 - RNA, 17 nt, Pseudomonas aeruginosa PA01
ggcuucuacgccuugcg

SEQ ID NO: 3403788 - RNA, 14 nt, Pseudomonas aeruginosa PA01
ggcuucuucaggca

SEQ ID NO: 3403789 - RNA, 19 nt, Pseudomonas aeruginosa PA01
ggcuucuuccuggccggga

SEQ ID NO: 3403790 - RNA, 14 nt, Pseudomonas aeruginosa PA01
ggcuucuugagccc

SEQ ID NO: 3403791 - RNA, 14 nt, Pseudomonas aeruginosa PA01
ggcuugaccgccgc

SEQ ID NO: 3403792 - RNA, 19 nt, Pseudomonas aeruginosa PA01
ggcuugaccgccgccgccu

SEQ ID NO: 3403793 - RNA, 18 nt, Pseudomonas aeruginosa PA01
ggcuugaggaaaaagaca

SEQ ID NO: 3403794 - RNA, 19 nt, Pseudomonas aeruginosa PA01
ggcuugaucgagucgccgg

SEQ ID NO: 3403795 - RNA, 13 nt, Pseudomonas aeruginosa PA01
ggcuugcaauccg

SEQ ID NO: 3403796 - RNA, 14 nt, Pseudomonas aeruginosa PA01
ggcuugcagguagc

SEQ ID NO: 3403797 - RNA, 22 nt, Pseudomonas aeruginosa PA01
ggcuugccacugcgcgccaguc

SEQ ID NO: 3403798 - RNA, 12 nt, Pseudomonas aeruginosa PA01
ggcuugccggcg

SEQ ID NO: 3403799 - RNA, 13 nt, Pseudomonas aeruginosa PA01
ggcuugccggcgc

SEQ ID NO: 3403800 - RNA, 15 nt, Pseudomonas aeruginosa PA01
ggcuugccggcggcg

SEQ ID NO: 3403801 - RNA, 16 nt, Pseudomonas aeruginosa PA01
ggcuugccggcggcgc

SEQ ID NO: 3403802 - RNA, 17 nt, Pseudomonas aeruginosa PA01
ggcuugccggcggcgcu

SEQ ID NO: 3403803 - RNA, 14 nt, Pseudomonas aeruginosa PA01
ggcuugccgggguc

SEQ ID NO: 3403804 - RNA, 14 nt, Pseudomonas aeruginosa PA01
ggcuugcgccgaag

SEQ ID NO: 3403805 - RNA, 16 nt, Pseudomonas aeruginosa PA01
ggcuugcgcgccacca

SEQ ID NO: 3403806 - RNA, 18 nt, Pseudomonas aeruginosa PA01
ggcuugcgcgccaccagc

SEQ ID NO: 3403807 - RNA, 19 nt, Pseudomonas aeruginosa PA01
ggcuugcgcgccaccagcg

SEQ ID NO: 3403808 - RNA, 17 nt, Pseudomonas aeruginosa PA01
ggcuugggucagcgggu

SEQ ID NO: 3403809 - RNA, 20 nt, Pseudomonas aeruginosa PA01
ggcuuggucgggcgccgcgc

SEQ ID NO: 3403810 - RNA, 22 nt, Pseudomonas aeruginosa PA01
ggcuuggucgggcgccgcgccu

SEQ ID NO: 3403811 - RNA, 10 nt, Pseudomonas aeruginosa PA01
ggcuuguccu

SEQ ID NO: 3403812 - RNA, 16 nt, Pseudomonas aeruginosa PA01
ggcuuguccuggcgca

SEQ ID NO: 3403813 - RNA, 16 nt, Pseudomonas aeruginosa PA01
ggcuuguccuuggccu

SEQ ID NO: 3403814 - RNA, 20 nt, Pseudomonas aeruginosa PA01
ggcuugugcagagaggcugg

SEQ ID NO: 3403815 - RNA, 22 nt, Pseudomonas aeruginosa PA01
ggcuugugcagagaggcuggcg

SEQ ID NO: 3403816 - RNA, 22 nt, Pseudomonas aeruginosa PA01
ggcuugugcgaauguccggcga

SEQ ID NO: 3403817 - RNA, 21 nt, Pseudomonas aeruginosa PA01
ggcuuguucagcucggcguag

SEQ ID NO: 3403818 - RNA, 22 nt, Pseudomonas aeruginosa PA01
ggcuuguugcgcuccacccagg

SEQ ID NO: 3403819 - RNA, 15 nt, Pseudomonas aeruginosa PA01
ggcuuguuuagccau

SEQ ID NO: 3403820 - RNA, 16 nt, Pseudomonas aeruginosa PA01
ggcuuuccaccgccag

SEQ ID NO: 3403821 - RNA, 18 nt, Pseudomonas aeruginosa PA01
ggcuuuccagcaggcgcu

SEQ ID NO: 3403822 - RNA, 20 nt, Pseudomonas aeruginosa PA01
ggcuuuccaggcgccgcuug

SEQ ID NO: 3403823 - RNA, 19 nt, Pseudomonas aeruginosa PA01
ggcuuuccagggccuggcg

SEQ ID NO: 3403824 - RNA, 21 nt, Pseudomonas aeruginosa PA01
ggcuuuccagggccuggcgca

SEQ ID NO: 3403825 - RNA, 18 nt, Pseudomonas aeruginosa PA01
ggcuuuccucggccaugc

SEQ ID NO: 3403826 - RNA, 20 nt, Pseudomonas aeruginosa PA01
ggcuuucguaggcaggcgcg

SEQ ID NO: 3403827 - RNA, 21 nt, Pseudomonas aeruginosa PA01
ggcuuuuucauggcuggcccu

SEQ ID NO: 3403828 - RNA, 20 nt, Pseudomonas aeruginosa PA01
ggcuuuuucaugggcgcgcg

SEQ ID NO: 3403829 - RNA, 23 nt, Pseudomonas aeruginosa PA01
ggcuuuuucgacaaggagacuca

SEQ ID NO: 3403830 - RNA, 18 nt, Pseudomonas aeruginosa PA01
ggcuuuuuuaugcgcagc

SEQ ID NO: 3403831 - RNA, 18 nt, Pseudomonas aeruginosa PA01
ggcuuuuuuucgccugcg

SEQ ID NO: 3403832 - RNA, 21 nt, Pseudomonas aeruginosa PA01
gggaaaaaagggagccaggcg

SEQ ID NO: 3403833 - RNA, 14 nt, Pseudomonas aeruginosa PA01
gggaaacaccaggc

SEQ ID NO: 3403834 - RNA, 21 nt, Pseudomonas aeruginosa PA01
gggaucgacgccgcuggcggc

SEQ ID NO: 3403835 - RNA, 22 nt, Pseudomonas aeruginosa PA01
gggaucgacgccgcuggcggcg

SEQ ID NO: 3403836 - RNA, 18 nt, Pseudomonas aeruginosa PA01
gggaucgaugcgcgcccu

SEQ ID NO: 3403837 - RNA, 15 nt, Pseudomonas aeruginosa PA01
gggaucgccacgccg

SEQ ID NO: 3403838 - RNA, 16 nt, Pseudomonas aeruginosa PA01
gggaucgcgcggcugg

SEQ ID NO: 3403839 - RNA, 20 nt, Pseudomonas aeruginosa PA01
gggaucgcgcggcuggcugc

SEQ ID NO: 3403840 - RNA, 15 nt, Pseudomonas aeruginosa PA01
gggaucggcgaucag

SEQ ID NO: 3403841 - RNA, 15 nt, Pseudomonas aeruginosa PA01
gggaucuccgcgcca

SEQ ID NO: 3403842 - RNA, 17 nt, Pseudomonas aeruginosa PA01
gggaucuccgcgccacg

SEQ ID NO: 3403843 - RNA, 22 nt, Pseudomonas aeruginosa PA01
gggaucuccucgacggcgggag

SEQ ID NO: 3403844 - RNA, 18 nt, Pseudomonas aeruginosa PA01
gggaucuggcccugcaac

SEQ ID NO: 3403845 - RNA, 14 nt, Pseudomonas aeruginosa PA01
gggaugccauggca

SEQ ID NO: 3403846 - RNA, 12 nt, Pseudomonas aeruginosa PA01
gggaugccgccg

SEQ ID NO: 3403847 - RNA, 13 nt, Pseudomonas aeruginosa PA01
gggaugccgccgg

SEQ ID NO: 3403848 - RNA, 15 nt, Pseudomonas aeruginosa PA01
gggaugccgccggca

SEQ ID NO: 3403849 - RNA, 12 nt, Pseudomonas aeruginosa PA01
gggaugccgggc

SEQ ID NO: 3403850 - RNA, 16 nt, Pseudomonas aeruginosa PA01
gggaugccgggccgag

SEQ ID NO: 3403851 - RNA, 17 nt, Pseudomonas aeruginosa PA01
gggauggcgcgguccgc

SEQ ID NO: 3403852 - RNA, 18 nt, Pseudomonas aeruginosa PA01
gggauggcgcgguccgcg

SEQ ID NO: 3403853 - RNA, 12 nt, Pseudomonas aeruginosa PA01
gggauggcgggc

SEQ ID NO: 3403854 - RNA, 20 nt, Pseudomonas aeruginosa PA01
gggauggggcugccggcccu

SEQ ID NO: 3403855 - RNA, 13 nt, Pseudomonas aeruginosa PA01
gggauggucgaga

SEQ ID NO: 3403856 - RNA, 22 nt, Pseudomonas aeruginosa PA01
gggauggucgagagaauccgcc

SEQ ID NO: 3403857 - RNA, 13 nt, Pseudomonas aeruginosa PA01
gggauggucgagg

SEQ ID NO: 3403858 - RNA, 21 nt, Pseudomonas aeruginosa PA01
gggauggucgagggcgcguug

SEQ ID NO: 3403859 - RNA, 19 nt, Pseudomonas aeruginosa PA01
gggauggucggugacccgc

SEQ ID NO: 3403860 - RNA, 17 nt, Pseudomonas aeruginosa PA01
gggauguacgccagggu

SEQ ID NO: 3403861 - RNA, 14 nt, Pseudomonas aeruginosa PA01
gggauguuccaggc

SEQ ID NO: 3403862 - RNA, 17 nt, Pseudomonas aeruginosa PA01
gggauguuccaggcccg

SEQ ID NO: 3403863 - RNA, 21 nt, Pseudomonas aeruginosa PA01
gggauguuccaggcccgccgc

SEQ ID NO: 3403864 - RNA, 22 nt, Pseudomonas aeruginosa PA01
gggauguuccaggcccgccgcg

SEQ ID NO: 3403865 - RNA, 18 nt, Pseudomonas aeruginosa PA01
gggauuccuuggucaggu

SEQ ID NO: 3403866 - RNA, 23 nt, Pseudomonas aeruginosa PA01
gggauuccuuggucaggucgacg

SEQ ID NO: 3403867 - RNA, 16 nt, Pseudomonas aeruginosa PA01
gggauugucgccgccg

SEQ ID NO: 3403868 - RNA, 13 nt, Pseudomonas aeruginosa PA01
gggcaaaggcgcg

SEQ ID NO: 3403869 - RNA, 22 nt, Pseudomonas aeruginosa PA01
gggcaaaggcgcgcagggccgc

SEQ ID NO: 3403870 - RNA, 15 nt, Pseudomonas aeruginosa PA01
gggcaaaugccgcaa

SEQ ID NO: 3403871 - RNA, 13 nt, Pseudomonas aeruginosa PA01
gggcaacaggccg

SEQ ID NO: 3403872 - RNA, 14 nt, Pseudomonas aeruginosa PA01
gggcaacaggccga

SEQ ID NO: 3403873 - RNA, 18 nt, Pseudomonas aeruginosa PA01
gggcaaccgcggcggccu

SEQ ID NO: 3403874 - RNA, 13 nt, Pseudomonas aeruginosa PA01
gggcaacgccagg

SEQ ID NO: 3403875 - RNA, 15 nt, Pseudomonas aeruginosa PA01
gggcaacgccaggcu

SEQ ID NO: 3403876 - RNA, 23 nt, Pseudomonas aeruginosa PA01
gggcaacgccaggcugucagggc

SEQ ID NO: 3403877 - RNA, 14 nt, Pseudomonas aeruginosa PA01
gggcaacggcuggg

SEQ ID NO: 3403878 - RNA, 19 nt, Pseudomonas aeruginosa PA01
gggcaacugaucagccggg

SEQ ID NO: 3403879 - RNA, 21 nt, Pseudomonas aeruginosa PA01
gggcaagcucgacgagccgcg

SEQ ID NO: 3403880 - RNA, 12 nt, Pseudomonas aeruginosa PA01
gggcaagcugca

SEQ ID NO: 3403881 - RNA, 15 nt, Pseudomonas aeruginosa PA01
gggcaagcugcacgg

SEQ ID NO: 3403882 - RNA, 21 nt, Pseudomonas aeruginosa PA01
gggcaagcugcacggcgaccc

SEQ ID NO: 3403883 - RNA, 20 nt, Pseudomonas aeruginosa PA01
gggcacccgguugaccccgc

SEQ ID NO: 3403884 - RNA, 21 nt, Pseudomonas aeruginosa PA01
gggcacccgguugaccccgcg

SEQ ID NO: 3403885 - RNA, 21 nt, Pseudomonas aeruginosa PA01
gggcaccgacgaugggcacga

SEQ ID NO: 3403886 - RNA, 17 nt, Pseudomonas aeruginosa PA01
gggcaccgagucggcaa

SEQ ID NO: 3403887 - RNA, 14 nt, Pseudomonas aeruginosa PA01
gggcaccgccgagg

SEQ ID NO: 3403888 - RNA, 23 nt, Pseudomonas aeruginosa PA01
gggcaccgcgccggcggugcgga

SEQ ID NO: 3403889 - RNA, 19 nt, Pseudomonas aeruginosa PA01
gggcacgccgguggccagg

SEQ ID NO: 3403890 - RNA, 21 nt, Pseudomonas aeruginosa PA01
gggcacgccgguggccaggcu

SEQ ID NO: 3403891 - RNA, 16 nt, Pseudomonas aeruginosa PA01
gggcacgcuggcgaga

SEQ ID NO: 3403892 - RNA, 15 nt, Pseudomonas aeruginosa PA01
gggcacggaaucgga

SEQ ID NO: 3403893 - RNA, 19 nt, Pseudomonas aeruginosa PA01
gggcacggaaucggacgau

SEQ ID NO: 3403894 - RNA, 15 nt, Pseudomonas aeruginosa PA01
gggcacgugcagcgg

SEQ ID NO: 3403895 - RNA, 17 nt, Pseudomonas aeruginosa PA01
gggcacgugcagcggca

SEQ ID NO: 3403896 - RNA, 23 nt, Pseudomonas aeruginosa PA01
gggcacgugcagcggcagcgucu

SEQ ID NO: 3403897 - RNA, 20 nt, Pseudomonas aeruginosa PA01
gggcacuucguccaggccgc

SEQ ID NO: 3403898 - RNA, 23 nt, Pseudomonas aeruginosa PA01
gggcacuucucgaacagcuccuc

SEQ ID NO: 3403899 - RNA, 15 nt, Pseudomonas aeruginosa PA01
gggcagaacacccgg

SEQ ID NO: 3403900 - RNA, 17 nt, Pseudomonas aeruginosa PA01
gggcagacaccaccagg

SEQ ID NO: 3403901 - RNA, 16 nt, Pseudomonas aeruginosa PA01
gggcagauguccaggc

SEQ ID NO: 3403902 - RNA, 16 nt, Pseudomonas aeruginosa PA01
gggcagcacgcuggcg

SEQ ID NO: 3403903 - RNA, 17 nt, Pseudomonas aeruginosa PA01
gggcagcagccggacca

SEQ ID NO: 3403904 - RNA, 12 nt, Pseudomonas aeruginosa PA01
gggcagcagcga

SEQ ID NO: 3403905 - RNA, 14 nt, Pseudomonas aeruginosa PA01
gggcagcagcgaac

SEQ ID NO: 3403906 - RNA, 14 nt, Pseudomonas aeruginosa PA01
gggcagcagucgca

SEQ ID NO: 3403907 - RNA, 20 nt, Pseudomonas aeruginosa PA01
gggcagcagucgcagcucgg

SEQ ID NO: 3403908 - RNA, 20 nt, Pseudomonas aeruginosa PA01
gggcagccgccgcggcaccg

SEQ ID NO: 3403909 - RNA, 15 nt, Pseudomonas aeruginosa PA01
gggcagccuggcugc

SEQ ID NO: 3403910 - RNA, 12 nt, Pseudomonas aeruginosa PA01
gggcagcggcga

SEQ ID NO: 3403911 - RNA, 13 nt, Pseudomonas aeruginosa PA01
gggcagcggcgca

SEQ ID NO: 3403912 - RNA, 15 nt, Pseudomonas aeruginosa PA01
gggcagcggucgccg

SEQ ID NO: 3403913 - RNA, 14 nt, Pseudomonas aeruginosa PA01
gggcagcgucgccg

SEQ ID NO: 3403914 - RNA, 19 nt, Pseudomonas aeruginosa PA01
gggcagcgucgccgggcgu

SEQ ID NO: 3403915 - RNA, 23 nt, Pseudomonas aeruginosa PA01
gggcagcucguugcacagcgccc

SEQ ID NO: 3403916 - RNA, 20 nt, Pseudomonas aeruginosa PA01
gggcaggauaucgcccaggg

SEQ ID NO: 3403917 - RNA, 21 nt, Pseudomonas aeruginosa PA01
gggcaggauaucgcccagggc

SEQ ID NO: 3403918 - RNA, 24 nt, Pseudomonas aeruginosa PA01
gggcaggauaucgcccagggccag

SEQ ID NO: 3403919 - RNA, 19 nt, Pseudomonas aeruginosa PA01
gggcaggcaugcggccccg

SEQ ID NO: 3403920 - RNA, 17 nt, Pseudomonas aeruginosa PA01
gggcaggccgaggccgg

SEQ ID NO: 3403921 - RNA, 17 nt, Pseudomonas aeruginosa PA01
gggcagggcagccgccg

SEQ ID NO: 3403922 - RNA, 11 nt, Pseudomonas aeruginosa PA01
gggcaggugga

SEQ ID NO: 3403923 - RNA, 22 nt, Pseudomonas aeruginosa PA01
gggcaguuccgccagaugcgcg

SEQ ID NO: 3403924 - RNA, 15 nt, Pseudomonas aeruginosa PA01
gggcauagaugccgc

SEQ ID NO: 3403925 - RNA, 21 nt, Pseudomonas aeruginosa PA01
gggcauaggaauacggcgcga

SEQ ID NO: 3403926 - RNA, 15 nt, Pseudomonas aeruginosa PA01
gggcaucagccccuc

SEQ ID NO: 3403927 - RNA, 21 nt, Pseudomonas aeruginosa PA01
gggcaucagccccucggccag

SEQ ID NO: 3403928 - RNA, 17 nt, Pseudomonas aeruginosa PA01
gggcaucaugccgagca

SEQ ID NO: 3403929 - RNA, 17 nt, Pseudomonas aeruginosa PA01
gggcauccugccgccug

SEQ ID NO: 3403930 - RNA, 14 nt, Pseudomonas aeruginosa PA01
gggcaucgaugacc

SEQ ID NO: 3403931 - RNA, 16 nt, Pseudomonas aeruginosa PA01
gggcaucgaugaccuu

SEQ ID NO: 3403932 - RNA, 18 nt, Pseudomonas aeruginosa PA01
gggcaucgccgacagguc

SEQ ID NO: 3403933 - RNA, 15 nt, Pseudomonas aeruginosa PA01
gggcaucgccgacca

SEQ ID NO: 3403934 - RNA, 22 nt, Pseudomonas aeruginosa PA01
gggcaugaccgauggcgccgcg

SEQ ID NO: 3403935 - RNA, 16 nt, Pseudomonas aeruginosa PA01
gggcaugcucggccag

SEQ ID NO: 3403936 - RNA, 12 nt, Pseudomonas aeruginosa PA01
gggcauggcugg

SEQ ID NO: 3403937 - RNA, 12 nt, Pseudomonas aeruginosa PA01
gggccgcgcugu

SEQ ID NO: 3403938 - RNA, 15 nt, Pseudomonas aeruginosa PA01
gggccgcggcgacca

SEQ ID NO: 3403939 - RNA, 13 nt, Pseudomonas aeruginosa PA01
gggccgcggcgga

SEQ ID NO: 3403940 - RNA, 22 nt, Pseudomonas aeruginosa PA01
gggccgcggcguugucggccag

SEQ ID NO: 3403941 - RNA, 23 nt, Pseudomonas aeruginosa PA01
gggccgcggcguugucggccagc

SEQ ID NO: 3403942 - RNA, 22 nt, Pseudomonas aeruginosa PA01
gggccggacguuuccagcggcu

SEQ ID NO: 3403943 - RNA, 15 nt, Pseudomonas aeruginosa PA01
gggccggaucggccu

SEQ ID NO: 3403944 - RNA, 17 nt, Pseudomonas aeruginosa PA01
gggccggaucggccuug

SEQ ID NO: 3403945 - RNA, 23 nt, Pseudomonas aeruginosa PA01
gggccggcaugcucagccgcgcc

SEQ ID NO: 3403946 - RNA, 12 nt, Pseudomonas aeruginosa PA01
gggccggccagg

SEQ ID NO: 3403947 - RNA, 13 nt, Pseudomonas aeruginosa PA01
gggccggcgccag

SEQ ID NO: 3403948 - RNA, 15 nt, Pseudomonas aeruginosa PA01
gggccggcguccagg

SEQ ID NO: 3403949 - RNA, 15 nt, Pseudomonas aeruginosa PA01
gggccggggaucggc

SEQ ID NO: 3403950 - RNA, 18 nt, Pseudomonas aeruginosa PA01
gggccgggggcggcgccu

SEQ ID NO: 3403951 - RNA, 20 nt, Pseudomonas aeruginosa PA01
gggccgggggcggcgccugg

SEQ ID NO: 3403952 - RNA, 21 nt, Pseudomonas aeruginosa PA01
gggccgggucaucaccggcag

SEQ ID NO: 3403953 - RNA, 19 nt, Pseudomonas aeruginosa PA01
gggccgguucggauccgga

SEQ ID NO: 3403954 - RNA, 23 nt, Pseudomonas aeruginosa PA01
gggccgguucggauccggacugg

SEQ ID NO: 3403955 - RNA, 17 nt, Pseudomonas aeruginosa PA01
gggccgguugcggcgcc

SEQ ID NO: 3403956 - RNA, 19 nt, Pseudomonas aeruginosa PA01
gggccgguugcggcgccgg

SEQ ID NO: 3403957 - RNA, 23 nt, Pseudomonas aeruginosa PA01
gggccguaggugaccgcccaggg

SEQ ID NO: 3403958 - RNA, 19 nt, Pseudomonas aeruginosa PA01
gggccguccgccaggucca

SEQ ID NO: 3403959 - RNA, 22 nt, Pseudomonas aeruginosa PA01
gggccguccgccagguccaggc

SEQ ID NO: 3403960 - RNA, 14 nt, Pseudomonas aeruginosa PA01
gggccgugagcacg

SEQ ID NO: 3403961 - RNA, 21 nt, Pseudomonas aeruginosa PA01
gggccguuuuuuaugccgagg

SEQ ID NO: 3403962 - RNA, 22 nt, Pseudomonas aeruginosa PA01
gggccguuuuuuaugccgaggc

SEQ ID NO: 3403963 - RNA, 22 nt, Pseudomonas aeruginosa PA01
gggccuacugcuggacggcgga

SEQ ID NO: 3403964 - RNA, 17 nt, Pseudomonas aeruginosa PA01
gggccuccuggcggcgu

SEQ ID NO: 3403965 - RNA, 19 nt, Pseudomonas aeruginosa PA01
gggccuccuggcggcgugg

SEQ ID NO: 3403966 - RNA, 15 nt, Pseudomonas aeruginosa PA01
gggccucgccacgcu

SEQ ID NO: 3403967 - RNA, 12 nt, Pseudomonas aeruginosa PA01
gggccucgcugu

SEQ ID NO: 3403968 - RNA, 15 nt, Pseudomonas aeruginosa PA01
gggccucggccagcg

SEQ ID NO: 3403969 - RNA, 14 nt, Pseudomonas aeruginosa PA01
gggccucggcgaag

SEQ ID NO: 3403970 - RNA, 14 nt, Pseudomonas aeruginosa PA01
gggccucgggcggg

SEQ ID NO: 3403971 - RNA, 22 nt, Pseudomonas aeruginosa PA01
gggccucggggccguccgccag

SEQ ID NO: 3403972 - RNA, 14 nt, Pseudomonas aeruginosa PA01
gggccugcucagcg

SEQ ID NO: 3403973 - RNA, 18 nt, Pseudomonas aeruginosa PA01
gggccugcucagcguccu

SEQ ID NO: 3403974 - RNA, 15 nt, Pseudomonas aeruginosa PA01
gggccugcuccucgg

SEQ ID NO: 3403975 - RNA, 18 nt, Pseudomonas aeruginosa PA01
gggccugcuccucggcag

SEQ ID NO: 3403976 - RNA, 22 nt, Pseudomonas aeruginosa PA01
gggccugcuccucggcagcgcu

SEQ ID NO: 3403977 - RNA, 12 nt, Pseudomonas aeruginosa PA01
gggccugcucgg

SEQ ID NO: 3403978 - RNA, 19 nt, Pseudomonas aeruginosa PA01
gggccugcugcgggcgcug

SEQ ID NO: 3403979 - RNA, 20 nt, Pseudomonas aeruginosa PA01
gggccuggaggcacgaaccg

SEQ ID NO: 3403980 - RNA, 12 nt, Pseudomonas aeruginosa PA01
gggccuggcgca

SEQ ID NO: 3403981 - RNA, 20 nt, Pseudomonas aeruginosa PA01
gggccuggcucgaucggcag

SEQ ID NO: 3403982 - RNA, 15 nt, Pseudomonas aeruginosa PA01
gggccugggcgccgc

SEQ ID NO: 3403983 - RNA, 23 nt, Pseudomonas aeruginosa PA01
gggccugucgggggcugcgcauc

SEQ ID NO: 3403984 - RNA, 17 nt, Pseudomonas aeruginosa PA01
gggccuucaggcgcucc

SEQ ID NO: 3403985 - RNA, 16 nt, Pseudomonas aeruginosa PA01
gggccuucaggcugcg

SEQ ID NO: 3403986 - RNA, 13 nt, Pseudomonas aeruginosa PA01
gggccuucgccag

SEQ ID NO: 3403987 - RNA, 20 nt, Pseudomonas aeruginosa PA01
gggccuucgccagcggccag

SEQ ID NO: 3403988 - RNA, 17 nt, Pseudomonas aeruginosa PA01
gggccuugaccaccgcc

SEQ ID NO: 3403989 - RNA, 22 nt, Pseudomonas aeruginosa PA01
gggccuugaccaccgccaggcu

SEQ ID NO: 3403990 - RNA, 14 nt, Pseudomonas aeruginosa PA01
gggccuugagcagg

SEQ ID NO: 3403991 - RNA, 15 nt, Pseudomonas aeruginosa PA01
gggccuugagcaggc

SEQ ID NO: 3403992 - RNA, 21 nt, Pseudomonas aeruginosa PA01
gggccuugagcaggcguuccg

SEQ ID NO: 3403993 - RNA, 15 nt, Pseudomonas aeruginosa PA01
gggccuuggccucca

SEQ ID NO: 3403994 - RNA, 18 nt, Pseudomonas aeruginosa PA01
gggccuuguucagggugg

SEQ ID NO: 3403995 - RNA, 21 nt, Pseudomonas aeruginosa PA01
gggccuuuucuuuggcgacga

SEQ ID NO: 3403996 - RNA, 23 nt, Pseudomonas aeruginosa PA01
gggccuuuuucacuacaggaccu

SEQ ID NO: 3403997 - RNA, 16 nt, Pseudomonas aeruginosa PA01
gggcgaaacggcaggc

SEQ ID NO: 3403998 - RNA, 18 nt, Pseudomonas aeruginosa PA01
gggcgaaacggcaggcca

SEQ ID NO: 3403999 - RNA, 19 nt, Pseudomonas aeruginosa PA01
gggcgaaacggcaggccag

SEQ ID NO: 3404000 - RNA, 19 nt, Pseudomonas aeruginosa PA01
gggcgaacaacgccgccgg

SEQ ID NO: 3404001 - RNA, 21 nt, Pseudomonas aeruginosa PA01
gggcgaacaacgccgccggcg

SEQ ID NO: 3404002 - RNA, 14 nt, Pseudomonas aeruginosa PA01
gggcgaacagcagc

SEQ ID NO: 3404003 - RNA, 16 nt, Pseudomonas aeruginosa PA01
gggcgaacagcagcgg

SEQ ID NO: 3404004 - RNA, 15 nt, Pseudomonas aeruginosa PA01
gggcgaacagcgaga

SEQ ID NO: 3404005 - RNA, 21 nt, Pseudomonas aeruginosa PA01
gggcgaacagcgagacccggu

SEQ ID NO: 3404006 - RNA, 22 nt, Pseudomonas aeruginosa PA01
gggcgaacagcgccgcggcugg

SEQ ID NO: 3404007 - RNA, 14 nt, Pseudomonas aeruginosa PA01
gggcgaacggcagc

SEQ ID NO: 3404008 - RNA, 14 nt, Pseudomonas aeruginosa PA01
gggcgaagccggcg

SEQ ID NO: 3404009 - RNA, 19 nt, Pseudomonas aeruginosa PA01
gggcgaagccggcggcgcg

SEQ ID NO: 3404010 - RNA, 21 nt, Pseudomonas aeruginosa PA01
gggcgaagccggcggcgcggc

SEQ ID NO: 3404011 - RNA, 14 nt, Pseudomonas aeruginosa PA01
gggcgaagcgcagc

SEQ ID NO: 3404012 - RNA, 17 nt, Pseudomonas aeruginosa PA01
gggcgaaggccaccauc

SEQ ID NO: 3404013 - RNA, 20 nt, Pseudomonas aeruginosa PA01
gggcgaaggucugccccggc

SEQ ID NO: 3404014 - RNA, 19 nt, Pseudomonas aeruginosa PA01
gggcgaagucggcuugggu

SEQ ID NO: 3404015 - RNA, 21 nt, Pseudomonas aeruginosa PA01
gggcgaaguugaaacggcgga

SEQ ID NO: 3404016 - RNA, 23 nt, Pseudomonas aeruginosa PA01
gggcgaauaaccauugcgcggga

SEQ ID NO: 3404017 - RNA, 17 nt, Pseudomonas aeruginosa PA01
gggcgaauaacgccaca

SEQ ID NO: 3404018 - RNA, 20 nt, Pseudomonas aeruginosa PA01
gggcgaauaacgccacaggc

SEQ ID NO: 3404019 - RNA, 20 nt, Pseudomonas aeruginosa PA01
gggcgaauaacgccgcaggc

SEQ ID NO: 3404020 - RNA, 19 nt, Pseudomonas aeruginosa PA01
gggcgaauaccagugccgc

SEQ ID NO: 3404021 - RNA, 21 nt, Pseudomonas aeruginosa PA01
gggcgaauaccagugccgcgg

SEQ ID NO: 3404022 - RNA, 16 nt, Pseudomonas aeruginosa PA01
gggcgaauagcgccgc

SEQ ID NO: 3404023 - RNA, 16 nt, Pseudomonas aeruginosa PA01
gggcgaauaucgcggc

SEQ ID NO: 3404024 - RNA, 19 nt, Pseudomonas aeruginosa PA01
gggcgaauaucgcggcgcg

SEQ ID NO: 3404025 - RNA, 14 nt, Pseudomonas aeruginosa PA01
gggcgaccagaagg

SEQ ID NO: 3404026 - RNA, 17 nt, Pseudomonas aeruginosa PA01
gggcgacccagcgcugg

SEQ ID NO: 3404027 - RNA, 12 nt, Pseudomonas aeruginosa PA01
gggcgacccagg

SEQ ID NO: 3404028 - RNA, 13 nt, Pseudomonas aeruginosa PA01
gggcgacccaggc

SEQ ID NO: 3404029 - RNA, 16 nt, Pseudomonas aeruginosa PA01
gggcgacccaggccga

SEQ ID NO: 3404030 - RNA, 16 nt, Pseudomonas aeruginosa PA01
gggcgaccgccaggcg

SEQ ID NO: 3404031 - RNA, 21 nt, Pseudomonas aeruginosa PA01
gggcgaccggaugcuccaggu

SEQ ID NO: 3404032 - RNA, 11 nt, Pseudomonas aeruginosa PA01
gggcgaccugc

SEQ ID NO: 3404033 - RNA, 15 nt, Pseudomonas aeruginosa PA01
gggcgaccugcucgc

SEQ ID NO: 3404034 - RNA, 16 nt, Pseudomonas aeruginosa PA01
gggcgaccuucagcgg

SEQ ID NO: 3404035 - RNA, 19 nt, Pseudomonas aeruginosa PA01
gggcgaccuucagcggguc

SEQ ID NO: 3404036 - RNA, 15 nt, Pseudomonas aeruginosa PA01
gggcgacgacgaacg

SEQ ID NO: 3404037 - RNA, 13 nt, Pseudomonas aeruginosa PA01
gggcgacgccgau

SEQ ID NO: 3404038 - RNA, 19 nt, Pseudomonas aeruginosa PA01
gggcgacgccgaugcucgg

SEQ ID NO: 3404039 - RNA, 12 nt, Pseudomonas aeruginosa PA01
gggcggcgcggc

SEQ ID NO: 3404040 - RNA, 13 nt, Pseudomonas aeruginosa PA01
gggcggcggcgcg

SEQ ID NO: 3404041 - RNA, 16 nt, Pseudomonas aeruginosa PA01
gggcggcggcuaccag

SEQ ID NO: 3404042 - RNA, 13 nt, Pseudomonas aeruginosa PA01
gggcggcggcuca

SEQ ID NO: 3404043 - RNA, 20 nt, Pseudomonas aeruginosa PA01
gggcggcgucccggcgccgc

SEQ ID NO: 3404044 - RNA, 15 nt, Pseudomonas aeruginosa PA01
gggcggcgucgcgga

SEQ ID NO: 3404045 - RNA, 20 nt, Pseudomonas aeruginosa PA01
gggcggcucggcuccaggac

SEQ ID NO: 3404046 - RNA, 16 nt, Pseudomonas aeruginosa PA01
gggcggcuggccgagg

SEQ ID NO: 3404047 - RNA, 22 nt, Pseudomonas aeruginosa PA01
gggcggcuguagcggaucaggc

SEQ ID NO: 3404048 - RNA, 22 nt, Pseudomonas aeruginosa PA01
gggcggcuuccagguacggccc

SEQ ID NO: 3404049 - RNA, 17 nt, Pseudomonas aeruginosa PA01
gggcggcuuccugcugg

SEQ ID NO: 3404050 - RNA, 21 nt, Pseudomonas aeruginosa PA01
gggcgggaucaggucgccagc

SEQ ID NO: 3404051 - RNA, 21 nt, Pseudomonas aeruginosa PA01
gggcgggauugucgccgccga

SEQ ID NO: 3404052 - RNA, 15 nt, Pseudomonas aeruginosa PA01
gggcgggcgaagcga

SEQ ID NO: 3404053 - RNA, 13 nt, Pseudomonas aeruginosa PA01
gggcgggcguccg

SEQ ID NO: 3404054 - RNA, 19 nt, Pseudomonas aeruginosa PA01
gggcggguaaagcgcccgc

SEQ ID NO: 3404055 - RNA, 14 nt, Pseudomonas aeruginosa PA01
gggcgggucuggcg

SEQ ID NO: 3404056 - RNA, 16 nt, Pseudomonas aeruginosa PA01
gggcgggucuggcgga

SEQ ID NO: 3404057 - RNA, 13 nt, Pseudomonas aeruginosa PA01
gggcgguacgccg

SEQ ID NO: 3404058 - RNA, 18 nt, Pseudomonas aeruginosa PA01
gggcgguacgccgcgcug

SEQ ID NO: 3404059 - RNA, 17 nt, Pseudomonas aeruginosa PA01
gggcgguagcgggccag

SEQ ID NO: 3404060 - RNA, 19 nt, Pseudomonas aeruginosa PA01
gggcgguagcgggccagca

SEQ ID NO: 3404061 - RNA, 15 nt, Pseudomonas aeruginosa PA01
gggcgguaugccgga

SEQ ID NO: 3404062 - RNA, 13 nt, Pseudomonas aeruginosa PA01
gggcggucggcca

SEQ ID NO: 3404063 - RNA, 14 nt, Pseudomonas aeruginosa PA01
gggcggucggccag

SEQ ID NO: 3404064 - RNA, 17 nt, Pseudomonas aeruginosa PA01
gggcggucggcgagggc

SEQ ID NO: 3404065 - RNA, 15 nt, Pseudomonas aeruginosa PA01
gggcggucggcucag

SEQ ID NO: 3404066 - RNA, 14 nt, Pseudomonas aeruginosa PA01
gggcguaacggcuu

SEQ ID NO: 3404067 - RNA, 18 nt, Pseudomonas aeruginosa PA01
gggcguacaggccccagg

SEQ ID NO: 3404068 - RNA, 21 nt, Pseudomonas aeruginosa PA01
gggcguagaccuugcggccgu

SEQ ID NO: 3404069 - RNA, 16 nt, Pseudomonas aeruginosa PA01
gggcguagcgcggcag

SEQ ID NO: 3404070 - RNA, 14 nt, Pseudomonas aeruginosa PA01
gggcguagcggaag

SEQ ID NO: 3404071 - RNA, 21 nt, Pseudomonas aeruginosa PA01
gggcguagugcaucagccugg

SEQ ID NO: 3404072 - RNA, 18 nt, Pseudomonas aeruginosa PA01
gggcguccuugcccggcg

SEQ ID NO: 3404073 - RNA, 15 nt, Pseudomonas aeruginosa PA01
gggcgucgaacaccg

SEQ ID NO: 3404074 - RNA, 22 nt, Pseudomonas aeruginosa PA01
gggcgucgaacaccggcgccgc

SEQ ID NO: 3404075 - RNA, 19 nt, Pseudomonas aeruginosa PA01
gggcgucgaaggcggcgcg

SEQ ID NO: 3404076 - RNA, 15 nt, Pseudomonas aeruginosa PA01
gggcgucgacgaacg

SEQ ID NO: 3404077 - RNA, 16 nt, Pseudomonas aeruginosa PA01
gggcgucgcccucggc

SEQ ID NO: 3404078 - RNA, 21 nt, Pseudomonas aeruginosa PA01
gggcgucgcccucggcgcugg

SEQ ID NO: 3404079 - RNA, 17 nt, Pseudomonas aeruginosa PA01
gggcgucggcgugcugg

SEQ ID NO: 3404080 - RNA, 14 nt, Pseudomonas aeruginosa PA01
gggcgucuccugcc

SEQ ID NO: 3404081 - RNA, 21 nt, Pseudomonas aeruginosa PA01
gggcgucuccugccgccgaua

SEQ ID NO: 3404082 - RNA, 22 nt, Pseudomonas aeruginosa PA01
gggcgucuccugccgccgauag

SEQ ID NO: 3404083 - RNA, 14 nt, Pseudomonas aeruginosa PA01
gggcgucugcccgg

SEQ ID NO: 3404084 - RNA, 17 nt, Pseudomonas aeruginosa PA01
gggcgucugcucauucg

SEQ ID NO: 3404085 - RNA, 22 nt, Pseudomonas aeruginosa PA01
gggcgucugcucauucggccag

SEQ ID NO: 3404086 - RNA, 18 nt, Pseudomonas aeruginosa PA01
gggcgugcaggccgccga

SEQ ID NO: 3404087 - RNA, 19 nt, Pseudomonas aeruginosa PA01
gggcgugcaggccgccgag

SEQ ID NO: 3404088 - RNA, 22 nt, Pseudomonas aeruginosa PA01
gggcgugccaggagcuugccga

SEQ ID NO: 3404089 - RNA, 15 nt, Pseudomonas aeruginosa PA01
gggcgugcuccagca

SEQ ID NO: 3404090 - RNA, 22 nt, Pseudomonas aeruginosa PA01
gggcguggcaaaaaugcccuug

SEQ ID NO: 3404091 - RNA, 14 nt, Pseudomonas aeruginosa PA01
gggcguggcggccg

SEQ ID NO: 3404092 - RNA, 13 nt, Pseudomonas aeruginosa PA01
gggcgugucgagg

SEQ ID NO: 3404093 - RNA, 23 nt, Pseudomonas aeruginosa PA01
gggcgugucgaggaaggccagca

SEQ ID NO: 3404094 - RNA, 18 nt, Pseudomonas aeruginosa PA01
gggcguuggccagcgcca

SEQ ID NO: 3404095 - RNA, 22 nt, Pseudomonas aeruginosa PA01
gggcguuuucguuggcggccau

SEQ ID NO: 3404096 - RNA, 23 nt, Pseudomonas aeruginosa PA01
gggcguuuucguuggcggccauc

SEQ ID NO: 3404097 - RNA, 16 nt, Pseudomonas aeruginosa PA01
gggcuacaucgucugc

SEQ ID NO: 3404098 - RNA, 19 nt, Pseudomonas aeruginosa PA01
gggcuacaucgucugcgcg

SEQ ID NO: 3404099 - RNA, 16 nt, Pseudomonas aeruginosa PA01
gggcuagucgcgcagc

SEQ ID NO: 3404100 - RNA, 17 nt, Pseudomonas aeruginosa PA01
gggcuauagcucagcug

SEQ ID NO: 3404101 - RNA, 22 nt, Pseudomonas aeruginosa PA01
gggcuauucccgccgcuccggc

SEQ ID NO: 3404102 - RNA, 22 nt, Pseudomonas aeruginosa PA01
gggcucacauuaauugcgagcg

SEQ ID NO: 3404103 - RNA, 20 nt, Pseudomonas aeruginosa PA01
gggcucacucccguccagcg

SEQ ID NO: 3404104 - RNA, 15 nt, Pseudomonas aeruginosa PA01
gggcucagcccaggc

SEQ ID NO: 3404105 - RNA, 17 nt, Pseudomonas aeruginosa PA01
gggcucagcccaggcgc

SEQ ID NO: 3404106 - RNA, 22 nt, Pseudomonas aeruginosa PA01
gggcucagcccaggcgccgcuc

SEQ ID NO: 3404107 - RNA, 13 nt, Pseudomonas aeruginosa PA01
gggcucagcgcgc

SEQ ID NO: 3404108 - RNA, 13 nt, Pseudomonas aeruginosa PA01
gggcucaggccuu

SEQ ID NO: 3404109 - RNA, 14 nt, Pseudomonas aeruginosa PA01
gggcuccgccgcga

SEQ ID NO: 3404110 - RNA, 17 nt, Pseudomonas aeruginosa PA01
gggcucgcgcggggcgc

SEQ ID NO: 3404111 - RNA, 22 nt, Pseudomonas aeruginosa PA01
gggcucgcgcggggcgcgcugc

SEQ ID NO: 3404112 - RNA, 14 nt, Pseudomonas aeruginosa PA01
gggcucggcgagcg

SEQ ID NO: 3404113 - RNA, 15 nt, Pseudomonas aeruginosa PA01
gggcucgggcgcgga

SEQ ID NO: 3404114 - RNA, 19 nt, Pseudomonas aeruginosa PA01
gggcucgugcccucgcuac

SEQ ID NO: 3404115 - RNA, 23 nt, Pseudomonas aeruginosa PA01
gggcucuaugcaauggggcgcug

SEQ ID NO: 3404116 - RNA, 13 nt, Pseudomonas aeruginosa PA01
gggcucugccggu

SEQ ID NO: 3404117 - RNA, 22 nt, Pseudomonas aeruginosa PA01
gggcucuuucguuucagcgcca

SEQ ID NO: 3404118 - RNA, 24 nt, Pseudomonas aeruginosa PA01
gggcucuuucguuucagcgccagc

SEQ ID NO: 3404119 - RNA, 13 nt, Pseudomonas aeruginosa PA01
gggcugaacagcg

SEQ ID NO: 3404120 - RNA, 17 nt, Pseudomonas aeruginosa PA01
gggcugaacagcgccac

SEQ ID NO: 3404121 - RNA, 17 nt, Pseudomonas aeruginosa PA01
gggcugagacgcugccg

SEQ ID NO: 3404122 - RNA, 18 nt, Pseudomonas aeruginosa PA01
gggcugccaccgagggca

SEQ ID NO: 3404123 - RNA, 17 nt, Pseudomonas aeruginosa PA01
gggcugcccaccaccag

SEQ ID NO: 3404124 - RNA, 11 nt, Pseudomonas aeruginosa PA01
gggcugccgca

SEQ ID NO: 3404125 - RNA, 13 nt, Pseudomonas aeruginosa PA01
gggcugccgcaga

SEQ ID NO: 3404126 - RNA, 15 nt, Pseudomonas aeruginosa PA01
gggcugccgcggaag

SEQ ID NO: 3404127 - RNA, 12 nt, Pseudomonas aeruginosa PA01
gggcugccggcc

SEQ ID NO: 3404128 - RNA, 18 nt, Pseudomonas aeruginosa PA01
gggcugcgcaucgccugg

SEQ ID NO: 3404129 - RNA, 12 nt, Pseudomonas aeruginosa PA01
gggcugcugucc

SEQ ID NO: 3404130 - RNA, 19 nt, Pseudomonas aeruginosa PA01
gggcuggacguacauggga

SEQ ID NO: 3404131 - RNA, 16 nt, Pseudomonas aeruginosa PA01
gggcuggccaccgcca

SEQ ID NO: 3404132 - RNA, 21 nt, Pseudomonas aeruginosa PA01
gggcuggccaccgggaucagc

SEQ ID NO: 3404133 - RNA, 19 nt, Pseudomonas aeruginosa PA01
gggcuggccgucgaggucg

SEQ ID NO: 3404134 - RNA, 16 nt, Pseudomonas aeruginosa PA01
gggcugggcagcgccg

SEQ ID NO: 3404135 - RNA, 17 nt, Pseudomonas aeruginosa PA01
gggcugggcagcgccgc

SEQ ID NO: 3404136 - RNA, 23 nt, Pseudomonas aeruginosa PA01
gggcugggcagcgccgccgggcg

SEQ ID NO: 3404137 - RNA, 12 nt, Pseudomonas aeruginosa PA01
gggcugggcgcc

SEQ ID NO: 3404138 - RNA, 15 nt, Pseudomonas aeruginosa PA01
gggcugggucggcug

SEQ ID NO: 3404139 - RNA, 16 nt, Pseudomonas aeruginosa PA01
gggcugggucggcugg

SEQ ID NO: 3404140 - RNA, 16 nt, Pseudomonas aeruginosa PA01
gggcuguaaucgccgc

SEQ ID NO: 3404141 - RNA, 16 nt, Pseudomonas aeruginosa PA01
gggcuguugcugggcu

SEQ ID NO: 3404142 - RNA, 19 nt, Pseudomonas aeruginosa PA01
ggggugaggccgagccgac

SEQ ID NO: 3404143 - RNA, 15 nt, Pseudomonas aeruginosa PA01
ggggugauccagcug

SEQ ID NO: 3404144 - RNA, 22 nt, Pseudomonas aeruginosa PA01
ggggugcagauggucgccggag

SEQ ID NO: 3404145 - RNA, 13 nt, Pseudomonas aeruginosa PA01
ggggugccgccag

SEQ ID NO: 3404146 - RNA, 21 nt, Pseudomonas aeruginosa PA01
ggggugccgccagucggccug

SEQ ID NO: 3404147 - RNA, 22 nt, Pseudomonas aeruginosa PA01
ggggugcgcuggaacggccagg

SEQ ID NO: 3404148 - RNA, 22 nt, Pseudomonas aeruginosa PA01
gggguggccaggcgcaccagca

SEQ ID NO: 3404149 - RNA, 21 nt, Pseudomonas aeruginosa PA01
ggggugggcauaggaauacgg

SEQ ID NO: 3404150 - RNA, 16 nt, Pseudomonas aeruginosa PA01
gggguugaguugcagg

SEQ ID NO: 3404151 - RNA, 21 nt, Pseudomonas aeruginosa PA01
gggguugcccagcaggcucau

SEQ ID NO: 3404152 - RNA, 23 nt, Pseudomonas aeruginosa PA01
gggguuuucuuuuugcgccaggu

SEQ ID NO: 3404153 - RNA, 19 nt, Pseudomonas aeruginosa PA01
gggguuuuuuuugccugga

SEQ ID NO: 3404154 - RNA, 14 nt, Pseudomonas aeruginosa PA01
ggguaagcucgauc

SEQ ID NO: 3404155 - RNA, 20 nt, Pseudomonas aeruginosa PA01
ggguaauccaucgcuuucag

SEQ ID NO: 3404156 - RNA, 14 nt, Pseudomonas aeruginosa PA01
ggguacagcgccac

SEQ ID NO: 3404157 - RNA, 18 nt, Pseudomonas aeruginosa PA01
ggguaccgaaacagggcg

SEQ ID NO: 3404158 - RNA, 16 nt, Pseudomonas aeruginosa PA01
ggguaccgcuggcgcu

SEQ ID NO: 3404159 - RNA, 18 nt, Pseudomonas aeruginosa PA01
ggguaccgcuggcgcugg

SEQ ID NO: 3404160 - RNA, 19 nt, Pseudomonas aeruginosa PA01
ggguaccgcuggcgcuggg

SEQ ID NO: 3404161 - RNA, 14 nt, Pseudomonas aeruginosa PA01
ggguacgcaccggc

SEQ ID NO: 3404162 - RNA, 15 nt, Pseudomonas aeruginosa PA01
ggguacgcaccggcu

SEQ ID NO: 3404163 - RNA, 15 nt, Pseudomonas aeruginosa PA01
ggguacgcgggccuc

SEQ ID NO: 3404164 - RNA, 14 nt, Pseudomonas aeruginosa PA01
ggguacgguuggcc

SEQ ID NO: 3404165 - RNA, 19 nt, Pseudomonas aeruginosa PA01
ggguacgguuggccagcga

SEQ ID NO: 3404166 - RNA, 17 nt, Pseudomonas aeruginosa PA01
ggguacuccuggcaugg

SEQ ID NO: 3404167 - RNA, 13 nt, Pseudomonas aeruginosa PA01
ggguacuggcgcu

SEQ ID NO: 3404168 - RNA, 17 nt, Pseudomonas aeruginosa PA01
ggguagagucgcucgcg

SEQ ID NO: 3404169 - RNA, 17 nt, Pseudomonas aeruginosa PA01
ggguagccggccgauca

SEQ ID NO: 3404170 - RNA, 13 nt, Pseudomonas aeruginosa PA01
ggguagcugcugg

SEQ ID NO: 3404171 - RNA, 22 nt, Pseudomonas aeruginosa PA01
ggguaggaggaaauacagcacc

SEQ ID NO: 3404172 - RNA, 13 nt, Pseudomonas aeruginosa PA01
ggguaggccaggc

SEQ ID NO: 3404173 - RNA, 19 nt, Pseudomonas aeruginosa PA01
ggguagggguggccaggcg

SEQ ID NO: 3404174 - RNA, 22 nt, Pseudomonas aeruginosa PA01
ggguaguagaucagcuucucuu

SEQ ID NO: 3404175 - RNA, 22 nt, Pseudomonas aeruginosa PA01
ggguaguaguggaagccguggc

SEQ ID NO: 3404176 - RNA, 20 nt, Pseudomonas aeruginosa PA01
ggguauccagcggccgcgag

SEQ ID NO: 3404177 - RNA, 17 nt, Pseudomonas aeruginosa PA01
ggguaucguugaucggc

SEQ ID NO: 3404178 - RNA, 21 nt, Pseudomonas aeruginosa PA01
ggguaugugacgucuguugcg

SEQ ID NO: 3404179 - RNA, 19 nt, Pseudomonas aeruginosa PA01
ggguauucagugaaaggga

SEQ ID NO: 3404180 - RNA, 15 nt, Pseudomonas aeruginosa PA01
gggucaccagcgccg

SEQ ID NO: 3404181 - RNA, 16 nt, Pseudomonas aeruginosa PA01
gggucaccagcgccgg

SEQ ID NO: 3404182 - RNA, 16 nt, Pseudomonas aeruginosa PA01
gggucacgccgagggc

SEQ ID NO: 3404183 - RNA, 19 nt, Pseudomonas aeruginosa PA01
gggucacgccgagggcgcg

SEQ ID NO: 3404184 - RNA, 13 nt, Pseudomonas aeruginosa PA01
gggucacgccgau

SEQ ID NO: 3404185 - RNA, 14 nt, Pseudomonas aeruginosa PA01
gggucacgccgauc

SEQ ID NO: 3404186 - RNA, 15 nt, Pseudomonas aeruginosa PA01
gggucacgccgauca

SEQ ID NO: 3404187 - RNA, 20 nt, Pseudomonas aeruginosa PA01
gggucacgccgcggcugaug

SEQ ID NO: 3404188 - RNA, 20 nt, Pseudomonas aeruginosa PA01
gggucacgcguugcgagggc

SEQ ID NO: 3404189 - RNA, 18 nt, Pseudomonas aeruginosa PA01
gggucacgcugggcaggu

SEQ ID NO: 3404190 - RNA, 21 nt, Pseudomonas aeruginosa PA01
gggucacggugaggaccuggc

SEQ ID NO: 3404191 - RNA, 14 nt, Pseudomonas aeruginosa PA01
gggucagaccagcc

SEQ ID NO: 3404192 - RNA, 19 nt, Pseudomonas aeruginosa PA01
gggucagaccagcccuggc

SEQ ID NO: 3404193 - RNA, 20 nt, Pseudomonas aeruginosa PA01
gggucagaccagcccuggcg

SEQ ID NO: 3404194 - RNA, 22 nt, Pseudomonas aeruginosa PA01
gggucagaccagcccuggcgcg

SEQ ID NO: 3404195 - RNA, 14 nt, Pseudomonas aeruginosa PA01
gggucagcagcgcc

SEQ ID NO: 3404196 - RNA, 16 nt, Pseudomonas aeruginosa PA01
gggucagcagcgccag

SEQ ID NO: 3404197 - RNA, 15 nt, Pseudomonas aeruginosa PA01
gggucagcaggcugc

SEQ ID NO: 3404198 - RNA, 16 nt, Pseudomonas aeruginosa PA01
gggucagcaggcugcc

SEQ ID NO: 3404199 - RNA, 15 nt, Pseudomonas aeruginosa PA01
gggucagccgaugcu

SEQ ID NO: 3404200 - RNA, 17 nt, Pseudomonas aeruginosa PA01
gggucagccgaugcucg

SEQ ID NO: 3404201 - RNA, 22 nt, Pseudomonas aeruginosa PA01
gggucagccgaugcucgcgcca

SEQ ID NO: 3404202 - RNA, 15 nt, Pseudomonas aeruginosa PA01
gggucagccggccga

SEQ ID NO: 3404203 - RNA, 12 nt, Pseudomonas aeruginosa PA01
gggucagcuggc

SEQ ID NO: 3404204 - RNA, 19 nt, Pseudomonas aeruginosa PA01
gggucagcuggcgcgccuc

SEQ ID NO: 3404205 - RNA, 14 nt, Pseudomonas aeruginosa PA01
gggucagcuugccg

SEQ ID NO: 3404206 - RNA, 18 nt, Pseudomonas aeruginosa PA01
gggucagcuugccgcagg

SEQ ID NO: 3404207 - RNA, 21 nt, Pseudomonas aeruginosa PA01
gggucagcuugccgcaggucu

SEQ ID NO: 3404208 - RNA, 21 nt, Pseudomonas aeruginosa PA01
gggucaggccgagaaaccgcc

SEQ ID NO: 3404209 - RNA, 14 nt, Pseudomonas aeruginosa PA01
gggucaggccgagg

SEQ ID NO: 3404210 - RNA, 15 nt, Pseudomonas aeruginosa PA01
gggucaggccgaggc

SEQ ID NO: 3404211 - RNA, 21 nt, Pseudomonas aeruginosa PA01
gggucaggccgaggcgcuucu

SEQ ID NO: 3404212 - RNA, 20 nt, Pseudomonas aeruginosa PA01
gggucaggccgagggcugcc

SEQ ID NO: 3404213 - RNA, 14 nt, Pseudomonas aeruginosa PA01
gggucagucgagca

SEQ ID NO: 3404214 - RNA, 14 nt, Pseudomonas aeruginosa PA01
gggucaucaccggc

SEQ ID NO: 3404215 - RNA, 18 nt, Pseudomonas aeruginosa PA01
gggucaucaccggcagga

SEQ ID NO: 3404216 - RNA, 15 nt, Pseudomonas aeruginosa PA01
gggucaucgaggcca

SEQ ID NO: 3404217 - RNA, 21 nt, Pseudomonas aeruginosa PA01
gggucaucggcccgacgccgc

SEQ ID NO: 3404218 - RNA, 13 nt, Pseudomonas aeruginosa PA01
ggguccagcggcc

SEQ ID NO: 3404219 - RNA, 14 nt, Pseudomonas aeruginosa PA01
ggguccagcggccg

SEQ ID NO: 3404220 - RNA, 16 nt, Pseudomonas aeruginosa PA01
ggguccagcggccgcg

SEQ ID NO: 3404221 - RNA, 20 nt, Pseudomonas aeruginosa PA01
ggguccaggcgccagagcgc

SEQ ID NO: 3404222 - RNA, 13 nt, Pseudomonas aeruginosa PA01
ggguccgccgguc

SEQ ID NO: 3404223 - RNA, 13 nt, Pseudomonas aeruginosa PA01
ggguccgguacug

SEQ ID NO: 3404224 - RNA, 15 nt, Pseudomonas aeruginosa PA01
ggguccgguacugcu

SEQ ID NO: 3404225 - RNA, 22 nt, Pseudomonas aeruginosa PA01
ggguccugcagauaaagcugga

SEQ ID NO: 3404226 - RNA, 13 nt, Pseudomonas aeruginosa PA01
ggguccuggauca

SEQ ID NO: 3404227 - RNA, 15 nt, Pseudomonas aeruginosa PA01
ggguccuggguggcg

SEQ ID NO: 3404228 - RNA, 19 nt, Pseudomonas aeruginosa PA01
gggucgacaugcaggccgg

SEQ ID NO: 3404229 - RNA, 16 nt, Pseudomonas aeruginosa PA01
gggucgaccuugccga

SEQ ID NO: 3404230 - RNA, 19 nt, Pseudomonas aeruginosa PA01
gggucgacgcagggcggcg

SEQ ID NO: 3404231 - RNA, 19 nt, Pseudomonas aeruginosa PA01
gggucgacuucgcaccagc

SEQ ID NO: 3404232 - RNA, 22 nt, Pseudomonas aeruginosa PA01
gggucgacuucgcaccagccgg

SEQ ID NO: 3404233 - RNA, 22 nt, Pseudomonas aeruginosa PA01
gggucgaggcaaucugcccggc

SEQ ID NO: 3404234 - RNA, 16 nt, Pseudomonas aeruginosa PA01
gggucgaucaggcgca

SEQ ID NO: 3404235 - RNA, 21 nt, Pseudomonas aeruginosa PA01
gggucgaugcccucgcggcgg

SEQ ID NO: 3404236 - RNA, 14 nt, Pseudomonas aeruginosa PA01
gggucgauugcugg

SEQ ID NO: 3404237 - RNA, 19 nt, Pseudomonas aeruginosa PA01
gggucgauugcugggugcg

SEQ ID NO: 3404238 - RNA, 15 nt, Pseudomonas aeruginosa PA01
gggucgcagcaggcc

SEQ ID NO: 3404239 - RNA, 17 nt, Pseudomonas aeruginosa PA01
gggucgcagcaggccgc

SEQ ID NO: 3404240 - RNA, 13 nt, Pseudomonas aeruginosa PA01
gggucgcagccga

SEQ ID NO: 3404241 - RNA, 16 nt, Pseudomonas aeruginosa PA01
gggucgcagccgagcc

SEQ ID NO: 3404242 - RNA, 12 nt, Pseudomonas aeruginosa PA01
gggucgccuggg

SEQ ID NO: 3404243 - RNA, 13 nt, Pseudomonas aeruginosa PA01
gggucgcgcagcg

SEQ ID NO: 3404244 - RNA, 14 nt, Pseudomonas aeruginosa PA01
gggucgcgcagcgg

SEQ ID NO: 3404245 - RNA, 18 nt, Pseudomonas aeruginosa PA01
ggguucggcgaggaucgc

SEQ ID NO: 3404246 - RNA, 20 nt, Pseudomonas aeruginosa PA01
ggguucggggaacagcgcca

SEQ ID NO: 3404247 - RNA, 19 nt, Pseudomonas aeruginosa PA01
ggguucuugucgaccagcg

SEQ ID NO: 3404248 - RNA, 16 nt, Pseudomonas aeruginosa PA01
ggguugaugccgaggc

SEQ ID NO: 3404249 - RNA, 12 nt, Pseudomonas aeruginosa PA01
ggguugcccagc

SEQ ID NO: 3404250 - RNA, 15 nt, Pseudomonas aeruginosa PA01
ggguugcccggcucc

SEQ ID NO: 3404251 - RNA, 16 nt, Pseudomonas aeruginosa PA01
ggguugcccggcucca

SEQ ID NO: 3404252 - RNA, 18 nt, Pseudomonas aeruginosa PA01
ggguugcgccuccgggcg

SEQ ID NO: 3404253 - RNA, 17 nt, Pseudomonas aeruginosa PA01
ggguugcggcgcccgcc

SEQ ID NO: 3404254 - RNA, 12 nt, Pseudomonas aeruginosa PA01
ggguuggccgca

SEQ ID NO: 3404255 - RNA, 17 nt, Pseudomonas aeruginosa PA01
ggguuggccgcagcagc

SEQ ID NO: 3404256 - RNA, 17 nt, Pseudomonas aeruginosa PA01
ggguuggucggcaccag

SEQ ID NO: 3404257 - RNA, 16 nt, Pseudomonas aeruginosa PA01
ggguugguggccgcgc

SEQ ID NO: 3404258 - RNA, 18 nt, Pseudomonas aeruginosa PA01
ggguugucguugcgcagc

SEQ ID NO: 3404259 - RNA, 12 nt, Pseudomonas aeruginosa PA01
ggguuuccagca

SEQ ID NO: 3404260 - RNA, 14 nt, Pseudomonas aeruginosa PA01
ggguuuccagcagc

SEQ ID NO: 3404261 - RNA, 21 nt, Pseudomonas aeruginosa PA01
ggguuuucuuuuugcgccagg

SEQ ID NO: 3404262 - RNA, 22 nt, Pseudomonas aeruginosa PA01
ggguuuucuuuuugcgccaggu

SEQ ID NO: 3404263 - RNA, 17 nt, Pseudomonas aeruginosa PA01
gguaacccgcggcgagg

SEQ ID NO: 3404264 - RNA, 19 nt, Pseudomonas aeruginosa PA01
gguaaggauguccggguga

SEQ ID NO: 3404265 - RNA, 23 nt, Pseudomonas aeruginosa PA01
gguaaggcaccaccgccgccagc

SEQ ID NO: 3404266 - RNA, 16 nt, Pseudomonas aeruginosa PA01
gguaaggcaugcccag

SEQ ID NO: 3404267 - RNA, 18 nt, Pseudomonas aeruginosa PA01
gguaaggcaugcccaggc

SEQ ID NO: 3404268 - RNA, 21 nt, Pseudomonas aeruginosa PA01
gguaagguugccgaucaggcu

SEQ ID NO: 3404269 - RNA, 22 nt, Pseudomonas aeruginosa PA01
gguaagguugccgaucaggcug

SEQ ID NO: 3404270 - RNA, 15 nt, Pseudomonas aeruginosa PA01
gguaauagccguuga

SEQ ID NO: 3404271 - RNA, 19 nt, Pseudomonas aeruginosa PA01
gguaauaggcuucgaugcu

SEQ ID NO: 3404272 - RNA, 14 nt, Pseudomonas aeruginosa PA01
gguaauccacgcug

SEQ ID NO: 3404273 - RNA, 18 nt, Pseudomonas aeruginosa PA01
gguaauccagggagaaca

SEQ ID NO: 3404274 - RNA, 21 nt, Pseudomonas aeruginosa PA01
gguaauccagggagaacagca

SEQ ID NO: 3404275 - RNA, 16 nt, Pseudomonas aeruginosa PA01
gguaauuggccaggcu

SEQ ID NO: 3404276 - RNA, 19 nt, Pseudomonas aeruginosa PA01
gguacagcccccaggcacc

SEQ ID NO: 3404277 - RNA, 20 nt, Pseudomonas aeruginosa PA01
gguacagcgacucgcugccg

SEQ ID NO: 3404278 - RNA, 12 nt, Pseudomonas aeruginosa PA01
gguacagcgcca

SEQ ID NO: 3404279 - RNA, 22 nt, Pseudomonas aeruginosa PA01
gguacagcgccacggccagcag

SEQ ID NO: 3404280 - RNA, 18 nt, Pseudomonas aeruginosa PA01
gguacagcgccuggucgg

SEQ ID NO: 3404281 - RNA, 22 nt, Pseudomonas aeruginosa PA01
gguacagcgccuggucggcggc

SEQ ID NO: 3404282 - RNA, 18 nt, Pseudomonas aeruginosa PA01
gguacagugacugaccgu

SEQ ID NO: 3404283 - RNA, 20 nt, Pseudomonas aeruginosa PA01
gguacaguucaggcugggcc

SEQ ID NO: 3404284 - RNA, 21 nt, Pseudomonas aeruginosa PA01
gguacaguucaggcugggccg

SEQ ID NO: 3404285 - RNA, 13 nt, Pseudomonas aeruginosa PA01
gguaccagcagcg

SEQ ID NO: 3404286 - RNA, 16 nt, Pseudomonas aeruginosa PA01
gguaccagcagcgccg

SEQ ID NO: 3404287 - RNA, 12 nt, Pseudomonas aeruginosa PA01
gguaccagggaa

SEQ ID NO: 3404288 - RNA, 14 nt, Pseudomonas aeruginosa PA01
gguacccgccggcc

SEQ ID NO: 3404289 - RNA, 15 nt, Pseudomonas aeruginosa PA01
gguacccgccggcca

SEQ ID NO: 3404290 - RNA, 20 nt, Pseudomonas aeruginosa PA01
gguacccggcagggccagcg

SEQ ID NO: 3404291 - RNA, 13 nt, Pseudomonas aeruginosa PA01
gguaccgcuggcg

SEQ ID NO: 3404292 - RNA, 14 nt, Pseudomonas aeruginosa PA01
gguaccggccaggc

SEQ ID NO: 3404293 - RNA, 17 nt, Pseudomonas aeruginosa PA01
gguaccggccaggcggu

SEQ ID NO: 3404294 - RNA, 16 nt, Pseudomonas aeruginosa PA01
gguaccguugcgcagg

SEQ ID NO: 3404295 - RNA, 16 nt, Pseudomonas aeruginosa PA01
gguaccucgugggugc

SEQ ID NO: 3404296 - RNA, 13 nt, Pseudomonas aeruginosa PA01
gguaccugccggc

SEQ ID NO: 3404297 - RNA, 13 nt, Pseudomonas aeruginosa PA01
gguaccugcucgc

SEQ ID NO: 3404298 - RNA, 16 nt, Pseudomonas aeruginosa PA01
gguaccugcucgcggg

SEQ ID NO: 3404299 - RNA, 21 nt, Pseudomonas aeruginosa PA01
gguaccugcucgcgggucacc

SEQ ID NO: 3404300 - RNA, 14 nt, Pseudomonas aeruginosa PA01
gguacgacugacga

SEQ ID NO: 3404301 - RNA, 18 nt, Pseudomonas aeruginosa PA01
gguacgacugacgaaggc

SEQ ID NO: 3404302 - RNA, 16 nt, Pseudomonas aeruginosa PA01
gguacgcccuccagca

SEQ ID NO: 3404303 - RNA, 16 nt, Pseudomonas aeruginosa PA01
gguacgccgcgcugcg

SEQ ID NO: 3404304 - RNA, 23 nt, Pseudomonas aeruginosa PA01
gguacgccgcgcugcgccaggcc

SEQ ID NO: 3404305 - RNA, 15 nt, Pseudomonas aeruginosa PA01
gguacgcucaccacc

SEQ ID NO: 3404306 - RNA, 16 nt, Pseudomonas aeruginosa PA01
gguacgcucaccacca

SEQ ID NO: 3404307 - RNA, 14 nt, Pseudomonas aeruginosa PA01
gguacggaagcggc

SEQ ID NO: 3404308 - RNA, 15 nt, Pseudomonas aeruginosa PA01
gguacggaagcggcc

SEQ ID NO: 3404309 - RNA, 14 nt, Pseudomonas aeruginosa PA01
gguacggcgccgcu

SEQ ID NO: 3404310 - RNA, 14 nt, Pseudomonas aeruginosa PA01
gguacuaucccggu

SEQ ID NO: 3404311 - RNA, 15 nt, Pseudomonas aeruginosa PA01
gguacuccuccagca

SEQ ID NO: 3404312 - RNA, 17 nt, Pseudomonas aeruginosa PA01
gguacuccuggcauggc

SEQ ID NO: 3404313 - RNA, 22 nt, Pseudomonas aeruginosa PA01
gguacugccgcuaucgcuggcg

SEQ ID NO: 3404314 - RNA, 24 nt, Pseudomonas aeruginosa PA01
gguacugccgcuaucgcuggcgca

SEQ ID NO: 3404315 - RNA, 17 nt, Pseudomonas aeruginosa PA01
gguacugcgccaguucc

SEQ ID NO: 3404316 - RNA, 23 nt, Pseudomonas aeruginosa PA01
gguagaagaacaucggcgcuccg

SEQ ID NO: 3404317 - RNA, 14 nt, Pseudomonas aeruginosa PA01
gguagaagcggccg

SEQ ID NO: 3404318 - RNA, 15 nt, Pseudomonas aeruginosa PA01
gguagaagcggccgc

SEQ ID NO: 3404319 - RNA, 20 nt, Pseudomonas aeruginosa PA01
gguagagaagcguucgccga

SEQ ID NO: 3404320 - RNA, 16 nt, Pseudomonas aeruginosa PA01
gguagagaugcagcag

SEQ ID NO: 3404321 - RNA, 20 nt, Pseudomonas aeruginosa PA01
gguagagaugcagcagguag

SEQ ID NO: 3404322 - RNA, 13 nt, Pseudomonas aeruginosa PA01
gguagagggcgua

SEQ ID NO: 3404323 - RNA, 15 nt, Pseudomonas aeruginosa PA01
gguagaucugugcgg

SEQ ID NO: 3404324 - RNA, 17 nt, Pseudomonas aeruginosa PA01
gguagaucugugcggug

SEQ ID NO: 3404325 - RNA, 15 nt, Pseudomonas aeruginosa PA01
gguagauguccagug

SEQ ID NO: 3404326 - RNA, 21 nt, Pseudomonas aeruginosa PA01
gguagcagccguccagcuuga

SEQ ID NO: 3404327 - RNA, 18 nt, Pseudomonas aeruginosa PA01
gguagccaggggucaggc

SEQ ID NO: 3404328 - RNA, 20 nt, Pseudomonas aeruginosa PA01
gguagccaggggucaggccg

SEQ ID NO: 3404329 - RNA, 21 nt, Pseudomonas aeruginosa PA01
gguagccaugcacacgcuccc

SEQ ID NO: 3404330 - RNA, 14 nt, Pseudomonas aeruginosa PA01
gguagcccaggccg

SEQ ID NO: 3404331 - RNA, 16 nt, Pseudomonas aeruginosa PA01
gguagcccaggccgaa

SEQ ID NO: 3404332 - RNA, 17 nt, Pseudomonas aeruginosa PA01
gguagcccaggccgaag

SEQ ID NO: 3404333 - RNA, 12 nt, Pseudomonas aeruginosa PA01
gguagcccgcgg

SEQ ID NO: 3404334 - RNA, 18 nt, Pseudomonas aeruginosa PA01
gguagcccgcggcgagca

SEQ ID NO: 3404335 - RNA, 20 nt, Pseudomonas aeruginosa PA01
gguagcccgcggcgagcagc

SEQ ID NO: 3404336 - RNA, 14 nt, Pseudomonas aeruginosa PA01
gguagcccggcagc

SEQ ID NO: 3404337 - RNA, 11 nt, Pseudomonas aeruginosa PA01
gguagccgagg

SEQ ID NO: 3404338 - RNA, 17 nt, Pseudomonas aeruginosa PA01
gguagccgaggcggccg

SEQ ID NO: 3404339 - RNA, 16 nt, Pseudomonas aeruginosa PA01
gguagccgaucaacgc

SEQ ID NO: 3404340 - RNA, 12 nt, Pseudomonas aeruginosa PA01
gguagccgcagu

SEQ ID NO: 3404341 - RNA, 19 nt, Pseudomonas aeruginosa PA01
gguagccgcaguccagggc

SEQ ID NO: 3404342 - RNA, 13 nt, Pseudomonas aeruginosa PA01
gguagccgcccac

SEQ ID NO: 3404343 - RNA, 14 nt, Pseudomonas aeruginosa PA01
gguagccgcccacc

SEQ ID NO: 3404344 - RNA, 21 nt, Pseudomonas aeruginosa PA01
gguagccgccuuguuccaggc

SEQ ID NO: 3404345 - RNA, 17 nt, Pseudomonas aeruginosa PA01
gguagccggcgagcgcc

SEQ ID NO: 3404346 - RNA, 18 nt, Pseudomonas aeruginosa PA01
gguagccggcgaucagcg

SEQ ID NO: 3404347 - RNA, 14 nt, Pseudomonas aeruginosa PA01
gguagccgucaagc

SEQ ID NO: 3404348 - RNA, 17 nt, Pseudomonas aeruginosa PA01
ggucacggcgaagcggc

SEQ ID NO: 3404349 - RNA, 13 nt, Pseudomonas aeruginosa PA01
ggucacguggccg

SEQ ID NO: 3404350 - RNA, 17 nt, Pseudomonas aeruginosa PA01
ggucacuccgcugguaa

SEQ ID NO: 3404351 - RNA, 13 nt, Pseudomonas aeruginosa PA01
ggucacucggccu

SEQ ID NO: 3404352 - RNA, 19 nt, Pseudomonas aeruginosa PA01
ggucagaccagcccuggcg

SEQ ID NO: 3404353 - RNA, 19 nt, Pseudomonas aeruginosa PA01
ggucagagacagguacucg

SEQ ID NO: 3404354 - RNA, 23 nt, Pseudomonas aeruginosa PA01
ggucagagacagguacucggccc

SEQ ID NO: 3404355 - RNA, 17 nt, Pseudomonas aeruginosa PA01
ggucagagggugaucag

SEQ ID NO: 3404356 - RNA, 19 nt, Pseudomonas aeruginosa PA01
ggucagagggugaucagcu

SEQ ID NO: 3404357 - RNA, 21 nt, Pseudomonas aeruginosa PA01
ggucagagggugaucagcucc

SEQ ID NO: 3404358 - RNA, 13 nt, Pseudomonas aeruginosa PA01
ggucagaucagcg

SEQ ID NO: 3404359 - RNA, 23 nt, Pseudomonas aeruginosa PA01
ggucagcaacugccaaccgcgcu

SEQ ID NO: 3404360 - RNA, 13 nt, Pseudomonas aeruginosa PA01
ggucagcaccagg

SEQ ID NO: 3404361 - RNA, 20 nt, Pseudomonas aeruginosa PA01
ggucagcaccagggccaggg

SEQ ID NO: 3404362 - RNA, 21 nt, Pseudomonas aeruginosa PA01
ggucagcaccagggccagggc

SEQ ID NO: 3404363 - RNA, 14 nt, Pseudomonas aeruginosa PA01
ggucagcagcaccg

SEQ ID NO: 3404364 - RNA, 14 nt, Pseudomonas aeruginosa PA01
ggucagcaggcugc

SEQ ID NO: 3404365 - RNA, 15 nt, Pseudomonas aeruginosa PA01
ggucagcaggcugcc

SEQ ID NO: 3404366 - RNA, 21 nt, Pseudomonas aeruginosa PA01
ggucagccaccugcucgcuga

SEQ ID NO: 3404367 - RNA, 22 nt, Pseudomonas aeruginosa PA01
ggucagcccguguucggccagc

SEQ ID NO: 3404368 - RNA, 23 nt, Pseudomonas aeruginosa PA01
ggucagcccguguucggccagcc

SEQ ID NO: 3404369 - RNA, 16 nt, Pseudomonas aeruginosa PA01
ggucagccgcaggccg

SEQ ID NO: 3404370 - RNA, 19 nt, Pseudomonas aeruginosa PA01
ggucagccggccgaucuuc

SEQ ID NO: 3404371 - RNA, 20 nt, Pseudomonas aeruginosa PA01
ggucagcgacuggcccuggu

SEQ ID NO: 3404372 - RNA, 23 nt, Pseudomonas aeruginosa PA01
ggucagcgaguugaccuuggcca

SEQ ID NO: 3404373 - RNA, 13 nt, Pseudomonas aeruginosa PA01
ggucagcgccagc

SEQ ID NO: 3404374 - RNA, 16 nt, Pseudomonas aeruginosa PA01
ggucagcgccagcaac

SEQ ID NO: 3404375 - RNA, 15 nt, Pseudomonas aeruginosa PA01
ggucagcggcgcagc

SEQ ID NO: 3404376 - RNA, 16 nt, Pseudomonas aeruginosa PA01
ggucagcggcgcagcc

SEQ ID NO: 3404377 - RNA, 14 nt, Pseudomonas aeruginosa PA01
ggucagcgguaggu

SEQ ID NO: 3404378 - RNA, 23 nt, Pseudomonas aeruginosa PA01
ggucagcgguagguguacccagg

SEQ ID NO: 3404379 - RNA, 11 nt, Pseudomonas aeruginosa PA01
ggucagcuggc

SEQ ID NO: 3404380 - RNA, 16 nt, Pseudomonas aeruginosa PA01
ggucagcuucgccgcc

SEQ ID NO: 3404381 - RNA, 14 nt, Pseudomonas aeruginosa PA01
ggucagcuugccgc

SEQ ID NO: 3404382 - RNA, 15 nt, Pseudomonas aeruginosa PA01
ggucagcuugccgca

SEQ ID NO: 3404383 - RNA, 13 nt, Pseudomonas aeruginosa PA01
ggucaggaucaca

SEQ ID NO: 3404384 - RNA, 15 nt, Pseudomonas aeruginosa PA01
ggucaggccgaccag

SEQ ID NO: 3404385 - RNA, 21 nt, Pseudomonas aeruginosa PA01
ggucaggccgaccagcgccga

SEQ ID NO: 3404386 - RNA, 12 nt, Pseudomonas aeruginosa PA01
ggucaggccgag

SEQ ID NO: 3404387 - RNA, 20 nt, Pseudomonas aeruginosa PA01
ggucaggccgagaaaccgcc

SEQ ID NO: 3404388 - RNA, 14 nt, Pseudomonas aeruginosa PA01
ggucaggccgauca

SEQ ID NO: 3404389 - RNA, 17 nt, Pseudomonas aeruginosa PA01
ggucaggccgaucacca

SEQ ID NO: 3404390 - RNA, 16 nt, Pseudomonas aeruginosa PA01
ggucaggccggcgcga

SEQ ID NO: 3404391 - RNA, 20 nt, Pseudomonas aeruginosa PA01
ggucaggccuugacgcggga

SEQ ID NO: 3404392 - RNA, 15 nt, Pseudomonas aeruginosa PA01
ggucaggcgcccggu

SEQ ID NO: 3404393 - RNA, 12 nt, Pseudomonas aeruginosa PA01
ggucaggcugau

SEQ ID NO: 3404394 - RNA, 15 nt, Pseudomonas aeruginosa PA01
ggucaggcugaucgg

SEQ ID NO: 3404395 - RNA, 21 nt, Pseudomonas aeruginosa PA01
ggucaggcugaucggcgcgcc

SEQ ID NO: 3404396 - RNA, 16 nt, Pseudomonas aeruginosa PA01
ggucaggcugcgcacc

SEQ ID NO: 3404397 - RNA, 17 nt, Pseudomonas aeruginosa PA01
ggucaggcugcgcaccu

SEQ ID NO: 3404398 - RNA, 17 nt, Pseudomonas aeruginosa PA01
ggucaggcugcggcgga

SEQ ID NO: 3404399 - RNA, 14 nt, Pseudomonas aeruginosa PA01
ggucaggcuggccc

SEQ ID NO: 3404400 - RNA, 22 nt, Pseudomonas aeruginosa PA01
ggucaggcugguggucaccgcc

SEQ ID NO: 3404401 - RNA, 22 nt, Pseudomonas aeruginosa PA01
ggucagggcauauucauagccg

SEQ ID NO: 3404402 - RNA, 16 nt, Pseudomonas aeruginosa PA01
ggucagguacaggcgg

SEQ ID NO: 3404403 - RNA, 14 nt, Pseudomonas aeruginosa PA01
ggucagguaggcau

SEQ ID NO: 3404404 - RNA, 19 nt, Pseudomonas aeruginosa PA01
ggucagguauucgccggcc

SEQ ID NO: 3404405 - RNA, 15 nt, Pseudomonas aeruginosa PA01
ggucaggucgacgcc

SEQ ID NO: 3404406 - RNA, 19 nt, Pseudomonas aeruginosa PA01
ggucaggucgacgccgccg

SEQ ID NO: 3404407 - RNA, 18 nt, Pseudomonas aeruginosa PA01
ggucaggucgagggugau

SEQ ID NO: 3404408 - RNA, 19 nt, Pseudomonas aeruginosa PA01
ggucaguccuuguccggga

SEQ ID NO: 3404409 - RNA, 22 nt, Pseudomonas aeruginosa PA01
ggucaguucggugccgccggcg

SEQ ID NO: 3404410 - RNA, 21 nt, Pseudomonas aeruginosa PA01
ggucaguucguugagggccuu

SEQ ID NO: 3404411 - RNA, 20 nt, Pseudomonas aeruginosa PA01
ggucauagucggugaccucc

SEQ ID NO: 3404412 - RNA, 15 nt, Pseudomonas aeruginosa PA01
ggucauccgccggcg

SEQ ID NO: 3404413 - RNA, 18 nt, Pseudomonas aeruginosa PA01
ggucauccuggcccugga

SEQ ID NO: 3404414 - RNA, 17 nt, Pseudomonas aeruginosa PA01
ggucaucgcgccgccga

SEQ ID NO: 3404415 - RNA, 12 nt, Pseudomonas aeruginosa PA01
ggucaugcccag

SEQ ID NO: 3404416 - RNA, 14 nt, Pseudomonas aeruginosa PA01
ggucaugcccaggc

SEQ ID NO: 3404417 - RNA, 23 nt, Pseudomonas aeruginosa PA01
ggucaugcccuggccgacgcuga

SEQ ID NO: 3404418 - RNA, 14 nt, Pseudomonas aeruginosa PA01
ggucaugccgucuu

SEQ ID NO: 3404419 - RNA, 21 nt, Pseudomonas aeruginosa PA01
ggucaugcgcccuacgccacc

SEQ ID NO: 3404420 - RNA, 16 nt, Pseudomonas aeruginosa PA01
ggucauggcgcagacg

SEQ ID NO: 3404421 - RNA, 22 nt, Pseudomonas aeruginosa PA01
gguccaaccgggcaucgccgac

SEQ ID NO: 3404422 - RNA, 16 nt, Pseudomonas aeruginosa PA01
gguccaccagcccgca

SEQ ID NO: 3404423 - RNA, 23 nt, Pseudomonas aeruginosa PA01
gguccaccaggguaccgaaacag

SEQ ID NO: 3404424 - RNA, 23 nt, Pseudomonas aeruginosa PA01
gguccacguugcaguccaggccg

SEQ ID NO: 3404425 - RNA, 16 nt, Pseudomonas aeruginosa PA01
gguccagaucgccacc

SEQ ID NO: 3404426 - RNA, 17 nt, Pseudomonas aeruginosa PA01
gguccagcagguucucg

SEQ ID NO: 3404427 - RNA, 23 nt, Pseudomonas aeruginosa PA01
gguccagccagacguccggcagg

SEQ ID NO: 3404428 - RNA, 15 nt, Pseudomonas aeruginosa PA01
gguccagcgagcggg

SEQ ID NO: 3404429 - RNA, 16 nt, Pseudomonas aeruginosa PA01
gguccagcgagcgggc

SEQ ID NO: 3404430 - RNA, 13 nt, Pseudomonas aeruginosa PA01
gguccagcggccg

SEQ ID NO: 3404431 - RNA, 14 nt, Pseudomonas aeruginosa PA01
gguccagcggccgc

SEQ ID NO: 3404432 - RNA, 13 nt, Pseudomonas aeruginosa PA01
gguccagcucggu

SEQ ID NO: 3404433 - RNA, 23 nt, Pseudomonas aeruginosa PA01
gguccagcucggucagcggcgca

SEQ ID NO: 3404434 - RNA, 20 nt, Pseudomonas aeruginosa PA01
gguccagcuggcgcagccgu

SEQ ID NO: 3404435 - RNA, 12 nt, Pseudomonas aeruginosa PA01
gguccaggcgac

SEQ ID NO: 3404436 - RNA, 13 nt, Pseudomonas aeruginosa PA01
gguccaggcgacg

SEQ ID NO: 3404437 - RNA, 12 nt, Pseudomonas aeruginosa PA01
gguccaggcgcc

SEQ ID NO: 3404438 - RNA, 14 nt, Pseudomonas aeruginosa PA01
gguccaggcgccag

SEQ ID NO: 3404439 - RNA, 17 nt, Pseudomonas aeruginosa PA01
gguccaggcgccagagc

SEQ ID NO: 3404440 - RNA, 19 nt, Pseudomonas aeruginosa PA01
gguccaggcgucggcgccu

SEQ ID NO: 3404441 - RNA, 21 nt, Pseudomonas aeruginosa PA01
gguccaggggccgaugccggg

SEQ ID NO: 3404442 - RNA, 15 nt, Pseudomonas aeruginosa PA01
gguccagggugaucg

SEQ ID NO: 3404443 - RNA, 17 nt, Pseudomonas aeruginosa PA01
gguccaguucagggcga

SEQ ID NO: 3404444 - RNA, 16 nt, Pseudomonas aeruginosa PA01
gguccaucccuucgug

SEQ ID NO: 3404445 - RNA, 23 nt, Pseudomonas aeruginosa PA01
gguccaucugcaacgcggcguca

SEQ ID NO: 3404446 - RNA, 18 nt, Pseudomonas aeruginosa PA01
gguccauggaccgagacc

SEQ ID NO: 3404447 - RNA, 16 nt, Pseudomonas aeruginosa PA01
ggucccagaccagcag

SEQ ID NO: 3404448 - RNA, 17 nt, Pseudomonas aeruginosa PA01
ggucccagaccagcagc

SEQ ID NO: 3404449 - RNA, 19 nt, Pseudomonas aeruginosa PA01
ggucccagguagcgcugcg

SEQ ID NO: 3404450 - RNA, 22 nt, Pseudomonas aeruginosa PA01
ggucccagguagcgcugcgcca

SEQ ID NO: 3404451 - RNA, 14 nt, Pseudomonas aeruginosa PA01
ggucgaucucgucg

SEQ ID NO: 3404452 - RNA, 13 nt, Pseudomonas aeruginosa PA01
ggucgaugaucuu

SEQ ID NO: 3404453 - RNA, 23 nt, Pseudomonas aeruginosa PA01
ggucgaugcccaccugaacgcgc

SEQ ID NO: 3404454 - RNA, 17 nt, Pseudomonas aeruginosa PA01
ggucgaugcccucgcgg

SEQ ID NO: 3404455 - RNA, 18 nt, Pseudomonas aeruginosa PA01
ggucgaugucgcggcccu

SEQ ID NO: 3404456 - RNA, 20 nt, Pseudomonas aeruginosa PA01
ggucgauuccugucuccgca

SEQ ID NO: 3404457 - RNA, 13 nt, Pseudomonas aeruginosa PA01
ggucgcaccgcca

SEQ ID NO: 3404458 - RNA, 19 nt, Pseudomonas aeruginosa PA01
ggucgcaccgccagcaguu

SEQ ID NO: 3404459 - RNA, 18 nt, Pseudomonas aeruginosa PA01
ggucgcacgcagcgccgc

SEQ ID NO: 3404460 - RNA, 15 nt, Pseudomonas aeruginosa PA01
ggucgcagcaggccg

SEQ ID NO: 3404461 - RNA, 17 nt, Pseudomonas aeruginosa PA01
ggucgcagcaggccgcu

SEQ ID NO: 3404462 - RNA, 18 nt, Pseudomonas aeruginosa PA01
ggucgcagcaggccgcug

SEQ ID NO: 3404463 - RNA, 19 nt, Pseudomonas aeruginosa PA01
ggucgcagcaggccgcugg

SEQ ID NO: 3404464 - RNA, 12 nt, Pseudomonas aeruginosa PA01
ggucgcagccgc

SEQ ID NO: 3404465 - RNA, 18 nt, Pseudomonas aeruginosa PA01
ggucgcagcguuccagcg

SEQ ID NO: 3404466 - RNA, 22 nt, Pseudomonas aeruginosa PA01
ggucgcagcguuccagcgcugg

SEQ ID NO: 3404467 - RNA, 23 nt, Pseudomonas aeruginosa PA01
ggucgcagcguuccagcgcuggc

SEQ ID NO: 3404468 - RNA, 15 nt, Pseudomonas aeruginosa PA01
ggucgcagcuccagc

SEQ ID NO: 3404469 - RNA, 13 nt, Pseudomonas aeruginosa PA01
ggucgccagcgcc

SEQ ID NO: 3404470 - RNA, 14 nt, Pseudomonas aeruginosa PA01
ggucgccagcgccu

SEQ ID NO: 3404471 - RNA, 14 nt, Pseudomonas aeruginosa PA01
ggucgccaugcccg

SEQ ID NO: 3404472 - RNA, 14 nt, Pseudomonas aeruginosa PA01
ggucgcccaccuug

SEQ ID NO: 3404473 - RNA, 19 nt, Pseudomonas aeruginosa PA01
ggucgcccucggccaggca

SEQ ID NO: 3404474 - RNA, 17 nt, Pseudomonas aeruginosa PA01
ggucgccgaacagccgc

SEQ ID NO: 3404475 - RNA, 15 nt, Pseudomonas aeruginosa PA01
ggucgccgcagcccu

SEQ ID NO: 3404476 - RNA, 12 nt, Pseudomonas aeruginosa PA01
ggucgccgccag

SEQ ID NO: 3404477 - RNA, 14 nt, Pseudomonas aeruginosa PA01
ggucgccgccagca

SEQ ID NO: 3404478 - RNA, 19 nt, Pseudomonas aeruginosa PA01
ggucgccgccagcauggcg

SEQ ID NO: 3404479 - RNA, 15 nt, Pseudomonas aeruginosa PA01
ggucgccgcccacgc

SEQ ID NO: 3404480 - RNA, 19 nt, Pseudomonas aeruginosa PA01
ggucgccgccgccgggaaa

SEQ ID NO: 3404481 - RNA, 13 nt, Pseudomonas aeruginosa PA01
ggucgccgccggc

SEQ ID NO: 3404482 - RNA, 14 nt, Pseudomonas aeruginosa PA01
ggucgccgccggcg

SEQ ID NO: 3404483 - RNA, 22 nt, Pseudomonas aeruginosa PA01
ggucgccgccggcgaacagcca

SEQ ID NO: 3404484 - RNA, 13 nt, Pseudomonas aeruginosa PA01
ggucgccgcgacc

SEQ ID NO: 3404485 - RNA, 14 nt, Pseudomonas aeruginosa PA01
ggucgccgcgaccu

SEQ ID NO: 3404486 - RNA, 13 nt, Pseudomonas aeruginosa PA01
ggucgccgcgcug

SEQ ID NO: 3404487 - RNA, 12 nt, Pseudomonas aeruginosa PA01
ggucgccgcuca

SEQ ID NO: 3404488 - RNA, 19 nt, Pseudomonas aeruginosa PA01
ggucgccggcgcgcacggu

SEQ ID NO: 3404489 - RNA, 13 nt, Pseudomonas aeruginosa PA01
ggucgccggggcc

SEQ ID NO: 3404490 - RNA, 22 nt, Pseudomonas aeruginosa PA01
ggucgccguagaacagcacguc

SEQ ID NO: 3404491 - RNA, 21 nt, Pseudomonas aeruginosa PA01
ggucgccucgaacauggccac

SEQ ID NO: 3404492 - RNA, 22 nt, Pseudomonas aeruginosa PA01
ggucgccuugaccagcggcccg

SEQ ID NO: 3404493 - RNA, 23 nt, Pseudomonas aeruginosa PA01
ggucgcgacagguucaggacgcu

SEQ ID NO: 3404494 - RNA, 19 nt, Pseudomonas aeruginosa PA01
ggucgcgacugaccacgca

SEQ ID NO: 3404495 - RNA, 12 nt, Pseudomonas aeruginosa PA01
ggucgcgaucac

SEQ ID NO: 3404496 - RNA, 19 nt, Pseudomonas aeruginosa PA01
ggucgcgauguuggcgucg

SEQ ID NO: 3404497 - RNA, 16 nt, Pseudomonas aeruginosa PA01
ggucgcgcagcggcuc

SEQ ID NO: 3404498 - RNA, 15 nt, Pseudomonas aeruginosa PA01
ggucgcgcaggcggu

SEQ ID NO: 3404499 - RNA, 16 nt, Pseudomonas aeruginosa PA01
ggucgcgcagggccag

SEQ ID NO: 3404500 - RNA, 13 nt, Pseudomonas aeruginosa PA01
ggucgcgccccgc

SEQ ID NO: 3404501 - RNA, 15 nt, Pseudomonas aeruginosa PA01
ggucgcgccccgcca

SEQ ID NO: 3404502 - RNA, 18 nt, Pseudomonas aeruginosa PA01
ggucgcgcccgcugugcg

SEQ ID NO: 3404503 - RNA, 20 nt, Pseudomonas aeruginosa PA01
ggucgcgcccgcugugcggg

SEQ ID NO: 3404504 - RNA, 14 nt, Pseudomonas aeruginosa PA01
ggucgcgccgacga

SEQ ID NO: 3404505 - RNA, 14 nt, Pseudomonas aeruginosa PA01
ggucgcgccggugg

SEQ ID NO: 3404506 - RNA, 16 nt, Pseudomonas aeruginosa PA01
ggucgcgccgguggcg

SEQ ID NO: 3404507 - RNA, 23 nt, Pseudomonas aeruginosa PA01
ggucgcgccgguggcguacccgc

SEQ ID NO: 3404508 - RNA, 20 nt, Pseudomonas aeruginosa PA01
ggucgcgccguccaucaggc

SEQ ID NO: 3404509 - RNA, 21 nt, Pseudomonas aeruginosa PA01
ggucgcgcgccuucagcccca

SEQ ID NO: 3404510 - RNA, 22 nt, Pseudomonas aeruginosa PA01
ggucgcgcgggugcggcuggcg

SEQ ID NO: 3404511 - RNA, 14 nt, Pseudomonas aeruginosa PA01
ggucgcgcucuggc

SEQ ID NO: 3404512 - RNA, 20 nt, Pseudomonas aeruginosa PA01
ggucgcgcucuggcccagcu

SEQ ID NO: 3404513 - RNA, 22 nt, Pseudomonas aeruginosa PA01
ggucgcgcucuggcccagcuug

SEQ ID NO: 3404514 - RNA, 13 nt, Pseudomonas aeruginosa PA01
ggucgcgcuggac

SEQ ID NO: 3404515 - RNA, 20 nt, Pseudomonas aeruginosa PA01
ggucgcgcuggaccuggccg

SEQ ID NO: 3404516 - RNA, 15 nt, Pseudomonas aeruginosa PA01
ggucgcgcugggcga

SEQ ID NO: 3404517 - RNA, 18 nt, Pseudomonas aeruginosa PA01
ggucgcggaccuccagcc

SEQ ID NO: 3404518 - RNA, 13 nt, Pseudomonas aeruginosa PA01
ggucgcggcgacc

SEQ ID NO: 3404519 - RNA, 19 nt, Pseudomonas aeruginosa PA01
ggucgcggcgaccucuucg

SEQ ID NO: 3404520 - RNA, 12 nt, Pseudomonas aeruginosa PA01
ggucgcggcugc

SEQ ID NO: 3404521 - RNA, 20 nt, Pseudomonas aeruginosa PA01
ggucgcggcuggccgccugg

SEQ ID NO: 3404522 - RNA, 13 nt, Pseudomonas aeruginosa PA01
ggucgcgggcgau

SEQ ID NO: 3404523 - RNA, 19 nt, Pseudomonas aeruginosa PA01
ggucgcguacagcgggccg

SEQ ID NO: 3404524 - RNA, 19 nt, Pseudomonas aeruginosa PA01
ggucgcguagaccaucgcc

SEQ ID NO: 3404525 - RNA, 15 nt, Pseudomonas aeruginosa PA01
ggucgcguuccagcu

SEQ ID NO: 3404526 - RNA, 22 nt, Pseudomonas aeruginosa PA01
ggucgcguuccagcuccgucug

SEQ ID NO: 3404527 - RNA, 15 nt, Pseudomonas aeruginosa PA01
ggucgcguucgucgg

SEQ ID NO: 3404528 - RNA, 18 nt, Pseudomonas aeruginosa PA01
ggucgcguucgucggcca

SEQ ID NO: 3404529 - RNA, 22 nt, Pseudomonas aeruginosa PA01
ggucgcguucgucggccaccag

SEQ ID NO: 3404530 - RNA, 13 nt, Pseudomonas aeruginosa PA01
ggucgcguuggcg

SEQ ID NO: 3404531 - RNA, 17 nt, Pseudomonas aeruginosa PA01
ggucgcguuggcgugcu

SEQ ID NO: 3404532 - RNA, 13 nt, Pseudomonas aeruginosa PA01
ggucgcuccagcc

SEQ ID NO: 3404533 - RNA, 14 nt, Pseudomonas aeruginosa PA01
ggucgcuccagccc

SEQ ID NO: 3404534 - RNA, 16 nt, Pseudomonas aeruginosa PA01
ggucgcugaccacccg

SEQ ID NO: 3404535 - RNA, 21 nt, Pseudomonas aeruginosa PA01
ggucgcugaccacccggugca

SEQ ID NO: 3404536 - RNA, 19 nt, Pseudomonas aeruginosa PA01
ggucgcugaccagcccggc

SEQ ID NO: 3404537 - RNA, 21 nt, Pseudomonas aeruginosa PA01
ggucgcugaccagcccggcgg

SEQ ID NO: 3404538 - RNA, 23 nt, Pseudomonas aeruginosa PA01
ggucgcugaggccgcccuggccg

SEQ ID NO: 3404539 - RNA, 12 nt, Pseudomonas aeruginosa PA01
ggucgcugcuca

SEQ ID NO: 3404540 - RNA, 14 nt, Pseudomonas aeruginosa PA01
ggucgcugcucagg

SEQ ID NO: 3404541 - RNA, 15 nt, Pseudomonas aeruginosa PA01
ggucgcugcucaggg

SEQ ID NO: 3404542 - RNA, 18 nt, Pseudomonas aeruginosa PA01
ggucgcugcucagggccg

SEQ ID NO: 3404543 - RNA, 15 nt, Pseudomonas aeruginosa PA01
ggucgcugcugaaaa

SEQ ID NO: 3404544 - RNA, 11 nt, Pseudomonas aeruginosa PA01
ggucgcuggca

SEQ ID NO: 3404545 - RNA, 17 nt, Pseudomonas aeruginosa PA01
ggucgcuggcaccggcc

SEQ ID NO: 3404546 - RNA, 14 nt, Pseudomonas aeruginosa PA01
ggucgcuggcgucg

SEQ ID NO: 3404547 - RNA, 17 nt, Pseudomonas aeruginosa PA01
ggucgcuggcgucgacc

SEQ ID NO: 3404548 - RNA, 18 nt, Pseudomonas aeruginosa PA01
ggucgcuguccuccagcg

SEQ ID NO: 3404549 - RNA, 20 nt, Pseudomonas aeruginosa PA01
ggucgcuguccuccagcggc

SEQ ID NO: 3404550 - RNA, 14 nt, Pseudomonas aeruginosa PA01
ggucgcuuccucgg

SEQ ID NO: 3404551 - RNA, 17 nt, Pseudomonas aeruginosa PA01
ggucgcuuuuuccgcug

SEQ ID NO: 3404552 - RNA, 20 nt, Pseudomonas aeruginosa PA01
ggucgcuuuuuccgcugccg

SEQ ID NO: 3404553 - RNA, 15 nt, Pseudomonas aeruginosa PA01
ggucggacaggcauu

SEQ ID NO: 3404554 - RNA, 16 nt, Pseudomonas aeruginosa PA01
ggucugcucgcgcuuc

SEQ ID NO: 3404555 - RNA, 17 nt, Pseudomonas aeruginosa PA01
ggucugcucgcgcuucu

SEQ ID NO: 3404556 - RNA, 15 nt, Pseudomonas aeruginosa PA01
ggucugcucggcgau

SEQ ID NO: 3404557 - RNA, 23 nt, Pseudomonas aeruginosa PA01
ggucugcucggcgcccugggugg

SEQ ID NO: 3404558 - RNA, 15 nt, Pseudomonas aeruginosa PA01
ggucugcugcgcgca

SEQ ID NO: 3404559 - RNA, 18 nt, Pseudomonas aeruginosa PA01
ggucugcugcgcgcacca

SEQ ID NO: 3404560 - RNA, 22 nt, Pseudomonas aeruginosa PA01
ggucugcugguagcugcugccg

SEQ ID NO: 3404561 - RNA, 24 nt, Pseudomonas aeruginosa PA01
ggucugcugguagcugcugccggc

SEQ ID NO: 3404562 - RNA, 18 nt, Pseudomonas aeruginosa PA01
ggucugcuugcgcuggcc

SEQ ID NO: 3404563 - RNA, 19 nt, Pseudomonas aeruginosa PA01
ggucugcuugcgcuggccg

SEQ ID NO: 3404564 - RNA, 19 nt, Pseudomonas aeruginosa PA01
ggucuggccggcgaucaga

SEQ ID NO: 3404565 - RNA, 22 nt, Pseudomonas aeruginosa PA01
ggucugguagcgaaucugcagg

SEQ ID NO: 3404566 - RNA, 20 nt, Pseudomonas aeruginosa PA01
ggucuguugguggggcgccg

SEQ ID NO: 3404567 - RNA, 14 nt, Pseudomonas aeruginosa PA01
ggucuucaggcgcc

SEQ ID NO: 3404568 - RNA, 11 nt, Pseudomonas aeruginosa PA01
ggucuucagug

SEQ ID NO: 3404569 - RNA, 17 nt, Pseudomonas aeruginosa PA01
ggucuucagugcacguu

SEQ ID NO: 3404570 - RNA, 19 nt, Pseudomonas aeruginosa PA01
ggucuucaucaccuugccc

SEQ ID NO: 3404571 - RNA, 17 nt, Pseudomonas aeruginosa PA01
ggucuuccucggugucg

SEQ ID NO: 3404572 - RNA, 16 nt, Pseudomonas aeruginosa PA01
ggucuucgcguuggcg

SEQ ID NO: 3404573 - RNA, 22 nt, Pseudomonas aeruginosa PA01
ggucuucgcguuggcggugccg

SEQ ID NO: 3404574 - RNA, 17 nt, Pseudomonas aeruginosa PA01
ggucuugaucacgucca

SEQ ID NO: 3404575 - RNA, 13 nt, Pseudomonas aeruginosa PA01
ggucuugccgacc

SEQ ID NO: 3404576 - RNA, 20 nt, Pseudomonas aeruginosa PA01
ggucuugcgcagggcggcga

SEQ ID NO: 3404577 - RNA, 21 nt, Pseudomonas aeruginosa PA01
ggucuugcgcuugccggccgc

SEQ ID NO: 3404578 - RNA, 19 nt, Pseudomonas aeruginosa PA01
ggucuuggcggcgaucgcc

SEQ ID NO: 3404579 - RNA, 13 nt, Pseudomonas aeruginosa PA01
ggucuugucgaag

SEQ ID NO: 3404580 - RNA, 21 nt, Pseudomonas aeruginosa PA01
ggugaaaccggcaagcuccgc

SEQ ID NO: 3404581 - RNA, 14 nt, Pseudomonas aeruginosa PA01
ggugaacagcggcc

SEQ ID NO: 3404582 - RNA, 14 nt, Pseudomonas aeruginosa PA01
ggugaacgccaggc

SEQ ID NO: 3404583 - RNA, 13 nt, Pseudomonas aeruginosa PA01
ggugaacucaugc

SEQ ID NO: 3404584 - RNA, 16 nt, Pseudomonas aeruginosa PA01
ggugaacuggccgucg

SEQ ID NO: 3404585 - RNA, 17 nt, Pseudomonas aeruginosa PA01
ggugaagcccaccacca

SEQ ID NO: 3404586 - RNA, 16 nt, Pseudomonas aeruginosa PA01
ggugaagcccaggcgc

SEQ ID NO: 3404587 - RNA, 20 nt, Pseudomonas aeruginosa PA01
ggugaagcccaggcgcucgg

SEQ ID NO: 3404588 - RNA, 13 nt, Pseudomonas aeruginosa PA01
ggugaagcgcagg

SEQ ID NO: 3404589 - RNA, 14 nt, Pseudomonas aeruginosa PA01
ggugaagcgcggcg

SEQ ID NO: 3404590 - RNA, 21 nt, Pseudomonas aeruginosa PA01
ggugaagcgcuccggcagguu

SEQ ID NO: 3404591 - RNA, 22 nt, Pseudomonas aeruginosa PA01
ggugaauuccauauucaacguc

SEQ ID NO: 3404592 - RNA, 13 nt, Pseudomonas aeruginosa PA01
ggugacacccugc

SEQ ID NO: 3404593 - RNA, 21 nt, Pseudomonas aeruginosa PA01
ggugacacccugccgcgccgg

SEQ ID NO: 3404594 - RNA, 16 nt, Pseudomonas aeruginosa PA01
ggugaccaccuugauc

SEQ ID NO: 3404595 - RNA, 14 nt, Pseudomonas aeruginosa PA01
ggugaccagcggca

SEQ ID NO: 3404596 - RNA, 19 nt, Pseudomonas aeruginosa PA01
ggugacccacuccggcagg

SEQ ID NO: 3404597 - RNA, 15 nt, Pseudomonas aeruginosa PA01
ggugacccgcacggc

SEQ ID NO: 3404598 - RNA, 14 nt, Pseudomonas aeruginosa PA01
ggugaccgcccagg

SEQ ID NO: 3404599 - RNA, 22 nt, Pseudomonas aeruginosa PA01
ggugaccgcccagggggccggg

SEQ ID NO: 3404600 - RNA, 13 nt, Pseudomonas aeruginosa PA01
ggugaccggcuug

SEQ ID NO: 3404601 - RNA, 12 nt, Pseudomonas aeruginosa PA01
ggugaccgugcg

SEQ ID NO: 3404602 - RNA, 18 nt, Pseudomonas aeruginosa PA01
ggugaccguuucgccgcc

SEQ ID NO: 3404603 - RNA, 19 nt, Pseudomonas aeruginosa PA01
ggugaccguuucgccgccg

SEQ ID NO: 3404604 - RNA, 21 nt, Pseudomonas aeruginosa PA01
ggugaccguuucgccgccggc

SEQ ID NO: 3404605 - RNA, 23 nt, Pseudomonas aeruginosa PA01
ggugaccguuucgccgccggcca

SEQ ID NO: 3404606 - RNA, 17 nt, Pseudomonas aeruginosa PA01
ggugacgaacgaagcgc

SEQ ID NO: 3404607 - RNA, 19 nt, Pseudomonas aeruginosa PA01
ggugacgaacgaagcgccc

SEQ ID NO: 3404608 - RNA, 19 nt, Pseudomonas aeruginosa PA01
ggugacgguccgcgccacg

SEQ ID NO: 3404609 - RNA, 12 nt, Pseudomonas aeruginosa PA01
ggugacggugca

SEQ ID NO: 3404610 - RNA, 14 nt, Pseudomonas aeruginosa PA01
ggugacggugcagc

SEQ ID NO: 3404611 - RNA, 16 nt, Pseudomonas aeruginosa PA01
ggugacguugcgccgc

SEQ ID NO: 3404612 - RNA, 17 nt, Pseudomonas aeruginosa PA01
ggugacguugcgccgca

SEQ ID NO: 3404613 - RNA, 19 nt, Pseudomonas aeruginosa PA01
ggugagcaggcgccggacc

SEQ ID NO: 3404614 - RNA, 13 nt, Pseudomonas aeruginosa PA01
ggugagcauggcg

SEQ ID NO: 3404615 - RNA, 19 nt, Pseudomonas aeruginosa PA01
ggugagcauggcguugagg

SEQ ID NO: 3404616 - RNA, 23 nt, Pseudomonas aeruginosa PA01
ggugagcauggcguugagguugc

SEQ ID NO: 3404617 - RNA, 14 nt, Pseudomonas aeruginosa PA01
ggugagcgacccgc

SEQ ID NO: 3404618 - RNA, 13 nt, Pseudomonas aeruginosa PA01
ggugaggaccugg

SEQ ID NO: 3404619 - RNA, 21 nt, Pseudomonas aeruginosa PA01
ggugaggcgcagcagcgccag

SEQ ID NO: 3404620 - RNA, 17 nt, Pseudomonas aeruginosa PA01
ggugagguagaagcggc

SEQ ID NO: 3404621 - RNA, 20 nt, Pseudomonas aeruginosa PA01
ggugauaccgccggcggcga

SEQ ID NO: 3404622 - RNA, 15 nt, Pseudomonas aeruginosa PA01
ggugaucacccagag

SEQ ID NO: 3404623 - RNA, 14 nt, Pseudomonas aeruginosa PA01
ggugaucagcggcc

SEQ ID NO: 3404624 - RNA, 15 nt, Pseudomonas aeruginosa PA01
ggugaucagcggccg

SEQ ID NO: 3404625 - RNA, 15 nt, Pseudomonas aeruginosa PA01
ggugaucagcuccgc

SEQ ID NO: 3404626 - RNA, 18 nt, Pseudomonas aeruginosa PA01
ggugaucagcuccgccuc

SEQ ID NO: 3404627 - RNA, 20 nt, Pseudomonas aeruginosa PA01
ggugaucaucguccugccgg

SEQ ID NO: 3404628 - RNA, 18 nt, Pseudomonas aeruginosa PA01
ggugauccagcuggcgcg

SEQ ID NO: 3404629 - RNA, 20 nt, Pseudomonas aeruginosa PA01
ggugaucgaaaaaaggcgcc

SEQ ID NO: 3404630 - RNA, 22 nt, Pseudomonas aeruginosa PA01
ggugaucgaaaaaaggcgccuu

SEQ ID NO: 3404631 - RNA, 16 nt, Pseudomonas aeruginosa PA01
ggugaucgaccacaca

SEQ ID NO: 3404632 - RNA, 15 nt, Pseudomonas aeruginosa PA01
ggugaucgagccgcc

SEQ ID NO: 3404633 - RNA, 21 nt, Pseudomonas aeruginosa PA01
ggugaucgagccgccggggaa

SEQ ID NO: 3404634 - RNA, 17 nt, Pseudomonas aeruginosa PA01
ggugaucgagggccacg

SEQ ID NO: 3404635 - RNA, 16 nt, Pseudomonas aeruginosa PA01
ggugaucucgcggcgc

SEQ ID NO: 3404636 - RNA, 17 nt, Pseudomonas aeruginosa PA01
ggugaucucgcggcgcg

SEQ ID NO: 3404637 - RNA, 22 nt, Pseudomonas aeruginosa PA01
ggugaucuggaaauucagcgcu

SEQ ID NO: 3404638 - RNA, 24 nt, Pseudomonas aeruginosa PA01
ggugaugaccccggcgaugcugcu

SEQ ID NO: 3404639 - RNA, 22 nt, Pseudomonas aeruginosa PA01
ggugaugcacguugggauagcu

SEQ ID NO: 3404640 - RNA, 14 nt, Pseudomonas aeruginosa PA01
ggugaugccgcgga

SEQ ID NO: 3404641 - RNA, 17 nt, Pseudomonas aeruginosa PA01
ggugauguaggacgccu

SEQ ID NO: 3404642 - RNA, 14 nt, Pseudomonas aeruginosa PA01
ggugaugucgcggc

SEQ ID NO: 3404643 - RNA, 23 nt, Pseudomonas aeruginosa PA01
ggugaugucggcgcugucgccgu

SEQ ID NO: 3404644 - RNA, 22 nt, Pseudomonas aeruginosa PA01
ggugauuuacaggacugugcuu

SEQ ID NO: 3404645 - RNA, 22 nt, Pseudomonas aeruginosa PA01
ggugcaccaggcgaugcgccgg

SEQ ID NO: 3404646 - RNA, 17 nt, Pseudomonas aeruginosa PA01
ggugcaccgcgcuggag

SEQ ID NO: 3404647 - RNA, 13 nt, Pseudomonas aeruginosa PA01
ggugcaccuggcg

SEQ ID NO: 3404648 - RNA, 17 nt, Pseudomonas aeruginosa PA01
ggugcacgccgauggcg

SEQ ID NO: 3404649 - RNA, 14 nt, Pseudomonas aeruginosa PA01
ggugcacgcgccgg

SEQ ID NO: 3404650 - RNA, 13 nt, Pseudomonas aeruginosa PA01
ggugcacggccag

SEQ ID NO: 3404651 - RNA, 22 nt, Pseudomonas aeruginosa PA01
ggugcacggccaggccacggcc

SEQ ID NO: 3404652 - RNA, 20 nt, Pseudomonas aeruginosa PA01
ggugcagaagacgcccagca

SEQ ID NO: 3404653 - RNA, 20 nt, Pseudomonas aeruginosa PA01
ggugcagagcagagucgccg

SEQ ID NO: 3404654 - RNA, 21 nt, Pseudomonas aeruginosa PA01
ggugcagagcagagucgccgg

SEQ ID NO: 3404655 - RNA, 17 nt, Pseudomonas aeruginosa PA01
ggugcagauggucgccg

SEQ ID NO: 3404656 - RNA, 17 nt, Pseudomonas aeruginosa PA01
gguggaguaccaggcca

SEQ ID NO: 3404657 - RNA, 16 nt, Pseudomonas aeruginosa PA01
gguggauaucgucggg

SEQ ID NO: 3404658 - RNA, 14 nt, Pseudomonas aeruginosa PA01
gguggaucgcggcg

SEQ ID NO: 3404659 - RNA, 15 nt, Pseudomonas aeruginosa PA01
gguggcaugggccag

SEQ ID NO: 3404660 - RNA, 22 nt, Pseudomonas aeruginosa PA01
gguggcaugggccaguuccggc

SEQ ID NO: 3404661 - RNA, 14 nt, Pseudomonas aeruginosa PA01
gguggccaggacgc

SEQ ID NO: 3404662 - RNA, 19 nt, Pseudomonas aeruginosa PA01
gguggccaggacgcuggcg

SEQ ID NO: 3404663 - RNA, 20 nt, Pseudomonas aeruginosa PA01
gguggccaggacgcuggcga

SEQ ID NO: 3404664 - RNA, 21 nt, Pseudomonas aeruginosa PA01
gguggccaggacgcuggcgau

SEQ ID NO: 3404665 - RNA, 14 nt, Pseudomonas aeruginosa PA01
gguggccaggcgca

SEQ ID NO: 3404666 - RNA, 15 nt, Pseudomonas aeruginosa PA01
gguggcccugggcgg

SEQ ID NO: 3404667 - RNA, 20 nt, Pseudomonas aeruginosa PA01
gguggcccugggcggcgacc

SEQ ID NO: 3404668 - RNA, 13 nt, Pseudomonas aeruginosa PA01
gguggccgcgccg

SEQ ID NO: 3404669 - RNA, 15 nt, Pseudomonas aeruginosa PA01
gguggccgcgccgcc

SEQ ID NO: 3404670 - RNA, 14 nt, Pseudomonas aeruginosa PA01
gguggccgugcagc

SEQ ID NO: 3404671 - RNA, 15 nt, Pseudomonas aeruginosa PA01
gguggccgugcagcc

SEQ ID NO: 3404672 - RNA, 14 nt, Pseudomonas aeruginosa PA01
gguggcgaacagca

SEQ ID NO: 3404673 - RNA, 17 nt, Pseudomonas aeruginosa PA01
gguggcgaacagcaccu

SEQ ID NO: 3404674 - RNA, 16 nt, Pseudomonas aeruginosa PA01
gguggcgaccaggaca

SEQ ID NO: 3404675 - RNA, 18 nt, Pseudomonas aeruginosa PA01
gguggcgaccaggacagc

SEQ ID NO: 3404676 - RNA, 19 nt, Pseudomonas aeruginosa PA01
gguggcgacgcgcaggccg

SEQ ID NO: 3404677 - RNA, 20 nt, Pseudomonas aeruginosa PA01
gguggcgacgcgcaggccgg

SEQ ID NO: 3404678 - RNA, 17 nt, Pseudomonas aeruginosa PA01
gguggcgcccaugccgc

SEQ ID NO: 3404679 - RNA, 18 nt, Pseudomonas aeruginosa PA01
gguggcgcccaugccgcc

SEQ ID NO: 3404680 - RNA, 12 nt, Pseudomonas aeruginosa PA01
gguggcgccgcc

SEQ ID NO: 3404681 - RNA, 17 nt, Pseudomonas aeruginosa PA01
gguggcgccgccggcga

SEQ ID NO: 3404682 - RNA, 13 nt, Pseudomonas aeruginosa PA01
gguggcgccggcu

SEQ ID NO: 3404683 - RNA, 23 nt, Pseudomonas aeruginosa PA01
gguggcgccggcugacgcuggcg

SEQ ID NO: 3404684 - RNA, 16 nt, Pseudomonas aeruginosa PA01
gguggcgcgcaccacc

SEQ ID NO: 3404685 - RNA, 14 nt, Pseudomonas aeruginosa PA01
gguggcgcugucgc

SEQ ID NO: 3404686 - RNA, 16 nt, Pseudomonas aeruginosa PA01
gguggcggcggcgagu

SEQ ID NO: 3404687 - RNA, 17 nt, Pseudomonas aeruginosa PA01
gguggcggggaacagca

SEQ ID NO: 3404688 - RNA, 15 nt, Pseudomonas aeruginosa PA01
gguggcgggucggcg

SEQ ID NO: 3404689 - RNA, 13 nt, Pseudomonas aeruginosa PA01
gguggcgguugcg

SEQ ID NO: 3404690 - RNA, 23 nt, Pseudomonas aeruginosa PA01
gguggcguucucgaucaucgcca

SEQ ID NO: 3404691 - RNA, 15 nt, Pseudomonas aeruginosa PA01
gguggcguugcaggg

SEQ ID NO: 3404692 - RNA, 17 nt, Pseudomonas aeruginosa PA01
gguggcugaagccccag

SEQ ID NO: 3404693 - RNA, 21 nt, Pseudomonas aeruginosa PA01
ggugggaacgaaacgcuugcg

SEQ ID NO: 3404694 - RNA, 13 nt, Pseudomonas aeruginosa PA01
ggugggcagcagc

SEQ ID NO: 3404695 - RNA, 14 nt, Pseudomonas aeruginosa PA01
ggugggcagcagcg

SEQ ID NO: 3404696 - RNA, 12 nt, Pseudomonas aeruginosa PA01
ggugggcggcgg

SEQ ID NO: 3404697 - RNA, 13 nt, Pseudomonas aeruginosa PA01
ggugggcuccagc

SEQ ID NO: 3404698 - RNA, 19 nt, Pseudomonas aeruginosa PA01
ggugguacggcugagaccu

SEQ ID NO: 3404699 - RNA, 24 nt, Pseudomonas aeruginosa PA01
ggugguacggcugagaccuuccug

SEQ ID NO: 3404700 - RNA, 15 nt, Pseudomonas aeruginosa PA01
ggugguagagcggca

SEQ ID NO: 3404701 - RNA, 18 nt, Pseudomonas aeruginosa PA01
ggugguagagcggcaccu

SEQ ID NO: 3404702 - RNA, 23 nt, Pseudomonas aeruginosa PA01
gguggucaccagcgugggcaaca

SEQ ID NO: 3404703 - RNA, 13 nt, Pseudomonas aeruginosa PA01
gguggucaccgcc

SEQ ID NO: 3404704 - RNA, 15 nt, Pseudomonas aeruginosa PA01
gguggucaccgccag

SEQ ID NO: 3404705 - RNA, 15 nt, Pseudomonas aeruginosa PA01
gguggucagccagcc

SEQ ID NO: 3404706 - RNA, 22 nt, Pseudomonas aeruginosa PA01
gguggucgaggguggucagcca

SEQ ID NO: 3404707 - RNA, 19 nt, Pseudomonas aeruginosa PA01
gguggucgaugggcgagcg

SEQ ID NO: 3404708 - RNA, 20 nt, Pseudomonas aeruginosa PA01
gguggucguagcagguccgc

SEQ ID NO: 3404709 - RNA, 15 nt, Pseudomonas aeruginosa PA01
gguggucugcacggc

SEQ ID NO: 3404710 - RNA, 23 nt, Pseudomonas aeruginosa PA01
gguggugacauggaugaccacgu

SEQ ID NO: 3404711 - RNA, 18 nt, Pseudomonas aeruginosa PA01
gguggugaucagcggccg

SEQ ID NO: 3404712 - RNA, 22 nt, Pseudomonas aeruginosa PA01
gguggugauccaggcgucguug

SEQ ID NO: 3404713 - RNA, 18 nt, Pseudomonas aeruginosa PA01
gguggugucugguuccug

SEQ ID NO: 3404714 - RNA, 22 nt, Pseudomonas aeruginosa PA01
gguguacuugacggcgccgaug

SEQ ID NO: 3404715 - RNA, 17 nt, Pseudomonas aeruginosa PA01
gguguagaggaucuccg

SEQ ID NO: 3404716 - RNA, 13 nt, Pseudomonas aeruginosa PA01
gguguagcugcag

SEQ ID NO: 3404717 - RNA, 19 nt, Pseudomonas aeruginosa PA01
gguguaggcgaucuggcga

SEQ ID NO: 3404718 - RNA, 13 nt, Pseudomonas aeruginosa PA01
ggugucaggccga

SEQ ID NO: 3404719 - RNA, 14 nt, Pseudomonas aeruginosa PA01
gguguccaccacca

SEQ ID NO: 3404720 - RNA, 17 nt, Pseudomonas aeruginosa PA01
gguguccaccaccagca

SEQ ID NO: 3404721 - RNA, 20 nt, Pseudomonas aeruginosa PA01
gguguccaccaccagcaggc

SEQ ID NO: 3404722 - RNA, 13 nt, Pseudomonas aeruginosa PA01
gguguccgcggug

SEQ ID NO: 3404723 - RNA, 14 nt, Pseudomonas aeruginosa PA01
gguguccggcggcg

SEQ ID NO: 3404724 - RNA, 22 nt, Pseudomonas aeruginosa PA01
ggugucgacgacgaaaggccgc

SEQ ID NO: 3404725 - RNA, 15 nt, Pseudomonas aeruginosa PA01
ggugucgaugccgcc

SEQ ID NO: 3404726 - RNA, 11 nt, Pseudomonas aeruginosa PA01
ggugucgccgc

SEQ ID NO: 3404727 - RNA, 15 nt, Pseudomonas aeruginosa PA01
ggugucggccgccag

SEQ ID NO: 3404728 - RNA, 16 nt, Pseudomonas aeruginosa PA01
ggugucggugcccucg

SEQ ID NO: 3404729 - RNA, 13 nt, Pseudomonas aeruginosa PA01
ggugugaucacca

SEQ ID NO: 3404730 - RNA, 20 nt, Pseudomonas aeruginosa PA01
ggugugcaacggaaacacag

SEQ ID NO: 3404731 - RNA, 16 nt, Pseudomonas aeruginosa PA01
ggugugccgucaggca

SEQ ID NO: 3404732 - RNA, 12 nt, Pseudomonas aeruginosa PA01
ggugugcgcugc

SEQ ID NO: 3404733 - RNA, 15 nt, Pseudomonas aeruginosa PA01
ggugugcucaggcga

SEQ ID NO: 3404734 - RNA, 16 nt, Pseudomonas aeruginosa PA01
ggugugcucaggcgaa

SEQ ID NO: 3404735 - RNA, 18 nt, Pseudomonas aeruginosa PA01
gguguucccggaucagcu

SEQ ID NO: 3404736 - RNA, 12 nt, Pseudomonas aeruginosa PA01
gguguucggccc

SEQ ID NO: 3404737 - RNA, 14 nt, Pseudomonas aeruginosa PA01
gguguucggccccg

SEQ ID NO: 3404738 - RNA, 18 nt, Pseudomonas aeruginosa PA01
gguguucguccagaugcu

SEQ ID NO: 3404739 - RNA, 13 nt, Pseudomonas aeruginosa PA01
gguguugaugguc

SEQ ID NO: 3404740 - RNA, 14 nt, Pseudomonas aeruginosa PA01
gguguuggucaggc

SEQ ID NO: 3404741 - RNA, 15 nt, Pseudomonas aeruginosa PA01
gguguuggucaggcc

SEQ ID NO: 3404742 - RNA, 18 nt, Pseudomonas aeruginosa PA01
gguguugucgcggcugac

SEQ ID NO: 3404743 - RNA, 14 nt, Pseudomonas aeruginosa PA01
gguguuguggcugg

SEQ ID NO: 3404744 - RNA, 17 nt, Pseudomonas aeruginosa PA01
gguguuguucgccagca

SEQ ID NO: 3404745 - RNA, 14 nt, Pseudomonas aeruginosa PA01
gguguuucggccgc

SEQ ID NO: 3404746 - RNA, 18 nt, Pseudomonas aeruginosa PA01
gguuaacaguugagcugu

SEQ ID NO: 3404747 - RNA, 16 nt, Pseudomonas aeruginosa PA01
gguuaccggcgaccac

SEQ ID NO: 3404748 - RNA, 14 nt, Pseudomonas aeruginosa PA01
gguuagccggcgau

SEQ ID NO: 3404749 - RNA, 15 nt, Pseudomonas aeruginosa PA01
gguuauccgccgccu

SEQ ID NO: 3404750 - RNA, 23 nt, Pseudomonas aeruginosa PA01
gguuauccgccggaaccugcaug

SEQ ID NO: 3404751 - RNA, 18 nt, Pseudomonas aeruginosa PA01
gguuauccgccggcugug

SEQ ID NO: 3404752 - RNA, 19 nt, Pseudomonas aeruginosa PA01
gguuaucgaggcgucggcg

SEQ ID NO: 3404753 - RNA, 18 nt, Pseudomonas aeruginosa PA01
gguuauucgcccuacccc

SEQ ID NO: 3404754 - RNA, 23 nt, Pseudomonas aeruginosa PA01
gguucaauccuuccgucgucacc

SEQ ID NO: 3404755 - RNA, 17 nt, Pseudomonas aeruginosa PA01
gguucagcagcggcacc

SEQ ID NO: 3404756 - RNA, 22 nt, Pseudomonas aeruginosa PA01
gguucagcagcggcacccggcu

SEQ ID NO: 3404757 - RNA, 22 nt, Pseudomonas aeruginosa PA01
gguucagcgggacagcuugccg

SEQ ID NO: 3404758 - RNA, 13 nt, Pseudomonas aeruginosa PA01
gguucaggccggg

SEQ ID NO: 3404759 - RNA, 13 nt, Pseudomonas aeruginosa PA01
gguugcggcgccc

SEQ ID NO: 3404760 - RNA, 15 nt, Pseudomonas aeruginosa PA01
gguugcggcgcccgc

SEQ ID NO: 3404761 - RNA, 16 nt, Pseudomonas aeruginosa PA01
gguugcggcgcccgcc

SEQ ID NO: 3404762 - RNA, 19 nt, Pseudomonas aeruginosa PA01
gguugcggcgcccgccaag

SEQ ID NO: 3404763 - RNA, 18 nt, Pseudomonas aeruginosa PA01
gguugcgggagcacuggg

SEQ ID NO: 3404764 - RNA, 21 nt, Pseudomonas aeruginosa PA01
gguugcugcugcggggccgga

SEQ ID NO: 3404765 - RNA, 18 nt, Pseudomonas aeruginosa PA01
gguugcugcuugcgcgcg

SEQ ID NO: 3404766 - RNA, 21 nt, Pseudomonas aeruginosa PA01
gguugcugcuugcgcgcggcg

SEQ ID NO: 3404767 - RNA, 15 nt, Pseudomonas aeruginosa PA01
gguugcuguagaaug

SEQ ID NO: 3404768 - RNA, 17 nt, Pseudomonas aeruginosa PA01
gguuggccaguuggccc

SEQ ID NO: 3404769 - RNA, 14 nt, Pseudomonas aeruginosa PA01
gguuggccccgccg

SEQ ID NO: 3404770 - RNA, 22 nt, Pseudomonas aeruginosa PA01
gguuggccgaaagcacugcggc

SEQ ID NO: 3404771 - RNA, 14 nt, Pseudomonas aeruginosa PA01
gguuggccgcagca

SEQ ID NO: 3404772 - RNA, 12 nt, Pseudomonas aeruginosa PA01
gguuggccgccu

SEQ ID NO: 3404773 - RNA, 14 nt, Pseudomonas aeruginosa PA01
gguuggccgccugg

SEQ ID NO: 3404774 - RNA, 16 nt, Pseudomonas aeruginosa PA01
gguuggccgccuggcg

SEQ ID NO: 3404775 - RNA, 17 nt, Pseudomonas aeruginosa PA01
gguuggccuggcccggc

SEQ ID NO: 3404776 - RNA, 18 nt, Pseudomonas aeruginosa PA01
gguuggccuggcccggcg

SEQ ID NO: 3404777 - RNA, 20 nt, Pseudomonas aeruginosa PA01
gguuggcgaggucgcggacg

SEQ ID NO: 3404778 - RNA, 15 nt, Pseudomonas aeruginosa PA01
gguuggcgcaggccg

SEQ ID NO: 3404779 - RNA, 20 nt, Pseudomonas aeruginosa PA01
gguuggcuacccgcagggcu

SEQ ID NO: 3404780 - RNA, 22 nt, Pseudomonas aeruginosa PA01
gguuggcuacccgcagggcucg

SEQ ID NO: 3404781 - RNA, 13 nt, Pseudomonas aeruginosa PA01
gguuggcuuccag

SEQ ID NO: 3404782 - RNA, 18 nt, Pseudomonas aeruginosa PA01
gguugggcagcgucgccg

SEQ ID NO: 3404783 - RNA, 15 nt, Pseudomonas aeruginosa PA01
gguugggcaggcgca

SEQ ID NO: 3404784 - RNA, 15 nt, Pseudomonas aeruginosa PA01
gguuggucugcucgg

SEQ ID NO: 3404785 - RNA, 16 nt, Pseudomonas aeruginosa PA01
gguuggucugcucggc

SEQ ID NO: 3404786 - RNA, 18 nt, Pseudomonas aeruginosa PA01
gguuggucugcucggcga

SEQ ID NO: 3404787 - RNA, 21 nt, Pseudomonas aeruginosa PA01
gguugguggccgcgccgcccu

SEQ ID NO: 3404788 - RNA, 15 nt, Pseudomonas aeruginosa PA01
gguuguagcccuggg

SEQ ID NO: 3404789 - RNA, 13 nt, Pseudomonas aeruginosa PA01
gguuguaggcgcc

SEQ ID NO: 3404790 - RNA, 17 nt, Pseudomonas aeruginosa PA01
gguuguaggcgccgccg

SEQ ID NO: 3404791 - RNA, 16 nt, Pseudomonas aeruginosa PA01
gguugucaccggcagg

SEQ ID NO: 3404792 - RNA, 13 nt, Pseudomonas aeruginosa PA01
gguuucaggccuu

SEQ ID NO: 3404793 - RNA, 14 nt, Pseudomonas aeruginosa PA01
gguuuccaggcuca

SEQ ID NO: 3404794 - RNA, 15 nt, Pseudomonas aeruginosa PA01
gguuuccaggcucac

SEQ ID NO: 3404795 - RNA, 20 nt, Pseudomonas aeruginosa PA01
gguuuccgccggacccugcc

SEQ ID NO: 3404796 - RNA, 21 nt, Pseudomonas aeruginosa PA01
gguuuccgccggacccugccg

SEQ ID NO: 3404797 - RNA, 16 nt, Pseudomonas aeruginosa PA01
gguuuccggccaggcg

SEQ ID NO: 3404798 - RNA, 17 nt, Pseudomonas aeruginosa PA01
gguuucgaccggcgcgc

SEQ ID NO: 3404799 - RNA, 14 nt, Pseudomonas aeruginosa PA01
gguuucgcagcgcu

SEQ ID NO: 3404800 - RNA, 15 nt, Pseudomonas aeruginosa PA01
gguuucgcugcugcc

SEQ ID NO: 3404801 - RNA, 12 nt, Pseudomonas aeruginosa PA01
gguuucgucgcg

SEQ ID NO: 3404802 - RNA, 18 nt, Pseudomonas aeruginosa PA01
gguuucuuuuuauccggc

SEQ ID NO: 3404803 - RNA, 15 nt, Pseudomonas aeruginosa PA01
gguuuggcgcccgcc

SEQ ID NO: 3404804 - RNA, 22 nt, Pseudomonas aeruginosa PA01
gguuuuugagcgaaaacagccg

SEQ ID NO: 3404805 - RNA, 20 nt, Pseudomonas aeruginosa PA01
guaaacgcgaaugcccggca

SEQ ID NO: 3404806 - RNA, 21 nt, Pseudomonas aeruginosa PA01
guaacaagcauucuggaugca

SEQ ID NO: 3404807 - RNA, 15 nt, Pseudomonas aeruginosa PA01
guaacccagggugcg

SEQ ID NO: 3404808 - RNA, 21 nt, Pseudomonas aeruginosa PA01
guaacccgcggcgagguugcc

SEQ ID NO: 3404809 - RNA, 18 nt, Pseudomonas aeruginosa PA01
guaacgguagcggcagga

SEQ ID NO: 3404810 - RNA, 11 nt, Pseudomonas aeruginosa PA01
guaagcggcgu

SEQ ID NO: 3404811 - RNA, 17 nt, Pseudomonas aeruginosa PA01
guaaggauguccgggug

SEQ ID NO: 3404812 - RNA, 17 nt, Pseudomonas aeruginosa PA01
guaaggcaccaccgccg

SEQ ID NO: 3404813 - RNA, 21 nt, Pseudomonas aeruginosa PA01
guaaggcaccaccgccgccag

SEQ ID NO: 3404814 - RNA, 16 nt, Pseudomonas aeruginosa PA01
guaaggcaugcccagg

SEQ ID NO: 3404815 - RNA, 20 nt, Pseudomonas aeruginosa PA01
guaagguugccgaucaggcu

SEQ ID NO: 3404816 - RNA, 21 nt, Pseudomonas aeruginosa PA01
guaauaggcgaagcggcucgg

SEQ ID NO: 3404817 - RNA, 16 nt, Pseudomonas aeruginosa PA01
guaaucaccuuccucg

SEQ ID NO: 3404818 - RNA, 20 nt, Pseudomonas aeruginosa PA01
guaaugagcgauguccaggc

SEQ ID NO: 3404819 - RNA, 17 nt, Pseudomonas aeruginosa PA01
guaaugcaacccgccgc

SEQ ID NO: 3404820 - RNA, 20 nt, Pseudomonas aeruginosa PA01
guacaccaggguggcgcgca

SEQ ID NO: 3404821 - RNA, 13 nt, Pseudomonas aeruginosa PA01
guacaccgccagg

SEQ ID NO: 3404822 - RNA, 15 nt, Pseudomonas aeruginosa PA01
guacaccgcgcggca

SEQ ID NO: 3404823 - RNA, 17 nt, Pseudomonas aeruginosa PA01
guacaccgcgcggcaca

SEQ ID NO: 3404824 - RNA, 14 nt, Pseudomonas aeruginosa PA01
guacagcacccagg

SEQ ID NO: 3404825 - RNA, 12 nt, Pseudomonas aeruginosa PA01
guacagcaggag

SEQ ID NO: 3404826 - RNA, 14 nt, Pseudomonas aeruginosa PA01
guacagcaggagcg

SEQ ID NO: 3404827 - RNA, 12 nt, Pseudomonas aeruginosa PA01
guacagcaggca

SEQ ID NO: 3404828 - RNA, 15 nt, Pseudomonas aeruginosa PA01
guacagcaggcaggc

SEQ ID NO: 3404829 - RNA, 16 nt, Pseudomonas aeruginosa PA01
guacagcaggcaggca

SEQ ID NO: 3404830 - RNA, 17 nt, Pseudomonas aeruginosa PA01
guacagcaggcaggcau

SEQ ID NO: 3404831 - RNA, 17 nt, Pseudomonas aeruginosa PA01
guacagcccccgccggc

SEQ ID NO: 3404832 - RNA, 18 nt, Pseudomonas aeruginosa PA01
guacagcccccgccggcc

SEQ ID NO: 3404833 - RNA, 21 nt, Pseudomonas aeruginosa PA01
guacagcccccgccggccggg

SEQ ID NO: 3404834 - RNA, 22 nt, Pseudomonas aeruginosa PA01
guacagcccccgccggccggga

SEQ ID NO: 3404835 - RNA, 23 nt, Pseudomonas aeruginosa PA01
guacagcgacucgcugccggcgc

SEQ ID NO: 3404836 - RNA, 11 nt, Pseudomonas aeruginosa PA01
guacagcgagg

SEQ ID NO: 3404837 - RNA, 14 nt, Pseudomonas aeruginosa PA01
guacagcgaggccc

SEQ ID NO: 3404838 - RNA, 21 nt, Pseudomonas aeruginosa PA01
guacagcgccacggccagcag

SEQ ID NO: 3404839 - RNA, 22 nt, Pseudomonas aeruginosa PA01
guacagcgccacggccagcagg

SEQ ID NO: 3404840 - RNA, 20 nt, Pseudomonas aeruginosa PA01
guacagcgcgacaucggcga

SEQ ID NO: 3404841 - RNA, 23 nt, Pseudomonas aeruginosa PA01
guacagcgcgacaucggcgaugg

SEQ ID NO: 3404842 - RNA, 16 nt, Pseudomonas aeruginosa PA01
guacagcgggccgggg

SEQ ID NO: 3404843 - RNA, 17 nt, Pseudomonas aeruginosa PA01
guacagcgggucggcga

SEQ ID NO: 3404844 - RNA, 22 nt, Pseudomonas aeruginosa PA01
guacagcucaccccaggaaaac

SEQ ID NO: 3404845 - RNA, 13 nt, Pseudomonas aeruginosa PA01
guacagcucgcgc

SEQ ID NO: 3404846 - RNA, 22 nt, Pseudomonas aeruginosa PA01
guacagcucgcgcaaccagccg

SEQ ID NO: 3404847 - RNA, 14 nt, Pseudomonas aeruginosa PA01
guacagcucggcgc

SEQ ID NO: 3404848 - RNA, 14 nt, Pseudomonas aeruginosa PA01
guacagcucguccu

SEQ ID NO: 3404849 - RNA, 18 nt, Pseudomonas aeruginosa PA01
guacagcugcaccgcgcg

SEQ ID NO: 3404850 - RNA, 23 nt, Pseudomonas aeruginosa PA01
guacagcuguccgcgccgcgucg

SEQ ID NO: 3404851 - RNA, 20 nt, Pseudomonas aeruginosa PA01
guacaggaaucauuuggugu

SEQ ID NO: 3404852 - RNA, 15 nt, Pseudomonas aeruginosa PA01
guacaggccaccgcg

SEQ ID NO: 3404853 - RNA, 16 nt, Pseudomonas aeruginosa PA01
guacaggccccaggcg

SEQ ID NO: 3404854 - RNA, 22 nt, Pseudomonas aeruginosa PA01
guacaggcggauuuccugcggc

SEQ ID NO: 3404855 - RNA, 19 nt, Pseudomonas aeruginosa PA01
guacagggucuugccggua

SEQ ID NO: 3404856 - RNA, 18 nt, Pseudomonas aeruginosa PA01
guacagguuguucggcga

SEQ ID NO: 3404857 - RNA, 19 nt, Pseudomonas aeruginosa PA01
guacauggccuucucgucg

SEQ ID NO: 3404858 - RNA, 14 nt, Pseudomonas aeruginosa PA01
guaccacgcccgcg

SEQ ID NO: 3404859 - RNA, 18 nt, Pseudomonas aeruginosa PA01
guaccagcaaugcccagc

SEQ ID NO: 3404860 - RNA, 22 nt, Pseudomonas aeruginosa PA01
guaccagcaaugcccagcgcag

SEQ ID NO: 3404861 - RNA, 15 nt, Pseudomonas aeruginosa PA01
guaccagccgcgguc

SEQ ID NO: 3404862 - RNA, 17 nt, Pseudomonas aeruginosa PA01
guagaccaccagcagga

SEQ ID NO: 3404863 - RNA, 23 nt, Pseudomonas aeruginosa PA01
guagaccaccagcaggaucgagc

SEQ ID NO: 3404864 - RNA, 21 nt, Pseudomonas aeruginosa PA01
guagaccaccgugcgcaccuc

SEQ ID NO: 3404865 - RNA, 18 nt, Pseudomonas aeruginosa PA01
guagaccacgcaggccag

SEQ ID NO: 3404866 - RNA, 20 nt, Pseudomonas aeruginosa PA01
guagaccacgcaggccagcg

SEQ ID NO: 3404867 - RNA, 23 nt, Pseudomonas aeruginosa PA01
guagaccacgcaggccagcgcca

SEQ ID NO: 3404868 - RNA, 16 nt, Pseudomonas aeruginosa PA01
guagaccaucgccggc

SEQ ID NO: 3404869 - RNA, 18 nt, Pseudomonas aeruginosa PA01
guagaccaucgccggcga

SEQ ID NO: 3404870 - RNA, 21 nt, Pseudomonas aeruginosa PA01
guagaccaucgccggcgagcc

SEQ ID NO: 3404871 - RNA, 14 nt, Pseudomonas aeruginosa PA01
guagaccugggaac

SEQ ID NO: 3404872 - RNA, 19 nt, Pseudomonas aeruginosa PA01
guagacgaaacucaucagg

SEQ ID NO: 3404873 - RNA, 13 nt, Pseudomonas aeruginosa PA01
guagacgaugccg

SEQ ID NO: 3404874 - RNA, 17 nt, Pseudomonas aeruginosa PA01
guagacgaugccguucu

SEQ ID NO: 3404875 - RNA, 18 nt, Pseudomonas aeruginosa PA01
guagacguccuccaccgc

SEQ ID NO: 3404876 - RNA, 15 nt, Pseudomonas aeruginosa PA01
guagagacggcggcg

SEQ ID NO: 3404877 - RNA, 16 nt, Pseudomonas aeruginosa PA01
guagagacggcggcga

SEQ ID NO: 3404878 - RNA, 19 nt, Pseudomonas aeruginosa PA01
guagagaugcaccggccac

SEQ ID NO: 3404879 - RNA, 17 nt, Pseudomonas aeruginosa PA01
guagagcagcccgggca

SEQ ID NO: 3404880 - RNA, 14 nt, Pseudomonas aeruginosa PA01
guagagcaggcugc

SEQ ID NO: 3404881 - RNA, 14 nt, Pseudomonas aeruginosa PA01
guagagcgcggcgc

SEQ ID NO: 3404882 - RNA, 20 nt, Pseudomonas aeruginosa PA01
guagaggaugccggccucga

SEQ ID NO: 3404883 - RNA, 15 nt, Pseudomonas aeruginosa PA01
guagaggcucggcgg

SEQ ID NO: 3404884 - RNA, 16 nt, Pseudomonas aeruginosa PA01
guagaggcucggcggc

SEQ ID NO: 3404885 - RNA, 17 nt, Pseudomonas aeruginosa PA01
guagaggcuguagcgcu

SEQ ID NO: 3404886 - RNA, 19 nt, Pseudomonas aeruginosa PA01
guagaggcugucgucgagg

SEQ ID NO: 3404887 - RNA, 20 nt, Pseudomonas aeruginosa PA01
guagaggucgccguccuugu

SEQ ID NO: 3404888 - RNA, 14 nt, Pseudomonas aeruginosa PA01
guagagguugccgu

SEQ ID NO: 3404889 - RNA, 19 nt, Pseudomonas aeruginosa PA01
guagagucgcucgcgcagg

SEQ ID NO: 3404890 - RNA, 15 nt, Pseudomonas aeruginosa PA01
guagaguucgcugcg

SEQ ID NO: 3404891 - RNA, 19 nt, Pseudomonas aeruginosa PA01
guagaguucgcugcgcgcc

SEQ ID NO: 3404892 - RNA, 16 nt, Pseudomonas aeruginosa PA01
guagaguucggcugcg

SEQ ID NO: 3404893 - RNA, 17 nt, Pseudomonas aeruginosa PA01
guagaguuugccgaacu

SEQ ID NO: 3404894 - RNA, 17 nt, Pseudomonas aeruginosa PA01
guagaucccuucguccu

SEQ ID NO: 3404895 - RNA, 12 nt, Pseudomonas aeruginosa PA01
guagaucgaugc

SEQ ID NO: 3404896 - RNA, 14 nt, Pseudomonas aeruginosa PA01
guagaucggcagca

SEQ ID NO: 3404897 - RNA, 23 nt, Pseudomonas aeruginosa PA01
guagaucggcagcaucagccgcg

SEQ ID NO: 3404898 - RNA, 23 nt, Pseudomonas aeruginosa PA01
guagaucugugcggugccgcgca

SEQ ID NO: 3404899 - RNA, 17 nt, Pseudomonas aeruginosa PA01
guagaugcggcugugcu

SEQ ID NO: 3404900 - RNA, 16 nt, Pseudomonas aeruginosa PA01
guagauuuacaagccc

SEQ ID NO: 3404901 - RNA, 20 nt, Pseudomonas aeruginosa PA01
guagcaauacaccuuggugu

SEQ ID NO: 3404902 - RNA, 23 nt, Pseudomonas aeruginosa PA01
guagcacauggucuucccagacc

SEQ ID NO: 3404903 - RNA, 19 nt, Pseudomonas aeruginosa PA01
guagcagagggucgccagc

SEQ ID NO: 3404904 - RNA, 17 nt, Pseudomonas aeruginosa PA01
guagcagggugcgggcg

SEQ ID NO: 3404905 - RNA, 18 nt, Pseudomonas aeruginosa PA01
guagcagggugcgggcgc

SEQ ID NO: 3404906 - RNA, 15 nt, Pseudomonas aeruginosa PA01
guagcagguccgcgc

SEQ ID NO: 3404907 - RNA, 19 nt, Pseudomonas aeruginosa PA01
guagccaggggucaggccg

SEQ ID NO: 3404908 - RNA, 22 nt, Pseudomonas aeruginosa PA01
guagccaggggucaggccgaug

SEQ ID NO: 3404909 - RNA, 15 nt, Pseudomonas aeruginosa PA01
guagccaugcacacg

SEQ ID NO: 3404910 - RNA, 17 nt, Pseudomonas aeruginosa PA01
guagccaugcacacgcu

SEQ ID NO: 3404911 - RNA, 19 nt, Pseudomonas aeruginosa PA01
guagccaugcacacgcucc

SEQ ID NO: 3404912 - RNA, 14 nt, Pseudomonas aeruginosa PA01
guagcccaccucgg

SEQ ID NO: 3404913 - RNA, 14 nt, Pseudomonas aeruginosa PA01
guagcccaggccga

SEQ ID NO: 3404914 - RNA, 13 nt, Pseudomonas aeruginosa PA01
guagcccaggcgg

SEQ ID NO: 3404915 - RNA, 14 nt, Pseudomonas aeruginosa PA01
guagcccgcggcga

SEQ ID NO: 3404916 - RNA, 18 nt, Pseudomonas aeruginosa PA01
guagcccugggcgaugcg

SEQ ID NO: 3404917 - RNA, 18 nt, Pseudomonas aeruginosa PA01
guagcccuucuccgccag

SEQ ID NO: 3404918 - RNA, 20 nt, Pseudomonas aeruginosa PA01
guagcccuucuccgccagcc

SEQ ID NO: 3404919 - RNA, 17 nt, Pseudomonas aeruginosa PA01
guagccgaacggguaga

SEQ ID NO: 3404920 - RNA, 16 nt, Pseudomonas aeruginosa PA01
guagccgaagucggcg

SEQ ID NO: 3404921 - RNA, 18 nt, Pseudomonas aeruginosa PA01
guagccgaggcggccgag

SEQ ID NO: 3404922 - RNA, 22 nt, Pseudomonas aeruginosa PA01
guagccgaucaacgcggccagc

SEQ ID NO: 3404923 - RNA, 23 nt, Pseudomonas aeruginosa PA01
guagccgaucaacgcggccagca

SEQ ID NO: 3404924 - RNA, 19 nt, Pseudomonas aeruginosa PA01
guagccgcaguccagggcg

SEQ ID NO: 3404925 - RNA, 20 nt, Pseudomonas aeruginosa PA01
guagccgcaguccagggcga

SEQ ID NO: 3404926 - RNA, 16 nt, Pseudomonas aeruginosa PA01
guagccgcccaccgcg

SEQ ID NO: 3404927 - RNA, 20 nt, Pseudomonas aeruginosa PA01
guagccgcccuuuuccggau

SEQ ID NO: 3404928 - RNA, 16 nt, Pseudomonas aeruginosa PA01
guagccgccgggaccc

SEQ ID NO: 3404929 - RNA, 16 nt, Pseudomonas aeruginosa PA01
guagccgcgcgccagc

SEQ ID NO: 3404930 - RNA, 17 nt, Pseudomonas aeruginosa PA01
guagccgcgcgccagca

SEQ ID NO: 3404931 - RNA, 18 nt, Pseudomonas aeruginosa PA01
guagccggccaaccaccg

SEQ ID NO: 3404932 - RNA, 20 nt, Pseudomonas aeruginosa PA01
guagccggccaaccaccggc

SEQ ID NO: 3404933 - RNA, 15 nt, Pseudomonas aeruginosa PA01
guagccggccagggc

SEQ ID NO: 3404934 - RNA, 18 nt, Pseudomonas aeruginosa PA01
guagccggccagggcgcg

SEQ ID NO: 3404935 - RNA, 20 nt, Pseudomonas aeruginosa PA01
guagccggccagggcgcggu

SEQ ID NO: 3404936 - RNA, 15 nt, Pseudomonas aeruginosa PA01
guagccggccgauca

SEQ ID NO: 3404937 - RNA, 14 nt, Pseudomonas aeruginosa PA01
guagccggcgagcg

SEQ ID NO: 3404938 - RNA, 16 nt, Pseudomonas aeruginosa PA01
guagccggcgaucagc

SEQ ID NO: 3404939 - RNA, 14 nt, Pseudomonas aeruginosa PA01
guagccggcgaucc

SEQ ID NO: 3404940 - RNA, 15 nt, Pseudomonas aeruginosa PA01
guagccggcgaugug

SEQ ID NO: 3404941 - RNA, 11 nt, Pseudomonas aeruginosa PA01
guagccggcgc

SEQ ID NO: 3404942 - RNA, 12 nt, Pseudomonas aeruginosa PA01
guagccggcgcc

SEQ ID NO: 3404943 - RNA, 14 nt, Pseudomonas aeruginosa PA01
guagccggcgccgu

SEQ ID NO: 3404944 - RNA, 16 nt, Pseudomonas aeruginosa PA01
guagccggcgccgucg

SEQ ID NO: 3404945 - RNA, 16 nt, Pseudomonas aeruginosa PA01
guagccggcgcggcgc

SEQ ID NO: 3404946 - RNA, 17 nt, Pseudomonas aeruginosa PA01
guagccggcgcggcgca

SEQ ID NO: 3404947 - RNA, 13 nt, Pseudomonas aeruginosa PA01
guagccggcggcg

SEQ ID NO: 3404948 - RNA, 20 nt, Pseudomonas aeruginosa PA01
guagccggcguccgccgggu

SEQ ID NO: 3404949 - RNA, 17 nt, Pseudomonas aeruginosa PA01
guagccggugccgaucu

SEQ ID NO: 3404950 - RNA, 16 nt, Pseudomonas aeruginosa PA01
guagccgucaagcaac

SEQ ID NO: 3404951 - RNA, 16 nt, Pseudomonas aeruginosa PA01
guagccgucguagcgc

SEQ ID NO: 3404952 - RNA, 21 nt, Pseudomonas aeruginosa PA01
guagccgucguagcgcagcgg

SEQ ID NO: 3404953 - RNA, 18 nt, Pseudomonas aeruginosa PA01
guagccguucgacgcugc

SEQ ID NO: 3404954 - RNA, 17 nt, Pseudomonas aeruginosa PA01
guagccguugagcaccg

SEQ ID NO: 3404955 - RNA, 18 nt, Pseudomonas aeruginosa PA01
guagccucccgccgcggc

SEQ ID NO: 3404956 - RNA, 18 nt, Pseudomonas aeruginosa PA01
guagccugcggccagcgc

SEQ ID NO: 3404957 - RNA, 23 nt, Pseudomonas aeruginosa PA01
guagccugcggccagcgccagga

SEQ ID NO: 3404958 - RNA, 21 nt, Pseudomonas aeruginosa PA01
guagccuggauacgggcgcca

SEQ ID NO: 3404959 - RNA, 23 nt, Pseudomonas aeruginosa PA01
guagccuggauacgggcgccagg

SEQ ID NO: 3404960 - RNA, 21 nt, Pseudomonas aeruginosa PA01
guagcgaaucugcagggcauc

SEQ ID NO: 3404961 - RNA, 23 nt, Pseudomonas aeruginosa PA01
guagcgacccuucaacggcgacc

SEQ ID NO: 3404962 - RNA, 15 nt, Pseudomonas aeruginosa PA01
guagcgcagcggcag

SEQ ID NO: 3404963 - RNA, 13 nt, Pseudomonas aeruginosa PA01
guagcgcaggucg

SEQ ID NO: 3404964 - RNA, 17 nt, Pseudomonas aeruginosa PA01
guaggcgguggcgauca

SEQ ID NO: 3404965 - RNA, 15 nt, Pseudomonas aeruginosa PA01
guaggcguccuggcg

SEQ ID NO: 3404966 - RNA, 19 nt, Pseudomonas aeruginosa PA01
guaggcucccccgcgccgc

SEQ ID NO: 3404967 - RNA, 21 nt, Pseudomonas aeruginosa PA01
guaggcucccccgcgccgccg

SEQ ID NO: 3404968 - RNA, 22 nt, Pseudomonas aeruginosa PA01
guaggcucccccgcgccgccgg

SEQ ID NO: 3404969 - RNA, 19 nt, Pseudomonas aeruginosa PA01
guaggcucugcuccagcaa

SEQ ID NO: 3404970 - RNA, 14 nt, Pseudomonas aeruginosa PA01
guagggacggugca

SEQ ID NO: 3404971 - RNA, 16 nt, Pseudomonas aeruginosa PA01
guagggacggugcagg

SEQ ID NO: 3404972 - RNA, 17 nt, Pseudomonas aeruginosa PA01
guagggcaucgccgaca

SEQ ID NO: 3404973 - RNA, 14 nt, Pseudomonas aeruginosa PA01
guagggccgagguc

SEQ ID NO: 3404974 - RNA, 21 nt, Pseudomonas aeruginosa PA01
guagggcgaacaacgccgccg

SEQ ID NO: 3404975 - RNA, 17 nt, Pseudomonas aeruginosa PA01
guagggcgaauaaccgc

SEQ ID NO: 3404976 - RNA, 23 nt, Pseudomonas aeruginosa PA01
guagggcgaauaacgccgcaggc

SEQ ID NO: 3404977 - RNA, 19 nt, Pseudomonas aeruginosa PA01
guagggcgaauaucgcggc

SEQ ID NO: 3404978 - RNA, 19 nt, Pseudomonas aeruginosa PA01
guagggcgacgcccgaggc

SEQ ID NO: 3404979 - RNA, 20 nt, Pseudomonas aeruginosa PA01
guagggcgcauaaccgcucg

SEQ ID NO: 3404980 - RNA, 22 nt, Pseudomonas aeruginosa PA01
guagggcggauaacgccacagg

SEQ ID NO: 3404981 - RNA, 17 nt, Pseudomonas aeruginosa PA01
guagggcguauaaccgc

SEQ ID NO: 3404982 - RNA, 21 nt, Pseudomonas aeruginosa PA01
guagggcgucaguuccacgcg

SEQ ID NO: 3404983 - RNA, 22 nt, Pseudomonas aeruginosa PA01
guagggcuggacguacauggga

SEQ ID NO: 3404984 - RNA, 21 nt, Pseudomonas aeruginosa PA01
guaggggaauuucacgccgaa

SEQ ID NO: 3404985 - RNA, 14 nt, Pseudomonas aeruginosa PA01
guaggggaccaccc

SEQ ID NO: 3404986 - RNA, 15 nt, Pseudomonas aeruginosa PA01
guagggguggccagg

SEQ ID NO: 3404987 - RNA, 18 nt, Pseudomonas aeruginosa PA01
guagggucgcagcaggcc

SEQ ID NO: 3404988 - RNA, 14 nt, Pseudomonas aeruginosa PA01
guaggguucgccga

SEQ ID NO: 3404989 - RNA, 16 nt, Pseudomonas aeruginosa PA01
guaggguucgccgacg

SEQ ID NO: 3404990 - RNA, 21 nt, Pseudomonas aeruginosa PA01
guagguagagaugcagcaggu

SEQ ID NO: 3404991 - RNA, 17 nt, Pseudomonas aeruginosa PA01
guagguauccgccggcc

SEQ ID NO: 3404992 - RNA, 14 nt, Pseudomonas aeruginosa PA01
guagguccaggcga

SEQ ID NO: 3404993 - RNA, 22 nt, Pseudomonas aeruginosa PA01
guagguccaggcgucggcgccu

SEQ ID NO: 3404994 - RNA, 17 nt, Pseudomonas aeruginosa PA01
guaggugaagcccaggc

SEQ ID NO: 3404995 - RNA, 17 nt, Pseudomonas aeruginosa PA01
guaggugaccgcccagg

SEQ ID NO: 3404996 - RNA, 15 nt, Pseudomonas aeruginosa PA01
guaggugauguugcg

SEQ ID NO: 3404997 - RNA, 16 nt, Pseudomonas aeruginosa PA01
guaggugcccggcggg

SEQ ID NO: 3404998 - RNA, 17 nt, Pseudomonas aeruginosa PA01
guagguggauugcagcg

SEQ ID NO: 3404999 - RNA, 19 nt, Pseudomonas aeruginosa PA01
guagguuuucguugggugg

SEQ ID NO: 3405000 - RNA, 13 nt, Pseudomonas aeruginosa PA01
guaguaccucgaa

SEQ ID NO: 3405001 - RNA, 23 nt, Pseudomonas aeruginosa PA01
guaguaccucgaagcccagcgcc

SEQ ID NO: 3405002 - RNA, 13 nt, Pseudomonas aeruginosa PA01
guaguagaucagc

SEQ ID NO: 3405003 - RNA, 13 nt, Pseudomonas aeruginosa PA01
guaguagugcccc

SEQ ID NO: 3405004 - RNA, 16 nt, Pseudomonas aeruginosa PA01
guaguaguggaagccg

SEQ ID NO: 3405005 - RNA, 15 nt, Pseudomonas aeruginosa PA01
guagucauggccagu

SEQ ID NO: 3405006 - RNA, 17 nt, Pseudomonas aeruginosa PA01
guagucauugcgcugug

SEQ ID NO: 3405007 - RNA, 16 nt, Pseudomonas aeruginosa PA01
guaguccagcaggugg

SEQ ID NO: 3405008 - RNA, 16 nt, Pseudomonas aeruginosa PA01
guaguccagccagugc

SEQ ID NO: 3405009 - RNA, 13 nt, Pseudomonas aeruginosa PA01
guaguccagcgcc

SEQ ID NO: 3405010 - RNA, 14 nt, Pseudomonas aeruginosa PA01
guaguccagcgccg

SEQ ID NO: 3405011 - RNA, 18 nt, Pseudomonas aeruginosa PA01
guaguccagcgccgcgcu

SEQ ID NO: 3405012 - RNA, 20 nt, Pseudomonas aeruginosa PA01
guaguccagcgccgcgcugc

SEQ ID NO: 3405013 - RNA, 17 nt, Pseudomonas aeruginosa PA01
guaguccagcuccucga

SEQ ID NO: 3405014 - RNA, 15 nt, Pseudomonas aeruginosa PA01
guaguccaucaccgc

SEQ ID NO: 3405015 - RNA, 21 nt, Pseudomonas aeruginosa PA01
guagucccagaccacccggcu

SEQ ID NO: 3405016 - RNA, 18 nt, Pseudomonas aeruginosa PA01
guaguccgcugcgagcag

SEQ ID NO: 3405017 - RNA, 19 nt, Pseudomonas aeruginosa PA01
guaguccgcugcgagcagg

SEQ ID NO: 3405018 - RNA, 19 nt, Pseudomonas aeruginosa PA01
guaguccguuuccggcaug

SEQ ID NO: 3405019 - RNA, 14 nt, Pseudomonas aeruginosa PA01
guaguccugggccg

SEQ ID NO: 3405020 - RNA, 13 nt, Pseudomonas aeruginosa PA01
guagucgagccgg

SEQ ID NO: 3405021 - RNA, 16 nt, Pseudomonas aeruginosa PA01
guagucgagccggauc

SEQ ID NO: 3405022 - RNA, 18 nt, Pseudomonas aeruginosa PA01
guagucgcugcuggcgcc

SEQ ID NO: 3405023 - RNA, 12 nt, Pseudomonas aeruginosa PA01
guagucggcgua

SEQ ID NO: 3405024 - RNA, 20 nt, Pseudomonas aeruginosa PA01
guagucggugaagcgcggcg

SEQ ID NO: 3405025 - RNA, 21 nt, Pseudomonas aeruginosa PA01
guagucggugaagcgcggcgg

SEQ ID NO: 3405026 - RNA, 20 nt, Pseudomonas aeruginosa PA01
guagucguagaacaccaccc

SEQ ID NO: 3405027 - RNA, 17 nt, Pseudomonas aeruginosa PA01
guagugcaacaccuggc

SEQ ID NO: 3405028 - RNA, 16 nt, Pseudomonas aeruginosa PA01
guagugcagcugcgag

SEQ ID NO: 3405029 - RNA, 12 nt, Pseudomonas aeruginosa PA01
guagugccgccc

SEQ ID NO: 3405030 - RNA, 21 nt, Pseudomonas aeruginosa PA01
guagugcuccggggcgcuguu

SEQ ID NO: 3405031 - RNA, 14 nt, Pseudomonas aeruginosa PA01
guagugcucggcca

SEQ ID NO: 3405032 - RNA, 15 nt, Pseudomonas aeruginosa PA01
guagugcucggccag

SEQ ID NO: 3405033 - RNA, 15 nt, Pseudomonas aeruginosa PA01
guagugcuucaggua

SEQ ID NO: 3405034 - RNA, 16 nt, Pseudomonas aeruginosa PA01
guagugggcgaggcgc

SEQ ID NO: 3405035 - RNA, 12 nt, Pseudomonas aeruginosa PA01
guaguucagucg

SEQ ID NO: 3405036 - RNA, 22 nt, Pseudomonas aeruginosa PA01
guaguugacgucgccgaugcgg

SEQ ID NO: 3405037 - RNA, 17 nt, Pseudomonas aeruginosa PA01
guaguuguucggcuggg

SEQ ID NO: 3405038 - RNA, 13 nt, Pseudomonas aeruginosa PA01
guauaccagcggc

SEQ ID NO: 3405039 - RNA, 14 nt, Pseudomonas aeruginosa PA01
guauaccagcggcu

SEQ ID NO: 3405040 - RNA, 15 nt, Pseudomonas aeruginosa PA01
guauaccagcggcug

SEQ ID NO: 3405041 - RNA, 14 nt, Pseudomonas aeruginosa PA01
guauagaccagcac

SEQ ID NO: 3405042 - RNA, 20 nt, Pseudomonas aeruginosa PA01
guauagcucauggccagguc

SEQ ID NO: 3405043 - RNA, 18 nt, Pseudomonas aeruginosa PA01
guauaggcgcuggugcug

SEQ ID NO: 3405044 - RNA, 20 nt, Pseudomonas aeruginosa PA01
guauccaccggacccggcug

SEQ ID NO: 3405045 - RNA, 21 nt, Pseudomonas aeruginosa PA01
guauccaccggacccggcugc

SEQ ID NO: 3405046 - RNA, 18 nt, Pseudomonas aeruginosa PA01
guauccaccucgcccucg

SEQ ID NO: 3405047 - RNA, 15 nt, Pseudomonas aeruginosa PA01
guauccagcggccgc

SEQ ID NO: 3405048 - RNA, 16 nt, Pseudomonas aeruginosa PA01
guauccagcggccgcg

SEQ ID NO: 3405049 - RNA, 18 nt, Pseudomonas aeruginosa PA01
guauccagguucacccag

SEQ ID NO: 3405050 - RNA, 11 nt, Pseudomonas aeruginosa PA01
guauccauguc

SEQ ID NO: 3405051 - RNA, 19 nt, Pseudomonas aeruginosa PA01
guauccaugucagcgguga

SEQ ID NO: 3405052 - RNA, 22 nt, Pseudomonas aeruginosa PA01
guaucccggcugagcgccaggc

SEQ ID NO: 3405053 - RNA, 14 nt, Pseudomonas aeruginosa PA01
guauccgccggccg

SEQ ID NO: 3405054 - RNA, 22 nt, Pseudomonas aeruginosa PA01
guauccgccggccggggcgcgc

SEQ ID NO: 3405055 - RNA, 14 nt, Pseudomonas aeruginosa PA01
guauccuccgcgac

SEQ ID NO: 3405056 - RNA, 22 nt, Pseudomonas aeruginosa PA01
guauccucggccauaccuccag

SEQ ID NO: 3405057 - RNA, 14 nt, Pseudomonas aeruginosa PA01
guaucgaugcgcgc

SEQ ID NO: 3405058 - RNA, 17 nt, Pseudomonas aeruginosa PA01
guaucgaugcgcgcggc

SEQ ID NO: 3405059 - RNA, 19 nt, Pseudomonas aeruginosa PA01
guaucgaugcgcgcggcga

SEQ ID NO: 3405060 - RNA, 15 nt, Pseudomonas aeruginosa PA01
guaucgccguccugg

SEQ ID NO: 3405061 - RNA, 14 nt, Pseudomonas aeruginosa PA01
guaucgcgcuugga

SEQ ID NO: 3405062 - RNA, 17 nt, Pseudomonas aeruginosa PA01
guaucgcuuagcgccag

SEQ ID NO: 3405063 - RNA, 23 nt, Pseudomonas aeruginosa PA01
guaucggcguuuagcgcccgacg

SEQ ID NO: 3405064 - RNA, 17 nt, Pseudomonas aeruginosa PA01
guaucggcuugccggcg

SEQ ID NO: 3405065 - RNA, 16 nt, Pseudomonas aeruginosa PA01
guaucugggucuggcg

SEQ ID NO: 3405066 - RNA, 21 nt, Pseudomonas aeruginosa PA01
guaugcagcaacccggcccag

SEQ ID NO: 3405067 - RNA, 16 nt, Pseudomonas aeruginosa PA01
gucagcaggcugccgu

SEQ ID NO: 3405068 - RNA, 17 nt, Pseudomonas aeruginosa PA01
gucagccaccugcucgc

SEQ ID NO: 3405069 - RNA, 15 nt, Pseudomonas aeruginosa PA01
gucagccagccgagc

SEQ ID NO: 3405070 - RNA, 17 nt, Pseudomonas aeruginosa PA01
gucagccagccgagcaa

SEQ ID NO: 3405071 - RNA, 17 nt, Pseudomonas aeruginosa PA01
gucagccaggcuggcug

SEQ ID NO: 3405072 - RNA, 19 nt, Pseudomonas aeruginosa PA01
gucagcccguguucggcca

SEQ ID NO: 3405073 - RNA, 23 nt, Pseudomonas aeruginosa PA01
gucagcccguguucggccagccg

SEQ ID NO: 3405074 - RNA, 18 nt, Pseudomonas aeruginosa PA01
gucagccgaugcucgcgc

SEQ ID NO: 3405075 - RNA, 20 nt, Pseudomonas aeruginosa PA01
gucagccgaugcucgcgcca

SEQ ID NO: 3405076 - RNA, 22 nt, Pseudomonas aeruginosa PA01
gucagccgaugcucgcgccagc

SEQ ID NO: 3405077 - RNA, 23 nt, Pseudomonas aeruginosa PA01
gucagccgaugcucgcgccagcc

SEQ ID NO: 3405078 - RNA, 16 nt, Pseudomonas aeruginosa PA01
gucagccgcaggccgu

SEQ ID NO: 3405079 - RNA, 15 nt, Pseudomonas aeruginosa PA01
gucagccggccgauc

SEQ ID NO: 3405080 - RNA, 23 nt, Pseudomonas aeruginosa PA01
gucagccggccgaucuucagcag

SEQ ID NO: 3405081 - RNA, 20 nt, Pseudomonas aeruginosa PA01
gucagcgagcuaucgccucc

SEQ ID NO: 3405082 - RNA, 18 nt, Pseudomonas aeruginosa PA01
gucagcgaggcgggcgcg

SEQ ID NO: 3405083 - RNA, 21 nt, Pseudomonas aeruginosa PA01
gucagcgaguugaccuuggcc

SEQ ID NO: 3405084 - RNA, 14 nt, Pseudomonas aeruginosa PA01
gucagcgccagcaa

SEQ ID NO: 3405085 - RNA, 14 nt, Pseudomonas aeruginosa PA01
gucagcgcccggcu

SEQ ID NO: 3405086 - RNA, 17 nt, Pseudomonas aeruginosa PA01
gucagcgccuugaccuc

SEQ ID NO: 3405087 - RNA, 18 nt, Pseudomonas aeruginosa PA01
gucagcgccuugaccucg

SEQ ID NO: 3405088 - RNA, 19 nt, Pseudomonas aeruginosa PA01
gucagcgccuugaccucga

SEQ ID NO: 3405089 - RNA, 22 nt, Pseudomonas aeruginosa PA01
gucagcgccuugaccucgacgc

SEQ ID NO: 3405090 - RNA, 13 nt, Pseudomonas aeruginosa PA01
gucagcgcgccag

SEQ ID NO: 3405091 - RNA, 15 nt, Pseudomonas aeruginosa PA01
gucagcgcgccagca

SEQ ID NO: 3405092 - RNA, 15 nt, Pseudomonas aeruginosa PA01
gucagcggacaaccg

SEQ ID NO: 3405093 - RNA, 19 nt, Pseudomonas aeruginosa PA01
gucagcggacaaccgccgu

SEQ ID NO: 3405094 - RNA, 19 nt, Pseudomonas aeruginosa PA01
gucagcggguuggcuucca

SEQ ID NO: 3405095 - RNA, 19 nt, Pseudomonas aeruginosa PA01
gucagcgguaugccgcagg

SEQ ID NO: 3405096 - RNA, 20 nt, Pseudomonas aeruginosa PA01
gucagcgguaugccgcaggc

SEQ ID NO: 3405097 - RNA, 22 nt, Pseudomonas aeruginosa PA01
gucagcggugaaaauuucguga

SEQ ID NO: 3405098 - RNA, 17 nt, Pseudomonas aeruginosa PA01
gucagcuggcgcgccuc

SEQ ID NO: 3405099 - RNA, 18 nt, Pseudomonas aeruginosa PA01
gucagcuggcgcgccucc

SEQ ID NO: 3405100 - RNA, 16 nt, Pseudomonas aeruginosa PA01
gucagcuucgccgccc

SEQ ID NO: 3405101 - RNA, 20 nt, Pseudomonas aeruginosa PA01
gucagcuucgccgcccugga

SEQ ID NO: 3405102 - RNA, 13 nt, Pseudomonas aeruginosa PA01
gucagcuugcccu

SEQ ID NO: 3405103 - RNA, 15 nt, Pseudomonas aeruginosa PA01
gucagcuugcccuca

SEQ ID NO: 3405104 - RNA, 19 nt, Pseudomonas aeruginosa PA01
gucagcuugccgcaggucu

SEQ ID NO: 3405105 - RNA, 20 nt, Pseudomonas aeruginosa PA01
gucaggacagcgugcggccc

SEQ ID NO: 3405106 - RNA, 14 nt, Pseudomonas aeruginosa PA01
gucaggaucggcgc

SEQ ID NO: 3405107 - RNA, 18 nt, Pseudomonas aeruginosa PA01
gucaggaucggcgcccag

SEQ ID NO: 3405108 - RNA, 19 nt, Pseudomonas aeruginosa PA01
gucaggaucggcgcccagc

SEQ ID NO: 3405109 - RNA, 20 nt, Pseudomonas aeruginosa PA01
gucaggaucggcgcccagca

SEQ ID NO: 3405110 - RNA, 19 nt, Pseudomonas aeruginosa PA01
gucaggcaccucguccagc

SEQ ID NO: 3405111 - RNA, 12 nt, Pseudomonas aeruginosa PA01
gucaggccgacc

SEQ ID NO: 3405112 - RNA, 15 nt, Pseudomonas aeruginosa PA01
gucaggccgaccagc

SEQ ID NO: 3405113 - RNA, 18 nt, Pseudomonas aeruginosa PA01
gucaggccgaccagcgcc

SEQ ID NO: 3405114 - RNA, 18 nt, Pseudomonas aeruginosa PA01
gucaggccgagcagcgcc

SEQ ID NO: 3405115 - RNA, 21 nt, Pseudomonas aeruginosa PA01
gucaggccgagcagcgccagc

SEQ ID NO: 3405116 - RNA, 12 nt, Pseudomonas aeruginosa PA01
gucaggccgagg

SEQ ID NO: 3405117 - RNA, 15 nt, Pseudomonas aeruginosa PA01
gucaggccgaggcgc

SEQ ID NO: 3405118 - RNA, 13 nt, Pseudomonas aeruginosa PA01
gucaggccgaggg

SEQ ID NO: 3405119 - RNA, 19 nt, Pseudomonas aeruginosa PA01
gucaggccgagggcugccg

SEQ ID NO: 3405120 - RNA, 23 nt, Pseudomonas aeruginosa PA01
gucaggccgagggcugccgcccg

SEQ ID NO: 3405121 - RNA, 22 nt, Pseudomonas aeruginosa PA01
gucaggccgauggauucgaacc

SEQ ID NO: 3405122 - RNA, 15 nt, Pseudomonas aeruginosa PA01
gucaggccggcgcga

SEQ ID NO: 3405123 - RNA, 12 nt, Pseudomonas aeruginosa PA01
gucaggccuuga

SEQ ID NO: 3405124 - RNA, 16 nt, Pseudomonas aeruginosa PA01
gucaggccuugacgcg

SEQ ID NO: 3405125 - RNA, 20 nt, Pseudomonas aeruginosa PA01
gucaggccuugcgcggcgcc

SEQ ID NO: 3405126 - RNA, 22 nt, Pseudomonas aeruginosa PA01
gucaggccuugcgcggcgccgg

SEQ ID NO: 3405127 - RNA, 13 nt, Pseudomonas aeruginosa PA01
gucaggcgccagg

SEQ ID NO: 3405128 - RNA, 15 nt, Pseudomonas aeruginosa PA01
gucaggcgccggccu

SEQ ID NO: 3405129 - RNA, 16 nt, Pseudomonas aeruginosa PA01
gucaggcgcuggugau

SEQ ID NO: 3405130 - RNA, 22 nt, Pseudomonas aeruginosa PA01
gucaggcucagcucggcgaugc

SEQ ID NO: 3405131 - RNA, 17 nt, Pseudomonas aeruginosa PA01
gucaggcugaucggcgc

SEQ ID NO: 3405132 - RNA, 22 nt, Pseudomonas aeruginosa PA01
gucaggcugaucuugccgcugg

SEQ ID NO: 3405133 - RNA, 13 nt, Pseudomonas aeruginosa PA01
gucaggcugcgca

SEQ ID NO: 3405134 - RNA, 22 nt, Pseudomonas aeruginosa PA01
gucaggcugcgcaccucggcca

SEQ ID NO: 3405135 - RNA, 16 nt, Pseudomonas aeruginosa PA01
gucaggcugcggcgga

SEQ ID NO: 3405136 - RNA, 23 nt, Pseudomonas aeruginosa PA01
gucaggcugcggcggaaggcggc

SEQ ID NO: 3405137 - RNA, 17 nt, Pseudomonas aeruginosa PA01
gucaggcuggugccgcu

SEQ ID NO: 3405138 - RNA, 22 nt, Pseudomonas aeruginosa PA01
gucaggcuggugccgcuguagg

SEQ ID NO: 3405139 - RNA, 21 nt, Pseudomonas aeruginosa PA01
gucaggcugguggucaccgcc

SEQ ID NO: 3405140 - RNA, 14 nt, Pseudomonas aeruginosa PA01
gucaggcuguagcc

SEQ ID NO: 3405141 - RNA, 23 nt, Pseudomonas aeruginosa PA01
gucagggcuugcgcgccaccagc

SEQ ID NO: 3405142 - RNA, 24 nt, Pseudomonas aeruginosa PA01
gucagguaggagaugcagcgucgc

SEQ ID NO: 3405143 - RNA, 21 nt, Pseudomonas aeruginosa PA01
gucagguauucgccggccagg

SEQ ID NO: 3405144 - RNA, 17 nt, Pseudomonas aeruginosa PA01
gucagguccuuguuccu

SEQ ID NO: 3405145 - RNA, 23 nt, Pseudomonas aeruginosa PA01
gucagguccuuguuccugggcgg

SEQ ID NO: 3405146 - RNA, 14 nt, Pseudomonas aeruginosa PA01
gucaggucgacgcc

SEQ ID NO: 3405147 - RNA, 18 nt, Pseudomonas aeruginosa PA01
gucaggucgacgccgccg

SEQ ID NO: 3405148 - RNA, 19 nt, Pseudomonas aeruginosa PA01
gucaggucgacgccgccga

SEQ ID NO: 3405149 - RNA, 23 nt, Pseudomonas aeruginosa PA01
gucaggucguacacguuggccgu

SEQ ID NO: 3405150 - RNA, 23 nt, Pseudomonas aeruginosa PA01
gucagguugccggugaugucggc

SEQ ID NO: 3405151 - RNA, 13 nt, Pseudomonas aeruginosa PA01
gucagucgagcag

SEQ ID NO: 3405152 - RNA, 13 nt, Pseudomonas aeruginosa PA01
gucaguuccaggu

SEQ ID NO: 3405153 - RNA, 21 nt, Pseudomonas aeruginosa PA01
gucaguuccaggucggcggca

SEQ ID NO: 3405154 - RNA, 19 nt, Pseudomonas aeruginosa PA01
gucaguucggugccgccgg

SEQ ID NO: 3405155 - RNA, 20 nt, Pseudomonas aeruginosa PA01
gucaguucggugccgccggc

SEQ ID NO: 3405156 - RNA, 21 nt, Pseudomonas aeruginosa PA01
gucauacaacuguugcucggg

SEQ ID NO: 3405157 - RNA, 19 nt, Pseudomonas aeruginosa PA01
gucaucaccuucgccagca

SEQ ID NO: 3405158 - RNA, 22 nt, Pseudomonas aeruginosa PA01
gucaucaccuucgccagcaggc

SEQ ID NO: 3405159 - RNA, 17 nt, Pseudomonas aeruginosa PA01
gucauccuggcccugga

SEQ ID NO: 3405160 - RNA, 15 nt, Pseudomonas aeruginosa PA01
gucaucgagcaguuc

SEQ ID NO: 3405161 - RNA, 19 nt, Pseudomonas aeruginosa PA01
gucaucgaggccauccccg

SEQ ID NO: 3405162 - RNA, 12 nt, Pseudomonas aeruginosa PA01
gucaucgcgccg

SEQ ID NO: 3405163 - RNA, 13 nt, Pseudomonas aeruginosa PA01
gucaucgcgccgc

SEQ ID NO: 3405164 - RNA, 15 nt, Pseudomonas aeruginosa PA01
gucaucgcgccgccg

SEQ ID NO: 3405165 - RNA, 19 nt, Pseudomonas aeruginosa PA01
gucaucgcgccgccgaagc

SEQ ID NO: 3405166 - RNA, 23 nt, Pseudomonas aeruginosa PA01
gucaucgcgccgccgaagccgac

SEQ ID NO: 3405167 - RNA, 17 nt, Pseudomonas aeruginosa PA01
gucaucgcugaccugga

SEQ ID NO: 3405168 - RNA, 22 nt, Pseudomonas aeruginosa PA01
gucaugaaggaaaccggccagc

SEQ ID NO: 3405169 - RNA, 16 nt, Pseudomonas aeruginosa PA01
guccaggcgcugcucg

SEQ ID NO: 3405170 - RNA, 17 nt, Pseudomonas aeruginosa PA01
guccaggcgcugcucga

SEQ ID NO: 3405171 - RNA, 15 nt, Pseudomonas aeruginosa PA01
guccaggcgggccag

SEQ ID NO: 3405172 - RNA, 16 nt, Pseudomonas aeruginosa PA01
guccaggcgggccagc

SEQ ID NO: 3405173 - RNA, 14 nt, Pseudomonas aeruginosa PA01
guccaggcgucggc

SEQ ID NO: 3405174 - RNA, 16 nt, Pseudomonas aeruginosa PA01
guccaggcgucggcgc

SEQ ID NO: 3405175 - RNA, 13 nt, Pseudomonas aeruginosa PA01
guccaggcugccg

SEQ ID NO: 3405176 - RNA, 21 nt, Pseudomonas aeruginosa PA01
guccaggcuguggcgcggcug

SEQ ID NO: 3405177 - RNA, 20 nt, Pseudomonas aeruginosa PA01
guccagggcauccaucgcca

SEQ ID NO: 3405178 - RNA, 23 nt, Pseudomonas aeruginosa PA01
guccagggccggaucggccuugg

SEQ ID NO: 3405179 - RNA, 12 nt, Pseudomonas aeruginosa PA01
guccagggcgaa

SEQ ID NO: 3405180 - RNA, 23 nt, Pseudomonas aeruginosa PA01
guccagggcgaaccacucggcgc

SEQ ID NO: 3405181 - RNA, 16 nt, Pseudomonas aeruginosa PA01
guccagggcgauggcg

SEQ ID NO: 3405182 - RNA, 20 nt, Pseudomonas aeruginosa PA01
guccagggcgauggcgguga

SEQ ID NO: 3405183 - RNA, 14 nt, Pseudomonas aeruginosa PA01
guccagggcuucga

SEQ ID NO: 3405184 - RNA, 22 nt, Pseudomonas aeruginosa PA01
guccagggucuucagugcacgu

SEQ ID NO: 3405185 - RNA, 18 nt, Pseudomonas aeruginosa PA01
guccagggugaucacacc

SEQ ID NO: 3405186 - RNA, 20 nt, Pseudomonas aeruginosa PA01
guccaggguuggaagaaaga

SEQ ID NO: 3405187 - RNA, 21 nt, Pseudomonas aeruginosa PA01
guccaggucaugcccuggccg

SEQ ID NO: 3405188 - RNA, 15 nt, Pseudomonas aeruginosa PA01
guccagguccgcacc

SEQ ID NO: 3405189 - RNA, 16 nt, Pseudomonas aeruginosa PA01
guccaggugcggcugg

SEQ ID NO: 3405190 - RNA, 18 nt, Pseudomonas aeruginosa PA01
guccaggugcggcugggu

SEQ ID NO: 3405191 - RNA, 14 nt, Pseudomonas aeruginosa PA01
guccaguagcgccu

SEQ ID NO: 3405192 - RNA, 15 nt, Pseudomonas aeruginosa PA01
guccaguagcgccug

SEQ ID NO: 3405193 - RNA, 18 nt, Pseudomonas aeruginosa PA01
guccaguagcgccugguu

SEQ ID NO: 3405194 - RNA, 14 nt, Pseudomonas aeruginosa PA01
guccagucaccagg

SEQ ID NO: 3405195 - RNA, 15 nt, Pseudomonas aeruginosa PA01
guccagucaccaggu

SEQ ID NO: 3405196 - RNA, 15 nt, Pseudomonas aeruginosa PA01
guccagugcggcagu

SEQ ID NO: 3405197 - RNA, 16 nt, Pseudomonas aeruginosa PA01
guccagugcggcaguc

SEQ ID NO: 3405198 - RNA, 14 nt, Pseudomonas aeruginosa PA01
guccaguucagggc

SEQ ID NO: 3405199 - RNA, 23 nt, Pseudomonas aeruginosa PA01
guccaguucagggcgagcagggc

SEQ ID NO: 3405200 - RNA, 18 nt, Pseudomonas aeruginosa PA01
guccaucagccgcgcgcu

SEQ ID NO: 3405201 - RNA, 15 nt, Pseudomonas aeruginosa PA01
guccaucgccaggcc

SEQ ID NO: 3405202 - RNA, 17 nt, Pseudomonas aeruginosa PA01
guccaucgccgcggcga

SEQ ID NO: 3405203 - RNA, 16 nt, Pseudomonas aeruginosa PA01
guccaucucgccgcgc

SEQ ID NO: 3405204 - RNA, 17 nt, Pseudomonas aeruginosa PA01
guccaucucgccgcgca

SEQ ID NO: 3405205 - RNA, 20 nt, Pseudomonas aeruginosa PA01
guccaucuguaccaccgcca

SEQ ID NO: 3405206 - RNA, 20 nt, Pseudomonas aeruginosa PA01
guccaugccguacaggucgg

SEQ ID NO: 3405207 - RNA, 23 nt, Pseudomonas aeruginosa PA01
guccaugccguacaggucggcgc

SEQ ID NO: 3405208 - RNA, 12 nt, Pseudomonas aeruginosa PA01
guccaugcucgc

SEQ ID NO: 3405209 - RNA, 14 nt, Pseudomonas aeruginosa PA01
guccaugcucgcca

SEQ ID NO: 3405210 - RNA, 17 nt, Pseudomonas aeruginosa PA01
guccaugcucgccaccu

SEQ ID NO: 3405211 - RNA, 14 nt, Pseudomonas aeruginosa PA01
guccauggcggcga

SEQ ID NO: 3405212 - RNA, 22 nt, Pseudomonas aeruginosa PA01
guccauguagcguugcaggcag

SEQ ID NO: 3405213 - RNA, 14 nt, Pseudomonas aeruginosa PA01
guccauguugcggc

SEQ ID NO: 3405214 - RNA, 15 nt, Pseudomonas aeruginosa PA01
gucccacaggccggc

SEQ ID NO: 3405215 - RNA, 16 nt, Pseudomonas aeruginosa PA01
gucccacaggccggcu

SEQ ID NO: 3405216 - RNA, 14 nt, Pseudomonas aeruginosa PA01
gucccacuugucca

SEQ ID NO: 3405217 - RNA, 17 nt, Pseudomonas aeruginosa PA01
gucccacuuguccagag

SEQ ID NO: 3405218 - RNA, 24 nt, Pseudomonas aeruginosa PA01
gucccagaaguaguacugguccgg

SEQ ID NO: 3405219 - RNA, 14 nt, Pseudomonas aeruginosa PA01
gucccagaccaccc

SEQ ID NO: 3405220 - RNA, 16 nt, Pseudomonas aeruginosa PA01
gucccagaccacccgg

SEQ ID NO: 3405221 - RNA, 20 nt, Pseudomonas aeruginosa PA01
gucccagaccacccggcugc

SEQ ID NO: 3405222 - RNA, 23 nt, Pseudomonas aeruginosa PA01
gucccagaccacccggcugcaug

SEQ ID NO: 3405223 - RNA, 20 nt, Pseudomonas aeruginosa PA01
gucccagguagcgcugcgcc

SEQ ID NO: 3405224 - RNA, 20 nt, Pseudomonas aeruginosa PA01
gucccagucggcguccgccu

SEQ ID NO: 3405225 - RNA, 13 nt, Pseudomonas aeruginosa PA01
gucccaucagcag

SEQ ID NO: 3405226 - RNA, 22 nt, Pseudomonas aeruginosa PA01
gucccaugaccgucagccaggc

SEQ ID NO: 3405227 - RNA, 20 nt, Pseudomonas aeruginosa PA01
gucccauugcaucugcgccg

SEQ ID NO: 3405228 - RNA, 18 nt, Pseudomonas aeruginosa PA01
guccccccuacgaaagcg

SEQ ID NO: 3405229 - RNA, 14 nt, Pseudomonas aeruginosa PA01
guccccggccagca

SEQ ID NO: 3405230 - RNA, 14 nt, Pseudomonas aeruginosa PA01
guccccggccccgc

SEQ ID NO: 3405231 - RNA, 18 nt, Pseudomonas aeruginosa PA01
guccccggccccgcggua

SEQ ID NO: 3405232 - RNA, 15 nt, Pseudomonas aeruginosa PA01
guccccucacggcgc

SEQ ID NO: 3405233 - RNA, 17 nt, Pseudomonas aeruginosa PA01
guccccucacggcgcga

SEQ ID NO: 3405234 - RNA, 16 nt, Pseudomonas aeruginosa PA01
guccccuccagguagg

SEQ ID NO: 3405235 - RNA, 20 nt, Pseudomonas aeruginosa PA01
guccccuccagguaggggaa

SEQ ID NO: 3405236 - RNA, 17 nt, Pseudomonas aeruginosa PA01
gucccgaguaggcgcug

SEQ ID NO: 3405237 - RNA, 18 nt, Pseudomonas aeruginosa PA01
gucccgaguaggcgcugc

SEQ ID NO: 3405238 - RNA, 20 nt, Pseudomonas aeruginosa PA01
gucccgaguaggcgcugcaa

SEQ ID NO: 3405239 - RNA, 18 nt, Pseudomonas aeruginosa PA01
gucccgcaaagcccgcuc

SEQ ID NO: 3405240 - RNA, 15 nt, Pseudomonas aeruginosa PA01
gucccgccaggcgcc

SEQ ID NO: 3405241 - RNA, 18 nt, Pseudomonas aeruginosa PA01
gucccgccgcgccgcuca

SEQ ID NO: 3405242 - RNA, 22 nt, Pseudomonas aeruginosa PA01
gucccgccggagacuucagcgc

SEQ ID NO: 3405243 - RNA, 16 nt, Pseudomonas aeruginosa PA01
gucccgcgcgccgagc

SEQ ID NO: 3405244 - RNA, 14 nt, Pseudomonas aeruginosa PA01
gucccgcgcggccc

SEQ ID NO: 3405245 - RNA, 18 nt, Pseudomonas aeruginosa PA01
gucccgcuccagccggca

SEQ ID NO: 3405246 - RNA, 21 nt, Pseudomonas aeruginosa PA01
gucccgcuccagccggcaagc

SEQ ID NO: 3405247 - RNA, 13 nt, Pseudomonas aeruginosa PA01
gucccggacgacg

SEQ ID NO: 3405248 - RNA, 18 nt, Pseudomonas aeruginosa PA01
gucccggacgacgaaaga

SEQ ID NO: 3405249 - RNA, 20 nt, Pseudomonas aeruginosa PA01
gucccggacgggugcgcgcc

SEQ ID NO: 3405250 - RNA, 17 nt, Pseudomonas aeruginosa PA01
gucccggaguuccagcg

SEQ ID NO: 3405251 - RNA, 15 nt, Pseudomonas aeruginosa PA01
gucccggcgccgccc

SEQ ID NO: 3405252 - RNA, 17 nt, Pseudomonas aeruginosa PA01
gucccggcuugccggca

SEQ ID NO: 3405253 - RNA, 18 nt, Pseudomonas aeruginosa PA01
gucccgggaaaccaccag

SEQ ID NO: 3405254 - RNA, 15 nt, Pseudomonas aeruginosa PA01
gucccguccgcugcg

SEQ ID NO: 3405255 - RNA, 21 nt, Pseudomonas aeruginosa PA01
gucccguuccgcucaccaggc

SEQ ID NO: 3405256 - RNA, 22 nt, Pseudomonas aeruginosa PA01
gucccguuccgcucaccaggcc

SEQ ID NO: 3405257 - RNA, 18 nt, Pseudomonas aeruginosa PA01
gucccguuccggcgcagc

SEQ ID NO: 3405258 - RNA, 15 nt, Pseudomonas aeruginosa PA01
gucccuaccagcgca

SEQ ID NO: 3405259 - RNA, 22 nt, Pseudomonas aeruginosa PA01
gucccugaccagcagggugcgg

SEQ ID NO: 3405260 - RNA, 19 nt, Pseudomonas aeruginosa PA01
gucccugcacagggacgcg

SEQ ID NO: 3405261 - RNA, 19 nt, Pseudomonas aeruginosa PA01
gucccugcccgcgccucgc

SEQ ID NO: 3405262 - RNA, 15 nt, Pseudomonas aeruginosa PA01
gucccuggccggcga

SEQ ID NO: 3405263 - RNA, 22 nt, Pseudomonas aeruginosa PA01
gucccugggccugcagguuguc

SEQ ID NO: 3405264 - RNA, 16 nt, Pseudomonas aeruginosa PA01
gucccugucccgccgc

SEQ ID NO: 3405265 - RNA, 19 nt, Pseudomonas aeruginosa PA01
gucccugucccgccgcgcc

SEQ ID NO: 3405266 - RNA, 21 nt, Pseudomonas aeruginosa PA01
gucccugucccgccgcgccgc

SEQ ID NO: 3405267 - RNA, 17 nt, Pseudomonas aeruginosa PA01
gucccuucgugggccug

SEQ ID NO: 3405268 - RNA, 20 nt, Pseudomonas aeruginosa PA01
gucccuucgugggccugcuc

SEQ ID NO: 3405269 - RNA, 20 nt, Pseudomonas aeruginosa PA01
gucccuugaucagcgcgcgu

SEQ ID NO: 3405270 - RNA, 22 nt, Pseudomonas aeruginosa PA01
gucccuugcggguacgcgggcc

SEQ ID NO: 3405271 - RNA, 20 nt, Pseudomonas aeruginosa PA01
guccggucgcaccgccagca

SEQ ID NO: 3405272 - RNA, 20 nt, Pseudomonas aeruginosa PA01
guccgguugcuggcacaggu

SEQ ID NO: 3405273 - RNA, 16 nt, Pseudomonas aeruginosa PA01
guccguaaugcaaccc

SEQ ID NO: 3405274 - RNA, 23 nt, Pseudomonas aeruginosa PA01
guccguaaugcaacccgccgcug

SEQ ID NO: 3405275 - RNA, 14 nt, Pseudomonas aeruginosa PA01
guccguccagcgcg

SEQ ID NO: 3405276 - RNA, 21 nt, Pseudomonas aeruginosa PA01
guccguccagcgcgcccggcg

SEQ ID NO: 3405277 - RNA, 22 nt, Pseudomonas aeruginosa PA01
guccguccagcgcgcccggcgc

SEQ ID NO: 3405278 - RNA, 16 nt, Pseudomonas aeruginosa PA01
guccgucccacaggcc

SEQ ID NO: 3405279 - RNA, 17 nt, Pseudomonas aeruginosa PA01
guccgucccacaggccg

SEQ ID NO: 3405280 - RNA, 18 nt, Pseudomonas aeruginosa PA01
guccgucccacaggccgg

SEQ ID NO: 3405281 - RNA, 14 nt, Pseudomonas aeruginosa PA01
guccgucucgucga

SEQ ID NO: 3405282 - RNA, 14 nt, Pseudomonas aeruginosa PA01
guccgugguacacc

SEQ ID NO: 3405283 - RNA, 14 nt, Pseudomonas aeruginosa PA01
guccguucggcgcc

SEQ ID NO: 3405284 - RNA, 16 nt, Pseudomonas aeruginosa PA01
guccguucggcgccca

SEQ ID NO: 3405285 - RNA, 18 nt, Pseudomonas aeruginosa PA01
guccguucggcgcccagg

SEQ ID NO: 3405286 - RNA, 14 nt, Pseudomonas aeruginosa PA01
guccguugcgcagc

SEQ ID NO: 3405287 - RNA, 23 nt, Pseudomonas aeruginosa PA01
guccguugcgcagcaccacgaug

SEQ ID NO: 3405288 - RNA, 23 nt, Pseudomonas aeruginosa PA01
guccucaauaccgaacaccagca

SEQ ID NO: 3405289 - RNA, 16 nt, Pseudomonas aeruginosa PA01
guccucagccucaccc

SEQ ID NO: 3405290 - RNA, 17 nt, Pseudomonas aeruginosa PA01
guccucagccucacccu

SEQ ID NO: 3405291 - RNA, 22 nt, Pseudomonas aeruginosa PA01
guccucagccucacccugcugg

SEQ ID NO: 3405292 - RNA, 13 nt, Pseudomonas aeruginosa PA01
guccuccaccccc

SEQ ID NO: 3405293 - RNA, 15 nt, Pseudomonas aeruginosa PA01
guccuccaccgcucc

SEQ ID NO: 3405294 - RNA, 18 nt, Pseudomonas aeruginosa PA01
guccuccaccgcuccggc

SEQ ID NO: 3405295 - RNA, 11 nt, Pseudomonas aeruginosa PA01
guccuccagca

SEQ ID NO: 3405296 - RNA, 13 nt, Pseudomonas aeruginosa PA01
guccuccagcggc

SEQ ID NO: 3405297 - RNA, 13 nt, Pseudomonas aeruginosa PA01
guccuccaggcuc

SEQ ID NO: 3405298 - RNA, 23 nt, Pseudomonas aeruginosa PA01
guccucccagugcgagucggcga

SEQ ID NO: 3405299 - RNA, 20 nt, Pseudomonas aeruginosa PA01
guccuccucgaucacccgcg

SEQ ID NO: 3405300 - RNA, 22 nt, Pseudomonas aeruginosa PA01
guccuccuggauacgcucggcc

SEQ ID NO: 3405301 - RNA, 19 nt, Pseudomonas aeruginosa PA01
guccucgaaagccgccgcc

SEQ ID NO: 3405302 - RNA, 22 nt, Pseudomonas aeruginosa PA01
guccucgacauggaucaccgcc

SEQ ID NO: 3405303 - RNA, 17 nt, Pseudomonas aeruginosa PA01
guccucgaugcccgccu

SEQ ID NO: 3405304 - RNA, 22 nt, Pseudomonas aeruginosa PA01
guccucgccguuggcgaggacu

SEQ ID NO: 3405305 - RNA, 16 nt, Pseudomonas aeruginosa PA01
guccucggcgccgucg

SEQ ID NO: 3405306 - RNA, 20 nt, Pseudomonas aeruginosa PA01
guccucggcguagccggcca

SEQ ID NO: 3405307 - RNA, 16 nt, Pseudomonas aeruginosa PA01
guccucgggcaccagc

SEQ ID NO: 3405308 - RNA, 16 nt, Pseudomonas aeruginosa PA01
guccucggggaagcgc

SEQ ID NO: 3405309 - RNA, 22 nt, Pseudomonas aeruginosa PA01
guccucggggaagcgcggcucg

SEQ ID NO: 3405310 - RNA, 13 nt, Pseudomonas aeruginosa PA01
guccucguggcgc

SEQ ID NO: 3405311 - RNA, 19 nt, Pseudomonas aeruginosa PA01
guccucguggcgcgccgcu

SEQ ID NO: 3405312 - RNA, 21 nt, Pseudomonas aeruginosa PA01
guccugcaacugcucgaucaa

SEQ ID NO: 3405313 - RNA, 14 nt, Pseudomonas aeruginosa PA01
guccugcaacugga

SEQ ID NO: 3405314 - RNA, 21 nt, Pseudomonas aeruginosa PA01
guccugcaacuggaaggccgc

SEQ ID NO: 3405315 - RNA, 22 nt, Pseudomonas aeruginosa PA01
guccugcaggcucagcaccuug

SEQ ID NO: 3405316 - RNA, 15 nt, Pseudomonas aeruginosa PA01
guccugcccuccugc

SEQ ID NO: 3405317 - RNA, 16 nt, Pseudomonas aeruginosa PA01
guccugcccuccugcu

SEQ ID NO: 3405318 - RNA, 23 nt, Pseudomonas aeruginosa PA01
guccugcccuccugcucgaucca

SEQ ID NO: 3405319 - RNA, 14 nt, Pseudomonas aeruginosa PA01
guccugccgcaggc

SEQ ID NO: 3405320 - RNA, 16 nt, Pseudomonas aeruginosa PA01
guccugccggugcucg

SEQ ID NO: 3405321 - RNA, 19 nt, Pseudomonas aeruginosa PA01
guccugccggugcucggcc

SEQ ID NO: 3405322 - RNA, 20 nt, Pseudomonas aeruginosa PA01
guccugccggugcucggccu

SEQ ID NO: 3405323 - RNA, 17 nt, Pseudomonas aeruginosa PA01
guccugcgcggcgacga

SEQ ID NO: 3405324 - RNA, 24 nt, Pseudomonas aeruginosa PA01
guccugcggauucaucggcggcag

SEQ ID NO: 3405325 - RNA, 22 nt, Pseudomonas aeruginosa PA01
guccugcggccgcaaccagccc

SEQ ID NO: 3405326 - RNA, 15 nt, Pseudomonas aeruginosa PA01
guccugcggccgggu

SEQ ID NO: 3405327 - RNA, 15 nt, Pseudomonas aeruginosa PA01
guccugcggcggcag

SEQ ID NO: 3405328 - RNA, 20 nt, Pseudomonas aeruginosa PA01
guccugcggcggcaggucgg

SEQ ID NO: 3405329 - RNA, 10 nt, Pseudomonas aeruginosa PA01
guccugcugc

SEQ ID NO: 3405330 - RNA, 16 nt, Pseudomonas aeruginosa PA01
guccugcugcuggccu

SEQ ID NO: 3405331 - RNA, 19 nt, Pseudomonas aeruginosa PA01
guccugcugcuggccuucg

SEQ ID NO: 3405332 - RNA, 23 nt, Pseudomonas aeruginosa PA01
guccugcugcuggccuucgucgg

SEQ ID NO: 3405333 - RNA, 16 nt, Pseudomonas aeruginosa PA01
guccugcuugaccuug

SEQ ID NO: 3405334 - RNA, 17 nt, Pseudomonas aeruginosa PA01
guccuggacccguugcc

SEQ ID NO: 3405335 - RNA, 19 nt, Pseudomonas aeruginosa PA01
guccuggauaagccgcgcc

SEQ ID NO: 3405336 - RNA, 22 nt, Pseudomonas aeruginosa PA01
guccuggauaagccgcgccauc

SEQ ID NO: 3405337 - RNA, 23 nt, Pseudomonas aeruginosa PA01
guccuggauaagccgcgccaucg

SEQ ID NO: 3405338 - RNA, 16 nt, Pseudomonas aeruginosa PA01
guccuggaucggcagc

SEQ ID NO: 3405339 - RNA, 20 nt, Pseudomonas aeruginosa PA01
guccuggcgaguggcgaagc

SEQ ID NO: 3405340 - RNA, 14 nt, Pseudomonas aeruginosa PA01
guccuggcgcgaga

SEQ ID NO: 3405341 - RNA, 23 nt, Pseudomonas aeruginosa PA01
guccuggcggcaaggcacacgcc

SEQ ID NO: 3405342 - RNA, 16 nt, Pseudomonas aeruginosa PA01
guccuggcgguagccc

SEQ ID NO: 3405343 - RNA, 21 nt, Pseudomonas aeruginosa PA01
guccuggcgguagcccggcag

SEQ ID NO: 3405344 - RNA, 19 nt, Pseudomonas aeruginosa PA01
guccugggccaccuggcuc

SEQ ID NO: 3405345 - RNA, 22 nt, Pseudomonas aeruginosa PA01
guccuggguauagaccagcacc

SEQ ID NO: 3405346 - RNA, 22 nt, Pseudomonas aeruginosa PA01
guccuggguggcgacgccgguc

SEQ ID NO: 3405347 - RNA, 23 nt, Pseudomonas aeruginosa PA01
guccuggguggcgacgccggucg

SEQ ID NO: 3405348 - RNA, 15 nt, Pseudomonas aeruginosa PA01
guccuggugaucauc

SEQ ID NO: 3405349 - RNA, 19 nt, Pseudomonas aeruginosa PA01
guccuguggcgcuucguug

SEQ ID NO: 3405350 - RNA, 17 nt, Pseudomonas aeruginosa PA01
guccuuauucggcccau

SEQ ID NO: 3405351 - RNA, 20 nt, Pseudomonas aeruginosa PA01
guccuuccagcucucgcugg

SEQ ID NO: 3405352 - RNA, 13 nt, Pseudomonas aeruginosa PA01
guccuucggccag

SEQ ID NO: 3405353 - RNA, 14 nt, Pseudomonas aeruginosa PA01
guccuucggccagu

SEQ ID NO: 3405354 - RNA, 13 nt, Pseudomonas aeruginosa PA01
guccuucggccgc

SEQ ID NO: 3405355 - RNA, 18 nt, Pseudomonas aeruginosa PA01
guccuugaguagcuggcg

SEQ ID NO: 3405356 - RNA, 19 nt, Pseudomonas aeruginosa PA01
guccuugaguagcuggcgc

SEQ ID NO: 3405357 - RNA, 21 nt, Pseudomonas aeruginosa PA01
guccuugaguagcuggcgcag

SEQ ID NO: 3405358 - RNA, 22 nt, Pseudomonas aeruginosa PA01
guccuugaguagcuggcgcagg

SEQ ID NO: 3405359 - RNA, 19 nt, Pseudomonas aeruginosa PA01
guccuugaguucccagacc

SEQ ID NO: 3405360 - RNA, 14 nt, Pseudomonas aeruginosa PA01
guccuugaucggau

SEQ ID NO: 3405361 - RNA, 13 nt, Pseudomonas aeruginosa PA01
guccuugaucuug

SEQ ID NO: 3405362 - RNA, 17 nt, Pseudomonas aeruginosa PA01
guccuugaucuuguccg

SEQ ID NO: 3405363 - RNA, 14 nt, Pseudomonas aeruginosa PA01
guccuugcccggcg

SEQ ID NO: 3405364 - RNA, 15 nt, Pseudomonas aeruginosa PA01
guccuugcccggcgc

SEQ ID NO: 3405365 - RNA, 11 nt, Pseudomonas aeruginosa PA01
guccuuggccu

SEQ ID NO: 3405366 - RNA, 13 nt, Pseudomonas aeruginosa PA01
guccuugggccag

SEQ ID NO: 3405367 - RNA, 15 nt, Pseudomonas aeruginosa PA01
guccuuguucggcug

SEQ ID NO: 3405368 - RNA, 13 nt, Pseudomonas aeruginosa PA01
guccuuugccuga

SEQ ID NO: 3405369 - RNA, 17 nt, Pseudomonas aeruginosa PA01
gucgaaaaccggcgggc

SEQ ID NO: 3405370 - RNA, 21 nt, Pseudomonas aeruginosa PA01
gucgaaacgcuggcggccgag

SEQ ID NO: 3405371 - RNA, 21 nt, Pseudomonas aeruginosa PA01
gucgaaacggaacaggaaacu

SEQ ID NO: 3405372 - RNA, 16 nt, Pseudomonas aeruginosa PA01
gucgaaagccugccgg

SEQ ID NO: 3405373 - RNA, 13 nt, Pseudomonas aeruginosa PA01
gucgagcacggcg

SEQ ID NO: 3405374 - RNA, 14 nt, Pseudomonas aeruginosa PA01
gucgagcacggcgc

SEQ ID NO: 3405375 - RNA, 21 nt, Pseudomonas aeruginosa PA01
gucgagcacggcgcuggucuc

SEQ ID NO: 3405376 - RNA, 24 nt, Pseudomonas aeruginosa PA01
gucgagcagaguuuagccgccagu

SEQ ID NO: 3405377 - RNA, 11 nt, Pseudomonas aeruginosa PA01
gucgagcagcg

SEQ ID NO: 3405378 - RNA, 13 nt, Pseudomonas aeruginosa PA01
gucgagcagcgcc

SEQ ID NO: 3405379 - RNA, 14 nt, Pseudomonas aeruginosa PA01
gucgagcagcgccg

SEQ ID NO: 3405380 - RNA, 15 nt, Pseudomonas aeruginosa PA01
gucgagcagcgccgc

SEQ ID NO: 3405381 - RNA, 17 nt, Pseudomonas aeruginosa PA01
gucgagcagcgccgcgg

SEQ ID NO: 3405382 - RNA, 18 nt, Pseudomonas aeruginosa PA01
gucgagcagcgcgcggcu

SEQ ID NO: 3405383 - RNA, 21 nt, Pseudomonas aeruginosa PA01
gucgagcagggagaaccaggc

SEQ ID NO: 3405384 - RNA, 22 nt, Pseudomonas aeruginosa PA01
gucgagcagggagaaccaggcg

SEQ ID NO: 3405385 - RNA, 17 nt, Pseudomonas aeruginosa PA01
gucgagcaguuccggca

SEQ ID NO: 3405386 - RNA, 20 nt, Pseudomonas aeruginosa PA01
gucgagcaguuccggcacga

SEQ ID NO: 3405387 - RNA, 16 nt, Pseudomonas aeruginosa PA01
gucgagcaucugccgg

SEQ ID NO: 3405388 - RNA, 20 nt, Pseudomonas aeruginosa PA01
gucgagcaucugccgggcgc

SEQ ID NO: 3405389 - RNA, 12 nt, Pseudomonas aeruginosa PA01
gucgagccagcc

SEQ ID NO: 3405390 - RNA, 20 nt, Pseudomonas aeruginosa PA01
gucgagccagcccagcggcg

SEQ ID NO: 3405391 - RNA, 21 nt, Pseudomonas aeruginosa PA01
gucgagccagcccagcggcgc

SEQ ID NO: 3405392 - RNA, 14 nt, Pseudomonas aeruginosa PA01
gucgagccaggcgu

SEQ ID NO: 3405393 - RNA, 16 nt, Pseudomonas aeruginosa PA01
gucgagcgcagcgaca

SEQ ID NO: 3405394 - RNA, 13 nt, Pseudomonas aeruginosa PA01
gucgagcucggcc

SEQ ID NO: 3405395 - RNA, 16 nt, Pseudomonas aeruginosa PA01
gucgagcucggccagg

SEQ ID NO: 3405396 - RNA, 17 nt, Pseudomonas aeruginosa PA01
gucgagcucggccaggc

SEQ ID NO: 3405397 - RNA, 13 nt, Pseudomonas aeruginosa PA01
gucgagcugcucg

SEQ ID NO: 3405398 - RNA, 21 nt, Pseudomonas aeruginosa PA01
gucgagcugcucggcgguggg

SEQ ID NO: 3405399 - RNA, 13 nt, Pseudomonas aeruginosa PA01
gucgagcuggcgc

SEQ ID NO: 3405400 - RNA, 17 nt, Pseudomonas aeruginosa PA01
gucgagcuggcgcaggc

SEQ ID NO: 3405401 - RNA, 23 nt, Pseudomonas aeruginosa PA01
gucgagcuggcgcaggccuucga

SEQ ID NO: 3405402 - RNA, 21 nt, Pseudomonas aeruginosa PA01
gucgagcugggucacuccgcu

SEQ ID NO: 3405403 - RNA, 21 nt, Pseudomonas aeruginosa PA01
gucgagcuuguuggccagcag

SEQ ID NO: 3405404 - RNA, 23 nt, Pseudomonas aeruginosa PA01
gucgagcuuguuggccagcagcc

SEQ ID NO: 3405405 - RNA, 13 nt, Pseudomonas aeruginosa PA01
gucgaggaacagg

SEQ ID NO: 3405406 - RNA, 15 nt, Pseudomonas aeruginosa PA01
gucgaggaaggccag

SEQ ID NO: 3405407 - RNA, 16 nt, Pseudomonas aeruginosa PA01
gucgaggaaggccagc

SEQ ID NO: 3405408 - RNA, 19 nt, Pseudomonas aeruginosa PA01
gucgaggaaggccagcagg

SEQ ID NO: 3405409 - RNA, 17 nt, Pseudomonas aeruginosa PA01
gucgaggaaggccaggu

SEQ ID NO: 3405410 - RNA, 16 nt, Pseudomonas aeruginosa PA01
gucgaggaucuucucc

SEQ ID NO: 3405411 - RNA, 21 nt, Pseudomonas aeruginosa PA01
gucgaggcaaucugcccggca

SEQ ID NO: 3405412 - RNA, 18 nt, Pseudomonas aeruginosa PA01
gucgaggcccucggcggc

SEQ ID NO: 3405413 - RNA, 19 nt, Pseudomonas aeruginosa PA01
gucgaggcccucggcggcg

SEQ ID NO: 3405414 - RNA, 21 nt, Pseudomonas aeruginosa PA01
gucgaggcggagaagccgcug

SEQ ID NO: 3405415 - RNA, 13 nt, Pseudomonas aeruginosa PA01
gucgaggcugccg

SEQ ID NO: 3405416 - RNA, 17 nt, Pseudomonas aeruginosa PA01
gucgaggcugccgaagc

SEQ ID NO: 3405417 - RNA, 17 nt, Pseudomonas aeruginosa PA01
gucgaggcugucgcgga

SEQ ID NO: 3405418 - RNA, 19 nt, Pseudomonas aeruginosa PA01
gucgagggcaaaggcgcgc

SEQ ID NO: 3405419 - RNA, 22 nt, Pseudomonas aeruginosa PA01
gucgagggcaaaggcgcgcagg

SEQ ID NO: 3405420 - RNA, 14 nt, Pseudomonas aeruginosa PA01
gucgagggccuugu

SEQ ID NO: 3405421 - RNA, 17 nt, Pseudomonas aeruginosa PA01
gucgagggcugggcagc

SEQ ID NO: 3405422 - RNA, 16 nt, Pseudomonas aeruginosa PA01
gucgagggucugcucg

SEQ ID NO: 3405423 - RNA, 20 nt, Pseudomonas aeruginosa PA01
gucgaggguggcgccgagca

SEQ ID NO: 3405424 - RNA, 20 nt, Pseudomonas aeruginosa PA01
gucgaggguggucagccagc

SEQ ID NO: 3405425 - RNA, 22 nt, Pseudomonas aeruginosa PA01
gucgaggguggucagccagccg

SEQ ID NO: 3405426 - RNA, 18 nt, Pseudomonas aeruginosa PA01
gucgagggugguuuccag

SEQ ID NO: 3405427 - RNA, 22 nt, Pseudomonas aeruginosa PA01
gucgagggugguuuccaggcuc

SEQ ID NO: 3405428 - RNA, 23 nt, Pseudomonas aeruginosa PA01
gucgagggugguuuccaggcuca

SEQ ID NO: 3405429 - RNA, 17 nt, Pseudomonas aeruginosa PA01
gucgaggguugggcagc

SEQ ID NO: 3405430 - RNA, 22 nt, Pseudomonas aeruginosa PA01
gucgagguagaacaggcugccg

SEQ ID NO: 3405431 - RNA, 17 nt, Pseudomonas aeruginosa PA01
gucgagguagucgguga

SEQ ID NO: 3405432 - RNA, 16 nt, Pseudomonas aeruginosa PA01
gucgaggucgacggcg

SEQ ID NO: 3405433 - RNA, 18 nt, Pseudomonas aeruginosa PA01
gucgaggucgacggcggc

SEQ ID NO: 3405434 - RNA, 19 nt, Pseudomonas aeruginosa PA01
gucgaggucgacggcggcc

SEQ ID NO: 3405435 - RNA, 20 nt, Pseudomonas aeruginosa PA01
gucgaggucgagguccacgu

SEQ ID NO: 3405436 - RNA, 22 nt, Pseudomonas aeruginosa PA01
gucgaggugcggcugccggugc

SEQ ID NO: 3405437 - RNA, 17 nt, Pseudomonas aeruginosa PA01
gucgagguucuccaggc

SEQ ID NO: 3405438 - RNA, 20 nt, Pseudomonas aeruginosa PA01
gucgagguuguagcccuggg

SEQ ID NO: 3405439 - RNA, 21 nt, Pseudomonas aeruginosa PA01
gucgaguaccgcugcggccgg

SEQ ID NO: 3405440 - RNA, 23 nt, Pseudomonas aeruginosa PA01
gucgaguaccgcugcggccggcg

SEQ ID NO: 3405441 - RNA, 19 nt, Pseudomonas aeruginosa PA01
gucgagucgcgcagccagu

SEQ ID NO: 3405442 - RNA, 13 nt, Pseudomonas aeruginosa PA01
gucgagugcuccg

SEQ ID NO: 3405443 - RNA, 16 nt, Pseudomonas aeruginosa PA01
gucgauaccagcgccg

SEQ ID NO: 3405444 - RNA, 17 nt, Pseudomonas aeruginosa PA01
gucgauaccagcgccgc

SEQ ID NO: 3405445 - RNA, 18 nt, Pseudomonas aeruginosa PA01
gucgauaccagcgccgcu

SEQ ID NO: 3405446 - RNA, 20 nt, Pseudomonas aeruginosa PA01
gucgauacgcaucugcucga

SEQ ID NO: 3405447 - RNA, 15 nt, Pseudomonas aeruginosa PA01
gucgauauagcccug

SEQ ID NO: 3405448 - RNA, 20 nt, Pseudomonas aeruginosa PA01
gucgauauagcccugggcgc

SEQ ID NO: 3405449 - RNA, 16 nt, Pseudomonas aeruginosa PA01
gucgauauccagcggc

SEQ ID NO: 3405450 - RNA, 17 nt, Pseudomonas aeruginosa PA01
gucgauauccagcggca

SEQ ID NO: 3405451 - RNA, 18 nt, Pseudomonas aeruginosa PA01
gucgauauccagcggcag

SEQ ID NO: 3405452 - RNA, 23 nt, Pseudomonas aeruginosa PA01
gucgauauccagcggcagccccu

SEQ ID NO: 3405453 - RNA, 16 nt, Pseudomonas aeruginosa PA01
gucgauauugccgcgg

SEQ ID NO: 3405454 - RNA, 14 nt, Pseudomonas aeruginosa PA01
gucgaucagcagca

SEQ ID NO: 3405455 - RNA, 15 nt, Pseudomonas aeruginosa PA01
gucgaucagcgcgcg

SEQ ID NO: 3405456 - RNA, 16 nt, Pseudomonas aeruginosa PA01
gucgaucagcgcgcgg

SEQ ID NO: 3405457 - RNA, 17 nt, Pseudomonas aeruginosa PA01
gucgaucaggaacaccc

SEQ ID NO: 3405458 - RNA, 17 nt, Pseudomonas aeruginosa PA01
gucgaucaggaacgcgc

SEQ ID NO: 3405459 - RNA, 14 nt, Pseudomonas aeruginosa PA01
gucgaucaggcgca

SEQ ID NO: 3405460 - RNA, 15 nt, Pseudomonas aeruginosa PA01
gucgaucaggcgcau

SEQ ID NO: 3405461 - RNA, 15 nt, Pseudomonas aeruginosa PA01
gucgaucaggcgggc

SEQ ID NO: 3405462 - RNA, 19 nt, Pseudomonas aeruginosa PA01
gucgaucagguaggccggc

SEQ ID NO: 3405463 - RNA, 24 nt, Pseudomonas aeruginosa PA01
gucgaucagguaggccggcgugcc

SEQ ID NO: 3405464 - RNA, 14 nt, Pseudomonas aeruginosa PA01
gucgaucaggucgc

SEQ ID NO: 3405465 - RNA, 23 nt, Pseudomonas aeruginosa PA01
gucgaucaggucgccgccgccgg

SEQ ID NO: 3405466 - RNA, 23 nt, Pseudomonas aeruginosa PA01
gucgaucaucugcugcagcauca

SEQ ID NO: 3405467 - RNA, 23 nt, Pseudomonas aeruginosa PA01
gucgaucccggauucgccgagga

SEQ ID NO: 3405468 - RNA, 14 nt, Pseudomonas aeruginosa PA01
gucgauccgcgccu

SEQ ID NO: 3405469 - RNA, 15 nt, Pseudomonas aeruginosa PA01
gucgauccgcgccug

SEQ ID NO: 3405470 - RNA, 17 nt, Pseudomonas aeruginosa PA01
gucgaucguugccagcc

SEQ ID NO: 3405471 - RNA, 17 nt, Pseudomonas aeruginosa PA01
gucgaucuccuccucgg

SEQ ID NO: 3405472 - RNA, 21 nt, Pseudomonas aeruginosa PA01
gucgaucucgaagaccagcgg

SEQ ID NO: 3405473 - RNA, 17 nt, Pseudomonas aeruginosa PA01
gucgaucucgagcaugu

SEQ ID NO: 3405474 - RNA, 14 nt, Pseudomonas aeruginosa PA01
gucgaucucgccga

SEQ ID NO: 3405475 - RNA, 15 nt, Pseudomonas aeruginosa PA01
gucgcccgggcgcca

SEQ ID NO: 3405476 - RNA, 16 nt, Pseudomonas aeruginosa PA01
gucgcccgggcgccac

SEQ ID NO: 3405477 - RNA, 19 nt, Pseudomonas aeruginosa PA01
gucgcccgggcgccaccga

SEQ ID NO: 3405478 - RNA, 20 nt, Pseudomonas aeruginosa PA01
gucgcccgugccucggcgga

SEQ ID NO: 3405479 - RNA, 17 nt, Pseudomonas aeruginosa PA01
gucgcccucggccaggc

SEQ ID NO: 3405480 - RNA, 18 nt, Pseudomonas aeruginosa PA01
gucgcccucggccaggca

SEQ ID NO: 3405481 - RNA, 14 nt, Pseudomonas aeruginosa PA01
gucgcccucggcgc

SEQ ID NO: 3405482 - RNA, 15 nt, Pseudomonas aeruginosa PA01
gucgcccucggcgcu

SEQ ID NO: 3405483 - RNA, 16 nt, Pseudomonas aeruginosa PA01
gucgcccucggcgcug

SEQ ID NO: 3405484 - RNA, 19 nt, Pseudomonas aeruginosa PA01
gucgcccucggcgcuggcc

SEQ ID NO: 3405485 - RNA, 21 nt, Pseudomonas aeruginosa PA01
gucgcccucggcgcuggccag

SEQ ID NO: 3405486 - RNA, 15 nt, Pseudomonas aeruginosa PA01
gucgcccugcccggu

SEQ ID NO: 3405487 - RNA, 14 nt, Pseudomonas aeruginosa PA01
gucgcccuggccga

SEQ ID NO: 3405488 - RNA, 11 nt, Pseudomonas aeruginosa PA01
gucgcccuggu

SEQ ID NO: 3405489 - RNA, 22 nt, Pseudomonas aeruginosa PA01
gucgcccuggugcacggcgacc

SEQ ID NO: 3405490 - RNA, 18 nt, Pseudomonas aeruginosa PA01
gucgccgaacagccgccc

SEQ ID NO: 3405491 - RNA, 16 nt, Pseudomonas aeruginosa PA01
gucgccgaacggcagc

SEQ ID NO: 3405492 - RNA, 19 nt, Pseudomonas aeruginosa PA01
gucgccgaacggcagcugg

SEQ ID NO: 3405493 - RNA, 12 nt, Pseudomonas aeruginosa PA01
gucgccgacacg

SEQ ID NO: 3405494 - RNA, 12 nt, Pseudomonas aeruginosa PA01
gucgccgaccag

SEQ ID NO: 3405495 - RNA, 13 nt, Pseudomonas aeruginosa PA01
gucgccgaccagg

SEQ ID NO: 3405496 - RNA, 19 nt, Pseudomonas aeruginosa PA01
gucgccgaccaggcggccg

SEQ ID NO: 3405497 - RNA, 20 nt, Pseudomonas aeruginosa PA01
gucgccgaccaggcggccgu

SEQ ID NO: 3405498 - RNA, 15 nt, Pseudomonas aeruginosa PA01
gucgccgacccugca

SEQ ID NO: 3405499 - RNA, 13 nt, Pseudomonas aeruginosa PA01
gucgccgacugcg

SEQ ID NO: 3405500 - RNA, 19 nt, Pseudomonas aeruginosa PA01
gucgccgacuucggcaagc

SEQ ID NO: 3405501 - RNA, 17 nt, Pseudomonas aeruginosa PA01
gucgccgaucugcaggu

SEQ ID NO: 3405502 - RNA, 23 nt, Pseudomonas aeruginosa PA01
gucgccgauuucgcagaacgcgg

SEQ ID NO: 3405503 - RNA, 19 nt, Pseudomonas aeruginosa PA01
gucgccgcaccggcgaugg

SEQ ID NO: 3405504 - RNA, 23 nt, Pseudomonas aeruginosa PA01
gucgccgcaccggcgauggccgg

SEQ ID NO: 3405505 - RNA, 23 nt, Pseudomonas aeruginosa PA01
gucgccgcagcccuaggcgaccc

SEQ ID NO: 3405506 - RNA, 12 nt, Pseudomonas aeruginosa PA01
gucgccgccagc

SEQ ID NO: 3405507 - RNA, 13 nt, Pseudomonas aeruginosa PA01
gucgccgccagca

SEQ ID NO: 3405508 - RNA, 15 nt, Pseudomonas aeruginosa PA01
gucgccgccagcaug

SEQ ID NO: 3405509 - RNA, 15 nt, Pseudomonas aeruginosa PA01
gucgccgccagcuac

SEQ ID NO: 3405510 - RNA, 16 nt, Pseudomonas aeruginosa PA01
gucgccgccagcuacc

SEQ ID NO: 3405511 - RNA, 21 nt, Pseudomonas aeruginosa PA01
gucgccgccaguucggccauc

SEQ ID NO: 3405512 - RNA, 11 nt, Pseudomonas aeruginosa PA01
gucgccgccca

SEQ ID NO: 3405513 - RNA, 21 nt, Pseudomonas aeruginosa PA01
gucgccgcccacgccuugcag

SEQ ID NO: 3405514 - RNA, 15 nt, Pseudomonas aeruginosa PA01
gucgccgcccggcag

SEQ ID NO: 3405515 - RNA, 17 nt, Pseudomonas aeruginosa PA01
gucgccgcccggcagcg

SEQ ID NO: 3405516 - RNA, 18 nt, Pseudomonas aeruginosa PA01
gucgccgcccggcagcgg

SEQ ID NO: 3405517 - RNA, 22 nt, Pseudomonas aeruginosa PA01
gucgccgcccggcagcggcugg

SEQ ID NO: 3405518 - RNA, 20 nt, Pseudomonas aeruginosa PA01
gucgccgccgaggcgcgcca

SEQ ID NO: 3405519 - RNA, 13 nt, Pseudomonas aeruginosa PA01
gucgccgccgagu

SEQ ID NO: 3405520 - RNA, 17 nt, Pseudomonas aeruginosa PA01
gucgccgccgccgggaa

SEQ ID NO: 3405521 - RNA, 14 nt, Pseudomonas aeruginosa PA01
gucgccgccgcggg

SEQ ID NO: 3405522 - RNA, 15 nt, Pseudomonas aeruginosa PA01
gucgccgcgaccucg

SEQ ID NO: 3405523 - RNA, 16 nt, Pseudomonas aeruginosa PA01
gucgccgcgaccucgu

SEQ ID NO: 3405524 - RNA, 15 nt, Pseudomonas aeruginosa PA01
gucgccgcggacggc

SEQ ID NO: 3405525 - RNA, 22 nt, Pseudomonas aeruginosa PA01
gucgccgcugaauaccaccggg

SEQ ID NO: 3405526 - RNA, 23 nt, Pseudomonas aeruginosa PA01
gucgccgcugaauaccaccgggc

SEQ ID NO: 3405527 - RNA, 13 nt, Pseudomonas aeruginosa PA01
gucgccgcuggac

SEQ ID NO: 3405528 - RNA, 14 nt, Pseudomonas aeruginosa PA01
gucgccgcugggca

SEQ ID NO: 3405529 - RNA, 22 nt, Pseudomonas aeruginosa PA01
gucgccggaggggcggccgccg

SEQ ID NO: 3405530 - RNA, 22 nt, Pseudomonas aeruginosa PA01
gucgccggagucguagcgcgcg

SEQ ID NO: 3405531 - RNA, 19 nt, Pseudomonas aeruginosa PA01
gucgccggcaucguggcca

SEQ ID NO: 3405532 - RNA, 15 nt, Pseudomonas aeruginosa PA01
gucgccggccgcugu

SEQ ID NO: 3405533 - RNA, 15 nt, Pseudomonas aeruginosa PA01
gucgccggcgaacuc

SEQ ID NO: 3405534 - RNA, 23 nt, Pseudomonas aeruginosa PA01
gucgccggcgacggucagcaggc

SEQ ID NO: 3405535 - RNA, 13 nt, Pseudomonas aeruginosa PA01
gucgccggcgcgc

SEQ ID NO: 3405536 - RNA, 20 nt, Pseudomonas aeruginosa PA01
gucgccgggaaacagggcga

SEQ ID NO: 3405537 - RNA, 23 nt, Pseudomonas aeruginosa PA01
gucgccgggaaacagggcgacgc

SEQ ID NO: 3405538 - RNA, 23 nt, Pseudomonas aeruginosa PA01
gucgccgggucgacuucgcacca

SEQ ID NO: 3405539 - RNA, 18 nt, Pseudomonas aeruginosa PA01
gucgccggugaggaugcg

SEQ ID NO: 3405540 - RNA, 20 nt, Pseudomonas aeruginosa PA01
gucgccguagaacagcacgu

SEQ ID NO: 3405541 - RNA, 24 nt, Pseudomonas aeruginosa PA01
gucgccguagaacagcacgucgau

SEQ ID NO: 3405542 - RNA, 17 nt, Pseudomonas aeruginosa PA01
gucgccguggaugucga

SEQ ID NO: 3405543 - RNA, 14 nt, Pseudomonas aeruginosa PA01
gucgccgugguggc

SEQ ID NO: 3405544 - RNA, 17 nt, Pseudomonas aeruginosa PA01
gucgccguucagguuca

SEQ ID NO: 3405545 - RNA, 18 nt, Pseudomonas aeruginosa PA01
gucgccucgaacauggcc

SEQ ID NO: 3405546 - RNA, 15 nt, Pseudomonas aeruginosa PA01
gucgccucgggggug

SEQ ID NO: 3405547 - RNA, 15 nt, Pseudomonas aeruginosa PA01
gucgccugccaggcg

SEQ ID NO: 3405548 - RNA, 15 nt, Pseudomonas aeruginosa PA01
gucgccuggcccugg

SEQ ID NO: 3405549 - RNA, 16 nt, Pseudomonas aeruginosa PA01
gucgccuuccaccacc

SEQ ID NO: 3405550 - RNA, 20 nt, Pseudomonas aeruginosa PA01
gucgccuuccaccaccaggg

SEQ ID NO: 3405551 - RNA, 16 nt, Pseudomonas aeruginosa PA01
gucgccuuccggcagg

SEQ ID NO: 3405552 - RNA, 17 nt, Pseudomonas aeruginosa PA01
gucgccuuccggcaggu

SEQ ID NO: 3405553 - RNA, 17 nt, Pseudomonas aeruginosa PA01
gucgccuuccucggcga

SEQ ID NO: 3405554 - RNA, 18 nt, Pseudomonas aeruginosa PA01
gucgccuuccucggcgaa

SEQ ID NO: 3405555 - RNA, 16 nt, Pseudomonas aeruginosa PA01
gucgccuugaccagcg

SEQ ID NO: 3405556 - RNA, 19 nt, Pseudomonas aeruginosa PA01
gucgccuugaccagcggcc

SEQ ID NO: 3405557 - RNA, 20 nt, Pseudomonas aeruginosa PA01
gucgccuugaccagcggccc

SEQ ID NO: 3405558 - RNA, 16 nt, Pseudomonas aeruginosa PA01
gucgcgaacucggcgc

SEQ ID NO: 3405559 - RNA, 17 nt, Pseudomonas aeruginosa PA01
gucgcgaacucggcgcc

SEQ ID NO: 3405560 - RNA, 19 nt, Pseudomonas aeruginosa PA01
gucgcgaacucggcgccga

SEQ ID NO: 3405561 - RNA, 21 nt, Pseudomonas aeruginosa PA01
gucgcgaacucggcgccgauc

SEQ ID NO: 3405562 - RNA, 18 nt, Pseudomonas aeruginosa PA01
gucgcgaagaccggccgg

SEQ ID NO: 3405563 - RNA, 20 nt, Pseudomonas aeruginosa PA01
gucgcgaagaccggccggcu

SEQ ID NO: 3405564 - RNA, 20 nt, Pseudomonas aeruginosa PA01
gucgcgacugaccacgcaga

SEQ ID NO: 3405565 - RNA, 21 nt, Pseudomonas aeruginosa PA01
gucgcgacugaccacgcagag

SEQ ID NO: 3405566 - RNA, 15 nt, Pseudomonas aeruginosa PA01
gucgcgagcagggcg

SEQ ID NO: 3405567 - RNA, 19 nt, Pseudomonas aeruginosa PA01
gucgcgagguuccgcggcg

SEQ ID NO: 3405568 - RNA, 16 nt, Pseudomonas aeruginosa PA01
gucgcgauagacgccg

SEQ ID NO: 3405569 - RNA, 19 nt, Pseudomonas aeruginosa PA01
gucgcgauagacgccggcg

SEQ ID NO: 3405570 - RNA, 17 nt, Pseudomonas aeruginosa PA01
gucgcgaucaccgcguc

SEQ ID NO: 3405571 - RNA, 15 nt, Pseudomonas aeruginosa PA01
gucgcgauccaccgc

SEQ ID NO: 3405572 - RNA, 19 nt, Pseudomonas aeruginosa PA01
gucgcgauccaccgccagg

SEQ ID NO: 3405573 - RNA, 21 nt, Pseudomonas aeruginosa PA01
gucgcgauccaccgccagggc

SEQ ID NO: 3405574 - RNA, 15 nt, Pseudomonas aeruginosa PA01
gucgcgaucugcugg

SEQ ID NO: 3405575 - RNA, 16 nt, Pseudomonas aeruginosa PA01
gucgcgaucugcuggu

SEQ ID NO: 3405576 - RNA, 19 nt, Pseudomonas aeruginosa PA01
gucgcgauguuggcgucga

SEQ ID NO: 3405577 - RNA, 22 nt, Pseudomonas aeruginosa PA01
gucgcugagcaguugcgggcgc

SEQ ID NO: 3405578 - RNA, 17 nt, Pseudomonas aeruginosa PA01
gucgcugagcggcuggu

SEQ ID NO: 3405579 - RNA, 18 nt, Pseudomonas aeruginosa PA01
gucgcugagcggcuggug

SEQ ID NO: 3405580 - RNA, 21 nt, Pseudomonas aeruginosa PA01
gucgcugcacgcacgcgccug

SEQ ID NO: 3405581 - RNA, 21 nt, Pseudomonas aeruginosa PA01
gucgcugcccaucgccuccac

SEQ ID NO: 3405582 - RNA, 22 nt, Pseudomonas aeruginosa PA01
gucgcugcccaucgccuccacg

SEQ ID NO: 3405583 - RNA, 14 nt, Pseudomonas aeruginosa PA01
gucgcugccgccgc

SEQ ID NO: 3405584 - RNA, 14 nt, Pseudomonas aeruginosa PA01
gucgcugccgcuga

SEQ ID NO: 3405585 - RNA, 14 nt, Pseudomonas aeruginosa PA01
gucgcugcgcaacu

SEQ ID NO: 3405586 - RNA, 14 nt, Pseudomonas aeruginosa PA01
gucgcugcgcgggu

SEQ ID NO: 3405587 - RNA, 17 nt, Pseudomonas aeruginosa PA01
gucgcugcgcgggucgu

SEQ ID NO: 3405588 - RNA, 15 nt, Pseudomonas aeruginosa PA01
gucgcugcuggcgcc

SEQ ID NO: 3405589 - RNA, 16 nt, Pseudomonas aeruginosa PA01
gucgcugcuggcgccg

SEQ ID NO: 3405590 - RNA, 20 nt, Pseudomonas aeruginosa PA01
gucgcuggagcugcgcgcga

SEQ ID NO: 3405591 - RNA, 14 nt, Pseudomonas aeruginosa PA01
gucgcuggcaccgg

SEQ ID NO: 3405592 - RNA, 18 nt, Pseudomonas aeruginosa PA01
gucgcuggcaccggccag

SEQ ID NO: 3405593 - RNA, 19 nt, Pseudomonas aeruginosa PA01
gucgcuggcaccggccagg

SEQ ID NO: 3405594 - RNA, 21 nt, Pseudomonas aeruginosa PA01
gucgcuggcaccggccaggcg

SEQ ID NO: 3405595 - RNA, 23 nt, Pseudomonas aeruginosa PA01
gucgcuggcaccggccaggcgcu

SEQ ID NO: 3405596 - RNA, 11 nt, Pseudomonas aeruginosa PA01
gucgcuggcca

SEQ ID NO: 3405597 - RNA, 13 nt, Pseudomonas aeruginosa PA01
gucgcuggccagc

SEQ ID NO: 3405598 - RNA, 14 nt, Pseudomonas aeruginosa PA01
gucgcuggccagcu

SEQ ID NO: 3405599 - RNA, 15 nt, Pseudomonas aeruginosa PA01
gucgcuggccugcag

SEQ ID NO: 3405600 - RNA, 17 nt, Pseudomonas aeruginosa PA01
gucgcuggccugcaggu

SEQ ID NO: 3405601 - RNA, 15 nt, Pseudomonas aeruginosa PA01
gucgcuggccugggg

SEQ ID NO: 3405602 - RNA, 16 nt, Pseudomonas aeruginosa PA01
gucgcuggcgucgacc

SEQ ID NO: 3405603 - RNA, 21 nt, Pseudomonas aeruginosa PA01
gucgcuggcgucgaccgccug

SEQ ID NO: 3405604 - RNA, 17 nt, Pseudomonas aeruginosa PA01
gucgcuguagcggcucg

SEQ ID NO: 3405605 - RNA, 14 nt, Pseudomonas aeruginosa PA01
gucgcuguccucca

SEQ ID NO: 3405606 - RNA, 20 nt, Pseudomonas aeruginosa PA01
gucgcuguccuccagcggcg

SEQ ID NO: 3405607 - RNA, 21 nt, Pseudomonas aeruginosa PA01
gucgcuguccuccagcggcgg

SEQ ID NO: 3405608 - RNA, 23 nt, Pseudomonas aeruginosa PA01
gucgcuguccuccagcggcggga

SEQ ID NO: 3405609 - RNA, 16 nt, Pseudomonas aeruginosa PA01
gucgcuucaccgggca

SEQ ID NO: 3405610 - RNA, 21 nt, Pseudomonas aeruginosa PA01
gucgcuucacucauccucgcc

SEQ ID NO: 3405611 - RNA, 18 nt, Pseudomonas aeruginosa PA01
gucgcuuccgcgcggcgc

SEQ ID NO: 3405612 - RNA, 14 nt, Pseudomonas aeruginosa PA01
gucgcuuccggcgc

SEQ ID NO: 3405613 - RNA, 15 nt, Pseudomonas aeruginosa PA01
gucgcuuccggcgcc

SEQ ID NO: 3405614 - RNA, 17 nt, Pseudomonas aeruginosa PA01
gucgcuuccggcgccaa

SEQ ID NO: 3405615 - RNA, 19 nt, Pseudomonas aeruginosa PA01
gucgcuuccggcgccaacc

SEQ ID NO: 3405616 - RNA, 20 nt, Pseudomonas aeruginosa PA01
gucgcuuuuuccgcugccgu

SEQ ID NO: 3405617 - RNA, 17 nt, Pseudomonas aeruginosa PA01
gucggaaagcagggcga

SEQ ID NO: 3405618 - RNA, 14 nt, Pseudomonas aeruginosa PA01
gucggaacgaccgg

SEQ ID NO: 3405619 - RNA, 21 nt, Pseudomonas aeruginosa PA01
gucggaagcgucagccgcggc

SEQ ID NO: 3405620 - RNA, 15 nt, Pseudomonas aeruginosa PA01
gucggacuccgccca

SEQ ID NO: 3405621 - RNA, 19 nt, Pseudomonas aeruginosa PA01
gucggagagauagucgccg

SEQ ID NO: 3405622 - RNA, 22 nt, Pseudomonas aeruginosa PA01
gucggagagggagcgccuggcg

SEQ ID NO: 3405623 - RNA, 14 nt, Pseudomonas aeruginosa PA01
gucggaggcgagga

SEQ ID NO: 3405624 - RNA, 22 nt, Pseudomonas aeruginosa PA01
gucggaucggauagccgugcag

SEQ ID NO: 3405625 - RNA, 14 nt, Pseudomonas aeruginosa PA01
gucggaugcagcgc

SEQ ID NO: 3405626 - RNA, 15 nt, Pseudomonas aeruginosa PA01
gucggcaagcaggcc

SEQ ID NO: 3405627 - RNA, 19 nt, Pseudomonas aeruginosa PA01
gucggcagcagcuugccgg

SEQ ID NO: 3405628 - RNA, 21 nt, Pseudomonas aeruginosa PA01
gucggcagcagcuugccggca

SEQ ID NO: 3405629 - RNA, 16 nt, Pseudomonas aeruginosa PA01
gucggcagcucuaccg

SEQ ID NO: 3405630 - RNA, 22 nt, Pseudomonas aeruginosa PA01
gucggcagguggguaccgaacu

SEQ ID NO: 3405631 - RNA, 15 nt, Pseudomonas aeruginosa PA01
gucggcagucgccgc

SEQ ID NO: 3405632 - RNA, 14 nt, Pseudomonas aeruginosa PA01
gucggcauccggca

SEQ ID NO: 3405633 - RNA, 14 nt, Pseudomonas aeruginosa PA01
gucggcauggcugu

SEQ ID NO: 3405634 - RNA, 22 nt, Pseudomonas aeruginosa PA01
gucggccaccagggugcgaugg

SEQ ID NO: 3405635 - RNA, 14 nt, Pseudomonas aeruginosa PA01
gucggccagccccu

SEQ ID NO: 3405636 - RNA, 16 nt, Pseudomonas aeruginosa PA01
gucggccagccccugc

SEQ ID NO: 3405637 - RNA, 18 nt, Pseudomonas aeruginosa PA01
gucggccagccccugcgg

SEQ ID NO: 3405638 - RNA, 19 nt, Pseudomonas aeruginosa PA01
gucggccaggacgccacca

SEQ ID NO: 3405639 - RNA, 13 nt, Pseudomonas aeruginosa PA01
gucggccaggcgc

SEQ ID NO: 3405640 - RNA, 14 nt, Pseudomonas aeruginosa PA01
gucggccaggcggc

SEQ ID NO: 3405641 - RNA, 16 nt, Pseudomonas aeruginosa PA01
gucggccaggcggccg

SEQ ID NO: 3405642 - RNA, 19 nt, Pseudomonas aeruginosa PA01
gucggccaggcggccgacg

SEQ ID NO: 3405643 - RNA, 20 nt, Pseudomonas aeruginosa PA01
gucggccaggcggccgacga

SEQ ID NO: 3405644 - RNA, 19 nt, Pseudomonas aeruginosa PA01
gucggccaggggagcgccg

SEQ ID NO: 3405645 - RNA, 14 nt, Pseudomonas aeruginosa PA01
gucggccaggucgc

SEQ ID NO: 3405646 - RNA, 15 nt, Pseudomonas aeruginosa PA01
gucggccaguuccuu

SEQ ID NO: 3405647 - RNA, 23 nt, Pseudomonas aeruginosa PA01
gucggccaguuccuucacggcau

SEQ ID NO: 3405648 - RNA, 15 nt, Pseudomonas aeruginosa PA01
gucggccaucgccgu

SEQ ID NO: 3405649 - RNA, 17 nt, Pseudomonas aeruginosa PA01
gucggccaucgccgucu

SEQ ID NO: 3405650 - RNA, 20 nt, Pseudomonas aeruginosa PA01
gucggccaucuggcugccga

SEQ ID NO: 3405651 - RNA, 20 nt, Pseudomonas aeruginosa PA01
gucggcccggagaccgugcc

SEQ ID NO: 3405652 - RNA, 23 nt, Pseudomonas aeruginosa PA01
gucggcccuugugaaagggcggc

SEQ ID NO: 3405653 - RNA, 12 nt, Pseudomonas aeruginosa PA01
gucggccgacgg

SEQ ID NO: 3405654 - RNA, 16 nt, Pseudomonas aeruginosa PA01
gucggccgacggguuc

SEQ ID NO: 3405655 - RNA, 14 nt, Pseudomonas aeruginosa PA01
gucggccgccaggg

SEQ ID NO: 3405656 - RNA, 14 nt, Pseudomonas aeruginosa PA01
gucggccgcccagc

SEQ ID NO: 3405657 - RNA, 17 nt, Pseudomonas aeruginosa PA01
gucggccgcccagcgga

SEQ ID NO: 3405658 - RNA, 14 nt, Pseudomonas aeruginosa PA01
gucggccgcucggc

SEQ ID NO: 3405659 - RNA, 14 nt, Pseudomonas aeruginosa PA01
gucggccggcagcu

SEQ ID NO: 3405660 - RNA, 16 nt, Pseudomonas aeruginosa PA01
gucggccggcagcucc

SEQ ID NO: 3405661 - RNA, 17 nt, Pseudomonas aeruginosa PA01
gucggccggcagcuccg

SEQ ID NO: 3405662 - RNA, 20 nt, Pseudomonas aeruginosa PA01
gucggccggggucaggccga

SEQ ID NO: 3405663 - RNA, 14 nt, Pseudomonas aeruginosa PA01
gucggccucgacga

SEQ ID NO: 3405664 - RNA, 21 nt, Pseudomonas aeruginosa PA01
gucggccucgagcaucuccgg

SEQ ID NO: 3405665 - RNA, 13 nt, Pseudomonas aeruginosa PA01
gucggccucgccg

SEQ ID NO: 3405666 - RNA, 18 nt, Pseudomonas aeruginosa PA01
gucggccucgccgauguc

SEQ ID NO: 3405667 - RNA, 21 nt, Pseudomonas aeruginosa PA01
gucggccugcaacacccaggc

SEQ ID NO: 3405668 - RNA, 13 nt, Pseudomonas aeruginosa PA01
gucggccugcacc

SEQ ID NO: 3405669 - RNA, 16 nt, Pseudomonas aeruginosa PA01
gucggccugcaccagc

SEQ ID NO: 3405670 - RNA, 18 nt, Pseudomonas aeruginosa PA01
gucggccugcaccagcca

SEQ ID NO: 3405671 - RNA, 15 nt, Pseudomonas aeruginosa PA01
gucggccugcagccu

SEQ ID NO: 3405672 - RNA, 19 nt, Pseudomonas aeruginosa PA01
gucggccugcagccuggcg

SEQ ID NO: 3405673 - RNA, 17 nt, Pseudomonas aeruginosa PA01
gucggccugcgguucgc

SEQ ID NO: 3405674 - RNA, 14 nt, Pseudomonas aeruginosa PA01
gucggccugcucga

SEQ ID NO: 3405675 - RNA, 23 nt, Pseudomonas aeruginosa PA01
gucggccugcugcucgaccgccu

SEQ ID NO: 3405676 - RNA, 12 nt, Pseudomonas aeruginosa PA01
gucggccuggcg

SEQ ID NO: 3405677 - RNA, 15 nt, Pseudomonas aeruginosa PA01
gucggccuggcgcag

SEQ ID NO: 3405678 - RNA, 16 nt, Pseudomonas aeruginosa PA01
gucggccuggcgcagc

SEQ ID NO: 3405679 - RNA, 13 nt, Pseudomonas aeruginosa PA01
gucggccuggcgg

SEQ ID NO: 3405680 - RNA, 16 nt, Pseudomonas aeruginosa PA01
gucgggcucagaaguc

SEQ ID NO: 3405681 - RNA, 21 nt, Pseudomonas aeruginosa PA01
gucgggcucaugggcgaugcg

SEQ ID NO: 3405682 - RNA, 17 nt, Pseudomonas aeruginosa PA01
gucgggcucgacgagga

SEQ ID NO: 3405683 - RNA, 16 nt, Pseudomonas aeruginosa PA01
gucgggcuucagcgcc

SEQ ID NO: 3405684 - RNA, 18 nt, Pseudomonas aeruginosa PA01
gucgggcuucagcgccgg

SEQ ID NO: 3405685 - RNA, 14 nt, Pseudomonas aeruginosa PA01
gucgggcuucggug

SEQ ID NO: 3405686 - RNA, 16 nt, Pseudomonas aeruginosa PA01
gucgggcuucggugua

SEQ ID NO: 3405687 - RNA, 13 nt, Pseudomonas aeruginosa PA01
gucggggcaggcg

SEQ ID NO: 3405688 - RNA, 14 nt, Pseudomonas aeruginosa PA01
gucggggcaggcgc

SEQ ID NO: 3405689 - RNA, 19 nt, Pseudomonas aeruginosa PA01
gucggggcauucguccagc

SEQ ID NO: 3405690 - RNA, 13 nt, Pseudomonas aeruginosa PA01
gucggggccggcg

SEQ ID NO: 3405691 - RNA, 14 nt, Pseudomonas aeruginosa PA01
gucggggccggcga

SEQ ID NO: 3405692 - RNA, 20 nt, Pseudomonas aeruginosa PA01
gucggggcgcaaggccagcg

SEQ ID NO: 3405693 - RNA, 12 nt, Pseudomonas aeruginosa PA01
gucggggugccg

SEQ ID NO: 3405694 - RNA, 13 nt, Pseudomonas aeruginosa PA01
gucggggugccgc

SEQ ID NO: 3405695 - RNA, 14 nt, Pseudomonas aeruginosa PA01
gucggggugccgcc

SEQ ID NO: 3405696 - RNA, 15 nt, Pseudomonas aeruginosa PA01
gucggggugccgcca

SEQ ID NO: 3405697 - RNA, 17 nt, Pseudomonas aeruginosa PA01
gucggggugccgccagu

SEQ ID NO: 3405698 - RNA, 22 nt, Pseudomonas aeruginosa PA01
gucgggguucuugucgaccagc

SEQ ID NO: 3405699 - RNA, 13 nt, Pseudomonas aeruginosa PA01
gucgggucggcga

SEQ ID NO: 3405700 - RNA, 14 nt, Pseudomonas aeruginosa PA01
gucgggucggcgaa

SEQ ID NO: 3405701 - RNA, 14 nt, Pseudomonas aeruginosa PA01
gucgguagagcagu

SEQ ID NO: 3405702 - RNA, 17 nt, Pseudomonas aeruginosa PA01
gucggucacgaaggcga

SEQ ID NO: 3405703 - RNA, 21 nt, Pseudomonas aeruginosa PA01
gucggucacggaacggguccu

SEQ ID NO: 3405704 - RNA, 19 nt, Pseudomonas aeruginosa PA01
gucggucauguccggggcg

SEQ ID NO: 3405705 - RNA, 20 nt, Pseudomonas aeruginosa PA01
gucggucauguccggggcga

SEQ ID NO: 3405706 - RNA, 21 nt, Pseudomonas aeruginosa PA01
gucgguccagcuccuugcgcu

SEQ ID NO: 3405707 - RNA, 16 nt, Pseudomonas aeruginosa PA01
gucgguccgccgaugc

SEQ ID NO: 3405708 - RNA, 17 nt, Pseudomonas aeruginosa PA01
gucgguccgccgaugcg

SEQ ID NO: 3405709 - RNA, 20 nt, Pseudomonas aeruginosa PA01
gucggucgaacugaccacca

SEQ ID NO: 3405710 - RNA, 22 nt, Pseudomonas aeruginosa PA01
gucggucgaacugaccaccagg

SEQ ID NO: 3405711 - RNA, 23 nt, Pseudomonas aeruginosa PA01
gucggucgaacugaccaccagga

SEQ ID NO: 3405712 - RNA, 13 nt, Pseudomonas aeruginosa PA01
gucggucggcguc

SEQ ID NO: 3405713 - RNA, 15 nt, Pseudomonas aeruginosa PA01
gucggucucgccacc

SEQ ID NO: 3405714 - RNA, 16 nt, Pseudomonas aeruginosa PA01
gucggucuggcggccc

SEQ ID NO: 3405715 - RNA, 17 nt, Pseudomonas aeruginosa PA01
gucggugaagcgcggcg

SEQ ID NO: 3405716 - RNA, 19 nt, Pseudomonas aeruginosa PA01
gucggugaagcgcggcggc

SEQ ID NO: 3405717 - RNA, 20 nt, Pseudomonas aeruginosa PA01
gucggugaagcgcggcggcg

SEQ ID NO: 3405718 - RNA, 13 nt, Pseudomonas aeruginosa PA01
gucggugacccgc

SEQ ID NO: 3405719 - RNA, 14 nt, Pseudomonas aeruginosa PA01
gucggugacccgca

SEQ ID NO: 3405720 - RNA, 19 nt, Pseudomonas aeruginosa PA01
gucggugagcacgccgcga

SEQ ID NO: 3405721 - RNA, 21 nt, Pseudomonas aeruginosa PA01
gucggugagcacgccgcgacc

SEQ ID NO: 3405722 - RNA, 24 nt, Pseudomonas aeruginosa PA01
gucggugaucgagacgccguagcg

SEQ ID NO: 3405723 - RNA, 20 nt, Pseudomonas aeruginosa PA01
gucggugaugaagaagccau

SEQ ID NO: 3405724 - RNA, 15 nt, Pseudomonas aeruginosa PA01
gucggugccgcccgg

SEQ ID NO: 3405725 - RNA, 21 nt, Pseudomonas aeruginosa PA01
gucggugccgcccggcgccac

SEQ ID NO: 3405726 - RNA, 15 nt, Pseudomonas aeruginosa PA01
gucggugugaccuuc

SEQ ID NO: 3405727 - RNA, 20 nt, Pseudomonas aeruginosa PA01
gucgguuagaauaccggccu

SEQ ID NO: 3405728 - RNA, 19 nt, Pseudomonas aeruginosa PA01
gucgguucagcgcggagcg

SEQ ID NO: 3405729 - RNA, 15 nt, Pseudomonas aeruginosa PA01
gucgguucgcggcgc

SEQ ID NO: 3405730 - RNA, 16 nt, Pseudomonas aeruginosa PA01
gucgguucgcggcgca

SEQ ID NO: 3405731 - RNA, 18 nt, Pseudomonas aeruginosa PA01
gucgguucgcggcgcagc

SEQ ID NO: 3405732 - RNA, 14 nt, Pseudomonas aeruginosa PA01
gucguacaccagau

SEQ ID NO: 3405733 - RNA, 16 nt, Pseudomonas aeruginosa PA01
gucguacaccgcgcgg

SEQ ID NO: 3405734 - RNA, 19 nt, Pseudomonas aeruginosa PA01
gucguacucggcggggcgc

SEQ ID NO: 3405735 - RNA, 22 nt, Pseudomonas aeruginosa PA01
gucguagagcgugcggccgauc

SEQ ID NO: 3405736 - RNA, 20 nt, Pseudomonas aeruginosa PA01
gucguagcagguccgcgccu

SEQ ID NO: 3405737 - RNA, 13 nt, Pseudomonas aeruginosa PA01
gucguagccaggc

SEQ ID NO: 3405738 - RNA, 19 nt, Pseudomonas aeruginosa PA01
gucguagccaggcaccacc

SEQ ID NO: 3405739 - RNA, 15 nt, Pseudomonas aeruginosa PA01
gucguagcccauggu

SEQ ID NO: 3405740 - RNA, 22 nt, Pseudomonas aeruginosa PA01
gucguagcgcagcggcaggcca

SEQ ID NO: 3405741 - RNA, 19 nt, Pseudomonas aeruginosa PA01
gucguagcgcgcggcgagc

SEQ ID NO: 3405742 - RNA, 22 nt, Pseudomonas aeruginosa PA01
gucguaggaacgugcggccugc

SEQ ID NO: 3405743 - RNA, 15 nt, Pseudomonas aeruginosa PA01
gucguaggccgagcc

SEQ ID NO: 3405744 - RNA, 16 nt, Pseudomonas aeruginosa PA01
gucguaggcgcgggcg

SEQ ID NO: 3405745 - RNA, 20 nt, Pseudomonas aeruginosa PA01
gucguagggcgucaguucca

SEQ ID NO: 3405746 - RNA, 18 nt, Pseudomonas aeruginosa PA01
gucguaggucugcccgac

SEQ ID NO: 3405747 - RNA, 24 nt, Pseudomonas aeruginosa PA01
gucguaguccugggccgguugcgg

SEQ ID NO: 3405748 - RNA, 14 nt, Pseudomonas aeruginosa PA01
gucguauaggcgcu

SEQ ID NO: 3405749 - RNA, 21 nt, Pseudomonas aeruginosa PA01
gucguauaggcgcuggugcug

SEQ ID NO: 3405750 - RNA, 15 nt, Pseudomonas aeruginosa PA01
gucgucaagcgcgga

SEQ ID NO: 3405751 - RNA, 22 nt, Pseudomonas aeruginosa PA01
gucgucagcaggucucaccgcc

SEQ ID NO: 3405752 - RNA, 14 nt, Pseudomonas aeruginosa PA01
gucguccaccucca

SEQ ID NO: 3405753 - RNA, 12 nt, Pseudomonas aeruginosa PA01
gucguccagcag

SEQ ID NO: 3405754 - RNA, 19 nt, Pseudomonas aeruginosa PA01
gucguccagcagguucggc

SEQ ID NO: 3405755 - RNA, 13 nt, Pseudomonas aeruginosa PA01
gucguccagcgcc

SEQ ID NO: 3405756 - RNA, 20 nt, Pseudomonas aeruginosa PA01
gucguccagcggcucgcuga

SEQ ID NO: 3405757 - RNA, 16 nt, Pseudomonas aeruginosa PA01
gucguccaggcugagu

SEQ ID NO: 3405758 - RNA, 20 nt, Pseudomonas aeruginosa PA01
gucguccaucgacagggucg

SEQ ID NO: 3405759 - RNA, 16 nt, Pseudomonas aeruginosa PA01
gucguccugcgcggcg

SEQ ID NO: 3405760 - RNA, 20 nt, Pseudomonas aeruginosa PA01
gucguccugcgcggcgacga

SEQ ID NO: 3405761 - RNA, 16 nt, Pseudomonas aeruginosa PA01
gucgucgaagcgcagc

SEQ ID NO: 3405762 - RNA, 19 nt, Pseudomonas aeruginosa PA01
gucgucgaagcgcagcagg

SEQ ID NO: 3405763 - RNA, 22 nt, Pseudomonas aeruginosa PA01
gucgucgaaguuuuccacgaag

SEQ ID NO: 3405764 - RNA, 17 nt, Pseudomonas aeruginosa PA01
gucgucgcccuggccga

SEQ ID NO: 3405765 - RNA, 14 nt, Pseudomonas aeruginosa PA01
gucgucgcgcagcu

SEQ ID NO: 3405766 - RNA, 13 nt, Pseudomonas aeruginosa PA01
gucgucgcggcgc

SEQ ID NO: 3405767 - RNA, 20 nt, Pseudomonas aeruginosa PA01
gucgucgcggcgccuggcgu

SEQ ID NO: 3405768 - RNA, 18 nt, Pseudomonas aeruginosa PA01
gucgucgcgguacagccg

SEQ ID NO: 3405769 - RNA, 20 nt, Pseudomonas aeruginosa PA01
gucgucgcgguacagccggu

SEQ ID NO: 3405770 - RNA, 14 nt, Pseudomonas aeruginosa PA01
gucgucgcugagca

SEQ ID NO: 3405771 - RNA, 14 nt, Pseudomonas aeruginosa PA01
gucgucgcuggcgg

SEQ ID NO: 3405772 - RNA, 14 nt, Pseudomonas aeruginosa PA01
gucgucggccuuga

SEQ ID NO: 3405773 - RNA, 14 nt, Pseudomonas aeruginosa PA01
gucgucggcgcggc

SEQ ID NO: 3405774 - RNA, 20 nt, Pseudomonas aeruginosa PA01
gucgucggcgcggccggcgc

SEQ ID NO: 3405775 - RNA, 16 nt, Pseudomonas aeruginosa PA01
gucgucgggcagagug

SEQ ID NO: 3405776 - RNA, 23 nt, Pseudomonas aeruginosa PA01
gucgucgggcagaguggcgcggc

SEQ ID NO: 3405777 - RNA, 21 nt, Pseudomonas aeruginosa PA01
gucgucggggugccgccaguc

SEQ ID NO: 3405778 - RNA, 17 nt, Pseudomonas aeruginosa PA01
gucgucggucggccagg

SEQ ID NO: 3405779 - RNA, 23 nt, Pseudomonas aeruginosa PA01
gucgucguccagcgggcccaugg

SEQ ID NO: 3405780 - RNA, 24 nt, Pseudomonas aeruginosa PA01
gucgucguccagcgggcccauggc

SEQ ID NO: 3405781 - RNA, 14 nt, Pseudomonas aeruginosa PA01
gucgucuucggcca

SEQ ID NO: 3405782 - RNA, 16 nt, Pseudomonas aeruginosa PA01
gucuggcgccuggccu

SEQ ID NO: 3405783 - RNA, 18 nt, Pseudomonas aeruginosa PA01
gucuggcgccuggccugg

SEQ ID NO: 3405784 - RNA, 15 nt, Pseudomonas aeruginosa PA01
gucugggacggcagc

SEQ ID NO: 3405785 - RNA, 19 nt, Pseudomonas aeruginosa PA01
gucugggacggcagccugg

SEQ ID NO: 3405786 - RNA, 19 nt, Pseudomonas aeruginosa PA01
gucugggaguuccgcgcaa

SEQ ID NO: 3405787 - RNA, 23 nt, Pseudomonas aeruginosa PA01
gucuggggaaauucgcgcuggau

SEQ ID NO: 3405788 - RNA, 19 nt, Pseudomonas aeruginosa PA01
gucuggggugaggccgagc

SEQ ID NO: 3405789 - RNA, 17 nt, Pseudomonas aeruginosa PA01
gucugggugaccagcag

SEQ ID NO: 3405790 - RNA, 19 nt, Pseudomonas aeruginosa PA01
gucugggugaccagcaggu

SEQ ID NO: 3405791 - RNA, 23 nt, Pseudomonas aeruginosa PA01
gucugguagauggacgguuccca

SEQ ID NO: 3405792 - RNA, 17 nt, Pseudomonas aeruginosa PA01
gucugguaguaggcgcu

SEQ ID NO: 3405793 - RNA, 22 nt, Pseudomonas aeruginosa PA01
gucugguaguaggcgcucugga

SEQ ID NO: 3405794 - RNA, 17 nt, Pseudomonas aeruginosa PA01
gucugugccgaggccgc

SEQ ID NO: 3405795 - RNA, 18 nt, Pseudomonas aeruginosa PA01
gucugugccgaggccgcc

SEQ ID NO: 3405796 - RNA, 14 nt, Pseudomonas aeruginosa PA01
gucuguucggccag

SEQ ID NO: 3405797 - RNA, 15 nt, Pseudomonas aeruginosa PA01
gucuguucggccagg

SEQ ID NO: 3405798 - RNA, 14 nt, Pseudomonas aeruginosa PA01
gucuguugcggugg

SEQ ID NO: 3405799 - RNA, 22 nt, Pseudomonas aeruginosa PA01
gucuucagcacauagcugccga

SEQ ID NO: 3405800 - RNA, 12 nt, Pseudomonas aeruginosa PA01
gucuucagcuug

SEQ ID NO: 3405801 - RNA, 23 nt, Pseudomonas aeruginosa PA01
gucuucaggccgaguccgcgcgc

SEQ ID NO: 3405802 - RNA, 14 nt, Pseudomonas aeruginosa PA01
gucuucaggcgcuc

SEQ ID NO: 3405803 - RNA, 16 nt, Pseudomonas aeruginosa PA01
gucuucaggcgcuccu

SEQ ID NO: 3405804 - RNA, 19 nt, Pseudomonas aeruginosa PA01
gucuucaggcgcuccugga

SEQ ID NO: 3405805 - RNA, 16 nt, Pseudomonas aeruginosa PA01
gucuucaggcgugggc

SEQ ID NO: 3405806 - RNA, 20 nt, Pseudomonas aeruginosa PA01
gucuucaggcgugggccagc

SEQ ID NO: 3405807 - RNA, 21 nt, Pseudomonas aeruginosa PA01
gucuucaggcgugggccagcc

SEQ ID NO: 3405808 - RNA, 22 nt, Pseudomonas aeruginosa PA01
gucuucaggcgugggccagccc

SEQ ID NO: 3405809 - RNA, 20 nt, Pseudomonas aeruginosa PA01
gucuucaguaggccagcggc

SEQ ID NO: 3405810 - RNA, 15 nt, Pseudomonas aeruginosa PA01
gucuuccagggcggc

SEQ ID NO: 3405811 - RNA, 20 nt, Pseudomonas aeruginosa PA01
gucuuccagggcggcgcgga

SEQ ID NO: 3405812 - RNA, 17 nt, Pseudomonas aeruginosa PA01
gucuucccguaaggcca

SEQ ID NO: 3405813 - RNA, 19 nt, Pseudomonas aeruginosa PA01
gucuucccguaaggccagg

SEQ ID NO: 3405814 - RNA, 20 nt, Pseudomonas aeruginosa PA01
gucuucccguaaggccaggc

SEQ ID NO: 3405815 - RNA, 20 nt, Pseudomonas aeruginosa PA01
gucuuccucggugucggcca

SEQ ID NO: 3405816 - RNA, 20 nt, Pseudomonas aeruginosa PA01
gucuuccugcacgcugcgcc

SEQ ID NO: 3405817 - RNA, 22 nt, Pseudomonas aeruginosa PA01
gucuuccuugcugaagcccagg

SEQ ID NO: 3405818 - RNA, 20 nt, Pseudomonas aeruginosa PA01
gucuucgaaggucugcccgu

SEQ ID NO: 3405819 - RNA, 15 nt, Pseudomonas aeruginosa PA01
gucuucgauggcggc

SEQ ID NO: 3405820 - RNA, 17 nt, Pseudomonas aeruginosa PA01
gucuucgauggcggccg

SEQ ID NO: 3405821 - RNA, 18 nt, Pseudomonas aeruginosa PA01
gucuucgauggcggccgc

SEQ ID NO: 3405822 - RNA, 16 nt, Pseudomonas aeruginosa PA01
gucuucgccggccugc

SEQ ID NO: 3405823 - RNA, 17 nt, Pseudomonas aeruginosa PA01
gucuucgccggccugcg

SEQ ID NO: 3405824 - RNA, 14 nt, Pseudomonas aeruginosa PA01
gucuucgcuggcga

SEQ ID NO: 3405825 - RNA, 16 nt, Pseudomonas aeruginosa PA01
gucuucggcggcgccg

SEQ ID NO: 3405826 - RNA, 20 nt, Pseudomonas aeruginosa PA01
gucuucggcggcgccgguga

SEQ ID NO: 3405827 - RNA, 20 nt, Pseudomonas aeruginosa PA01
gucuucucaaagggcagcgg

SEQ ID NO: 3405828 - RNA, 23 nt, Pseudomonas aeruginosa PA01
gucuucucaaagggcagcggcga

SEQ ID NO: 3405829 - RNA, 15 nt, Pseudomonas aeruginosa PA01
gucuugaggaagucg

SEQ ID NO: 3405830 - RNA, 13 nt, Pseudomonas aeruginosa PA01
gucuugccgcugc

SEQ ID NO: 3405831 - RNA, 17 nt, Pseudomonas aeruginosa PA01
gucuugccggcugcgcc

SEQ ID NO: 3405832 - RNA, 19 nt, Pseudomonas aeruginosa PA01
gucuugcgcaggcggucgg

SEQ ID NO: 3405833 - RNA, 15 nt, Pseudomonas aeruginosa PA01
gucuuggccagccgc

SEQ ID NO: 3405834 - RNA, 17 nt, Pseudomonas aeruginosa PA01
gucuuggccagccgcgc

SEQ ID NO: 3405835 - RNA, 15 nt, Pseudomonas aeruginosa PA01
gucuugucgaagccc

SEQ ID NO: 3405836 - RNA, 16 nt, Pseudomonas aeruginosa PA01
gucuugucgaagcccg

SEQ ID NO: 3405837 - RNA, 13 nt, Pseudomonas aeruginosa PA01
gucuugucgcggg

SEQ ID NO: 3405838 - RNA, 18 nt, Pseudomonas aeruginosa PA01
gucuuucagcuucagggu

SEQ ID NO: 3405839 - RNA, 20 nt, Pseudomonas aeruginosa PA01
gucuuucagcuucagggugg

SEQ ID NO: 3405840 - RNA, 18 nt, Pseudomonas aeruginosa PA01
gucuuucaggugggccac

SEQ ID NO: 3405841 - RNA, 12 nt, Pseudomonas aeruginosa PA01
gucuuuccuuuc

SEQ ID NO: 3405842 - RNA, 24 nt, Pseudomonas aeruginosa PA01
gucuuuggucuaauggcaccugga

SEQ ID NO: 3405843 - RNA, 15 nt, Pseudomonas aeruginosa PA01
gucuuuuugcaggga

SEQ ID NO: 3405844 - RNA, 14 nt, Pseudomonas aeruginosa PA01
gugaaaagcggcgu

SEQ ID NO: 3405845 - RNA, 22 nt, Pseudomonas aeruginosa PA01
gugaaaccgauauaggcgacga

SEQ ID NO: 3405846 - RNA, 15 nt, Pseudomonas aeruginosa PA01
gugaaaccggcaagc

SEQ ID NO: 3405847 - RNA, 15 nt, Pseudomonas aeruginosa PA01
gugaaacggaucacg

SEQ ID NO: 3405848 - RNA, 13 nt, Pseudomonas aeruginosa PA01
gugaaagggaaau

SEQ ID NO: 3405849 - RNA, 14 nt, Pseudomonas aeruginosa PA01
gugaaagggcggca

SEQ ID NO: 3405850 - RNA, 14 nt, Pseudomonas aeruginosa PA01
gugaaccaggcgcc

SEQ ID NO: 3405851 - RNA, 16 nt, Pseudomonas aeruginosa PA01
gugaaccaggcgccga

SEQ ID NO: 3405852 - RNA, 14 nt, Pseudomonas aeruginosa PA01
gugaacgagcccag

SEQ ID NO: 3405853 - RNA, 16 nt, Pseudomonas aeruginosa PA01
gugaacgagcccaggc

SEQ ID NO: 3405854 - RNA, 22 nt, Pseudomonas aeruginosa PA01
gugaacgagcccaggcagaucg

SEQ ID NO: 3405855 - RNA, 14 nt, Pseudomonas aeruginosa PA01
gugaacgccaggca

SEQ ID NO: 3405856 - RNA, 13 nt, Pseudomonas aeruginosa PA01
gugaacucaugca

SEQ ID NO: 3405857 - RNA, 15 nt, Pseudomonas aeruginosa PA01
gugaacucaugcagg

SEQ ID NO: 3405858 - RNA, 19 nt, Pseudomonas aeruginosa PA01
gugaacucaugcaggccga

SEQ ID NO: 3405859 - RNA, 15 nt, Pseudomonas aeruginosa PA01
gugaacuggccgucg

SEQ ID NO: 3405860 - RNA, 22 nt, Pseudomonas aeruginosa PA01
gugaagagcucccugccgcccu

SEQ ID NO: 3405861 - RNA, 14 nt, Pseudomonas aeruginosa PA01
gugaagcacgguga

SEQ ID NO: 3405862 - RNA, 23 nt, Pseudomonas aeruginosa PA01
gugaagcccaccaccaccgacgc

SEQ ID NO: 3405863 - RNA, 14 nt, Pseudomonas aeruginosa PA01
gugaagcccaggcg

SEQ ID NO: 3405864 - RNA, 16 nt, Pseudomonas aeruginosa PA01
gugaagcccaggcgcu

SEQ ID NO: 3405865 - RNA, 16 nt, Pseudomonas aeruginosa PA01
gugaagccccuggcgc

SEQ ID NO: 3405866 - RNA, 20 nt, Pseudomonas aeruginosa PA01
gugaagccccuggcgcuggg

SEQ ID NO: 3405867 - RNA, 23 nt, Pseudomonas aeruginosa PA01
gugaagccccuggcgcugggccu

SEQ ID NO: 3405868 - RNA, 16 nt, Pseudomonas aeruginosa PA01
gugaagccgccgccca

SEQ ID NO: 3405869 - RNA, 17 nt, Pseudomonas aeruginosa PA01
gugaagccgccgcccag

SEQ ID NO: 3405870 - RNA, 22 nt, Pseudomonas aeruginosa PA01
gugaagccgccgcccagcagca

SEQ ID NO: 3405871 - RNA, 16 nt, Pseudomonas aeruginosa PA01
gugaagcugccgucga

SEQ ID NO: 3405872 - RNA, 14 nt, Pseudomonas aeruginosa PA01
gugaagcugcggcu

SEQ ID NO: 3405873 - RNA, 17 nt, Pseudomonas aeruginosa PA01
gugaagcuggagcagca

SEQ ID NO: 3405874 - RNA, 16 nt, Pseudomonas aeruginosa PA01
gugaaguagccgccgg

SEQ ID NO: 3405875 - RNA, 14 nt, Pseudomonas aeruginosa PA01
gugaagugaucgau

SEQ ID NO: 3405876 - RNA, 19 nt, Pseudomonas aeruginosa PA01
gugaauucgagaguuuuau

SEQ ID NO: 3405877 - RNA, 16 nt, Pseudomonas aeruginosa PA01
gugacacccugccgcg

SEQ ID NO: 3405878 - RNA, 20 nt, Pseudomonas aeruginosa PA01
gugacacccugccgcgccgg

SEQ ID NO: 3405879 - RNA, 21 nt, Pseudomonas aeruginosa PA01
gugacaggcugaaaaaagggg

SEQ ID NO: 3405880 - RNA, 14 nt, Pseudomonas aeruginosa PA01
gugacauggaugac

SEQ ID NO: 3405881 - RNA, 18 nt, Pseudomonas aeruginosa PA01
gugacauggaugaccacg

SEQ ID NO: 3405882 - RNA, 17 nt, Pseudomonas aeruginosa PA01
gugacauucgacagcag

SEQ ID NO: 3405883 - RNA, 14 nt, Pseudomonas aeruginosa PA01
gugaccaccaggcg

SEQ ID NO: 3405884 - RNA, 17 nt, Pseudomonas aeruginosa PA01
gugaccaccaggcgguc

SEQ ID NO: 3405885 - RNA, 15 nt, Pseudomonas aeruginosa PA01
gugcacggccaggcc

SEQ ID NO: 3405886 - RNA, 17 nt, Pseudomonas aeruginosa PA01
gugcacguuccagcucg

SEQ ID NO: 3405887 - RNA, 18 nt, Pseudomonas aeruginosa PA01
gugcacguuccagcucgg

SEQ ID NO: 3405888 - RNA, 21 nt, Pseudomonas aeruginosa PA01
gugcacguuccagcucggugc

SEQ ID NO: 3405889 - RNA, 16 nt, Pseudomonas aeruginosa PA01
gugcagaagacgccca

SEQ ID NO: 3405890 - RNA, 21 nt, Pseudomonas aeruginosa PA01
gugcagaagacgcccagcagg

SEQ ID NO: 3405891 - RNA, 15 nt, Pseudomonas aeruginosa PA01
gugcagagaggcugg

SEQ ID NO: 3405892 - RNA, 16 nt, Pseudomonas aeruginosa PA01
gugcagaugaccagcg

SEQ ID NO: 3405893 - RNA, 13 nt, Pseudomonas aeruginosa PA01
gugcagcagcacg

SEQ ID NO: 3405894 - RNA, 14 nt, Pseudomonas aeruginosa PA01
gugcagcagcgccu

SEQ ID NO: 3405895 - RNA, 22 nt, Pseudomonas aeruginosa PA01
gugcagcaggguaccgcuggcg

SEQ ID NO: 3405896 - RNA, 23 nt, Pseudomonas aeruginosa PA01
gugcagcaggguaccgcuggcgc

SEQ ID NO: 3405897 - RNA, 14 nt, Pseudomonas aeruginosa PA01
gugcagccacccag

SEQ ID NO: 3405898 - RNA, 19 nt, Pseudomonas aeruginosa PA01
gugcagccacccagcagca

SEQ ID NO: 3405899 - RNA, 12 nt, Pseudomonas aeruginosa PA01
gugcagccagac

SEQ ID NO: 3405900 - RNA, 22 nt, Pseudomonas aeruginosa PA01
gugcagcccggucacgccggga

SEQ ID NO: 3405901 - RNA, 16 nt, Pseudomonas aeruginosa PA01
gugcagcgagucgccg

SEQ ID NO: 3405902 - RNA, 17 nt, Pseudomonas aeruginosa PA01
gugcagcgagucgccgu

SEQ ID NO: 3405903 - RNA, 18 nt, Pseudomonas aeruginosa PA01
gugcagcggaagcccugc

SEQ ID NO: 3405904 - RNA, 24 nt, Pseudomonas aeruginosa PA01
gugcagcggcagcgucucggcugc

SEQ ID NO: 3405905 - RNA, 14 nt, Pseudomonas aeruginosa PA01
gugcagcuccaccg

SEQ ID NO: 3405906 - RNA, 19 nt, Pseudomonas aeruginosa PA01
gugcagcuccaccgauggc

SEQ ID NO: 3405907 - RNA, 21 nt, Pseudomonas aeruginosa PA01
gugcagcuccaccgauggcgc

SEQ ID NO: 3405908 - RNA, 14 nt, Pseudomonas aeruginosa PA01
gugcagcucggcac

SEQ ID NO: 3405909 - RNA, 20 nt, Pseudomonas aeruginosa PA01
gugcagcucggcacgcagca

SEQ ID NO: 3405910 - RNA, 22 nt, Pseudomonas aeruginosa PA01
gugcagcucggcacgcagcagc

SEQ ID NO: 3405911 - RNA, 23 nt, Pseudomonas aeruginosa PA01
gugcagcucggcacgcagcagcu

SEQ ID NO: 3405912 - RNA, 24 nt, Pseudomonas aeruginosa PA01
gugcagcuugguauccaccucgcc

SEQ ID NO: 3405913 - RNA, 13 nt, Pseudomonas aeruginosa PA01
gugcaggaacagc

SEQ ID NO: 3405914 - RNA, 16 nt, Pseudomonas aeruginosa PA01
gugcaggaagcgccgg

SEQ ID NO: 3405915 - RNA, 16 nt, Pseudomonas aeruginosa PA01
gugcaggaaguggcgg

SEQ ID NO: 3405916 - RNA, 15 nt, Pseudomonas aeruginosa PA01
gugcaggaucaccug

SEQ ID NO: 3405917 - RNA, 13 nt, Pseudomonas aeruginosa PA01
gugcaggccgacg

SEQ ID NO: 3405918 - RNA, 19 nt, Pseudomonas aeruginosa PA01
gugcaggccgagcugcucg

SEQ ID NO: 3405919 - RNA, 13 nt, Pseudomonas aeruginosa PA01
gugcaggccgccg

SEQ ID NO: 3405920 - RNA, 19 nt, Pseudomonas aeruginosa PA01
gugcaggccgcgcgauggc

SEQ ID NO: 3405921 - RNA, 13 nt, Pseudomonas aeruginosa PA01
gugcaggcgcccu

SEQ ID NO: 3405922 - RNA, 20 nt, Pseudomonas aeruginosa PA01
gugcaggcgcccuggccguc

SEQ ID NO: 3405923 - RNA, 16 nt, Pseudomonas aeruginosa PA01
gugcagggcagcggcc

SEQ ID NO: 3405924 - RNA, 17 nt, Pseudomonas aeruginosa PA01
gugcagggcagcggccc

SEQ ID NO: 3405925 - RNA, 19 nt, Pseudomonas aeruginosa PA01
gugcagggcguccaguagc

SEQ ID NO: 3405926 - RNA, 23 nt, Pseudomonas aeruginosa PA01
gugcaggguauuuuccagcaggc

SEQ ID NO: 3405927 - RNA, 16 nt, Pseudomonas aeruginosa PA01
gugcagggucacgcug

SEQ ID NO: 3405928 - RNA, 17 nt, Pseudomonas aeruginosa PA01
gugcagggucacgcugg

SEQ ID NO: 3405929 - RNA, 13 nt, Pseudomonas aeruginosa PA01
gugcagggucagg

SEQ ID NO: 3405930 - RNA, 17 nt, Pseudomonas aeruginosa PA01
gugcagggucaggucgu

SEQ ID NO: 3405931 - RNA, 18 nt, Pseudomonas aeruginosa PA01
gugcagguacggcgccgc

SEQ ID NO: 3405932 - RNA, 20 nt, Pseudomonas aeruginosa PA01
gugcagguacggcgccgcug

SEQ ID NO: 3405933 - RNA, 17 nt, Pseudomonas aeruginosa PA01
gugcagguagcagccgu

SEQ ID NO: 3405934 - RNA, 20 nt, Pseudomonas aeruginosa PA01
gugcagguagccgcgccggc

SEQ ID NO: 3405935 - RNA, 18 nt, Pseudomonas aeruginosa PA01
gugcaggucgcgcggcgc

SEQ ID NO: 3405936 - RNA, 14 nt, Pseudomonas aeruginosa PA01
gugcagguguucgg

SEQ ID NO: 3405937 - RNA, 18 nt, Pseudomonas aeruginosa PA01
gugcagguucaccgccuc

SEQ ID NO: 3405938 - RNA, 18 nt, Pseudomonas aeruginosa PA01
gugcaguacuuggccagc

SEQ ID NO: 3405939 - RNA, 17 nt, Pseudomonas aeruginosa PA01
gugcaucaccggcagca

SEQ ID NO: 3405940 - RNA, 20 nt, Pseudomonas aeruginosa PA01
gugcaucaccggcagcagcg

SEQ ID NO: 3405941 - RNA, 16 nt, Pseudomonas aeruginosa PA01
gugcaucagccuggcc

SEQ ID NO: 3405942 - RNA, 16 nt, Pseudomonas aeruginosa PA01
gugcauccgccgcaga

SEQ ID NO: 3405943 - RNA, 17 nt, Pseudomonas aeruginosa PA01
gugcauccgccgcagac

SEQ ID NO: 3405944 - RNA, 22 nt, Pseudomonas aeruginosa PA01
gugcauccgccgcagaccagcg

SEQ ID NO: 3405945 - RNA, 17 nt, Pseudomonas aeruginosa PA01
gugcaucggccgccagg

SEQ ID NO: 3405946 - RNA, 19 nt, Pseudomonas aeruginosa PA01
gugcaucggccgccaggcu

SEQ ID NO: 3405947 - RNA, 15 nt, Pseudomonas aeruginosa PA01
gugcaugaaggcgcu

SEQ ID NO: 3405948 - RNA, 16 nt, Pseudomonas aeruginosa PA01
gugcauguagcgcucc

SEQ ID NO: 3405949 - RNA, 22 nt, Pseudomonas aeruginosa PA01
gugcauguagcgcuccucgcgc

SEQ ID NO: 3405950 - RNA, 16 nt, Pseudomonas aeruginosa PA01
gugccaauccgggcgu

SEQ ID NO: 3405951 - RNA, 13 nt, Pseudomonas aeruginosa PA01
gugccacaggccc

SEQ ID NO: 3405952 - RNA, 19 nt, Pseudomonas aeruginosa PA01
gugccacaggcccuggauc

SEQ ID NO: 3405953 - RNA, 13 nt, Pseudomonas aeruginosa PA01
gugccacaggugg

SEQ ID NO: 3405954 - RNA, 15 nt, Pseudomonas aeruginosa PA01
gugccaggaccagcc

SEQ ID NO: 3405955 - RNA, 15 nt, Pseudomonas aeruginosa PA01
gugccaggccugggu

SEQ ID NO: 3405956 - RNA, 22 nt, Pseudomonas aeruginosa PA01
gugccaggccugggucaccagc

SEQ ID NO: 3405957 - RNA, 19 nt, Pseudomonas aeruginosa PA01
gugccaggcgcucgcgcug

SEQ ID NO: 3405958 - RNA, 20 nt, Pseudomonas aeruginosa PA01
gugccaggcgcucgcgcugc

SEQ ID NO: 3405959 - RNA, 15 nt, Pseudomonas aeruginosa PA01
gugccaggcggcagc

SEQ ID NO: 3405960 - RNA, 18 nt, Pseudomonas aeruginosa PA01
gugccaggcggcagccgc

SEQ ID NO: 3405961 - RNA, 19 nt, Pseudomonas aeruginosa PA01
gugccaggcucgccgccag

SEQ ID NO: 3405962 - RNA, 21 nt, Pseudomonas aeruginosa PA01
gugccaggcucgccgccagca

SEQ ID NO: 3405963 - RNA, 16 nt, Pseudomonas aeruginosa PA01
gugccagggcggucgg

SEQ ID NO: 3405964 - RNA, 17 nt, Pseudomonas aeruginosa PA01
gugccagggcggucggc

SEQ ID NO: 3405965 - RNA, 19 nt, Pseudomonas aeruginosa PA01
gugccagggcuucccaggc

SEQ ID NO: 3405966 - RNA, 23 nt, Pseudomonas aeruginosa PA01
gugccagggcuucccaggccagc

SEQ ID NO: 3405967 - RNA, 16 nt, Pseudomonas aeruginosa PA01
gugccauacagcgccc

SEQ ID NO: 3405968 - RNA, 18 nt, Pseudomonas aeruginosa PA01
gugccauacagcgcccau

SEQ ID NO: 3405969 - RNA, 22 nt, Pseudomonas aeruginosa PA01
gugccauacucggacggcucgc

SEQ ID NO: 3405970 - RNA, 17 nt, Pseudomonas aeruginosa PA01
gugccaucaggccgcgg

SEQ ID NO: 3405971 - RNA, 18 nt, Pseudomonas aeruginosa PA01
gugccaucaggccgcggc

SEQ ID NO: 3405972 - RNA, 19 nt, Pseudomonas aeruginosa PA01
gugccauggaucaccaggg

SEQ ID NO: 3405973 - RNA, 18 nt, Pseudomonas aeruginosa PA01
gugccauugcuugagcag

SEQ ID NO: 3405974 - RNA, 19 nt, Pseudomonas aeruginosa PA01
gugccauugcuugagcagu

SEQ ID NO: 3405975 - RNA, 18 nt, Pseudomonas aeruginosa PA01
gugcccagcaggcugcug

SEQ ID NO: 3405976 - RNA, 13 nt, Pseudomonas aeruginosa PA01
gugcccagcggcg

SEQ ID NO: 3405977 - RNA, 17 nt, Pseudomonas aeruginosa PA01
gugcccagcggcgccuc

SEQ ID NO: 3405978 - RNA, 13 nt, Pseudomonas aeruginosa PA01
gugcccaggcgcu

SEQ ID NO: 3405979 - RNA, 18 nt, Pseudomonas aeruginosa PA01
gugcccaggcgcuggcgc

SEQ ID NO: 3405980 - RNA, 13 nt, Pseudomonas aeruginosa PA01
gugcccagggcgg

SEQ ID NO: 3405981 - RNA, 20 nt, Pseudomonas aeruginosa PA01
gugcccaucaggcucaggcg

SEQ ID NO: 3405982 - RNA, 16 nt, Pseudomonas aeruginosa PA01
gugccccaggcacggc

SEQ ID NO: 3405983 - RNA, 20 nt, Pseudomonas aeruginosa PA01
gugccccaggccgaacucac

SEQ ID NO: 3405984 - RNA, 13 nt, Pseudomonas aeruginosa PA01
gugccccaggcga

SEQ ID NO: 3405985 - RNA, 19 nt, Pseudomonas aeruginosa PA01
gugcccccggcaacacccu

SEQ ID NO: 3405986 - RNA, 22 nt, Pseudomonas aeruginosa PA01
gugccccgacugucgugccucc

SEQ ID NO: 3405987 - RNA, 13 nt, Pseudomonas aeruginosa PA01
gugcgccgcagcg

SEQ ID NO: 3405988 - RNA, 15 nt, Pseudomonas aeruginosa PA01
gugcgccgcagcgca

SEQ ID NO: 3405989 - RNA, 21 nt, Pseudomonas aeruginosa PA01
gugcgccgcagcgcaagucgg

SEQ ID NO: 3405990 - RNA, 14 nt, Pseudomonas aeruginosa PA01
gugcgccgcggguc

SEQ ID NO: 3405991 - RNA, 15 nt, Pseudomonas aeruginosa PA01
gugcgccgcggguca

SEQ ID NO: 3405992 - RNA, 20 nt, Pseudomonas aeruginosa PA01
gugcgccgcgggucaccagc

SEQ ID NO: 3405993 - RNA, 22 nt, Pseudomonas aeruginosa PA01
gugcgccgcgggucaccagcgc

SEQ ID NO: 3405994 - RNA, 23 nt, Pseudomonas aeruginosa PA01
gugcgccgcgggucaccagcgcc

SEQ ID NO: 3405995 - RNA, 12 nt, Pseudomonas aeruginosa PA01
gugcgccgcucg

SEQ ID NO: 3405996 - RNA, 22 nt, Pseudomonas aeruginosa PA01
gugcgccgcucgcgcacggcga

SEQ ID NO: 3405997 - RNA, 13 nt, Pseudomonas aeruginosa PA01
gugcgccggcggg

SEQ ID NO: 3405998 - RNA, 14 nt, Pseudomonas aeruginosa PA01
gugcgccggcggga

SEQ ID NO: 3405999 - RNA, 18 nt, Pseudomonas aeruginosa PA01
gugcgccggcgggaucga

SEQ ID NO: 3406000 - RNA, 21 nt, Pseudomonas aeruginosa PA01
gugcgccggggaucaggucgc

SEQ ID NO: 3406001 - RNA, 13 nt, Pseudomonas aeruginosa PA01
gugcgccguagca

SEQ ID NO: 3406002 - RNA, 19 nt, Pseudomonas aeruginosa PA01
gugcgcgaaugguucaucu

SEQ ID NO: 3406003 - RNA, 21 nt, Pseudomonas aeruginosa PA01
gugcgcgcaacuggucgcggc

SEQ ID NO: 3406004 - RNA, 13 nt, Pseudomonas aeruginosa PA01
gugcgcgcggccu

SEQ ID NO: 3406005 - RNA, 12 nt, Pseudomonas aeruginosa PA01
gugcgcggcagg

SEQ ID NO: 3406006 - RNA, 16 nt, Pseudomonas aeruginosa PA01
gugcgcgguccgcgug

SEQ ID NO: 3406007 - RNA, 17 nt, Pseudomonas aeruginosa PA01
gugcgcgguccgcgugg

SEQ ID NO: 3406008 - RNA, 15 nt, Pseudomonas aeruginosa PA01
gugcgcuccgccagg

SEQ ID NO: 3406009 - RNA, 17 nt, Pseudomonas aeruginosa PA01
gugcgcuccgccaggcc

SEQ ID NO: 3406010 - RNA, 19 nt, Pseudomonas aeruginosa PA01
gugcgcuccgccaggccgc

SEQ ID NO: 3406011 - RNA, 22 nt, Pseudomonas aeruginosa PA01
gugcgcuccgccaggccgcgca

SEQ ID NO: 3406012 - RNA, 22 nt, Pseudomonas aeruginosa PA01
gugcgcucguugauccgcgugg

SEQ ID NO: 3406013 - RNA, 23 nt, Pseudomonas aeruginosa PA01
gugcgcugcguucuuccccugca

SEQ ID NO: 3406014 - RNA, 18 nt, Pseudomonas aeruginosa PA01
gugcgcuggaacggccag

SEQ ID NO: 3406015 - RNA, 19 nt, Pseudomonas aeruginosa PA01
gugcgcuggaacggccagg

SEQ ID NO: 3406016 - RNA, 20 nt, Pseudomonas aeruginosa PA01
gugcgcugguaccugccggc

SEQ ID NO: 3406017 - RNA, 20 nt, Pseudomonas aeruginosa PA01
gugcggaaaccgcggccggc

SEQ ID NO: 3406018 - RNA, 19 nt, Pseudomonas aeruginosa PA01
gugcggagggucaggccga

SEQ ID NO: 3406019 - RNA, 13 nt, Pseudomonas aeruginosa PA01
gugcggcaccagc

SEQ ID NO: 3406020 - RNA, 19 nt, Pseudomonas aeruginosa PA01
gugcggcaccagccaggug

SEQ ID NO: 3406021 - RNA, 18 nt, Pseudomonas aeruginosa PA01
gugcggcacgcugcuugc

SEQ ID NO: 3406022 - RNA, 14 nt, Pseudomonas aeruginosa PA01
gugcggcagcaggc

SEQ ID NO: 3406023 - RNA, 13 nt, Pseudomonas aeruginosa PA01
gugcggcauuccg

SEQ ID NO: 3406024 - RNA, 17 nt, Pseudomonas aeruginosa PA01
gugcggcauuccgggcg

SEQ ID NO: 3406025 - RNA, 12 nt, Pseudomonas aeruginosa PA01
gugcggccaggc

SEQ ID NO: 3406026 - RNA, 12 nt, Pseudomonas aeruginosa PA01
gugcggccgagg

SEQ ID NO: 3406027 - RNA, 13 nt, Pseudomonas aeruginosa PA01
gugcggccgagga

SEQ ID NO: 3406028 - RNA, 22 nt, Pseudomonas aeruginosa PA01
gugcggccgaucaucggcuggu

SEQ ID NO: 3406029 - RNA, 13 nt, Pseudomonas aeruginosa PA01
gugcggccgauga

SEQ ID NO: 3406030 - RNA, 21 nt, Pseudomonas aeruginosa PA01
gugcggccuacuugaucagcc

SEQ ID NO: 3406031 - RNA, 20 nt, Pseudomonas aeruginosa PA01
gugcggcgaugucggccugc

SEQ ID NO: 3406032 - RNA, 13 nt, Pseudomonas aeruginosa PA01
gugcggcgggcgc

SEQ ID NO: 3406033 - RNA, 16 nt, Pseudomonas aeruginosa PA01
gugcggcgggcgcccg

SEQ ID NO: 3406034 - RNA, 14 nt, Pseudomonas aeruginosa PA01
gugcggcguggcga

SEQ ID NO: 3406035 - RNA, 17 nt, Pseudomonas aeruginosa PA01
gugcggcguucgccgcg

SEQ ID NO: 3406036 - RNA, 14 nt, Pseudomonas aeruginosa PA01
gugcggcuggcgcg

SEQ ID NO: 3406037 - RNA, 23 nt, Pseudomonas aeruginosa PA01
gugcggcugggugucgaccuccg

SEQ ID NO: 3406038 - RNA, 22 nt, Pseudomonas aeruginosa PA01
gugcgggcagacaccaccaggu

SEQ ID NO: 3406039 - RNA, 18 nt, Pseudomonas aeruginosa PA01
gugcgggcaguccuggcg

SEQ ID NO: 3406040 - RNA, 13 nt, Pseudomonas aeruginosa PA01
gugcgggcgcggg

SEQ ID NO: 3406041 - RNA, 20 nt, Pseudomonas aeruginosa PA01
gugcggggaaagcuccucgg

SEQ ID NO: 3406042 - RNA, 23 nt, Pseudomonas aeruginosa PA01
gugcggggaaagcuccucggccu

SEQ ID NO: 3406043 - RNA, 14 nt, Pseudomonas aeruginosa PA01
gugcggggcgcucg

SEQ ID NO: 3406044 - RNA, 18 nt, Pseudomonas aeruginosa PA01
gugcggggcgcucgcccu

SEQ ID NO: 3406045 - RNA, 12 nt, Pseudomonas aeruginosa PA01
gugcggggugcg

SEQ ID NO: 3406046 - RNA, 18 nt, Pseudomonas aeruginosa PA01
gugcggguaucgaucucg

SEQ ID NO: 3406047 - RNA, 13 nt, Pseudomonas aeruginosa PA01
gugcgggugccga

SEQ ID NO: 3406048 - RNA, 20 nt, Pseudomonas aeruginosa PA01
gugcgguauagcucauggcc

SEQ ID NO: 3406049 - RNA, 15 nt, Pseudomonas aeruginosa PA01
gugcggugccgcgca

SEQ ID NO: 3406050 - RNA, 16 nt, Pseudomonas aeruginosa PA01
gugcggugccgcgcag

SEQ ID NO: 3406051 - RNA, 14 nt, Pseudomonas aeruginosa PA01
gugcgguggcuggc

SEQ ID NO: 3406052 - RNA, 19 nt, Pseudomonas aeruginosa PA01
gugcggugggcgagggcgc

SEQ ID NO: 3406053 - RNA, 18 nt, Pseudomonas aeruginosa PA01
gugcgguuguucgcccaa

SEQ ID NO: 3406054 - RNA, 18 nt, Pseudomonas aeruginosa PA01
gugcguacuuggcccggc

SEQ ID NO: 3406055 - RNA, 13 nt, Pseudomonas aeruginosa PA01
gugcguccaucca

SEQ ID NO: 3406056 - RNA, 16 nt, Pseudomonas aeruginosa PA01
gugcguccauccaggc

SEQ ID NO: 3406057 - RNA, 12 nt, Pseudomonas aeruginosa PA01
gugcgucgaggg

SEQ ID NO: 3406058 - RNA, 21 nt, Pseudomonas aeruginosa PA01
gugcguggugcauccgccgca

SEQ ID NO: 3406059 - RNA, 22 nt, Pseudomonas aeruginosa PA01
gugcguggugcauccgccgcag

SEQ ID NO: 3406060 - RNA, 16 nt, Pseudomonas aeruginosa PA01
gugcguguucggcggc

SEQ ID NO: 3406061 - RNA, 16 nt, Pseudomonas aeruginosa PA01
gugcguucgcgggcgc

SEQ ID NO: 3406062 - RNA, 14 nt, Pseudomonas aeruginosa PA01
gugcguugcgcggc

SEQ ID NO: 3406063 - RNA, 21 nt, Pseudomonas aeruginosa PA01
gugcucaggacguccuggccg

SEQ ID NO: 3406064 - RNA, 22 nt, Pseudomonas aeruginosa PA01
gugcucaggacguccuggccga

SEQ ID NO: 3406065 - RNA, 21 nt, Pseudomonas aeruginosa PA01
gugcuccgugucggcggcgcc

SEQ ID NO: 3406066 - RNA, 22 nt, Pseudomonas aeruginosa PA01
gugcuccucgucguacuggcgg

SEQ ID NO: 3406067 - RNA, 22 nt, Pseudomonas aeruginosa PA01
gugcuccuugacccucugguug

SEQ ID NO: 3406068 - RNA, 16 nt, Pseudomonas aeruginosa PA01
gugcucgaacgggcac

SEQ ID NO: 3406069 - RNA, 15 nt, Pseudomonas aeruginosa PA01
gugcucgacgggcgc

SEQ ID NO: 3406070 - RNA, 22 nt, Pseudomonas aeruginosa PA01
gugcucgaucagguaggcgccg

SEQ ID NO: 3406071 - RNA, 21 nt, Pseudomonas aeruginosa PA01
gugcucgcgcaugaucgccuc

SEQ ID NO: 3406072 - RNA, 19 nt, Pseudomonas aeruginosa PA01
gugcucgcggaccagcucc

SEQ ID NO: 3406073 - RNA, 12 nt, Pseudomonas aeruginosa PA01
gugcucggccag

SEQ ID NO: 3406074 - RNA, 13 nt, Pseudomonas aeruginosa PA01
gugcucggccagu

SEQ ID NO: 3406075 - RNA, 22 nt, Pseudomonas aeruginosa PA01
gugcucggccugaucaucuggg

SEQ ID NO: 3406076 - RNA, 20 nt, Pseudomonas aeruginosa PA01
gugcucggcgaucucgccca

SEQ ID NO: 3406077 - RNA, 22 nt, Pseudomonas aeruginosa PA01
gugcucuuuucccgcaccggcg

SEQ ID NO: 3406078 - RNA, 13 nt, Pseudomonas aeruginosa PA01
gugcugaacauca

SEQ ID NO: 3406079 - RNA, 16 nt, Pseudomonas aeruginosa PA01
gugcugaacaucaggu

SEQ ID NO: 3406080 - RNA, 19 nt, Pseudomonas aeruginosa PA01
gugcugaagauaucgccuu

SEQ ID NO: 3406081 - RNA, 20 nt, Pseudomonas aeruginosa PA01
gugcugaccuucacuucgcg

SEQ ID NO: 3406082 - RNA, 14 nt, Pseudomonas aeruginosa PA01
gugcugcaccagca

SEQ ID NO: 3406083 - RNA, 15 nt, Pseudomonas aeruginosa PA01
gugcugcaccagcag

SEQ ID NO: 3406084 - RNA, 20 nt, Pseudomonas aeruginosa PA01
gugcugcaccagcaggucga

SEQ ID NO: 3406085 - RNA, 21 nt, Pseudomonas aeruginosa PA01
gugcugcaccagcaggucgag

SEQ ID NO: 3406086 - RNA, 14 nt, Pseudomonas aeruginosa PA01
gugcugcgcgcggc

SEQ ID NO: 3406087 - RNA, 16 nt, Pseudomonas aeruginosa PA01
gugcugcggcagguag

SEQ ID NO: 3406088 - RNA, 24 nt, Pseudomonas aeruginosa PA01
gugcuggacuucggucucguccgg

SEQ ID NO: 3406089 - RNA, 14 nt, Pseudomonas aeruginosa PA01
gugcuggcgcaaca

SEQ ID NO: 3406090 - RNA, 13 nt, Pseudomonas aeruginosa PA01
guggccgccaggg

SEQ ID NO: 3406091 - RNA, 23 nt, Pseudomonas aeruginosa PA01
guggccgcgccccacggcgcggc

SEQ ID NO: 3406092 - RNA, 19 nt, Pseudomonas aeruginosa PA01
guggccgcgccgcccuggc

SEQ ID NO: 3406093 - RNA, 18 nt, Pseudomonas aeruginosa PA01
guggccgcgggaggccgc

SEQ ID NO: 3406094 - RNA, 19 nt, Pseudomonas aeruginosa PA01
guggccggcgaccagcucg

SEQ ID NO: 3406095 - RNA, 19 nt, Pseudomonas aeruginosa PA01
guggccggugugcgacugg

SEQ ID NO: 3406096 - RNA, 22 nt, Pseudomonas aeruginosa PA01
guggccggugugcgacuggggc

SEQ ID NO: 3406097 - RNA, 23 nt, Pseudomonas aeruginosa PA01
guggccgucgaagggcacgccgc

SEQ ID NO: 3406098 - RNA, 16 nt, Pseudomonas aeruginosa PA01
guggccgugcagcccu

SEQ ID NO: 3406099 - RNA, 17 nt, Pseudomonas aeruginosa PA01
guggccgugcagcccuc

SEQ ID NO: 3406100 - RNA, 13 nt, Pseudomonas aeruginosa PA01
guggccguggcgc

SEQ ID NO: 3406101 - RNA, 15 nt, Pseudomonas aeruginosa PA01
guggccguggcgccc

SEQ ID NO: 3406102 - RNA, 15 nt, Pseudomonas aeruginosa PA01
guggccgugggccgc

SEQ ID NO: 3406103 - RNA, 21 nt, Pseudomonas aeruginosa PA01
guggccguugagcaccucgac

SEQ ID NO: 3406104 - RNA, 15 nt, Pseudomonas aeruginosa PA01
guggccuccugcaac

SEQ ID NO: 3406105 - RNA, 21 nt, Pseudomonas aeruginosa PA01
guggccuccugcaacgccugg

SEQ ID NO: 3406106 - RNA, 23 nt, Pseudomonas aeruginosa PA01
guggccuccugcaacgccuggug

SEQ ID NO: 3406107 - RNA, 21 nt, Pseudomonas aeruginosa PA01
guggccuuuuucauuggcgcg

SEQ ID NO: 3406108 - RNA, 20 nt, Pseudomonas aeruginosa PA01
guggcgaaaaucgaaggguu

SEQ ID NO: 3406109 - RNA, 16 nt, Pseudomonas aeruginosa PA01
guggcgaaacuccagc

SEQ ID NO: 3406110 - RNA, 17 nt, Pseudomonas aeruginosa PA01
guggcgaaacuccagca

SEQ ID NO: 3406111 - RNA, 14 nt, Pseudomonas aeruginosa PA01
guggcgaacagcac

SEQ ID NO: 3406112 - RNA, 14 nt, Pseudomonas aeruginosa PA01
guggcgaaccacga

SEQ ID NO: 3406113 - RNA, 15 nt, Pseudomonas aeruginosa PA01
guggcgacgaagacg

SEQ ID NO: 3406114 - RNA, 17 nt, Pseudomonas aeruginosa PA01
guggcgacgcagcacgg

SEQ ID NO: 3406115 - RNA, 13 nt, Pseudomonas aeruginosa PA01
guggcgacgccgg

SEQ ID NO: 3406116 - RNA, 14 nt, Pseudomonas aeruginosa PA01
guggcgacgccggu

SEQ ID NO: 3406117 - RNA, 19 nt, Pseudomonas aeruginosa PA01
guggcgacgcgcaggccgg

SEQ ID NO: 3406118 - RNA, 20 nt, Pseudomonas aeruginosa PA01
guggcgacgcgcaggccggu

SEQ ID NO: 3406119 - RNA, 15 nt, Pseudomonas aeruginosa PA01
guggcgagcgcgauc

SEQ ID NO: 3406120 - RNA, 22 nt, Pseudomonas aeruginosa PA01
guggcgaucacgucguacucgg

SEQ ID NO: 3406121 - RNA, 19 nt, Pseudomonas aeruginosa PA01
guggcgaucaggcagcgcg

SEQ ID NO: 3406122 - RNA, 23 nt, Pseudomonas aeruginosa PA01
guggcgaucaggcagcgcgcggc

SEQ ID NO: 3406123 - RNA, 16 nt, Pseudomonas aeruginosa PA01
guggcgaugcccuggc

SEQ ID NO: 3406124 - RNA, 16 nt, Pseudomonas aeruginosa PA01
guggcgcagcaucauc

SEQ ID NO: 3406125 - RNA, 13 nt, Pseudomonas aeruginosa PA01
guggcgcagccgu

SEQ ID NO: 3406126 - RNA, 16 nt, Pseudomonas aeruginosa PA01
guggcgcagcgcccga

SEQ ID NO: 3406127 - RNA, 13 nt, Pseudomonas aeruginosa PA01
guggcgccagcca

SEQ ID NO: 3406128 - RNA, 14 nt, Pseudomonas aeruginosa PA01
guggcgccagccag

SEQ ID NO: 3406129 - RNA, 15 nt, Pseudomonas aeruginosa PA01
guggcgccagccagc

SEQ ID NO: 3406130 - RNA, 16 nt, Pseudomonas aeruginosa PA01
guggcgccauccucca

SEQ ID NO: 3406131 - RNA, 13 nt, Pseudomonas aeruginosa PA01
guggcgcccagcc

SEQ ID NO: 3406132 - RNA, 14 nt, Pseudomonas aeruginosa PA01
guggcgcccagcca

SEQ ID NO: 3406133 - RNA, 15 nt, Pseudomonas aeruginosa PA01
guggcgcccaugccg

SEQ ID NO: 3406134 - RNA, 17 nt, Pseudomonas aeruginosa PA01
guggcgcccaugccgcc

SEQ ID NO: 3406135 - RNA, 18 nt, Pseudomonas aeruginosa PA01
guggcgcccaugccgccc

SEQ ID NO: 3406136 - RNA, 19 nt, Pseudomonas aeruginosa PA01
guggcgccgagcagcggcg

SEQ ID NO: 3406137 - RNA, 13 nt, Pseudomonas aeruginosa PA01
guggcgccgcagg

SEQ ID NO: 3406138 - RNA, 13 nt, Pseudomonas aeruginosa PA01
guggcgccgccgg

SEQ ID NO: 3406139 - RNA, 15 nt, Pseudomonas aeruginosa PA01
guggcgccgccggcg

SEQ ID NO: 3406140 - RNA, 13 nt, Pseudomonas aeruginosa PA01
guggcgccggcgc

SEQ ID NO: 3406141 - RNA, 14 nt, Pseudomonas aeruginosa PA01
guggcgccggcgcg

SEQ ID NO: 3406142 - RNA, 14 nt, Pseudomonas aeruginosa PA01
guggcgccggcuga

SEQ ID NO: 3406143 - RNA, 18 nt, Pseudomonas aeruginosa PA01
guggcgccggcugacgcu

SEQ ID NO: 3406144 - RNA, 15 nt, Pseudomonas aeruginosa PA01
guggcgcgcaucggu

SEQ ID NO: 3406145 - RNA, 21 nt, Pseudomonas aeruginosa PA01
guggcgcggcugaucggccgc

SEQ ID NO: 3406146 - RNA, 20 nt, Pseudomonas aeruginosa PA01
guggcgcuacgcucgccgac

SEQ ID NO: 3406147 - RNA, 23 nt, Pseudomonas aeruginosa PA01
guggcgcuacgcucgccgacggc

SEQ ID NO: 3406148 - RNA, 16 nt, Pseudomonas aeruginosa PA01
guggcgcuggccgaau

SEQ ID NO: 3406149 - RNA, 17 nt, Pseudomonas aeruginosa PA01
guggcgcugucgccggu

SEQ ID NO: 3406150 - RNA, 23 nt, Pseudomonas aeruginosa PA01
guggcgcugucgccggucaggcu

SEQ ID NO: 3406151 - RNA, 20 nt, Pseudomonas aeruginosa PA01
guggcgcuucguugcgaugg

SEQ ID NO: 3406152 - RNA, 16 nt, Pseudomonas aeruginosa PA01
guggcgcuugagcagc

SEQ ID NO: 3406153 - RNA, 18 nt, Pseudomonas aeruginosa PA01
guggcgcuugagcagcca

SEQ ID NO: 3406154 - RNA, 19 nt, Pseudomonas aeruginosa PA01
guggcgcuugagcagccag

SEQ ID NO: 3406155 - RNA, 22 nt, Pseudomonas aeruginosa PA01
guggcgcuugagcagccaggcg

SEQ ID NO: 3406156 - RNA, 19 nt, Pseudomonas aeruginosa PA01
guggcggacaacccggcgc

SEQ ID NO: 3406157 - RNA, 21 nt, Pseudomonas aeruginosa PA01
guggcggacaacccggcgcug

SEQ ID NO: 3406158 - RNA, 14 nt, Pseudomonas aeruginosa PA01
guggcggccgccgc

SEQ ID NO: 3406159 - RNA, 15 nt, Pseudomonas aeruginosa PA01
guggcggccgccggc

SEQ ID NO: 3406160 - RNA, 17 nt, Pseudomonas aeruginosa PA01
guggcggccgccggcgc

SEQ ID NO: 3406161 - RNA, 23 nt, Pseudomonas aeruginosa PA01
guggcggcgcgcgucguccaggg

SEQ ID NO: 3406162 - RNA, 14 nt, Pseudomonas aeruginosa PA01
guggcggcgcucag

SEQ ID NO: 3406163 - RNA, 13 nt, Pseudomonas aeruginosa PA01
guggcggcugaag

SEQ ID NO: 3406164 - RNA, 13 nt, Pseudomonas aeruginosa PA01
guggcgggccagc

SEQ ID NO: 3406165 - RNA, 15 nt, Pseudomonas aeruginosa PA01
guggcgggccagcag

SEQ ID NO: 3406166 - RNA, 16 nt, Pseudomonas aeruginosa PA01
guggcgggccagcagg

SEQ ID NO: 3406167 - RNA, 18 nt, Pseudomonas aeruginosa PA01
guggcgggccagcaggcg

SEQ ID NO: 3406168 - RNA, 13 nt, Pseudomonas aeruginosa PA01
guggcgggcucug

SEQ ID NO: 3406169 - RNA, 19 nt, Pseudomonas aeruginosa PA01
guggcggggaacagcaugg

SEQ ID NO: 3406170 - RNA, 16 nt, Pseudomonas aeruginosa PA01
guggcgugcucggcga

SEQ ID NO: 3406171 - RNA, 17 nt, Pseudomonas aeruginosa PA01
guggcgugcucggcgau

SEQ ID NO: 3406172 - RNA, 17 nt, Pseudomonas aeruginosa PA01
guggcguuauucgcccu

SEQ ID NO: 3406173 - RNA, 17 nt, Pseudomonas aeruginosa PA01
guggcguuccaggcggc

SEQ ID NO: 3406174 - RNA, 19 nt, Pseudomonas aeruginosa PA01
guggcguuccaggcggcgg

SEQ ID NO: 3406175 - RNA, 23 nt, Pseudomonas aeruginosa PA01
guggcguuccaggcggcggacga

SEQ ID NO: 3406176 - RNA, 23 nt, Pseudomonas aeruginosa PA01
guggcguucucgaucaucgccag

SEQ ID NO: 3406177 - RNA, 15 nt, Pseudomonas aeruginosa PA01
guggcguugcagggu

SEQ ID NO: 3406178 - RNA, 17 nt, Pseudomonas aeruginosa PA01
guggcuacggaugcugu

SEQ ID NO: 3406179 - RNA, 23 nt, Pseudomonas aeruginosa PA01
guggcuacggaugcugucccaac

SEQ ID NO: 3406180 - RNA, 21 nt, Pseudomonas aeruginosa PA01
guggcuauccuccaggccgcc

SEQ ID NO: 3406181 - RNA, 22 nt, Pseudomonas aeruginosa PA01
guggcucgaucagccggcgcgc

SEQ ID NO: 3406182 - RNA, 22 nt, Pseudomonas aeruginosa PA01
guggcucgauugcugaggggug

SEQ ID NO: 3406183 - RNA, 14 nt, Pseudomonas aeruginosa PA01
guggcucggcggca

SEQ ID NO: 3406184 - RNA, 11 nt, Pseudomonas aeruginosa PA01
guggcugcgcu

SEQ ID NO: 3406185 - RNA, 17 nt, Pseudomonas aeruginosa PA01
guggcugcgcucaccug

SEQ ID NO: 3406186 - RNA, 20 nt, Pseudomonas aeruginosa PA01
guggcuggccucggcgaucg

SEQ ID NO: 3406187 - RNA, 21 nt, Pseudomonas aeruginosa PA01
guggcuggcgccgcgggucug

SEQ ID NO: 3406188 - RNA, 13 nt, Pseudomonas aeruginosa PA01
guggcuggugaug

SEQ ID NO: 3406189 - RNA, 14 nt, Pseudomonas aeruginosa PA01
guggcuggugaugc

SEQ ID NO: 3406190 - RNA, 20 nt, Pseudomonas aeruginosa PA01
guggcuggugaugccgcgga

SEQ ID NO: 3406191 - RNA, 17 nt, Pseudomonas aeruginosa PA01
guggcugugcuggccac

SEQ ID NO: 3406192 - RNA, 15 nt, Pseudomonas aeruginosa PA01
guggcuuuccagcau

SEQ ID NO: 3406193 - RNA, 18 nt, Pseudomonas aeruginosa PA01
gugucggugcccucgcgg

SEQ ID NO: 3406194 - RNA, 16 nt, Pseudomonas aeruginosa PA01
gugucugguuccuggu

SEQ ID NO: 3406195 - RNA, 18 nt, Pseudomonas aeruginosa PA01
gugugaucaccagccacu

SEQ ID NO: 3406196 - RNA, 22 nt, Pseudomonas aeruginosa PA01
gugugcaccgaguugaccagca

SEQ ID NO: 3406197 - RNA, 22 nt, Pseudomonas aeruginosa PA01
gugugccggccaugcaggccag

SEQ ID NO: 3406198 - RNA, 22 nt, Pseudomonas aeruginosa PA01
gugugccgucaggcaccucguc

SEQ ID NO: 3406199 - RNA, 16 nt, Pseudomonas aeruginosa PA01
gugugcgcugcaucgg

SEQ ID NO: 3406200 - RNA, 23 nt, Pseudomonas aeruginosa PA01
gugugcgcugcaucggcgcgccg

SEQ ID NO: 3406201 - RNA, 14 nt, Pseudomonas aeruginosa PA01
gugugcucaggcga

SEQ ID NO: 3406202 - RNA, 12 nt, Pseudomonas aeruginosa PA01
guguggccuggg

SEQ ID NO: 3406203 - RNA, 15 nt, Pseudomonas aeruginosa PA01
guguucauagaaacg

SEQ ID NO: 3406204 - RNA, 18 nt, Pseudomonas aeruginosa PA01
guguucggccagccggcg

SEQ ID NO: 3406205 - RNA, 21 nt, Pseudomonas aeruginosa PA01
guguucggccagccggcgccg

SEQ ID NO: 3406206 - RNA, 20 nt, Pseudomonas aeruginosa PA01
guguucggcggcgugcaggg

SEQ ID NO: 3406207 - RNA, 13 nt, Pseudomonas aeruginosa PA01
guguucggcggcu

SEQ ID NO: 3406208 - RNA, 17 nt, Pseudomonas aeruginosa PA01
guguugaucgccgcgcc

SEQ ID NO: 3406209 - RNA, 16 nt, Pseudomonas aeruginosa PA01
guguugccguggucgc

SEQ ID NO: 3406210 - RNA, 17 nt, Pseudomonas aeruginosa PA01
guguugcggagaggugg

SEQ ID NO: 3406211 - RNA, 16 nt, Pseudomonas aeruginosa PA01
guguuguucgccagca

SEQ ID NO: 3406212 - RNA, 17 nt, Pseudomonas aeruginosa PA01
guguuucggccgcugcc

SEQ ID NO: 3406213 - RNA, 16 nt, Pseudomonas aeruginosa PA01
guuaacaguugagcug

SEQ ID NO: 3406214 - RNA, 15 nt, Pseudomonas aeruginosa PA01
guuacagcaggaaaa

SEQ ID NO: 3406215 - RNA, 17 nt, Pseudomonas aeruginosa PA01
guuaccgcgggcucagg

SEQ ID NO: 3406216 - RNA, 17 nt, Pseudomonas aeruginosa PA01
guuaccggcgaccaccg

SEQ ID NO: 3406217 - RNA, 15 nt, Pseudomonas aeruginosa PA01
guuaccuuggccacg

SEQ ID NO: 3406218 - RNA, 13 nt, Pseudomonas aeruginosa PA01
guuacgcgcagcg

SEQ ID NO: 3406219 - RNA, 15 nt, Pseudomonas aeruginosa PA01
guuagaauaccggcc

SEQ ID NO: 3406220 - RNA, 18 nt, Pseudomonas aeruginosa PA01
guuagaauaccggccugu

SEQ ID NO: 3406221 - RNA, 22 nt, Pseudomonas aeruginosa PA01
guuagaauaccggccugucacg

SEQ ID NO: 3406222 - RNA, 13 nt, Pseudomonas aeruginosa PA01
guuauccgccgau

SEQ ID NO: 3406223 - RNA, 14 nt, Pseudomonas aeruginosa PA01
guuauccgccgccg

SEQ ID NO: 3406224 - RNA, 16 nt, Pseudomonas aeruginosa PA01
guuauccgccgccgac

SEQ ID NO: 3406225 - RNA, 17 nt, Pseudomonas aeruginosa PA01
guuauccgccgccgacg

SEQ ID NO: 3406226 - RNA, 14 nt, Pseudomonas aeruginosa PA01
guuauccgccggug

SEQ ID NO: 3406227 - RNA, 22 nt, Pseudomonas aeruginosa PA01
guuauccgccggugcgcgaucg

SEQ ID NO: 3406228 - RNA, 23 nt, Pseudomonas aeruginosa PA01
guuaugcacguucuugaccuucu

SEQ ID NO: 3406229 - RNA, 13 nt, Pseudomonas aeruginosa PA01
guuauggccgacc

SEQ ID NO: 3406230 - RNA, 20 nt, Pseudomonas aeruginosa PA01
guuauuccgcgggacgcggc

SEQ ID NO: 3406231 - RNA, 18 nt, Pseudomonas aeruginosa PA01
guuauugaaguggugaug

SEQ ID NO: 3406232 - RNA, 17 nt, Pseudomonas aeruginosa PA01
guucacauuggcuuccg

SEQ ID NO: 3406233 - RNA, 14 nt, Pseudomonas aeruginosa PA01
guucaccccgcccu

SEQ ID NO: 3406234 - RNA, 20 nt, Pseudomonas aeruginosa PA01
guucaccccgcccuuggcgg

SEQ ID NO: 3406235 - RNA, 23 nt, Pseudomonas aeruginosa PA01
guucaccccgcccuuggcggcgc

SEQ ID NO: 3406236 - RNA, 18 nt, Pseudomonas aeruginosa PA01
guucaccgccucggagaa

SEQ ID NO: 3406237 - RNA, 13 nt, Pseudomonas aeruginosa PA01
guucaccgcgcaa

SEQ ID NO: 3406238 - RNA, 20 nt, Pseudomonas aeruginosa PA01
guucaccguggcgcuggccg

SEQ ID NO: 3406239 - RNA, 19 nt, Pseudomonas aeruginosa PA01
guucacgcaguacagcugc

SEQ ID NO: 3406240 - RNA, 15 nt, Pseudomonas aeruginosa PA01
guucacgccuggcgg

SEQ ID NO: 3406241 - RNA, 20 nt, Pseudomonas aeruginosa PA01
guucacgccuggcggcuggc

SEQ ID NO: 3406242 - RNA, 15 nt, Pseudomonas aeruginosa PA01
guucacgcgaccacc

SEQ ID NO: 3406243 - RNA, 20 nt, Pseudomonas aeruginosa PA01
guucacguaggagccggcca

SEQ ID NO: 3406244 - RNA, 22 nt, Pseudomonas aeruginosa PA01
guucacguaggagccggccagg

SEQ ID NO: 3406245 - RNA, 15 nt, Pseudomonas aeruginosa PA01
guucacuccacgagg

SEQ ID NO: 3406246 - RNA, 17 nt, Pseudomonas aeruginosa PA01
guucacuccacgaggau

SEQ ID NO: 3406247 - RNA, 16 nt, Pseudomonas aeruginosa PA01
guucagcagcaugccg

SEQ ID NO: 3406248 - RNA, 11 nt, Pseudomonas aeruginosa PA01
guucagcagcg

SEQ ID NO: 3406249 - RNA, 19 nt, Pseudomonas aeruginosa PA01
guucagcagcggcacccgg

SEQ ID NO: 3406250 - RNA, 22 nt, Pseudomonas aeruginosa PA01
guucagcaggagcagcuugcgc

SEQ ID NO: 3406251 - RNA, 19 nt, Pseudomonas aeruginosa PA01
guucagcaggucgcggccc

SEQ ID NO: 3406252 - RNA, 14 nt, Pseudomonas aeruginosa PA01
guucagccacugcc

SEQ ID NO: 3406253 - RNA, 20 nt, Pseudomonas aeruginosa PA01
guucagccgguacugcgcca

SEQ ID NO: 3406254 - RNA, 22 nt, Pseudomonas aeruginosa PA01
guucagcggcgcgucgaccacg

SEQ ID NO: 3406255 - RNA, 17 nt, Pseudomonas aeruginosa PA01
guucagcgggcgcuuga

SEQ ID NO: 3406256 - RNA, 18 nt, Pseudomonas aeruginosa PA01
guucagcgggcgcuugaa

SEQ ID NO: 3406257 - RNA, 21 nt, Pseudomonas aeruginosa PA01
guucagcgggcgcuugaagcc

SEQ ID NO: 3406258 - RNA, 22 nt, Pseudomonas aeruginosa PA01
guucagcggguucuugccgcug

SEQ ID NO: 3406259 - RNA, 17 nt, Pseudomonas aeruginosa PA01
guucaggacgcuccugc

SEQ ID NO: 3406260 - RNA, 17 nt, Pseudomonas aeruginosa PA01
guucaggcaaccgggua

SEQ ID NO: 3406261 - RNA, 14 nt, Pseudomonas aeruginosa PA01
guucaggccggcgc

SEQ ID NO: 3406262 - RNA, 16 nt, Pseudomonas aeruginosa PA01
guucaggccggcgccg

SEQ ID NO: 3406263 - RNA, 20 nt, Pseudomonas aeruginosa PA01
guucaggccgggcaggccga

SEQ ID NO: 3406264 - RNA, 22 nt, Pseudomonas aeruginosa PA01
guucaggcuccaauucgacgcc

SEQ ID NO: 3406265 - RNA, 13 nt, Pseudomonas aeruginosa PA01
guucaggcugggc

SEQ ID NO: 3406266 - RNA, 19 nt, Pseudomonas aeruginosa PA01
guucagggaggaacccagg

SEQ ID NO: 3406267 - RNA, 23 nt, Pseudomonas aeruginosa PA01
guucagggcguagcggaagccgu

SEQ ID NO: 3406268 - RNA, 17 nt, Pseudomonas aeruginosa PA01
guucaggguggcgaccg

SEQ ID NO: 3406269 - RNA, 22 nt, Pseudomonas aeruginosa PA01
guucaggguggcgaucacgucg

SEQ ID NO: 3406270 - RNA, 19 nt, Pseudomonas aeruginosa PA01
guucaggucgaggccgcgg

SEQ ID NO: 3406271 - RNA, 14 nt, Pseudomonas aeruginosa PA01
guucaggucgaugc

SEQ ID NO: 3406272 - RNA, 15 nt, Pseudomonas aeruginosa PA01
guucaggucgaugcc

SEQ ID NO: 3406273 - RNA, 14 nt, Pseudomonas aeruginosa PA01
guucaggugcugga

SEQ ID NO: 3406274 - RNA, 17 nt, Pseudomonas aeruginosa PA01
guucagucccgcggcgc

SEQ ID NO: 3406275 - RNA, 18 nt, Pseudomonas aeruginosa PA01
guucagucccgcggcgcg

SEQ ID NO: 3406276 - RNA, 15 nt, Pseudomonas aeruginosa PA01
guucagucggccagg

SEQ ID NO: 3406277 - RNA, 18 nt, Pseudomonas aeruginosa PA01
guucagucgguuagaaua

SEQ ID NO: 3406278 - RNA, 14 nt, Pseudomonas aeruginosa PA01
guucaguucugggc

SEQ ID NO: 3406279 - RNA, 16 nt, Pseudomonas aeruginosa PA01
guucaguucugggcgg

SEQ ID NO: 3406280 - RNA, 17 nt, Pseudomonas aeruginosa PA01
guucaguucugggcggc

SEQ ID NO: 3406281 - RNA, 19 nt, Pseudomonas aeruginosa PA01
guucaguucugggcggcca

SEQ ID NO: 3406282 - RNA, 21 nt, Pseudomonas aeruginosa PA01
guucaguucugggcggccagg

SEQ ID NO: 3406283 - RNA, 13 nt, Pseudomonas aeruginosa PA01
guucaucgagcag

SEQ ID NO: 3406284 - RNA, 18 nt, Pseudomonas aeruginosa PA01
guucaucgagcggcggcc

SEQ ID NO: 3406285 - RNA, 21 nt, Pseudomonas aeruginosa PA01
guucaucgagcggcggccguc

SEQ ID NO: 3406286 - RNA, 22 nt, Pseudomonas aeruginosa PA01
guucaucgagcggcggccgucg

SEQ ID NO: 3406287 - RNA, 16 nt, Pseudomonas aeruginosa PA01
guucaucgccgccagg

SEQ ID NO: 3406288 - RNA, 17 nt, Pseudomonas aeruginosa PA01
guucaucgucggcagcc

SEQ ID NO: 3406289 - RNA, 14 nt, Pseudomonas aeruginosa PA01
guucaucuucgcgc

SEQ ID NO: 3406290 - RNA, 16 nt, Pseudomonas aeruginosa PA01
guucaucuugcggcaa

SEQ ID NO: 3406291 - RNA, 13 nt, Pseudomonas aeruginosa PA01
guucaugccgcga

SEQ ID NO: 3406292 - RNA, 21 nt, Pseudomonas aeruginosa PA01
guucaugccgcgagccuucag

SEQ ID NO: 3406293 - RNA, 19 nt, Pseudomonas aeruginosa PA01
guucauguagcgcuccuuc

SEQ ID NO: 3406294 - RNA, 21 nt, Pseudomonas aeruginosa PA01
guuccaccgccuggaccaggu

SEQ ID NO: 3406295 - RNA, 21 nt, Pseudomonas aeruginosa PA01
guucgccuugcggggcggcgc

SEQ ID NO: 3406296 - RNA, 15 nt, Pseudomonas aeruginosa PA01
guucgcgcaggaccu

SEQ ID NO: 3406297 - RNA, 15 nt, Pseudomonas aeruginosa PA01
guucgcgcaggcgcu

SEQ ID NO: 3406298 - RNA, 17 nt, Pseudomonas aeruginosa PA01
guucgcgcaggcgcugg

SEQ ID NO: 3406299 - RNA, 22 nt, Pseudomonas aeruginosa PA01
guucgcgcccgucgucguggcg

SEQ ID NO: 3406300 - RNA, 19 nt, Pseudomonas aeruginosa PA01
guucgcgcgccucgcggcg

SEQ ID NO: 3406301 - RNA, 17 nt, Pseudomonas aeruginosa PA01
guucgcggcgaugcgca

SEQ ID NO: 3406302 - RNA, 14 nt, Pseudomonas aeruginosa PA01
guucgcggcgcagc

SEQ ID NO: 3406303 - RNA, 19 nt, Pseudomonas aeruginosa PA01
guucgcggcgcagcuucuc

SEQ ID NO: 3406304 - RNA, 17 nt, Pseudomonas aeruginosa PA01
guucgcggcucuggcgc

SEQ ID NO: 3406305 - RNA, 15 nt, Pseudomonas aeruginosa PA01
guucgcgggccgcgg

SEQ ID NO: 3406306 - RNA, 17 nt, Pseudomonas aeruginosa PA01
guucgcgggccgcggcg

SEQ ID NO: 3406307 - RNA, 15 nt, Pseudomonas aeruginosa PA01
guucgcgggcgccgu

SEQ ID NO: 3406308 - RNA, 20 nt, Pseudomonas aeruginosa PA01
guucgcguagccccucgcgc

SEQ ID NO: 3406309 - RNA, 14 nt, Pseudomonas aeruginosa PA01
guucgcuccgggcc

SEQ ID NO: 3406310 - RNA, 19 nt, Pseudomonas aeruginosa PA01
guucgcugacccagcgcac

SEQ ID NO: 3406311 - RNA, 20 nt, Pseudomonas aeruginosa PA01
guucgcugacccagcgcacg

SEQ ID NO: 3406312 - RNA, 20 nt, Pseudomonas aeruginosa PA01
guucgcugaggacugccagg

SEQ ID NO: 3406313 - RNA, 15 nt, Pseudomonas aeruginosa PA01
guucgcugccgccgc

SEQ ID NO: 3406314 - RNA, 12 nt, Pseudomonas aeruginosa PA01
guucgcugcgcg

SEQ ID NO: 3406315 - RNA, 17 nt, Pseudomonas aeruginosa PA01
guucggaucggcccggc

SEQ ID NO: 3406316 - RNA, 14 nt, Pseudomonas aeruginosa PA01
guucggcagcgccu

SEQ ID NO: 3406317 - RNA, 18 nt, Pseudomonas aeruginosa PA01
guucggcagcgccucggc

SEQ ID NO: 3406318 - RNA, 20 nt, Pseudomonas aeruginosa PA01
guucggcauuggugcugccg

SEQ ID NO: 3406319 - RNA, 15 nt, Pseudomonas aeruginosa PA01
guucggccagggagu

SEQ ID NO: 3406320 - RNA, 14 nt, Pseudomonas aeruginosa PA01
guucggcccagcag

SEQ ID NO: 3406321 - RNA, 17 nt, Pseudomonas aeruginosa PA01
guucggcccagcagcgc

SEQ ID NO: 3406322 - RNA, 14 nt, Pseudomonas aeruginosa PA01
guucggccccggcc

SEQ ID NO: 3406323 - RNA, 16 nt, Pseudomonas aeruginosa PA01
guucggccgcggcugg

SEQ ID NO: 3406324 - RNA, 16 nt, Pseudomonas aeruginosa PA01
guucggcgagaggucg

SEQ ID NO: 3406325 - RNA, 23 nt, Pseudomonas aeruginosa PA01
guucggcgaggaucgccagcaau

SEQ ID NO: 3406326 - RNA, 14 nt, Pseudomonas aeruginosa PA01
guucggcgccagcu

SEQ ID NO: 3406327 - RNA, 15 nt, Pseudomonas aeruginosa PA01
guucggcgcccaggu

SEQ ID NO: 3406328 - RNA, 17 nt, Pseudomonas aeruginosa PA01
guucggcgcugaccucg

SEQ ID NO: 3406329 - RNA, 23 nt, Pseudomonas aeruginosa PA01
guucggcgcugaccucgauggcg

SEQ ID NO: 3406330 - RNA, 19 nt, Pseudomonas aeruginosa PA01
guucggcggaaauccuuuc

SEQ ID NO: 3406331 - RNA, 19 nt, Pseudomonas aeruginosa PA01
guucggcgggaucgacgcc

SEQ ID NO: 3406332 - RNA, 19 nt, Pseudomonas aeruginosa PA01
guucggcgucuucggcggc

SEQ ID NO: 3406333 - RNA, 23 nt, Pseudomonas aeruginosa PA01
guucggcgucuucggcggcgccg

SEQ ID NO: 3406334 - RNA, 14 nt, Pseudomonas aeruginosa PA01
guucggcugggcca

SEQ ID NO: 3406335 - RNA, 15 nt, Pseudomonas aeruginosa PA01
guucggcugggccag

SEQ ID NO: 3406336 - RNA, 16 nt, Pseudomonas aeruginosa PA01
guucggcugggccagg

SEQ ID NO: 3406337 - RNA, 20 nt, Pseudomonas aeruginosa PA01
guucggcuguuucaggccgg

SEQ ID NO: 3406338 - RNA, 23 nt, Pseudomonas aeruginosa PA01
guucggcuguuucaggccggcgu

SEQ ID NO: 3406339 - RNA, 22 nt, Pseudomonas aeruginosa PA01
guucggggcccuccaggcgaag

SEQ ID NO: 3406340 - RNA, 17 nt, Pseudomonas aeruginosa PA01
guucgggucgcggcuga

SEQ ID NO: 3406341 - RNA, 15 nt, Pseudomonas aeruginosa PA01
guucggucaggcuga

SEQ ID NO: 3406342 - RNA, 18 nt, Pseudomonas aeruginosa PA01
guucggugccgccggcgc

SEQ ID NO: 3406343 - RNA, 20 nt, Pseudomonas aeruginosa PA01
guucggugccgccggcgccg

SEQ ID NO: 3406344 - RNA, 18 nt, Pseudomonas aeruginosa PA01
guucgguguaguucaccg

SEQ ID NO: 3406345 - RNA, 16 nt, Pseudomonas aeruginosa PA01
guucgucaaccagcac

SEQ ID NO: 3406346 - RNA, 17 nt, Pseudomonas aeruginosa PA01
guucgucaccggcgcca

SEQ ID NO: 3406347 - RNA, 20 nt, Pseudomonas aeruginosa PA01
guucguccaucgccaggcca

SEQ ID NO: 3406348 - RNA, 17 nt, Pseudomonas aeruginosa PA01
guucgucccgagcaccg

SEQ ID NO: 3406349 - RNA, 14 nt, Pseudomonas aeruginosa PA01
guucgucuggcgcc

SEQ ID NO: 3406350 - RNA, 20 nt, Pseudomonas aeruginosa PA01
guucgucuggcgccuggccu

SEQ ID NO: 3406351 - RNA, 19 nt, Pseudomonas aeruginosa PA01
guucgucuuccagcggcca

SEQ ID NO: 3406352 - RNA, 19 nt, Pseudomonas aeruginosa PA01
guucgugccaggcggcagc

SEQ ID NO: 3406353 - RNA, 19 nt, Pseudomonas aeruginosa PA01
guucguucuguucgucccg

SEQ ID NO: 3406354 - RNA, 18 nt, Pseudomonas aeruginosa PA01
guucucauugcgccgccg

SEQ ID NO: 3406355 - RNA, 20 nt, Pseudomonas aeruginosa PA01
guucuccaccgccaccugcc

SEQ ID NO: 3406356 - RNA, 13 nt, Pseudomonas aeruginosa PA01
guucuccagcaag

SEQ ID NO: 3406357 - RNA, 17 nt, Pseudomonas aeruginosa PA01
guucucccgcgcgcugu

SEQ ID NO: 3406358 - RNA, 14 nt, Pseudomonas aeruginosa PA01
guucucccugagcc

SEQ ID NO: 3406359 - RNA, 13 nt, Pseudomonas aeruginosa PA01
guucuccgggucg

SEQ ID NO: 3406360 - RNA, 21 nt, Pseudomonas aeruginosa PA01
guucuccucccgccccuccag

SEQ ID NO: 3406361 - RNA, 22 nt, Pseudomonas aeruginosa PA01
guucuccucccgccccuccagu

SEQ ID NO: 3406362 - RNA, 13 nt, Pseudomonas aeruginosa PA01
guucucgacccgc

SEQ ID NO: 3406363 - RNA, 18 nt, Pseudomonas aeruginosa PA01
guucucgaucaucgccag

SEQ ID NO: 3406364 - RNA, 16 nt, Pseudomonas aeruginosa PA01
guucucggccagguac

SEQ ID NO: 3406365 - RNA, 19 nt, Pseudomonas aeruginosa PA01
guucucguguugcagcaga

SEQ ID NO: 3406366 - RNA, 21 nt, Pseudomonas aeruginosa PA01
guucugccagagcgcugccug

SEQ ID NO: 3406367 - RNA, 22 nt, Pseudomonas aeruginosa PA01
guucugccagagcgcugccugc

SEQ ID NO: 3406368 - RNA, 14 nt, Pseudomonas aeruginosa PA01
guucugcccgccgg

SEQ ID NO: 3406369 - RNA, 16 nt, Pseudomonas aeruginosa PA01
guucugcccgccggcg

SEQ ID NO: 3406370 - RNA, 18 nt, Pseudomonas aeruginosa PA01
guucugcccgccggcgcc

SEQ ID NO: 3406371 - RNA, 19 nt, Pseudomonas aeruginosa PA01
guucugcccgccggcgccc

SEQ ID NO: 3406372 - RNA, 18 nt, Pseudomonas aeruginosa PA01
guucugccgcagcgccuc

SEQ ID NO: 3406373 - RNA, 22 nt, Pseudomonas aeruginosa PA01
guucugcgacaucuccaggccg

SEQ ID NO: 3406374 - RNA, 23 nt, Pseudomonas aeruginosa PA01
guucugcgacaucuccaggccgc

SEQ ID NO: 3406375 - RNA, 17 nt, Pseudomonas aeruginosa PA01
guucugcucgcugcccg

SEQ ID NO: 3406376 - RNA, 16 nt, Pseudomonas aeruginosa PA01
guucugcuucucggcu

SEQ ID NO: 3406377 - RNA, 14 nt, Pseudomonas aeruginosa PA01
guucugggcggcca

SEQ ID NO: 3406378 - RNA, 15 nt, Pseudomonas aeruginosa PA01
guucugggcggccag

SEQ ID NO: 3406379 - RNA, 16 nt, Pseudomonas aeruginosa PA01
guucugguaacuggga

SEQ ID NO: 3406380 - RNA, 15 nt, Pseudomonas aeruginosa PA01
guucuggucgccgac

SEQ ID NO: 3406381 - RNA, 14 nt, Pseudomonas aeruginosa PA01
guucugugcggcga

SEQ ID NO: 3406382 - RNA, 15 nt, Pseudomonas aeruginosa PA01
guucuguguggccug

SEQ ID NO: 3406383 - RNA, 23 nt, Pseudomonas aeruginosa PA01
guucuuccccugcaugccggccg

SEQ ID NO: 3406384 - RNA, 15 nt, Pseudomonas aeruginosa PA01
guucuucgccgcccg

SEQ ID NO: 3406385 - RNA, 19 nt, Pseudomonas aeruginosa PA01
guucuucgccgcccgcgcc

SEQ ID NO: 3406386 - RNA, 19 nt, Pseudomonas aeruginosa PA01
guucuugaagaagcugccg

SEQ ID NO: 3406387 - RNA, 21 nt, Pseudomonas aeruginosa PA01
guucuugaagaagcugccggc

SEQ ID NO: 3406388 - RNA, 16 nt, Pseudomonas aeruginosa PA01
guucuugaccuucugc

SEQ ID NO: 3406389 - RNA, 20 nt, Pseudomonas aeruginosa PA01
guucuugaccuucugcaccg

SEQ ID NO: 3406390 - RNA, 23 nt, Pseudomonas aeruginosa PA01
guucuugauccgcuccagcgccu

SEQ ID NO: 3406391 - RNA, 14 nt, Pseudomonas aeruginosa PA01
guucuugcccagca

SEQ ID NO: 3406392 - RNA, 14 nt, Pseudomonas aeruginosa PA01
guucuugccgcugu

SEQ ID NO: 3406393 - RNA, 20 nt, Pseudomonas aeruginosa PA01
guucuuguugagcuggccga

SEQ ID NO: 3406394 - RNA, 21 nt, Pseudomonas aeruginosa PA01
guugaacgucucggcgaacga

SEQ ID NO: 3406395 - RNA, 20 nt, Pseudomonas aeruginosa PA01
guugaagaacggcccgcucu

SEQ ID NO: 3406396 - RNA, 14 nt, Pseudomonas aeruginosa PA01
guugaagccgccau

SEQ ID NO: 3406397 - RNA, 17 nt, Pseudomonas aeruginosa PA01
guugccgcgcuugccgu

SEQ ID NO: 3406398 - RNA, 17 nt, Pseudomonas aeruginosa PA01
guugccggaaucacgcu

SEQ ID NO: 3406399 - RNA, 15 nt, Pseudomonas aeruginosa PA01
guugccggacuuccu

SEQ ID NO: 3406400 - RNA, 23 nt, Pseudomonas aeruginosa PA01
guugccgguacucgccgggcguc

SEQ ID NO: 3406401 - RNA, 17 nt, Pseudomonas aeruginosa PA01
guugccggucuugccgg

SEQ ID NO: 3406402 - RNA, 19 nt, Pseudomonas aeruginosa PA01
guugccggucuugccggcu

SEQ ID NO: 3406403 - RNA, 20 nt, Pseudomonas aeruginosa PA01
guugccggucuugccggcug

SEQ ID NO: 3406404 - RNA, 19 nt, Pseudomonas aeruginosa PA01
guugccggugugacggccg

SEQ ID NO: 3406405 - RNA, 20 nt, Pseudomonas aeruginosa PA01
guugccggugugacggccgg

SEQ ID NO: 3406406 - RNA, 22 nt, Pseudomonas aeruginosa PA01
guugccggugugacggccgggg

SEQ ID NO: 3406407 - RNA, 17 nt, Pseudomonas aeruginosa PA01
guugccgucgagcacca

SEQ ID NO: 3406408 - RNA, 19 nt, Pseudomonas aeruginosa PA01
guugccgucgagcaccagc

SEQ ID NO: 3406409 - RNA, 13 nt, Pseudomonas aeruginosa PA01
guugccgugccgg

SEQ ID NO: 3406410 - RNA, 16 nt, Pseudomonas aeruginosa PA01
guugccguggcggcgc

SEQ ID NO: 3406411 - RNA, 17 nt, Pseudomonas aeruginosa PA01
guugccguggcggcgcg

SEQ ID NO: 3406412 - RNA, 22 nt, Pseudomonas aeruginosa PA01
guugccguggucgcgcaggcgg

SEQ ID NO: 3406413 - RNA, 12 nt, Pseudomonas aeruginosa PA01
guugccugcugu

SEQ ID NO: 3406414 - RNA, 10 nt, Pseudomonas aeruginosa PA01
guugccuggc

SEQ ID NO: 3406415 - RNA, 14 nt, Pseudomonas aeruginosa PA01
guugccuguccagc

SEQ ID NO: 3406416 - RNA, 20 nt, Pseudomonas aeruginosa PA01
guugcgauagaccaggaagg

SEQ ID NO: 3406417 - RNA, 20 nt, Pseudomonas aeruginosa PA01
guugcgaugggugccgcgca

SEQ ID NO: 3406418 - RNA, 19 nt, Pseudomonas aeruginosa PA01
guugcgauuguccaccggc

SEQ ID NO: 3406419 - RNA, 17 nt, Pseudomonas aeruginosa PA01
guugcgcaaccagcgcu

SEQ ID NO: 3406420 - RNA, 19 nt, Pseudomonas aeruginosa PA01
guugcgcacccgcucggcc

SEQ ID NO: 3406421 - RNA, 21 nt, Pseudomonas aeruginosa PA01
guugcgcagcaacuggucgcc

SEQ ID NO: 3406422 - RNA, 23 nt, Pseudomonas aeruginosa PA01
guugcgcagcuucugcagggcgg

SEQ ID NO: 3406423 - RNA, 13 nt, Pseudomonas aeruginosa PA01
guugcgcaucugc

SEQ ID NO: 3406424 - RNA, 20 nt, Pseudomonas aeruginosa PA01
guugcgcauuugcacgucgg

SEQ ID NO: 3406425 - RNA, 21 nt, Pseudomonas aeruginosa PA01
guugcgcauuugcacgucggu

SEQ ID NO: 3406426 - RNA, 22 nt, Pseudomonas aeruginosa PA01
guugcgccauugccgccaggug

SEQ ID NO: 3406427 - RNA, 23 nt, Pseudomonas aeruginosa PA01
guugcgcccgucgaagaucaccg

SEQ ID NO: 3406428 - RNA, 13 nt, Pseudomonas aeruginosa PA01
guugcgccgcaag

SEQ ID NO: 3406429 - RNA, 14 nt, Pseudomonas aeruginosa PA01
guugcgccgcagca

SEQ ID NO: 3406430 - RNA, 16 nt, Pseudomonas aeruginosa PA01
guugcgccgcagcaag

SEQ ID NO: 3406431 - RNA, 19 nt, Pseudomonas aeruginosa PA01
guugcgccgcagcggcguc

SEQ ID NO: 3406432 - RNA, 16 nt, Pseudomonas aeruginosa PA01
guugcgccgccugcgg

SEQ ID NO: 3406433 - RNA, 17 nt, Pseudomonas aeruginosa PA01
guugcgccgccugcggc

SEQ ID NO: 3406434 - RNA, 13 nt, Pseudomonas aeruginosa PA01
guugcgccggccc

SEQ ID NO: 3406435 - RNA, 18 nt, Pseudomonas aeruginosa PA01
guugcgccggcccagcag

SEQ ID NO: 3406436 - RNA, 19 nt, Pseudomonas aeruginosa PA01
guugcgccggcccagcagg

SEQ ID NO: 3406437 - RNA, 23 nt, Pseudomonas aeruginosa PA01
guugcgccggcccagcaggccgg

SEQ ID NO: 3406438 - RNA, 15 nt, Pseudomonas aeruginosa PA01
guugcgcgagcaccg

SEQ ID NO: 3406439 - RNA, 19 nt, Pseudomonas aeruginosa PA01
guugcgcgagcaccgcgca

SEQ ID NO: 3406440 - RNA, 23 nt, Pseudomonas aeruginosa PA01
guugcgcgagcaccgcgcagacc

SEQ ID NO: 3406441 - RNA, 17 nt, Pseudomonas aeruginosa PA01
guugcgcgcauagcagg

SEQ ID NO: 3406442 - RNA, 16 nt, Pseudomonas aeruginosa PA01
guugcgcggcaggugg

SEQ ID NO: 3406443 - RNA, 17 nt, Pseudomonas aeruginosa PA01
guugcgcggcagguggc

SEQ ID NO: 3406444 - RNA, 21 nt, Pseudomonas aeruginosa PA01
guugcgcuaucggcccggggc

SEQ ID NO: 3406445 - RNA, 19 nt, Pseudomonas aeruginosa PA01
guugcgcuccacccaggcg

SEQ ID NO: 3406446 - RNA, 20 nt, Pseudomonas aeruginosa PA01
guugcgcuccauccagucgg

SEQ ID NO: 3406447 - RNA, 16 nt, Pseudomonas aeruginosa PA01
guugcgcuccgguggc

SEQ ID NO: 3406448 - RNA, 14 nt, Pseudomonas aeruginosa PA01
guugcgcuggcgca

SEQ ID NO: 3406449 - RNA, 22 nt, Pseudomonas aeruginosa PA01
guugcggaaagcgacgccgcga

SEQ ID NO: 3406450 - RNA, 12 nt, Pseudomonas aeruginosa PA01
guugcggagagg

SEQ ID NO: 3406451 - RNA, 15 nt, Pseudomonas aeruginosa PA01
guugcggcccagcgg

SEQ ID NO: 3406452 - RNA, 20 nt, Pseudomonas aeruginosa PA01
guugcggcccagcggcaggu

SEQ ID NO: 3406453 - RNA, 13 nt, Pseudomonas aeruginosa PA01
guugcggcccuuc

SEQ ID NO: 3406454 - RNA, 13 nt, Pseudomonas aeruginosa PA01
guugcggcgccgg

SEQ ID NO: 3406455 - RNA, 22 nt, Pseudomonas aeruginosa PA01
guugcggcgccgguugcugcug

SEQ ID NO: 3406456 - RNA, 12 nt, Pseudomonas aeruginosa PA01
guugcggcgggu

SEQ ID NO: 3406457 - RNA, 20 nt, Pseudomonas aeruginosa PA01
guugcggcgggucacgccga

SEQ ID NO: 3406458 - RNA, 20 nt, Pseudomonas aeruginosa PA01
guugcggucgcgcccgcugu

SEQ ID NO: 3406459 - RNA, 18 nt, Pseudomonas aeruginosa PA01
guugcgguuauucgcccu

SEQ ID NO: 3406460 - RNA, 19 nt, Pseudomonas aeruginosa PA01
guugcgguuauucgcccua

SEQ ID NO: 3406461 - RNA, 16 nt, Pseudomonas aeruginosa PA01
guugcguuccaacugg

SEQ ID NO: 3406462 - RNA, 20 nt, Pseudomonas aeruginosa PA01
guugcuccugcggcuggcga

SEQ ID NO: 3406463 - RNA, 17 nt, Pseudomonas aeruginosa PA01
guugcucgaaugcuguu

SEQ ID NO: 3406464 - RNA, 23 nt, Pseudomonas aeruginosa PA01
guugcucgagccguuccaggcgg

SEQ ID NO: 3406465 - RNA, 16 nt, Pseudomonas aeruginosa PA01
guugcucgcaccaggc

SEQ ID NO: 3406466 - RNA, 20 nt, Pseudomonas aeruginosa PA01
guugcucgcaccaggccagg

SEQ ID NO: 3406467 - RNA, 21 nt, Pseudomonas aeruginosa PA01
guugcucgcaccaggccaggu

SEQ ID NO: 3406468 - RNA, 17 nt, Pseudomonas aeruginosa PA01
guugcugaucaggccga

SEQ ID NO: 3406469 - RNA, 16 nt, Pseudomonas aeruginosa PA01
guugcugcccuggcgc

SEQ ID NO: 3406470 - RNA, 18 nt, Pseudomonas aeruginosa PA01
guugcugcuugcgcgcgg

SEQ ID NO: 3406471 - RNA, 12 nt, Pseudomonas aeruginosa PA01
guugcuggccgg

SEQ ID NO: 3406472 - RNA, 14 nt, Pseudomonas aeruginosa PA01
guugcuuccaggca

SEQ ID NO: 3406473 - RNA, 19 nt, Pseudomonas aeruginosa PA01
guugcuuguguccgccgag

SEQ ID NO: 3406474 - RNA, 21 nt, Pseudomonas aeruginosa PA01
guugcuuguguccgccgaggu

SEQ ID NO: 3406475 - RNA, 21 nt, Pseudomonas aeruginosa PA01
guuggaauaguggaucgcccg

SEQ ID NO: 3406476 - RNA, 17 nt, Pseudomonas aeruginosa PA01
guuggacagguccugga

SEQ ID NO: 3406477 - RNA, 14 nt, Pseudomonas aeruginosa PA01
guuggacgcggccu

SEQ ID NO: 3406478 - RNA, 15 nt, Pseudomonas aeruginosa PA01
guuggacgcggccug

SEQ ID NO: 3406479 - RNA, 22 nt, Pseudomonas aeruginosa PA01
guuggcacgacgcucggacagc

SEQ ID NO: 3406480 - RNA, 14 nt, Pseudomonas aeruginosa PA01
guuggcauccggcu

SEQ ID NO: 3406481 - RNA, 14 nt, Pseudomonas aeruginosa PA01
guuggccaccugca

SEQ ID NO: 3406482 - RNA, 17 nt, Pseudomonas aeruginosa PA01
guuggccagcaggcgcc

SEQ ID NO: 3406483 - RNA, 18 nt, Pseudomonas aeruginosa PA01
guuggccagcaggcgccg

SEQ ID NO: 3406484 - RNA, 13 nt, Pseudomonas aeruginosa PA01
guuggccagcgcc

SEQ ID NO: 3406485 - RNA, 22 nt, Pseudomonas aeruginosa PA01
guuggccagcgccaccagcagg

SEQ ID NO: 3406486 - RNA, 18 nt, Pseudomonas aeruginosa PA01
guuggcccaauccgcgcc

SEQ ID NO: 3406487 - RNA, 19 nt, Pseudomonas aeruginosa PA01
guuggcccaauccgcgccg

SEQ ID NO: 3406488 - RNA, 21 nt, Pseudomonas aeruginosa PA01
guuggcccaauccgcgccggu

SEQ ID NO: 3406489 - RNA, 14 nt, Pseudomonas aeruginosa PA01
guuggcccagaccu

SEQ ID NO: 3406490 - RNA, 14 nt, Pseudomonas aeruginosa PA01
guuggccccgccga

SEQ ID NO: 3406491 - RNA, 19 nt, Pseudomonas aeruginosa PA01
guuggccgaggaggccagc

SEQ ID NO: 3406492 - RNA, 14 nt, Pseudomonas aeruginosa PA01
guuggccgccuggc

SEQ ID NO: 3406493 - RNA, 17 nt, Pseudomonas aeruginosa PA01
guuggccgccuggcgca

SEQ ID NO: 3406494 - RNA, 15 nt, Pseudomonas aeruginosa PA01
guuggccggcugcuc

SEQ ID NO: 3406495 - RNA, 20 nt, Pseudomonas aeruginosa PA01
guuggccgucuccaggcgcg

SEQ ID NO: 3406496 - RNA, 21 nt, Pseudomonas aeruginosa PA01
guuggccgucuccaggcgcgc

SEQ ID NO: 3406497 - RNA, 15 nt, Pseudomonas aeruginosa PA01
guuggccuggcccgg

SEQ ID NO: 3406498 - RNA, 16 nt, Pseudomonas aeruginosa PA01
guuggccuggcccggc

SEQ ID NO: 3406499 - RNA, 18 nt, Pseudomonas aeruginosa PA01
guuugcggcgcaggcgga

SEQ ID NO: 3406500 - RNA, 19 nt, Pseudomonas aeruginosa PA01
guuuucaggcgacgccgcg

SEQ ID NO: 3406501 - RNA, 16 nt, Pseudomonas aeruginosa PA01
guuuucauuuuccauu

SEQ ID NO: 3406502 - RNA, 14 nt, Pseudomonas aeruginosa PA01
guuuuccauggcga

SEQ ID NO: 3406503 - RNA, 17 nt, Pseudomonas aeruginosa PA01
guuuuccgguugcagcc

SEQ ID NO: 3406504 - RNA, 15 nt, Pseudomonas aeruginosa PA01
guuuuccuggcccug

SEQ ID NO: 3406505 - RNA, 20 nt, Pseudomonas aeruginosa PA01
guuuucuuuuugcgccaggu

SEQ ID NO: 3406506 - RNA, 18 nt, Pseudomonas aeruginosa PA01
guuuuucauugggcagcc

SEQ ID NO: 3406507 - RNA, 20 nt, Pseudomonas aeruginosa PA01
uaaaaagccccgcuucggcg

SEQ ID NO: 3406508 - RNA, 17 nt, Pseudomonas aeruginosa PA01
uaaaauccacaaucuau

SEQ ID NO: 3406509 - RNA, 16 nt, Pseudomonas aeruginosa PA01
uaaaauggcgcgccuc

SEQ ID NO: 3406510 - RNA, 21 nt, Pseudomonas aeruginosa PA01
uaaacggcaugcacgcccugg

SEQ ID NO: 3406511 - RNA, 17 nt, Pseudomonas aeruginosa PA01
uaaagaaaaggccgcgu

SEQ ID NO: 3406512 - RNA, 21 nt, Pseudomonas aeruginosa PA01
uaaagcuggaccaccguggcg

SEQ ID NO: 3406513 - RNA, 22 nt, Pseudomonas aeruginosa PA01
uaaaugcccgggagguuugcca

SEQ ID NO: 3406514 - RNA, 18 nt, Pseudomonas aeruginosa PA01
uaaaugcuugaaaaucaa

SEQ ID NO: 3406515 - RNA, 22 nt, Pseudomonas aeruginosa PA01
uaaaugcuugaaaaucaaggau

SEQ ID NO: 3406516 - RNA, 21 nt, Pseudomonas aeruginosa PA01
uaacaagucgaaucaagcaau

SEQ ID NO: 3406517 - RNA, 22 nt, Pseudomonas aeruginosa PA01
uaaccgcucgcgguuauccgcc

SEQ ID NO: 3406518 - RNA, 20 nt, Pseudomonas aeruginosa PA01
uaacgccaacggcguuaucc

SEQ ID NO: 3406519 - RNA, 20 nt, Pseudomonas aeruginosa PA01
uaacgccacaggcguuaucc

SEQ ID NO: 3406520 - RNA, 17 nt, Pseudomonas aeruginosa PA01
uaacgccccucuuccac

SEQ ID NO: 3406521 - RNA, 12 nt, Pseudomonas aeruginosa PA01
uaacggcagccg

SEQ ID NO: 3406522 - RNA, 23 nt, Pseudomonas aeruginosa PA01
uaacggcagccgcguugucccug

SEQ ID NO: 3406523 - RNA, 21 nt, Pseudomonas aeruginosa PA01
uaacgguagcggcaggagcau

SEQ ID NO: 3406524 - RNA, 15 nt, Pseudomonas aeruginosa PA01
uaacguuacgcagau

SEQ ID NO: 3406525 - RNA, 22 nt, Pseudomonas aeruginosa PA01
uaacguuacgcagauagaggcg

SEQ ID NO: 3406526 - RNA, 12 nt, Pseudomonas aeruginosa PA01
uaagagaaugcg

SEQ ID NO: 3406527 - RNA, 19 nt, Pseudomonas aeruginosa PA01
uaagagaaugcgauugcug

SEQ ID NO: 3406528 - RNA, 20 nt, Pseudomonas aeruginosa PA01
uaagccgcgccaucggucgc

SEQ ID NO: 3406529 - RNA, 22 nt, Pseudomonas aeruginosa PA01
uaagcggccuuuucucugcauc

SEQ ID NO: 3406530 - RNA, 18 nt, Pseudomonas aeruginosa PA01
uaaggaaaaacccggccc

SEQ ID NO: 3406531 - RNA, 19 nt, Pseudomonas aeruginosa PA01
uaaggcaugcccaggcucg

SEQ ID NO: 3406532 - RNA, 14 nt, Pseudomonas aeruginosa PA01
uaagugccgaccac

SEQ ID NO: 3406533 - RNA, 20 nt, Pseudomonas aeruginosa PA01
uaagugccgaccacaugggc

SEQ ID NO: 3406534 - RNA, 21 nt, Pseudomonas aeruginosa PA01
uaaucaccuuccucgcgccuu

SEQ ID NO: 3406535 - RNA, 19 nt, Pseudomonas aeruginosa PA01
uaauccagggagaacagca

SEQ ID NO: 3406536 - RNA, 19 nt, Pseudomonas aeruginosa PA01
uaauccggcacuuugcauc

SEQ ID NO: 3406537 - RNA, 22 nt, Pseudomonas aeruginosa PA01
uaaucgaaggucaggucgaggg

SEQ ID NO: 3406538 - RNA, 19 nt, Pseudomonas aeruginosa PA01
uaaucgccauuggccaggg

SEQ ID NO: 3406539 - RNA, 22 nt, Pseudomonas aeruginosa PA01
uaaugacgaucucgaugaccuu

SEQ ID NO: 3406540 - RNA, 23 nt, Pseudomonas aeruginosa PA01
uaauggcaccuggauaucaccuc

SEQ ID NO: 3406541 - RNA, 21 nt, Pseudomonas aeruginosa PA01
uaauucgcugacgaggacgcc

SEQ ID NO: 3406542 - RNA, 23 nt, Pseudomonas aeruginosa PA01
uaauugcgagcgagcuugcaauc

SEQ ID NO: 3406543 - RNA, 22 nt, Pseudomonas aeruginosa PA01
uacaaagcauuucuucaccacc

SEQ ID NO: 3406544 - RNA, 23 nt, Pseudomonas aeruginosa PA01
uacaagagcagacacaaaaaacc

SEQ ID NO: 3406545 - RNA, 12 nt, Pseudomonas aeruginosa PA01
uacaccgagcgc

SEQ ID NO: 3406546 - RNA, 17 nt, Pseudomonas aeruginosa PA01
uacaccgagcgcaguuc

SEQ ID NO: 3406547 - RNA, 18 nt, Pseudomonas aeruginosa PA01
uacaccgcugcgccgccg

SEQ ID NO: 3406548 - RNA, 19 nt, Pseudomonas aeruginosa PA01
uacaccgcugcgccgccgu

SEQ ID NO: 3406549 - RNA, 20 nt, Pseudomonas aeruginosa PA01
uacaccgcugcgccgccguc

SEQ ID NO: 3406550 - RNA, 19 nt, Pseudomonas aeruginosa PA01
uacaccugcaacucggcgu

SEQ ID NO: 3406551 - RNA, 20 nt, Pseudomonas aeruginosa PA01
uacaccuugcgacaggcuuc

SEQ ID NO: 3406552 - RNA, 14 nt, Pseudomonas aeruginosa PA01
uacagcaauuacac

SEQ ID NO: 3406553 - RNA, 22 nt, Pseudomonas aeruginosa PA01
uacagcaauuacacccaacuug

SEQ ID NO: 3406554 - RNA, 13 nt, Pseudomonas aeruginosa PA01
uacagcaggaaaa

SEQ ID NO: 3406555 - RNA, 13 nt, Pseudomonas aeruginosa PA01
uacagcaggagcg

SEQ ID NO: 3406556 - RNA, 20 nt, Pseudomonas aeruginosa PA01
uacagcaggagcgccaucag

SEQ ID NO: 3406557 - RNA, 16 nt, Pseudomonas aeruginosa PA01
uacagcccccccagca

SEQ ID NO: 3406558 - RNA, 16 nt, Pseudomonas aeruginosa PA01
uacagcccccgccggc

SEQ ID NO: 3406559 - RNA, 19 nt, Pseudomonas aeruginosa PA01
uacagccugacguugccgc

SEQ ID NO: 3406560 - RNA, 20 nt, Pseudomonas aeruginosa PA01
uacagcgacucgcugccggc

SEQ ID NO: 3406561 - RNA, 12 nt, Pseudomonas aeruginosa PA01
uacagcgccacg

SEQ ID NO: 3406562 - RNA, 15 nt, Pseudomonas aeruginosa PA01
uacagcgccacggcc

SEQ ID NO: 3406563 - RNA, 19 nt, Pseudomonas aeruginosa PA01
uacagcgccacggccagca

SEQ ID NO: 3406564 - RNA, 18 nt, Pseudomonas aeruginosa PA01
uacagcgccuggucggcg

SEQ ID NO: 3406565 - RNA, 22 nt, Pseudomonas aeruginosa PA01
uacagcgccuggucggcggccu

SEQ ID NO: 3406566 - RNA, 19 nt, Pseudomonas aeruginosa PA01
uacagcgcgacaucggcga

SEQ ID NO: 3406567 - RNA, 16 nt, Pseudomonas aeruginosa PA01
uacagcgggccgggga

SEQ ID NO: 3406568 - RNA, 22 nt, Pseudomonas aeruginosa PA01
uacagcucgcugucgccgagca

SEQ ID NO: 3406569 - RNA, 15 nt, Pseudomonas aeruginosa PA01
uacagcucggcgccc

SEQ ID NO: 3406570 - RNA, 19 nt, Pseudomonas aeruginosa PA01
uacagcucggcgcccuggc

SEQ ID NO: 3406571 - RNA, 14 nt, Pseudomonas aeruginosa PA01
uacagcucguccuu

SEQ ID NO: 3406572 - RNA, 19 nt, Pseudomonas aeruginosa PA01
uacagcuucaggcgcacua

SEQ ID NO: 3406573 - RNA, 20 nt, Pseudomonas aeruginosa PA01
uacaggacugugcuuaauac

SEQ ID NO: 3406574 - RNA, 13 nt, Pseudomonas aeruginosa PA01
uacaggcgcgccu

SEQ ID NO: 3406575 - RNA, 22 nt, Pseudomonas aeruginosa PA01
uacaggcgcgccuggcccuggc

SEQ ID NO: 3406576 - RNA, 15 nt, Pseudomonas aeruginosa PA01
uacaggucggcgccg

SEQ ID NO: 3406577 - RNA, 15 nt, Pseudomonas aeruginosa PA01
uacaguucaggcugg

SEQ ID NO: 3406578 - RNA, 16 nt, Pseudomonas aeruginosa PA01
uacaucgggauaccgg

SEQ ID NO: 3406579 - RNA, 19 nt, Pseudomonas aeruginosa PA01
uacaucgggauaccggcca

SEQ ID NO: 3406580 - RNA, 17 nt, Pseudomonas aeruginosa PA01
uaccacccgcagccccg

SEQ ID NO: 3406581 - RNA, 16 nt, Pseudomonas aeruginosa PA01
uaccaccgggccgucg

SEQ ID NO: 3406582 - RNA, 19 nt, Pseudomonas aeruginosa PA01
uaccaccgugcccgccggc

SEQ ID NO: 3406583 - RNA, 14 nt, Pseudomonas aeruginosa PA01
uaccacgcagccac

SEQ ID NO: 3406584 - RNA, 17 nt, Pseudomonas aeruginosa PA01
uaccacgggcaguucca

SEQ ID NO: 3406585 - RNA, 18 nt, Pseudomonas aeruginosa PA01
uaccacguggccggcgcg

SEQ ID NO: 3406586 - RNA, 18 nt, Pseudomonas aeruginosa PA01
uaccagaagccggccggg

SEQ ID NO: 3406587 - RNA, 14 nt, Pseudomonas aeruginosa PA01
uaccagaccgcagc

SEQ ID NO: 3406588 - RNA, 17 nt, Pseudomonas aeruginosa PA01
uaccagaccgcagccgg

SEQ ID NO: 3406589 - RNA, 12 nt, Pseudomonas aeruginosa PA01
uaccagcagcgc

SEQ ID NO: 3406590 - RNA, 22 nt, Pseudomonas aeruginosa PA01
uaccagccgcgguccaucccuu

SEQ ID NO: 3406591 - RNA, 16 nt, Pseudomonas aeruginosa PA01
uaccagcgcaccaggg

SEQ ID NO: 3406592 - RNA, 13 nt, Pseudomonas aeruginosa PA01
uaccagcgccgcu

SEQ ID NO: 3406593 - RNA, 17 nt, Pseudomonas aeruginosa PA01
uaccagcuugucgccuu

SEQ ID NO: 3406594 - RNA, 18 nt, Pseudomonas aeruginosa PA01
uaccagcuugucgccuuc

SEQ ID NO: 3406595 - RNA, 22 nt, Pseudomonas aeruginosa PA01
uaccaggaagcucggcagcacg

SEQ ID NO: 3406596 - RNA, 13 nt, Pseudomonas aeruginosa PA01
uaccaggaccagc

SEQ ID NO: 3406597 - RNA, 18 nt, Pseudomonas aeruginosa PA01
uaccaggaccagcgccug

SEQ ID NO: 3406598 - RNA, 16 nt, Pseudomonas aeruginosa PA01
uaccagggaagcgcgc

SEQ ID NO: 3406599 - RNA, 23 nt, Pseudomonas aeruginosa PA01
uaccaggguguugucgcggcuga

SEQ ID NO: 3406600 - RNA, 17 nt, Pseudomonas aeruginosa PA01
uaccaguagcgacagca

SEQ ID NO: 3406601 - RNA, 20 nt, Pseudomonas aeruginosa PA01
uacggauucucucccaggag

SEQ ID NO: 3406602 - RNA, 19 nt, Pseudomonas aeruginosa PA01
uacggcaggguagccacgc

SEQ ID NO: 3406603 - RNA, 22 nt, Pseudomonas aeruginosa PA01
uacggcaggguagccacgccgg

SEQ ID NO: 3406604 - RNA, 16 nt, Pseudomonas aeruginosa PA01
uacggcaucaccggcg

SEQ ID NO: 3406605 - RNA, 19 nt, Pseudomonas aeruginosa PA01
uacggccccaggcugccca

SEQ ID NO: 3406606 - RNA, 13 nt, Pseudomonas aeruginosa PA01
uacggcgcagcag

SEQ ID NO: 3406607 - RNA, 17 nt, Pseudomonas aeruginosa PA01
uacggcgcagcagggcg

SEQ ID NO: 3406608 - RNA, 18 nt, Pseudomonas aeruginosa PA01
uacggcggggucgggcag

SEQ ID NO: 3406609 - RNA, 17 nt, Pseudomonas aeruginosa PA01
uacggcuccggcuccgc

SEQ ID NO: 3406610 - RNA, 14 nt, Pseudomonas aeruginosa PA01
uacggcucuugaaa

SEQ ID NO: 3406611 - RNA, 21 nt, Pseudomonas aeruginosa PA01
uacggggcgugucgagggcug

SEQ ID NO: 3406612 - RNA, 19 nt, Pseudomonas aeruginosa PA01
uacggguggcaugggccag

SEQ ID NO: 3406613 - RNA, 14 nt, Pseudomonas aeruginosa PA01
uacgguacaguuca

SEQ ID NO: 3406614 - RNA, 23 nt, Pseudomonas aeruginosa PA01
uacggucaugccgaacuucuccg

SEQ ID NO: 3406615 - RNA, 14 nt, Pseudomonas aeruginosa PA01
uacguacucgucgc

SEQ ID NO: 3406616 - RNA, 13 nt, Pseudomonas aeruginosa PA01
uacguagcgcggu

SEQ ID NO: 3406617 - RNA, 21 nt, Pseudomonas aeruginosa PA01
uacgugggggauuuccucguc

SEQ ID NO: 3406618 - RNA, 17 nt, Pseudomonas aeruginosa PA01
uacuaucccggucgggu

SEQ ID NO: 3406619 - RNA, 16 nt, Pseudomonas aeruginosa PA01
uacucaugcaggcguc

SEQ ID NO: 3406620 - RNA, 15 nt, Pseudomonas aeruginosa PA01
uacuccagcagcgca

SEQ ID NO: 3406621 - RNA, 19 nt, Pseudomonas aeruginosa PA01
uacuccgagggccgcgccg

SEQ ID NO: 3406622 - RNA, 22 nt, Pseudomonas aeruginosa PA01
uacuccgagggccgcgccgacc

SEQ ID NO: 3406623 - RNA, 22 nt, Pseudomonas aeruginosa PA01
uacuccgccggcguugcgcgcc

SEQ ID NO: 3406624 - RNA, 21 nt, Pseudomonas aeruginosa PA01
uacuccuggcauggcuuucca

SEQ ID NO: 3406625 - RNA, 14 nt, Pseudomonas aeruginosa PA01
uacucgacgcugcc

SEQ ID NO: 3406626 - RNA, 13 nt, Pseudomonas aeruginosa PA01
uacucgccgggcg

SEQ ID NO: 3406627 - RNA, 20 nt, Pseudomonas aeruginosa PA01
uacucggcccgggccuggug

SEQ ID NO: 3406628 - RNA, 15 nt, Pseudomonas aeruginosa PA01
uacucgugggccggu

SEQ ID NO: 3406629 - RNA, 19 nt, Pseudomonas aeruginosa PA01
uacucguguuccggcagga

SEQ ID NO: 3406630 - RNA, 15 nt, Pseudomonas aeruginosa PA01
uacugcacgcccagg

SEQ ID NO: 3406631 - RNA, 22 nt, Pseudomonas aeruginosa PA01
uacugcuucaugaagucagcca

SEQ ID NO: 3406632 - RNA, 14 nt, Pseudomonas aeruginosa PA01
uacuggccgaaauu

SEQ ID NO: 3406633 - RNA, 21 nt, Pseudomonas aeruginosa PA01
uacuggccgaaauugaccagg

SEQ ID NO: 3406634 - RNA, 17 nt, Pseudomonas aeruginosa PA01
uacuggcgccaggccgc

SEQ ID NO: 3406635 - RNA, 18 nt, Pseudomonas aeruginosa PA01
uacuggcgcugcgcggcg

SEQ ID NO: 3406636 - RNA, 18 nt, Pseudomonas aeruginosa PA01
uacuggucgcgcgcggcc

SEQ ID NO: 3406637 - RNA, 16 nt, Pseudomonas aeruginosa PA01
uacuugacggcgccga

SEQ ID NO: 3406638 - RNA, 22 nt, Pseudomonas aeruginosa PA01
uagaaaagaaaauuuucgaaaa

SEQ ID NO: 3406639 - RNA, 18 nt, Pseudomonas aeruginosa PA01
uagaaaccgauguuggug

SEQ ID NO: 3406640 - RNA, 18 nt, Pseudomonas aeruginosa PA01
uagaaaugguggaccagc

SEQ ID NO: 3406641 - RNA, 15 nt, Pseudomonas aeruginosa PA01
uagaacggcggcaac

SEQ ID NO: 3406642 - RNA, 15 nt, Pseudomonas aeruginosa PA01
uagaagcgcgcggua

SEQ ID NO: 3406643 - RNA, 20 nt, Pseudomonas aeruginosa PA01
uagaaggcguccaccggcgc

SEQ ID NO: 3406644 - RNA, 19 nt, Pseudomonas aeruginosa PA01
uagaaggugcccagcggcg

SEQ ID NO: 3406645 - RNA, 20 nt, Pseudomonas aeruginosa PA01
uagaaggugcccagcggcgc

SEQ ID NO: 3406646 - RNA, 13 nt, Pseudomonas aeruginosa PA01
uagaccaccagca

SEQ ID NO: 3406647 - RNA, 15 nt, Pseudomonas aeruginosa PA01
uagaccaccagcagg

SEQ ID NO: 3406648 - RNA, 19 nt, Pseudomonas aeruginosa PA01
uagaccaccagcaggaucg

SEQ ID NO: 3406649 - RNA, 13 nt, Pseudomonas aeruginosa PA01
uagaccaccagcg

SEQ ID NO: 3406650 - RNA, 17 nt, Pseudomonas aeruginosa PA01
uagaccacgcaggccag

SEQ ID NO: 3406651 - RNA, 18 nt, Pseudomonas aeruginosa PA01
uagaccacgcaggccagc

SEQ ID NO: 3406652 - RNA, 23 nt, Pseudomonas aeruginosa PA01
uagaccacgcaggccagcgccag

SEQ ID NO: 3406653 - RNA, 19 nt, Pseudomonas aeruginosa PA01
uagaccagcaccgccugca

SEQ ID NO: 3406654 - RNA, 13 nt, Pseudomonas aeruginosa PA01
uagaccagcagcg

SEQ ID NO: 3406655 - RNA, 16 nt, Pseudomonas aeruginosa PA01
uagaccagcagcgagc

SEQ ID NO: 3406656 - RNA, 16 nt, Pseudomonas aeruginosa PA01
uagaccaucgccggcg

SEQ ID NO: 3406657 - RNA, 15 nt, Pseudomonas aeruginosa PA01
uagaccaucugccag

SEQ ID NO: 3406658 - RNA, 21 nt, Pseudomonas aeruginosa PA01
uagaccccggugugcgcugca

SEQ ID NO: 3406659 - RNA, 14 nt, Pseudomonas aeruginosa PA01
uagaccuucucguc

SEQ ID NO: 3406660 - RNA, 14 nt, Pseudomonas aeruginosa PA01
uagacgcaggugcc

SEQ ID NO: 3406661 - RNA, 13 nt, Pseudomonas aeruginosa PA01
uagacgccggcga

SEQ ID NO: 3406662 - RNA, 23 nt, Pseudomonas aeruginosa PA01
uagacgccucccaccgcgcggca

SEQ ID NO: 3406663 - RNA, 18 nt, Pseudomonas aeruginosa PA01
uagacgcgcacgucaccg

SEQ ID NO: 3406664 - RNA, 15 nt, Pseudomonas aeruginosa PA01
uagagaugcaccggc

SEQ ID NO: 3406665 - RNA, 15 nt, Pseudomonas aeruginosa PA01
uagagaugcagcagg

SEQ ID NO: 3406666 - RNA, 14 nt, Pseudomonas aeruginosa PA01
uagagauucuuccg

SEQ ID NO: 3406667 - RNA, 16 nt, Pseudomonas aeruginosa PA01
uagagcagcccgggca

SEQ ID NO: 3406668 - RNA, 20 nt, Pseudomonas aeruginosa PA01
uagagcgggccguuggcuuc

SEQ ID NO: 3406669 - RNA, 16 nt, Pseudomonas aeruginosa PA01
uagagcuucccgcaug

SEQ ID NO: 3406670 - RNA, 17 nt, Pseudomonas aeruginosa PA01
uagaggaucuccgaguc

SEQ ID NO: 3406671 - RNA, 17 nt, Pseudomonas aeruginosa PA01
uagaggaugccggccuc

SEQ ID NO: 3406672 - RNA, 19 nt, Pseudomonas aeruginosa PA01
uagaggaugccggccucga

SEQ ID NO: 3406673 - RNA, 22 nt, Pseudomonas aeruginosa PA01
uagaggaugccggccucgagga

SEQ ID NO: 3406674 - RNA, 13 nt, Pseudomonas aeruginosa PA01
uagaguacucggc

SEQ ID NO: 3406675 - RNA, 20 nt, Pseudomonas aeruginosa PA01
uagaguacucggcuacgaac

SEQ ID NO: 3406676 - RNA, 22 nt, Pseudomonas aeruginosa PA01
uagaucauuuuccgggucaugc

SEQ ID NO: 3406677 - RNA, 22 nt, Pseudomonas aeruginosa PA01
uagaucgcccgcaguuccucgc

SEQ ID NO: 3406678 - RNA, 15 nt, Pseudomonas aeruginosa PA01
uagaucugcaccgcc

SEQ ID NO: 3406679 - RNA, 21 nt, Pseudomonas aeruginosa PA01
uagaugaacuggucgcuccag

SEQ ID NO: 3406680 - RNA, 23 nt, Pseudomonas aeruginosa PA01
uagaugccacugacgcgcagcgc

SEQ ID NO: 3406681 - RNA, 14 nt, Pseudomonas aeruginosa PA01
uagaugccgcccug

SEQ ID NO: 3406682 - RNA, 20 nt, Pseudomonas aeruginosa PA01
uagauguggguauccagcgg

SEQ ID NO: 3406683 - RNA, 16 nt, Pseudomonas aeruginosa PA01
uagcagccauagcaau

SEQ ID NO: 3406684 - RNA, 18 nt, Pseudomonas aeruginosa PA01
uagcagccauagcaauac

SEQ ID NO: 3406685 - RNA, 19 nt, Pseudomonas aeruginosa PA01
uagcagccguccagcuuga

SEQ ID NO: 3406686 - RNA, 17 nt, Pseudomonas aeruginosa PA01
uagcagcgccgcgccug

SEQ ID NO: 3406687 - RNA, 17 nt, Pseudomonas aeruginosa PA01
uagcaggccuggagcgc

SEQ ID NO: 3406688 - RNA, 15 nt, Pseudomonas aeruginosa PA01
uagccaggggucagg

SEQ ID NO: 3406689 - RNA, 16 nt, Pseudomonas aeruginosa PA01
uagccaggggucaggc

SEQ ID NO: 3406690 - RNA, 19 nt, Pseudomonas aeruginosa PA01
uagccaggggucaggccga

SEQ ID NO: 3406691 - RNA, 19 nt, Pseudomonas aeruginosa PA01
uagccaugcacacgcuccc

SEQ ID NO: 3406692 - RNA, 22 nt, Pseudomonas aeruginosa PA01
uagcccauggucagcgguaggu

SEQ ID NO: 3406693 - RNA, 12 nt, Pseudomonas aeruginosa PA01
uagccccggccc

SEQ ID NO: 3406694 - RNA, 14 nt, Pseudomonas aeruginosa PA01
uagccccucgcgca

SEQ ID NO: 3406695 - RNA, 12 nt, Pseudomonas aeruginosa PA01
uagcccgcggcg

SEQ ID NO: 3406696 - RNA, 15 nt, Pseudomonas aeruginosa PA01
uagcccgcggcgagc

SEQ ID NO: 3406697 - RNA, 18 nt, Pseudomonas aeruginosa PA01
uagcccgcggcgagcagc

SEQ ID NO: 3406698 - RNA, 22 nt, Pseudomonas aeruginosa PA01
uagcccgcggcgagcagcggcg

SEQ ID NO: 3406699 - RNA, 18 nt, Pseudomonas aeruginosa PA01
uagcccgggaucgaugcg

SEQ ID NO: 3406700 - RNA, 19 nt, Pseudomonas aeruginosa PA01
uagcccggguugcccucgc

SEQ ID NO: 3406701 - RNA, 14 nt, Pseudomonas aeruginosa PA01
uagcccucgaccug

SEQ ID NO: 3406702 - RNA, 12 nt, Pseudomonas aeruginosa PA01
uagcccugcugc

SEQ ID NO: 3406703 - RNA, 12 nt, Pseudomonas aeruginosa PA01
uagcccugggcg

SEQ ID NO: 3406704 - RNA, 20 nt, Pseudomonas aeruginosa PA01
uagcugcagcgccccagcac

SEQ ID NO: 3406705 - RNA, 15 nt, Pseudomonas aeruginosa PA01
uagcugcgcagggcg

SEQ ID NO: 3406706 - RNA, 13 nt, Pseudomonas aeruginosa PA01
uagcuggcgcagg

SEQ ID NO: 3406707 - RNA, 18 nt, Pseudomonas aeruginosa PA01
uagcuguagcggcuugca

SEQ ID NO: 3406708 - RNA, 20 nt, Pseudomonas aeruginosa PA01
uagcuguagcggcuugcagu

SEQ ID NO: 3406709 - RNA, 15 nt, Pseudomonas aeruginosa PA01
uagcuuuccagggca

SEQ ID NO: 3406710 - RNA, 18 nt, Pseudomonas aeruginosa PA01
uaggaacgugcggccugc

SEQ ID NO: 3406711 - RNA, 15 nt, Pseudomonas aeruginosa PA01
uaggacaccgcccuu

SEQ ID NO: 3406712 - RNA, 15 nt, Pseudomonas aeruginosa PA01
uaggacagggccagg

SEQ ID NO: 3406713 - RNA, 19 nt, Pseudomonas aeruginosa PA01
uaggacagggccaggccga

SEQ ID NO: 3406714 - RNA, 18 nt, Pseudomonas aeruginosa PA01
uaggacgccucgucggag

SEQ ID NO: 3406715 - RNA, 19 nt, Pseudomonas aeruginosa PA01
uaggagaugcagcgucgcg

SEQ ID NO: 3406716 - RNA, 16 nt, Pseudomonas aeruginosa PA01
uaggagccggccaggc

SEQ ID NO: 3406717 - RNA, 15 nt, Pseudomonas aeruginosa PA01
uaggagccgucgccg

SEQ ID NO: 3406718 - RNA, 19 nt, Pseudomonas aeruginosa PA01
uaggagccugcgugagcug

SEQ ID NO: 3406719 - RNA, 20 nt, Pseudomonas aeruginosa PA01
uaggagcgagagcgcugccg

SEQ ID NO: 3406720 - RNA, 20 nt, Pseudomonas aeruginosa PA01
uaggaugccgagguguagaa

SEQ ID NO: 3406721 - RNA, 17 nt, Pseudomonas aeruginosa PA01
uaggccacuucccggcg

SEQ ID NO: 3406722 - RNA, 21 nt, Pseudomonas aeruginosa PA01
uaggccagcagggucucgcug

SEQ ID NO: 3406723 - RNA, 14 nt, Pseudomonas aeruginosa PA01
uaggccagccccag

SEQ ID NO: 3406724 - RNA, 13 nt, Pseudomonas aeruginosa PA01
uaggccagcggcu

SEQ ID NO: 3406725 - RNA, 23 nt, Pseudomonas aeruginosa PA01
uaggccaggcagaccagcgcaag

SEQ ID NO: 3406726 - RNA, 16 nt, Pseudomonas aeruginosa PA01
uaggccaugaucaucg

SEQ ID NO: 3406727 - RNA, 18 nt, Pseudomonas aeruginosa PA01
uaggccaugaucaucgcc

SEQ ID NO: 3406728 - RNA, 23 nt, Pseudomonas aeruginosa PA01
uaggccaugaucaucgccugcug

SEQ ID NO: 3406729 - RNA, 21 nt, Pseudomonas aeruginosa PA01
uaggccgcuuccggcccggcc

SEQ ID NO: 3406730 - RNA, 21 nt, Pseudomonas aeruginosa PA01
uaggccggcgugcccauccgc

SEQ ID NO: 3406731 - RNA, 16 nt, Pseudomonas aeruginosa PA01
uaggccgucgcugccg

SEQ ID NO: 3406732 - RNA, 12 nt, Pseudomonas aeruginosa PA01
uaggccuggccg

SEQ ID NO: 3406733 - RNA, 13 nt, Pseudomonas aeruginosa PA01
uaggccuggccgc

SEQ ID NO: 3406734 - RNA, 16 nt, Pseudomonas aeruginosa PA01
uaggccuggccgccca

SEQ ID NO: 3406735 - RNA, 16 nt, Pseudomonas aeruginosa PA01
uaggccuuggcgaucu

SEQ ID NO: 3406736 - RNA, 22 nt, Pseudomonas aeruginosa PA01
uaggcgaacacgucggcgcgca

SEQ ID NO: 3406737 - RNA, 13 nt, Pseudomonas aeruginosa PA01
uaggcgaagccca

SEQ ID NO: 3406738 - RNA, 16 nt, Pseudomonas aeruginosa PA01
uaggcgacgaagcugg

SEQ ID NO: 3406739 - RNA, 15 nt, Pseudomonas aeruginosa PA01
uaggcgacgaucagc

SEQ ID NO: 3406740 - RNA, 17 nt, Pseudomonas aeruginosa PA01
uaggcgcaccaggccag

SEQ ID NO: 3406741 - RNA, 13 nt, Pseudomonas aeruginosa PA01
uaggcgccagccu

SEQ ID NO: 3406742 - RNA, 18 nt, Pseudomonas aeruginosa PA01
uaggcgccggcgcgcggc

SEQ ID NO: 3406743 - RNA, 21 nt, Pseudomonas aeruginosa PA01
uaggcgccggcgcgcggcggg

SEQ ID NO: 3406744 - RNA, 22 nt, Pseudomonas aeruginosa PA01
uaggcgcgcaacgcuuccagca

SEQ ID NO: 3406745 - RNA, 23 nt, Pseudomonas aeruginosa PA01
uaggcgcgcaacgcuuccagcac

SEQ ID NO: 3406746 - RNA, 18 nt, Pseudomonas aeruginosa PA01
uaggcgcgccaaggccgc

SEQ ID NO: 3406747 - RNA, 17 nt, Pseudomonas aeruginosa PA01
uaggcgcgggcggcggc

SEQ ID NO: 3406748 - RNA, 18 nt, Pseudomonas aeruginosa PA01
uaggcgcgggcggcggcg

SEQ ID NO: 3406749 - RNA, 22 nt, Pseudomonas aeruginosa PA01
uaggcgguggccacgucgcccc

SEQ ID NO: 3406750 - RNA, 16 nt, Pseudomonas aeruginosa PA01
uaggcgguggcgauca

SEQ ID NO: 3406751 - RNA, 17 nt, Pseudomonas aeruginosa PA01
uaggcucugcuccagca

SEQ ID NO: 3406752 - RNA, 18 nt, Pseudomonas aeruginosa PA01
uaggcucugcuccagcaa

SEQ ID NO: 3406753 - RNA, 15 nt, Pseudomonas aeruginosa PA01
uaggcuggaagccgc

SEQ ID NO: 3406754 - RNA, 14 nt, Pseudomonas aeruginosa PA01
uaggcuugcgccga

SEQ ID NO: 3406755 - RNA, 14 nt, Pseudomonas aeruginosa PA01
uaggcuuggucggg

SEQ ID NO: 3406756 - RNA, 14 nt, Pseudomonas aeruginosa PA01
uagggagcgacacc

SEQ ID NO: 3406757 - RNA, 13 nt, Pseudomonas aeruginosa PA01
uagggcaucagcc

SEQ ID NO: 3406758 - RNA, 18 nt, Pseudomonas aeruginosa PA01
uagggcaucgccgacagg

SEQ ID NO: 3406759 - RNA, 12 nt, Pseudomonas aeruginosa PA01
uagggccgaggu

SEQ ID NO: 3406760 - RNA, 21 nt, Pseudomonas aeruginosa PA01
uagggcgaacaaccgcucgcg

SEQ ID NO: 3406761 - RNA, 23 nt, Pseudomonas aeruginosa PA01
uagggcgaacaacgccgccggcg

SEQ ID NO: 3406762 - RNA, 22 nt, Pseudomonas aeruginosa PA01
uagggcgaauaaccgcaucgcg

SEQ ID NO: 3406763 - RNA, 18 nt, Pseudomonas aeruginosa PA01
uagggcgaauagcgccgc

SEQ ID NO: 3406764 - RNA, 23 nt, Pseudomonas aeruginosa PA01
uagggcgcauaacgccaacggcg

SEQ ID NO: 3406765 - RNA, 15 nt, Pseudomonas aeruginosa PA01
uagggcggcgcggcg

SEQ ID NO: 3406766 - RNA, 15 nt, Pseudomonas aeruginosa PA01
uaggggagcacggca

SEQ ID NO: 3406767 - RNA, 16 nt, Pseudomonas aeruginosa PA01
uagggggugaagcgca

SEQ ID NO: 3406768 - RNA, 22 nt, Pseudomonas aeruginosa PA01
uagguagagaugcagcagguag

SEQ ID NO: 3406769 - RNA, 19 nt, Pseudomonas aeruginosa PA01
uagguauccgccggccggg

SEQ ID NO: 3406770 - RNA, 23 nt, Pseudomonas aeruginosa PA01
uagguauccgccggccggggcgc

SEQ ID NO: 3406771 - RNA, 13 nt, Pseudomonas aeruginosa PA01
uaggucaccgcgc

SEQ ID NO: 3406772 - RNA, 15 nt, Pseudomonas aeruginosa PA01
uaggucaugcccagg

SEQ ID NO: 3406773 - RNA, 24 nt, Pseudomonas aeruginosa PA01
uaggugaagcccaggcgcucggcg

SEQ ID NO: 3406774 - RNA, 16 nt, Pseudomonas aeruginosa PA01
uaggugcgcuggcgcc

SEQ ID NO: 3406775 - RNA, 17 nt, Pseudomonas aeruginosa PA01
uagguggcgccgccggc

SEQ ID NO: 3406776 - RNA, 14 nt, Pseudomonas aeruginosa PA01
uagguggugcuggu

SEQ ID NO: 3406777 - RNA, 18 nt, Pseudomonas aeruginosa PA01
uagguuuccccguggcgc

SEQ ID NO: 3406778 - RNA, 16 nt, Pseudomonas aeruginosa PA01
uaguaggguucgccga

SEQ ID NO: 3406779 - RNA, 22 nt, Pseudomonas aeruginosa PA01
uaguccagcgguaccagcagcg

SEQ ID NO: 3406780 - RNA, 14 nt, Pseudomonas aeruginosa PA01
uaguccaucaccgc

SEQ ID NO: 3406781 - RNA, 19 nt, Pseudomonas aeruginosa PA01
uagucccagaccacccggc

SEQ ID NO: 3406782 - RNA, 22 nt, Pseudomonas aeruginosa PA01
uaguccuccgcgcccaggcgca

SEQ ID NO: 3406783 - RNA, 15 nt, Pseudomonas aeruginosa PA01
uagucgcccagcgcc

SEQ ID NO: 3406784 - RNA, 17 nt, Pseudomonas aeruginosa PA01
uagucgcccggcucgcc

SEQ ID NO: 3406785 - RNA, 18 nt, Pseudomonas aeruginosa PA01
uagucggugaagcgcggc

SEQ ID NO: 3406786 - RNA, 19 nt, Pseudomonas aeruginosa PA01
uagucggugaagcgcggcg

SEQ ID NO: 3406787 - RNA, 14 nt, Pseudomonas aeruginosa PA01
uagugcucggccag

SEQ ID NO: 3406788 - RNA, 16 nt, Pseudomonas aeruginosa PA01
uagugcucggccaguu

SEQ ID NO: 3406789 - RNA, 22 nt, Pseudomonas aeruginosa PA01
uagugcuggguggaggcccaga

SEQ ID NO: 3406790 - RNA, 22 nt, Pseudomonas aeruginosa PA01
uaguggcguuccaggcggcgga

SEQ ID NO: 3406791 - RNA, 21 nt, Pseudomonas aeruginosa PA01
uaguguugaagccgccaucga

SEQ ID NO: 3406792 - RNA, 14 nt, Pseudomonas aeruginosa PA01
uauacccggcgccc

SEQ ID NO: 3406793 - RNA, 13 nt, Pseudomonas aeruginosa PA01
uauagcuggucaa

SEQ ID NO: 3406794 - RNA, 22 nt, Pseudomonas aeruginosa PA01
uauaggagccugcgugagcugg

SEQ ID NO: 3406795 - RNA, 17 nt, Pseudomonas aeruginosa PA01
uauaggguuucucgcuc

SEQ ID NO: 3406796 - RNA, 22 nt, Pseudomonas aeruginosa PA01
uauccaccgucgcggucaucgc

SEQ ID NO: 3406797 - RNA, 14 nt, Pseudomonas aeruginosa PA01
uauccacgccgucg

SEQ ID NO: 3406798 - RNA, 14 nt, Pseudomonas aeruginosa PA01
uauccagcacccgc

SEQ ID NO: 3406799 - RNA, 23 nt, Pseudomonas aeruginosa PA01
uauccagcggccgcgaggacaac

SEQ ID NO: 3406800 - RNA, 18 nt, Pseudomonas aeruginosa PA01
uaucccagcgcgugcagg

SEQ ID NO: 3406801 - RNA, 21 nt, Pseudomonas aeruginosa PA01
uauccccccacccgucccgcg

SEQ ID NO: 3406802 - RNA, 15 nt, Pseudomonas aeruginosa PA01
uaucccgccgccgcg

SEQ ID NO: 3406803 - RNA, 15 nt, Pseudomonas aeruginosa PA01
uaucccggcugagcg

SEQ ID NO: 3406804 - RNA, 22 nt, Pseudomonas aeruginosa PA01
uaucccggcugagcgccaggcg

SEQ ID NO: 3406805 - RNA, 23 nt, Pseudomonas aeruginosa PA01
uauccgcccuacggaccggugcc

SEQ ID NO: 3406806 - RNA, 18 nt, Pseudomonas aeruginosa PA01
ucacccgcgaaugcuccg

SEQ ID NO: 3406807 - RNA, 16 nt, Pseudomonas aeruginosa PA01
ucacccgcgaggccgg

SEQ ID NO: 3406808 - RNA, 14 nt, Pseudomonas aeruginosa PA01
ucacccgcgccugc

SEQ ID NO: 3406809 - RNA, 15 nt, Pseudomonas aeruginosa PA01
ucacccgcgccugca

SEQ ID NO: 3406810 - RNA, 20 nt, Pseudomonas aeruginosa PA01
ucacccgguucucgccccag

SEQ ID NO: 3406811 - RNA, 21 nt, Pseudomonas aeruginosa PA01
ucacccugcugggcgggaucu

SEQ ID NO: 3406812 - RNA, 17 nt, Pseudomonas aeruginosa PA01
ucacccugucccaucac

SEQ ID NO: 3406813 - RNA, 20 nt, Pseudomonas aeruginosa PA01
ucaccgaaaggcucuugggc

SEQ ID NO: 3406814 - RNA, 22 nt, Pseudomonas aeruginosa PA01
ucaccgaaaggcucuugggcuc

SEQ ID NO: 3406815 - RNA, 19 nt, Pseudomonas aeruginosa PA01
ucaccgacagucccaggcc

SEQ ID NO: 3406816 - RNA, 17 nt, Pseudomonas aeruginosa PA01
ucaccgauugcgcccuc

SEQ ID NO: 3406817 - RNA, 14 nt, Pseudomonas aeruginosa PA01
ucaccgcauagucg

SEQ ID NO: 3406818 - RNA, 19 nt, Pseudomonas aeruginosa PA01
ucaccgcauagucgcgaug

SEQ ID NO: 3406819 - RNA, 22 nt, Pseudomonas aeruginosa PA01
ucaccgcaucgaaggcgccggc

SEQ ID NO: 3406820 - RNA, 17 nt, Pseudomonas aeruginosa PA01
ucaccgccaaggccucg

SEQ ID NO: 3406821 - RNA, 20 nt, Pseudomonas aeruginosa PA01
ucaccgccaaggccucggca

SEQ ID NO: 3406822 - RNA, 19 nt, Pseudomonas aeruginosa PA01
ucaccgccaccccgccggc

SEQ ID NO: 3406823 - RNA, 20 nt, Pseudomonas aeruginosa PA01
ucaccgccaccccgccggcg

SEQ ID NO: 3406824 - RNA, 16 nt, Pseudomonas aeruginosa PA01
ucaccgccaucagcac

SEQ ID NO: 3406825 - RNA, 20 nt, Pseudomonas aeruginosa PA01
ucaccgcgcaaaccggcagc

SEQ ID NO: 3406826 - RNA, 15 nt, Pseudomonas aeruginosa PA01
ucaccgcgccgaagg

SEQ ID NO: 3406827 - RNA, 23 nt, Pseudomonas aeruginosa PA01
ucaccgcgcuugacgacugcacg

SEQ ID NO: 3406828 - RNA, 15 nt, Pseudomonas aeruginosa PA01
ucaccgcggccuugg

SEQ ID NO: 3406829 - RNA, 13 nt, Pseudomonas aeruginosa PA01
ucaccgcggcgcu

SEQ ID NO: 3406830 - RNA, 15 nt, Pseudomonas aeruginosa PA01
ucaccgcggcgcuga

SEQ ID NO: 3406831 - RNA, 20 nt, Pseudomonas aeruginosa PA01
ucaccgcguccauccccgcc

SEQ ID NO: 3406832 - RNA, 15 nt, Pseudomonas aeruginosa PA01
ucaccgcucgccaga

SEQ ID NO: 3406833 - RNA, 21 nt, Pseudomonas aeruginosa PA01
ucaccggaaaaauccucgccu

SEQ ID NO: 3406834 - RNA, 22 nt, Pseudomonas aeruginosa PA01
ucaccggaccguggugacgguc

SEQ ID NO: 3406835 - RNA, 22 nt, Pseudomonas aeruginosa PA01
ucaccggacggcugaggcuggc

SEQ ID NO: 3406836 - RNA, 14 nt, Pseudomonas aeruginosa PA01
ucaccggcagcagc

SEQ ID NO: 3406837 - RNA, 18 nt, Pseudomonas aeruginosa PA01
ucaccggcagcagcggau

SEQ ID NO: 3406838 - RNA, 23 nt, Pseudomonas aeruginosa PA01
ucaccggcaggaucggcgcgguc

SEQ ID NO: 3406839 - RNA, 22 nt, Pseudomonas aeruginosa PA01
ucaccggcgccacccucggcuu

SEQ ID NO: 3406840 - RNA, 14 nt, Pseudomonas aeruginosa PA01
ucaccggcggauga

SEQ ID NO: 3406841 - RNA, 16 nt, Pseudomonas aeruginosa PA01
ucaccggcuggcccuc

SEQ ID NO: 3406842 - RNA, 24 nt, Pseudomonas aeruginosa PA01
ucaccggcuggcccuccauccagu

SEQ ID NO: 3406843 - RNA, 19 nt, Pseudomonas aeruginosa PA01
ucaccguccuucggccgca

SEQ ID NO: 3406844 - RNA, 17 nt, Pseudomonas aeruginosa PA01
ucaccgugaucccgcgc

SEQ ID NO: 3406845 - RNA, 16 nt, Pseudomonas aeruginosa PA01
ucaccguggagagguc

SEQ ID NO: 3406846 - RNA, 22 nt, Pseudomonas aeruginosa PA01
ucaccguggagaggucgccgac

SEQ ID NO: 3406847 - RNA, 15 nt, Pseudomonas aeruginosa PA01
ucaccguggcgcugg

SEQ ID NO: 3406848 - RNA, 20 nt, Pseudomonas aeruginosa PA01
ucaccguggcgcuggccgaa

SEQ ID NO: 3406849 - RNA, 21 nt, Pseudomonas aeruginosa PA01
ucaccguggucauggcgcaga

SEQ ID NO: 3406850 - RNA, 18 nt, Pseudomonas aeruginosa PA01
ucaccuggaucgccaggc

SEQ ID NO: 3406851 - RNA, 15 nt, Pseudomonas aeruginosa PA01
ucaccuggucgccga

SEQ ID NO: 3406852 - RNA, 20 nt, Pseudomonas aeruginosa PA01
ucaccuucaccggcacgccc

SEQ ID NO: 3406853 - RNA, 13 nt, Pseudomonas aeruginosa PA01
ucaccuucgcccu

SEQ ID NO: 3406854 - RNA, 20 nt, Pseudomonas aeruginosa PA01
ucaccuugcggaacccgcgc

SEQ ID NO: 3406855 - RNA, 19 nt, Pseudomonas aeruginosa PA01
ucaccuuggugccgaccuu

SEQ ID NO: 3406856 - RNA, 21 nt, Pseudomonas aeruginosa PA01
ucaccuuggugccgaccuuca

SEQ ID NO: 3406857 - RNA, 13 nt, Pseudomonas aeruginosa PA01
ucacgaacagcuu

SEQ ID NO: 3406858 - RNA, 12 nt, Pseudomonas aeruginosa PA01
ucacgaagcggu

SEQ ID NO: 3406859 - RNA, 14 nt, Pseudomonas aeruginosa PA01
ucacgacaggcggc

SEQ ID NO: 3406860 - RNA, 18 nt, Pseudomonas aeruginosa PA01
ucacgaucggcaccauca

SEQ ID NO: 3406861 - RNA, 21 nt, Pseudomonas aeruginosa PA01
ucacgaucggcaccaucaccg

SEQ ID NO: 3406862 - RNA, 14 nt, Pseudomonas aeruginosa PA01
ucacgauggccggc

SEQ ID NO: 3406863 - RNA, 15 nt, Pseudomonas aeruginosa PA01
ucacgauggccggca

SEQ ID NO: 3406864 - RNA, 17 nt, Pseudomonas aeruginosa PA01
ucacgauggccggcagc

SEQ ID NO: 3406865 - RNA, 23 nt, Pseudomonas aeruginosa PA01
ucacgauggccggcagcagcgcc

SEQ ID NO: 3406866 - RNA, 19 nt, Pseudomonas aeruginosa PA01
ucacgcaagugcccugggc

SEQ ID NO: 3406867 - RNA, 20 nt, Pseudomonas aeruginosa PA01
ucacgcaccucgucgagcag

SEQ ID NO: 3406868 - RNA, 21 nt, Pseudomonas aeruginosa PA01
ucacgcaccucgucgagcagc

SEQ ID NO: 3406869 - RNA, 15 nt, Pseudomonas aeruginosa PA01
ucacgcaggcgcugg

SEQ ID NO: 3406870 - RNA, 17 nt, Pseudomonas aeruginosa PA01
ucacgcaggcuuuccag

SEQ ID NO: 3406871 - RNA, 22 nt, Pseudomonas aeruginosa PA01
ucacgcaggcuuuccagcccgg

SEQ ID NO: 3406872 - RNA, 21 nt, Pseudomonas aeruginosa PA01
ucacgcaguacagcugcaccg

SEQ ID NO: 3406873 - RNA, 22 nt, Pseudomonas aeruginosa PA01
ucacgcaguacagcugcaccgc

SEQ ID NO: 3406874 - RNA, 18 nt, Pseudomonas aeruginosa PA01
ucacgccagagaacgaag

SEQ ID NO: 3406875 - RNA, 16 nt, Pseudomonas aeruginosa PA01
ucacgccccagcgcau

SEQ ID NO: 3406876 - RNA, 20 nt, Pseudomonas aeruginosa PA01
ucacgccccagcgcaucgcg

SEQ ID NO: 3406877 - RNA, 23 nt, Pseudomonas aeruginosa PA01
ucacgccgaaggugaaguccggc

SEQ ID NO: 3406878 - RNA, 12 nt, Pseudomonas aeruginosa PA01
ucacgccgaggg

SEQ ID NO: 3406879 - RNA, 22 nt, Pseudomonas aeruginosa PA01
ucacgccgagggcgcggcgcca

SEQ ID NO: 3406880 - RNA, 11 nt, Pseudomonas aeruginosa PA01
ucacgccgauc

SEQ ID NO: 3406881 - RNA, 19 nt, Pseudomonas aeruginosa PA01
ucacgccgaucccggcggc

SEQ ID NO: 3406882 - RNA, 21 nt, Pseudomonas aeruginosa PA01
ucacgccgaucccggcggcga

SEQ ID NO: 3406883 - RNA, 19 nt, Pseudomonas aeruginosa PA01
ucacgccgggaauccccag

SEQ ID NO: 3406884 - RNA, 17 nt, Pseudomonas aeruginosa PA01
ucacgccuggcggcugg

SEQ ID NO: 3406885 - RNA, 22 nt, Pseudomonas aeruginosa PA01
ucacgcgaccaccuucuacacc

SEQ ID NO: 3406886 - RNA, 20 nt, Pseudomonas aeruginosa PA01
ucacgcggacccaguugggc

SEQ ID NO: 3406887 - RNA, 23 nt, Pseudomonas aeruginosa PA01
ucacgcggacccaguugggccag

SEQ ID NO: 3406888 - RNA, 17 nt, Pseudomonas aeruginosa PA01
ucacgcguucggcgaug

SEQ ID NO: 3406889 - RNA, 13 nt, Pseudomonas aeruginosa PA01
ucacgcugcucgc

SEQ ID NO: 3406890 - RNA, 18 nt, Pseudomonas aeruginosa PA01
ucacgcugcucgcagccg

SEQ ID NO: 3406891 - RNA, 17 nt, Pseudomonas aeruginosa PA01
ucacgcuuuccggcuug

SEQ ID NO: 3406892 - RNA, 13 nt, Pseudomonas aeruginosa PA01
ucacggacccgcu

SEQ ID NO: 3406893 - RNA, 20 nt, Pseudomonas aeruginosa PA01
ucacggacccgcucggccuu

SEQ ID NO: 3406894 - RNA, 12 nt, Pseudomonas aeruginosa PA01
ucacggauaggc

SEQ ID NO: 3406895 - RNA, 16 nt, Pseudomonas aeruginosa PA01
ucacggcauccuggcg

SEQ ID NO: 3406896 - RNA, 15 nt, Pseudomonas aeruginosa PA01
ucacggcauucucuc

SEQ ID NO: 3406897 - RNA, 18 nt, Pseudomonas aeruginosa PA01
ucacggccccgagaaaac

SEQ ID NO: 3406898 - RNA, 19 nt, Pseudomonas aeruginosa PA01
ucacggcgaaaccggccag

SEQ ID NO: 3406899 - RNA, 13 nt, Pseudomonas aeruginosa PA01
ucacggcgcagcc

SEQ ID NO: 3406900 - RNA, 21 nt, Pseudomonas aeruginosa PA01
ucacggcgcagccgcaaggcc

SEQ ID NO: 3406901 - RNA, 19 nt, Pseudomonas aeruginosa PA01
ucacggcgccccgggucgg

SEQ ID NO: 3406902 - RNA, 17 nt, Pseudomonas aeruginosa PA01
ucacggcgcgagaaaaa

SEQ ID NO: 3406903 - RNA, 18 nt, Pseudomonas aeruginosa PA01
ucacggcgcgagaaaaac

SEQ ID NO: 3406904 - RNA, 20 nt, Pseudomonas aeruginosa PA01
ucacggcggauaaccgcgag

SEQ ID NO: 3406905 - RNA, 22 nt, Pseudomonas aeruginosa PA01
ucacggcggauaaccgcgagcg

SEQ ID NO: 3406906 - RNA, 15 nt, Pseudomonas aeruginosa PA01
ucacggucagcucgg

SEQ ID NO: 3406907 - RNA, 17 nt, Pseudomonas aeruginosa PA01
ucacggucgugcuugca

SEQ ID NO: 3406908 - RNA, 18 nt, Pseudomonas aeruginosa PA01
ucagcccacccccggccc

SEQ ID NO: 3406909 - RNA, 19 nt, Pseudomonas aeruginosa PA01
ucagcccacgcgccuggcc

SEQ ID NO: 3406910 - RNA, 20 nt, Pseudomonas aeruginosa PA01
ucagcccacgcgccuggccg

SEQ ID NO: 3406911 - RNA, 22 nt, Pseudomonas aeruginosa PA01
ucagcccacgcgccuggccguc

SEQ ID NO: 3406912 - RNA, 18 nt, Pseudomonas aeruginosa PA01
ucagcccauacaccaggc

SEQ ID NO: 3406913 - RNA, 20 nt, Pseudomonas aeruginosa PA01
ucagcccauacaccaggccg

SEQ ID NO: 3406914 - RNA, 22 nt, Pseudomonas aeruginosa PA01
ucagcccauacaccaggccggc

SEQ ID NO: 3406915 - RNA, 17 nt, Pseudomonas aeruginosa PA01
ucagccccucggccagg

SEQ ID NO: 3406916 - RNA, 20 nt, Pseudomonas aeruginosa PA01
ucagccccucggccaggacc

SEQ ID NO: 3406917 - RNA, 14 nt, Pseudomonas aeruginosa PA01
ucagcccgccggcg

SEQ ID NO: 3406918 - RNA, 18 nt, Pseudomonas aeruginosa PA01
ucagcccgccggcgaugc

SEQ ID NO: 3406919 - RNA, 15 nt, Pseudomonas aeruginosa PA01
ucagcccgccgugcg

SEQ ID NO: 3406920 - RNA, 19 nt, Pseudomonas aeruginosa PA01
ucagcccgccgugcgcucc

SEQ ID NO: 3406921 - RNA, 16 nt, Pseudomonas aeruginosa PA01
ucagcccgcugaccgg

SEQ ID NO: 3406922 - RNA, 19 nt, Pseudomonas aeruginosa PA01
ucagcccgcugaccgggcg

SEQ ID NO: 3406923 - RNA, 13 nt, Pseudomonas aeruginosa PA01
ucagcccgcugag

SEQ ID NO: 3406924 - RNA, 16 nt, Pseudomonas aeruginosa PA01
ucagcccggcaccagg

SEQ ID NO: 3406925 - RNA, 14 nt, Pseudomonas aeruginosa PA01
ucagcccgucggcc

SEQ ID NO: 3406926 - RNA, 20 nt, Pseudomonas aeruginosa PA01
ucagcccguguucggccagc

SEQ ID NO: 3406927 - RNA, 15 nt, Pseudomonas aeruginosa PA01
ucagcccucggcccg

SEQ ID NO: 3406928 - RNA, 16 nt, Pseudomonas aeruginosa PA01
ucagcccuucgcgcuc

SEQ ID NO: 3406929 - RNA, 19 nt, Pseudomonas aeruginosa PA01
ucagcccuucgcgcucgac

SEQ ID NO: 3406930 - RNA, 17 nt, Pseudomonas aeruginosa PA01
ucagccgaccaccuuca

SEQ ID NO: 3406931 - RNA, 21 nt, Pseudomonas aeruginosa PA01
ucagccgaccguccgccugcg

SEQ ID NO: 3406932 - RNA, 20 nt, Pseudomonas aeruginosa PA01
ucagccgagguucuugccca

SEQ ID NO: 3406933 - RNA, 18 nt, Pseudomonas aeruginosa PA01
ucagccgaugcucgcgcc

SEQ ID NO: 3406934 - RNA, 22 nt, Pseudomonas aeruginosa PA01
ucagccgaugcucgcgccagcc

SEQ ID NO: 3406935 - RNA, 15 nt, Pseudomonas aeruginosa PA01
ucagccgcaggcaga

SEQ ID NO: 3406936 - RNA, 14 nt, Pseudomonas aeruginosa PA01
ucagccgcaggccg

SEQ ID NO: 3406937 - RNA, 21 nt, Pseudomonas aeruginosa PA01
ucagccgcgacgacugcggca

SEQ ID NO: 3406938 - RNA, 16 nt, Pseudomonas aeruginosa PA01
ucagccgcgacucggc

SEQ ID NO: 3406939 - RNA, 13 nt, Pseudomonas aeruginosa PA01
ucagccgcgccgg

SEQ ID NO: 3406940 - RNA, 15 nt, Pseudomonas aeruginosa PA01
ucagccgcgccgggg

SEQ ID NO: 3406941 - RNA, 16 nt, Pseudomonas aeruginosa PA01
ucagccgcgccggggc

SEQ ID NO: 3406942 - RNA, 24 nt, Pseudomonas aeruginosa PA01
ucagccgcgccggggcagcagggc

SEQ ID NO: 3406943 - RNA, 14 nt, Pseudomonas aeruginosa PA01
ucagccgcgcgcug

SEQ ID NO: 3406944 - RNA, 13 nt, Pseudomonas aeruginosa PA01
ucagccgcggccg

SEQ ID NO: 3406945 - RNA, 15 nt, Pseudomonas aeruginosa PA01
ucagccgcuccagga

SEQ ID NO: 3406946 - RNA, 16 nt, Pseudomonas aeruginosa PA01
ucagccgcuccaggau

SEQ ID NO: 3406947 - RNA, 23 nt, Pseudomonas aeruginosa PA01
ucagccggcccauccgccgcagg

SEQ ID NO: 3406948 - RNA, 13 nt, Pseudomonas aeruginosa PA01
ucagccggccgau

SEQ ID NO: 3406949 - RNA, 17 nt, Pseudomonas aeruginosa PA01
ucagccucacccugcug

SEQ ID NO: 3406950 - RNA, 20 nt, Pseudomonas aeruginosa PA01
ucagccucacccugcugggc

SEQ ID NO: 3406951 - RNA, 21 nt, Pseudomonas aeruginosa PA01
ucagccucacccugcugggcg

SEQ ID NO: 3406952 - RNA, 13 nt, Pseudomonas aeruginosa PA01
ucagccuggccag

SEQ ID NO: 3406953 - RNA, 18 nt, Pseudomonas aeruginosa PA01
ucagccuggccagcgucg

SEQ ID NO: 3406954 - RNA, 21 nt, Pseudomonas aeruginosa PA01
ucagccugucacucaggcaug

SEQ ID NO: 3406955 - RNA, 18 nt, Pseudomonas aeruginosa PA01
ucagcgacagcauggccu

SEQ ID NO: 3406956 - RNA, 17 nt, Pseudomonas aeruginosa PA01
ucagcgacugguggucg

SEQ ID NO: 3406957 - RNA, 21 nt, Pseudomonas aeruginosa PA01
ucagcgacugguggucgaggg

SEQ ID NO: 3406958 - RNA, 16 nt, Pseudomonas aeruginosa PA01
ucagcgagagcugucc

SEQ ID NO: 3406959 - RNA, 19 nt, Pseudomonas aeruginosa PA01
ucagcgagagcuguccggc

SEQ ID NO: 3406960 - RNA, 20 nt, Pseudomonas aeruginosa PA01
ucagcgagagcuguccggcg

SEQ ID NO: 3406961 - RNA, 21 nt, Pseudomonas aeruginosa PA01
ucagcgagagcuguccggcgc

SEQ ID NO: 3406962 - RNA, 16 nt, Pseudomonas aeruginosa PA01
ucagcgagcuaucgcc

SEQ ID NO: 3406963 - RNA, 18 nt, Pseudomonas aeruginosa PA01
ucagcgagcuucgccgcg

SEQ ID NO: 3406964 - RNA, 20 nt, Pseudomonas aeruginosa PA01
ucagcgagcuucgccgcgca

SEQ ID NO: 3406965 - RNA, 22 nt, Pseudomonas aeruginosa PA01
ucagcgagcuucgccgcgcaag

SEQ ID NO: 3406966 - RNA, 21 nt, Pseudomonas aeruginosa PA01
ucagcgaguugaccuuggcca

SEQ ID NO: 3406967 - RNA, 17 nt, Pseudomonas aeruginosa PA01
ucagcgcaccgcccugc

SEQ ID NO: 3406968 - RNA, 17 nt, Pseudomonas aeruginosa PA01
ucagcgcauaggccugg

SEQ ID NO: 3406969 - RNA, 16 nt, Pseudomonas aeruginosa PA01
ucagcgccagcaggcg

SEQ ID NO: 3406970 - RNA, 14 nt, Pseudomonas aeruginosa PA01
ucagcgccaggccg

SEQ ID NO: 3406971 - RNA, 15 nt, Pseudomonas aeruginosa PA01
ucagcgccaggccga

SEQ ID NO: 3406972 - RNA, 15 nt, Pseudomonas aeruginosa PA01
ucagcgccagggcau

SEQ ID NO: 3406973 - RNA, 13 nt, Pseudomonas aeruginosa PA01
ucagcgcccggcu

SEQ ID NO: 3406974 - RNA, 16 nt, Pseudomonas aeruginosa PA01
ucagcgccgccaggcc

SEQ ID NO: 3406975 - RNA, 17 nt, Pseudomonas aeruginosa PA01
ucagcgccgccaggccc

SEQ ID NO: 3406976 - RNA, 15 nt, Pseudomonas aeruginosa PA01
ucagcgccgccucgc

SEQ ID NO: 3406977 - RNA, 21 nt, Pseudomonas aeruginosa PA01
ucagcgccgccucgcugggcg

SEQ ID NO: 3406978 - RNA, 13 nt, Pseudomonas aeruginosa PA01
ucagcgccgcucg

SEQ ID NO: 3406979 - RNA, 14 nt, Pseudomonas aeruginosa PA01
ucagcgccgcucgg

SEQ ID NO: 3406980 - RNA, 15 nt, Pseudomonas aeruginosa PA01
ucagcgccgcucggc

SEQ ID NO: 3406981 - RNA, 12 nt, Pseudomonas aeruginosa PA01
ucagcgccggcc

SEQ ID NO: 3406982 - RNA, 15 nt, Pseudomonas aeruginosa PA01
ucagcgccggccagg

SEQ ID NO: 3406983 - RNA, 13 nt, Pseudomonas aeruginosa PA01
ucagcgccgggug

SEQ ID NO: 3406984 - RNA, 17 nt, Pseudomonas aeruginosa PA01
ucagcgccgggugaccg

SEQ ID NO: 3406985 - RNA, 20 nt, Pseudomonas aeruginosa PA01
ucagcgccgguagcggcgca

SEQ ID NO: 3406986 - RNA, 16 nt, Pseudomonas aeruginosa PA01
ucagcgccuccagcac

SEQ ID NO: 3406987 - RNA, 19 nt, Pseudomonas aeruginosa PA01
ucagcgccucgaccucggc

SEQ ID NO: 3406988 - RNA, 13 nt, Pseudomonas aeruginosa PA01
ucagcgccucggc

SEQ ID NO: 3406989 - RNA, 16 nt, Pseudomonas aeruginosa PA01
ucagcgccucggcgca

SEQ ID NO: 3406990 - RNA, 18 nt, Pseudomonas aeruginosa PA01
ucagcgccuugaccucga

SEQ ID NO: 3406991 - RNA, 20 nt, Pseudomonas aeruginosa PA01
ucagcgccuugaccucgacg

SEQ ID NO: 3406992 - RNA, 22 nt, Pseudomonas aeruginosa PA01
ucagcgccuugaccucgacgcc

SEQ ID NO: 3406993 - RNA, 12 nt, Pseudomonas aeruginosa PA01
ucagcgcgacag

SEQ ID NO: 3406994 - RNA, 14 nt, Pseudomonas aeruginosa PA01
ucagcgcgacaggc

SEQ ID NO: 3406995 - RNA, 17 nt, Pseudomonas aeruginosa PA01
ucagcgcgacaggcugg

SEQ ID NO: 3406996 - RNA, 15 nt, Pseudomonas aeruginosa PA01
ucagcgcgccagcac

SEQ ID NO: 3406997 - RNA, 12 nt, Pseudomonas aeruginosa PA01
ucagcgcgccga

SEQ ID NO: 3406998 - RNA, 18 nt, Pseudomonas aeruginosa PA01
ucagcgcgccgagccagg

SEQ ID NO: 3406999 - RNA, 19 nt, Pseudomonas aeruginosa PA01
ucagcgcgccgagccaggu

SEQ ID NO: 3407000 - RNA, 22 nt, Pseudomonas aeruginosa PA01
ucagcgcgccgaguucgccgcg

SEQ ID NO: 3407001 - RNA, 19 nt, Pseudomonas aeruginosa PA01
ucagcgcgcguagcgugcc

SEQ ID NO: 3407002 - RNA, 14 nt, Pseudomonas aeruginosa PA01
ucagcgcgcucggc

SEQ ID NO: 3407003 - RNA, 19 nt, Pseudomonas aeruginosa PA01
ucagcgcggagcguccacc

SEQ ID NO: 3407004 - RNA, 12 nt, Pseudomonas aeruginosa PA01
ucagcgcggcca

SEQ ID NO: 3407005 - RNA, 14 nt, Pseudomonas aeruginosa PA01
ucagcgcggcggcg

SEQ ID NO: 3407006 - RNA, 17 nt, Pseudomonas aeruginosa PA01
ucagcgcggugagcagg

SEQ ID NO: 3407007 - RNA, 22 nt, Pseudomonas aeruginosa PA01
ucagcgcggugagcagggugac

SEQ ID NO: 3407008 - RNA, 13 nt, Pseudomonas aeruginosa PA01
ucagcgcuuccag

SEQ ID NO: 3407009 - RNA, 21 nt, Pseudomonas aeruginosa PA01
ucagcgcuucggcuccagcac

SEQ ID NO: 3407010 - RNA, 17 nt, Pseudomonas aeruginosa PA01
ucagcgcuucucggcag

SEQ ID NO: 3407011 - RNA, 22 nt, Pseudomonas aeruginosa PA01
ucaggccuggcccuggcgcagg

SEQ ID NO: 3407012 - RNA, 19 nt, Pseudomonas aeruginosa PA01
ucaggccuugacgcgggac

SEQ ID NO: 3407013 - RNA, 17 nt, Pseudomonas aeruginosa PA01
ucaggccuugcgcggcg

SEQ ID NO: 3407014 - RNA, 14 nt, Pseudomonas aeruginosa PA01
ucaggcgacgccgc

SEQ ID NO: 3407015 - RNA, 15 nt, Pseudomonas aeruginosa PA01
ucaggcgacgccgcg

SEQ ID NO: 3407016 - RNA, 16 nt, Pseudomonas aeruginosa PA01
ucaggcgacgccgcgc

SEQ ID NO: 3407017 - RNA, 14 nt, Pseudomonas aeruginosa PA01
ucaggcgcagcguc

SEQ ID NO: 3407018 - RNA, 21 nt, Pseudomonas aeruginosa PA01
ucaggcgcagcguccugcccu

SEQ ID NO: 3407019 - RNA, 17 nt, Pseudomonas aeruginosa PA01
ucaggcgcaugcccagg

SEQ ID NO: 3407020 - RNA, 21 nt, Pseudomonas aeruginosa PA01
ucaggcgccaggacucgccau

SEQ ID NO: 3407021 - RNA, 19 nt, Pseudomonas aeruginosa PA01
ucaggcgccaggccucaga

SEQ ID NO: 3407022 - RNA, 13 nt, Pseudomonas aeruginosa PA01
ucaggcgccgcug

SEQ ID NO: 3407023 - RNA, 11 nt, Pseudomonas aeruginosa PA01
ucaggcgccgu

SEQ ID NO: 3407024 - RNA, 14 nt, Pseudomonas aeruginosa PA01
ucaggcgcgcggcc

SEQ ID NO: 3407025 - RNA, 15 nt, Pseudomonas aeruginosa PA01
ucaggcgcgcggcca

SEQ ID NO: 3407026 - RNA, 16 nt, Pseudomonas aeruginosa PA01
ucaggcgcgcggccag

SEQ ID NO: 3407027 - RNA, 23 nt, Pseudomonas aeruginosa PA01
ucaggcgcgcggucuucaucacc

SEQ ID NO: 3407028 - RNA, 21 nt, Pseudomonas aeruginosa PA01
ucaggcgcgcucgggaucgcc

SEQ ID NO: 3407029 - RNA, 23 nt, Pseudomonas aeruginosa PA01
ucaggcgcuccuggagguucggc

SEQ ID NO: 3407030 - RNA, 23 nt, Pseudomonas aeruginosa PA01
ucaggcgcuccuugagcagcucg

SEQ ID NO: 3407031 - RNA, 13 nt, Pseudomonas aeruginosa PA01
ucaggcgcugcug

SEQ ID NO: 3407032 - RNA, 11 nt, Pseudomonas aeruginosa PA01
ucaggcgcugg

SEQ ID NO: 3407033 - RNA, 12 nt, Pseudomonas aeruginosa PA01
ucaggcgcuggu

SEQ ID NO: 3407034 - RNA, 13 nt, Pseudomonas aeruginosa PA01
ucaggcgcugucc

SEQ ID NO: 3407035 - RNA, 15 nt, Pseudomonas aeruginosa PA01
ucaggcgcuugucca

SEQ ID NO: 3407036 - RNA, 18 nt, Pseudomonas aeruginosa PA01
ucaggcggcacucggcga

SEQ ID NO: 3407037 - RNA, 18 nt, Pseudomonas aeruginosa PA01
ucaggcggcgaaagccau

SEQ ID NO: 3407038 - RNA, 18 nt, Pseudomonas aeruginosa PA01
ucaggcguaggccgucgc

SEQ ID NO: 3407039 - RNA, 20 nt, Pseudomonas aeruginosa PA01
ucaggcgucccgcuccagcc

SEQ ID NO: 3407040 - RNA, 15 nt, Pseudomonas aeruginosa PA01
ucaggcgugggccag

SEQ ID NO: 3407041 - RNA, 16 nt, Pseudomonas aeruginosa PA01
ucaggcgugggccagc

SEQ ID NO: 3407042 - RNA, 14 nt, Pseudomonas aeruginosa PA01
ucaggcucaggccg

SEQ ID NO: 3407043 - RNA, 13 nt, Pseudomonas aeruginosa PA01
ucaggcucgagcc

SEQ ID NO: 3407044 - RNA, 14 nt, Pseudomonas aeruginosa PA01
ucaggcucggccug

SEQ ID NO: 3407045 - RNA, 17 nt, Pseudomonas aeruginosa PA01
ucaggcugaagcggccg

SEQ ID NO: 3407046 - RNA, 18 nt, Pseudomonas aeruginosa PA01
ucaggcugaagcggccgc

SEQ ID NO: 3407047 - RNA, 21 nt, Pseudomonas aeruginosa PA01
ucaggcugaucggcgcgccgg

SEQ ID NO: 3407048 - RNA, 17 nt, Pseudomonas aeruginosa PA01
ucaggcugccgagcagg

SEQ ID NO: 3407049 - RNA, 15 nt, Pseudomonas aeruginosa PA01
ucaggcugcgcaccu

SEQ ID NO: 3407050 - RNA, 14 nt, Pseudomonas aeruginosa PA01
ucaggcugcgcgca

SEQ ID NO: 3407051 - RNA, 17 nt, Pseudomonas aeruginosa PA01
ucaggcugcggcggaag

SEQ ID NO: 3407052 - RNA, 22 nt, Pseudomonas aeruginosa PA01
ucaggcugcggcggaaggcggc

SEQ ID NO: 3407053 - RNA, 13 nt, Pseudomonas aeruginosa PA01
ucaggcuggcccc

SEQ ID NO: 3407054 - RNA, 16 nt, Pseudomonas aeruginosa PA01
ucaggcuggccccggu

SEQ ID NO: 3407055 - RNA, 20 nt, Pseudomonas aeruginosa PA01
ucaggcuggcguacuugggc

SEQ ID NO: 3407056 - RNA, 18 nt, Pseudomonas aeruginosa PA01
ucaggcugggguugcggc

SEQ ID NO: 3407057 - RNA, 23 nt, Pseudomonas aeruginosa PA01
ucaggcugggguugcggcgcccg

SEQ ID NO: 3407058 - RNA, 16 nt, Pseudomonas aeruginosa PA01
ucaggcuguccacgcc

SEQ ID NO: 3407059 - RNA, 12 nt, Pseudomonas aeruginosa PA01
ucaggcugugca

SEQ ID NO: 3407060 - RNA, 15 nt, Pseudomonas aeruginosa PA01
ucaggcugugcagga

SEQ ID NO: 3407061 - RNA, 20 nt, Pseudomonas aeruginosa PA01
ucaggcuguugcccugggcc

SEQ ID NO: 3407062 - RNA, 19 nt, Pseudomonas aeruginosa PA01
ucagggacaugucgagggc

SEQ ID NO: 3407063 - RNA, 14 nt, Pseudomonas aeruginosa PA01
ucagggcaccgccg

SEQ ID NO: 3407064 - RNA, 15 nt, Pseudomonas aeruginosa PA01
ucagggcgagcaggg

SEQ ID NO: 3407065 - RNA, 17 nt, Pseudomonas aeruginosa PA01
ucagggcgagcagggca

SEQ ID NO: 3407066 - RNA, 17 nt, Pseudomonas aeruginosa PA01
ucagggcguagcggaag

SEQ ID NO: 3407067 - RNA, 13 nt, Pseudomonas aeruginosa PA01
ucagggcugggcg

SEQ ID NO: 3407068 - RNA, 18 nt, Pseudomonas aeruginosa PA01
ucagggcuugcgcgccac

SEQ ID NO: 3407069 - RNA, 23 nt, Pseudomonas aeruginosa PA01
ucagggcuugcgcgccaccagcg

SEQ ID NO: 3407070 - RNA, 22 nt, Pseudomonas aeruginosa PA01
ucagggguugcaauagaaaaga

SEQ ID NO: 3407071 - RNA, 17 nt, Pseudomonas aeruginosa PA01
ucagggucuucaggcgu

SEQ ID NO: 3407072 - RNA, 22 nt, Pseudomonas aeruginosa PA01
ucagggugaucuguucgaccag

SEQ ID NO: 3407073 - RNA, 17 nt, Pseudomonas aeruginosa PA01
ucaggguggcgaccgcc

SEQ ID NO: 3407074 - RNA, 15 nt, Pseudomonas aeruginosa PA01
ucaggguggcgauca

SEQ ID NO: 3407075 - RNA, 19 nt, Pseudomonas aeruginosa PA01
ucaggguggcgaucacguc

SEQ ID NO: 3407076 - RNA, 18 nt, Pseudomonas aeruginosa PA01
ucaggguggcgcugccuu

SEQ ID NO: 3407077 - RNA, 21 nt, Pseudomonas aeruginosa PA01
ucaggguggcgcugccuucga

SEQ ID NO: 3407078 - RNA, 19 nt, Pseudomonas aeruginosa PA01
ucagguaaggcaccaccgc

SEQ ID NO: 3407079 - RNA, 23 nt, Pseudomonas aeruginosa PA01
ucagguaaggcaccaccgccgcc

SEQ ID NO: 3407080 - RNA, 16 nt, Pseudomonas aeruginosa PA01
ucagguagaugaacug

SEQ ID NO: 3407081 - RNA, 17 nt, Pseudomonas aeruginosa PA01
ucagguagauguccagu

SEQ ID NO: 3407082 - RNA, 23 nt, Pseudomonas aeruginosa PA01
ucagguagcucaucggcgacacc

SEQ ID NO: 3407083 - RNA, 14 nt, Pseudomonas aeruginosa PA01
ucagguaggcaucg

SEQ ID NO: 3407084 - RNA, 15 nt, Pseudomonas aeruginosa PA01
ucagguaggcaucga

SEQ ID NO: 3407085 - RNA, 15 nt, Pseudomonas aeruginosa PA01
ucagguaggccggcg

SEQ ID NO: 3407086 - RNA, 16 nt, Pseudomonas aeruginosa PA01
ucagguaggcgcgggc

SEQ ID NO: 3407087 - RNA, 22 nt, Pseudomonas aeruginosa PA01
ucagguaggcgcgggcguagcc

SEQ ID NO: 3407088 - RNA, 19 nt, Pseudomonas aeruginosa PA01
ucagguagguggaggccgu

SEQ ID NO: 3407089 - RNA, 14 nt, Pseudomonas aeruginosa PA01
ucagguagucggcg

SEQ ID NO: 3407090 - RNA, 15 nt, Pseudomonas aeruginosa PA01
ucagguagugcaaca

SEQ ID NO: 3407091 - RNA, 21 nt, Pseudomonas aeruginosa PA01
ucagguagugcaacaccuggc

SEQ ID NO: 3407092 - RNA, 22 nt, Pseudomonas aeruginosa PA01
ucagguagugcaacaccuggcg

SEQ ID NO: 3407093 - RNA, 13 nt, Pseudomonas aeruginosa PA01
ucaggucgacgcc

SEQ ID NO: 3407094 - RNA, 15 nt, Pseudomonas aeruginosa PA01
ucaggucgaggccgc

SEQ ID NO: 3407095 - RNA, 17 nt, Pseudomonas aeruginosa PA01
ucaggucgaugcccagc

SEQ ID NO: 3407096 - RNA, 22 nt, Pseudomonas aeruginosa PA01
ucaggucgaugcccagccaggg

SEQ ID NO: 3407097 - RNA, 15 nt, Pseudomonas aeruginosa PA01
ucaggucgccgccgc

SEQ ID NO: 3407098 - RNA, 14 nt, Pseudomonas aeruginosa PA01
ucaggucgcgcgcc

SEQ ID NO: 3407099 - RNA, 12 nt, Pseudomonas aeruginosa PA01
ucaggucggccg

SEQ ID NO: 3407100 - RNA, 14 nt, Pseudomonas aeruginosa PA01
ucaggucggccgcc

SEQ ID NO: 3407101 - RNA, 17 nt, Pseudomonas aeruginosa PA01
ucaggucggcgcgcacc

SEQ ID NO: 3407102 - RNA, 21 nt, Pseudomonas aeruginosa PA01
ucaggugcguacuuggcccgg

SEQ ID NO: 3407103 - RNA, 23 nt, Pseudomonas aeruginosa PA01
ucaggugcguacuuggcccggcg

SEQ ID NO: 3407104 - RNA, 16 nt, Pseudomonas aeruginosa PA01
ucaggugcuggacucg

SEQ ID NO: 3407105 - RNA, 20 nt, Pseudomonas aeruginosa PA01
ucaggugcuggacucgcgcc

SEQ ID NO: 3407106 - RNA, 17 nt, Pseudomonas aeruginosa PA01
ucagguucggcagcgcc

SEQ ID NO: 3407107 - RNA, 23 nt, Pseudomonas aeruginosa PA01
ucagguucggcagcgccucggcg

SEQ ID NO: 3407108 - RNA, 14 nt, Pseudomonas aeruginosa PA01
ucagguuggacagg

SEQ ID NO: 3407109 - RNA, 18 nt, Pseudomonas aeruginosa PA01
ucaguaccugcaaggcgg

SEQ ID NO: 3407110 - RNA, 12 nt, Pseudomonas aeruginosa PA01
ucaguacucugg

SEQ ID NO: 3407111 - RNA, 13 nt, Pseudomonas aeruginosa PA01
ucagucaggaucg

SEQ ID NO: 3407112 - RNA, 14 nt, Pseudomonas aeruginosa PA01
ucagucccgcggcg

SEQ ID NO: 3407113 - RNA, 15 nt, Pseudomonas aeruginosa PA01
ucagucccgcggcgc

SEQ ID NO: 3407114 - RNA, 23 nt, Pseudomonas aeruginosa PA01
uccaccaccagggucuccaggac

SEQ ID NO: 3407115 - RNA, 21 nt, Pseudomonas aeruginosa PA01
uccaccagaaggcgggcagcc

SEQ ID NO: 3407116 - RNA, 13 nt, Pseudomonas aeruginosa PA01
uccaccagcccgc

SEQ ID NO: 3407117 - RNA, 23 nt, Pseudomonas aeruginosa PA01
uccaccagcgcccguagcacaug

SEQ ID NO: 3407118 - RNA, 22 nt, Pseudomonas aeruginosa PA01
uccaccagcgccggcggcgcgu

SEQ ID NO: 3407119 - RNA, 20 nt, Pseudomonas aeruginosa PA01
uccaccagggccucggggcc

SEQ ID NO: 3407120 - RNA, 22 nt, Pseudomonas aeruginosa PA01
uccaccagggucgguucgcggc

SEQ ID NO: 3407121 - RNA, 16 nt, Pseudomonas aeruginosa PA01
uccacccaggcgccga

SEQ ID NO: 3407122 - RNA, 23 nt, Pseudomonas aeruginosa PA01
uccacccccaucgcccgcagcca

SEQ ID NO: 3407123 - RNA, 18 nt, Pseudomonas aeruginosa PA01
uccacccccgcaaccgcu

SEQ ID NO: 3407124 - RNA, 13 nt, Pseudomonas aeruginosa PA01
uccacccgcagcc

SEQ ID NO: 3407125 - RNA, 14 nt, Pseudomonas aeruginosa PA01
uccacccgcagccg

SEQ ID NO: 3407126 - RNA, 17 nt, Pseudomonas aeruginosa PA01
uccacccguucgccggc

SEQ ID NO: 3407127 - RNA, 19 nt, Pseudomonas aeruginosa PA01
uccacccguucgccggccu

SEQ ID NO: 3407128 - RNA, 18 nt, Pseudomonas aeruginosa PA01
uccaccgaguggcgcagc

SEQ ID NO: 3407129 - RNA, 19 nt, Pseudomonas aeruginosa PA01
uccaccgaguggcgcagcg

SEQ ID NO: 3407130 - RNA, 21 nt, Pseudomonas aeruginosa PA01
uccaccgaguggcgcagcgcc

SEQ ID NO: 3407131 - RNA, 22 nt, Pseudomonas aeruginosa PA01
uccaccgaguggcgcagcgccc

SEQ ID NO: 3407132 - RNA, 14 nt, Pseudomonas aeruginosa PA01
uccaccgauuucag

SEQ ID NO: 3407133 - RNA, 14 nt, Pseudomonas aeruginosa PA01
uccaccgccagcac

SEQ ID NO: 3407134 - RNA, 13 nt, Pseudomonas aeruginosa PA01
uccaccgccgcca

SEQ ID NO: 3407135 - RNA, 14 nt, Pseudomonas aeruginosa PA01
uccaccgccugccc

SEQ ID NO: 3407136 - RNA, 15 nt, Pseudomonas aeruginosa PA01
uccaccgcgcuccgc

SEQ ID NO: 3407137 - RNA, 15 nt, Pseudomonas aeruginosa PA01
uccaccgcuccggcg

SEQ ID NO: 3407138 - RNA, 18 nt, Pseudomonas aeruginosa PA01
uccaccgcuccggcgccg

SEQ ID NO: 3407139 - RNA, 18 nt, Pseudomonas aeruginosa PA01
uccaccggaucgcccugg

SEQ ID NO: 3407140 - RNA, 13 nt, Pseudomonas aeruginosa PA01
uccaccggcccgg

SEQ ID NO: 3407141 - RNA, 13 nt, Pseudomonas aeruginosa PA01
uccaccggccgcg

SEQ ID NO: 3407142 - RNA, 17 nt, Pseudomonas aeruginosa PA01
uccaccggcguccacuc

SEQ ID NO: 3407143 - RNA, 16 nt, Pseudomonas aeruginosa PA01
uccaccggcuggccgc

SEQ ID NO: 3407144 - RNA, 19 nt, Pseudomonas aeruginosa PA01
uccaccggcuugccgggug

SEQ ID NO: 3407145 - RNA, 22 nt, Pseudomonas aeruginosa PA01
uccaccgucgcggucaucgccg

SEQ ID NO: 3407146 - RNA, 23 nt, Pseudomonas aeruginosa PA01
uccaccgucgcggucaucgccgg

SEQ ID NO: 3407147 - RNA, 21 nt, Pseudomonas aeruginosa PA01
uccaccguuccgacccggccg

SEQ ID NO: 3407148 - RNA, 13 nt, Pseudomonas aeruginosa PA01
uccaccuccaccu

SEQ ID NO: 3407149 - RNA, 18 nt, Pseudomonas aeruginosa PA01
uccaccucgacccuggcg

SEQ ID NO: 3407150 - RNA, 19 nt, Pseudomonas aeruginosa PA01
uccaccucgacccuggcgc

SEQ ID NO: 3407151 - RNA, 20 nt, Pseudomonas aeruginosa PA01
uccaccucgacccuggcgcc

SEQ ID NO: 3407152 - RNA, 13 nt, Pseudomonas aeruginosa PA01
uccaccucgcccu

SEQ ID NO: 3407153 - RNA, 17 nt, Pseudomonas aeruginosa PA01
uccaccuugccgcgccc

SEQ ID NO: 3407154 - RNA, 18 nt, Pseudomonas aeruginosa PA01
uccaccuugccgcgcccg

SEQ ID NO: 3407155 - RNA, 20 nt, Pseudomonas aeruginosa PA01
uccaccuugccgcgcccggc

SEQ ID NO: 3407156 - RNA, 18 nt, Pseudomonas aeruginosa PA01
uccacgaaaaagcccggc

SEQ ID NO: 3407157 - RNA, 16 nt, Pseudomonas aeruginosa PA01
uccacgaagagcaccu

SEQ ID NO: 3407158 - RNA, 15 nt, Pseudomonas aeruginosa PA01
uccacgacgaacggc

SEQ ID NO: 3407159 - RNA, 19 nt, Pseudomonas aeruginosa PA01
uccacgacucacccgcugc

SEQ ID NO: 3407160 - RNA, 16 nt, Pseudomonas aeruginosa PA01
uccacgagagaaauga

SEQ ID NO: 3407161 - RNA, 22 nt, Pseudomonas aeruginosa PA01
uccacgccauaggcggcgcaga

SEQ ID NO: 3407162 - RNA, 20 nt, Pseudomonas aeruginosa PA01
uccacgccgaagucggcgag

SEQ ID NO: 3407163 - RNA, 15 nt, Pseudomonas aeruginosa PA01
uccacgccuggcccu

SEQ ID NO: 3407164 - RNA, 17 nt, Pseudomonas aeruginosa PA01
uccacgccuucgcggcc

SEQ ID NO: 3407165 - RNA, 12 nt, Pseudomonas aeruginosa PA01
uccacgcgccga

SEQ ID NO: 3407166 - RNA, 22 nt, Pseudomonas aeruginosa PA01
uccacgcugugcggcagcaggc

SEQ ID NO: 3407167 - RNA, 20 nt, Pseudomonas aeruginosa PA01
uccacgcuguugguguugau

SEQ ID NO: 3407168 - RNA, 16 nt, Pseudomonas aeruginosa PA01
uccacgggucgcagcc

SEQ ID NO: 3407169 - RNA, 20 nt, Pseudomonas aeruginosa PA01
uccacgggucgcagccgagc

SEQ ID NO: 3407170 - RNA, 17 nt, Pseudomonas aeruginosa PA01
uccacguccuccaggcu

SEQ ID NO: 3407171 - RNA, 16 nt, Pseudomonas aeruginosa PA01
uccacgucgagcgggc

SEQ ID NO: 3407172 - RNA, 17 nt, Pseudomonas aeruginosa PA01
uccacgucgagcgggcg

SEQ ID NO: 3407173 - RNA, 14 nt, Pseudomonas aeruginosa PA01
uccacgucgccgac

SEQ ID NO: 3407174 - RNA, 15 nt, Pseudomonas aeruginosa PA01
uccacgucgccgacc

SEQ ID NO: 3407175 - RNA, 16 nt, Pseudomonas aeruginosa PA01
uccacgucgccgacca

SEQ ID NO: 3407176 - RNA, 19 nt, Pseudomonas aeruginosa PA01
uccacgucgccgaccaggc

SEQ ID NO: 3407177 - RNA, 20 nt, Pseudomonas aeruginosa PA01
uccacgucgccgaccaggcg

SEQ ID NO: 3407178 - RNA, 18 nt, Pseudomonas aeruginosa PA01
uccacguugcaguccagg

SEQ ID NO: 3407179 - RNA, 19 nt, Pseudomonas aeruginosa PA01
uccacguugcaguccaggc

SEQ ID NO: 3407180 - RNA, 18 nt, Pseudomonas aeruginosa PA01
uccacuccggcagcaccc

SEQ ID NO: 3407181 - RNA, 19 nt, Pseudomonas aeruginosa PA01
uccacuccggcagcacccg

SEQ ID NO: 3407182 - RNA, 22 nt, Pseudomonas aeruginosa PA01
uccacucgcccuugaccagucc

SEQ ID NO: 3407183 - RNA, 15 nt, Pseudomonas aeruginosa PA01
uccacugcuuggcca

SEQ ID NO: 3407184 - RNA, 16 nt, Pseudomonas aeruginosa PA01
uccacugcuuggccag

SEQ ID NO: 3407185 - RNA, 14 nt, Pseudomonas aeruginosa PA01
uccacugucucgcc

SEQ ID NO: 3407186 - RNA, 15 nt, Pseudomonas aeruginosa PA01
uccacugucucgccg

SEQ ID NO: 3407187 - RNA, 15 nt, Pseudomonas aeruginosa PA01
uccacuugcgccggc

SEQ ID NO: 3407188 - RNA, 16 nt, Pseudomonas aeruginosa PA01
uccagaaacggcugcc

SEQ ID NO: 3407189 - RNA, 20 nt, Pseudomonas aeruginosa PA01
uccagaacgccgcgcaccuc

SEQ ID NO: 3407190 - RNA, 16 nt, Pseudomonas aeruginosa PA01
uccagaaucucccgca

SEQ ID NO: 3407191 - RNA, 15 nt, Pseudomonas aeruginosa PA01
uccagacauccgggu

SEQ ID NO: 3407192 - RNA, 17 nt, Pseudomonas aeruginosa PA01
uccagaccuccagguag

SEQ ID NO: 3407193 - RNA, 16 nt, Pseudomonas aeruginosa PA01
uccagaccucgagcag

SEQ ID NO: 3407194 - RNA, 19 nt, Pseudomonas aeruginosa PA01
uccagaccucgagcaggcc

SEQ ID NO: 3407195 - RNA, 14 nt, Pseudomonas aeruginosa PA01
uccagaguccaugc

SEQ ID NO: 3407196 - RNA, 18 nt, Pseudomonas aeruginosa PA01
uccagagugcgcagcagc

SEQ ID NO: 3407197 - RNA, 20 nt, Pseudomonas aeruginosa PA01
uccagagugcgcagcagcgu

SEQ ID NO: 3407198 - RNA, 20 nt, Pseudomonas aeruginosa PA01
uccagauagugcggccaggc

SEQ ID NO: 3407199 - RNA, 21 nt, Pseudomonas aeruginosa PA01
uccagauagugcggccaggcg

SEQ ID NO: 3407200 - RNA, 16 nt, Pseudomonas aeruginosa PA01
uccagaugaaacugcc

SEQ ID NO: 3407201 - RNA, 19 nt, Pseudomonas aeruginosa PA01
uccagaugcuggagcuugc

SEQ ID NO: 3407202 - RNA, 19 nt, Pseudomonas aeruginosa PA01
uccagaugcuugcacaccu

SEQ ID NO: 3407203 - RNA, 17 nt, Pseudomonas aeruginosa PA01
uccagcaacgccgcccc

SEQ ID NO: 3407204 - RNA, 15 nt, Pseudomonas aeruginosa PA01
uccagcaacgccucg

SEQ ID NO: 3407205 - RNA, 14 nt, Pseudomonas aeruginosa PA01
uccagcaacggcau

SEQ ID NO: 3407206 - RNA, 22 nt, Pseudomonas aeruginosa PA01
uccagcaacggcaucgcucugc

SEQ ID NO: 3407207 - RNA, 14 nt, Pseudomonas aeruginosa PA01
uccagcaacggcuu

SEQ ID NO: 3407208 - RNA, 15 nt, Pseudomonas aeruginosa PA01
uccagcacccaggua

SEQ ID NO: 3407209 - RNA, 21 nt, Pseudomonas aeruginosa PA01
uccagcaccgcuuucaccagg

SEQ ID NO: 3407210 - RNA, 15 nt, Pseudomonas aeruginosa PA01
uccagcaccguggcg

SEQ ID NO: 3407211 - RNA, 15 nt, Pseudomonas aeruginosa PA01
uccagcacgccgauc

SEQ ID NO: 3407212 - RNA, 17 nt, Pseudomonas aeruginosa PA01
uccagcacgcuggcgag

SEQ ID NO: 3407213 - RNA, 18 nt, Pseudomonas aeruginosa PA01
uccagcacuacgcccaug

SEQ ID NO: 3407214 - RNA, 23 nt, Pseudomonas aeruginosa PA01
uccagcacucgcuccuccgggcg

SEQ ID NO: 3407215 - RNA, 15 nt, Pseudomonas aeruginosa PA01
uccagcagcacccgg

SEQ ID NO: 3407216 - RNA, 17 nt, Pseudomonas aeruginosa PA01
uccaggcgcgccuggau

SEQ ID NO: 3407217 - RNA, 13 nt, Pseudomonas aeruginosa PA01
uccaggcgcugcu

SEQ ID NO: 3407218 - RNA, 14 nt, Pseudomonas aeruginosa PA01
uccaggcgcugcuc

SEQ ID NO: 3407219 - RNA, 18 nt, Pseudomonas aeruginosa PA01
uccaggcggggucagagg

SEQ ID NO: 3407220 - RNA, 24 nt, Pseudomonas aeruginosa PA01
uccaggcgggugaacucaugcagg

SEQ ID NO: 3407221 - RNA, 16 nt, Pseudomonas aeruginosa PA01
uccaggcgguugcgga

SEQ ID NO: 3407222 - RNA, 17 nt, Pseudomonas aeruginosa PA01
uccaggcguccgcuggc

SEQ ID NO: 3407223 - RNA, 18 nt, Pseudomonas aeruginosa PA01
uccaggcguccgcuggcc

SEQ ID NO: 3407224 - RNA, 19 nt, Pseudomonas aeruginosa PA01
uccaggcguccgcuggccu

SEQ ID NO: 3407225 - RNA, 17 nt, Pseudomonas aeruginosa PA01
uccaggcgucggcgccu

SEQ ID NO: 3407226 - RNA, 20 nt, Pseudomonas aeruginosa PA01
uccaggcucuucagcacgcg

SEQ ID NO: 3407227 - RNA, 13 nt, Pseudomonas aeruginosa PA01
uccaggcuggccu

SEQ ID NO: 3407228 - RNA, 19 nt, Pseudomonas aeruginosa PA01
uccaggcuguagccggcga

SEQ ID NO: 3407229 - RNA, 18 nt, Pseudomonas aeruginosa PA01
uccaggcuguggcgcggc

SEQ ID NO: 3407230 - RNA, 20 nt, Pseudomonas aeruginosa PA01
uccaggcuguggcgcggcug

SEQ ID NO: 3407231 - RNA, 18 nt, Pseudomonas aeruginosa PA01
uccaggcuuuccaccgcc

SEQ ID NO: 3407232 - RNA, 21 nt, Pseudomonas aeruginosa PA01
uccaggcuuuccaccgccagc

SEQ ID NO: 3407233 - RNA, 16 nt, Pseudomonas aeruginosa PA01
uccaggcuuugcggca

SEQ ID NO: 3407234 - RNA, 18 nt, Pseudomonas aeruginosa PA01
uccagggagcgcucgcgc

SEQ ID NO: 3407235 - RNA, 20 nt, Pseudomonas aeruginosa PA01
uccagggcauccaucgccag

SEQ ID NO: 3407236 - RNA, 14 nt, Pseudomonas aeruginosa PA01
uccagggccagcuu

SEQ ID NO: 3407237 - RNA, 13 nt, Pseudomonas aeruginosa PA01
uccagggccagga

SEQ ID NO: 3407238 - RNA, 16 nt, Pseudomonas aeruginosa PA01
uccagggccaggauga

SEQ ID NO: 3407239 - RNA, 20 nt, Pseudomonas aeruginosa PA01
uccagggccggaucggccuu

SEQ ID NO: 3407240 - RNA, 15 nt, Pseudomonas aeruginosa PA01
uccagggccuggcgc

SEQ ID NO: 3407241 - RNA, 16 nt, Pseudomonas aeruginosa PA01
uccagggccuggcgca

SEQ ID NO: 3407242 - RNA, 17 nt, Pseudomonas aeruginosa PA01
uccagggcgaagucggc

SEQ ID NO: 3407243 - RNA, 19 nt, Pseudomonas aeruginosa PA01
uccagggcgaagucggcgc

SEQ ID NO: 3407244 - RNA, 19 nt, Pseudomonas aeruginosa PA01
uccagggcgcugaccaggu

SEQ ID NO: 3407245 - RNA, 14 nt, Pseudomonas aeruginosa PA01
uccagggcggcccg

SEQ ID NO: 3407246 - RNA, 18 nt, Pseudomonas aeruginosa PA01
uccagggcggcgcggagc

SEQ ID NO: 3407247 - RNA, 19 nt, Pseudomonas aeruginosa PA01
uccagggcgguuaccaggu

SEQ ID NO: 3407248 - RNA, 15 nt, Pseudomonas aeruginosa PA01
uccagggcugccacc

SEQ ID NO: 3407249 - RNA, 11 nt, Pseudomonas aeruginosa PA01
uccagggcuuc

SEQ ID NO: 3407250 - RNA, 21 nt, Pseudomonas aeruginosa PA01
uccaggggcauguccaccgcc

SEQ ID NO: 3407251 - RNA, 20 nt, Pseudomonas aeruginosa PA01
uccaggguagcgccgcgggc

SEQ ID NO: 3407252 - RNA, 14 nt, Pseudomonas aeruginosa PA01
uccaggguuggaag

SEQ ID NO: 3407253 - RNA, 16 nt, Pseudomonas aeruginosa PA01
uccaggguuggaagaa

SEQ ID NO: 3407254 - RNA, 19 nt, Pseudomonas aeruginosa PA01
uccagguaaaggccaccag

SEQ ID NO: 3407255 - RNA, 20 nt, Pseudomonas aeruginosa PA01
uccagguaaaggccaccaga

SEQ ID NO: 3407256 - RNA, 17 nt, Pseudomonas aeruginosa PA01
uccagguacagccgcag

SEQ ID NO: 3407257 - RNA, 15 nt, Pseudomonas aeruginosa PA01
uccagguagcccacc

SEQ ID NO: 3407258 - RNA, 18 nt, Pseudomonas aeruginosa PA01
uccaggucaugcccuggc

SEQ ID NO: 3407259 - RNA, 19 nt, Pseudomonas aeruginosa PA01
uccaggucaugcccuggcc

SEQ ID NO: 3407260 - RNA, 21 nt, Pseudomonas aeruginosa PA01
uccagguccgcaccguagcgg

SEQ ID NO: 3407261 - RNA, 20 nt, Pseudomonas aeruginosa PA01
uccaggucgaacagcggcug

SEQ ID NO: 3407262 - RNA, 18 nt, Pseudomonas aeruginosa PA01
uccaggucgaucagcagc

SEQ ID NO: 3407263 - RNA, 11 nt, Pseudomonas aeruginosa PA01
uccaggucggu

SEQ ID NO: 3407264 - RNA, 11 nt, Pseudomonas aeruginosa PA01
uccaggugcac

SEQ ID NO: 3407265 - RNA, 15 nt, Pseudomonas aeruginosa PA01
uccaggugcacggcc

SEQ ID NO: 3407266 - RNA, 18 nt, Pseudomonas aeruginosa PA01
uccaggugcacggccagg

SEQ ID NO: 3407267 - RNA, 19 nt, Pseudomonas aeruginosa PA01
uccaggugcacggccaggc

SEQ ID NO: 3407268 - RNA, 20 nt, Pseudomonas aeruginosa PA01
uccaggugccaauccgggcg

SEQ ID NO: 3407269 - RNA, 14 nt, Pseudomonas aeruginosa PA01
uccaggugcggcug

SEQ ID NO: 3407270 - RNA, 17 nt, Pseudomonas aeruginosa PA01
uccagguucggcgccag

SEQ ID NO: 3407271 - RNA, 20 nt, Pseudomonas aeruginosa PA01
uccagguucggcgccagcuc

SEQ ID NO: 3407272 - RNA, 19 nt, Pseudomonas aeruginosa PA01
uccaguacacccagggcag

SEQ ID NO: 3407273 - RNA, 13 nt, Pseudomonas aeruginosa PA01
uccaguagcgccu

SEQ ID NO: 3407274 - RNA, 15 nt, Pseudomonas aeruginosa PA01
uccaguagcgccugg

SEQ ID NO: 3407275 - RNA, 16 nt, Pseudomonas aeruginosa PA01
uccaguauccauguca

SEQ ID NO: 3407276 - RNA, 14 nt, Pseudomonas aeruginosa PA01
uccagucaccaggu

SEQ ID NO: 3407277 - RNA, 16 nt, Pseudomonas aeruginosa PA01
uccagucggggcaggc

SEQ ID NO: 3407278 - RNA, 21 nt, Pseudomonas aeruginosa PA01
uccagucggggcaggcgcagg

SEQ ID NO: 3407279 - RNA, 16 nt, Pseudomonas aeruginosa PA01
uccagugccucccggc

SEQ ID NO: 3407280 - RNA, 19 nt, Pseudomonas aeruginosa PA01
uccagugccucccggccau

SEQ ID NO: 3407281 - RNA, 18 nt, Pseudomonas aeruginosa PA01
uccaguucagggccacgc

SEQ ID NO: 3407282 - RNA, 21 nt, Pseudomonas aeruginosa PA01
uccaguucagggcgagcaggg

SEQ ID NO: 3407283 - RNA, 14 nt, Pseudomonas aeruginosa PA01
uccaguucaucgag

SEQ ID NO: 3407284 - RNA, 18 nt, Pseudomonas aeruginosa PA01
uccaguucaucgagcagg

SEQ ID NO: 3407285 - RNA, 14 nt, Pseudomonas aeruginosa PA01
uccaguuccucgcg

SEQ ID NO: 3407286 - RNA, 19 nt, Pseudomonas aeruginosa PA01
uccaguuccugcuccuccg

SEQ ID NO: 3407287 - RNA, 16 nt, Pseudomonas aeruginosa PA01
uccaguucggccgcgg

SEQ ID NO: 3407288 - RNA, 17 nt, Pseudomonas aeruginosa PA01
uccaguucggccgcggc

SEQ ID NO: 3407289 - RNA, 14 nt, Pseudomonas aeruginosa PA01
uccaguucggcgau

SEQ ID NO: 3407290 - RNA, 15 nt, Pseudomonas aeruginosa PA01
uccaguugcagcacc

SEQ ID NO: 3407291 - RNA, 22 nt, Pseudomonas aeruginosa PA01
uccaguugcagggugcuguguu

SEQ ID NO: 3407292 - RNA, 18 nt, Pseudomonas aeruginosa PA01
uccauagggcggcgcggc

SEQ ID NO: 3407293 - RNA, 22 nt, Pseudomonas aeruginosa PA01
uccauaguagagaugcaccggc

SEQ ID NO: 3407294 - RNA, 16 nt, Pseudomonas aeruginosa PA01
uccaucagcgccucca

SEQ ID NO: 3407295 - RNA, 18 nt, Pseudomonas aeruginosa PA01
uccauccagucuucgccg

SEQ ID NO: 3407296 - RNA, 12 nt, Pseudomonas aeruginosa PA01
uccaucccugcu

SEQ ID NO: 3407297 - RNA, 17 nt, Pseudomonas aeruginosa PA01
uccaucgcaggcagcgc

SEQ ID NO: 3407298 - RNA, 12 nt, Pseudomonas aeruginosa PA01
uccaucgccgcg

SEQ ID NO: 3407299 - RNA, 14 nt, Pseudomonas aeruginosa PA01
uccaucgccgcggc

SEQ ID NO: 3407300 - RNA, 16 nt, Pseudomonas aeruginosa PA01
uccaucgccgcggcga

SEQ ID NO: 3407301 - RNA, 16 nt, Pseudomonas aeruginosa PA01
uccaucucgccgcgca

SEQ ID NO: 3407302 - RNA, 15 nt, Pseudomonas aeruginosa PA01
uccaucucgcggcgg

SEQ ID NO: 3407303 - RNA, 16 nt, Pseudomonas aeruginosa PA01
uccaugaacucuuccc

SEQ ID NO: 3407304 - RNA, 17 nt, Pseudomonas aeruginosa PA01
uccaugcucgccaccug

SEQ ID NO: 3407305 - RNA, 12 nt, Pseudomonas aeruginosa PA01
uccaugggcaga

SEQ ID NO: 3407306 - RNA, 13 nt, Pseudomonas aeruginosa PA01
uccaugggcagac

SEQ ID NO: 3407307 - RNA, 23 nt, Pseudomonas aeruginosa PA01
uccauguagcguugcaggcaguc

SEQ ID NO: 3407308 - RNA, 18 nt, Pseudomonas aeruginosa PA01
uccaugucgcuggccugc

SEQ ID NO: 3407309 - RNA, 22 nt, Pseudomonas aeruginosa PA01
uccaugucgcuggccugcaggu

SEQ ID NO: 3407310 - RNA, 23 nt, Pseudomonas aeruginosa PA01
uccauguugcggcccagcggcag

SEQ ID NO: 3407311 - RNA, 22 nt, Pseudomonas aeruginosa PA01
uccauuagcgucgcgcggccag

SEQ ID NO: 3407312 - RNA, 15 nt, Pseudomonas aeruginosa PA01
ucccaacuggucuug

SEQ ID NO: 3407313 - RNA, 24 nt, Pseudomonas aeruginosa PA01
ucccaacuggucuugccgauggcg

SEQ ID NO: 3407314 - RNA, 13 nt, Pseudomonas aeruginosa PA01
ucccacaggccgg

SEQ ID NO: 3407315 - RNA, 21 nt, Pseudomonas aeruginosa PA01
ucccacaggccggcuaaccgc

SEQ ID NO: 3407316 - RNA, 14 nt, Pseudomonas aeruginosa PA01
ucccaccgcgcggc

SEQ ID NO: 3407317 - RNA, 20 nt, Pseudomonas aeruginosa PA01
ucccaccgcuuucagcgccg

SEQ ID NO: 3407318 - RNA, 23 nt, Pseudomonas aeruginosa PA01
ucccaccgcuuucagcgccgcuc

SEQ ID NO: 3407319 - RNA, 15 nt, Pseudomonas aeruginosa PA01
ucccgcgccagcgcc

SEQ ID NO: 3407320 - RNA, 18 nt, Pseudomonas aeruginosa PA01
ucccgcgccagcgccgcc

SEQ ID NO: 3407321 - RNA, 19 nt, Pseudomonas aeruginosa PA01
ucccgcgccagcgccgcca

SEQ ID NO: 3407322 - RNA, 20 nt, Pseudomonas aeruginosa PA01
ucccgcgccagcgccgccag

SEQ ID NO: 3407323 - RNA, 12 nt, Pseudomonas aeruginosa PA01
ucccgcgcgccg

SEQ ID NO: 3407324 - RNA, 23 nt, Pseudomonas aeruginosa PA01
ucccgcgcgccgagcccccggcg

SEQ ID NO: 3407325 - RNA, 12 nt, Pseudomonas aeruginosa PA01
ucccgcgcggcc

SEQ ID NO: 3407326 - RNA, 13 nt, Pseudomonas aeruginosa PA01
ucccgcgcggccc

SEQ ID NO: 3407327 - RNA, 20 nt, Pseudomonas aeruginosa PA01
ucccgcgcggcccuucgacg

SEQ ID NO: 3407328 - RNA, 14 nt, Pseudomonas aeruginosa PA01
ucccgcgcgggccg

SEQ ID NO: 3407329 - RNA, 22 nt, Pseudomonas aeruginosa PA01
ucccgcggcccgccgccggggc

SEQ ID NO: 3407330 - RNA, 18 nt, Pseudomonas aeruginosa PA01
ucccgcggcuccagccgc

SEQ ID NO: 3407331 - RNA, 15 nt, Pseudomonas aeruginosa PA01
ucccgcuccagccgg

SEQ ID NO: 3407332 - RNA, 16 nt, Pseudomonas aeruginosa PA01
ucccgcuccagccggc

SEQ ID NO: 3407333 - RNA, 17 nt, Pseudomonas aeruginosa PA01
ucccgcuucggcccgcu

SEQ ID NO: 3407334 - RNA, 16 nt, Pseudomonas aeruginosa PA01
ucccggacgggugcgc

SEQ ID NO: 3407335 - RNA, 23 nt, Pseudomonas aeruginosa PA01
ucccggccauugaacggaccuug

SEQ ID NO: 3407336 - RNA, 21 nt, Pseudomonas aeruginosa PA01
ucccggccuggugacccggac

SEQ ID NO: 3407337 - RNA, 14 nt, Pseudomonas aeruginosa PA01
ucccggcgcagagc

SEQ ID NO: 3407338 - RNA, 14 nt, Pseudomonas aeruginosa PA01
ucccggcgccgccc

SEQ ID NO: 3407339 - RNA, 12 nt, Pseudomonas aeruginosa PA01
ucccggcgcggc

SEQ ID NO: 3407340 - RNA, 13 nt, Pseudomonas aeruginosa PA01
ucccggcgcggcc

SEQ ID NO: 3407341 - RNA, 22 nt, Pseudomonas aeruginosa PA01
ucccggcgcggcuacccucucc

SEQ ID NO: 3407342 - RNA, 18 nt, Pseudomonas aeruginosa PA01
ucccggcugagcgccagg

SEQ ID NO: 3407343 - RNA, 12 nt, Pseudomonas aeruginosa PA01
ucccgggaaacc

SEQ ID NO: 3407344 - RNA, 14 nt, Pseudomonas aeruginosa PA01
ucccgggccagcuc

SEQ ID NO: 3407345 - RNA, 20 nt, Pseudomonas aeruginosa PA01
ucccgggccagcuccgccug

SEQ ID NO: 3407346 - RNA, 13 nt, Pseudomonas aeruginosa PA01
ucccgggcuccgg

SEQ ID NO: 3407347 - RNA, 21 nt, Pseudomonas aeruginosa PA01
ucccgggguugcccagcaggc

SEQ ID NO: 3407348 - RNA, 22 nt, Pseudomonas aeruginosa PA01
ucccgggguugcccagcaggcu

SEQ ID NO: 3407349 - RNA, 15 nt, Pseudomonas aeruginosa PA01
ucccggguucugcuc

SEQ ID NO: 3407350 - RNA, 20 nt, Pseudomonas aeruginosa PA01
ucccggguucugcucgaaca

SEQ ID NO: 3407351 - RNA, 15 nt, Pseudomonas aeruginosa PA01
ucccguaaggccagg

SEQ ID NO: 3407352 - RNA, 17 nt, Pseudomonas aeruginosa PA01
ucccguaaggccaggcu

SEQ ID NO: 3407353 - RNA, 20 nt, Pseudomonas aeruginosa PA01
ucccguaaggccaggcucgg

SEQ ID NO: 3407354 - RNA, 14 nt, Pseudomonas aeruginosa PA01
ucccguccagcgcu

SEQ ID NO: 3407355 - RNA, 16 nt, Pseudomonas aeruginosa PA01
ucccguccgcugcgcc

SEQ ID NO: 3407356 - RNA, 17 nt, Pseudomonas aeruginosa PA01
ucccguccgcugcgcca

SEQ ID NO: 3407357 - RNA, 13 nt, Pseudomonas aeruginosa PA01
ucccguccgggca

SEQ ID NO: 3407358 - RNA, 14 nt, Pseudomonas aeruginosa PA01
ucccgugccgggcc

SEQ ID NO: 3407359 - RNA, 17 nt, Pseudomonas aeruginosa PA01
ucccgugccgggccagc

SEQ ID NO: 3407360 - RNA, 15 nt, Pseudomonas aeruginosa PA01
ucccgugcggccuac

SEQ ID NO: 3407361 - RNA, 13 nt, Pseudomonas aeruginosa PA01
ucccguuccggcg

SEQ ID NO: 3407362 - RNA, 21 nt, Pseudomonas aeruginosa PA01
ucccuagggguucuccggguc

SEQ ID NO: 3407363 - RNA, 19 nt, Pseudomonas aeruginosa PA01
ucccuaucuccgccggggg

SEQ ID NO: 3407364 - RNA, 18 nt, Pseudomonas aeruginosa PA01
ucccucagguagucggcg

SEQ ID NO: 3407365 - RNA, 22 nt, Pseudomonas aeruginosa PA01
ucccucagguagucggcgaugc

SEQ ID NO: 3407366 - RNA, 13 nt, Pseudomonas aeruginosa PA01
ucccucgccgacc

SEQ ID NO: 3407367 - RNA, 12 nt, Pseudomonas aeruginosa PA01
ucccugaaggga

SEQ ID NO: 3407368 - RNA, 15 nt, Pseudomonas aeruginosa PA01
ucccugaccagcagg

SEQ ID NO: 3407369 - RNA, 20 nt, Pseudomonas aeruginosa PA01
ucccugcaauggggcggccg

SEQ ID NO: 3407370 - RNA, 22 nt, Pseudomonas aeruginosa PA01
ucccugcaauggggcggccggc

SEQ ID NO: 3407371 - RNA, 17 nt, Pseudomonas aeruginosa PA01
ucccugcccgcgccucg

SEQ ID NO: 3407372 - RNA, 15 nt, Pseudomonas aeruginosa PA01
ucccugccgcccuuc

SEQ ID NO: 3407373 - RNA, 13 nt, Pseudomonas aeruginosa PA01
ucccugccggcgg

SEQ ID NO: 3407374 - RNA, 13 nt, Pseudomonas aeruginosa PA01
ucccugcgccucg

SEQ ID NO: 3407375 - RNA, 21 nt, Pseudomonas aeruginosa PA01
ucccugcgggacccagacagg

SEQ ID NO: 3407376 - RNA, 19 nt, Pseudomonas aeruginosa PA01
ucccugcucgcgcaggguc

SEQ ID NO: 3407377 - RNA, 14 nt, Pseudomonas aeruginosa PA01
ucccugcugcggca

SEQ ID NO: 3407378 - RNA, 16 nt, Pseudomonas aeruginosa PA01
ucccuggagcagggcg

SEQ ID NO: 3407379 - RNA, 15 nt, Pseudomonas aeruginosa PA01
ucccuggccggcgau

SEQ ID NO: 3407380 - RNA, 23 nt, Pseudomonas aeruginosa PA01
ucccuggccggcgauggccgccu

SEQ ID NO: 3407381 - RNA, 15 nt, Pseudomonas aeruginosa PA01
ucccugggccugcag

SEQ ID NO: 3407382 - RNA, 13 nt, Pseudomonas aeruginosa PA01
ucccugucccgcc

SEQ ID NO: 3407383 - RNA, 17 nt, Pseudomonas aeruginosa PA01
ucccuucagggagagga

SEQ ID NO: 3407384 - RNA, 12 nt, Pseudomonas aeruginosa PA01
ucccuucuuuuu

SEQ ID NO: 3407385 - RNA, 20 nt, Pseudomonas aeruginosa PA01
ucccuucuuuuuuucaccgc

SEQ ID NO: 3407386 - RNA, 13 nt, Pseudomonas aeruginosa PA01
ucccuugccgccg

SEQ ID NO: 3407387 - RNA, 20 nt, Pseudomonas aeruginosa PA01
ucccuuguuuuccuggcccu

SEQ ID NO: 3407388 - RNA, 19 nt, Pseudomonas aeruginosa PA01
uccgaacagggcgaaggcc

SEQ ID NO: 3407389 - RNA, 21 nt, Pseudomonas aeruginosa PA01
uccgaacgcgaggucucgaug

SEQ ID NO: 3407390 - RNA, 22 nt, Pseudomonas aeruginosa PA01
uccgaauacugcacgcccaggc

SEQ ID NO: 3407391 - RNA, 13 nt, Pseudomonas aeruginosa PA01
uccgaaucgccua

SEQ ID NO: 3407392 - RNA, 16 nt, Pseudomonas aeruginosa PA01
uccgacaaggagcgcg

SEQ ID NO: 3407393 - RNA, 21 nt, Pseudomonas aeruginosa PA01
uccgacaaggagcgcgagcgg

SEQ ID NO: 3407394 - RNA, 17 nt, Pseudomonas aeruginosa PA01
uccgacaaucagcggcg

SEQ ID NO: 3407395 - RNA, 19 nt, Pseudomonas aeruginosa PA01
uccgacccggccgaccagg

SEQ ID NO: 3407396 - RNA, 19 nt, Pseudomonas aeruginosa PA01
uccgaccggggaguucgac

SEQ ID NO: 3407397 - RNA, 16 nt, Pseudomonas aeruginosa PA01
uccgaccuggggcggc

SEQ ID NO: 3407398 - RNA, 19 nt, Pseudomonas aeruginosa PA01
uccgaccuuugagggucag

SEQ ID NO: 3407399 - RNA, 21 nt, Pseudomonas aeruginosa PA01
uccgacgaucucaucgcccau

SEQ ID NO: 3407400 - RNA, 14 nt, Pseudomonas aeruginosa PA01
uccgacgccgcguc

SEQ ID NO: 3407401 - RNA, 18 nt, Pseudomonas aeruginosa PA01
uccgagaccggcagccgg

SEQ ID NO: 3407402 - RNA, 17 nt, Pseudomonas aeruginosa PA01
uccgagacgcugcaccg

SEQ ID NO: 3407403 - RNA, 18 nt, Pseudomonas aeruginosa PA01
uccgagacgcugcaccgc

SEQ ID NO: 3407404 - RNA, 21 nt, Pseudomonas aeruginosa PA01
uccgagcaggccuugcagggc

SEQ ID NO: 3407405 - RNA, 22 nt, Pseudomonas aeruginosa PA01
uccgagccguuggucaacggcg

SEQ ID NO: 3407406 - RNA, 20 nt, Pseudomonas aeruginosa PA01
uccgaggauaccgcacggcc

SEQ ID NO: 3407407 - RNA, 13 nt, Pseudomonas aeruginosa PA01
uccgaggaugggc

SEQ ID NO: 3407408 - RNA, 20 nt, Pseudomonas aeruginosa PA01
uccgaggcggauuugccgcc

SEQ ID NO: 3407409 - RNA, 21 nt, Pseudomonas aeruginosa PA01
uccgaggcggauuugccgccg

SEQ ID NO: 3407410 - RNA, 22 nt, Pseudomonas aeruginosa PA01
uccgaggcggauuugccgccga

SEQ ID NO: 3407411 - RNA, 14 nt, Pseudomonas aeruginosa PA01
uccgagggccgcgc

SEQ ID NO: 3407412 - RNA, 17 nt, Pseudomonas aeruginosa PA01
uccgaugaagcaggcgg

SEQ ID NO: 3407413 - RNA, 19 nt, Pseudomonas aeruginosa PA01
uccgauuucagcuucaucg

SEQ ID NO: 3407414 - RNA, 13 nt, Pseudomonas aeruginosa PA01
uccgcacccgggc

SEQ ID NO: 3407415 - RNA, 16 nt, Pseudomonas aeruginosa PA01
uccgcaccguagcggc

SEQ ID NO: 3407416 - RNA, 22 nt, Pseudomonas aeruginosa PA01
uccgcagcgcuuuucaggaugu

SEQ ID NO: 3407417 - RNA, 20 nt, Pseudomonas aeruginosa PA01
uccgcaggaaaccccucggc

SEQ ID NO: 3407418 - RNA, 23 nt, Pseudomonas aeruginosa PA01
uccgcaggaaaccccucggcuaa

SEQ ID NO: 3407419 - RNA, 16 nt, Pseudomonas aeruginosa PA01
uccgcaggcaggucgc

SEQ ID NO: 3407420 - RNA, 20 nt, Pseudomonas aeruginosa PA01
uccgcaggcaggucgcugcc

SEQ ID NO: 3407421 - RNA, 14 nt, Pseudomonas aeruginosa PA01
uccgcaguugaggc

SEQ ID NO: 3407422 - RNA, 18 nt, Pseudomonas aeruginosa PA01
uccgcgcccggcuggcca

SEQ ID NO: 3407423 - RNA, 21 nt, Pseudomonas aeruginosa PA01
uccgcgcccggcuggccaucc

SEQ ID NO: 3407424 - RNA, 15 nt, Pseudomonas aeruginosa PA01
uccgcgccgaccagc

SEQ ID NO: 3407425 - RNA, 16 nt, Pseudomonas aeruginosa PA01
uccgcgccgaccagcc

SEQ ID NO: 3407426 - RNA, 18 nt, Pseudomonas aeruginosa PA01
uccgcgccgaccagccgc

SEQ ID NO: 3407427 - RNA, 18 nt, Pseudomonas aeruginosa PA01
uccgcgccgcgucgccgc

SEQ ID NO: 3407428 - RNA, 22 nt, Pseudomonas aeruginosa PA01
uccgcgccgcgucgccgccagc

SEQ ID NO: 3407429 - RNA, 20 nt, Pseudomonas aeruginosa PA01
uccgcgcgaucgaggccuac

SEQ ID NO: 3407430 - RNA, 19 nt, Pseudomonas aeruginosa PA01
uccgcgcgcuuccaggcac

SEQ ID NO: 3407431 - RNA, 19 nt, Pseudomonas aeruginosa PA01
uccgcgcggcgcccugccg

SEQ ID NO: 3407432 - RNA, 22 nt, Pseudomonas aeruginosa PA01
uccgcgcggcgcccugccgggc

SEQ ID NO: 3407433 - RNA, 17 nt, Pseudomonas aeruginosa PA01
uccgcgcguucagccac

SEQ ID NO: 3407434 - RNA, 13 nt, Pseudomonas aeruginosa PA01
uccgcggagagga

SEQ ID NO: 3407435 - RNA, 16 nt, Pseudomonas aeruginosa PA01
uccgcggagucgccgg

SEQ ID NO: 3407436 - RNA, 19 nt, Pseudomonas aeruginosa PA01
uccgcggaucguccgggcg

SEQ ID NO: 3407437 - RNA, 18 nt, Pseudomonas aeruginosa PA01
uccgcggcacuccggcau

SEQ ID NO: 3407438 - RNA, 15 nt, Pseudomonas aeruginosa PA01
uccgcggccccggcg

SEQ ID NO: 3407439 - RNA, 16 nt, Pseudomonas aeruginosa PA01
uccgcggccccggcgu

SEQ ID NO: 3407440 - RNA, 18 nt, Pseudomonas aeruginosa PA01
uccgcggcccugcucgcc

SEQ ID NO: 3407441 - RNA, 21 nt, Pseudomonas aeruginosa PA01
uccgcggcccugcucgccggc

SEQ ID NO: 3407442 - RNA, 22 nt, Pseudomonas aeruginosa PA01
uccgcggcccugcucgccggcg

SEQ ID NO: 3407443 - RNA, 23 nt, Pseudomonas aeruginosa PA01
uccgcggcccugcucgccggcgc

SEQ ID NO: 3407444 - RNA, 15 nt, Pseudomonas aeruginosa PA01
uccgcgggacgcggc

SEQ ID NO: 3407445 - RNA, 18 nt, Pseudomonas aeruginosa PA01
uccgcgggacgcggcgug

SEQ ID NO: 3407446 - RNA, 21 nt, Pseudomonas aeruginosa PA01
uccgcgguagcugcgcagggc

SEQ ID NO: 3407447 - RNA, 22 nt, Pseudomonas aeruginosa PA01
uccgcgguagcugcgcagggcg

SEQ ID NO: 3407448 - RNA, 22 nt, Pseudomonas aeruginosa PA01
uccgcgguguuuccgucguggc

SEQ ID NO: 3407449 - RNA, 14 nt, Pseudomonas aeruginosa PA01
uccgcgucacggac

SEQ ID NO: 3407450 - RNA, 17 nt, Pseudomonas aeruginosa PA01
uccgcgucacggacccg

SEQ ID NO: 3407451 - RNA, 23 nt, Pseudomonas aeruginosa PA01
uccgcgucacggacccgcucggc

SEQ ID NO: 3407452 - RNA, 12 nt, Pseudomonas aeruginosa PA01
uccgcguggcga

SEQ ID NO: 3407453 - RNA, 21 nt, Pseudomonas aeruginosa PA01
uccgcguggcgaugcccuggc

SEQ ID NO: 3407454 - RNA, 21 nt, Pseudomonas aeruginosa PA01
uccgcguggcgugcucggcga

SEQ ID NO: 3407455 - RNA, 23 nt, Pseudomonas aeruginosa PA01
uccgcguggcgugcucggcgauc

SEQ ID NO: 3407456 - RNA, 20 nt, Pseudomonas aeruginosa PA01
uccgcguuaccguccgcgcc

SEQ ID NO: 3407457 - RNA, 13 nt, Pseudomonas aeruginosa PA01
uccgcucaccagg

SEQ ID NO: 3407458 - RNA, 20 nt, Pseudomonas aeruginosa PA01
uccgcucaccaggcccgccg

SEQ ID NO: 3407459 - RNA, 13 nt, Pseudomonas aeruginosa PA01
uccgcuccagcag

SEQ ID NO: 3407460 - RNA, 17 nt, Pseudomonas aeruginosa PA01
uccgcucgaucccggcg

SEQ ID NO: 3407461 - RNA, 14 nt, Pseudomonas aeruginosa PA01
uccgcucugcuggc

SEQ ID NO: 3407462 - RNA, 15 nt, Pseudomonas aeruginosa PA01
uccgcucugcuggcc

SEQ ID NO: 3407463 - RNA, 22 nt, Pseudomonas aeruginosa PA01
uccgcugaggauguagccggcu

SEQ ID NO: 3407464 - RNA, 23 nt, Pseudomonas aeruginosa PA01
uccgcugcaugaaaaagcccggc

SEQ ID NO: 3407465 - RNA, 15 nt, Pseudomonas aeruginosa PA01
uccgcugcgagcagg

SEQ ID NO: 3407466 - RNA, 17 nt, Pseudomonas aeruginosa PA01
uccgcugguagcccagg

SEQ ID NO: 3407467 - RNA, 20 nt, Pseudomonas aeruginosa PA01
uccgcugguagcccaggccg

SEQ ID NO: 3407468 - RNA, 16 nt, Pseudomonas aeruginosa PA01
uccgcuguccgccgcc

SEQ ID NO: 3407469 - RNA, 19 nt, Pseudomonas aeruginosa PA01
uccgcuucagcgcgccgag

SEQ ID NO: 3407470 - RNA, 21 nt, Pseudomonas aeruginosa PA01
uccgcuuccacgcugaggcuc

SEQ ID NO: 3407471 - RNA, 17 nt, Pseudomonas aeruginosa PA01
uccggacgccgaacgcc

SEQ ID NO: 3407472 - RNA, 21 nt, Pseudomonas aeruginosa PA01
uccggacgccgaacgccccag

SEQ ID NO: 3407473 - RNA, 22 nt, Pseudomonas aeruginosa PA01
uccggacgccgaacgccccagu

SEQ ID NO: 3407474 - RNA, 16 nt, Pseudomonas aeruginosa PA01
uccggacgcugcaugc

SEQ ID NO: 3407475 - RNA, 16 nt, Pseudomonas aeruginosa PA01
uccggacugcccagcg

SEQ ID NO: 3407476 - RNA, 21 nt, Pseudomonas aeruginosa PA01
uccggacugcccagcgccgcc

SEQ ID NO: 3407477 - RNA, 13 nt, Pseudomonas aeruginosa PA01
uccggagccgggc

SEQ ID NO: 3407478 - RNA, 19 nt, Pseudomonas aeruginosa PA01
uccggaugcagauccagcg

SEQ ID NO: 3407479 - RNA, 23 nt, Pseudomonas aeruginosa PA01
uccggaugcagauccagcggcag

SEQ ID NO: 3407480 - RNA, 17 nt, Pseudomonas aeruginosa PA01
uccggauggcugacccg

SEQ ID NO: 3407481 - RNA, 15 nt, Pseudomonas aeruginosa PA01
uccggcaccaccacc

SEQ ID NO: 3407482 - RNA, 19 nt, Pseudomonas aeruginosa PA01
uccggcaccaccaccggac

SEQ ID NO: 3407483 - RNA, 18 nt, Pseudomonas aeruginosa PA01
uccggcaccaccagcgcg

SEQ ID NO: 3407484 - RNA, 19 nt, Pseudomonas aeruginosa PA01
uccggcaccgcucugcagu

SEQ ID NO: 3407485 - RNA, 22 nt, Pseudomonas aeruginosa PA01
uccggcaccuugcgaaaagccc

SEQ ID NO: 3407486 - RNA, 19 nt, Pseudomonas aeruginosa PA01
uccggcacgaacgaggcuc

SEQ ID NO: 3407487 - RNA, 21 nt, Pseudomonas aeruginosa PA01
uccggcacgcugccgccgaug

SEQ ID NO: 3407488 - RNA, 17 nt, Pseudomonas aeruginosa PA01
uccggcagcacccgcac

SEQ ID NO: 3407489 - RNA, 20 nt, Pseudomonas aeruginosa PA01
uccggcagcacccgcaccag

SEQ ID NO: 3407490 - RNA, 21 nt, Pseudomonas aeruginosa PA01
uccggcagcacccgcaccagc

SEQ ID NO: 3407491 - RNA, 15 nt, Pseudomonas aeruginosa PA01
uccggcagcaggguc

SEQ ID NO: 3407492 - RNA, 18 nt, Pseudomonas aeruginosa PA01
uccggcagcagggucagc

SEQ ID NO: 3407493 - RNA, 14 nt, Pseudomonas aeruginosa PA01
uccggcagccagcc

SEQ ID NO: 3407494 - RNA, 15 nt, Pseudomonas aeruginosa PA01
uccggcagccagccg

SEQ ID NO: 3407495 - RNA, 19 nt, Pseudomonas aeruginosa PA01
uccggcagccagccgccga

SEQ ID NO: 3407496 - RNA, 15 nt, Pseudomonas aeruginosa PA01
uccggcaggcucagc

SEQ ID NO: 3407497 - RNA, 18 nt, Pseudomonas aeruginosa PA01
uccggcagguucagcagg

SEQ ID NO: 3407498 - RNA, 19 nt, Pseudomonas aeruginosa PA01
uccggcagguucagcaggu

SEQ ID NO: 3407499 - RNA, 18 nt, Pseudomonas aeruginosa PA01
uccggcauaccgcccguc

SEQ ID NO: 3407500 - RNA, 15 nt, Pseudomonas aeruginosa PA01
uccggcaugcuugcc

SEQ ID NO: 3407501 - RNA, 16 nt, Pseudomonas aeruginosa PA01
uccggcaugcuugcca

SEQ ID NO: 3407502 - RNA, 12 nt, Pseudomonas aeruginosa PA01
uccggccaggcg

SEQ ID NO: 3407503 - RNA, 14 nt, Pseudomonas aeruginosa PA01
uccggccaggcgcg

SEQ ID NO: 3407504 - RNA, 22 nt, Pseudomonas aeruginosa PA01
uccggcccacgcucagugcgcc

SEQ ID NO: 3407505 - RNA, 14 nt, Pseudomonas aeruginosa PA01
uccggcccggccag

SEQ ID NO: 3407506 - RNA, 16 nt, Pseudomonas aeruginosa PA01
uccggcccggccaggc

SEQ ID NO: 3407507 - RNA, 16 nt, Pseudomonas aeruginosa PA01
uccggcccggccaggu

SEQ ID NO: 3407508 - RNA, 15 nt, Pseudomonas aeruginosa PA01
uccggcgaccaccac

SEQ ID NO: 3407509 - RNA, 16 nt, Pseudomonas aeruginosa PA01
uccggcgagcacggcg

SEQ ID NO: 3407510 - RNA, 12 nt, Pseudomonas aeruginosa PA01
uccggcgcagcc

SEQ ID NO: 3407511 - RNA, 16 nt, Pseudomonas aeruginosa PA01
uccggcgcagcccagc

SEQ ID NO: 3407512 - RNA, 22 nt, Pseudomonas aeruginosa PA01
uccggcgcagcggaggauucag

SEQ ID NO: 3407513 - RNA, 21 nt, Pseudomonas aeruginosa PA01
uccggcgccaacugcuugccg

SEQ ID NO: 3407514 - RNA, 16 nt, Pseudomonas aeruginosa PA01
uccggcgccaggccgg

SEQ ID NO: 3407515 - RNA, 12 nt, Pseudomonas aeruginosa PA01
uccggcgccgag

SEQ ID NO: 3407516 - RNA, 17 nt, Pseudomonas aeruginosa PA01
uccggcgcgccauggcg

SEQ ID NO: 3407517 - RNA, 13 nt, Pseudomonas aeruginosa PA01
uccggcgcggccu

SEQ ID NO: 3407518 - RNA, 14 nt, Pseudomonas aeruginosa PA01
uccggcgcggccug

SEQ ID NO: 3407519 - RNA, 15 nt, Pseudomonas aeruginosa PA01
uccggcgcggccugc

SEQ ID NO: 3407520 - RNA, 19 nt, Pseudomonas aeruginosa PA01
uccggcgcggccugcagcg

SEQ ID NO: 3407521 - RNA, 19 nt, Pseudomonas aeruginosa PA01
uccggcgcguuggcuggcg

SEQ ID NO: 3407522 - RNA, 15 nt, Pseudomonas aeruginosa PA01
uccggcgcugagcga

SEQ ID NO: 3407523 - RNA, 12 nt, Pseudomonas aeruginosa PA01
uccggcggcgau

SEQ ID NO: 3407524 - RNA, 20 nt, Pseudomonas aeruginosa PA01
uccucccaugaaaaauggcc

SEQ ID NO: 3407525 - RNA, 18 nt, Pseudomonas aeruginosa PA01
uccucccgccccuccagu

SEQ ID NO: 3407526 - RNA, 22 nt, Pseudomonas aeruginosa PA01
uccucccgccccuccaguuccu

SEQ ID NO: 3407527 - RNA, 18 nt, Pseudomonas aeruginosa PA01
uccuccgacgccccccac

SEQ ID NO: 3407528 - RNA, 13 nt, Pseudomonas aeruginosa PA01
uccuccgcgccca

SEQ ID NO: 3407529 - RNA, 15 nt, Pseudomonas aeruginosa PA01
uccuccgcgcccagg

SEQ ID NO: 3407530 - RNA, 17 nt, Pseudomonas aeruginosa PA01
uccuccggacgccgaac

SEQ ID NO: 3407531 - RNA, 16 nt, Pseudomonas aeruginosa PA01
uccuccuccaguuccu

SEQ ID NO: 3407532 - RNA, 15 nt, Pseudomonas aeruginosa PA01
uccuccucgccgccg

SEQ ID NO: 3407533 - RNA, 11 nt, Pseudomonas aeruginosa PA01
uccuccuggau

SEQ ID NO: 3407534 - RNA, 20 nt, Pseudomonas aeruginosa PA01
uccuccuggauacgcucggc

SEQ ID NO: 3407535 - RNA, 17 nt, Pseudomonas aeruginosa PA01
uccucgaaagccgccgc

SEQ ID NO: 3407536 - RNA, 20 nt, Pseudomonas aeruginosa PA01
uccucgacauggaucaccgc

SEQ ID NO: 3407537 - RNA, 22 nt, Pseudomonas aeruginosa PA01
uccucgacauggaucaccgcca

SEQ ID NO: 3407538 - RNA, 19 nt, Pseudomonas aeruginosa PA01
uccucgacccacuggcgga

SEQ ID NO: 3407539 - RNA, 21 nt, Pseudomonas aeruginosa PA01
uccucgacgaaauaaugcggc

SEQ ID NO: 3407540 - RNA, 13 nt, Pseudomonas aeruginosa PA01
uccucgaucaggc

SEQ ID NO: 3407541 - RNA, 21 nt, Pseudomonas aeruginosa PA01
uccucgaugaaacgcagggcc

SEQ ID NO: 3407542 - RNA, 21 nt, Pseudomonas aeruginosa PA01
uccucgaugaaugcgcagguc

SEQ ID NO: 3407543 - RNA, 19 nt, Pseudomonas aeruginosa PA01
uccucgauggugacguugc

SEQ ID NO: 3407544 - RNA, 18 nt, Pseudomonas aeruginosa PA01
uccucgccccgccgggag

SEQ ID NO: 3407545 - RNA, 14 nt, Pseudomonas aeruginosa PA01
uccucgccgccgac

SEQ ID NO: 3407546 - RNA, 11 nt, Pseudomonas aeruginosa PA01
uccucgccgcu

SEQ ID NO: 3407547 - RNA, 19 nt, Pseudomonas aeruginosa PA01
uccucgccgcuccgcgcca

SEQ ID NO: 3407548 - RNA, 14 nt, Pseudomonas aeruginosa PA01
uccucgccgcuggc

SEQ ID NO: 3407549 - RNA, 21 nt, Pseudomonas aeruginosa PA01
uccucgccguacagcaggcag

SEQ ID NO: 3407550 - RNA, 20 nt, Pseudomonas aeruginosa PA01
uccucgccguuggcgaggac

SEQ ID NO: 3407551 - RNA, 14 nt, Pseudomonas aeruginosa PA01
uccucgccucgcgc

SEQ ID NO: 3407552 - RNA, 16 nt, Pseudomonas aeruginosa PA01
uccucgccucgcgcca

SEQ ID NO: 3407553 - RNA, 16 nt, Pseudomonas aeruginosa PA01
uccucgcgacaccggg

SEQ ID NO: 3407554 - RNA, 17 nt, Pseudomonas aeruginosa PA01
uccucgcgcaccgcggc

SEQ ID NO: 3407555 - RNA, 17 nt, Pseudomonas aeruginosa PA01
uccucggagagcagcca

SEQ ID NO: 3407556 - RNA, 16 nt, Pseudomonas aeruginosa PA01
uccucggcagcgcugg

SEQ ID NO: 3407557 - RNA, 17 nt, Pseudomonas aeruginosa PA01
uccucggcagcgcuggc

SEQ ID NO: 3407558 - RNA, 13 nt, Pseudomonas aeruginosa PA01
uccucggcaucca

SEQ ID NO: 3407559 - RNA, 20 nt, Pseudomonas aeruginosa PA01
uccucggccaacggccgcuu

SEQ ID NO: 3407560 - RNA, 23 nt, Pseudomonas aeruginosa PA01
uccucggccauaccuccagccag

SEQ ID NO: 3407561 - RNA, 14 nt, Pseudomonas aeruginosa PA01
uccucggccaugcc

SEQ ID NO: 3407562 - RNA, 13 nt, Pseudomonas aeruginosa PA01
uccucggccgaca

SEQ ID NO: 3407563 - RNA, 13 nt, Pseudomonas aeruginosa PA01
uccucggccgcca

SEQ ID NO: 3407564 - RNA, 15 nt, Pseudomonas aeruginosa PA01
uccucggccgccagg

SEQ ID NO: 3407565 - RNA, 16 nt, Pseudomonas aeruginosa PA01
uccucggccugggcgc

SEQ ID NO: 3407566 - RNA, 22 nt, Pseudomonas aeruginosa PA01
uccucggcgaacuccgccagcu

SEQ ID NO: 3407567 - RNA, 20 nt, Pseudomonas aeruginosa PA01
uccucggcggccuuuucggc

SEQ ID NO: 3407568 - RNA, 14 nt, Pseudomonas aeruginosa PA01
uccucggcggcggu

SEQ ID NO: 3407569 - RNA, 17 nt, Pseudomonas aeruginosa PA01
uccucggcguagccggc

SEQ ID NO: 3407570 - RNA, 18 nt, Pseudomonas aeruginosa PA01
uccucggcguagccggcc

SEQ ID NO: 3407571 - RNA, 14 nt, Pseudomonas aeruginosa PA01
uccucgggcaccag

SEQ ID NO: 3407572 - RNA, 16 nt, Pseudomonas aeruginosa PA01
uccucgggcaccagca

SEQ ID NO: 3407573 - RNA, 21 nt, Pseudomonas aeruginosa PA01
uccucgggcaccagcacggug

SEQ ID NO: 3407574 - RNA, 24 nt, Pseudomonas aeruginosa PA01
uccucgggcggaucgagcagcggc

SEQ ID NO: 3407575 - RNA, 17 nt, Pseudomonas aeruginosa PA01
uccucggucuuuuucgc

SEQ ID NO: 3407576 - RNA, 17 nt, Pseudomonas aeruginosa PA01
uccucggugcgcacgca

SEQ ID NO: 3407577 - RNA, 22 nt, Pseudomonas aeruginosa PA01
uccucguccagcaggcccagcc

SEQ ID NO: 3407578 - RNA, 13 nt, Pseudomonas aeruginosa PA01
uccucgucgaggu

SEQ ID NO: 3407579 - RNA, 19 nt, Pseudomonas aeruginosa PA01
uccucgucguacuggcgga

SEQ ID NO: 3407580 - RNA, 22 nt, Pseudomonas aeruginosa PA01
uccucuaccaggcgguuggccc

SEQ ID NO: 3407581 - RNA, 17 nt, Pseudomonas aeruginosa PA01
uccugaccccggccugg

SEQ ID NO: 3407582 - RNA, 18 nt, Pseudomonas aeruginosa PA01
uccugaccccggccuggc

SEQ ID NO: 3407583 - RNA, 12 nt, Pseudomonas aeruginosa PA01
uccugaggcucc

SEQ ID NO: 3407584 - RNA, 15 nt, Pseudomonas aeruginosa PA01
uccugaggcucccag

SEQ ID NO: 3407585 - RNA, 17 nt, Pseudomonas aeruginosa PA01
uccugauagggggcugc

SEQ ID NO: 3407586 - RNA, 20 nt, Pseudomonas aeruginosa PA01
uccugaugaaucgccucccu

SEQ ID NO: 3407587 - RNA, 18 nt, Pseudomonas aeruginosa PA01
uccugcaacgccuggugc

SEQ ID NO: 3407588 - RNA, 21 nt, Pseudomonas aeruginosa PA01
uccugcaacgccuggugcagg

SEQ ID NO: 3407589 - RNA, 14 nt, Pseudomonas aeruginosa PA01
uccugcaacugacg

SEQ ID NO: 3407590 - RNA, 19 nt, Pseudomonas aeruginosa PA01
uccugcaacugacggcgga

SEQ ID NO: 3407591 - RNA, 13 nt, Pseudomonas aeruginosa PA01
uccugcaacugga

SEQ ID NO: 3407592 - RNA, 14 nt, Pseudomonas aeruginosa PA01
uccugcaacuggaa

SEQ ID NO: 3407593 - RNA, 14 nt, Pseudomonas aeruginosa PA01
uccugcacgcugcg

SEQ ID NO: 3407594 - RNA, 22 nt, Pseudomonas aeruginosa PA01
uccugcacgcugcgccggcgcu

SEQ ID NO: 3407595 - RNA, 11 nt, Pseudomonas aeruginosa PA01
uccugcagcag

SEQ ID NO: 3407596 - RNA, 19 nt, Pseudomonas aeruginosa PA01
uccugcaggcccugccagu

SEQ ID NO: 3407597 - RNA, 15 nt, Pseudomonas aeruginosa PA01
uccugcaggcucagc

SEQ ID NO: 3407598 - RNA, 19 nt, Pseudomonas aeruginosa PA01
uccugcaggcucagcaccu

SEQ ID NO: 3407599 - RNA, 21 nt, Pseudomonas aeruginosa PA01
uccugcaggcucagcaccuug

SEQ ID NO: 3407600 - RNA, 17 nt, Pseudomonas aeruginosa PA01
uccugccccgugcaccg

SEQ ID NO: 3407601 - RNA, 15 nt, Pseudomonas aeruginosa PA01
uccugccgcaggcgg

SEQ ID NO: 3407602 - RNA, 16 nt, Pseudomonas aeruginosa PA01
uccugccgcaggcggg

SEQ ID NO: 3407603 - RNA, 12 nt, Pseudomonas aeruginosa PA01
uccugccgccga

SEQ ID NO: 3407604 - RNA, 13 nt, Pseudomonas aeruginosa PA01
uccugccgcggcg

SEQ ID NO: 3407605 - RNA, 14 nt, Pseudomonas aeruginosa PA01
uccugccgcggcga

SEQ ID NO: 3407606 - RNA, 17 nt, Pseudomonas aeruginosa PA01
uccugccggugcucggc

SEQ ID NO: 3407607 - RNA, 18 nt, Pseudomonas aeruginosa PA01
uccugcgcgccucuuccu

SEQ ID NO: 3407608 - RNA, 15 nt, Pseudomonas aeruginosa PA01
uccugcgcggcgacg

SEQ ID NO: 3407609 - RNA, 14 nt, Pseudomonas aeruginosa PA01
uccugcggaaacgg

SEQ ID NO: 3407610 - RNA, 21 nt, Pseudomonas aeruginosa PA01
uccugcggauucaucggcggc

SEQ ID NO: 3407611 - RNA, 18 nt, Pseudomonas aeruginosa PA01
uccugcggccgcaaccag

SEQ ID NO: 3407612 - RNA, 13 nt, Pseudomonas aeruginosa PA01
uccugcggccggg

SEQ ID NO: 3407613 - RNA, 14 nt, Pseudomonas aeruginosa PA01
uccugcggcggcag

SEQ ID NO: 3407614 - RNA, 16 nt, Pseudomonas aeruginosa PA01
uccugcggcuggcgaa

SEQ ID NO: 3407615 - RNA, 17 nt, Pseudomonas aeruginosa PA01
uccugcggcuggcgaac

SEQ ID NO: 3407616 - RNA, 15 nt, Pseudomonas aeruginosa PA01
uccugcggcuugccc

SEQ ID NO: 3407617 - RNA, 19 nt, Pseudomonas aeruginosa PA01
uccugcucagcggcccagc

SEQ ID NO: 3407618 - RNA, 15 nt, Pseudomonas aeruginosa PA01
uccugcucccuggcg

SEQ ID NO: 3407619 - RNA, 20 nt, Pseudomonas aeruginosa PA01
uccugcucccuggcggauau

SEQ ID NO: 3407620 - RNA, 13 nt, Pseudomonas aeruginosa PA01
uccugcucgagau

SEQ ID NO: 3407621 - RNA, 19 nt, Pseudomonas aeruginosa PA01
uccugcucgauccagccgg

SEQ ID NO: 3407622 - RNA, 20 nt, Pseudomonas aeruginosa PA01
uccugcucgauccagccggc

SEQ ID NO: 3407623 - RNA, 21 nt, Pseudomonas aeruginosa PA01
uccugcucgauccagccggca

SEQ ID NO: 3407624 - RNA, 20 nt, Pseudomonas aeruginosa PA01
uccugcugagcagucgccug

SEQ ID NO: 3407625 - RNA, 14 nt, Pseudomonas aeruginosa PA01
uccugcugcgacag

SEQ ID NO: 3407626 - RNA, 16 nt, Pseudomonas aeruginosa PA01
uccugcuggcuggcag

SEQ ID NO: 3407627 - RNA, 12 nt, Pseudomonas aeruginosa PA01
ucgaacuggcca

SEQ ID NO: 3407628 - RNA, 18 nt, Pseudomonas aeruginosa PA01
ucgaagaaaaggcccggc

SEQ ID NO: 3407629 - RNA, 20 nt, Pseudomonas aeruginosa PA01
ucgaagaagcgcaccaccug

SEQ ID NO: 3407630 - RNA, 19 nt, Pseudomonas aeruginosa PA01
ucgaagaaggcucaccggu

SEQ ID NO: 3407631 - RNA, 19 nt, Pseudomonas aeruginosa PA01
ucgaagaaugccuucaccg

SEQ ID NO: 3407632 - RNA, 19 nt, Pseudomonas aeruginosa PA01
ucgaagaccagcggagcgu

SEQ ID NO: 3407633 - RNA, 16 nt, Pseudomonas aeruginosa PA01
ucgaagaccagggugg

SEQ ID NO: 3407634 - RNA, 19 nt, Pseudomonas aeruginosa PA01
ucgaagacccccugccgcc

SEQ ID NO: 3407635 - RNA, 20 nt, Pseudomonas aeruginosa PA01
ucgaagacccccugccgccc

SEQ ID NO: 3407636 - RNA, 20 nt, Pseudomonas aeruginosa PA01
ucgaagagcuggcggccgcg

SEQ ID NO: 3407637 - RNA, 13 nt, Pseudomonas aeruginosa PA01
ucgaagcaauacc

SEQ ID NO: 3407638 - RNA, 16 nt, Pseudomonas aeruginosa PA01
ucgaagcccagcgccu

SEQ ID NO: 3407639 - RNA, 17 nt, Pseudomonas aeruginosa PA01
ucgaagcccagcgccug

SEQ ID NO: 3407640 - RNA, 16 nt, Pseudomonas aeruginosa PA01
ucgaagccgagcugcc

SEQ ID NO: 3407641 - RNA, 23 nt, Pseudomonas aeruginosa PA01
ucgaagccgaggcuuuccagcag

SEQ ID NO: 3407642 - RNA, 15 nt, Pseudomonas aeruginosa PA01
ucgaagccgccgccg

SEQ ID NO: 3407643 - RNA, 16 nt, Pseudomonas aeruginosa PA01
ucgaagccgccgccga

SEQ ID NO: 3407644 - RNA, 18 nt, Pseudomonas aeruginosa PA01
ucgaagccgccgccgaga

SEQ ID NO: 3407645 - RNA, 24 nt, Pseudomonas aeruginosa PA01
ucgaagccggauucgcgcagcagg

SEQ ID NO: 3407646 - RNA, 11 nt, Pseudomonas aeruginosa PA01
ucgaagcgauc

SEQ ID NO: 3407647 - RNA, 15 nt, Pseudomonas aeruginosa PA01
ucgaagcgcagcagg

SEQ ID NO: 3407648 - RNA, 15 nt, Pseudomonas aeruginosa PA01
ucgaagcgcaguacc

SEQ ID NO: 3407649 - RNA, 20 nt, Pseudomonas aeruginosa PA01
ucgaagcgcaguacccggcc

SEQ ID NO: 3407650 - RNA, 14 nt, Pseudomonas aeruginosa PA01
ucgaagcgccaggc

SEQ ID NO: 3407651 - RNA, 12 nt, Pseudomonas aeruginosa PA01
ucgaagcgcgcc

SEQ ID NO: 3407652 - RNA, 20 nt, Pseudomonas aeruginosa PA01
ucgaagcggaucucgucgcc

SEQ ID NO: 3407653 - RNA, 18 nt, Pseudomonas aeruginosa PA01
ucgaagcuccagcgugcc

SEQ ID NO: 3407654 - RNA, 23 nt, Pseudomonas aeruginosa PA01
ucgaagcuccagcgugcccgcug

SEQ ID NO: 3407655 - RNA, 14 nt, Pseudomonas aeruginosa PA01
ucgaagcucggcgc

SEQ ID NO: 3407656 - RNA, 17 nt, Pseudomonas aeruginosa PA01
ucgaagcucuucgccag

SEQ ID NO: 3407657 - RNA, 13 nt, Pseudomonas aeruginosa PA01
ucgaagcuggcca

SEQ ID NO: 3407658 - RNA, 14 nt, Pseudomonas aeruginosa PA01
ucgaagcuggccag

SEQ ID NO: 3407659 - RNA, 14 nt, Pseudomonas aeruginosa PA01
ucgaagcugucggc

SEQ ID NO: 3407660 - RNA, 17 nt, Pseudomonas aeruginosa PA01
ucgaagcugucggcccg

SEQ ID NO: 3407661 - RNA, 20 nt, Pseudomonas aeruginosa PA01
ucgaaggccagcucgucgcc

SEQ ID NO: 3407662 - RNA, 23 nt, Pseudomonas aeruginosa PA01
ucgaaggccucggucaggcgcug

SEQ ID NO: 3407663 - RNA, 14 nt, Pseudomonas aeruginosa PA01
ucgaaggccucguc

SEQ ID NO: 3407664 - RNA, 17 nt, Pseudomonas aeruginosa PA01
ucgaaggccucgucgcc

SEQ ID NO: 3407665 - RNA, 15 nt, Pseudomonas aeruginosa PA01
ucgaaggcgccggca

SEQ ID NO: 3407666 - RNA, 20 nt, Pseudomonas aeruginosa PA01
ucgaaggguuccucucguca

SEQ ID NO: 3407667 - RNA, 22 nt, Pseudomonas aeruginosa PA01
ucgaaggguuggccgcagcagc

SEQ ID NO: 3407668 - RNA, 20 nt, Pseudomonas aeruginosa PA01
ucgaaggucaggucgagggu

SEQ ID NO: 3407669 - RNA, 21 nt, Pseudomonas aeruginosa PA01
ucgaaggucugcccguggcgc

SEQ ID NO: 3407670 - RNA, 18 nt, Pseudomonas aeruginosa PA01
ucgaaguacaccuuggcg

SEQ ID NO: 3407671 - RNA, 22 nt, Pseudomonas aeruginosa PA01
ucgaaguacaccuuggcgcgac

SEQ ID NO: 3407672 - RNA, 19 nt, Pseudomonas aeruginosa PA01
ucgaaguagucggcguagc

SEQ ID NO: 3407673 - RNA, 14 nt, Pseudomonas aeruginosa PA01
ucgaagucgaacuu

SEQ ID NO: 3407674 - RNA, 18 nt, Pseudomonas aeruginosa PA01
ucgaagucgaagcagccc

SEQ ID NO: 3407675 - RNA, 16 nt, Pseudomonas aeruginosa PA01
ucgaagucgaucaccg

SEQ ID NO: 3407676 - RNA, 19 nt, Pseudomonas aeruginosa PA01
ucgaagucguugaagcggc

SEQ ID NO: 3407677 - RNA, 18 nt, Pseudomonas aeruginosa PA01
ucgaaguucuccagcaag

SEQ ID NO: 3407678 - RNA, 13 nt, Pseudomonas aeruginosa PA01
ucgaaucaagcaa

SEQ ID NO: 3407679 - RNA, 21 nt, Pseudomonas aeruginosa PA01
ucgaauggaguuuccgcgagg

SEQ ID NO: 3407680 - RNA, 15 nt, Pseudomonas aeruginosa PA01
ucgaauggcgccggc

SEQ ID NO: 3407681 - RNA, 22 nt, Pseudomonas aeruginosa PA01
ucgaauggcgccggccagagcu

SEQ ID NO: 3407682 - RNA, 17 nt, Pseudomonas aeruginosa PA01
ucgaauuggacagcagg

SEQ ID NO: 3407683 - RNA, 19 nt, Pseudomonas aeruginosa PA01
ucgaauuggacagcaggcu

SEQ ID NO: 3407684 - RNA, 23 nt, Pseudomonas aeruginosa PA01
ucgacaccccggucaggccgauc

SEQ ID NO: 3407685 - RNA, 21 nt, Pseudomonas aeruginosa PA01
ucgacacugauauccgcucug

SEQ ID NO: 3407686 - RNA, 14 nt, Pseudomonas aeruginosa PA01
ucgacagcagcgcc

SEQ ID NO: 3407687 - RNA, 15 nt, Pseudomonas aeruginosa PA01
ucgacagcagcgcca

SEQ ID NO: 3407688 - RNA, 16 nt, Pseudomonas aeruginosa PA01
ucgacagcagcgccag

SEQ ID NO: 3407689 - RNA, 15 nt, Pseudomonas aeruginosa PA01
ucgacagcgcggauc

SEQ ID NO: 3407690 - RNA, 23 nt, Pseudomonas aeruginosa PA01
ucgacaggccauucuucuccaga

SEQ ID NO: 3407691 - RNA, 16 nt, Pseudomonas aeruginosa PA01
ucgacaggucggcgaa

SEQ ID NO: 3407692 - RNA, 21 nt, Pseudomonas aeruginosa PA01
ucgacaggucggcgaaauccu

SEQ ID NO: 3407693 - RNA, 16 nt, Pseudomonas aeruginosa PA01
ucgacauacuccgccg

SEQ ID NO: 3407694 - RNA, 21 nt, Pseudomonas aeruginosa PA01
ucgacauagcgcagcaccggc

SEQ ID NO: 3407695 - RNA, 18 nt, Pseudomonas aeruginosa PA01
ucgacaugcaccaggccg

SEQ ID NO: 3407696 - RNA, 21 nt, Pseudomonas aeruginosa PA01
ucgacaugcaccaggccgcca

SEQ ID NO: 3407697 - RNA, 18 nt, Pseudomonas aeruginosa PA01
ucgacauggaucaccgcc

SEQ ID NO: 3407698 - RNA, 16 nt, Pseudomonas aeruginosa PA01
ucgacaugggccgcgc

SEQ ID NO: 3407699 - RNA, 15 nt, Pseudomonas aeruginosa PA01
ucgacauugcugccg

SEQ ID NO: 3407700 - RNA, 12 nt, Pseudomonas aeruginosa PA01
ucgaccacacau

SEQ ID NO: 3407701 - RNA, 14 nt, Pseudomonas aeruginosa PA01
ucgaccacacaugc

SEQ ID NO: 3407702 - RNA, 16 nt, Pseudomonas aeruginosa PA01
ucgaccacacaugcag

SEQ ID NO: 3407703 - RNA, 17 nt, Pseudomonas aeruginosa PA01
ucgaccacacaugcagg

SEQ ID NO: 3407704 - RNA, 21 nt, Pseudomonas aeruginosa PA01
ucgaccacggccuucggcagg

SEQ ID NO: 3407705 - RNA, 22 nt, Pseudomonas aeruginosa PA01
ucgaccacggccuucggcagga

SEQ ID NO: 3407706 - RNA, 19 nt, Pseudomonas aeruginosa PA01
ucgaccagacgcagcagcu

SEQ ID NO: 3407707 - RNA, 16 nt, Pseudomonas aeruginosa PA01
ucgaccagcagcggcu

SEQ ID NO: 3407708 - RNA, 18 nt, Pseudomonas aeruginosa PA01
ucgaccagcgccgcggcg

SEQ ID NO: 3407709 - RNA, 16 nt, Pseudomonas aeruginosa PA01
ucgaccagcggcggua

SEQ ID NO: 3407710 - RNA, 23 nt, Pseudomonas aeruginosa PA01
ucgaccaggaauuccuggccggu

SEQ ID NO: 3407711 - RNA, 18 nt, Pseudomonas aeruginosa PA01
ucgaccagggcauccagg

SEQ ID NO: 3407712 - RNA, 18 nt, Pseudomonas aeruginosa PA01
ucgaccaggucgccaugc

SEQ ID NO: 3407713 - RNA, 14 nt, Pseudomonas aeruginosa PA01
ucgaccaucaccag

SEQ ID NO: 3407714 - RNA, 15 nt, Pseudomonas aeruginosa PA01
ucgaccaucggcggc

SEQ ID NO: 3407715 - RNA, 16 nt, Pseudomonas aeruginosa PA01
ucgaccaucggcggcg

SEQ ID NO: 3407716 - RNA, 17 nt, Pseudomonas aeruginosa PA01
ucgaccaucggcggcgg

SEQ ID NO: 3407717 - RNA, 21 nt, Pseudomonas aeruginosa PA01
ucgaccauucccacgacccgc

SEQ ID NO: 3407718 - RNA, 15 nt, Pseudomonas aeruginosa PA01
ucgacccaggcccag

SEQ ID NO: 3407719 - RNA, 11 nt, Pseudomonas aeruginosa PA01
ucgacccaugc

SEQ ID NO: 3407720 - RNA, 20 nt, Pseudomonas aeruginosa PA01
ucgacccgcccgccguccuc

SEQ ID NO: 3407721 - RNA, 23 nt, Pseudomonas aeruginosa PA01
ucgacccgcccgccguccuccag

SEQ ID NO: 3407722 - RNA, 19 nt, Pseudomonas aeruginosa PA01
ucgacccgguacagccaac

SEQ ID NO: 3407723 - RNA, 20 nt, Pseudomonas aeruginosa PA01
ucgacccgguuaccggcgac

SEQ ID NO: 3407724 - RNA, 13 nt, Pseudomonas aeruginosa PA01
ucgacccuggcgc

SEQ ID NO: 3407725 - RNA, 13 nt, Pseudomonas aeruginosa PA01
ucgaccgcgccgg

SEQ ID NO: 3407726 - RNA, 22 nt, Pseudomonas aeruginosa PA01
ucgaccggaaucacgucgaucu

SEQ ID NO: 3407727 - RNA, 17 nt, Pseudomonas aeruginosa PA01
ucgaccgucgccacgcu

SEQ ID NO: 3407728 - RNA, 16 nt, Pseudomonas aeruginosa PA01
ucgaccuccaggccga

SEQ ID NO: 3407729 - RNA, 13 nt, Pseudomonas aeruginosa PA01
ucgagcaccagca

SEQ ID NO: 3407730 - RNA, 15 nt, Pseudomonas aeruginosa PA01
ucgagcaccagcagg

SEQ ID NO: 3407731 - RNA, 16 nt, Pseudomonas aeruginosa PA01
ucgagcaccagcaggu

SEQ ID NO: 3407732 - RNA, 13 nt, Pseudomonas aeruginosa PA01
ucgagcaccaggc

SEQ ID NO: 3407733 - RNA, 15 nt, Pseudomonas aeruginosa PA01
ucgagcaccaggcgg

SEQ ID NO: 3407734 - RNA, 21 nt, Pseudomonas aeruginosa PA01
ucgagcaccgcggucuucccg

SEQ ID NO: 3407735 - RNA, 21 nt, Pseudomonas aeruginosa PA01
ucgagcacggcgcuggucucu

SEQ ID NO: 3407736 - RNA, 21 nt, Pseudomonas aeruginosa PA01
ucgagcagaguuuagccgcca

SEQ ID NO: 3407737 - RNA, 22 nt, Pseudomonas aeruginosa PA01
ucgagcagaguuuagccgccag

SEQ ID NO: 3407738 - RNA, 15 nt, Pseudomonas aeruginosa PA01
ucgagcagcgccgcg

SEQ ID NO: 3407739 - RNA, 18 nt, Pseudomonas aeruginosa PA01
ucgagcagcgcgcggcuc

SEQ ID NO: 3407740 - RNA, 14 nt, Pseudomonas aeruginosa PA01
ucgagcagcggcgc

SEQ ID NO: 3407741 - RNA, 16 nt, Pseudomonas aeruginosa PA01
ucgagcagcggcgcca

SEQ ID NO: 3407742 - RNA, 20 nt, Pseudomonas aeruginosa PA01
ucgagcagggucgcgagcag

SEQ ID NO: 3407743 - RNA, 13 nt, Pseudomonas aeruginosa PA01
ucgagcaguucca

SEQ ID NO: 3407744 - RNA, 14 nt, Pseudomonas aeruginosa PA01
ucgagcaguuccag

SEQ ID NO: 3407745 - RNA, 20 nt, Pseudomonas aeruginosa PA01
ucgagcaguuccaggcgucc

SEQ ID NO: 3407746 - RNA, 20 nt, Pseudomonas aeruginosa PA01
ucgagcaguucccccagcac

SEQ ID NO: 3407747 - RNA, 22 nt, Pseudomonas aeruginosa PA01
ucgagcaguucccccagcaccu

SEQ ID NO: 3407748 - RNA, 13 nt, Pseudomonas aeruginosa PA01
ucgagcaguuccg

SEQ ID NO: 3407749 - RNA, 17 nt, Pseudomonas aeruginosa PA01
ucgagcaguuccggcac

SEQ ID NO: 3407750 - RNA, 16 nt, Pseudomonas aeruginosa PA01
ucgagcaucugccggg

SEQ ID NO: 3407751 - RNA, 19 nt, Pseudomonas aeruginosa PA01
ucgagcaucugccgggcgc

SEQ ID NO: 3407752 - RNA, 15 nt, Pseudomonas aeruginosa PA01
ucgagcaugucgcug

SEQ ID NO: 3407753 - RNA, 16 nt, Pseudomonas aeruginosa PA01
ucgagccacucgugca

SEQ ID NO: 3407754 - RNA, 20 nt, Pseudomonas aeruginosa PA01
ucgagccagcccagcggcgc

SEQ ID NO: 3407755 - RNA, 13 nt, Pseudomonas aeruginosa PA01
ucgagccagcgcu

SEQ ID NO: 3407756 - RNA, 12 nt, Pseudomonas aeruginosa PA01
ucgagcccuggu

SEQ ID NO: 3407757 - RNA, 14 nt, Pseudomonas aeruginosa PA01
ucgagccgccgggg

SEQ ID NO: 3407758 - RNA, 15 nt, Pseudomonas aeruginosa PA01
ucgagccggcugaug

SEQ ID NO: 3407759 - RNA, 14 nt, Pseudomonas aeruginosa PA01
ucgagccuggccag

SEQ ID NO: 3407760 - RNA, 16 nt, Pseudomonas aeruginosa PA01
ucgagccuggccaggc

SEQ ID NO: 3407761 - RNA, 21 nt, Pseudomonas aeruginosa PA01
ucgagccuggccaggcgcucc

SEQ ID NO: 3407762 - RNA, 16 nt, Pseudomonas aeruginosa PA01
ucgagccuugcggcgc

SEQ ID NO: 3407763 - RNA, 12 nt, Pseudomonas aeruginosa PA01
ucgagcgccagg

SEQ ID NO: 3407764 - RNA, 20 nt, Pseudomonas aeruginosa PA01
ucgagcgccaggaacgccuc

SEQ ID NO: 3407765 - RNA, 13 nt, Pseudomonas aeruginosa PA01
ucgagcgcgccca

SEQ ID NO: 3407766 - RNA, 16 nt, Pseudomonas aeruginosa PA01
ucgagcgcuccaccgc

SEQ ID NO: 3407767 - RNA, 18 nt, Pseudomonas aeruginosa PA01
ucgagcggcggccgucgc

SEQ ID NO: 3407768 - RNA, 20 nt, Pseudomonas aeruginosa PA01
ucgagcgggcggucgucgcc

SEQ ID NO: 3407769 - RNA, 12 nt, Pseudomonas aeruginosa PA01
ucgagcucggcc

SEQ ID NO: 3407770 - RNA, 16 nt, Pseudomonas aeruginosa PA01
ucgagcucggccaggc

SEQ ID NO: 3407771 - RNA, 18 nt, Pseudomonas aeruginosa PA01
ucgagcucggccaggcac

SEQ ID NO: 3407772 - RNA, 21 nt, Pseudomonas aeruginosa PA01
ucgagcugcucgauggcggcc

SEQ ID NO: 3407773 - RNA, 17 nt, Pseudomonas aeruginosa PA01
ucgagcuggacgcgcuu

SEQ ID NO: 3407774 - RNA, 15 nt, Pseudomonas aeruginosa PA01
ucgagcuggcgcagg

SEQ ID NO: 3407775 - RNA, 20 nt, Pseudomonas aeruginosa PA01
ucgagcuggcgcaggccuuc

SEQ ID NO: 3407776 - RNA, 19 nt, Pseudomonas aeruginosa PA01
ucgagcuguccaucucgcc

SEQ ID NO: 3407777 - RNA, 21 nt, Pseudomonas aeruginosa PA01
ucgagcuguccaucucgccgc

SEQ ID NO: 3407778 - RNA, 18 nt, Pseudomonas aeruginosa PA01
ucgagcuuguuggccagc

SEQ ID NO: 3407779 - RNA, 20 nt, Pseudomonas aeruginosa PA01
ucgaggaacaggucgacggc

SEQ ID NO: 3407780 - RNA, 18 nt, Pseudomonas aeruginosa PA01
ucgaggaaggccagcagg

SEQ ID NO: 3407781 - RNA, 21 nt, Pseudomonas aeruginosa PA01
ucgaggaauuccggcagcgac

SEQ ID NO: 3407782 - RNA, 19 nt, Pseudomonas aeruginosa PA01
ucgaggaccgacggcaacu

SEQ ID NO: 3407783 - RNA, 20 nt, Pseudomonas aeruginosa PA01
ucgaggaucuugcgcccggc

SEQ ID NO: 3407784 - RNA, 22 nt, Pseudomonas aeruginosa PA01
ucgaggauguacagggucuugc

SEQ ID NO: 3407785 - RNA, 17 nt, Pseudomonas aeruginosa PA01
ucgaggccaggccgagc

SEQ ID NO: 3407786 - RNA, 13 nt, Pseudomonas aeruginosa PA01
ucgaggccauccc

SEQ ID NO: 3407787 - RNA, 17 nt, Pseudomonas aeruginosa PA01
ucgaggcccucggcggc

SEQ ID NO: 3407788 - RNA, 18 nt, Pseudomonas aeruginosa PA01
ucgaggcccucggcggcg

SEQ ID NO: 3407789 - RNA, 15 nt, Pseudomonas aeruginosa PA01
ucgaggccgagccgg

SEQ ID NO: 3407790 - RNA, 13 nt, Pseudomonas aeruginosa PA01
ucgaggccgccca

SEQ ID NO: 3407791 - RNA, 14 nt, Pseudomonas aeruginosa PA01
ucgaggccgcccag

SEQ ID NO: 3407792 - RNA, 12 nt, Pseudomonas aeruginosa PA01
ucgaggccgcgg

SEQ ID NO: 3407793 - RNA, 15 nt, Pseudomonas aeruginosa PA01
ucgaggccgcggagc

SEQ ID NO: 3407794 - RNA, 18 nt, Pseudomonas aeruginosa PA01
ucgaggccggcaugcagg

SEQ ID NO: 3407795 - RNA, 15 nt, Pseudomonas aeruginosa PA01
ucgaggcgccgacca

SEQ ID NO: 3407796 - RNA, 16 nt, Pseudomonas aeruginosa PA01
ucgaggcgccgaccac

SEQ ID NO: 3407797 - RNA, 17 nt, Pseudomonas aeruginosa PA01
ucgaggcgcuccaccgc

SEQ ID NO: 3407798 - RNA, 18 nt, Pseudomonas aeruginosa PA01
ucgaggcgggcgucggcg

SEQ ID NO: 3407799 - RNA, 16 nt, Pseudomonas aeruginosa PA01
ucgaggcugccgaagc

SEQ ID NO: 3407800 - RNA, 18 nt, Pseudomonas aeruginosa PA01
ucgaggcugucgcggacc

SEQ ID NO: 3407801 - RNA, 21 nt, Pseudomonas aeruginosa PA01
ucgagggcgaacagcagcggu

SEQ ID NO: 3407802 - RNA, 20 nt, Pseudomonas aeruginosa PA01
ucgagggcgaccgccaggcg

SEQ ID NO: 3407803 - RNA, 22 nt, Pseudomonas aeruginosa PA01
ucgagggcguccuugcccggcg

SEQ ID NO: 3407804 - RNA, 23 nt, Pseudomonas aeruginosa PA01
ucgagggcguccuugcccggcgc

SEQ ID NO: 3407805 - RNA, 20 nt, Pseudomonas aeruginosa PA01
ucgaggguacuccuggcaug

SEQ ID NO: 3407806 - RNA, 20 nt, Pseudomonas aeruginosa PA01
ucgagggugguuuccaggcu

SEQ ID NO: 3407807 - RNA, 21 nt, Pseudomonas aeruginosa PA01
ucgaggguugucaccggcagg

SEQ ID NO: 3407808 - RNA, 16 nt, Pseudomonas aeruginosa PA01
ucgagguagguccagg

SEQ ID NO: 3407809 - RNA, 19 nt, Pseudomonas aeruginosa PA01
ucgagguagguccaggcga

SEQ ID NO: 3407810 - RNA, 19 nt, Pseudomonas aeruginosa PA01
ucgagguagucggugaagc

SEQ ID NO: 3407811 - RNA, 21 nt, Pseudomonas aeruginosa PA01
ucgagguauugcgcguggcgu

SEQ ID NO: 3407812 - RNA, 14 nt, Pseudomonas aeruginosa PA01
ucgaggucgacggc

SEQ ID NO: 3407813 - RNA, 14 nt, Pseudomonas aeruginosa PA01
ucgaggucgagguc

SEQ ID NO: 3407814 - RNA, 15 nt, Pseudomonas aeruginosa PA01
ucgaggucggcgauc

SEQ ID NO: 3407815 - RNA, 21 nt, Pseudomonas aeruginosa PA01
ucgagguucuccacuuccacu

SEQ ID NO: 3407816 - RNA, 17 nt, Pseudomonas aeruginosa PA01
ucgagguucuccaggcu

SEQ ID NO: 3407817 - RNA, 20 nt, Pseudomonas aeruginosa PA01
ucgagguucucgacccgcuc

SEQ ID NO: 3407818 - RNA, 23 nt, Pseudomonas aeruginosa PA01
ucgagguuguagcccugggcgau

SEQ ID NO: 3407819 - RNA, 15 nt, Pseudomonas aeruginosa PA01
ucgaguaccgcugcg

SEQ ID NO: 3407820 - RNA, 17 nt, Pseudomonas aeruginosa PA01
ucgaguaccgcugcggc

SEQ ID NO: 3407821 - RNA, 20 nt, Pseudomonas aeruginosa PA01
ucgaguaccgcugcggccgg

SEQ ID NO: 3407822 - RNA, 21 nt, Pseudomonas aeruginosa PA01
ucgaguaccgcugcggccggc

SEQ ID NO: 3407823 - RNA, 23 nt, Pseudomonas aeruginosa PA01
ucgaguagguccaggcgucggcg

SEQ ID NO: 3407824 - RNA, 13 nt, Pseudomonas aeruginosa PA01
ucgagucccgucc

SEQ ID NO: 3407825 - RNA, 12 nt, Pseudomonas aeruginosa PA01
ucgagucgccgg

SEQ ID NO: 3407826 - RNA, 15 nt, Pseudomonas aeruginosa PA01
ucgagucgcgcagcc

SEQ ID NO: 3407827 - RNA, 18 nt, Pseudomonas aeruginosa PA01
ucgauaacaccaggagcg

SEQ ID NO: 3407828 - RNA, 20 nt, Pseudomonas aeruginosa PA01
ucgauaacaccaggagcgcc

SEQ ID NO: 3407829 - RNA, 14 nt, Pseudomonas aeruginosa PA01
ucgauaccagcgcc

SEQ ID NO: 3407830 - RNA, 18 nt, Pseudomonas aeruginosa PA01
ucgauauagcccugggcg

SEQ ID NO: 3407831 - RNA, 16 nt, Pseudomonas aeruginosa PA01
ucgauauccagcggca

SEQ ID NO: 3407832 - RNA, 18 nt, Pseudomonas aeruginosa PA01
ucgaugucgaacaacccg

SEQ ID NO: 3407833 - RNA, 14 nt, Pseudomonas aeruginosa PA01
ucgaugucgcggcc

SEQ ID NO: 3407834 - RNA, 15 nt, Pseudomonas aeruginosa PA01
ucgaugucgcggcgc

SEQ ID NO: 3407835 - RNA, 19 nt, Pseudomonas aeruginosa PA01
ucgaugucguggucgccgu

SEQ ID NO: 3407836 - RNA, 19 nt, Pseudomonas aeruginosa PA01
ucgauguuuccgacccgga

SEQ ID NO: 3407837 - RNA, 14 nt, Pseudomonas aeruginosa PA01
ucgcaaagcucgcg

SEQ ID NO: 3407838 - RNA, 16 nt, Pseudomonas aeruginosa PA01
ucgcaaagcucgcgca

SEQ ID NO: 3407839 - RNA, 15 nt, Pseudomonas aeruginosa PA01
ucgcaaaggucggcg

SEQ ID NO: 3407840 - RNA, 17 nt, Pseudomonas aeruginosa PA01
ucgcaaaggucggcgaa

SEQ ID NO: 3407841 - RNA, 17 nt, Pseudomonas aeruginosa PA01
ucgcaacgcuguccgcc

SEQ ID NO: 3407842 - RNA, 12 nt, Pseudomonas aeruginosa PA01
ucgcaauggcgg

SEQ ID NO: 3407843 - RNA, 13 nt, Pseudomonas aeruginosa PA01
ucgcaauggcgga

SEQ ID NO: 3407844 - RNA, 18 nt, Pseudomonas aeruginosa PA01
ucgcaauugaucauccag

SEQ ID NO: 3407845 - RNA, 21 nt, Pseudomonas aeruginosa PA01
ucgcaauugaucauccaggac

SEQ ID NO: 3407846 - RNA, 19 nt, Pseudomonas aeruginosa PA01
ucgcaccagccggccgcgu

SEQ ID NO: 3407847 - RNA, 20 nt, Pseudomonas aeruginosa PA01
ucgcaccagccggccgcguc

SEQ ID NO: 3407848 - RNA, 20 nt, Pseudomonas aeruginosa PA01
ucgcaccagccuuccggcac

SEQ ID NO: 3407849 - RNA, 23 nt, Pseudomonas aeruginosa PA01
ucgcaccagccuuccggcaccac

SEQ ID NO: 3407850 - RNA, 13 nt, Pseudomonas aeruginosa PA01
ucgcacccggccc

SEQ ID NO: 3407851 - RNA, 16 nt, Pseudomonas aeruginosa PA01
ucgcaccgccagcagu

SEQ ID NO: 3407852 - RNA, 23 nt, Pseudomonas aeruginosa PA01
ucgcaccugggacucccgcagau

SEQ ID NO: 3407853 - RNA, 18 nt, Pseudomonas aeruginosa PA01
ucgcaccuguuccagcaa

SEQ ID NO: 3407854 - RNA, 16 nt, Pseudomonas aeruginosa PA01
ucgcacgcagcgccgc

SEQ ID NO: 3407855 - RNA, 17 nt, Pseudomonas aeruginosa PA01
ucgcacgcagcgccgcg

SEQ ID NO: 3407856 - RNA, 12 nt, Pseudomonas aeruginosa PA01
ucgcacggcggg

SEQ ID NO: 3407857 - RNA, 17 nt, Pseudomonas aeruginosa PA01
ucgcacggcgggacagg

SEQ ID NO: 3407858 - RNA, 17 nt, Pseudomonas aeruginosa PA01
ucgcacggucguccugc

SEQ ID NO: 3407859 - RNA, 13 nt, Pseudomonas aeruginosa PA01
ucgcagacggggc

SEQ ID NO: 3407860 - RNA, 12 nt, Pseudomonas aeruginosa PA01
ucgcagagacgc

SEQ ID NO: 3407861 - RNA, 17 nt, Pseudomonas aeruginosa PA01
ucgcagagacgcagcgc

SEQ ID NO: 3407862 - RNA, 17 nt, Pseudomonas aeruginosa PA01
ucgcagagaucggcggc

SEQ ID NO: 3407863 - RNA, 15 nt, Pseudomonas aeruginosa PA01
ucgcagagggcgaug

SEQ ID NO: 3407864 - RNA, 13 nt, Pseudomonas aeruginosa PA01
ucgcagaugucgg

SEQ ID NO: 3407865 - RNA, 13 nt, Pseudomonas aeruginosa PA01
ucgcagcaggccg

SEQ ID NO: 3407866 - RNA, 16 nt, Pseudomonas aeruginosa PA01
ucgcagcaggccgcug

SEQ ID NO: 3407867 - RNA, 13 nt, Pseudomonas aeruginosa PA01
ucgcagcaggcgu

SEQ ID NO: 3407868 - RNA, 17 nt, Pseudomonas aeruginosa PA01
ucgcagccgagccccca

SEQ ID NO: 3407869 - RNA, 13 nt, Pseudomonas aeruginosa PA01
ucgcagccgcgca

SEQ ID NO: 3407870 - RNA, 15 nt, Pseudomonas aeruginosa PA01
ucgcagccgcgcaac

SEQ ID NO: 3407871 - RNA, 17 nt, Pseudomonas aeruginosa PA01
ucgcagccgcgcucggc

SEQ ID NO: 3407872 - RNA, 14 nt, Pseudomonas aeruginosa PA01
ucgcagccggcggc

SEQ ID NO: 3407873 - RNA, 21 nt, Pseudomonas aeruginosa PA01
ucgcagccgguggucuucagc

SEQ ID NO: 3407874 - RNA, 18 nt, Pseudomonas aeruginosa PA01
ucgcagcgcggucauccg

SEQ ID NO: 3407875 - RNA, 21 nt, Pseudomonas aeruginosa PA01
ucgcagcgcggucauccgccc

SEQ ID NO: 3407876 - RNA, 12 nt, Pseudomonas aeruginosa PA01
ucgcagcgcucc

SEQ ID NO: 3407877 - RNA, 14 nt, Pseudomonas aeruginosa PA01
ucgcagcggccccg

SEQ ID NO: 3407878 - RNA, 22 nt, Pseudomonas aeruginosa PA01
ucgcagcggccccgagcgggcc

SEQ ID NO: 3407879 - RNA, 15 nt, Pseudomonas aeruginosa PA01
ucgcagcggccguag

SEQ ID NO: 3407880 - RNA, 16 nt, Pseudomonas aeruginosa PA01
ucgcagcggccguagc

SEQ ID NO: 3407881 - RNA, 15 nt, Pseudomonas aeruginosa PA01
ucgcagcguuccagc

SEQ ID NO: 3407882 - RNA, 17 nt, Pseudomonas aeruginosa PA01
ucgcagcguuccagcgc

SEQ ID NO: 3407883 - RNA, 18 nt, Pseudomonas aeruginosa PA01
ucgcagcguuccagcgcu

SEQ ID NO: 3407884 - RNA, 11 nt, Pseudomonas aeruginosa PA01
ucgcagcucca

SEQ ID NO: 3407885 - RNA, 18 nt, Pseudomonas aeruginosa PA01
ucgcagcuccagcggaau

SEQ ID NO: 3407886 - RNA, 17 nt, Pseudomonas aeruginosa PA01
ucgcaggagucgacgaa

SEQ ID NO: 3407887 - RNA, 13 nt, Pseudomonas aeruginosa PA01
ucgcaggccaggc

SEQ ID NO: 3407888 - RNA, 14 nt, Pseudomonas aeruginosa PA01
ucgcaggccaggcc

SEQ ID NO: 3407889 - RNA, 23 nt, Pseudomonas aeruginosa PA01
ucgcaggccaggccccagggccg

SEQ ID NO: 3407890 - RNA, 24 nt, Pseudomonas aeruginosa PA01
ucgcaggccaggccccagggccgg

SEQ ID NO: 3407891 - RNA, 16 nt, Pseudomonas aeruginosa PA01
ucgcaggccaggcgca

SEQ ID NO: 3407892 - RNA, 23 nt, Pseudomonas aeruginosa PA01
ucgcaggccaggcgcagugccug

SEQ ID NO: 3407893 - RNA, 21 nt, Pseudomonas aeruginosa PA01
ucgcaggcgaaaaaaagcccc

SEQ ID NO: 3407894 - RNA, 16 nt, Pseudomonas aeruginosa PA01
ucgcagguaacccgcg

SEQ ID NO: 3407895 - RNA, 22 nt, Pseudomonas aeruginosa PA01
ucgcagguaacccgcggcgagg

SEQ ID NO: 3407896 - RNA, 22 nt, Pseudomonas aeruginosa PA01
ucgcaguagcuguugugucccg

SEQ ID NO: 3407897 - RNA, 21 nt, Pseudomonas aeruginosa PA01
ucgcagucgcuuccgcgcggc

SEQ ID NO: 3407898 - RNA, 22 nt, Pseudomonas aeruginosa PA01
ucgcagucgggcucagaagucc

SEQ ID NO: 3407899 - RNA, 14 nt, Pseudomonas aeruginosa PA01
ucgcauagccggcg

SEQ ID NO: 3407900 - RNA, 16 nt, Pseudomonas aeruginosa PA01
ucgcauagccggcgcg

SEQ ID NO: 3407901 - RNA, 18 nt, Pseudomonas aeruginosa PA01
ucgcauagccggcgcgcc

SEQ ID NO: 3407902 - RNA, 22 nt, Pseudomonas aeruginosa PA01
ucgcauagccggcgcgcccggc

SEQ ID NO: 3407903 - RNA, 16 nt, Pseudomonas aeruginosa PA01
ucgcauaggcggccag

SEQ ID NO: 3407904 - RNA, 22 nt, Pseudomonas aeruginosa PA01
ucgcauaggcggccagccuucc

SEQ ID NO: 3407905 - RNA, 13 nt, Pseudomonas aeruginosa PA01
ucgcauccaccag

SEQ ID NO: 3407906 - RNA, 20 nt, Pseudomonas aeruginosa PA01
ucgccaaaaaaagccccggc

SEQ ID NO: 3407907 - RNA, 22 nt, Pseudomonas aeruginosa PA01
ucgccaaaaaaagccccggcau

SEQ ID NO: 3407908 - RNA, 14 nt, Pseudomonas aeruginosa PA01
ucgccaaccaggaa

SEQ ID NO: 3407909 - RNA, 19 nt, Pseudomonas aeruginosa PA01
ucgccaacgccaccgcgcg

SEQ ID NO: 3407910 - RNA, 17 nt, Pseudomonas aeruginosa PA01
ucgccaacgcgccgucg

SEQ ID NO: 3407911 - RNA, 23 nt, Pseudomonas aeruginosa PA01
ucgccaacgcgccgucgcgaccu

SEQ ID NO: 3407912 - RNA, 16 nt, Pseudomonas aeruginosa PA01
ucgccaagcccggcga

SEQ ID NO: 3407913 - RNA, 21 nt, Pseudomonas aeruginosa PA01
ucgccaagguacggggcugcg

SEQ ID NO: 3407914 - RNA, 19 nt, Pseudomonas aeruginosa PA01
ucgccaauaaauccgucau

SEQ ID NO: 3407915 - RNA, 12 nt, Pseudomonas aeruginosa PA01
ucgccaccagca

SEQ ID NO: 3407916 - RNA, 13 nt, Pseudomonas aeruginosa PA01
ucgccaccagcag

SEQ ID NO: 3407917 - RNA, 17 nt, Pseudomonas aeruginosa PA01
ucgccaccccgccgcug

SEQ ID NO: 3407918 - RNA, 22 nt, Pseudomonas aeruginosa PA01
ucgccaccccgccgcuggcggc

SEQ ID NO: 3407919 - RNA, 15 nt, Pseudomonas aeruginosa PA01
ucgccaccccgcucc

SEQ ID NO: 3407920 - RNA, 15 nt, Pseudomonas aeruginosa PA01
ucgccaccgcggauc

SEQ ID NO: 3407921 - RNA, 19 nt, Pseudomonas aeruginosa PA01
ucgccaccgggugcagguu

SEQ ID NO: 3407922 - RNA, 21 nt, Pseudomonas aeruginosa PA01
ucgccacgcaguucgcgggcc

SEQ ID NO: 3407923 - RNA, 22 nt, Pseudomonas aeruginosa PA01
ucgccacgcaguucgcgggccg

SEQ ID NO: 3407924 - RNA, 14 nt, Pseudomonas aeruginosa PA01
ucgccacgcccgcc

SEQ ID NO: 3407925 - RNA, 13 nt, Pseudomonas aeruginosa PA01
ucgccacgccggc

SEQ ID NO: 3407926 - RNA, 14 nt, Pseudomonas aeruginosa PA01
ucgccacgccggcg

SEQ ID NO: 3407927 - RNA, 17 nt, Pseudomonas aeruginosa PA01
ucgccacgccggcgcuc

SEQ ID NO: 3407928 - RNA, 13 nt, Pseudomonas aeruginosa PA01
ucgccacgcugcu

SEQ ID NO: 3407929 - RNA, 14 nt, Pseudomonas aeruginosa PA01
ucgccacgcugcug

SEQ ID NO: 3407930 - RNA, 16 nt, Pseudomonas aeruginosa PA01
ucgccacgcugcugcc

SEQ ID NO: 3407931 - RNA, 19 nt, Pseudomonas aeruginosa PA01
ucgccacgcugcugccggc

SEQ ID NO: 3407932 - RNA, 20 nt, Pseudomonas aeruginosa PA01
ucgccacgcugcugccggcc

SEQ ID NO: 3407933 - RNA, 14 nt, Pseudomonas aeruginosa PA01
ucgccacgcuucug

SEQ ID NO: 3407934 - RNA, 23 nt, Pseudomonas aeruginosa PA01
ucgccacugauaccgcuggccag

SEQ ID NO: 3407935 - RNA, 12 nt, Pseudomonas aeruginosa PA01
ucgcccucagca

SEQ ID NO: 3407936 - RNA, 15 nt, Pseudomonas aeruginosa PA01
ucgcccucagcagcg

SEQ ID NO: 3407937 - RNA, 16 nt, Pseudomonas aeruginosa PA01
ucgcccucagcagcgc

SEQ ID NO: 3407938 - RNA, 21 nt, Pseudomonas aeruginosa PA01
ucgcccucagcagcgccgccc

SEQ ID NO: 3407939 - RNA, 12 nt, Pseudomonas aeruginosa PA01
ucgcccucggcg

SEQ ID NO: 3407940 - RNA, 19 nt, Pseudomonas aeruginosa PA01
ucgcccucggcgcuggcca

SEQ ID NO: 3407941 - RNA, 19 nt, Pseudomonas aeruginosa PA01
ucgcccugcggauggcgcg

SEQ ID NO: 3407942 - RNA, 21 nt, Pseudomonas aeruginosa PA01
ucgcccugcggauggcgcggg

SEQ ID NO: 3407943 - RNA, 16 nt, Pseudomonas aeruginosa PA01
ucgcccugcguggaac

SEQ ID NO: 3407944 - RNA, 23 nt, Pseudomonas aeruginosa PA01
ucgcccugcguggaaccgcggcg

SEQ ID NO: 3407945 - RNA, 18 nt, Pseudomonas aeruginosa PA01
ucgcccugcuuggccagc

SEQ ID NO: 3407946 - RNA, 18 nt, Pseudomonas aeruginosa PA01
ucgcccuggccucggcgu

SEQ ID NO: 3407947 - RNA, 16 nt, Pseudomonas aeruginosa PA01
ucgcccuggcgccagc

SEQ ID NO: 3407948 - RNA, 13 nt, Pseudomonas aeruginosa PA01
ucgcccuggugca

SEQ ID NO: 3407949 - RNA, 18 nt, Pseudomonas aeruginosa PA01
ucgcccuggugcacggcg

SEQ ID NO: 3407950 - RNA, 15 nt, Pseudomonas aeruginosa PA01
ucgcccuucuuccag

SEQ ID NO: 3407951 - RNA, 22 nt, Pseudomonas aeruginosa PA01
ucgccgaaaaauucagcgcagc

SEQ ID NO: 3407952 - RNA, 23 nt, Pseudomonas aeruginosa PA01
ucgccgaaaagaagccccgcagc

SEQ ID NO: 3407953 - RNA, 17 nt, Pseudomonas aeruginosa PA01
ucgccgaaauagcgcgc

SEQ ID NO: 3407954 - RNA, 16 nt, Pseudomonas aeruginosa PA01
ucgccgaacggcagcu

SEQ ID NO: 3407955 - RNA, 22 nt, Pseudomonas aeruginosa PA01
ucgccgaacggcagcuggaucc

SEQ ID NO: 3407956 - RNA, 20 nt, Pseudomonas aeruginosa PA01
ucgccgaacuccgagcagga

SEQ ID NO: 3407957 - RNA, 21 nt, Pseudomonas aeruginosa PA01
ucgccgaacuccgagcaggac

SEQ ID NO: 3407958 - RNA, 23 nt, Pseudomonas aeruginosa PA01
ucgccgaagauccgcuccaggcu

SEQ ID NO: 3407959 - RNA, 24 nt, Pseudomonas aeruginosa PA01
ucgccgaagauccgcuccaggcug

SEQ ID NO: 3407960 - RNA, 20 nt, Pseudomonas aeruginosa PA01
ucgccgaaggugcaggccgc

SEQ ID NO: 3407961 - RNA, 14 nt, Pseudomonas aeruginosa PA01
ucgccgaaguacuc

SEQ ID NO: 3407962 - RNA, 21 nt, Pseudomonas aeruginosa PA01
ucgccgacaacgaaaagagcc

SEQ ID NO: 3407963 - RNA, 19 nt, Pseudomonas aeruginosa PA01
ucgccgaccacuuccaggu

SEQ ID NO: 3407964 - RNA, 21 nt, Pseudomonas aeruginosa PA01
ucgccgaccacuuccagguag

SEQ ID NO: 3407965 - RNA, 19 nt, Pseudomonas aeruginosa PA01
ucgccgaccagcuugggca

SEQ ID NO: 3407966 - RNA, 13 nt, Pseudomonas aeruginosa PA01
ucgccgaccaggc

SEQ ID NO: 3407967 - RNA, 17 nt, Pseudomonas aeruginosa PA01
ucgccgaccagguccgc

SEQ ID NO: 3407968 - RNA, 14 nt, Pseudomonas aeruginosa PA01
ucgccgacccugca

SEQ ID NO: 3407969 - RNA, 15 nt, Pseudomonas aeruginosa PA01
ucgccgaccgccaag

SEQ ID NO: 3407970 - RNA, 19 nt, Pseudomonas aeruginosa PA01
ucgccgacggcuucgacca

SEQ ID NO: 3407971 - RNA, 16 nt, Pseudomonas aeruginosa PA01
ucgccgacguccucca

SEQ ID NO: 3407972 - RNA, 17 nt, Pseudomonas aeruginosa PA01
ucgccgacguccuccag

SEQ ID NO: 3407973 - RNA, 20 nt, Pseudomonas aeruginosa PA01
ucgccgacguccuccaggac

SEQ ID NO: 3407974 - RNA, 17 nt, Pseudomonas aeruginosa PA01
ucgccgacuuccaggcg

SEQ ID NO: 3407975 - RNA, 19 nt, Pseudomonas aeruginosa PA01
ucgccgacuuccaggcgca

SEQ ID NO: 3407976 - RNA, 21 nt, Pseudomonas aeruginosa PA01
ucgccgacuuccaggcgcagg

SEQ ID NO: 3407977 - RNA, 16 nt, Pseudomonas aeruginosa PA01
ucgccgacuucggcaa

SEQ ID NO: 3407978 - RNA, 14 nt, Pseudomonas aeruginosa PA01
ucgccgagcgccgc

SEQ ID NO: 3407979 - RNA, 16 nt, Pseudomonas aeruginosa PA01
ucgccgagcgccgcca

SEQ ID NO: 3407980 - RNA, 18 nt, Pseudomonas aeruginosa PA01
ucgccgagcgccgccagg

SEQ ID NO: 3407981 - RNA, 21 nt, Pseudomonas aeruginosa PA01
ucgccgagcgccgccaggcag

SEQ ID NO: 3407982 - RNA, 19 nt, Pseudomonas aeruginosa PA01
ucgccgaggcggcgcagca

SEQ ID NO: 3407983 - RNA, 14 nt, Pseudomonas aeruginosa PA01
ucgccgagggcaag

SEQ ID NO: 3407984 - RNA, 16 nt, Pseudomonas aeruginosa PA01
ucgccgagggcgaaga

SEQ ID NO: 3407985 - RNA, 19 nt, Pseudomonas aeruginosa PA01
ucgccgagguugcugcggc

SEQ ID NO: 3407986 - RNA, 14 nt, Pseudomonas aeruginosa PA01
ucgccgaucaccag

SEQ ID NO: 3407987 - RNA, 16 nt, Pseudomonas aeruginosa PA01
ucgccgaucaccagga

SEQ ID NO: 3407988 - RNA, 21 nt, Pseudomonas aeruginosa PA01
ucgccgaucaccaggaucgcc

SEQ ID NO: 3407989 - RNA, 17 nt, Pseudomonas aeruginosa PA01
ucgccgaucuccuccgc

SEQ ID NO: 3407990 - RNA, 18 nt, Pseudomonas aeruginosa PA01
ucgccgaucuccuccgcc

SEQ ID NO: 3407991 - RNA, 14 nt, Pseudomonas aeruginosa PA01
ucgccgaucugcag

SEQ ID NO: 3407992 - RNA, 18 nt, Pseudomonas aeruginosa PA01
ucgccgaugcgccgacgc

SEQ ID NO: 3407993 - RNA, 22 nt, Pseudomonas aeruginosa PA01
ucgccgaugcgguagucgcugc

SEQ ID NO: 3407994 - RNA, 12 nt, Pseudomonas aeruginosa PA01
ucgccgaugucg

SEQ ID NO: 3407995 - RNA, 17 nt, Pseudomonas aeruginosa PA01
ucgccgaugucguagcc

SEQ ID NO: 3407996 - RNA, 18 nt, Pseudomonas aeruginosa PA01
ucgccgcacaccgcgcgc

SEQ ID NO: 3407997 - RNA, 21 nt, Pseudomonas aeruginosa PA01
ucgccgcacaccgcgcgcgcc

SEQ ID NO: 3407998 - RNA, 24 nt, Pseudomonas aeruginosa PA01
ucgccgcacaccgcgcgcgccugc

SEQ ID NO: 3407999 - RNA, 23 nt, Pseudomonas aeruginosa PA01
ucgccgcaccggcgauggccggc

SEQ ID NO: 3408000 - RNA, 16 nt, Pseudomonas aeruginosa PA01
ucgccgcagcccuagg

SEQ ID NO: 3408001 - RNA, 17 nt, Pseudomonas aeruginosa PA01
ucgccgcagcccuaggc

SEQ ID NO: 3408002 - RNA, 20 nt, Pseudomonas aeruginosa PA01
ucgccgcagcccuaggcgac

SEQ ID NO: 3408003 - RNA, 13 nt, Pseudomonas aeruginosa PA01
ucgccgccaccac

SEQ ID NO: 3408004 - RNA, 19 nt, Pseudomonas aeruginosa PA01
ucgccgccagcauggcgaa

SEQ ID NO: 3408005 - RNA, 14 nt, Pseudomonas aeruginosa PA01
ucgccgccaggcag

SEQ ID NO: 3408006 - RNA, 19 nt, Pseudomonas aeruginosa PA01
ucgccgccaggcagaccug

SEQ ID NO: 3408007 - RNA, 19 nt, Pseudomonas aeruginosa PA01
ucgccgccaguucggccau

SEQ ID NO: 3408008 - RNA, 23 nt, Pseudomonas aeruginosa PA01
ucgccgccaguucggccaucagc

SEQ ID NO: 3408009 - RNA, 15 nt, Pseudomonas aeruginosa PA01
ucgccgcccgaggcg

SEQ ID NO: 3408010 - RNA, 18 nt, Pseudomonas aeruginosa PA01
ucgccgcccgcgccucca

SEQ ID NO: 3408011 - RNA, 22 nt, Pseudomonas aeruginosa PA01
ucgccgcccgcgccuccaggcg

SEQ ID NO: 3408012 - RNA, 16 nt, Pseudomonas aeruginosa PA01
ucgccgcccggcagcg

SEQ ID NO: 3408013 - RNA, 17 nt, Pseudomonas aeruginosa PA01
ucgccgcccggcagcgg

SEQ ID NO: 3408014 - RNA, 18 nt, Pseudomonas aeruginosa PA01
ucgccgcccggcagcggc

SEQ ID NO: 3408015 - RNA, 19 nt, Pseudomonas aeruginosa PA01
ucgccgcccggcagcggcu

SEQ ID NO: 3408016 - RNA, 12 nt, Pseudomonas aeruginosa PA01
ucgccgccgaca

SEQ ID NO: 3408017 - RNA, 16 nt, Pseudomonas aeruginosa PA01
ucgccgccgacacccg

SEQ ID NO: 3408018 - RNA, 21 nt, Pseudomonas aeruginosa PA01
ucgccgccgacacccgcgccg

SEQ ID NO: 3408019 - RNA, 14 nt, Pseudomonas aeruginosa PA01
ucgccgccgaccgg

SEQ ID NO: 3408020 - RNA, 15 nt, Pseudomonas aeruginosa PA01
ucgccgccgaccggg

SEQ ID NO: 3408021 - RNA, 13 nt, Pseudomonas aeruginosa PA01
ucgccgccgagca

SEQ ID NO: 3408022 - RNA, 15 nt, Pseudomonas aeruginosa PA01
ucgccgccgagcagg

SEQ ID NO: 3408023 - RNA, 17 nt, Pseudomonas aeruginosa PA01
ucgccgccgagcaggcc

SEQ ID NO: 3408024 - RNA, 15 nt, Pseudomonas aeruginosa PA01
ucgccgccgagcgcc

SEQ ID NO: 3408025 - RNA, 13 nt, Pseudomonas aeruginosa PA01
ucgccgccgaggc

SEQ ID NO: 3408026 - RNA, 14 nt, Pseudomonas aeruginosa PA01
ucgccgccgcagcc

SEQ ID NO: 3408027 - RNA, 19 nt, Pseudomonas aeruginosa PA01
ucgccgccgcagccguggc

SEQ ID NO: 3408028 - RNA, 20 nt, Pseudomonas aeruginosa PA01
ucgccgccgcagccguggcg

SEQ ID NO: 3408029 - RNA, 23 nt, Pseudomonas aeruginosa PA01
ucgccgccgcagccguggcgcga

SEQ ID NO: 3408030 - RNA, 14 nt, Pseudomonas aeruginosa PA01
ucgccgccgccagu

SEQ ID NO: 3408031 - RNA, 10 nt, Pseudomonas aeruginosa PA01
ucgccgccgg

SEQ ID NO: 3408032 - RNA, 12 nt, Pseudomonas aeruginosa PA01
ucgccgccggcc

SEQ ID NO: 3408033 - RNA, 13 nt, Pseudomonas aeruginosa PA01
ucgccgccggcca

SEQ ID NO: 3408034 - RNA, 15 nt, Pseudomonas aeruginosa PA01
ucgccgccggccagc

SEQ ID NO: 3408035 - RNA, 18 nt, Pseudomonas aeruginosa PA01
ucgccgccggccagccgc

SEQ ID NO: 3408036 - RNA, 19 nt, Pseudomonas aeruginosa PA01
ucgccgccggccagccgcg

SEQ ID NO: 3408037 - RNA, 12 nt, Pseudomonas aeruginosa PA01
ucgccucccggc

SEQ ID NO: 3408038 - RNA, 13 nt, Pseudomonas aeruginosa PA01
ucgccuccggcac

SEQ ID NO: 3408039 - RNA, 20 nt, Pseudomonas aeruginosa PA01
ucgccucgaacauggccacc

SEQ ID NO: 3408040 - RNA, 13 nt, Pseudomonas aeruginosa PA01
ucgccucgccggc

SEQ ID NO: 3408041 - RNA, 14 nt, Pseudomonas aeruginosa PA01
ucgccucgccggcc

SEQ ID NO: 3408042 - RNA, 14 nt, Pseudomonas aeruginosa PA01
ucgccucgcgccag

SEQ ID NO: 3408043 - RNA, 15 nt, Pseudomonas aeruginosa PA01
ucgccucgcgccaga

SEQ ID NO: 3408044 - RNA, 17 nt, Pseudomonas aeruginosa PA01
ucgccucgcgccagaga

SEQ ID NO: 3408045 - RNA, 11 nt, Pseudomonas aeruginosa PA01
ucgccucggcc

SEQ ID NO: 3408046 - RNA, 12 nt, Pseudomonas aeruginosa PA01
ucgccucggcca

SEQ ID NO: 3408047 - RNA, 16 nt, Pseudomonas aeruginosa PA01
ucgccucggcgcgcgc

SEQ ID NO: 3408048 - RNA, 22 nt, Pseudomonas aeruginosa PA01
ucgccucgggggugcccaucag

SEQ ID NO: 3408049 - RNA, 17 nt, Pseudomonas aeruginosa PA01
ucgccucguucagcagc

SEQ ID NO: 3408050 - RNA, 18 nt, Pseudomonas aeruginosa PA01
ucgccucguucagcagca

SEQ ID NO: 3408051 - RNA, 16 nt, Pseudomonas aeruginosa PA01
ucgccugcuuggcggc

SEQ ID NO: 3408052 - RNA, 19 nt, Pseudomonas aeruginosa PA01
ucgccugcuuggcggcggu

SEQ ID NO: 3408053 - RNA, 13 nt, Pseudomonas aeruginosa PA01
ucgccuggcgcga

SEQ ID NO: 3408054 - RNA, 20 nt, Pseudomonas aeruginosa PA01
ucgccuggcgcgacgaggcg

SEQ ID NO: 3408055 - RNA, 14 nt, Pseudomonas aeruginosa PA01
ucgccugggccggc

SEQ ID NO: 3408056 - RNA, 16 nt, Pseudomonas aeruginosa PA01
ucgccugguaggcggc

SEQ ID NO: 3408057 - RNA, 21 nt, Pseudomonas aeruginosa PA01
ucgccuggucgauauagcccu

SEQ ID NO: 3408058 - RNA, 15 nt, Pseudomonas aeruginosa PA01
ucgccuuccaccacc

SEQ ID NO: 3408059 - RNA, 17 nt, Pseudomonas aeruginosa PA01
ucgccuuccaccaccag

SEQ ID NO: 3408060 - RNA, 18 nt, Pseudomonas aeruginosa PA01
ucgccuuccaccaccagg

SEQ ID NO: 3408061 - RNA, 21 nt, Pseudomonas aeruginosa PA01
ucgccuuccaccaccaggguc

SEQ ID NO: 3408062 - RNA, 21 nt, Pseudomonas aeruginosa PA01
ucgccuucccagacguccagc

SEQ ID NO: 3408063 - RNA, 21 nt, Pseudomonas aeruginosa PA01
ucgccuucccggucgacggcg

SEQ ID NO: 3408064 - RNA, 15 nt, Pseudomonas aeruginosa PA01
ucgccuuccucggcg

SEQ ID NO: 3408065 - RNA, 17 nt, Pseudomonas aeruginosa PA01
ucgccuuccucggcgaa

SEQ ID NO: 3408066 - RNA, 19 nt, Pseudomonas aeruginosa PA01
ucgccuuccucggcgauca

SEQ ID NO: 3408067 - RNA, 23 nt, Pseudomonas aeruginosa PA01
ucgccuucggcgugcauggccgg

SEQ ID NO: 3408068 - RNA, 16 nt, Pseudomonas aeruginosa PA01
ucgccuucguccaugc

SEQ ID NO: 3408069 - RNA, 15 nt, Pseudomonas aeruginosa PA01
ucgccuugaccagcg

SEQ ID NO: 3408070 - RNA, 18 nt, Pseudomonas aeruginosa PA01
ucgccuugaccagcggcc

SEQ ID NO: 3408071 - RNA, 22 nt, Pseudomonas aeruginosa PA01
ucgccuugaccagcggcccggc

SEQ ID NO: 3408072 - RNA, 15 nt, Pseudomonas aeruginosa PA01
ucgccuugcccuggc

SEQ ID NO: 3408073 - RNA, 18 nt, Pseudomonas aeruginosa PA01
ucgccuugcccuggccgg

SEQ ID NO: 3408074 - RNA, 19 nt, Pseudomonas aeruginosa PA01
ucgccuugcccuggccggc

SEQ ID NO: 3408075 - RNA, 21 nt, Pseudomonas aeruginosa PA01
ucgcgaaaacucccggccugg

SEQ ID NO: 3408076 - RNA, 20 nt, Pseudomonas aeruginosa PA01
ucgcgaaccacauccuugcc

SEQ ID NO: 3408077 - RNA, 16 nt, Pseudomonas aeruginosa PA01
ucgcgaacucggcgcc

SEQ ID NO: 3408078 - RNA, 17 nt, Pseudomonas aeruginosa PA01
ucgcgaagaacacgccc

SEQ ID NO: 3408079 - RNA, 18 nt, Pseudomonas aeruginosa PA01
ucgcgaagaccggccggc

SEQ ID NO: 3408080 - RNA, 14 nt, Pseudomonas aeruginosa PA01
ucgcgaagcgcagc

SEQ ID NO: 3408081 - RNA, 14 nt, Pseudomonas aeruginosa PA01
ucgcgacaccgggc

SEQ ID NO: 3408082 - RNA, 20 nt, Pseudomonas aeruginosa PA01
ucgcgacacgugccccaggc

SEQ ID NO: 3408083 - RNA, 20 nt, Pseudomonas aeruginosa PA01
ucgcgacccucagucgcccc

SEQ ID NO: 3408084 - RNA, 15 nt, Pseudomonas aeruginosa PA01
ucgcgacccuggccg

SEQ ID NO: 3408085 - RNA, 16 nt, Pseudomonas aeruginosa PA01
ucgcgacccuggccgc

SEQ ID NO: 3408086 - RNA, 18 nt, Pseudomonas aeruginosa PA01
ucgcgacccuggccgcgc

SEQ ID NO: 3408087 - RNA, 16 nt, Pseudomonas aeruginosa PA01
ucgcgaccgagaugcu

SEQ ID NO: 3408088 - RNA, 14 nt, Pseudomonas aeruginosa PA01
ucgcgacggcauuc

SEQ ID NO: 3408089 - RNA, 12 nt, Pseudomonas aeruginosa PA01
ucgcgacgguga

SEQ ID NO: 3408090 - RNA, 23 nt, Pseudomonas aeruginosa PA01
ucgcgacggugaaguagaucgcc

SEQ ID NO: 3408091 - RNA, 18 nt, Pseudomonas aeruginosa PA01
ucgcgacugaccacgcag

SEQ ID NO: 3408092 - RNA, 16 nt, Pseudomonas aeruginosa PA01
ucgcgacugccgucgg

SEQ ID NO: 3408093 - RNA, 21 nt, Pseudomonas aeruginosa PA01
ucgcgagauggcgucgauccc

SEQ ID NO: 3408094 - RNA, 13 nt, Pseudomonas aeruginosa PA01
ucgcgagcagggc

SEQ ID NO: 3408095 - RNA, 17 nt, Pseudomonas aeruginosa PA01
ucgcgagguuccgcggc

SEQ ID NO: 3408096 - RNA, 18 nt, Pseudomonas aeruginosa PA01
ucgcgagguuccgcggcg

SEQ ID NO: 3408097 - RNA, 20 nt, Pseudomonas aeruginosa PA01
ucgcgagguuccgcggcgac

SEQ ID NO: 3408098 - RNA, 21 nt, Pseudomonas aeruginosa PA01
ucgcgauacucgugggccggu

SEQ ID NO: 3408099 - RNA, 17 nt, Pseudomonas aeruginosa PA01
ucgcgauagacgccggc

SEQ ID NO: 3408100 - RNA, 18 nt, Pseudomonas aeruginosa PA01
ucgcgauagacgccggcg

SEQ ID NO: 3408101 - RNA, 13 nt, Pseudomonas aeruginosa PA01
ucgcgaucaccgc

SEQ ID NO: 3408102 - RNA, 17 nt, Pseudomonas aeruginosa PA01
ucgcgauccaccgccag

SEQ ID NO: 3408103 - RNA, 18 nt, Pseudomonas aeruginosa PA01
ucgcgauccaccgccagg

SEQ ID NO: 3408104 - RNA, 19 nt, Pseudomonas aeruginosa PA01
ucgcgauccaccgccaggg

SEQ ID NO: 3408105 - RNA, 15 nt, Pseudomonas aeruginosa PA01
ucgcgaucggcgucc

SEQ ID NO: 3408106 - RNA, 18 nt, Pseudomonas aeruginosa PA01
ucgcgaucggcguccgcg

SEQ ID NO: 3408107 - RNA, 13 nt, Pseudomonas aeruginosa PA01
ucgcgaucugcug

SEQ ID NO: 3408108 - RNA, 21 nt, Pseudomonas aeruginosa PA01
ucgcgaugguaguccgcugcg

SEQ ID NO: 3408109 - RNA, 16 nt, Pseudomonas aeruginosa PA01
ucgcgcaacgccgacg

SEQ ID NO: 3408110 - RNA, 18 nt, Pseudomonas aeruginosa PA01
ucgcgcaacgccuugcca

SEQ ID NO: 3408111 - RNA, 22 nt, Pseudomonas aeruginosa PA01
ucgcgcaacgccuugccauagg

SEQ ID NO: 3408112 - RNA, 18 nt, Pseudomonas aeruginosa PA01
ucgcgcaacugcggggcg

SEQ ID NO: 3408113 - RNA, 21 nt, Pseudomonas aeruginosa PA01
ucgcgcaacugcggggcgcuc

SEQ ID NO: 3408114 - RNA, 14 nt, Pseudomonas aeruginosa PA01
ucgcgcaacugcuc

SEQ ID NO: 3408115 - RNA, 15 nt, Pseudomonas aeruginosa PA01
ucgcgcaacugcucg

SEQ ID NO: 3408116 - RNA, 20 nt, Pseudomonas aeruginosa PA01
ucgcgcaacugcucgaacug

SEQ ID NO: 3408117 - RNA, 16 nt, Pseudomonas aeruginosa PA01
ucgcgcaagcgcccgg

SEQ ID NO: 3408118 - RNA, 17 nt, Pseudomonas aeruginosa PA01
ucgcgcaagcgcccggc

SEQ ID NO: 3408119 - RNA, 19 nt, Pseudomonas aeruginosa PA01
ucgcgcaagcgcccggcga

SEQ ID NO: 3408120 - RNA, 16 nt, Pseudomonas aeruginosa PA01
ucgcgcacaugccgag

SEQ ID NO: 3408121 - RNA, 22 nt, Pseudomonas aeruginosa PA01
ucgcgcaccgccucgugcagca

SEQ ID NO: 3408122 - RNA, 14 nt, Pseudomonas aeruginosa PA01
ucgcgcaccgcggc

SEQ ID NO: 3408123 - RNA, 17 nt, Pseudomonas aeruginosa PA01
ucgcgcaccgcggccag

SEQ ID NO: 3408124 - RNA, 20 nt, Pseudomonas aeruginosa PA01
ucgcgcaccgcggccaguug

SEQ ID NO: 3408125 - RNA, 15 nt, Pseudomonas aeruginosa PA01
ucgcgcaccgcggcg

SEQ ID NO: 3408126 - RNA, 16 nt, Pseudomonas aeruginosa PA01
ucgcgcaccgcggcga

SEQ ID NO: 3408127 - RNA, 18 nt, Pseudomonas aeruginosa PA01
ucgcgcaccgcggcgagc

SEQ ID NO: 3408128 - RNA, 19 nt, Pseudomonas aeruginosa PA01
ucgcgcaccgcggcgagcc

SEQ ID NO: 3408129 - RNA, 13 nt, Pseudomonas aeruginosa PA01
ucgcgcaccuggc

SEQ ID NO: 3408130 - RNA, 23 nt, Pseudomonas aeruginosa PA01
ucgcgcacgaggauuuccgcgcc

SEQ ID NO: 3408131 - RNA, 14 nt, Pseudomonas aeruginosa PA01
ucgcgcacggcgaa

SEQ ID NO: 3408132 - RNA, 15 nt, Pseudomonas aeruginosa PA01
ucgcgcacggcgaag

SEQ ID NO: 3408133 - RNA, 16 nt, Pseudomonas aeruginosa PA01
ucgcgcacggcgaaga

SEQ ID NO: 3408134 - RNA, 16 nt, Pseudomonas aeruginosa PA01
ucgcgcagaucgccgc

SEQ ID NO: 3408135 - RNA, 13 nt, Pseudomonas aeruginosa PA01
ucgcgcagcaccg

SEQ ID NO: 3408136 - RNA, 12 nt, Pseudomonas aeruginosa PA01
ucgcgcagcagg

SEQ ID NO: 3408137 - RNA, 20 nt, Pseudomonas aeruginosa PA01
ucgcgcagcaggauccaggu

SEQ ID NO: 3408138 - RNA, 13 nt, Pseudomonas aeruginosa PA01
ucgcgcagcaggc

SEQ ID NO: 3408139 - RNA, 15 nt, Pseudomonas aeruginosa PA01
ucgcgcagcaggcgg

SEQ ID NO: 3408140 - RNA, 21 nt, Pseudomonas aeruginosa PA01
ucgcguuggcgugcucgcgca

SEQ ID NO: 3408141 - RNA, 13 nt, Pseudomonas aeruginosa PA01
ucgcuaccgacag

SEQ ID NO: 3408142 - RNA, 21 nt, Pseudomonas aeruginosa PA01
ucgcuacggaaggucgccggg

SEQ ID NO: 3408143 - RNA, 15 nt, Pseudomonas aeruginosa PA01
ucgcuagucuuccug

SEQ ID NO: 3408144 - RNA, 22 nt, Pseudomonas aeruginosa PA01
ucgcuagucuuccugcacgcug

SEQ ID NO: 3408145 - RNA, 15 nt, Pseudomonas aeruginosa PA01
ucgcuauccaccguc

SEQ ID NO: 3408146 - RNA, 17 nt, Pseudomonas aeruginosa PA01
ucgcucaacggcgugcc

SEQ ID NO: 3408147 - RNA, 23 nt, Pseudomonas aeruginosa PA01
ucgcucaacggcgugccgggcag

SEQ ID NO: 3408148 - RNA, 18 nt, Pseudomonas aeruginosa PA01
ucgcucagcgggccgauc

SEQ ID NO: 3408149 - RNA, 15 nt, Pseudomonas aeruginosa PA01
ucgcucauccgcgag

SEQ ID NO: 3408150 - RNA, 18 nt, Pseudomonas aeruginosa PA01
ucgcucauggcgccgcca

SEQ ID NO: 3408151 - RNA, 13 nt, Pseudomonas aeruginosa PA01
ucgcuccagaccu

SEQ ID NO: 3408152 - RNA, 12 nt, Pseudomonas aeruginosa PA01
ucgcuccagccc

SEQ ID NO: 3408153 - RNA, 13 nt, Pseudomonas aeruginosa PA01
ucgcucccaggcu

SEQ ID NO: 3408154 - RNA, 14 nt, Pseudomonas aeruginosa PA01
ucgcucccaggcuc

SEQ ID NO: 3408155 - RNA, 18 nt, Pseudomonas aeruginosa PA01
ucgcucccuacgaugcug

SEQ ID NO: 3408156 - RNA, 14 nt, Pseudomonas aeruginosa PA01
ucgcuccgagcagg

SEQ ID NO: 3408157 - RNA, 15 nt, Pseudomonas aeruginosa PA01
ucgcuccggcagcgc

SEQ ID NO: 3408158 - RNA, 13 nt, Pseudomonas aeruginosa PA01
ucgcuccucagag

SEQ ID NO: 3408159 - RNA, 14 nt, Pseudomonas aeruginosa PA01
ucgcuccuccgggc

SEQ ID NO: 3408160 - RNA, 15 nt, Pseudomonas aeruginosa PA01
ucgcuccuccgggcg

SEQ ID NO: 3408161 - RNA, 13 nt, Pseudomonas aeruginosa PA01
ucgcucgcgcagg

SEQ ID NO: 3408162 - RNA, 14 nt, Pseudomonas aeruginosa PA01
ucgcucucgcgcuu

SEQ ID NO: 3408163 - RNA, 15 nt, Pseudomonas aeruginosa PA01
ucgcucugcgccagg

SEQ ID NO: 3408164 - RNA, 17 nt, Pseudomonas aeruginosa PA01
ucgcugaaauccaccag

SEQ ID NO: 3408165 - RNA, 18 nt, Pseudomonas aeruginosa PA01
ucgcugaccagcccggcg

SEQ ID NO: 3408166 - RNA, 23 nt, Pseudomonas aeruginosa PA01
ucgcugaccagcccggcggcggc

SEQ ID NO: 3408167 - RNA, 21 nt, Pseudomonas aeruginosa PA01
ucgcugacccaggcuucggcg

SEQ ID NO: 3408168 - RNA, 13 nt, Pseudomonas aeruginosa PA01
ucgcugaccggcc

SEQ ID NO: 3408169 - RNA, 14 nt, Pseudomonas aeruginosa PA01
ucgcugaccggccg

SEQ ID NO: 3408170 - RNA, 19 nt, Pseudomonas aeruginosa PA01
ucgcugaccggccgcagca

SEQ ID NO: 3408171 - RNA, 20 nt, Pseudomonas aeruginosa PA01
ucgcugacgccauucaggcg

SEQ ID NO: 3408172 - RNA, 23 nt, Pseudomonas aeruginosa PA01
ucgcugacuuccaucagcuccac

SEQ ID NO: 3408173 - RNA, 15 nt, Pseudomonas aeruginosa PA01
ucgcugagcaccggg

SEQ ID NO: 3408174 - RNA, 16 nt, Pseudomonas aeruginosa PA01
ucgcugagcaccggga

SEQ ID NO: 3408175 - RNA, 18 nt, Pseudomonas aeruginosa PA01
ucgcugagcaccgggacg

SEQ ID NO: 3408176 - RNA, 21 nt, Pseudomonas aeruginosa PA01
ucgcugagcaguugcgggcgc

SEQ ID NO: 3408177 - RNA, 21 nt, Pseudomonas aeruginosa PA01
ucgcugaguuugcccagcgcc

SEQ ID NO: 3408178 - RNA, 23 nt, Pseudomonas aeruginosa PA01
ucgcugaguuugcccagcgccgc

SEQ ID NO: 3408179 - RNA, 11 nt, Pseudomonas aeruginosa PA01
ucgcugccgag

SEQ ID NO: 3408180 - RNA, 12 nt, Pseudomonas aeruginosa PA01
ucgcugccgccg

SEQ ID NO: 3408181 - RNA, 14 nt, Pseudomonas aeruginosa PA01
ucgcugccgccgcg

SEQ ID NO: 3408182 - RNA, 21 nt, Pseudomonas aeruginosa PA01
ucgcugccgccgcgcccggcg

SEQ ID NO: 3408183 - RNA, 16 nt, Pseudomonas aeruginosa PA01
ucgcugccggcgcgca

SEQ ID NO: 3408184 - RNA, 23 nt, Pseudomonas aeruginosa PA01
ucgcugccggcgcgcacggaggc

SEQ ID NO: 3408185 - RNA, 19 nt, Pseudomonas aeruginosa PA01
ucgcugcgcagugucgcga

SEQ ID NO: 3408186 - RNA, 18 nt, Pseudomonas aeruginosa PA01
ucgcugcgggcguagcgc

SEQ ID NO: 3408187 - RNA, 24 nt, Pseudomonas aeruginosa PA01
ucgcugcgggcguagcgcggcagc

SEQ ID NO: 3408188 - RNA, 23 nt, Pseudomonas aeruginosa PA01
ucgcugcggguucagucggccag

SEQ ID NO: 3408189 - RNA, 18 nt, Pseudomonas aeruginosa PA01
ucgcugcgugcguugcgc

SEQ ID NO: 3408190 - RNA, 21 nt, Pseudomonas aeruginosa PA01
ucgcugcgugcguugcgcggc

SEQ ID NO: 3408191 - RNA, 14 nt, Pseudomonas aeruginosa PA01
ucgcugcucggccu

SEQ ID NO: 3408192 - RNA, 14 nt, Pseudomonas aeruginosa PA01
ucgcugcuggcgcc

SEQ ID NO: 3408193 - RNA, 13 nt, Pseudomonas aeruginosa PA01
ucgcuggaccagg

SEQ ID NO: 3408194 - RNA, 14 nt, Pseudomonas aeruginosa PA01
ucgcuggaccaggc

SEQ ID NO: 3408195 - RNA, 15 nt, Pseudomonas aeruginosa PA01
ucgcuggaccaggcg

SEQ ID NO: 3408196 - RNA, 17 nt, Pseudomonas aeruginosa PA01
ucgcuggaccaggcggc

SEQ ID NO: 3408197 - RNA, 17 nt, Pseudomonas aeruginosa PA01
ucgcuggcaccggccag

SEQ ID NO: 3408198 - RNA, 20 nt, Pseudomonas aeruginosa PA01
ucgcuggcaccggccaggcg

SEQ ID NO: 3408199 - RNA, 23 nt, Pseudomonas aeruginosa PA01
ucgcuggcaccggccaggcgcug

SEQ ID NO: 3408200 - RNA, 20 nt, Pseudomonas aeruginosa PA01
ucgcuggccugggguagccg

SEQ ID NO: 3408201 - RNA, 22 nt, Pseudomonas aeruginosa PA01
ucgcuggcgaagaaccacugga

SEQ ID NO: 3408202 - RNA, 23 nt, Pseudomonas aeruginosa PA01
ucgcuggcgaagaaccacuggau

SEQ ID NO: 3408203 - RNA, 13 nt, Pseudomonas aeruginosa PA01
ucgcuggcgaugu

SEQ ID NO: 3408204 - RNA, 13 nt, Pseudomonas aeruginosa PA01
ucgcuggcgcagc

SEQ ID NO: 3408205 - RNA, 18 nt, Pseudomonas aeruginosa PA01
ucgcuggcgcagccgcug

SEQ ID NO: 3408206 - RNA, 11 nt, Pseudomonas aeruginosa PA01
ucgcuggcgga

SEQ ID NO: 3408207 - RNA, 18 nt, Pseudomonas aeruginosa PA01
ucgcuggcgucgaccgcc

SEQ ID NO: 3408208 - RNA, 15 nt, Pseudomonas aeruginosa PA01
ucgcugggcgccucg

SEQ ID NO: 3408209 - RNA, 18 nt, Pseudomonas aeruginosa PA01
ucgcugggcgccucgucg

SEQ ID NO: 3408210 - RNA, 20 nt, Pseudomonas aeruginosa PA01
ucgcuggguuuucuggcagg

SEQ ID NO: 3408211 - RNA, 20 nt, Pseudomonas aeruginosa PA01
ucgcuguagcggcucgccga

SEQ ID NO: 3408212 - RNA, 18 nt, Pseudomonas aeruginosa PA01
ucgcugucaaucgcgcaa

SEQ ID NO: 3408213 - RNA, 16 nt, Pseudomonas aeruginosa PA01
ucgcuguccuccagcg

SEQ ID NO: 3408214 - RNA, 15 nt, Pseudomonas aeruginosa PA01
ucgcugucgagcagg

SEQ ID NO: 3408215 - RNA, 17 nt, Pseudomonas aeruginosa PA01
ucgcugucgcccggguu

SEQ ID NO: 3408216 - RNA, 13 nt, Pseudomonas aeruginosa PA01
ucgcugucgccga

SEQ ID NO: 3408217 - RNA, 15 nt, Pseudomonas aeruginosa PA01
ucgcugucgcucagc

SEQ ID NO: 3408218 - RNA, 16 nt, Pseudomonas aeruginosa PA01
ucgcugucgucggcgc

SEQ ID NO: 3408219 - RNA, 16 nt, Pseudomonas aeruginosa PA01
ucgcuuccggcgccaa

SEQ ID NO: 3408220 - RNA, 14 nt, Pseudomonas aeruginosa PA01
ucgcuuccucggca

SEQ ID NO: 3408221 - RNA, 16 nt, Pseudomonas aeruginosa PA01
ucgcuuccucggcacu

SEQ ID NO: 3408222 - RNA, 13 nt, Pseudomonas aeruginosa PA01
ucgcuucggccac

SEQ ID NO: 3408223 - RNA, 22 nt, Pseudomonas aeruginosa PA01
ucgcuugacggauaaaauccac

SEQ ID NO: 3408224 - RNA, 16 nt, Pseudomonas aeruginosa PA01
ucgcuuuccucggucu

SEQ ID NO: 3408225 - RNA, 15 nt, Pseudomonas aeruginosa PA01
ucgcuuuccuggccg

SEQ ID NO: 3408226 - RNA, 21 nt, Pseudomonas aeruginosa PA01
ucggaaagcagggcgauggcc

SEQ ID NO: 3408227 - RNA, 15 nt, Pseudomonas aeruginosa PA01
ucggaacagcgccuu

SEQ ID NO: 3408228 - RNA, 18 nt, Pseudomonas aeruginosa PA01
ucggaacgaccacgccug

SEQ ID NO: 3408229 - RNA, 20 nt, Pseudomonas aeruginosa PA01
ucggaacgaccacgccugcc

SEQ ID NO: 3408230 - RNA, 19 nt, Pseudomonas aeruginosa PA01
ucggaacgaccgguagcca

SEQ ID NO: 3408231 - RNA, 20 nt, Pseudomonas aeruginosa PA01
ucggaacgaccgguagccau

SEQ ID NO: 3408232 - RNA, 13 nt, Pseudomonas aeruginosa PA01
ucggaagaucgcc

SEQ ID NO: 3408233 - RNA, 18 nt, Pseudomonas aeruginosa PA01
ucggaagaucgcccgccu

SEQ ID NO: 3408234 - RNA, 19 nt, Pseudomonas aeruginosa PA01
ucggacaagggccagagca

SEQ ID NO: 3408235 - RNA, 14 nt, Pseudomonas aeruginosa PA01
ucggacaggcauuc

SEQ ID NO: 3408236 - RNA, 19 nt, Pseudomonas aeruginosa PA01
ucggacagguuggcgccgg

SEQ ID NO: 3408237 - RNA, 15 nt, Pseudomonas aeruginosa PA01
ucggaccagaggcug

SEQ ID NO: 3408238 - RNA, 19 nt, Pseudomonas aeruginosa PA01
ucggacgacaucucguccu

SEQ ID NO: 3408239 - RNA, 19 nt, Pseudomonas aeruginosa PA01
ucggacgccguagcggccu

SEQ ID NO: 3408240 - RNA, 21 nt, Pseudomonas aeruginosa PA01
ucggacggcucgcgcagcggc

SEQ ID NO: 3408241 - RNA, 23 nt, Pseudomonas aeruginosa PA01
ucggacggcucgcgcagcggcgc

SEQ ID NO: 3408242 - RNA, 13 nt, Pseudomonas aeruginosa PA01
ucggacuccgccc

SEQ ID NO: 3408243 - RNA, 15 nt, Pseudomonas aeruginosa PA01
ucggccaggaccagg

SEQ ID NO: 3408244 - RNA, 16 nt, Pseudomonas aeruginosa PA01
ucggccaggaccaggg

SEQ ID NO: 3408245 - RNA, 17 nt, Pseudomonas aeruginosa PA01
ucggccaggaccagggc

SEQ ID NO: 3408246 - RNA, 18 nt, Pseudomonas aeruginosa PA01
ucggccaggaccagggcg

SEQ ID NO: 3408247 - RNA, 18 nt, Pseudomonas aeruginosa PA01
ucggccaggacgccacca

SEQ ID NO: 3408248 - RNA, 20 nt, Pseudomonas aeruginosa PA01
ucggccaggacgccaccagg

SEQ ID NO: 3408249 - RNA, 22 nt, Pseudomonas aeruginosa PA01
ucggccaggacgccaccaggcc

SEQ ID NO: 3408250 - RNA, 20 nt, Pseudomonas aeruginosa PA01
ucggccaggcauuccuccag

SEQ ID NO: 3408251 - RNA, 13 nt, Pseudomonas aeruginosa PA01
ucggccaggcgcc

SEQ ID NO: 3408252 - RNA, 16 nt, Pseudomonas aeruginosa PA01
ucggccaggcgccagg

SEQ ID NO: 3408253 - RNA, 17 nt, Pseudomonas aeruginosa PA01
ucggccaggcgccaggg

SEQ ID NO: 3408254 - RNA, 18 nt, Pseudomonas aeruginosa PA01
ucggccaggcgccagggc

SEQ ID NO: 3408255 - RNA, 21 nt, Pseudomonas aeruginosa PA01
ucggccaggcgccagggccgg

SEQ ID NO: 3408256 - RNA, 14 nt, Pseudomonas aeruginosa PA01
ucggccagggaguc

SEQ ID NO: 3408257 - RNA, 22 nt, Pseudomonas aeruginosa PA01
ucggccagggagucgcuggcca

SEQ ID NO: 3408258 - RNA, 16 nt, Pseudomonas aeruginosa PA01
ucggccagggccgcuc

SEQ ID NO: 3408259 - RNA, 20 nt, Pseudomonas aeruginosa PA01
ucggccaggggagcgccggc

SEQ ID NO: 3408260 - RNA, 21 nt, Pseudomonas aeruginosa PA01
ucggccaggggagcgccggcg

SEQ ID NO: 3408261 - RNA, 23 nt, Pseudomonas aeruginosa PA01
ucggccaggggagcgccggcgcg

SEQ ID NO: 3408262 - RNA, 24 nt, Pseudomonas aeruginosa PA01
ucggccagguauucgcgcucggcg

SEQ ID NO: 3408263 - RNA, 18 nt, Pseudomonas aeruginosa PA01
ucggccaggucgcgacug

SEQ ID NO: 3408264 - RNA, 19 nt, Pseudomonas aeruginosa PA01
ucggccaggucgcggguga

SEQ ID NO: 3408265 - RNA, 19 nt, Pseudomonas aeruginosa PA01
ucggccaguccggucagca

SEQ ID NO: 3408266 - RNA, 13 nt, Pseudomonas aeruginosa PA01
ucggccaguuccu

SEQ ID NO: 3408267 - RNA, 13 nt, Pseudomonas aeruginosa PA01
ucggccaguucgc

SEQ ID NO: 3408268 - RNA, 14 nt, Pseudomonas aeruginosa PA01
ucggccaguucguc

SEQ ID NO: 3408269 - RNA, 19 nt, Pseudomonas aeruginosa PA01
ucggccaguucgucgagca

SEQ ID NO: 3408270 - RNA, 16 nt, Pseudomonas aeruginosa PA01
ucggccauaccuccag

SEQ ID NO: 3408271 - RNA, 18 nt, Pseudomonas aeruginosa PA01
ucggccauaccuccagcc

SEQ ID NO: 3408272 - RNA, 21 nt, Pseudomonas aeruginosa PA01
ucggccauaccuccagccagc

SEQ ID NO: 3408273 - RNA, 14 nt, Pseudomonas aeruginosa PA01
ucggccaucagcac

SEQ ID NO: 3408274 - RNA, 19 nt, Pseudomonas aeruginosa PA01
ucggccaucagcgccaggg

SEQ ID NO: 3408275 - RNA, 18 nt, Pseudomonas aeruginosa PA01
ucggccaucgagcgcucc

SEQ ID NO: 3408276 - RNA, 14 nt, Pseudomonas aeruginosa PA01
ucggccaugccggc

SEQ ID NO: 3408277 - RNA, 16 nt, Pseudomonas aeruginosa PA01
ucggccaugccggcca

SEQ ID NO: 3408278 - RNA, 19 nt, Pseudomonas aeruginosa PA01
ucggccaugccggccagga

SEQ ID NO: 3408279 - RNA, 22 nt, Pseudomonas aeruginosa PA01
ucggccaugccggccaggaagg

SEQ ID NO: 3408280 - RNA, 16 nt, Pseudomonas aeruginosa PA01
ucggccauggccgagc

SEQ ID NO: 3408281 - RNA, 17 nt, Pseudomonas aeruginosa PA01
ucggccauggccgagcc

SEQ ID NO: 3408282 - RNA, 18 nt, Pseudomonas aeruginosa PA01
ucggccauggucucgcug

SEQ ID NO: 3408283 - RNA, 21 nt, Pseudomonas aeruginosa PA01
ucggccauggucucgcugacc

SEQ ID NO: 3408284 - RNA, 22 nt, Pseudomonas aeruginosa PA01
ucggccauggucucgcugaccc

SEQ ID NO: 3408285 - RNA, 23 nt, Pseudomonas aeruginosa PA01
ucggccauggucucgcugaccca

SEQ ID NO: 3408286 - RNA, 12 nt, Pseudomonas aeruginosa PA01
ucggcccagcag

SEQ ID NO: 3408287 - RNA, 14 nt, Pseudomonas aeruginosa PA01
ucggcccagcagcg

SEQ ID NO: 3408288 - RNA, 15 nt, Pseudomonas aeruginosa PA01
ucggcccagcagcgc

SEQ ID NO: 3408289 - RNA, 24 nt, Pseudomonas aeruginosa PA01
ucggcccaugaaaaagcccggccu

SEQ ID NO: 3408290 - RNA, 16 nt, Pseudomonas aeruginosa PA01
ucggccccaccuggcg

SEQ ID NO: 3408291 - RNA, 20 nt, Pseudomonas aeruginosa PA01
ucggccccaccuggcgacag

SEQ ID NO: 3408292 - RNA, 23 nt, Pseudomonas aeruginosa PA01
ucggcccgacccacuugaacacc

SEQ ID NO: 3408293 - RNA, 17 nt, Pseudomonas aeruginosa PA01
ucggcccgacgccgccc

SEQ ID NO: 3408294 - RNA, 20 nt, Pseudomonas aeruginosa PA01
ucggcccgacgccgcccggc

SEQ ID NO: 3408295 - RNA, 23 nt, Pseudomonas aeruginosa PA01
ucggcccgcaugaacgccucgcc

SEQ ID NO: 3408296 - RNA, 21 nt, Pseudomonas aeruginosa PA01
ucggcccgcgccauguuccac

SEQ ID NO: 3408297 - RNA, 12 nt, Pseudomonas aeruginosa PA01
ucggcccgcugg

SEQ ID NO: 3408298 - RNA, 20 nt, Pseudomonas aeruginosa PA01
ucggcccggagaccgugccg

SEQ ID NO: 3408299 - RNA, 21 nt, Pseudomonas aeruginosa PA01
ucggcccggagaccgugccgc

SEQ ID NO: 3408300 - RNA, 18 nt, Pseudomonas aeruginosa PA01
ucggcccggagccaacgc

SEQ ID NO: 3408301 - RNA, 17 nt, Pseudomonas aeruginosa PA01
ucggcccgggccuggug

SEQ ID NO: 3408302 - RNA, 16 nt, Pseudomonas aeruginosa PA01
ucggcccggggcucug

SEQ ID NO: 3408303 - RNA, 22 nt, Pseudomonas aeruginosa PA01
ucggcccgguuuuccgcuucca

SEQ ID NO: 3408304 - RNA, 17 nt, Pseudomonas aeruginosa PA01
ucggcccuccccuggcc

SEQ ID NO: 3408305 - RNA, 19 nt, Pseudomonas aeruginosa PA01
ucggcccuccccuggcccu

SEQ ID NO: 3408306 - RNA, 23 nt, Pseudomonas aeruginosa PA01
ucggcccuccccuggcccugcau

SEQ ID NO: 3408307 - RNA, 13 nt, Pseudomonas aeruginosa PA01
ucggcccuggcgg

SEQ ID NO: 3408308 - RNA, 16 nt, Pseudomonas aeruginosa PA01
ucggcccuggcggcga

SEQ ID NO: 3408309 - RNA, 17 nt, Pseudomonas aeruginosa PA01
ucggcccuggcggcgaa

SEQ ID NO: 3408310 - RNA, 11 nt, Pseudomonas aeruginosa PA01
ucggcccuggg

SEQ ID NO: 3408311 - RNA, 11 nt, Pseudomonas aeruginosa PA01
ucggcccuucg

SEQ ID NO: 3408312 - RNA, 21 nt, Pseudomonas aeruginosa PA01
ucggcccuucgacaugggccg

SEQ ID NO: 3408313 - RNA, 20 nt, Pseudomonas aeruginosa PA01
ucggccgacagagcggccgg

SEQ ID NO: 3408314 - RNA, 22 nt, Pseudomonas aeruginosa PA01
ucggccgacagagcggccggcg

SEQ ID NO: 3408315 - RNA, 23 nt, Pseudomonas aeruginosa PA01
ucggccgacagagcggccggcgc

SEQ ID NO: 3408316 - RNA, 15 nt, Pseudomonas aeruginosa PA01
ucggccgacaggcug

SEQ ID NO: 3408317 - RNA, 21 nt, Pseudomonas aeruginosa PA01
ucggccgagggcagccucagc

SEQ ID NO: 3408318 - RNA, 13 nt, Pseudomonas aeruginosa PA01
ucggccgcaccag

SEQ ID NO: 3408319 - RNA, 12 nt, Pseudomonas aeruginosa PA01
ucggccgccagg

SEQ ID NO: 3408320 - RNA, 14 nt, Pseudomonas aeruginosa PA01
ucggccgccaggcg

SEQ ID NO: 3408321 - RNA, 16 nt, Pseudomonas aeruginosa PA01
ucggccgccaggcgcg

SEQ ID NO: 3408322 - RNA, 13 nt, Pseudomonas aeruginosa PA01
ucggccgccaggg

SEQ ID NO: 3408323 - RNA, 12 nt, Pseudomonas aeruginosa PA01
ucggccgccagu

SEQ ID NO: 3408324 - RNA, 18 nt, Pseudomonas aeruginosa PA01
ucggccgcccagcggaug

SEQ ID NO: 3408325 - RNA, 13 nt, Pseudomonas aeruginosa PA01
ucggccgcggcug

SEQ ID NO: 3408326 - RNA, 13 nt, Pseudomonas aeruginosa PA01
ucggccgcugccg

SEQ ID NO: 3408327 - RNA, 19 nt, Pseudomonas aeruginosa PA01
ucggccgggauacagcagc

SEQ ID NO: 3408328 - RNA, 16 nt, Pseudomonas aeruginosa PA01
ucggccucgcggcgcu

SEQ ID NO: 3408329 - RNA, 19 nt, Pseudomonas aeruginosa PA01
ucggccucgcggcgcucga

SEQ ID NO: 3408330 - RNA, 20 nt, Pseudomonas aeruginosa PA01
ucggccucggcgucgcgcag

SEQ ID NO: 3408331 - RNA, 16 nt, Pseudomonas aeruginosa PA01
ucggccugaucaucug

SEQ ID NO: 3408332 - RNA, 19 nt, Pseudomonas aeruginosa PA01
ucggccugaucaucugggc

SEQ ID NO: 3408333 - RNA, 22 nt, Pseudomonas aeruginosa PA01
ucggccugaucaucugggccau

SEQ ID NO: 3408334 - RNA, 15 nt, Pseudomonas aeruginosa PA01
ucggccugcaacacc

SEQ ID NO: 3408335 - RNA, 22 nt, Pseudomonas aeruginosa PA01
ucggccugcaacacccaggccu

SEQ ID NO: 3408336 - RNA, 21 nt, Pseudomonas aeruginosa PA01
ucggccugcagccuggcgucg

SEQ ID NO: 3408337 - RNA, 22 nt, Pseudomonas aeruginosa PA01
ucggccugcagccuggcgucgc

SEQ ID NO: 3408338 - RNA, 20 nt, Pseudomonas aeruginosa PA01
ucggccugcggguucggcga

SEQ ID NO: 3408339 - RNA, 19 nt, Pseudomonas aeruginosa PA01
ucggccugcgucgcaucca

SEQ ID NO: 3408340 - RNA, 21 nt, Pseudomonas aeruginosa PA01
ucggccugcucgaacggcgga

SEQ ID NO: 3408341 - RNA, 13 nt, Pseudomonas aeruginosa PA01
ucggccugcugcu

SEQ ID NO: 3408342 - RNA, 21 nt, Pseudomonas aeruginosa PA01
ucggccugcugcucgaccgcc

SEQ ID NO: 3408343 - RNA, 23 nt, Pseudomonas aeruginosa PA01
ucggccugcugcucgaccgccug

SEQ ID NO: 3408344 - RNA, 13 nt, Pseudomonas aeruginosa PA01
ucggccuggcagu

SEQ ID NO: 3408345 - RNA, 18 nt, Pseudomonas aeruginosa PA01
ucggcgccauaggccagc

SEQ ID NO: 3408346 - RNA, 20 nt, Pseudomonas aeruginosa PA01
ucggcgccauaggccagcac

SEQ ID NO: 3408347 - RNA, 22 nt, Pseudomonas aeruginosa PA01
ucggcgccauaggccagcaccu

SEQ ID NO: 3408348 - RNA, 20 nt, Pseudomonas aeruginosa PA01
ucggcgcccaaugcaucggc

SEQ ID NO: 3408349 - RNA, 17 nt, Pseudomonas aeruginosa PA01
ucggcgcccagggcuuc

SEQ ID NO: 3408350 - RNA, 16 nt, Pseudomonas aeruginosa PA01
ucggcgcccagguagg

SEQ ID NO: 3408351 - RNA, 22 nt, Pseudomonas aeruginosa PA01
ucggcgcccagguaggagaggg

SEQ ID NO: 3408352 - RNA, 13 nt, Pseudomonas aeruginosa PA01
ucggcgcccgccu

SEQ ID NO: 3408353 - RNA, 15 nt, Pseudomonas aeruginosa PA01
ucggcgcccgccugc

SEQ ID NO: 3408354 - RNA, 16 nt, Pseudomonas aeruginosa PA01
ucggcgcccuggccgc

SEQ ID NO: 3408355 - RNA, 17 nt, Pseudomonas aeruginosa PA01
ucggcgcccuggccgcc

SEQ ID NO: 3408356 - RNA, 18 nt, Pseudomonas aeruginosa PA01
ucggcgcccuggccgcca

SEQ ID NO: 3408357 - RNA, 13 nt, Pseudomonas aeruginosa PA01
ucggcgcccuggg

SEQ ID NO: 3408358 - RNA, 20 nt, Pseudomonas aeruginosa PA01
ucggcgcccuggguggucug

SEQ ID NO: 3408359 - RNA, 12 nt, Pseudomonas aeruginosa PA01
ucggcgccgcgc

SEQ ID NO: 3408360 - RNA, 13 nt, Pseudomonas aeruginosa PA01
ucggcgccgcgca

SEQ ID NO: 3408361 - RNA, 16 nt, Pseudomonas aeruginosa PA01
ucggcgccgcgcaccu

SEQ ID NO: 3408362 - RNA, 19 nt, Pseudomonas aeruginosa PA01
ucggcgccggccuccagcg

SEQ ID NO: 3408363 - RNA, 20 nt, Pseudomonas aeruginosa PA01
ucggcgccggccuccagcgc

SEQ ID NO: 3408364 - RNA, 14 nt, Pseudomonas aeruginosa PA01
ucggcgccgucgau

SEQ ID NO: 3408365 - RNA, 18 nt, Pseudomonas aeruginosa PA01
ucggcgccgucgaucagg

SEQ ID NO: 3408366 - RNA, 23 nt, Pseudomonas aeruginosa PA01
ucggcgccgucgaucagguaggc

SEQ ID NO: 3408367 - RNA, 21 nt, Pseudomonas aeruginosa PA01
ucggcgccugcggaccacagg

SEQ ID NO: 3408368 - RNA, 16 nt, Pseudomonas aeruginosa PA01
ucggcgccuuccugcu

SEQ ID NO: 3408369 - RNA, 13 nt, Pseudomonas aeruginosa PA01
ucggcgcgacggc

SEQ ID NO: 3408370 - RNA, 21 nt, Pseudomonas aeruginosa PA01
ucggcgcgacggcccacggcg

SEQ ID NO: 3408371 - RNA, 18 nt, Pseudomonas aeruginosa PA01
ucggcgcgauccuccgcc

SEQ ID NO: 3408372 - RNA, 20 nt, Pseudomonas aeruginosa PA01
ucggcgcgauccuccgccag

SEQ ID NO: 3408373 - RNA, 13 nt, Pseudomonas aeruginosa PA01
ucggcgcgcaccu

SEQ ID NO: 3408374 - RNA, 14 nt, Pseudomonas aeruginosa PA01
ucggcgcgcagggc

SEQ ID NO: 3408375 - RNA, 18 nt, Pseudomonas aeruginosa PA01
ucggcgcgcagggccagc

SEQ ID NO: 3408376 - RNA, 14 nt, Pseudomonas aeruginosa PA01
ucggcgcgcccggc

SEQ ID NO: 3408377 - RNA, 15 nt, Pseudomonas aeruginosa PA01
ucggcgcgcccggcg

SEQ ID NO: 3408378 - RNA, 14 nt, Pseudomonas aeruginosa PA01
ucggcgcgccgaag

SEQ ID NO: 3408379 - RNA, 15 nt, Pseudomonas aeruginosa PA01
ucggcgcgccgaagg

SEQ ID NO: 3408380 - RNA, 17 nt, Pseudomonas aeruginosa PA01
ucggcgcgccgaaggcg

SEQ ID NO: 3408381 - RNA, 20 nt, Pseudomonas aeruginosa PA01
ucggcgcgccgaaggcgaua

SEQ ID NO: 3408382 - RNA, 14 nt, Pseudomonas aeruginosa PA01
ucggcgcgccggcc

SEQ ID NO: 3408383 - RNA, 16 nt, Pseudomonas aeruginosa PA01
ucggcgcgccggcccg

SEQ ID NO: 3408384 - RNA, 12 nt, Pseudomonas aeruginosa PA01
ucggcgcgcgcc

SEQ ID NO: 3408385 - RNA, 15 nt, Pseudomonas aeruginosa PA01
ucggcgcgcggcagc

SEQ ID NO: 3408386 - RNA, 21 nt, Pseudomonas aeruginosa PA01
ucggcgcgcggcagcaccagg

SEQ ID NO: 3408387 - RNA, 13 nt, Pseudomonas aeruginosa PA01
ucggcgcggccgg

SEQ ID NO: 3408388 - RNA, 14 nt, Pseudomonas aeruginosa PA01
ucggcgcggccggc

SEQ ID NO: 3408389 - RNA, 21 nt, Pseudomonas aeruginosa PA01
ucggcgcggcgcuccaggcgg

SEQ ID NO: 3408390 - RNA, 15 nt, Pseudomonas aeruginosa PA01
ucggcgcgggcaugg

SEQ ID NO: 3408391 - RNA, 22 nt, Pseudomonas aeruginosa PA01
ucggcgcgggccuucaggcugc

SEQ ID NO: 3408392 - RNA, 23 nt, Pseudomonas aeruginosa PA01
ucggcgcggggcccggcuccagc

SEQ ID NO: 3408393 - RNA, 17 nt, Pseudomonas aeruginosa PA01
ucggcgcggggcguucc

SEQ ID NO: 3408394 - RNA, 22 nt, Pseudomonas aeruginosa PA01
ucggcgcggucggguccgggcc

SEQ ID NO: 3408395 - RNA, 14 nt, Pseudomonas aeruginosa PA01
ucggcgcucaccgc

SEQ ID NO: 3408396 - RNA, 12 nt, Pseudomonas aeruginosa PA01
ucggcgcuccgc

SEQ ID NO: 3408397 - RNA, 12 nt, Pseudomonas aeruginosa PA01
ucggcgcugacc

SEQ ID NO: 3408398 - RNA, 22 nt, Pseudomonas aeruginosa PA01
ucggcgcugaccucgauggcgu

SEQ ID NO: 3408399 - RNA, 14 nt, Pseudomonas aeruginosa PA01
ucggcgcugccggc

SEQ ID NO: 3408400 - RNA, 19 nt, Pseudomonas aeruginosa PA01
ucggcgcugccggccaggg

SEQ ID NO: 3408401 - RNA, 19 nt, Pseudomonas aeruginosa PA01
ucggcgcuggccagguagg

SEQ ID NO: 3408402 - RNA, 14 nt, Pseudomonas aeruginosa PA01
ucggcgcuggcgcg

SEQ ID NO: 3408403 - RNA, 15 nt, Pseudomonas aeruginosa PA01
ucggcgcugucgccg

SEQ ID NO: 3408404 - RNA, 19 nt, Pseudomonas aeruginosa PA01
ucggcgcugucgccguugg

SEQ ID NO: 3408405 - RNA, 17 nt, Pseudomonas aeruginosa PA01
ucggcgcuuucgcucug

SEQ ID NO: 3408406 - RNA, 19 nt, Pseudomonas aeruginosa PA01
ucggcggacagcccgcgcu

SEQ ID NO: 3408407 - RNA, 20 nt, Pseudomonas aeruginosa PA01
ucggcggacagcccgcgcuc

SEQ ID NO: 3408408 - RNA, 21 nt, Pseudomonas aeruginosa PA01
ucggcggauaaacggcaugca

SEQ ID NO: 3408409 - RNA, 14 nt, Pseudomonas aeruginosa PA01
ucggcggauaacgc

SEQ ID NO: 3408410 - RNA, 19 nt, Pseudomonas aeruginosa PA01
ucggcggauaacgccgcug

SEQ ID NO: 3408411 - RNA, 22 nt, Pseudomonas aeruginosa PA01
ucggcggauaacgccgcuggcg

SEQ ID NO: 3408412 - RNA, 23 nt, Pseudomonas aeruginosa PA01
ucggcggauaacgcuacccucag

SEQ ID NO: 3408413 - RNA, 19 nt, Pseudomonas aeruginosa PA01
ucggcggcacccucuuccg

SEQ ID NO: 3408414 - RNA, 20 nt, Pseudomonas aeruginosa PA01
ucggcggcacccucuuccgc

SEQ ID NO: 3408415 - RNA, 12 nt, Pseudomonas aeruginosa PA01
ucggcggcagcu

SEQ ID NO: 3408416 - RNA, 14 nt, Pseudomonas aeruginosa PA01
ucggcggcagcugc

SEQ ID NO: 3408417 - RNA, 21 nt, Pseudomonas aeruginosa PA01
ucggcggcagcugcggcggca

SEQ ID NO: 3408418 - RNA, 15 nt, Pseudomonas aeruginosa PA01
ucggcggcaggccga

SEQ ID NO: 3408419 - RNA, 18 nt, Pseudomonas aeruginosa PA01
ucggcggcaggcgcauca

SEQ ID NO: 3408420 - RNA, 22 nt, Pseudomonas aeruginosa PA01
ucggcggcaggcugcgccgcug

SEQ ID NO: 3408421 - RNA, 12 nt, Pseudomonas aeruginosa PA01
ucggcggccagc

SEQ ID NO: 3408422 - RNA, 13 nt, Pseudomonas aeruginosa PA01
ucggcggccaggc

SEQ ID NO: 3408423 - RNA, 16 nt, Pseudomonas aeruginosa PA01
ucggcggccaggcgcu

SEQ ID NO: 3408424 - RNA, 17 nt, Pseudomonas aeruginosa PA01
ucggcggccaggcgcuc

SEQ ID NO: 3408425 - RNA, 17 nt, Pseudomonas aeruginosa PA01
ucggcggccauugccgc

SEQ ID NO: 3408426 - RNA, 15 nt, Pseudomonas aeruginosa PA01
ucggcggccgccuug

SEQ ID NO: 3408427 - RNA, 15 nt, Pseudomonas aeruginosa PA01
ucggcggccgggucg

SEQ ID NO: 3408428 - RNA, 23 nt, Pseudomonas aeruginosa PA01
ucggcggccgggucgaggucgag

SEQ ID NO: 3408429 - RNA, 11 nt, Pseudomonas aeruginosa PA01
ucggcggccuc

SEQ ID NO: 3408430 - RNA, 12 nt, Pseudomonas aeruginosa PA01
ucggcggccucg

SEQ ID NO: 3408431 - RNA, 15 nt, Pseudomonas aeruginosa PA01
ucggcggccucggcc

SEQ ID NO: 3408432 - RNA, 13 nt, Pseudomonas aeruginosa PA01
ucggcggcgagcg

SEQ ID NO: 3408433 - RNA, 21 nt, Pseudomonas aeruginosa PA01
ucggcggcgagcgccgcggcg

SEQ ID NO: 3408434 - RNA, 23 nt, Pseudomonas aeruginosa PA01
ucggcggcgagcgccgcggcgaa

SEQ ID NO: 3408435 - RNA, 19 nt, Pseudomonas aeruginosa PA01
ucggcggcgccggugaggc

SEQ ID NO: 3408436 - RNA, 22 nt, Pseudomonas aeruginosa PA01
ucggcggcgccggugaggcgca

SEQ ID NO: 3408437 - RNA, 16 nt, Pseudomonas aeruginosa PA01
ucggcggcgcgcagcg

SEQ ID NO: 3408438 - RNA, 19 nt, Pseudomonas aeruginosa PA01
ucggcggcgcgcagcgaac

SEQ ID NO: 3408439 - RNA, 14 nt, Pseudomonas aeruginosa PA01
ucggcggcgcgcug

SEQ ID NO: 3408440 - RNA, 15 nt, Pseudomonas aeruginosa PA01
ucggcggcgcgcugc

SEQ ID NO: 3408441 - RNA, 16 nt, Pseudomonas aeruginosa PA01
ucggcggcgcggcgua

SEQ ID NO: 3408442 - RNA, 13 nt, Pseudomonas aeruginosa PA01
ucggcggcggccc

SEQ ID NO: 3408443 - RNA, 15 nt, Pseudomonas aeruginosa PA01
ucggcggcggcccgc

SEQ ID NO: 3408444 - RNA, 21 nt, Pseudomonas aeruginosa PA01
ucggcggcgguucgccgagcg

SEQ ID NO: 3408445 - RNA, 17 nt, Pseudomonas aeruginosa PA01
ucggcggcgugcagggu

SEQ ID NO: 3408446 - RNA, 12 nt, Pseudomonas aeruginosa PA01
ucggcggcucug

SEQ ID NO: 3408447 - RNA, 18 nt, Pseudomonas aeruginosa PA01
ucggcgggacggcgcaua

SEQ ID NO: 3408448 - RNA, 17 nt, Pseudomonas aeruginosa PA01
ucgggcgaaacggcagg

SEQ ID NO: 3408449 - RNA, 20 nt, Pseudomonas aeruginosa PA01
ucgggcgaaacggcaggcca

SEQ ID NO: 3408450 - RNA, 22 nt, Pseudomonas aeruginosa PA01
ucgggcgaaacggcaggccagc

SEQ ID NO: 3408451 - RNA, 23 nt, Pseudomonas aeruginosa PA01
ucgggcgaaacggcaggccagca

SEQ ID NO: 3408452 - RNA, 21 nt, Pseudomonas aeruginosa PA01
ucgggcgagaaucgccgaggc

SEQ ID NO: 3408453 - RNA, 15 nt, Pseudomonas aeruginosa PA01
ucgggcgagcgcaga

SEQ ID NO: 3408454 - RNA, 21 nt, Pseudomonas aeruginosa PA01
ucgggcgcggacaagcccagc

SEQ ID NO: 3408455 - RNA, 22 nt, Pseudomonas aeruginosa PA01
ucgggcggaucgagcagcggcg

SEQ ID NO: 3408456 - RNA, 19 nt, Pseudomonas aeruginosa PA01
ucgggcgggaucaggucgc

SEQ ID NO: 3408457 - RNA, 22 nt, Pseudomonas aeruginosa PA01
ucgggcgggaucaggucgccag

SEQ ID NO: 3408458 - RNA, 19 nt, Pseudomonas aeruginosa PA01
ucgggcgucuccugccgcc

SEQ ID NO: 3408459 - RNA, 21 nt, Pseudomonas aeruginosa PA01
ucgggcgucuccugccgccga

SEQ ID NO: 3408460 - RNA, 21 nt, Pseudomonas aeruginosa PA01
ucgggcucagaagucccagcg

SEQ ID NO: 3408461 - RNA, 22 nt, Pseudomonas aeruginosa PA01
ucgggcucaugggcgaugcgcc

SEQ ID NO: 3408462 - RNA, 21 nt, Pseudomonas aeruginosa PA01
ucgggcucgacgaggaacgcc

SEQ ID NO: 3408463 - RNA, 17 nt, Pseudomonas aeruginosa PA01
ucgggcuucagcgccgg

SEQ ID NO: 3408464 - RNA, 18 nt, Pseudomonas aeruginosa PA01
ucgggcuucuucaccagg

SEQ ID NO: 3408465 - RNA, 18 nt, Pseudomonas aeruginosa PA01
ucggggaacagcgccagc

SEQ ID NO: 3408466 - RNA, 20 nt, Pseudomonas aeruginosa PA01
ucggggaacagcgccagcgg

SEQ ID NO: 3408467 - RNA, 21 nt, Pseudomonas aeruginosa PA01
ucggggaagggacgucgccag

SEQ ID NO: 3408468 - RNA, 14 nt, Pseudomonas aeruginosa PA01
ucggggcaggcgca

SEQ ID NO: 3408469 - RNA, 17 nt, Pseudomonas aeruginosa PA01
ucggggcauucguccag

SEQ ID NO: 3408470 - RNA, 19 nt, Pseudomonas aeruginosa PA01
ucggggcauucguccagcc

SEQ ID NO: 3408471 - RNA, 20 nt, Pseudomonas aeruginosa PA01
ucggggcauucguccagccg

SEQ ID NO: 3408472 - RNA, 22 nt, Pseudomonas aeruginosa PA01
ucggggcauucguccagccgcc

SEQ ID NO: 3408473 - RNA, 17 nt, Pseudomonas aeruginosa PA01
ucggggcccuccaggcg

SEQ ID NO: 3408474 - RNA, 18 nt, Pseudomonas aeruginosa PA01
ucggggcccuccaggcga

SEQ ID NO: 3408475 - RNA, 20 nt, Pseudomonas aeruginosa PA01
ucggggccgaggucgaccag

SEQ ID NO: 3408476 - RNA, 24 nt, Pseudomonas aeruginosa PA01
ucggggccgaggucgaccagccag

SEQ ID NO: 3408477 - RNA, 15 nt, Pseudomonas aeruginosa PA01
ucggggccggcgaug

SEQ ID NO: 3408478 - RNA, 21 nt, Pseudomonas aeruginosa PA01
ucggggcgcaaggccagcggc

SEQ ID NO: 3408479 - RNA, 22 nt, Pseudomonas aeruginosa PA01
ucggggcgcaaggccagcggca

SEQ ID NO: 3408480 - RNA, 14 nt, Pseudomonas aeruginosa PA01
ucggggcgccucca

SEQ ID NO: 3408481 - RNA, 19 nt, Pseudomonas aeruginosa PA01
ucgggggcugcgcaucgcc

SEQ ID NO: 3408482 - RNA, 21 nt, Pseudomonas aeruginosa PA01
ucgggggcugcgcaucgccug

SEQ ID NO: 3408483 - RNA, 18 nt, Pseudomonas aeruginosa PA01
ucgggggugcccaucagg

SEQ ID NO: 3408484 - RNA, 16 nt, Pseudomonas aeruginosa PA01
ucggggguucgaaucc

SEQ ID NO: 3408485 - RNA, 12 nt, Pseudomonas aeruginosa PA01
ucggggugcagg

SEQ ID NO: 3408486 - RNA, 14 nt, Pseudomonas aeruginosa PA01
ucggggugccgcca

SEQ ID NO: 3408487 - RNA, 15 nt, Pseudomonas aeruginosa PA01
ucggggugcgcggcg

SEQ ID NO: 3408488 - RNA, 16 nt, Pseudomonas aeruginosa PA01
ucggggugcgcggcga

SEQ ID NO: 3408489 - RNA, 17 nt, Pseudomonas aeruginosa PA01
ucggggugcgcggcgaa

SEQ ID NO: 3408490 - RNA, 15 nt, Pseudomonas aeruginosa PA01
ucggggugggcauag

SEQ ID NO: 3408491 - RNA, 18 nt, Pseudomonas aeruginosa PA01
ucggggugggcauaggaa

SEQ ID NO: 3408492 - RNA, 20 nt, Pseudomonas aeruginosa PA01
ucgggguucuugucgaccag

SEQ ID NO: 3408493 - RNA, 22 nt, Pseudomonas aeruginosa PA01
ucgggguugcguguucccugua

SEQ ID NO: 3408494 - RNA, 19 nt, Pseudomonas aeruginosa PA01
ucggguaauccacgcugug

SEQ ID NO: 3408495 - RNA, 18 nt, Pseudomonas aeruginosa PA01
ucggguagagcgcggcgc

SEQ ID NO: 3408496 - RNA, 15 nt, Pseudomonas aeruginosa PA01
ucggguccaggcgcc

SEQ ID NO: 3408497 - RNA, 18 nt, Pseudomonas aeruginosa PA01
ucggguccaggcgccaga

SEQ ID NO: 3408498 - RNA, 16 nt, Pseudomonas aeruginosa PA01
ucgggucgagcuugcc

SEQ ID NO: 3408499 - RNA, 12 nt, Pseudomonas aeruginosa PA01
ucgggucgcccu

SEQ ID NO: 3408500 - RNA, 17 nt, Pseudomonas aeruginosa PA01
ucgggucgcccuugagg

SEQ ID NO: 3408501 - RNA, 22 nt, Pseudomonas aeruginosa PA01
ucgggucgcguucgucggccac

SEQ ID NO: 3408502 - RNA, 15 nt, Pseudomonas aeruginosa PA01
ucgggugggacaugg

SEQ ID NO: 3408503 - RNA, 17 nt, Pseudomonas aeruginosa PA01
ucggguugaucgacgcc

SEQ ID NO: 3408504 - RNA, 16 nt, Pseudomonas aeruginosa PA01
ucggguuuggcgcccg

SEQ ID NO: 3408505 - RNA, 14 nt, Pseudomonas aeruginosa PA01
ucgguagccggcca

SEQ ID NO: 3408506 - RNA, 19 nt, Pseudomonas aeruginosa PA01
ucgguagccggccaaccac

SEQ ID NO: 3408507 - RNA, 20 nt, Pseudomonas aeruginosa PA01
ucgguagggccgaggucgag

SEQ ID NO: 3408508 - RNA, 15 nt, Pseudomonas aeruginosa PA01
ucgguauggcugcug

SEQ ID NO: 3408509 - RNA, 16 nt, Pseudomonas aeruginosa PA01
ucgguauucaucggcg

SEQ ID NO: 3408510 - RNA, 15 nt, Pseudomonas aeruginosa PA01
ucggucaccgugguc

SEQ ID NO: 3408511 - RNA, 20 nt, Pseudomonas aeruginosa PA01
ucggucagguauucgccggc

SEQ ID NO: 3408512 - RNA, 16 nt, Pseudomonas aeruginosa PA01
ucgguccaacccaugu

SEQ ID NO: 3408513 - RNA, 14 nt, Pseudomonas aeruginosa PA01
ucgguccgccgaug

SEQ ID NO: 3408514 - RNA, 15 nt, Pseudomonas aeruginosa PA01
ucggucgcccucggc

SEQ ID NO: 3408515 - RNA, 15 nt, Pseudomonas aeruginosa PA01
ucggucgccgccagc

SEQ ID NO: 3408516 - RNA, 14 nt, Pseudomonas aeruginosa PA01
ucggucgcgccccc

SEQ ID NO: 3408517 - RNA, 12 nt, Pseudomonas aeruginosa PA01
ucggucggccag

SEQ ID NO: 3408518 - RNA, 21 nt, Pseudomonas aeruginosa PA01
ucggucucgaucggcccgggc

SEQ ID NO: 3408519 - RNA, 16 nt, Pseudomonas aeruginosa PA01
ucggucucguccggcg

SEQ ID NO: 3408520 - RNA, 17 nt, Pseudomonas aeruginosa PA01
ucggugaacgagcccag

SEQ ID NO: 3408521 - RNA, 23 nt, Pseudomonas aeruginosa PA01
ucggugaacuucuccagguacag

SEQ ID NO: 3408522 - RNA, 17 nt, Pseudomonas aeruginosa PA01
ucggugaagcgcggcgg

SEQ ID NO: 3408523 - RNA, 14 nt, Pseudomonas aeruginosa PA01
ucggugaccaccag

SEQ ID NO: 3408524 - RNA, 16 nt, Pseudomonas aeruginosa PA01
ucggugaccaccaggc

SEQ ID NO: 3408525 - RNA, 14 nt, Pseudomonas aeruginosa PA01
ucggugacccgcac

SEQ ID NO: 3408526 - RNA, 17 nt, Pseudomonas aeruginosa PA01
ucggugacccgcacggc

SEQ ID NO: 3408527 - RNA, 18 nt, Pseudomonas aeruginosa PA01
ucggugauaccgccggcg

SEQ ID NO: 3408528 - RNA, 14 nt, Pseudomonas aeruginosa PA01
ucggugcccucgcg

SEQ ID NO: 3408529 - RNA, 12 nt, Pseudomonas aeruginosa PA01
ucggugccgccc

SEQ ID NO: 3408530 - RNA, 15 nt, Pseudomonas aeruginosa PA01
ucggugccgccggcg

SEQ ID NO: 3408531 - RNA, 16 nt, Pseudomonas aeruginosa PA01
ucggugcgcacgcaau

SEQ ID NO: 3408532 - RNA, 22 nt, Pseudomonas aeruginosa PA01
ucggugcgccccaggugcagcg

SEQ ID NO: 3408533 - RNA, 14 nt, Pseudomonas aeruginosa PA01
ucggugcgcuccug

SEQ ID NO: 3408534 - RNA, 14 nt, Pseudomonas aeruginosa PA01
ucggugcggccgag

SEQ ID NO: 3408535 - RNA, 15 nt, Pseudomonas aeruginosa PA01
ucggugcggccgagg

SEQ ID NO: 3408536 - RNA, 19 nt, Pseudomonas aeruginosa PA01
ucggugcgguuggagcgga

SEQ ID NO: 3408537 - RNA, 14 nt, Pseudomonas aeruginosa PA01
ucggugcucaggcg

SEQ ID NO: 3408538 - RNA, 16 nt, Pseudomonas aeruginosa PA01
ucggugcucaggcggc

SEQ ID NO: 3408539 - RNA, 13 nt, Pseudomonas aeruginosa PA01
ucgguggcaggaa

SEQ ID NO: 3408540 - RNA, 19 nt, Pseudomonas aeruginosa PA01
ucgguggcaggaaaugccu

SEQ ID NO: 3408541 - RNA, 21 nt, Pseudomonas aeruginosa PA01
ucgguggcaugguguccggcg

SEQ ID NO: 3408542 - RNA, 16 nt, Pseudomonas aeruginosa PA01
ucgguggcgaccagga

SEQ ID NO: 3408543 - RNA, 13 nt, Pseudomonas aeruginosa PA01
ucgguggcggcga

SEQ ID NO: 3408544 - RNA, 14 nt, Pseudomonas aeruginosa PA01
ucggugggcuugcc

SEQ ID NO: 3408545 - RNA, 19 nt, Pseudomonas aeruginosa PA01
ucgguguccaccaccagca

SEQ ID NO: 3408546 - RNA, 16 nt, Pseudomonas aeruginosa PA01
ucgguguccgcggugc

SEQ ID NO: 3408547 - RNA, 15 nt, Pseudomonas aeruginosa PA01
ucggugucggccaac

SEQ ID NO: 3408548 - RNA, 19 nt, Pseudomonas aeruginosa PA01
ucggugucguauuccaggg

SEQ ID NO: 3408549 - RNA, 18 nt, Pseudomonas aeruginosa PA01
ucggugugaucaccagcc

SEQ ID NO: 3408550 - RNA, 20 nt, Pseudomonas aeruginosa PA01
ucggugugaucaccagccac

SEQ ID NO: 3408551 - RNA, 12 nt, Pseudomonas aeruginosa PA01
ucgguuccagcu

SEQ ID NO: 3408552 - RNA, 15 nt, Pseudomonas aeruginosa PA01
ucgguucgucgagga

SEQ ID NO: 3408553 - RNA, 20 nt, Pseudomonas aeruginosa PA01
ucgguucugcgcaccaugcc

SEQ ID NO: 3408554 - RNA, 19 nt, Pseudomonas aeruginosa PA01
ucgguugccaggccggcgc

SEQ ID NO: 3408555 - RNA, 12 nt, Pseudomonas aeruginosa PA01
ucgguugccgcg

SEQ ID NO: 3408556 - RNA, 13 nt, Pseudomonas aeruginosa PA01
ucgguuuccaccu

SEQ ID NO: 3408557 - RNA, 16 nt, Pseudomonas aeruginosa PA01
ucgguuuccggccagg

SEQ ID NO: 3408558 - RNA, 14 nt, Pseudomonas aeruginosa PA01
ucgguuugcgccga

SEQ ID NO: 3408559 - RNA, 16 nt, Pseudomonas aeruginosa PA01
ucgguuugcgccgaau

SEQ ID NO: 3408560 - RNA, 19 nt, Pseudomonas aeruginosa PA01
ucguaaaggacgucgacga

SEQ ID NO: 3408561 - RNA, 16 nt, Pseudomonas aeruginosa PA01
ucguaagucagguccu

SEQ ID NO: 3408562 - RNA, 17 nt, Pseudomonas aeruginosa PA01
ucguacaccgcgcggca

SEQ ID NO: 3408563 - RNA, 21 nt, Pseudomonas aeruginosa PA01
ucguacucggcggggcgcagc

SEQ ID NO: 3408564 - RNA, 17 nt, Pseudomonas aeruginosa PA01
ucguacuucagcgucac

SEQ ID NO: 3408565 - RNA, 19 nt, Pseudomonas aeruginosa PA01
ucguagaacuuuaggucug

SEQ ID NO: 3408566 - RNA, 15 nt, Pseudomonas aeruginosa PA01
ucguagacgcccgga

SEQ ID NO: 3408567 - RNA, 21 nt, Pseudomonas aeruginosa PA01
ucguagacgcgcacgucaccg

SEQ ID NO: 3408568 - RNA, 21 nt, Pseudomonas aeruginosa PA01
ucguagagcgugcggccgauc

SEQ ID NO: 3408569 - RNA, 13 nt, Pseudomonas aeruginosa PA01
ucguagcagccac

SEQ ID NO: 3408570 - RNA, 13 nt, Pseudomonas aeruginosa PA01
ucguagcccaugg

SEQ ID NO: 3408571 - RNA, 14 nt, Pseudomonas aeruginosa PA01
ucguagccgcgcgc

SEQ ID NO: 3408572 - RNA, 16 nt, Pseudomonas aeruginosa PA01
ucguagccggcgcggc

SEQ ID NO: 3408573 - RNA, 19 nt, Pseudomonas aeruginosa PA01
ucguagccggcgcggcgca

SEQ ID NO: 3408574 - RNA, 21 nt, Pseudomonas aeruginosa PA01
ucguagccggcgcggcgcagc

SEQ ID NO: 3408575 - RNA, 16 nt, Pseudomonas aeruginosa PA01
ucguagcgcagcggca

SEQ ID NO: 3408576 - RNA, 17 nt, Pseudomonas aeruginosa PA01
ucguagcgcagcggcag

SEQ ID NO: 3408577 - RNA, 18 nt, Pseudomonas aeruginosa PA01
ucguagcgcagcggcagg

SEQ ID NO: 3408578 - RNA, 15 nt, Pseudomonas aeruginosa PA01
ucguagcgcgcggcg

SEQ ID NO: 3408579 - RNA, 17 nt, Pseudomonas aeruginosa PA01
ucguagcgcgcggcgag

SEQ ID NO: 3408580 - RNA, 19 nt, Pseudomonas aeruginosa PA01
ucguagcggucgugcagca

SEQ ID NO: 3408581 - RNA, 21 nt, Pseudomonas aeruginosa PA01
ucguaggaacgugcggccugc

SEQ ID NO: 3408582 - RNA, 15 nt, Pseudomonas aeruginosa PA01
ucguaggcaggcgcg

SEQ ID NO: 3408583 - RNA, 17 nt, Pseudomonas aeruginosa PA01
ucguaggcaggcgcggc

SEQ ID NO: 3408584 - RNA, 13 nt, Pseudomonas aeruginosa PA01
ucguaggccgacu

SEQ ID NO: 3408585 - RNA, 14 nt, Pseudomonas aeruginosa PA01
ucguaggccgacuc

SEQ ID NO: 3408586 - RNA, 13 nt, Pseudomonas aeruginosa PA01
ucguaggccgagc

SEQ ID NO: 3408587 - RNA, 16 nt, Pseudomonas aeruginosa PA01
ucguaggcguccuggc

SEQ ID NO: 3408588 - RNA, 20 nt, Pseudomonas aeruginosa PA01
ucguaggucugcccgacgaa

SEQ ID NO: 3408589 - RNA, 23 nt, Pseudomonas aeruginosa PA01
ucguagguuuccggguccuggau

SEQ ID NO: 3408590 - RNA, 14 nt, Pseudomonas aeruginosa PA01
ucguaguccugggc

SEQ ID NO: 3408591 - RNA, 18 nt, Pseudomonas aeruginosa PA01
ucguaguccugggccggu

SEQ ID NO: 3408592 - RNA, 14 nt, Pseudomonas aeruginosa PA01
ucguauaggcgcug

SEQ ID NO: 3408593 - RNA, 15 nt, Pseudomonas aeruginosa PA01
ucguauaggcgcugg

SEQ ID NO: 3408594 - RNA, 18 nt, Pseudomonas aeruginosa PA01
ucguaugccugugcaccg

SEQ ID NO: 3408595 - RNA, 13 nt, Pseudomonas aeruginosa PA01
ucgucaaccagca

SEQ ID NO: 3408596 - RNA, 13 nt, Pseudomonas aeruginosa PA01
ucgucacccgcgc

SEQ ID NO: 3408597 - RNA, 14 nt, Pseudomonas aeruginosa PA01
ucgucacgcaggcu

SEQ ID NO: 3408598 - RNA, 17 nt, Pseudomonas aeruginosa PA01
ucgucaucguccagcuc

SEQ ID NO: 3408599 - RNA, 22 nt, Pseudomonas aeruginosa PA01
ucgucaucguccagcucggcca

SEQ ID NO: 3408600 - RNA, 19 nt, Pseudomonas aeruginosa PA01
ucgucauggcgcacgccgc

SEQ ID NO: 3408601 - RNA, 22 nt, Pseudomonas aeruginosa PA01
ucguccagaugcuugcacaccu

SEQ ID NO: 3408602 - RNA, 14 nt, Pseudomonas aeruginosa PA01
ucguccagcaggcc

SEQ ID NO: 3408603 - RNA, 17 nt, Pseudomonas aeruginosa PA01
ucguccagccgccgcug

SEQ ID NO: 3408604 - RNA, 18 nt, Pseudomonas aeruginosa PA01
ucguccagccgccgcugc

SEQ ID NO: 3408605 - RNA, 22 nt, Pseudomonas aeruginosa PA01
ucguccagcgaggcguggaagg

SEQ ID NO: 3408606 - RNA, 12 nt, Pseudomonas aeruginosa PA01
ucguccagcgcc

SEQ ID NO: 3408607 - RNA, 14 nt, Pseudomonas aeruginosa PA01
ucguccagcggcuc

SEQ ID NO: 3408608 - RNA, 21 nt, Pseudomonas aeruginosa PA01
ucguccagcggguagaugcca

SEQ ID NO: 3408609 - RNA, 23 nt, Pseudomonas aeruginosa PA01
ucguccagcggguagaugccacu

SEQ ID NO: 3408610 - RNA, 16 nt, Pseudomonas aeruginosa PA01
ucguccagcucggcca

SEQ ID NO: 3408611 - RNA, 15 nt, Pseudomonas aeruginosa PA01
ucguccaggcaagcg

SEQ ID NO: 3408612 - RNA, 16 nt, Pseudomonas aeruginosa PA01
ucguccaggccgcagg

SEQ ID NO: 3408613 - RNA, 16 nt, Pseudomonas aeruginosa PA01
ucguccaggccgccua

SEQ ID NO: 3408614 - RNA, 12 nt, Pseudomonas aeruginosa PA01
ucguccagggcg

SEQ ID NO: 3408615 - RNA, 13 nt, Pseudomonas aeruginosa PA01
ucguccaguucca

SEQ ID NO: 3408616 - RNA, 18 nt, Pseudomonas aeruginosa PA01
ucguccaguuccaggguc

SEQ ID NO: 3408617 - RNA, 15 nt, Pseudomonas aeruginosa PA01
ucguccaucgccgcg

SEQ ID NO: 3408618 - RNA, 12 nt, Pseudomonas aeruginosa PA01
ucgucccgagca

SEQ ID NO: 3408619 - RNA, 14 nt, Pseudomonas aeruginosa PA01
ucguccgccaccac

SEQ ID NO: 3408620 - RNA, 13 nt, Pseudomonas aeruginosa PA01
ucguccggagccg

SEQ ID NO: 3408621 - RNA, 20 nt, Pseudomonas aeruginosa PA01
ucguccggccgcccgagccg

SEQ ID NO: 3408622 - RNA, 23 nt, Pseudomonas aeruginosa PA01
ucguccgggcgguacaggcgcac

SEQ ID NO: 3408623 - RNA, 19 nt, Pseudomonas aeruginosa PA01
ucguccuccucgaucaccc

SEQ ID NO: 3408624 - RNA, 15 nt, Pseudomonas aeruginosa PA01
ucguccucgcccugc

SEQ ID NO: 3408625 - RNA, 20 nt, Pseudomonas aeruginosa PA01
ucguccucggcguagccggc

SEQ ID NO: 3408626 - RNA, 14 nt, Pseudomonas aeruginosa PA01
ucguccugcgcggc

SEQ ID NO: 3408627 - RNA, 22 nt, Pseudomonas aeruginosa PA01
ucguccugcggauucaucggcg

SEQ ID NO: 3408628 - RNA, 13 nt, Pseudomonas aeruginosa PA01
ucguccugcugcu

SEQ ID NO: 3408629 - RNA, 17 nt, Pseudomonas aeruginosa PA01
ucguccuuuccuccguc

SEQ ID NO: 3408630 - RNA, 13 nt, Pseudomonas aeruginosa PA01
ucgucgaccugcg

SEQ ID NO: 3408631 - RNA, 14 nt, Pseudomonas aeruginosa PA01
ucgucgagaugcug

SEQ ID NO: 3408632 - RNA, 22 nt, Pseudomonas aeruginosa PA01
ucgucgagcaugccgaggaacg

SEQ ID NO: 3408633 - RNA, 14 nt, Pseudomonas aeruginosa PA01
ucgucgagcgcagc

SEQ ID NO: 3408634 - RNA, 17 nt, Pseudomonas aeruginosa PA01
ucgucgagcgcagcgac

SEQ ID NO: 3408635 - RNA, 17 nt, Pseudomonas aeruginosa PA01
ucgucgagcugcucggc

SEQ ID NO: 3408636 - RNA, 13 nt, Pseudomonas aeruginosa PA01
ucgucgaggcugu

SEQ ID NO: 3408637 - RNA, 17 nt, Pseudomonas aeruginosa PA01
ucgucgaucagguccug

SEQ ID NO: 3408638 - RNA, 21 nt, Pseudomonas aeruginosa PA01
ucgucgaucagguccuggccg

SEQ ID NO: 3408639 - RNA, 14 nt, Pseudomonas aeruginosa PA01
ucgucgaucucgcc

SEQ ID NO: 3408640 - RNA, 19 nt, Pseudomonas aeruginosa PA01
ucgucgaucucgccgaagg

SEQ ID NO: 3408641 - RNA, 21 nt, Pseudomonas aeruginosa PA01
ucgucgaugcuccaaugcacc

SEQ ID NO: 3408642 - RNA, 21 nt, Pseudomonas aeruginosa PA01
ucgucgcaccuguuccagcaa

SEQ ID NO: 3408643 - RNA, 22 nt, Pseudomonas aeruginosa PA01
ucgucgcaccuguuccagcaac

SEQ ID NO: 3408644 - RNA, 14 nt, Pseudomonas aeruginosa PA01
ucgucgccaagccc

SEQ ID NO: 3408645 - RNA, 18 nt, Pseudomonas aeruginosa PA01
ucgucgccaagcccggcg

SEQ ID NO: 3408646 - RNA, 13 nt, Pseudomonas aeruginosa PA01
ucgucgccagccc

SEQ ID NO: 3408647 - RNA, 13 nt, Pseudomonas aeruginosa PA01
ucgucgcccuuca

SEQ ID NO: 3408648 - RNA, 12 nt, Pseudomonas aeruginosa PA01
ucgucgccgacc

SEQ ID NO: 3408649 - RNA, 13 nt, Pseudomonas aeruginosa PA01
ucgucgccgaccc

SEQ ID NO: 3408650 - RNA, 15 nt, Pseudomonas aeruginosa PA01
ucgucgccgcccggc

SEQ ID NO: 3408651 - RNA, 17 nt, Pseudomonas aeruginosa PA01
ucgucgccgcccggcag

SEQ ID NO: 3408652 - RNA, 22 nt, Pseudomonas aeruginosa PA01
ucgucgccgcccggcagcggcu

SEQ ID NO: 3408653 - RNA, 18 nt, Pseudomonas aeruginosa PA01
ucgucgccgccgaggcgc

SEQ ID NO: 3408654 - RNA, 13 nt, Pseudomonas aeruginosa PA01
ucuagcgcaggcg

SEQ ID NO: 3408655 - RNA, 16 nt, Pseudomonas aeruginosa PA01
ucuagcgccccggccg

SEQ ID NO: 3408656 - RNA, 19 nt, Pseudomonas aeruginosa PA01
ucuagcgccccggccgcgc

SEQ ID NO: 3408657 - RNA, 21 nt, Pseudomonas aeruginosa PA01
ucuaguggccuaggacaccgc

SEQ ID NO: 3408658 - RNA, 18 nt, Pseudomonas aeruginosa PA01
ucuaucccgugccgggcc

SEQ ID NO: 3408659 - RNA, 14 nt, Pseudomonas aeruginosa PA01
ucuaucgacaggau

SEQ ID NO: 3408660 - RNA, 19 nt, Pseudomonas aeruginosa PA01
ucuaucugcguaacguuac

SEQ ID NO: 3408661 - RNA, 23 nt, Pseudomonas aeruginosa PA01
ucuaucugcguaacguuacgcua

SEQ ID NO: 3408662 - RNA, 15 nt, Pseudomonas aeruginosa PA01
ucuaugaaccggggc

SEQ ID NO: 3408663 - RNA, 23 nt, Pseudomonas aeruginosa PA01
ucuaugggacgaccucagaccac

SEQ ID NO: 3408664 - RNA, 16 nt, Pseudomonas aeruginosa PA01
ucucaaagggcagcgg

SEQ ID NO: 3408665 - RNA, 20 nt, Pseudomonas aeruginosa PA01
ucucaaagggcagcggcgag

SEQ ID NO: 3408666 - RNA, 20 nt, Pseudomonas aeruginosa PA01
ucucaccgcccugcgcgauc

SEQ ID NO: 3408667 - RNA, 14 nt, Pseudomonas aeruginosa PA01
ucucagccggcgcu

SEQ ID NO: 3408668 - RNA, 23 nt, Pseudomonas aeruginosa PA01
ucucagccggcgcuacgccaauc

SEQ ID NO: 3408669 - RNA, 20 nt, Pseudomonas aeruginosa PA01
ucucaggaccuuccgccagc

SEQ ID NO: 3408670 - RNA, 23 nt, Pseudomonas aeruginosa PA01
ucucaggaccuuccgccagcagg

SEQ ID NO: 3408671 - RNA, 21 nt, Pseudomonas aeruginosa PA01
ucucaggggccgacgcgcugc

SEQ ID NO: 3408672 - RNA, 12 nt, Pseudomonas aeruginosa PA01
ucucaucccugu

SEQ ID NO: 3408673 - RNA, 14 nt, Pseudomonas aeruginosa PA01
ucucauugcgccgc

SEQ ID NO: 3408674 - RNA, 16 nt, Pseudomonas aeruginosa PA01
ucuccacgucguccgg

SEQ ID NO: 3408675 - RNA, 17 nt, Pseudomonas aeruginosa PA01
ucuccacuaccgccgag

SEQ ID NO: 3408676 - RNA, 17 nt, Pseudomonas aeruginosa PA01
ucuccagaaucucccgc

SEQ ID NO: 3408677 - RNA, 21 nt, Pseudomonas aeruginosa PA01
ucuccagcagggucgccuggg

SEQ ID NO: 3408678 - RNA, 15 nt, Pseudomonas aeruginosa PA01
ucuccagccgcaccc

SEQ ID NO: 3408679 - RNA, 14 nt, Pseudomonas aeruginosa PA01
ucuccagcucggcg

SEQ ID NO: 3408680 - RNA, 15 nt, Pseudomonas aeruginosa PA01
ucuccaggccgcuca

SEQ ID NO: 3408681 - RNA, 17 nt, Pseudomonas aeruginosa PA01
ucuccaggccgcucacc

SEQ ID NO: 3408682 - RNA, 22 nt, Pseudomonas aeruginosa PA01
ucuccaggccgcucaccgccac

SEQ ID NO: 3408683 - RNA, 15 nt, Pseudomonas aeruginosa PA01
ucuccaggcgcgccg

SEQ ID NO: 3408684 - RNA, 23 nt, Pseudomonas aeruginosa PA01
ucuccaggcgcgccgugcggcgu

SEQ ID NO: 3408685 - RNA, 11 nt, Pseudomonas aeruginosa PA01
ucuccaggcuu

SEQ ID NO: 3408686 - RNA, 14 nt, Pseudomonas aeruginosa PA01
ucuccagggaaacc

SEQ ID NO: 3408687 - RNA, 17 nt, Pseudomonas aeruginosa PA01
ucuccagggaaaccacc

SEQ ID NO: 3408688 - RNA, 19 nt, Pseudomonas aeruginosa PA01
ucuccagggaaaccaccug

SEQ ID NO: 3408689 - RNA, 20 nt, Pseudomonas aeruginosa PA01
ucuccagggaaaccaccugg

SEQ ID NO: 3408690 - RNA, 18 nt, Pseudomonas aeruginosa PA01
ucuccaggucggucggcg

SEQ ID NO: 3408691 - RNA, 13 nt, Pseudomonas aeruginosa PA01
ucuccaguucggc

SEQ ID NO: 3408692 - RNA, 17 nt, Pseudomonas aeruginosa PA01
ucuccaguucggcgaug

SEQ ID NO: 3408693 - RNA, 17 nt, Pseudomonas aeruginosa PA01
ucuccccagacccucuc

SEQ ID NO: 3408694 - RNA, 21 nt, Pseudomonas aeruginosa PA01
ucuccccagacccucucccug

SEQ ID NO: 3408695 - RNA, 13 nt, Pseudomonas aeruginosa PA01
ucuccccgcuccc

SEQ ID NO: 3408696 - RNA, 20 nt, Pseudomonas aeruginosa PA01
ucuccccgcucccgcggccc

SEQ ID NO: 3408697 - RNA, 19 nt, Pseudomonas aeruginosa PA01
ucucccgcgauucgccggg

SEQ ID NO: 3408698 - RNA, 14 nt, Pseudomonas aeruginosa PA01
ucucccggcugguc

SEQ ID NO: 3408699 - RNA, 21 nt, Pseudomonas aeruginosa PA01
ucucccugaagggagagggaa

SEQ ID NO: 3408700 - RNA, 22 nt, Pseudomonas aeruginosa PA01
ucucccugaagggagagggaac

SEQ ID NO: 3408701 - RNA, 19 nt, Pseudomonas aeruginosa PA01
ucucccuguccuacccgag

SEQ ID NO: 3408702 - RNA, 12 nt, Pseudomonas aeruginosa PA01
ucucccuucagg

SEQ ID NO: 3408703 - RNA, 16 nt, Pseudomonas aeruginosa PA01
ucuccgaguccugcug

SEQ ID NO: 3408704 - RNA, 20 nt, Pseudomonas aeruginosa PA01
ucuccgccagccagccgcgc

SEQ ID NO: 3408705 - RNA, 16 nt, Pseudomonas aeruginosa PA01
ucuccgcgccacgcgc

SEQ ID NO: 3408706 - RNA, 20 nt, Pseudomonas aeruginosa PA01
ucuccgcgccgcggcggcgg

SEQ ID NO: 3408707 - RNA, 12 nt, Pseudomonas aeruginosa PA01
ucuccgcucggg

SEQ ID NO: 3408708 - RNA, 12 nt, Pseudomonas aeruginosa PA01
ucuccggcgccg

SEQ ID NO: 3408709 - RNA, 17 nt, Pseudomonas aeruginosa PA01
ucuccggggcccggcag

SEQ ID NO: 3408710 - RNA, 20 nt, Pseudomonas aeruginosa PA01
ucuccggggcccggcaggca

SEQ ID NO: 3408711 - RNA, 20 nt, Pseudomonas aeruginosa PA01
ucuccgucaaugcggccugc

SEQ ID NO: 3408712 - RNA, 21 nt, Pseudomonas aeruginosa PA01
ucuccgugcuggccggcagca

SEQ ID NO: 3408713 - RNA, 16 nt, Pseudomonas aeruginosa PA01
ucuccuccucggcggc

SEQ ID NO: 3408714 - RNA, 16 nt, Pseudomonas aeruginosa PA01
ucuccucgacggcggg

SEQ ID NO: 3408715 - RNA, 16 nt, Pseudomonas aeruginosa PA01
ucuccucgauccgcug

SEQ ID NO: 3408716 - RNA, 13 nt, Pseudomonas aeruginosa PA01
ucuccucgcgcag

SEQ ID NO: 3408717 - RNA, 19 nt, Pseudomonas aeruginosa PA01
ucuccucgcgcagcggcuc

SEQ ID NO: 3408718 - RNA, 20 nt, Pseudomonas aeruginosa PA01
ucucgaacaccaggcgccag

SEQ ID NO: 3408719 - RNA, 22 nt, Pseudomonas aeruginosa PA01
ucucgaacaccaggcgccaggg

SEQ ID NO: 3408720 - RNA, 16 nt, Pseudomonas aeruginosa PA01
ucucgaacagcagcaa

SEQ ID NO: 3408721 - RNA, 18 nt, Pseudomonas aeruginosa PA01
ucucgaacagcagcaagc

SEQ ID NO: 3408722 - RNA, 15 nt, Pseudomonas aeruginosa PA01
ucucgaacagcuccu

SEQ ID NO: 3408723 - RNA, 19 nt, Pseudomonas aeruginosa PA01
ucucgaacagcuccuccag

SEQ ID NO: 3408724 - RNA, 17 nt, Pseudomonas aeruginosa PA01
ucucgaacgccaggcag

SEQ ID NO: 3408725 - RNA, 22 nt, Pseudomonas aeruginosa PA01
ucucgaacucgaaggccagcuc

SEQ ID NO: 3408726 - RNA, 13 nt, Pseudomonas aeruginosa PA01
ucucgaagaccag

SEQ ID NO: 3408727 - RNA, 13 nt, Pseudomonas aeruginosa PA01
ucucgaagcgcgc

SEQ ID NO: 3408728 - RNA, 21 nt, Pseudomonas aeruginosa PA01
ucucgaagcgcgccugcucuu

SEQ ID NO: 3408729 - RNA, 15 nt, Pseudomonas aeruginosa PA01
ucucgacccgcucga

SEQ ID NO: 3408730 - RNA, 17 nt, Pseudomonas aeruginosa PA01
ucucgacgaaggcgcgc

SEQ ID NO: 3408731 - RNA, 21 nt, Pseudomonas aeruginosa PA01
ucucgacuuccgccuuguccu

SEQ ID NO: 3408732 - RNA, 15 nt, Pseudomonas aeruginosa PA01
ucucgaucagcgccg

SEQ ID NO: 3408733 - RNA, 14 nt, Pseudomonas aeruginosa PA01
ucucgaucaucgcc

SEQ ID NO: 3408734 - RNA, 19 nt, Pseudomonas aeruginosa PA01
ucucgaucaucgccagcgg

SEQ ID NO: 3408735 - RNA, 15 nt, Pseudomonas aeruginosa PA01
ucucgaucggcccgg

SEQ ID NO: 3408736 - RNA, 22 nt, Pseudomonas aeruginosa PA01
ucucgauggcagccuuggccac

SEQ ID NO: 3408737 - RNA, 20 nt, Pseudomonas aeruginosa PA01
ucucgcagcaggcguucggc

SEQ ID NO: 3408738 - RNA, 19 nt, Pseudomonas aeruginosa PA01
ucucgcccaguaccgccac

SEQ ID NO: 3408739 - RNA, 22 nt, Pseudomonas aeruginosa PA01
ucucgccgaaggugcaggccgc

SEQ ID NO: 3408740 - RNA, 14 nt, Pseudomonas aeruginosa PA01
ucucgccgccgagc

SEQ ID NO: 3408741 - RNA, 14 nt, Pseudomonas aeruginosa PA01
ucucgccgccggag

SEQ ID NO: 3408742 - RNA, 19 nt, Pseudomonas aeruginosa PA01
ucucgccgccggagagcga

SEQ ID NO: 3408743 - RNA, 17 nt, Pseudomonas aeruginosa PA01
ucucgccgcgcacgucg

SEQ ID NO: 3408744 - RNA, 15 nt, Pseudomonas aeruginosa PA01
ucucgccgcgcucgc

SEQ ID NO: 3408745 - RNA, 19 nt, Pseudomonas aeruginosa PA01
ucucgccggcacuguuccu

SEQ ID NO: 3408746 - RNA, 14 nt, Pseudomonas aeruginosa PA01
ucucgccgucggcg

SEQ ID NO: 3408747 - RNA, 18 nt, Pseudomonas aeruginosa PA01
ucucgccgucggcgguca

SEQ ID NO: 3408748 - RNA, 20 nt, Pseudomonas aeruginosa PA01
ucucgccucccggcucgccg

SEQ ID NO: 3408749 - RNA, 14 nt, Pseudomonas aeruginosa PA01
ucucgccucggcgg

SEQ ID NO: 3408750 - RNA, 17 nt, Pseudomonas aeruginosa PA01
ucucgcgacccuggccg

SEQ ID NO: 3408751 - RNA, 20 nt, Pseudomonas aeruginosa PA01
ucucgcgacccuggccgcgc

SEQ ID NO: 3408752 - RNA, 14 nt, Pseudomonas aeruginosa PA01
ucucgcgcagcggc

SEQ ID NO: 3408753 - RNA, 18 nt, Pseudomonas aeruginosa PA01
ucucgcgcagcggcggau

SEQ ID NO: 3408754 - RNA, 19 nt, Pseudomonas aeruginosa PA01
ucucgcgggcguuggccug

SEQ ID NO: 3408755 - RNA, 21 nt, Pseudomonas aeruginosa PA01
ucucgcgggcguuggccugga

SEQ ID NO: 3408756 - RNA, 19 nt, Pseudomonas aeruginosa PA01
ucuggcugaucaguucgga

SEQ ID NO: 3408757 - RNA, 14 nt, Pseudomonas aeruginosa PA01
ucuggcugcccagg

SEQ ID NO: 3408758 - RNA, 17 nt, Pseudomonas aeruginosa PA01
ucuggcugcgcgccacc

SEQ ID NO: 3408759 - RNA, 22 nt, Pseudomonas aeruginosa PA01
ucugggacggcagccugggggu

SEQ ID NO: 3408760 - RNA, 16 nt, Pseudomonas aeruginosa PA01
ucugggcauggcuggc

SEQ ID NO: 3408761 - RNA, 19 nt, Pseudomonas aeruginosa PA01
ucugggccaugaccucggc

SEQ ID NO: 3408762 - RNA, 16 nt, Pseudomonas aeruginosa PA01
ucuggggugaggccga

SEQ ID NO: 3408763 - RNA, 18 nt, Pseudomonas aeruginosa PA01
ucuggggugaggccgagc

SEQ ID NO: 3408764 - RNA, 15 nt, Pseudomonas aeruginosa PA01
ucugggucuggcgau

SEQ ID NO: 3408765 - RNA, 20 nt, Pseudomonas aeruginosa PA01
ucugggucuuggucacggcg

SEQ ID NO: 3408766 - RNA, 15 nt, Pseudomonas aeruginosa PA01
ucugguagccgcagu

SEQ ID NO: 3408767 - RNA, 21 nt, Pseudomonas aeruginosa PA01
ucugguagcgaaucugcaggg

SEQ ID NO: 3408768 - RNA, 18 nt, Pseudomonas aeruginosa PA01
ucugguagcugcggccga

SEQ ID NO: 3408769 - RNA, 14 nt, Pseudomonas aeruginosa PA01
ucugguaggccagc

SEQ ID NO: 3408770 - RNA, 16 nt, Pseudomonas aeruginosa PA01
ucugguaggccagcag

SEQ ID NO: 3408771 - RNA, 13 nt, Pseudomonas aeruginosa PA01
ucuggucgccgac

SEQ ID NO: 3408772 - RNA, 14 nt, Pseudomonas aeruginosa PA01
ucuggucgccgaca

SEQ ID NO: 3408773 - RNA, 15 nt, Pseudomonas aeruginosa PA01
ucuggucgccgacac

SEQ ID NO: 3408774 - RNA, 17 nt, Pseudomonas aeruginosa PA01
ucuggugcgcguccauc

SEQ ID NO: 3408775 - RNA, 14 nt, Pseudomonas aeruginosa PA01
ucugucccugggcc

SEQ ID NO: 3408776 - RNA, 13 nt, Pseudomonas aeruginosa PA01
ucugugccgaggc

SEQ ID NO: 3408777 - RNA, 18 nt, Pseudomonas aeruginosa PA01
ucugugccgaggccgccg

SEQ ID NO: 3408778 - RNA, 18 nt, Pseudomonas aeruginosa PA01
ucugugcggugccgcgca

SEQ ID NO: 3408779 - RNA, 17 nt, Pseudomonas aeruginosa PA01
ucuguguggccugggcg

SEQ ID NO: 3408780 - RNA, 14 nt, Pseudomonas aeruginosa PA01
ucuguuccucggcg

SEQ ID NO: 3408781 - RNA, 14 nt, Pseudomonas aeruginosa PA01
ucuguucgaccagu

SEQ ID NO: 3408782 - RNA, 13 nt, Pseudomonas aeruginosa PA01
ucuucaccaggcc

SEQ ID NO: 3408783 - RNA, 15 nt, Pseudomonas aeruginosa PA01
ucuucacccgcagcg

SEQ ID NO: 3408784 - RNA, 21 nt, Pseudomonas aeruginosa PA01
ucuucacccgcagcggcagcg

SEQ ID NO: 3408785 - RNA, 17 nt, Pseudomonas aeruginosa PA01
ucuucacgccuugcugc

SEQ ID NO: 3408786 - RNA, 14 nt, Pseudomonas aeruginosa PA01
ucuucagcacgccc

SEQ ID NO: 3408787 - RNA, 13 nt, Pseudomonas aeruginosa PA01
ucuucagccuggg

SEQ ID NO: 3408788 - RNA, 12 nt, Pseudomonas aeruginosa PA01
ucuucagcuugg

SEQ ID NO: 3408789 - RNA, 21 nt, Pseudomonas aeruginosa PA01
ucuucaggcgugggccagccc

SEQ ID NO: 3408790 - RNA, 20 nt, Pseudomonas aeruginosa PA01
ucuucagucccucgucauca

SEQ ID NO: 3408791 - RNA, 13 nt, Pseudomonas aeruginosa PA01
ucuucaguucggg

SEQ ID NO: 3408792 - RNA, 13 nt, Pseudomonas aeruginosa PA01
ucuucaucaccuu

SEQ ID NO: 3408793 - RNA, 22 nt, Pseudomonas aeruginosa PA01
ucuuccacgcgccgauccaggc

SEQ ID NO: 3408794 - RNA, 23 nt, Pseudomonas aeruginosa PA01
ucuuccagcacgcggagggcggc

SEQ ID NO: 3408795 - RNA, 12 nt, Pseudomonas aeruginosa PA01
ucuuccagggcg

SEQ ID NO: 3408796 - RNA, 19 nt, Pseudomonas aeruginosa PA01
ucuucccguaaggccaggc

SEQ ID NO: 3408797 - RNA, 21 nt, Pseudomonas aeruginosa PA01
ucuucccguaaggccaggcuc

SEQ ID NO: 3408798 - RNA, 17 nt, Pseudomonas aeruginosa PA01
ucuuccgcgcugaccug

SEQ ID NO: 3408799 - RNA, 22 nt, Pseudomonas aeruginosa PA01
ucuuccguugugauuggguucc

SEQ ID NO: 3408800 - RNA, 17 nt, Pseudomonas aeruginosa PA01
ucuuccucgcugccuac

SEQ ID NO: 3408801 - RNA, 18 nt, Pseudomonas aeruginosa PA01
ucuuccucggacuugcuc

SEQ ID NO: 3408802 - RNA, 21 nt, Pseudomonas aeruginosa PA01
ucuuccuggaccuccgccagg

SEQ ID NO: 3408803 - RNA, 15 nt, Pseudomonas aeruginosa PA01
ucuuccuggccggga

SEQ ID NO: 3408804 - RNA, 22 nt, Pseudomonas aeruginosa PA01
ucuuccuugcugaagcccaggc

SEQ ID NO: 3408805 - RNA, 13 nt, Pseudomonas aeruginosa PA01
ucuuccuugucgu

SEQ ID NO: 3408806 - RNA, 22 nt, Pseudomonas aeruginosa PA01
ucuucgaaggucugcccguggc

SEQ ID NO: 3408807 - RNA, 10 nt, Pseudomonas aeruginosa PA01
ucuucgacgc

SEQ ID NO: 3408808 - RNA, 15 nt, Pseudomonas aeruginosa PA01
ucuucgauggcggcc

SEQ ID NO: 3408809 - RNA, 18 nt, Pseudomonas aeruginosa PA01
ucuucgauggcggccgcc

SEQ ID NO: 3408810 - RNA, 18 nt, Pseudomonas aeruginosa PA01
ucuucgccauccuugagu

SEQ ID NO: 3408811 - RNA, 15 nt, Pseudomonas aeruginosa PA01
ucuucgccgacagau

SEQ ID NO: 3408812 - RNA, 15 nt, Pseudomonas aeruginosa PA01
ucuucgccgcggcgu

SEQ ID NO: 3408813 - RNA, 15 nt, Pseudomonas aeruginosa PA01
ucuucgccuugcccu

SEQ ID NO: 3408814 - RNA, 15 nt, Pseudomonas aeruginosa PA01
ucuucggccaguucg

SEQ ID NO: 3408815 - RNA, 17 nt, Pseudomonas aeruginosa PA01
ucuucggcggccagcgg

SEQ ID NO: 3408816 - RNA, 16 nt, Pseudomonas aeruginosa PA01
ucuucggguagccaug

SEQ ID NO: 3408817 - RNA, 23 nt, Pseudomonas aeruginosa PA01
ucuucgggugucaacuggaucgu

SEQ ID NO: 3408818 - RNA, 22 nt, Pseudomonas aeruginosa PA01
ucuucguaaugcacgcucaugc

SEQ ID NO: 3408819 - RNA, 12 nt, Pseudomonas aeruginosa PA01
ucuucgucggcg

SEQ ID NO: 3408820 - RNA, 20 nt, Pseudomonas aeruginosa PA01
ucuucguuuucaggcgacgc

SEQ ID NO: 3408821 - RNA, 17 nt, Pseudomonas aeruginosa PA01
ucuucuaccuggcgcug

SEQ ID NO: 3408822 - RNA, 19 nt, Pseudomonas aeruginosa PA01
ucuucuccgauuccugcgg

SEQ ID NO: 3408823 - RNA, 13 nt, Pseudomonas aeruginosa PA01
ucuucuccgccgc

SEQ ID NO: 3408824 - RNA, 14 nt, Pseudomonas aeruginosa PA01
ucuucucggcgauu

SEQ ID NO: 3408825 - RNA, 14 nt, Pseudomonas aeruginosa PA01
ucuucugguaggcc

SEQ ID NO: 3408826 - RNA, 16 nt, Pseudomonas aeruginosa PA01
ucuucugguaggccag

SEQ ID NO: 3408827 - RNA, 18 nt, Pseudomonas aeruginosa PA01
ucuucugguaggccagca

SEQ ID NO: 3408828 - RNA, 19 nt, Pseudomonas aeruginosa PA01
ucuucuuucgacaugcagu

SEQ ID NO: 3408829 - RNA, 16 nt, Pseudomonas aeruginosa PA01
ucuugaccuucugcac

SEQ ID NO: 3408830 - RNA, 17 nt, Pseudomonas aeruginosa PA01
ucuugaccuucugcacc

SEQ ID NO: 3408831 - RNA, 18 nt, Pseudomonas aeruginosa PA01
ucuugaccuucugcaccg

SEQ ID NO: 3408832 - RNA, 17 nt, Pseudomonas aeruginosa PA01
ucuugaucacguccagg

SEQ ID NO: 3408833 - RNA, 20 nt, Pseudomonas aeruginosa PA01
ucuugauccgcuccagcgcc

SEQ ID NO: 3408834 - RNA, 15 nt, Pseudomonas aeruginosa PA01
ucuugaucgccagcg

SEQ ID NO: 3408835 - RNA, 23 nt, Pseudomonas aeruginosa PA01
ucuugcaggcucacgcguucggc

SEQ ID NO: 3408836 - RNA, 20 nt, Pseudomonas aeruginosa PA01
ucuugccgcgagcuuggccc

SEQ ID NO: 3408837 - RNA, 21 nt, Pseudomonas aeruginosa PA01
ucuugccggaaagcaguucgc

SEQ ID NO: 3408838 - RNA, 16 nt, Pseudomonas aeruginosa PA01
ucuugccuuccaccgg

SEQ ID NO: 3408839 - RNA, 14 nt, Pseudomonas aeruginosa PA01
ucuugcgcccggcg

SEQ ID NO: 3408840 - RNA, 14 nt, Pseudomonas aeruginosa PA01
ucuugcugccggcg

SEQ ID NO: 3408841 - RNA, 14 nt, Pseudomonas aeruginosa PA01
ucuuggcggcgauc

SEQ ID NO: 3408842 - RNA, 14 nt, Pseudomonas aeruginosa PA01
ucuuggcucggcag

SEQ ID NO: 3408843 - RNA, 17 nt, Pseudomonas aeruginosa PA01
ucuuggucacggcgaag

SEQ ID NO: 3408844 - RNA, 14 nt, Pseudomonas aeruginosa PA01
ucuugucgaccagc

SEQ ID NO: 3408845 - RNA, 20 nt, Pseudomonas aeruginosa PA01
ucuugucgcgggucugcgag

SEQ ID NO: 3408846 - RNA, 14 nt, Pseudomonas aeruginosa PA01
ucuuguugagcugg

SEQ ID NO: 3408847 - RNA, 17 nt, Pseudomonas aeruginosa PA01
ucuuucaccuggucgcc

SEQ ID NO: 3408848 - RNA, 11 nt, Pseudomonas aeruginosa PA01
ucuuuccuuuc

SEQ ID NO: 3408849 - RNA, 13 nt, Pseudomonas aeruginosa PA01
ucuuugccuggaa

SEQ ID NO: 3408850 - RNA, 17 nt, Pseudomonas aeruginosa PA01
ucuuugccuggaaaaag

SEQ ID NO: 3408851 - RNA, 15 nt, Pseudomonas aeruginosa PA01
ucuuuggccaauugc

SEQ ID NO: 3408852 - RNA, 15 nt, Pseudomonas aeruginosa PA01
ucuuuuuaagagaau

SEQ ID NO: 3408853 - RNA, 22 nt, Pseudomonas aeruginosa PA01
ucuuuuugcgccagguagccug

SEQ ID NO: 3408854 - RNA, 15 nt, Pseudomonas aeruginosa PA01
ugaaaaacgccggcg

SEQ ID NO: 3408855 - RNA, 19 nt, Pseudomonas aeruginosa PA01
ugaaaaagcccggccgcug

SEQ ID NO: 3408856 - RNA, 15 nt, Pseudomonas aeruginosa PA01
ugaaaaaggccggug

SEQ ID NO: 3408857 - RNA, 15 nt, Pseudomonas aeruginosa PA01
ugaaaaaggcgcccg

SEQ ID NO: 3408858 - RNA, 11 nt, Pseudomonas aeruginosa PA01
ugaaaaaggga

SEQ ID NO: 3408859 - RNA, 14 nt, Pseudomonas aeruginosa PA01
ugaaaaagggaugc

SEQ ID NO: 3408860 - RNA, 20 nt, Pseudomonas aeruginosa PA01
ugaccaggcugaucagcccg

SEQ ID NO: 3408861 - RNA, 16 nt, Pseudomonas aeruginosa PA01
ugaccaggguggcggc

SEQ ID NO: 3408862 - RNA, 20 nt, Pseudomonas aeruginosa PA01
ugaccaggucguggaaggcu

SEQ ID NO: 3408863 - RNA, 21 nt, Pseudomonas aeruginosa PA01
ugaccaggucguggaaggcuu

SEQ ID NO: 3408864 - RNA, 13 nt, Pseudomonas aeruginosa PA01
ugaccauaggcuu

SEQ ID NO: 3408865 - RNA, 20 nt, Pseudomonas aeruginosa PA01
ugaccauaggcuugcgccga

SEQ ID NO: 3408866 - RNA, 21 nt, Pseudomonas aeruginosa PA01
ugaccauaggcuugcgccgaa

SEQ ID NO: 3408867 - RNA, 22 nt, Pseudomonas aeruginosa PA01
ugaccauaggcuugcgccgaag

SEQ ID NO: 3408868 - RNA, 16 nt, Pseudomonas aeruginosa PA01
ugaccaucuuuuccug

SEQ ID NO: 3408869 - RNA, 17 nt, Pseudomonas aeruginosa PA01
ugaccauggugaugcgc

SEQ ID NO: 3408870 - RNA, 20 nt, Pseudomonas aeruginosa PA01
ugaccauggugaugcgcaug

SEQ ID NO: 3408871 - RNA, 17 nt, Pseudomonas aeruginosa PA01
ugacccacuccggcagg

SEQ ID NO: 3408872 - RNA, 21 nt, Pseudomonas aeruginosa PA01
ugacccacuccggcaggcgcu

SEQ ID NO: 3408873 - RNA, 16 nt, Pseudomonas aeruginosa PA01
ugacccagagccgcuc

SEQ ID NO: 3408874 - RNA, 19 nt, Pseudomonas aeruginosa PA01
ugacccagagccgcucggc

SEQ ID NO: 3408875 - RNA, 21 nt, Pseudomonas aeruginosa PA01
ugacccagagccgcucggcgg

SEQ ID NO: 3408876 - RNA, 12 nt, Pseudomonas aeruginosa PA01
ugaccccaccgg

SEQ ID NO: 3408877 - RNA, 21 nt, Pseudomonas aeruginosa PA01
ugaccccggccuggcuggccu

SEQ ID NO: 3408878 - RNA, 20 nt, Pseudomonas aeruginosa PA01
ugacccgcaccuugcccugc

SEQ ID NO: 3408879 - RNA, 13 nt, Pseudomonas aeruginosa PA01
ugacccgcacggc

SEQ ID NO: 3408880 - RNA, 15 nt, Pseudomonas aeruginosa PA01
ugacccgcaguuccu

SEQ ID NO: 3408881 - RNA, 13 nt, Pseudomonas aeruginosa PA01
ugacccgccccug

SEQ ID NO: 3408882 - RNA, 22 nt, Pseudomonas aeruginosa PA01
ugacccgccccugcuccucgcc

SEQ ID NO: 3408883 - RNA, 16 nt, Pseudomonas aeruginosa PA01
ugacccgcucgccggg

SEQ ID NO: 3408884 - RNA, 14 nt, Pseudomonas aeruginosa PA01
ugacccgcugcacc

SEQ ID NO: 3408885 - RNA, 16 nt, Pseudomonas aeruginosa PA01
ugacccgcugcaccag

SEQ ID NO: 3408886 - RNA, 17 nt, Pseudomonas aeruginosa PA01
ugacccgcugcaccagc

SEQ ID NO: 3408887 - RNA, 19 nt, Pseudomonas aeruginosa PA01
ugacccgcugcuggauggg

SEQ ID NO: 3408888 - RNA, 18 nt, Pseudomonas aeruginosa PA01
ugacccgcuguccgccgg

SEQ ID NO: 3408889 - RNA, 15 nt, Pseudomonas aeruginosa PA01
ugacccgggugccuu

SEQ ID NO: 3408890 - RNA, 19 nt, Pseudomonas aeruginosa PA01
ugacccgguacagcgccug

SEQ ID NO: 3408891 - RNA, 16 nt, Pseudomonas aeruginosa PA01
ugacccguugcgccuc

SEQ ID NO: 3408892 - RNA, 19 nt, Pseudomonas aeruginosa PA01
ugaccgagcaugcgcggca

SEQ ID NO: 3408893 - RNA, 20 nt, Pseudomonas aeruginosa PA01
ugaccgagcaugcgcggcag

SEQ ID NO: 3408894 - RNA, 16 nt, Pseudomonas aeruginosa PA01
ugaccgauggcgccgc

SEQ ID NO: 3408895 - RNA, 12 nt, Pseudomonas aeruginosa PA01
ugaccgccccgg

SEQ ID NO: 3408896 - RNA, 23 nt, Pseudomonas aeruginosa PA01
ugaccgccccggcagccaccagg

SEQ ID NO: 3408897 - RNA, 14 nt, Pseudomonas aeruginosa PA01
ugaccgccgccgcc

SEQ ID NO: 3408898 - RNA, 22 nt, Pseudomonas aeruginosa PA01
ugaccgccgcucaucugcacca

SEQ ID NO: 3408899 - RNA, 17 nt, Pseudomonas aeruginosa PA01
ugaccgcgagcgccgcc

SEQ ID NO: 3408900 - RNA, 17 nt, Pseudomonas aeruginosa PA01
ugaccgcgcgccauggc

SEQ ID NO: 3408901 - RNA, 18 nt, Pseudomonas aeruginosa PA01
ugaccgcgcgccauggcc

SEQ ID NO: 3408902 - RNA, 16 nt, Pseudomonas aeruginosa PA01
ugaccgcgugggccgg

SEQ ID NO: 3408903 - RNA, 17 nt, Pseudomonas aeruginosa PA01
ugaccgcgugggccggc

SEQ ID NO: 3408904 - RNA, 18 nt, Pseudomonas aeruginosa PA01
ugaccgcugaugaucgcg

SEQ ID NO: 3408905 - RNA, 19 nt, Pseudomonas aeruginosa PA01
ugaccggcaucgaccagca

SEQ ID NO: 3408906 - RNA, 16 nt, Pseudomonas aeruginosa PA01
ugaccgucagccaggc

SEQ ID NO: 3408907 - RNA, 18 nt, Pseudomonas aeruginosa PA01
ugaccguccacggcgcgu

SEQ ID NO: 3408908 - RNA, 22 nt, Pseudomonas aeruginosa PA01
ugaccgugaugcccagcggcgc

SEQ ID NO: 3408909 - RNA, 20 nt, Pseudomonas aeruginosa PA01
ugaccguuucgccgccggcc

SEQ ID NO: 3408910 - RNA, 21 nt, Pseudomonas aeruginosa PA01
ugaccguuucgccgccggcca

SEQ ID NO: 3408911 - RNA, 15 nt, Pseudomonas aeruginosa PA01
ugaccucccgcgcca

SEQ ID NO: 3408912 - RNA, 17 nt, Pseudomonas aeruginosa PA01
ugaccucccgcgccagc

SEQ ID NO: 3408913 - RNA, 20 nt, Pseudomonas aeruginosa PA01
ugaccucccgcgccagcucg

SEQ ID NO: 3408914 - RNA, 13 nt, Pseudomonas aeruginosa PA01
ugaccucgacgcc

SEQ ID NO: 3408915 - RNA, 22 nt, Pseudomonas aeruginosa PA01
ugaccucgacgccgagccagcc

SEQ ID NO: 3408916 - RNA, 23 nt, Pseudomonas aeruginosa PA01
ugaccucgacgccgagccagccg

SEQ ID NO: 3408917 - RNA, 23 nt, Pseudomonas aeruginosa PA01
ugaccucgagcuggacgcgcuug

SEQ ID NO: 3408918 - RNA, 15 nt, Pseudomonas aeruginosa PA01
ugaccugcagcgccu

SEQ ID NO: 3408919 - RNA, 14 nt, Pseudomonas aeruginosa PA01
ugaccugcgaggcg

SEQ ID NO: 3408920 - RNA, 13 nt, Pseudomonas aeruginosa PA01
ugaccugcugggc

SEQ ID NO: 3408921 - RNA, 15 nt, Pseudomonas aeruginosa PA01
ugaccugcugggcca

SEQ ID NO: 3408922 - RNA, 20 nt, Pseudomonas aeruginosa PA01
ugaccugcugggccagcgcc

SEQ ID NO: 3408923 - RNA, 14 nt, Pseudomonas aeruginosa PA01
ugaccuggccgccg

SEQ ID NO: 3408924 - RNA, 19 nt, Pseudomonas aeruginosa PA01
ugaccuggucguugcgcgc

SEQ ID NO: 3408925 - RNA, 22 nt, Pseudomonas aeruginosa PA01
ugaccuguccagucaccagguc

SEQ ID NO: 3408926 - RNA, 22 nt, Pseudomonas aeruginosa PA01
ugaccuucagcaccugcgccga

SEQ ID NO: 3408927 - RNA, 22 nt, Pseudomonas aeruginosa PA01
ugaccuucugcaccgugcgcgc

SEQ ID NO: 3408928 - RNA, 14 nt, Pseudomonas aeruginosa PA01
ugaccuugccgccg

SEQ ID NO: 3408929 - RNA, 20 nt, Pseudomonas aeruginosa PA01
ugaccuuguccuggccggcg

SEQ ID NO: 3408930 - RNA, 16 nt, Pseudomonas aeruginosa PA01
ugaccuugucggccga

SEQ ID NO: 3408931 - RNA, 17 nt, Pseudomonas aeruginosa PA01
ugaccuugucggccgac

SEQ ID NO: 3408932 - RNA, 18 nt, Pseudomonas aeruginosa PA01
ugacgaaaaagccggaag

SEQ ID NO: 3408933 - RNA, 22 nt, Pseudomonas aeruginosa PA01
ugacgaaauacucgucgacggc

SEQ ID NO: 3408934 - RNA, 23 nt, Pseudomonas aeruginosa PA01
ugacgaacaguucgaugggccgg

SEQ ID NO: 3408935 - RNA, 14 nt, Pseudomonas aeruginosa PA01
ugacgaacaucgcc

SEQ ID NO: 3408936 - RNA, 16 nt, Pseudomonas aeruginosa PA01
ugacgaacaucgccag

SEQ ID NO: 3408937 - RNA, 18 nt, Pseudomonas aeruginosa PA01
ugacgaacaucgccagcg

SEQ ID NO: 3408938 - RNA, 19 nt, Pseudomonas aeruginosa PA01
ugacgaacaucgccagcgc

SEQ ID NO: 3408939 - RNA, 20 nt, Pseudomonas aeruginosa PA01
ugacgaacaucgccagcgcc

SEQ ID NO: 3408940 - RNA, 22 nt, Pseudomonas aeruginosa PA01
ugacgaacaucgccagcgccac

SEQ ID NO: 3408941 - RNA, 23 nt, Pseudomonas aeruginosa PA01
ugacgaacaucgccagcgccacg

SEQ ID NO: 3408942 - RNA, 16 nt, Pseudomonas aeruginosa PA01
ugacgaacugcacgcc

SEQ ID NO: 3408943 - RNA, 16 nt, Pseudomonas aeruginosa PA01
ugacgaagcgcaccgg

SEQ ID NO: 3408944 - RNA, 18 nt, Pseudomonas aeruginosa PA01
ugacgaaggcggcagcgg

SEQ ID NO: 3408945 - RNA, 12 nt, Pseudomonas aeruginosa PA01
ugacgaaggcug

SEQ ID NO: 3408946 - RNA, 22 nt, Pseudomonas aeruginosa PA01
ugacgaagugauggaagagcgc

SEQ ID NO: 3408947 - RNA, 19 nt, Pseudomonas aeruginosa PA01
ugacgaauuccgauuucag

SEQ ID NO: 3408948 - RNA, 23 nt, Pseudomonas aeruginosa PA01
ugacgacugcacgcagacgucga

SEQ ID NO: 3408949 - RNA, 16 nt, Pseudomonas aeruginosa PA01
ugacgaggggcugcgg

SEQ ID NO: 3408950 - RNA, 16 nt, Pseudomonas aeruginosa PA01
ugacgauacgcucggc

SEQ ID NO: 3408951 - RNA, 16 nt, Pseudomonas aeruginosa PA01
ugacgauaucggcgcc

SEQ ID NO: 3408952 - RNA, 13 nt, Pseudomonas aeruginosa PA01
ugacgaucgcccc

SEQ ID NO: 3408953 - RNA, 15 nt, Pseudomonas aeruginosa PA01
ugacgaucgccccgc

SEQ ID NO: 3408954 - RNA, 16 nt, Pseudomonas aeruginosa PA01
ugacgaucuucugcac

SEQ ID NO: 3408955 - RNA, 22 nt, Pseudomonas aeruginosa PA01
ugacgaugaagccccagccucc

SEQ ID NO: 3408956 - RNA, 16 nt, Pseudomonas aeruginosa PA01
ugacgaugaagcgguu

SEQ ID NO: 3408957 - RNA, 15 nt, Pseudomonas aeruginosa PA01
ugacgaugcggcccg

SEQ ID NO: 3408958 - RNA, 20 nt, Pseudomonas aeruginosa PA01
ugacgaugcggcccgccggc

SEQ ID NO: 3408959 - RNA, 21 nt, Pseudomonas aeruginosa PA01
ugacgaugcggcccgccggcg

SEQ ID NO: 3408960 - RNA, 15 nt, Pseudomonas aeruginosa PA01
ugacgauggcccaga

SEQ ID NO: 3408961 - RNA, 15 nt, Pseudomonas aeruginosa PA01
ugacgauggccgccg

SEQ ID NO: 3408962 - RNA, 16 nt, Pseudomonas aeruginosa PA01
ugaggguguugcgaug

SEQ ID NO: 3408963 - RNA, 18 nt, Pseudomonas aeruginosa PA01
ugaggguguugcgaugga

SEQ ID NO: 3408964 - RNA, 22 nt, Pseudomonas aeruginosa PA01
ugaggguguugcgauggaaguu

SEQ ID NO: 3408965 - RNA, 22 nt, Pseudomonas aeruginosa PA01
ugagguagagcacgccgucgcg

SEQ ID NO: 3408966 - RNA, 17 nt, Pseudomonas aeruginosa PA01
ugagguaggccagcccc

SEQ ID NO: 3408967 - RNA, 21 nt, Pseudomonas aeruginosa PA01
ugaggucgcagcguuccagcg

SEQ ID NO: 3408968 - RNA, 20 nt, Pseudomonas aeruginosa PA01
ugaggucgcgggcgauggcc

SEQ ID NO: 3408969 - RNA, 13 nt, Pseudomonas aeruginosa PA01
ugaggucggccuc

SEQ ID NO: 3408970 - RNA, 16 nt, Pseudomonas aeruginosa PA01
ugaggucguuggccag

SEQ ID NO: 3408971 - RNA, 12 nt, Pseudomonas aeruginosa PA01
ugagguucaggc

SEQ ID NO: 3408972 - RNA, 17 nt, Pseudomonas aeruginosa PA01
ugagguucaggccgggc

SEQ ID NO: 3408973 - RNA, 15 nt, Pseudomonas aeruginosa PA01
ugagguucaugccgc

SEQ ID NO: 3408974 - RNA, 13 nt, Pseudomonas aeruginosa PA01
ugagguugccgcc

SEQ ID NO: 3408975 - RNA, 14 nt, Pseudomonas aeruginosa PA01
ugagguugccgccg

SEQ ID NO: 3408976 - RNA, 15 nt, Pseudomonas aeruginosa PA01
ugagguuggccacgu

SEQ ID NO: 3408977 - RNA, 17 nt, Pseudomonas aeruginosa PA01
ugagguuguacagguug

SEQ ID NO: 3408978 - RNA, 15 nt, Pseudomonas aeruginosa PA01
ugaguagaaaagaaa

SEQ ID NO: 3408979 - RNA, 15 nt, Pseudomonas aeruginosa PA01
ugaguagcuggcgca

SEQ ID NO: 3408980 - RNA, 19 nt, Pseudomonas aeruginosa PA01
ugaguagcuggcgcagggc

SEQ ID NO: 3408981 - RNA, 18 nt, Pseudomonas aeruginosa PA01
ugagucgcaggcucaguu

SEQ ID NO: 3408982 - RNA, 20 nt, Pseudomonas aeruginosa PA01
ugaguucgaagcgccaggcg

SEQ ID NO: 3408983 - RNA, 22 nt, Pseudomonas aeruginosa PA01
ugaguucgaagcgccaggcgug

SEQ ID NO: 3408984 - RNA, 14 nt, Pseudomonas aeruginosa PA01
ugaguuugcccagc

SEQ ID NO: 3408985 - RNA, 14 nt, Pseudomonas aeruginosa PA01
ugauaacuuuagua

SEQ ID NO: 3408986 - RNA, 22 nt, Pseudomonas aeruginosa PA01
ugauaagcucggcuugacuggc

SEQ ID NO: 3408987 - RNA, 15 nt, Pseudomonas aeruginosa PA01
ugauaccgcuggcca

SEQ ID NO: 3408988 - RNA, 16 nt, Pseudomonas aeruginosa PA01
ugauaccgcuggccag

SEQ ID NO: 3408989 - RNA, 18 nt, Pseudomonas aeruginosa PA01
ugauaccgcuggccaggu

SEQ ID NO: 3408990 - RNA, 21 nt, Pseudomonas aeruginosa PA01
ugauagcgcggccuucagcgg

SEQ ID NO: 3408991 - RNA, 22 nt, Pseudomonas aeruginosa PA01
ugauagucgacggaacaggagc

SEQ ID NO: 3408992 - RNA, 18 nt, Pseudomonas aeruginosa PA01
ugauaucgauacggaaca

SEQ ID NO: 3408993 - RNA, 20 nt, Pseudomonas aeruginosa PA01
ugauaucguuguucagcagg

SEQ ID NO: 3408994 - RNA, 20 nt, Pseudomonas aeruginosa PA01
ugaucaccaccacgccgucg

SEQ ID NO: 3408995 - RNA, 19 nt, Pseudomonas aeruginosa PA01
ugaucaccaccggcuggcg

SEQ ID NO: 3408996 - RNA, 18 nt, Pseudomonas aeruginosa PA01
ugaucaccagccacugcu

SEQ ID NO: 3408997 - RNA, 14 nt, Pseudomonas aeruginosa PA01
ugaucacccagagc

SEQ ID NO: 3408998 - RNA, 17 nt, Pseudomonas aeruginosa PA01
ugaucaccgcggugcgg

SEQ ID NO: 3408999 - RNA, 14 nt, Pseudomonas aeruginosa PA01
ugaucaccuugcca

SEQ ID NO: 3409000 - RNA, 20 nt, Pseudomonas aeruginosa PA01
ugaucaccuuguacggcagc

SEQ ID NO: 3409001 - RNA, 23 nt, Pseudomonas aeruginosa PA01
ugaucacgaacagcuugccguug

SEQ ID NO: 3409002 - RNA, 22 nt, Pseudomonas aeruginosa PA01
ugaucacguagaugccggugcu

SEQ ID NO: 3409003 - RNA, 19 nt, Pseudomonas aeruginosa PA01
ugaucagcccuucgcgcuc

SEQ ID NO: 3409004 - RNA, 22 nt, Pseudomonas aeruginosa PA01
ugaucagcccuucgcgcucgac

SEQ ID NO: 3409005 - RNA, 19 nt, Pseudomonas aeruginosa PA01
ugaucagcuucuucagcag

SEQ ID NO: 3409006 - RNA, 20 nt, Pseudomonas aeruginosa PA01
ugaucagcuucuucagcagc

SEQ ID NO: 3409007 - RNA, 22 nt, Pseudomonas aeruginosa PA01
ugaucaggaggaucgccaggac

SEQ ID NO: 3409008 - RNA, 14 nt, Pseudomonas aeruginosa PA01
ugaucaggccgagc

SEQ ID NO: 3409009 - RNA, 18 nt, Pseudomonas aeruginosa PA01
ugaucaggccgagcaccg

SEQ ID NO: 3409010 - RNA, 16 nt, Pseudomonas aeruginosa PA01
ugaucaggucggccgc

SEQ ID NO: 3409011 - RNA, 19 nt, Pseudomonas aeruginosa PA01
ugaucagguucggcagcgc

SEQ ID NO: 3409012 - RNA, 17 nt, Pseudomonas aeruginosa PA01
ugaucagguugccggcg

SEQ ID NO: 3409013 - RNA, 20 nt, Pseudomonas aeruginosa PA01
ugaucagguugccggcgugc

SEQ ID NO: 3409014 - RNA, 14 nt, Pseudomonas aeruginosa PA01
ugaucaucagcagg

SEQ ID NO: 3409015 - RNA, 19 nt, Pseudomonas aeruginosa PA01
ugaucaucggcuggccgag

SEQ ID NO: 3409016 - RNA, 21 nt, Pseudomonas aeruginosa PA01
ugaucaucguccugccggugc

SEQ ID NO: 3409017 - RNA, 21 nt, Pseudomonas aeruginosa PA01
ugauccaggucgaucagcagc

SEQ ID NO: 3409018 - RNA, 18 nt, Pseudomonas aeruginosa PA01
ugaucccggaggcggcga

SEQ ID NO: 3409019 - RNA, 21 nt, Pseudomonas aeruginosa PA01
ugauccgcacccgcgacucga

SEQ ID NO: 3409020 - RNA, 17 nt, Pseudomonas aeruginosa PA01
ugauccgcguggcgugc

SEQ ID NO: 3409021 - RNA, 22 nt, Pseudomonas aeruginosa PA01
ugauccgcguggcgugcucggc

SEQ ID NO: 3409022 - RNA, 23 nt, Pseudomonas aeruginosa PA01
ugauccgcguggcgugcucggcg

SEQ ID NO: 3409023 - RNA, 15 nt, Pseudomonas aeruginosa PA01
ugauccgcuccagcg

SEQ ID NO: 3409024 - RNA, 19 nt, Pseudomonas aeruginosa PA01
ugauccgcucgaucccggc

SEQ ID NO: 3409025 - RNA, 23 nt, Pseudomonas aeruginosa PA01
ugauccgcucgaucccggcgcgg

SEQ ID NO: 3409026 - RNA, 22 nt, Pseudomonas aeruginosa PA01
ugauccgguugauuuccgcacc

SEQ ID NO: 3409027 - RNA, 18 nt, Pseudomonas aeruginosa PA01
ugauccugggcgccagcc

SEQ ID NO: 3409028 - RNA, 16 nt, Pseudomonas aeruginosa PA01
ugaucgaagcccaucg

SEQ ID NO: 3409029 - RNA, 19 nt, Pseudomonas aeruginosa PA01
ugaucgaccacacaugcag

SEQ ID NO: 3409030 - RNA, 16 nt, Pseudomonas aeruginosa PA01
ugaucgaccucgcggg

SEQ ID NO: 3409031 - RNA, 21 nt, Pseudomonas aeruginosa PA01
ugaucgacgccagcucggccg

SEQ ID NO: 3409032 - RNA, 21 nt, Pseudomonas aeruginosa PA01
ugaucgacucgauggcgcggu

SEQ ID NO: 3409033 - RNA, 20 nt, Pseudomonas aeruginosa PA01
ugaucgagcccuugcgcggc

SEQ ID NO: 3409034 - RNA, 23 nt, Pseudomonas aeruginosa PA01
ugaucgagcccuugcgcggcgca

SEQ ID NO: 3409035 - RNA, 22 nt, Pseudomonas aeruginosa PA01
ugaucgagggaggucgcacgca

SEQ ID NO: 3409036 - RNA, 17 nt, Pseudomonas aeruginosa PA01
ugaucgagucgccggcg

SEQ ID NO: 3409037 - RNA, 20 nt, Pseudomonas aeruginosa PA01
ugaucgccagcccguagucg

SEQ ID NO: 3409038 - RNA, 13 nt, Pseudomonas aeruginosa PA01
ugaucgccgcgcc

SEQ ID NO: 3409039 - RNA, 14 nt, Pseudomonas aeruginosa PA01
ugaucgccgcgccg

SEQ ID NO: 3409040 - RNA, 18 nt, Pseudomonas aeruginosa PA01
ugaucgccgcgccgccga

SEQ ID NO: 3409041 - RNA, 13 nt, Pseudomonas aeruginosa PA01
ugaucggcagccg

SEQ ID NO: 3409042 - RNA, 19 nt, Pseudomonas aeruginosa PA01
ugaucggccgccagugcau

SEQ ID NO: 3409043 - RNA, 12 nt, Pseudomonas aeruginosa PA01
ugaucggcgcgc

SEQ ID NO: 3409044 - RNA, 16 nt, Pseudomonas aeruginosa PA01
ugaucggcuccagcuu

SEQ ID NO: 3409045 - RNA, 23 nt, Pseudomonas aeruginosa PA01
ugaucggcuccagcuugucgucg

SEQ ID NO: 3409046 - RNA, 21 nt, Pseudomonas aeruginosa PA01
ugaucgggugggacauggaga

SEQ ID NO: 3409047 - RNA, 15 nt, Pseudomonas aeruginosa PA01
ugaucgguucccgcc

SEQ ID NO: 3409048 - RNA, 22 nt, Pseudomonas aeruginosa PA01
ugaucgguucccgcccgcucau

SEQ ID NO: 3409049 - RNA, 23 nt, Pseudomonas aeruginosa PA01
ugaucuccgcgccgggcuggccg

SEQ ID NO: 3409050 - RNA, 23 nt, Pseudomonas aeruginosa PA01
ugaucucgaacucgaaggccagc

SEQ ID NO: 3409051 - RNA, 14 nt, Pseudomonas aeruginosa PA01
ugaucucgcggcgc

SEQ ID NO: 3409052 - RNA, 16 nt, Pseudomonas aeruginosa PA01
ugaucucgcggcgcgg

SEQ ID NO: 3409053 - RNA, 14 nt, Pseudomonas aeruginosa PA01
ugaucugcauggcg

SEQ ID NO: 3409054 - RNA, 13 nt, Pseudomonas aeruginosa PA01
ugaucuggccacc

SEQ ID NO: 3409055 - RNA, 14 nt, Pseudomonas aeruginosa PA01
ugaucuuguccggg

SEQ ID NO: 3409056 - RNA, 14 nt, Pseudomonas aeruginosa PA01
ugaugaagucggcg

SEQ ID NO: 3409057 - RNA, 20 nt, Pseudomonas aeruginosa PA01
ugaugaccguccacggcgcg

SEQ ID NO: 3409058 - RNA, 13 nt, Pseudomonas aeruginosa PA01
ugaugaugccgcg

SEQ ID NO: 3409059 - RNA, 14 nt, Pseudomonas aeruginosa PA01
ugaugaugccgcgg

SEQ ID NO: 3409060 - RNA, 15 nt, Pseudomonas aeruginosa PA01
ugaugcaauggaugu

SEQ ID NO: 3409061 - RNA, 23 nt, Pseudomonas aeruginosa PA01
ugaugcaauggauguugccgccg

SEQ ID NO: 3409062 - RNA, 16 nt, Pseudomonas aeruginosa PA01
ugaugcccagcggcgc

SEQ ID NO: 3409063 - RNA, 23 nt, Pseudomonas aeruginosa PA01
ugaugcccgggucgucggucggc

SEQ ID NO: 3409064 - RNA, 15 nt, Pseudomonas aeruginosa PA01
ugcacgcaggccgcu

SEQ ID NO: 3409065 - RNA, 16 nt, Pseudomonas aeruginosa PA01
ugcacgcaggccgcug

SEQ ID NO: 3409066 - RNA, 16 nt, Pseudomonas aeruginosa PA01
ugcacgcccaggcgcu

SEQ ID NO: 3409067 - RNA, 18 nt, Pseudomonas aeruginosa PA01
ugcacgcccaggcgcucg

SEQ ID NO: 3409068 - RNA, 21 nt, Pseudomonas aeruginosa PA01
ugcacgcccaucgccaccagc

SEQ ID NO: 3409069 - RNA, 19 nt, Pseudomonas aeruginosa PA01
ugcacgccgugcaucaccg

SEQ ID NO: 3409070 - RNA, 21 nt, Pseudomonas aeruginosa PA01
ugcacgccgugcaucaccggc

SEQ ID NO: 3409071 - RNA, 13 nt, Pseudomonas aeruginosa PA01
ugcacgcgccggg

SEQ ID NO: 3409072 - RNA, 14 nt, Pseudomonas aeruginosa PA01
ugcacgcgccgggu

SEQ ID NO: 3409073 - RNA, 15 nt, Pseudomonas aeruginosa PA01
ugcacgcgccggguc

SEQ ID NO: 3409074 - RNA, 22 nt, Pseudomonas aeruginosa PA01
ugcacgcugaagaucgccacga

SEQ ID NO: 3409075 - RNA, 14 nt, Pseudomonas aeruginosa PA01
ugcacgcugcgccg

SEQ ID NO: 3409076 - RNA, 16 nt, Pseudomonas aeruginosa PA01
ugcacgcugcgccggc

SEQ ID NO: 3409077 - RNA, 17 nt, Pseudomonas aeruginosa PA01
ugcacgcugcgccggcg

SEQ ID NO: 3409078 - RNA, 19 nt, Pseudomonas aeruginosa PA01
ugcacggagugggccgcgu

SEQ ID NO: 3409079 - RNA, 18 nt, Pseudomonas aeruginosa PA01
ugcacggauaccacccgc

SEQ ID NO: 3409080 - RNA, 22 nt, Pseudomonas aeruginosa PA01
ugcacggauaccacccgcagcc

SEQ ID NO: 3409081 - RNA, 18 nt, Pseudomonas aeruginosa PA01
ugcacggcaacgucgcgg

SEQ ID NO: 3409082 - RNA, 13 nt, Pseudomonas aeruginosa PA01
ugcacggccaggc

SEQ ID NO: 3409083 - RNA, 22 nt, Pseudomonas aeruginosa PA01
ugcacggccaggccacggccgg

SEQ ID NO: 3409084 - RNA, 23 nt, Pseudomonas aeruginosa PA01
ugcacggccaggccacggccggc

SEQ ID NO: 3409085 - RNA, 12 nt, Pseudomonas aeruginosa PA01
ugcacggccggu

SEQ ID NO: 3409086 - RNA, 13 nt, Pseudomonas aeruginosa PA01
ugcacggccggua

SEQ ID NO: 3409087 - RNA, 13 nt, Pseudomonas aeruginosa PA01
ugcacggcgaccc

SEQ ID NO: 3409088 - RNA, 17 nt, Pseudomonas aeruginosa PA01
ugcacggcgacccgccg

SEQ ID NO: 3409089 - RNA, 15 nt, Pseudomonas aeruginosa PA01
ugcacggucugcucg

SEQ ID NO: 3409090 - RNA, 20 nt, Pseudomonas aeruginosa PA01
ugcacgucguagcccuucuc

SEQ ID NO: 3409091 - RNA, 15 nt, Pseudomonas aeruginosa PA01
ugcacgugcagcucg

SEQ ID NO: 3409092 - RNA, 18 nt, Pseudomonas aeruginosa PA01
ugcacguggaguucaccg

SEQ ID NO: 3409093 - RNA, 16 nt, Pseudomonas aeruginosa PA01
ugcacguuccagcucg

SEQ ID NO: 3409094 - RNA, 17 nt, Pseudomonas aeruginosa PA01
ugcacguuccagcucgg

SEQ ID NO: 3409095 - RNA, 17 nt, Pseudomonas aeruginosa PA01
ugcacuucgaccaguac

SEQ ID NO: 3409096 - RNA, 15 nt, Pseudomonas aeruginosa PA01
ugcacuugcggcagu

SEQ ID NO: 3409097 - RNA, 21 nt, Pseudomonas aeruginosa PA01
ugcagaagacgcccagcaggg

SEQ ID NO: 3409098 - RNA, 23 nt, Pseudomonas aeruginosa PA01
ugcagaagacgcccagcagggcc

SEQ ID NO: 3409099 - RNA, 18 nt, Pseudomonas aeruginosa PA01
ugcagacgcugccgagga

SEQ ID NO: 3409100 - RNA, 19 nt, Pseudomonas aeruginosa PA01
ugcagacgguucagcagcg

SEQ ID NO: 3409101 - RNA, 19 nt, Pseudomonas aeruginosa PA01
ugcagagaaaaggccgcuu

SEQ ID NO: 3409102 - RNA, 15 nt, Pseudomonas aeruginosa PA01
ugcagagaggcuggc

SEQ ID NO: 3409103 - RNA, 13 nt, Pseudomonas aeruginosa PA01
ugcagagcggcca

SEQ ID NO: 3409104 - RNA, 15 nt, Pseudomonas aeruginosa PA01
ugcagagcggccagg

SEQ ID NO: 3409105 - RNA, 16 nt, Pseudomonas aeruginosa PA01
ugcagagcggccaggu

SEQ ID NO: 3409106 - RNA, 18 nt, Pseudomonas aeruginosa PA01
ugcagagcggccaggucg

SEQ ID NO: 3409107 - RNA, 14 nt, Pseudomonas aeruginosa PA01
ugcagaugaccagc

SEQ ID NO: 3409108 - RNA, 14 nt, Pseudomonas aeruginosa PA01
ugcagcaacccggc

SEQ ID NO: 3409109 - RNA, 17 nt, Pseudomonas aeruginosa PA01
ugcagcaacucgccgcc

SEQ ID NO: 3409110 - RNA, 18 nt, Pseudomonas aeruginosa PA01
ugcagcaacucgccgccg

SEQ ID NO: 3409111 - RNA, 16 nt, Pseudomonas aeruginosa PA01
ugcagcaagccgcagc

SEQ ID NO: 3409112 - RNA, 21 nt, Pseudomonas aeruginosa PA01
ugcagcacauagagggucagc

SEQ ID NO: 3409113 - RNA, 14 nt, Pseudomonas aeruginosa PA01
ugcagcaccaccuc

SEQ ID NO: 3409114 - RNA, 21 nt, Pseudomonas aeruginosa PA01
ugcagcacccccagcaggcca

SEQ ID NO: 3409115 - RNA, 15 nt, Pseudomonas aeruginosa PA01
ugcagcaccgccugg

SEQ ID NO: 3409116 - RNA, 12 nt, Pseudomonas aeruginosa PA01
ugcagcagcacg

SEQ ID NO: 3409117 - RNA, 15 nt, Pseudomonas aeruginosa PA01
ugcagcagcgaccug

SEQ ID NO: 3409118 - RNA, 13 nt, Pseudomonas aeruginosa PA01
ugcagcagcgccu

SEQ ID NO: 3409119 - RNA, 20 nt, Pseudomonas aeruginosa PA01
ugcagcagguagugcucggc

SEQ ID NO: 3409120 - RNA, 19 nt, Pseudomonas aeruginosa PA01
ugcagcaggucgagcaguu

SEQ ID NO: 3409121 - RNA, 22 nt, Pseudomonas aeruginosa PA01
ugcagcaggucgagcaguuccg

SEQ ID NO: 3409122 - RNA, 18 nt, Pseudomonas aeruginosa PA01
ugcagcagguuccuccug

SEQ ID NO: 3409123 - RNA, 21 nt, Pseudomonas aeruginosa PA01
ugcagcagguuccuccugggc

SEQ ID NO: 3409124 - RNA, 19 nt, Pseudomonas aeruginosa PA01
ugcagcaguuccaggcgug

SEQ ID NO: 3409125 - RNA, 16 nt, Pseudomonas aeruginosa PA01
ugcagccagccgucgu

SEQ ID NO: 3409126 - RNA, 16 nt, Pseudomonas aeruginosa PA01
ugcagccagcuucagc

SEQ ID NO: 3409127 - RNA, 20 nt, Pseudomonas aeruginosa PA01
ugcagcccggucacgccggg

SEQ ID NO: 3409128 - RNA, 19 nt, Pseudomonas aeruginosa PA01
ugcagcccuggcguggccg

SEQ ID NO: 3409129 - RNA, 20 nt, Pseudomonas aeruginosa PA01
ugcagcccuggcguggccgg

SEQ ID NO: 3409130 - RNA, 22 nt, Pseudomonas aeruginosa PA01
ugcagcccuggcguggccggcg

SEQ ID NO: 3409131 - RNA, 16 nt, Pseudomonas aeruginosa PA01
ugcagccgauggcgaa

SEQ ID NO: 3409132 - RNA, 12 nt, Pseudomonas aeruginosa PA01
ugcagccggggc

SEQ ID NO: 3409133 - RNA, 19 nt, Pseudomonas aeruginosa PA01
ugcagcgacuccagccagg

SEQ ID NO: 3409134 - RNA, 19 nt, Pseudomonas aeruginosa PA01
ugcagcgaggggaagaucu

SEQ ID NO: 3409135 - RNA, 19 nt, Pseudomonas aeruginosa PA01
ugcagcgccccagcaccuc

SEQ ID NO: 3409136 - RNA, 19 nt, Pseudomonas aeruginosa PA01
ugcagcgccucguggaaca

SEQ ID NO: 3409137 - RNA, 20 nt, Pseudomonas aeruginosa PA01
ugcagcgccucguggaacag

SEQ ID NO: 3409138 - RNA, 18 nt, Pseudomonas aeruginosa PA01
ugcagcgccuguuccagg

SEQ ID NO: 3409139 - RNA, 19 nt, Pseudomonas aeruginosa PA01
ugcagcgccuguuccaggg

SEQ ID NO: 3409140 - RNA, 23 nt, Pseudomonas aeruginosa PA01
ugcagcgccuguuccagggccug

SEQ ID NO: 3409141 - RNA, 19 nt, Pseudomonas aeruginosa PA01
ugcagcgcuuguagcagcc

SEQ ID NO: 3409142 - RNA, 21 nt, Pseudomonas aeruginosa PA01
ugcagcgcuuguagcagccgc

SEQ ID NO: 3409143 - RNA, 23 nt, Pseudomonas aeruginosa PA01
ugcagcgcuuguagcagccgcag

SEQ ID NO: 3409144 - RNA, 17 nt, Pseudomonas aeruginosa PA01
ugcagcggaagcccugc

SEQ ID NO: 3409145 - RNA, 19 nt, Pseudomonas aeruginosa PA01
ugcagcggaagcccugcug

SEQ ID NO: 3409146 - RNA, 15 nt, Pseudomonas aeruginosa PA01
ugcagcgucgacgcc

SEQ ID NO: 3409147 - RNA, 18 nt, Pseudomonas aeruginosa PA01
ugcagcgucgacgccgag

SEQ ID NO: 3409148 - RNA, 13 nt, Pseudomonas aeruginosa PA01
ugcagcgucgcgc

SEQ ID NO: 3409149 - RNA, 16 nt, Pseudomonas aeruginosa PA01
ugcagcucggcacgca

SEQ ID NO: 3409150 - RNA, 19 nt, Pseudomonas aeruginosa PA01
ugcagcucggcacgcagca

SEQ ID NO: 3409151 - RNA, 22 nt, Pseudomonas aeruginosa PA01
ugcagcucggcacgcagcagcu

SEQ ID NO: 3409152 - RNA, 22 nt, Pseudomonas aeruginosa PA01
ugcagcucguuggccaccugca

SEQ ID NO: 3409153 - RNA, 16 nt, Pseudomonas aeruginosa PA01
ugcagcuucuccaggg

SEQ ID NO: 3409154 - RNA, 23 nt, Pseudomonas aeruginosa PA01
ugcagcuuggcgaauagccggcg

SEQ ID NO: 3409155 - RNA, 16 nt, Pseudomonas aeruginosa PA01
ugcagcuugugggcau

SEQ ID NO: 3409156 - RNA, 18 nt, Pseudomonas aeruginosa PA01
ugcagcuugugggcaugc

SEQ ID NO: 3409157 - RNA, 13 nt, Pseudomonas aeruginosa PA01
ugcaggaacaggu

SEQ ID NO: 3409158 - RNA, 17 nt, Pseudomonas aeruginosa PA01
ugcaggaacagguucgg

SEQ ID NO: 3409159 - RNA, 22 nt, Pseudomonas aeruginosa PA01
ugcaggaacagguucggcaggc

SEQ ID NO: 3409160 - RNA, 24 nt, Pseudomonas aeruginosa PA01
ugcaggaagcgccgggccgcaucg

SEQ ID NO: 3409161 - RNA, 13 nt, Pseudomonas aeruginosa PA01
ugcaggacccgcg

SEQ ID NO: 3409162 - RNA, 15 nt, Pseudomonas aeruginosa PA01
ugcaggacccgcgac

SEQ ID NO: 3409163 - RNA, 19 nt, Pseudomonas aeruginosa PA01
ugcaggcacggaagcgcug

SEQ ID NO: 3409164 - RNA, 20 nt, Pseudomonas aeruginosa PA01
ugcaggcacggaagcgcugc

SEQ ID NO: 3409165 - RNA, 14 nt, Pseudomonas aeruginosa PA01
ugcaggccaccgga

SEQ ID NO: 3409166 - RNA, 13 nt, Pseudomonas aeruginosa PA01
ugccaccgcucga

SEQ ID NO: 3409167 - RNA, 13 nt, Pseudomonas aeruginosa PA01
ugccacgcaccac

SEQ ID NO: 3409168 - RNA, 17 nt, Pseudomonas aeruginosa PA01
ugccacgcaccaccagg

SEQ ID NO: 3409169 - RNA, 18 nt, Pseudomonas aeruginosa PA01
ugccacgcaccaccaggu

SEQ ID NO: 3409170 - RNA, 13 nt, Pseudomonas aeruginosa PA01
ugccacugacgcg

SEQ ID NO: 3409171 - RNA, 21 nt, Pseudomonas aeruginosa PA01
ugccacugacgcgcagcgccg

SEQ ID NO: 3409172 - RNA, 13 nt, Pseudomonas aeruginosa PA01
ugccacugcgcgc

SEQ ID NO: 3409173 - RNA, 15 nt, Pseudomonas aeruginosa PA01
ugccacugcgcgcca

SEQ ID NO: 3409174 - RNA, 19 nt, Pseudomonas aeruginosa PA01
ugccacugcgcgccagucc

SEQ ID NO: 3409175 - RNA, 21 nt, Pseudomonas aeruginosa PA01
ugccacuugcgggugcgcagg

SEQ ID NO: 3409176 - RNA, 22 nt, Pseudomonas aeruginosa PA01
ugccagaccgagauuggccgcc

SEQ ID NO: 3409177 - RNA, 15 nt, Pseudomonas aeruginosa PA01
ugccagaccguggcg

SEQ ID NO: 3409178 - RNA, 22 nt, Pseudomonas aeruginosa PA01
ugccagacgaucagcggcccga

SEQ ID NO: 3409179 - RNA, 14 nt, Pseudomonas aeruginosa PA01
ugccagacgcucgg

SEQ ID NO: 3409180 - RNA, 14 nt, Pseudomonas aeruginosa PA01
ugccagagcgcugc

SEQ ID NO: 3409181 - RNA, 16 nt, Pseudomonas aeruginosa PA01
ugccagaggaucggcc

SEQ ID NO: 3409182 - RNA, 18 nt, Pseudomonas aeruginosa PA01
ugccagaggaucggccaa

SEQ ID NO: 3409183 - RNA, 16 nt, Pseudomonas aeruginosa PA01
ugccagcaggccgagc

SEQ ID NO: 3409184 - RNA, 19 nt, Pseudomonas aeruginosa PA01
ugccagcaguaucgacgau

SEQ ID NO: 3409185 - RNA, 20 nt, Pseudomonas aeruginosa PA01
ugccagccgcuuccggcgcu

SEQ ID NO: 3409186 - RNA, 13 nt, Pseudomonas aeruginosa PA01
ugccagccggccu

SEQ ID NO: 3409187 - RNA, 16 nt, Pseudomonas aeruginosa PA01
ugccagccggccuugc

SEQ ID NO: 3409188 - RNA, 20 nt, Pseudomonas aeruginosa PA01
ugccagcgccacgccgcugu

SEQ ID NO: 3409189 - RNA, 22 nt, Pseudomonas aeruginosa PA01
ugccagcgggcgccgccgccga

SEQ ID NO: 3409190 - RNA, 13 nt, Pseudomonas aeruginosa PA01
ugccagcucuugc

SEQ ID NO: 3409191 - RNA, 14 nt, Pseudomonas aeruginosa PA01
ugccaggaccagcc

SEQ ID NO: 3409192 - RNA, 16 nt, Pseudomonas aeruginosa PA01
ugccaggaccagcccg

SEQ ID NO: 3409193 - RNA, 16 nt, Pseudomonas aeruginosa PA01
ugccaggagcacgccg

SEQ ID NO: 3409194 - RNA, 15 nt, Pseudomonas aeruginosa PA01
ugccaggagcuugcc

SEQ ID NO: 3409195 - RNA, 14 nt, Pseudomonas aeruginosa PA01
ugccaggccggcgc

SEQ ID NO: 3409196 - RNA, 21 nt, Pseudomonas aeruginosa PA01
ugccaggccugggucaccagc

SEQ ID NO: 3409197 - RNA, 15 nt, Pseudomonas aeruginosa PA01
ugccaggcgcucgcg

SEQ ID NO: 3409198 - RNA, 18 nt, Pseudomonas aeruginosa PA01
ugccaggcggcagccgcg

SEQ ID NO: 3409199 - RNA, 21 nt, Pseudomonas aeruginosa PA01
ugccaggcggggauggcgggc

SEQ ID NO: 3409200 - RNA, 10 nt, Pseudomonas aeruginosa PA01
ugccaggcuc

SEQ ID NO: 3409201 - RNA, 17 nt, Pseudomonas aeruginosa PA01
ugccaggcucgccgcca

SEQ ID NO: 3409202 - RNA, 19 nt, Pseudomonas aeruginosa PA01
ugccaggcucgccgccagc

SEQ ID NO: 3409203 - RNA, 18 nt, Pseudomonas aeruginosa PA01
ugccagggcggucggcca

SEQ ID NO: 3409204 - RNA, 18 nt, Pseudomonas aeruginosa PA01
ugccaguauuuggcgucg

SEQ ID NO: 3409205 - RNA, 18 nt, Pseudomonas aeruginosa PA01
ugccagugccucgcgcgu

SEQ ID NO: 3409206 - RNA, 13 nt, Pseudomonas aeruginosa PA01
ugccauacagcgc

SEQ ID NO: 3409207 - RNA, 14 nt, Pseudomonas aeruginosa PA01
ugccauagccgacg

SEQ ID NO: 3409208 - RNA, 14 nt, Pseudomonas aeruginosa PA01
ugccaucaggccgc

SEQ ID NO: 3409209 - RNA, 24 nt, Pseudomonas aeruginosa PA01
ugccaucaucggacgccguagcgg

SEQ ID NO: 3409210 - RNA, 15 nt, Pseudomonas aeruginosa PA01
ugccauccagcgccu

SEQ ID NO: 3409211 - RNA, 16 nt, Pseudomonas aeruginosa PA01
ugccauccagcgccug

SEQ ID NO: 3409212 - RNA, 21 nt, Pseudomonas aeruginosa PA01
ugccauccgcgccgaccagcc

SEQ ID NO: 3409213 - RNA, 15 nt, Pseudomonas aeruginosa PA01
ugccauggaucacca

SEQ ID NO: 3409214 - RNA, 18 nt, Pseudomonas aeruginosa PA01
ugccauggaucaccaggg

SEQ ID NO: 3409215 - RNA, 21 nt, Pseudomonas aeruginosa PA01
ugcccaacuccagcucgaccc

SEQ ID NO: 3409216 - RNA, 14 nt, Pseudomonas aeruginosa PA01
ugcccaagggccug

SEQ ID NO: 3409217 - RNA, 16 nt, Pseudomonas aeruginosa PA01
ugcccaauacccacag

SEQ ID NO: 3409218 - RNA, 14 nt, Pseudomonas aeruginosa PA01
ugcccaccaccagg

SEQ ID NO: 3409219 - RNA, 17 nt, Pseudomonas aeruginosa PA01
ugcccaccaccaggacc

SEQ ID NO: 3409220 - RNA, 17 nt, Pseudomonas aeruginosa PA01
ugcccaccagcgucgcc

SEQ ID NO: 3409221 - RNA, 18 nt, Pseudomonas aeruginosa PA01
ugcccaccagcgucgcca

SEQ ID NO: 3409222 - RNA, 21 nt, Pseudomonas aeruginosa PA01
ugcccaccagcgucgccaggc

SEQ ID NO: 3409223 - RNA, 22 nt, Pseudomonas aeruginosa PA01
ugcccaccccggacugcccgac

SEQ ID NO: 3409224 - RNA, 23 nt, Pseudomonas aeruginosa PA01
ugcccaccgaauccuugaucacc

SEQ ID NO: 3409225 - RNA, 21 nt, Pseudomonas aeruginosa PA01
ugcccaccugaacgcgcccgg

SEQ ID NO: 3409226 - RNA, 22 nt, Pseudomonas aeruginosa PA01
ugcccaccugaacgcgcccggc

SEQ ID NO: 3409227 - RNA, 23 nt, Pseudomonas aeruginosa PA01
ugcccaccugaacgcgcccggcc

SEQ ID NO: 3409228 - RNA, 14 nt, Pseudomonas aeruginosa PA01
ugcccacgcagaag

SEQ ID NO: 3409229 - RNA, 17 nt, Pseudomonas aeruginosa PA01
ugcccacgcagaaggcg

SEQ ID NO: 3409230 - RNA, 14 nt, Pseudomonas aeruginosa PA01
ugcccacggccagg

SEQ ID NO: 3409231 - RNA, 15 nt, Pseudomonas aeruginosa PA01
ugcccacggccaggc

SEQ ID NO: 3409232 - RNA, 17 nt, Pseudomonas aeruginosa PA01
ugcccagcaggcugcug

SEQ ID NO: 3409233 - RNA, 19 nt, Pseudomonas aeruginosa PA01
ugcccagcaggcugcugcu

SEQ ID NO: 3409234 - RNA, 16 nt, Pseudomonas aeruginosa PA01
ugcccagccagggccg

SEQ ID NO: 3409235 - RNA, 18 nt, Pseudomonas aeruginosa PA01
ugcccagccccaccgcca

SEQ ID NO: 3409236 - RNA, 21 nt, Pseudomonas aeruginosa PA01
ugcccagccccaccgccaggu

SEQ ID NO: 3409237 - RNA, 16 nt, Pseudomonas aeruginosa PA01
ugcccagcccgccuuc

SEQ ID NO: 3409238 - RNA, 14 nt, Pseudomonas aeruginosa PA01
ugcccagcgcaggc

SEQ ID NO: 3409239 - RNA, 16 nt, Pseudomonas aeruginosa PA01
ugcccagcgcaggccg

SEQ ID NO: 3409240 - RNA, 12 nt, Pseudomonas aeruginosa PA01
ugcccagcgccg

SEQ ID NO: 3409241 - RNA, 16 nt, Pseudomonas aeruginosa PA01
ugcccagcgccgccag

SEQ ID NO: 3409242 - RNA, 18 nt, Pseudomonas aeruginosa PA01
ugcccagcgccgccagca

SEQ ID NO: 3409243 - RNA, 21 nt, Pseudomonas aeruginosa PA01
ugcccagcgccgccagcaggu

SEQ ID NO: 3409244 - RNA, 19 nt, Pseudomonas aeruginosa PA01
ugcccagcgccgccugcug

SEQ ID NO: 3409245 - RNA, 15 nt, Pseudomonas aeruginosa PA01
ugcccagcggcgcca

SEQ ID NO: 3409246 - RNA, 17 nt, Pseudomonas aeruginosa PA01
ugcccagcggcgccagc

SEQ ID NO: 3409247 - RNA, 18 nt, Pseudomonas aeruginosa PA01
ugcccagcggcgccagcu

SEQ ID NO: 3409248 - RNA, 18 nt, Pseudomonas aeruginosa PA01
ugcccagcggcgccucga

SEQ ID NO: 3409249 - RNA, 15 nt, Pseudomonas aeruginosa PA01
ugcccagcguggcca

SEQ ID NO: 3409250 - RNA, 17 nt, Pseudomonas aeruginosa PA01
ugcccagcguggccagc

SEQ ID NO: 3409251 - RNA, 14 nt, Pseudomonas aeruginosa PA01
ugcccaggccgccg

SEQ ID NO: 3409252 - RNA, 15 nt, Pseudomonas aeruginosa PA01
ugcccaggccgccga

SEQ ID NO: 3409253 - RNA, 18 nt, Pseudomonas aeruginosa PA01
ugcccaggccgccgaucc

SEQ ID NO: 3409254 - RNA, 18 nt, Pseudomonas aeruginosa PA01
ugcccaggcgcuggcgcc

SEQ ID NO: 3409255 - RNA, 10 nt, Pseudomonas aeruginosa PA01
ugcccaggcu

SEQ ID NO: 3409256 - RNA, 12 nt, Pseudomonas aeruginosa PA01
ugcccagggcca

SEQ ID NO: 3409257 - RNA, 17 nt, Pseudomonas aeruginosa PA01
ugcccagggccagcagc

SEQ ID NO: 3409258 - RNA, 20 nt, Pseudomonas aeruginosa PA01
ugcccagggccagcagcggc

SEQ ID NO: 3409259 - RNA, 20 nt, Pseudomonas aeruginosa PA01
ugcccagguagccggcgagc

SEQ ID NO: 3409260 - RNA, 17 nt, Pseudomonas aeruginosa PA01
ugcccaguacccgcugg

SEQ ID NO: 3409261 - RNA, 16 nt, Pseudomonas aeruginosa PA01
ugcccaguugcgcggc

SEQ ID NO: 3409262 - RNA, 17 nt, Pseudomonas aeruginosa PA01
ugcccaguugcgcggcg

SEQ ID NO: 3409263 - RNA, 15 nt, Pseudomonas aeruginosa PA01
ugcccaucgccucca

SEQ ID NO: 3409264 - RNA, 14 nt, Pseudomonas aeruginosa PA01
ugcccaugaucgcc

SEQ ID NO: 3409265 - RNA, 18 nt, Pseudomonas aeruginosa PA01
ugccccacaggcccugca

SEQ ID NO: 3409266 - RNA, 13 nt, Pseudomonas aeruginosa PA01
ugccccagcaucg

SEQ ID NO: 3409267 - RNA, 19 nt, Pseudomonas aeruginosa PA01
ugccccagcaucgccggca

SEQ ID NO: 3409268 - RNA, 20 nt, Pseudomonas aeruginosa PA01
ugccccagcaucgccggcag

SEQ ID NO: 3409269 - RNA, 20 nt, Pseudomonas aeruginosa PA01
ugccgacgagcagcucgccg

SEQ ID NO: 3409270 - RNA, 21 nt, Pseudomonas aeruginosa PA01
ugccgacgagcagcucgccgg

SEQ ID NO: 3409271 - RNA, 14 nt, Pseudomonas aeruginosa PA01
ugccgacgccgcgg

SEQ ID NO: 3409272 - RNA, 15 nt, Pseudomonas aeruginosa PA01
ugccgacgccgcggc

SEQ ID NO: 3409273 - RNA, 21 nt, Pseudomonas aeruginosa PA01
ugccgacgccgcggccggcga

SEQ ID NO: 3409274 - RNA, 17 nt, Pseudomonas aeruginosa PA01
ugccgacgcugaucauc

SEQ ID NO: 3409275 - RNA, 19 nt, Pseudomonas aeruginosa PA01
ugccgacggcggcggcgga

SEQ ID NO: 3409276 - RNA, 14 nt, Pseudomonas aeruginosa PA01
ugccgacgucgaug

SEQ ID NO: 3409277 - RNA, 19 nt, Pseudomonas aeruginosa PA01
ugccgagaaucugcccggc

SEQ ID NO: 3409278 - RNA, 19 nt, Pseudomonas aeruginosa PA01
ugccgagcgaaaucggcag

SEQ ID NO: 3409279 - RNA, 20 nt, Pseudomonas aeruginosa PA01
ugccgagcgaaaucggcagg

SEQ ID NO: 3409280 - RNA, 18 nt, Pseudomonas aeruginosa PA01
ugccgagcugggcguugc

SEQ ID NO: 3409281 - RNA, 13 nt, Pseudomonas aeruginosa PA01
ugccgaggaacgc

SEQ ID NO: 3409282 - RNA, 18 nt, Pseudomonas aeruginosa PA01
ugccgaggaacgccgaca

SEQ ID NO: 3409283 - RNA, 15 nt, Pseudomonas aeruginosa PA01
ugccgaggaacucgc

SEQ ID NO: 3409284 - RNA, 17 nt, Pseudomonas aeruginosa PA01
ugccgaggaagucggcg

SEQ ID NO: 3409285 - RNA, 18 nt, Pseudomonas aeruginosa PA01
ugccgaggaagucggcgg

SEQ ID NO: 3409286 - RNA, 21 nt, Pseudomonas aeruginosa PA01
ugccgaggaagucggcggccg

SEQ ID NO: 3409287 - RNA, 23 nt, Pseudomonas aeruginosa PA01
ugccgaggaagucggcggccgcc

SEQ ID NO: 3409288 - RNA, 14 nt, Pseudomonas aeruginosa PA01
ugccgaggccgagg

SEQ ID NO: 3409289 - RNA, 13 nt, Pseudomonas aeruginosa PA01
ugccgaggccgcc

SEQ ID NO: 3409290 - RNA, 12 nt, Pseudomonas aeruginosa PA01
ugccgaggcggc

SEQ ID NO: 3409291 - RNA, 14 nt, Pseudomonas aeruginosa PA01
ugccgaggcggccg

SEQ ID NO: 3409292 - RNA, 16 nt, Pseudomonas aeruginosa PA01
ugccgagguguagaaa

SEQ ID NO: 3409293 - RNA, 14 nt, Pseudomonas aeruginosa PA01
ugccgaucaggcug

SEQ ID NO: 3409294 - RNA, 22 nt, Pseudomonas aeruginosa PA01
ugccgaucaggcugaagcggcc

SEQ ID NO: 3409295 - RNA, 16 nt, Pseudomonas aeruginosa PA01
ugccgaucaugcucgg

SEQ ID NO: 3409296 - RNA, 23 nt, Pseudomonas aeruginosa PA01
ugccgaucaugggggccagcagg

SEQ ID NO: 3409297 - RNA, 20 nt, Pseudomonas aeruginosa PA01
ugccgaucgccgcgcggucg

SEQ ID NO: 3409298 - RNA, 16 nt, Pseudomonas aeruginosa PA01
ugccgaucucgcccag

SEQ ID NO: 3409299 - RNA, 23 nt, Pseudomonas aeruginosa PA01
ugccgaucucgcccaguaccgcc

SEQ ID NO: 3409300 - RNA, 15 nt, Pseudomonas aeruginosa PA01
ugccgaugccgccga

SEQ ID NO: 3409301 - RNA, 18 nt, Pseudomonas aeruginosa PA01
ugccgaugccggaaagcc

SEQ ID NO: 3409302 - RNA, 23 nt, Pseudomonas aeruginosa PA01
ugccgaugccggaaagccuggcc

SEQ ID NO: 3409303 - RNA, 18 nt, Pseudomonas aeruginosa PA01
ugccgauggacaggcugg

SEQ ID NO: 3409304 - RNA, 17 nt, Pseudomonas aeruginosa PA01
ugccgauggcgcaccac

SEQ ID NO: 3409305 - RNA, 18 nt, Pseudomonas aeruginosa PA01
ugccgauggcgcaccacu

SEQ ID NO: 3409306 - RNA, 15 nt, Pseudomonas aeruginosa PA01
ugccgauggcgccgc

SEQ ID NO: 3409307 - RNA, 19 nt, Pseudomonas aeruginosa PA01
ugccgauggcgccgccgag

SEQ ID NO: 3409308 - RNA, 17 nt, Pseudomonas aeruginosa PA01
ugccgauggugauacgc

SEQ ID NO: 3409309 - RNA, 16 nt, Pseudomonas aeruginosa PA01
ugccgaugucgccggc

SEQ ID NO: 3409310 - RNA, 17 nt, Pseudomonas aeruginosa PA01
ugccgaugucgccggca

SEQ ID NO: 3409311 - RNA, 20 nt, Pseudomonas aeruginosa PA01
ugccgaugucgccggcaugg

SEQ ID NO: 3409312 - RNA, 18 nt, Pseudomonas aeruginosa PA01
ugccgaugugcacgcuga

SEQ ID NO: 3409313 - RNA, 17 nt, Pseudomonas aeruginosa PA01
ugccgcaaacccccugc

SEQ ID NO: 3409314 - RNA, 18 nt, Pseudomonas aeruginosa PA01
ugccgcacaggcuggcca

SEQ ID NO: 3409315 - RNA, 19 nt, Pseudomonas aeruginosa PA01
ugccgcaccccauccucgc

SEQ ID NO: 3409316 - RNA, 20 nt, Pseudomonas aeruginosa PA01
ugccgcaccgccucgaucag

SEQ ID NO: 3409317 - RNA, 15 nt, Pseudomonas aeruginosa PA01
ugccgcacggugcgc

SEQ ID NO: 3409318 - RNA, 18 nt, Pseudomonas aeruginosa PA01
ugccgcagacaucgccga

SEQ ID NO: 3409319 - RNA, 20 nt, Pseudomonas aeruginosa PA01
ugccgcagacaucgccgagg

SEQ ID NO: 3409320 - RNA, 21 nt, Pseudomonas aeruginosa PA01
ugccgcagacaucgccgaggg

SEQ ID NO: 3409321 - RNA, 22 nt, Pseudomonas aeruginosa PA01
ugccgcagacaucgccgagggc

SEQ ID NO: 3409322 - RNA, 14 nt, Pseudomonas aeruginosa PA01
ugccgcagagcauc

SEQ ID NO: 3409323 - RNA, 16 nt, Pseudomonas aeruginosa PA01
ugccgcagaucaucgc

SEQ ID NO: 3409324 - RNA, 11 nt, Pseudomonas aeruginosa PA01
ugccgcagcag

SEQ ID NO: 3409325 - RNA, 12 nt, Pseudomonas aeruginosa PA01
ugccgcagcagc

SEQ ID NO: 3409326 - RNA, 13 nt, Pseudomonas aeruginosa PA01
ugccgcagcagcg

SEQ ID NO: 3409327 - RNA, 14 nt, Pseudomonas aeruginosa PA01
ugccgcagcagcgg

SEQ ID NO: 3409328 - RNA, 15 nt, Pseudomonas aeruginosa PA01
ugccgcagcagcggc

SEQ ID NO: 3409329 - RNA, 16 nt, Pseudomonas aeruginosa PA01
ugccgcagcagcggcg

SEQ ID NO: 3409330 - RNA, 21 nt, Pseudomonas aeruginosa PA01
ugccgcagcgccucccgggcc

SEQ ID NO: 3409331 - RNA, 13 nt, Pseudomonas aeruginosa PA01
ugccgcaggcagu

SEQ ID NO: 3409332 - RNA, 16 nt, Pseudomonas aeruginosa PA01
ugccgcaggcaguggc

SEQ ID NO: 3409333 - RNA, 17 nt, Pseudomonas aeruginosa PA01
ugccgcaggcaguggcg

SEQ ID NO: 3409334 - RNA, 21 nt, Pseudomonas aeruginosa PA01
ugccgcaggcaguggcgccag

SEQ ID NO: 3409335 - RNA, 13 nt, Pseudomonas aeruginosa PA01
ugccgcaggcauu

SEQ ID NO: 3409336 - RNA, 16 nt, Pseudomonas aeruginosa PA01
ugccgcaggccgcggc

SEQ ID NO: 3409337 - RNA, 17 nt, Pseudomonas aeruginosa PA01
ugccgcaggccgcggcc

SEQ ID NO: 3409338 - RNA, 19 nt, Pseudomonas aeruginosa PA01
ugccgcaggccgcggccga

SEQ ID NO: 3409339 - RNA, 14 nt, Pseudomonas aeruginosa PA01
ugccgcaggcgggc

SEQ ID NO: 3409340 - RNA, 13 nt, Pseudomonas aeruginosa PA01
ugccgcaugcagu

SEQ ID NO: 3409341 - RNA, 17 nt, Pseudomonas aeruginosa PA01
ugccgcaugcaguggaa

SEQ ID NO: 3409342 - RNA, 18 nt, Pseudomonas aeruginosa PA01
ugccgcaugcaguggaag

SEQ ID NO: 3409343 - RNA, 14 nt, Pseudomonas aeruginosa PA01
ugccgccaagcccu

SEQ ID NO: 3409344 - RNA, 19 nt, Pseudomonas aeruginosa PA01
ugccgccaggccuuccaga

SEQ ID NO: 3409345 - RNA, 14 nt, Pseudomonas aeruginosa PA01
ugccgccagucggc

SEQ ID NO: 3409346 - RNA, 19 nt, Pseudomonas aeruginosa PA01
ugccgccagucggccuggc

SEQ ID NO: 3409347 - RNA, 20 nt, Pseudomonas aeruginosa PA01
ugccgccagucggccuggcu

SEQ ID NO: 3409348 - RNA, 17 nt, Pseudomonas aeruginosa PA01
ugccgccaucgaccagg

SEQ ID NO: 3409349 - RNA, 16 nt, Pseudomonas aeruginosa PA01
ugccgccaucgccucg

SEQ ID NO: 3409350 - RNA, 21 nt, Pseudomonas aeruginosa PA01
ugccgccaucgccucgccggc

SEQ ID NO: 3409351 - RNA, 15 nt, Pseudomonas aeruginosa PA01
ugccgcccagcaccg

SEQ ID NO: 3409352 - RNA, 21 nt, Pseudomonas aeruginosa PA01
ugccgcccggcgccaccgcgu

SEQ ID NO: 3409353 - RNA, 21 nt, Pseudomonas aeruginosa PA01
ugccgcccuccaucagcgccu

SEQ ID NO: 3409354 - RNA, 11 nt, Pseudomonas aeruginosa PA01
ugccgcccugc

SEQ ID NO: 3409355 - RNA, 17 nt, Pseudomonas aeruginosa PA01
ugccgcccugcggcagg

SEQ ID NO: 3409356 - RNA, 22 nt, Pseudomonas aeruginosa PA01
ugccgcccugggguuucugcug

SEQ ID NO: 3409357 - RNA, 14 nt, Pseudomonas aeruginosa PA01
ugccgcccuugcca

SEQ ID NO: 3409358 - RNA, 18 nt, Pseudomonas aeruginosa PA01
ugccgcccuugccauccu

SEQ ID NO: 3409359 - RNA, 12 nt, Pseudomonas aeruginosa PA01
ugccgccgaagc

SEQ ID NO: 3409360 - RNA, 19 nt, Pseudomonas aeruginosa PA01
ugccgccgaccucggccgc

SEQ ID NO: 3409361 - RNA, 21 nt, Pseudomonas aeruginosa PA01
ugccgccgaccucggccgcca

SEQ ID NO: 3409362 - RNA, 20 nt, Pseudomonas aeruginosa PA01
ugccgccgacgccggacgag

SEQ ID NO: 3409363 - RNA, 12 nt, Pseudomonas aeruginosa PA01
ugccgccgaggg

SEQ ID NO: 3409364 - RNA, 17 nt, Pseudomonas aeruginosa PA01
ugccgccgaucagcgcg

SEQ ID NO: 3409365 - RNA, 20 nt, Pseudomonas aeruginosa PA01
ugccgccgaucagcgcgccu

SEQ ID NO: 3409366 - RNA, 17 nt, Pseudomonas aeruginosa PA01
ugccgccgaugcuguuc

SEQ ID NO: 3409367 - RNA, 22 nt, Pseudomonas aeruginosa PA01
ugccgccgaugcuguucagcag

SEQ ID NO: 3409368 - RNA, 18 nt, Pseudomonas aeruginosa PA01
ugccgccgcagagccagc

SEQ ID NO: 3409369 - RNA, 15 nt, Pseudomonas aeruginosa PA01
ugccgccgccgagga

SEQ ID NO: 3409370 - RNA, 15 nt, Pseudomonas aeruginosa PA01
ugccgccgccggagg

SEQ ID NO: 3409371 - RNA, 18 nt, Pseudomonas aeruginosa PA01
ugccgccgccggagggaa

SEQ ID NO: 3409372 - RNA, 19 nt, Pseudomonas aeruginosa PA01
ugccggaaagccuggccgg

SEQ ID NO: 3409373 - RNA, 20 nt, Pseudomonas aeruginosa PA01
ugccggaaagccuggccggc

SEQ ID NO: 3409374 - RNA, 21 nt, Pseudomonas aeruginosa PA01
ugccggaaagccuggccggcg

SEQ ID NO: 3409375 - RNA, 15 nt, Pseudomonas aeruginosa PA01
ugccggacgcgaucc

SEQ ID NO: 3409376 - RNA, 17 nt, Pseudomonas aeruginosa PA01
ugccggagacgauggcg

SEQ ID NO: 3409377 - RNA, 15 nt, Pseudomonas aeruginosa PA01
ugccggagagcagca

SEQ ID NO: 3409378 - RNA, 19 nt, Pseudomonas aeruginosa PA01
ugccggagaugugcgcggu

SEQ ID NO: 3409379 - RNA, 17 nt, Pseudomonas aeruginosa PA01
ugccggagucucgggaa

SEQ ID NO: 3409380 - RNA, 17 nt, Pseudomonas aeruginosa PA01
ugccggagugccgcgga

SEQ ID NO: 3409381 - RNA, 18 nt, Pseudomonas aeruginosa PA01
ugccggcacgcucaggcg

SEQ ID NO: 3409382 - RNA, 14 nt, Pseudomonas aeruginosa PA01
ugccggcagcgacc

SEQ ID NO: 3409383 - RNA, 20 nt, Pseudomonas aeruginosa PA01
ugccggcagcgaccaccacc

SEQ ID NO: 3409384 - RNA, 19 nt, Pseudomonas aeruginosa PA01
ugccggcaggccuucgacg

SEQ ID NO: 3409385 - RNA, 14 nt, Pseudomonas aeruginosa PA01
ugccggccaccauc

SEQ ID NO: 3409386 - RNA, 18 nt, Pseudomonas aeruginosa PA01
ugccggccaugcaggcca

SEQ ID NO: 3409387 - RNA, 22 nt, Pseudomonas aeruginosa PA01
ugccggccaugcaggccagggc

SEQ ID NO: 3409388 - RNA, 15 nt, Pseudomonas aeruginosa PA01
ugccggccgccagca

SEQ ID NO: 3409389 - RNA, 17 nt, Pseudomonas aeruginosa PA01
ugccggccgccagcagg

SEQ ID NO: 3409390 - RNA, 22 nt, Pseudomonas aeruginosa PA01
ugccggccgccagcagguagac

SEQ ID NO: 3409391 - RNA, 23 nt, Pseudomonas aeruginosa PA01
ugccggccggggccggcacccgg

SEQ ID NO: 3409392 - RNA, 17 nt, Pseudomonas aeruginosa PA01
ugccggccgucgcgcac

SEQ ID NO: 3409393 - RNA, 15 nt, Pseudomonas aeruginosa PA01
ugccggccucgagga

SEQ ID NO: 3409394 - RNA, 13 nt, Pseudomonas aeruginosa PA01
ugccggcgaugau

SEQ ID NO: 3409395 - RNA, 20 nt, Pseudomonas aeruginosa PA01
ugccggcgcagaucgcggcg

SEQ ID NO: 3409396 - RNA, 11 nt, Pseudomonas aeruginosa PA01
ugccggcgcca

SEQ ID NO: 3409397 - RNA, 21 nt, Pseudomonas aeruginosa PA01
ugccggcgccaucgaucagca

SEQ ID NO: 3409398 - RNA, 11 nt, Pseudomonas aeruginosa PA01
ugccggcgcgc

SEQ ID NO: 3409399 - RNA, 20 nt, Pseudomonas aeruginosa PA01
ugccggcgcgcacggaggcg

SEQ ID NO: 3409400 - RNA, 17 nt, Pseudomonas aeruginosa PA01
ugccggcgcgucgcugc

SEQ ID NO: 3409401 - RNA, 12 nt, Pseudomonas aeruginosa PA01
ugccggcgcugu

SEQ ID NO: 3409402 - RNA, 22 nt, Pseudomonas aeruginosa PA01
ugccggcgcugucucgccagcc

SEQ ID NO: 3409403 - RNA, 13 nt, Pseudomonas aeruginosa PA01
ugccggcggcauc

SEQ ID NO: 3409404 - RNA, 13 nt, Pseudomonas aeruginosa PA01
ugccggcggcgcu

SEQ ID NO: 3409405 - RNA, 18 nt, Pseudomonas aeruginosa PA01
ugccggcggcgcugagga

SEQ ID NO: 3409406 - RNA, 21 nt, Pseudomonas aeruginosa PA01
ugccggcggcggacgcaggcc

SEQ ID NO: 3409407 - RNA, 22 nt, Pseudomonas aeruginosa PA01
ugccggcggcggacgcaggccg

SEQ ID NO: 3409408 - RNA, 22 nt, Pseudomonas aeruginosa PA01
ugccggcgggacgcgcaugcag

SEQ ID NO: 3409409 - RNA, 21 nt, Pseudomonas aeruginosa PA01
ugccggcgguggacgucggcg

SEQ ID NO: 3409410 - RNA, 23 nt, Pseudomonas aeruginosa PA01
ugccggcguccuugccgaggaag

SEQ ID NO: 3409411 - RNA, 22 nt, Pseudomonas aeruginosa PA01
ugccggcgucggcgagcaggcg

SEQ ID NO: 3409412 - RNA, 22 nt, Pseudomonas aeruginosa PA01
ugccggcgucguccugcgcggc

SEQ ID NO: 3409413 - RNA, 20 nt, Pseudomonas aeruginosa PA01
ugccggcgugaacgcggcga

SEQ ID NO: 3409414 - RNA, 17 nt, Pseudomonas aeruginosa PA01
ugccggcugcgccgcgu

SEQ ID NO: 3409415 - RNA, 17 nt, Pseudomonas aeruginosa PA01
ugccggcuugcugcagg

SEQ ID NO: 3409416 - RNA, 20 nt, Pseudomonas aeruginosa PA01
ugccggcuugcugcaggugg

SEQ ID NO: 3409417 - RNA, 14 nt, Pseudomonas aeruginosa PA01
ugccgggaagcgca

SEQ ID NO: 3409418 - RNA, 17 nt, Pseudomonas aeruginosa PA01
ugccgggaauacgcggu

SEQ ID NO: 3409419 - RNA, 20 nt, Pseudomonas aeruginosa PA01
ugccgggcaacgcgcagagg

SEQ ID NO: 3409420 - RNA, 12 nt, Pseudomonas aeruginosa PA01
ugccgggccagc

SEQ ID NO: 3409421 - RNA, 15 nt, Pseudomonas aeruginosa PA01
ugccgggccagcucc

SEQ ID NO: 3409422 - RNA, 21 nt, Pseudomonas aeruginosa PA01
ugccgggccagcuccagcacc

SEQ ID NO: 3409423 - RNA, 18 nt, Pseudomonas aeruginosa PA01
ugccgggccggccagggc

SEQ ID NO: 3409424 - RNA, 12 nt, Pseudomonas aeruginosa PA01
ugccgggcgcgc

SEQ ID NO: 3409425 - RNA, 17 nt, Pseudomonas aeruginosa PA01
ugccgggcucugguagc

SEQ ID NO: 3409426 - RNA, 18 nt, Pseudomonas aeruginosa PA01
ugccgggcuuccuggccg

SEQ ID NO: 3409427 - RNA, 17 nt, Pseudomonas aeruginosa PA01
ugccggggaaccacacc

SEQ ID NO: 3409428 - RNA, 16 nt, Pseudomonas aeruginosa PA01
ugccgggguccgccgg

SEQ ID NO: 3409429 - RNA, 20 nt, Pseudomonas aeruginosa PA01
ugccgggguggaguaccagg

SEQ ID NO: 3409430 - RNA, 22 nt, Pseudomonas aeruginosa PA01
ugccggguauccagcacccgca

SEQ ID NO: 3409431 - RNA, 19 nt, Pseudomonas aeruginosa PA01
ugccgguaauuggccaggc

SEQ ID NO: 3409432 - RNA, 20 nt, Pseudomonas aeruginosa PA01
ugccgguaauuggccaggcu

SEQ ID NO: 3409433 - RNA, 16 nt, Pseudomonas aeruginosa PA01
ugccgguacgcaccag

SEQ ID NO: 3409434 - RNA, 17 nt, Pseudomonas aeruginosa PA01
ugccgguacgcaccagc

SEQ ID NO: 3409435 - RNA, 20 nt, Pseudomonas aeruginosa PA01
ugccgguacgcaccagcggu

SEQ ID NO: 3409436 - RNA, 17 nt, Pseudomonas aeruginosa PA01
ugccgguacucgccggg

SEQ ID NO: 3409437 - RNA, 24 nt, Pseudomonas aeruginosa PA01
ugccgguacucgccgggcgucugc

SEQ ID NO: 3409438 - RNA, 16 nt, Pseudomonas aeruginosa PA01
ugccgguagcuggcca

SEQ ID NO: 3409439 - RNA, 19 nt, Pseudomonas aeruginosa PA01
ugccgguaggucaccaggu

SEQ ID NO: 3409440 - RNA, 20 nt, Pseudomonas aeruginosa PA01
ugccggucaggcuggugccg

SEQ ID NO: 3409441 - RNA, 19 nt, Pseudomonas aeruginosa PA01
ugccggucgcgcagcaccg

SEQ ID NO: 3409442 - RNA, 13 nt, Pseudomonas aeruginosa PA01
ugccggucggccu

SEQ ID NO: 3409443 - RNA, 14 nt, Pseudomonas aeruginosa PA01
ugccggucuugccg

SEQ ID NO: 3409444 - RNA, 21 nt, Pseudomonas aeruginosa PA01
ugccggugaugucggcgcugu

SEQ ID NO: 3409445 - RNA, 16 nt, Pseudomonas aeruginosa PA01
ugccggugccaccguc

SEQ ID NO: 3409446 - RNA, 22 nt, Pseudomonas aeruginosa PA01
ugccggugcggguggucgccgc

SEQ ID NO: 3409447 - RNA, 23 nt, Pseudomonas aeruginosa PA01
ugccggugcggguggucgccgcc

SEQ ID NO: 3409448 - RNA, 18 nt, Pseudomonas aeruginosa PA01
ugccggugcuggugcggc

SEQ ID NO: 3409449 - RNA, 23 nt, Pseudomonas aeruginosa PA01
ugccggugcuguaguaggcggug

SEQ ID NO: 3409450 - RNA, 13 nt, Pseudomonas aeruginosa PA01
ugccgguggcgcc

SEQ ID NO: 3409451 - RNA, 20 nt, Pseudomonas aeruginosa PA01
ugccgguggcgcccagccag

SEQ ID NO: 3409452 - RNA, 18 nt, Pseudomonas aeruginosa PA01
ugccggugugacggccgg

SEQ ID NO: 3409453 - RNA, 21 nt, Pseudomonas aeruginosa PA01
ugccggugugacggccggggc

SEQ ID NO: 3409454 - RNA, 17 nt, Pseudomonas aeruginosa PA01
ugccgguuaucgaggcg

SEQ ID NO: 3409455 - RNA, 22 nt, Pseudomonas aeruginosa PA01
ugccgguuaucgaggcgucggc

SEQ ID NO: 3409456 - RNA, 15 nt, Pseudomonas aeruginosa PA01
ugccgguucccgcag

SEQ ID NO: 3409457 - RNA, 16 nt, Pseudomonas aeruginosa PA01
ugccgguucccgcagc

SEQ ID NO: 3409458 - RNA, 17 nt, Pseudomonas aeruginosa PA01
ugccgguucccgcagcg

SEQ ID NO: 3409459 - RNA, 15 nt, Pseudomonas aeruginosa PA01
ugccguacaggucgg

SEQ ID NO: 3409460 - RNA, 17 nt, Pseudomonas aeruginosa PA01
ugccguacaggucggcg

SEQ ID NO: 3409461 - RNA, 21 nt, Pseudomonas aeruginosa PA01
ugccguacaggucggcgccgg

SEQ ID NO: 3409462 - RNA, 18 nt, Pseudomonas aeruginosa PA01
ugccguacuucaggguga

SEQ ID NO: 3409463 - RNA, 17 nt, Pseudomonas aeruginosa PA01
ugccguacuugaaggug

SEQ ID NO: 3409464 - RNA, 15 nt, Pseudomonas aeruginosa PA01
ugccguagaggucgc

SEQ ID NO: 3409465 - RNA, 23 nt, Pseudomonas aeruginosa PA01
ugccguagaucaggacgaugaag

SEQ ID NO: 3409466 - RNA, 21 nt, Pseudomonas aeruginosa PA01
ugccguagugguugcgcacgc

SEQ ID NO: 3409467 - RNA, 17 nt, Pseudomonas aeruginosa PA01
ugccguauccgcggcag

SEQ ID NO: 3409468 - RNA, 13 nt, Pseudomonas aeruginosa PA01
ugccguccaggcg

SEQ ID NO: 3409469 - RNA, 14 nt, Pseudomonas aeruginosa PA01
ugccguccgucggc

SEQ ID NO: 3409470 - RNA, 19 nt, Pseudomonas aeruginosa PA01
ugccguccgucggcagugg

SEQ ID NO: 3409471 - RNA, 16 nt, Pseudomonas aeruginosa PA01
ugccgucggcgcccuu

SEQ ID NO: 3409472 - RNA, 23 nt, Pseudomonas aeruginosa PA01
ugccgucuucgaugaaggucagc

SEQ ID NO: 3409473 - RNA, 15 nt, Pseudomonas aeruginosa PA01
ugccgugaucaccug

SEQ ID NO: 3409474 - RNA, 17 nt, Pseudomonas aeruginosa PA01
ugcgauggaugcgcggc

SEQ ID NO: 3409475 - RNA, 21 nt, Pseudomonas aeruginosa PA01
ugcgcaacgggacgccaggcg

SEQ ID NO: 3409476 - RNA, 21 nt, Pseudomonas aeruginosa PA01
ugcgcaaugaaagagccccuc

SEQ ID NO: 3409477 - RNA, 15 nt, Pseudomonas aeruginosa PA01
ugcgcaccacucccg

SEQ ID NO: 3409478 - RNA, 17 nt, Pseudomonas aeruginosa PA01
ugcgcaccacucccggc

SEQ ID NO: 3409479 - RNA, 20 nt, Pseudomonas aeruginosa PA01
ugcgcaccacucccggcgac

SEQ ID NO: 3409480 - RNA, 22 nt, Pseudomonas aeruginosa PA01
ugcgcaccaugcccgcugggca

SEQ ID NO: 3409481 - RNA, 13 nt, Pseudomonas aeruginosa PA01
ugcgcaccgccug

SEQ ID NO: 3409482 - RNA, 15 nt, Pseudomonas aeruginosa PA01
ugcgcaccgccugca

SEQ ID NO: 3409483 - RNA, 14 nt, Pseudomonas aeruginosa PA01
ugcgcaccgcgccg

SEQ ID NO: 3409484 - RNA, 16 nt, Pseudomonas aeruginosa PA01
ugcgcaccucgcccuu

SEQ ID NO: 3409485 - RNA, 19 nt, Pseudomonas aeruginosa PA01
ugcgcaccucggccaggcg

SEQ ID NO: 3409486 - RNA, 22 nt, Pseudomonas aeruginosa PA01
ugcgcacgcaauagugcagcuc

SEQ ID NO: 3409487 - RNA, 20 nt, Pseudomonas aeruginosa PA01
ugcgcacggucuccggggag

SEQ ID NO: 3409488 - RNA, 23 nt, Pseudomonas aeruginosa PA01
ugcgcagaugcggggcgaccagc

SEQ ID NO: 3409489 - RNA, 22 nt, Pseudomonas aeruginosa PA01
ugcgcagcaacuggucgccgca

SEQ ID NO: 3409490 - RNA, 11 nt, Pseudomonas aeruginosa PA01
ugcgcagcagc

SEQ ID NO: 3409491 - RNA, 12 nt, Pseudomonas aeruginosa PA01
ugcgcagcagcg

SEQ ID NO: 3409492 - RNA, 21 nt, Pseudomonas aeruginosa PA01
ugcgcagcaucuucucggcga

SEQ ID NO: 3409493 - RNA, 14 nt, Pseudomonas aeruginosa PA01
ugcgcagccacccg

SEQ ID NO: 3409494 - RNA, 15 nt, Pseudomonas aeruginosa PA01
ugcgcagccacccgc

SEQ ID NO: 3409495 - RNA, 13 nt, Pseudomonas aeruginosa PA01
ugcgcagcgcggg

SEQ ID NO: 3409496 - RNA, 16 nt, Pseudomonas aeruginosa PA01
ugcgcagcuaggcgag

SEQ ID NO: 3409497 - RNA, 12 nt, Pseudomonas aeruginosa PA01
ugcgcagcuucu

SEQ ID NO: 3409498 - RNA, 19 nt, Pseudomonas aeruginosa PA01
ugcgcagcuucugcagggc

SEQ ID NO: 3409499 - RNA, 20 nt, Pseudomonas aeruginosa PA01
ugcgcagcuucugcagggcg

SEQ ID NO: 3409500 - RNA, 14 nt, Pseudomonas aeruginosa PA01
ugcgcaggccgaga

SEQ ID NO: 3409501 - RNA, 13 nt, Pseudomonas aeruginosa PA01
ugcgcaggccggg

SEQ ID NO: 3409502 - RNA, 12 nt, Pseudomonas aeruginosa PA01
ugcgcaggcgcu

SEQ ID NO: 3409503 - RNA, 20 nt, Pseudomonas aeruginosa PA01
ugcgcaggcgcucgcgggcc

SEQ ID NO: 3409504 - RNA, 16 nt, Pseudomonas aeruginosa PA01
ugcgcaggcgguaggu

SEQ ID NO: 3409505 - RNA, 22 nt, Pseudomonas aeruginosa PA01
ugcgcaggcguuccucgacgaa

SEQ ID NO: 3409506 - RNA, 13 nt, Pseudomonas aeruginosa PA01
ugcgcaggcuggc

SEQ ID NO: 3409507 - RNA, 15 nt, Pseudomonas aeruginosa PA01
ugcgcaggcuggccg

SEQ ID NO: 3409508 - RNA, 18 nt, Pseudomonas aeruginosa PA01
ugcgcaggcuggccgagc

SEQ ID NO: 3409509 - RNA, 19 nt, Pseudomonas aeruginosa PA01
ugcgcaggcuggccgagcg

SEQ ID NO: 3409510 - RNA, 23 nt, Pseudomonas aeruginosa PA01
ugcgcaggcuggccgagcgccgc

SEQ ID NO: 3409511 - RNA, 15 nt, Pseudomonas aeruginosa PA01
ugcgcagggcggcga

SEQ ID NO: 3409512 - RNA, 16 nt, Pseudomonas aeruginosa PA01
ugcgcagggcggcgag

SEQ ID NO: 3409513 - RNA, 22 nt, Pseudomonas aeruginosa PA01
ugcgcagggcgucgaaggcggc

SEQ ID NO: 3409514 - RNA, 20 nt, Pseudomonas aeruginosa PA01
ugcgcagggcuuccuuggcg

SEQ ID NO: 3409515 - RNA, 19 nt, Pseudomonas aeruginosa PA01
ugcgcaggggcgcggcgcg

SEQ ID NO: 3409516 - RNA, 21 nt, Pseudomonas aeruginosa PA01
ugcgcaggggcgcggcgcgga

SEQ ID NO: 3409517 - RNA, 14 nt, Pseudomonas aeruginosa PA01
ugcgcaggucgcga

SEQ ID NO: 3409518 - RNA, 17 nt, Pseudomonas aeruginosa PA01
ugcgcaggugcuuguca

SEQ ID NO: 3409519 - RNA, 22 nt, Pseudomonas aeruginosa PA01
ugcgcagugucgcgaacucggc

SEQ ID NO: 3409520 - RNA, 15 nt, Pseudomonas aeruginosa PA01
ugcgcaucaggucgg

SEQ ID NO: 3409521 - RNA, 13 nt, Pseudomonas aeruginosa PA01
ugcgcaucgccug

SEQ ID NO: 3409522 - RNA, 18 nt, Pseudomonas aeruginosa PA01
ugcgcaucgccugggccg

SEQ ID NO: 3409523 - RNA, 14 nt, Pseudomonas aeruginosa PA01
ugcgcaucugcgcg

SEQ ID NO: 3409524 - RNA, 14 nt, Pseudomonas aeruginosa PA01
ugcgcaugcccgcg

SEQ ID NO: 3409525 - RNA, 16 nt, Pseudomonas aeruginosa PA01
ugcgcaugcgcagcgc

SEQ ID NO: 3409526 - RNA, 13 nt, Pseudomonas aeruginosa PA01
ugcgcaugcuggg

SEQ ID NO: 3409527 - RNA, 17 nt, Pseudomonas aeruginosa PA01
ugcgcaugucguccagg

SEQ ID NO: 3409528 - RNA, 19 nt, Pseudomonas aeruginosa PA01
ugcgcaugucguccaggcu

SEQ ID NO: 3409529 - RNA, 18 nt, Pseudomonas aeruginosa PA01
ugcgccagaagguaucgg

SEQ ID NO: 3409530 - RNA, 22 nt, Pseudomonas aeruginosa PA01
ugcgccagaagguaucggccau

SEQ ID NO: 3409531 - RNA, 14 nt, Pseudomonas aeruginosa PA01
ugcgccagaccagc

SEQ ID NO: 3409532 - RNA, 15 nt, Pseudomonas aeruginosa PA01
ugcgccagaccagcc

SEQ ID NO: 3409533 - RNA, 14 nt, Pseudomonas aeruginosa PA01
ugcgccagagcagg

SEQ ID NO: 3409534 - RNA, 18 nt, Pseudomonas aeruginosa PA01
ugcgccagagcaggcgga

SEQ ID NO: 3409535 - RNA, 19 nt, Pseudomonas aeruginosa PA01
ugcgccagagcaggcggau

SEQ ID NO: 3409536 - RNA, 23 nt, Pseudomonas aeruginosa PA01
ugcgccagcaucgcaucggcgac

SEQ ID NO: 3409537 - RNA, 18 nt, Pseudomonas aeruginosa PA01
ugcgccagcggcccggca

SEQ ID NO: 3409538 - RNA, 12 nt, Pseudomonas aeruginosa PA01
ugcgccagcucg

SEQ ID NO: 3409539 - RNA, 14 nt, Pseudomonas aeruginosa PA01
ugcgccagcucggc

SEQ ID NO: 3409540 - RNA, 17 nt, Pseudomonas aeruginosa PA01
ugcgccagcucggccug

SEQ ID NO: 3409541 - RNA, 18 nt, Pseudomonas aeruginosa PA01
ugcgccagcucggccugu

SEQ ID NO: 3409542 - RNA, 18 nt, Pseudomonas aeruginosa PA01
ugcgccaggcccggcgcu

SEQ ID NO: 3409543 - RNA, 16 nt, Pseudomonas aeruginosa PA01
ugcgccaggccggugc

SEQ ID NO: 3409544 - RNA, 22 nt, Pseudomonas aeruginosa PA01
ugcgccaggccuugcagcaacu

SEQ ID NO: 3409545 - RNA, 22 nt, Pseudomonas aeruginosa PA01
ugcgccaggcuuuccgccgagc

SEQ ID NO: 3409546 - RNA, 18 nt, Pseudomonas aeruginosa PA01
ugcgccagguagccugga

SEQ ID NO: 3409547 - RNA, 20 nt, Pseudomonas aeruginosa PA01
ugcgccagguguucguccag

SEQ ID NO: 3409548 - RNA, 22 nt, Pseudomonas aeruginosa PA01
ugcgccaguuccuucgccgaaa

SEQ ID NO: 3409549 - RNA, 22 nt, Pseudomonas aeruginosa PA01
ugcgccaugccguucaggccgg

SEQ ID NO: 3409550 - RNA, 23 nt, Pseudomonas aeruginosa PA01
ugcgccaugccguucaggccggc

SEQ ID NO: 3409551 - RNA, 18 nt, Pseudomonas aeruginosa PA01
ugcgccaugcgcccgcug

SEQ ID NO: 3409552 - RNA, 14 nt, Pseudomonas aeruginosa PA01
ugcgccauugccgc

SEQ ID NO: 3409553 - RNA, 17 nt, Pseudomonas aeruginosa PA01
ugcgccauugccgccag

SEQ ID NO: 3409554 - RNA, 20 nt, Pseudomonas aeruginosa PA01
ugcgccauugccgccaggug

SEQ ID NO: 3409555 - RNA, 21 nt, Pseudomonas aeruginosa PA01
ugcgccauuucaaggcgacgc

SEQ ID NO: 3409556 - RNA, 13 nt, Pseudomonas aeruginosa PA01
ugcgcccagcagc

SEQ ID NO: 3409557 - RNA, 15 nt, Pseudomonas aeruginosa PA01
ugcgcccagcagcag

SEQ ID NO: 3409558 - RNA, 20 nt, Pseudomonas aeruginosa PA01
ugcgcccagggacgcgccgg

SEQ ID NO: 3409559 - RNA, 21 nt, Pseudomonas aeruginosa PA01
ugcgcccagggacgcgccggc

SEQ ID NO: 3409560 - RNA, 19 nt, Pseudomonas aeruginosa PA01
ugcgccccagcgccugggc

SEQ ID NO: 3409561 - RNA, 16 nt, Pseudomonas aeruginosa PA01
ugcgccccagcucagc

SEQ ID NO: 3409562 - RNA, 13 nt, Pseudomonas aeruginosa PA01
ugcgccccaggug

SEQ ID NO: 3409563 - RNA, 21 nt, Pseudomonas aeruginosa PA01
ugcgccccaggugcagcgagg

SEQ ID NO: 3409564 - RNA, 14 nt, Pseudomonas aeruginosa PA01
ugcgccccgggucg

SEQ ID NO: 3409565 - RNA, 16 nt, Pseudomonas aeruginosa PA01
ugcgccccgggucgcu

SEQ ID NO: 3409566 - RNA, 19 nt, Pseudomonas aeruginosa PA01
ugcgccccggucucgcgca

SEQ ID NO: 3409567 - RNA, 20 nt, Pseudomonas aeruginosa PA01
ugcgccccggucucgcgcag

SEQ ID NO: 3409568 - RNA, 17 nt, Pseudomonas aeruginosa PA01
ugcgcccgcucgacccg

SEQ ID NO: 3409569 - RNA, 15 nt, Pseudomonas aeruginosa PA01
ugcgcccggagcuuu

SEQ ID NO: 3409570 - RNA, 13 nt, Pseudomonas aeruginosa PA01
ugcgcccggcuuc

SEQ ID NO: 3409571 - RNA, 17 nt, Pseudomonas aeruginosa PA01
ugcgcccggcuucggcg

SEQ ID NO: 3409572 - RNA, 18 nt, Pseudomonas aeruginosa PA01
ugcgcccggcuucggcgg

SEQ ID NO: 3409573 - RNA, 24 nt, Pseudomonas aeruginosa PA01
ugcgcccggcuucggcggcgcgcu

SEQ ID NO: 3409574 - RNA, 20 nt, Pseudomonas aeruginosa PA01
ugcgcccguucgaucaauug

SEQ ID NO: 3409575 - RNA, 16 nt, Pseudomonas aeruginosa PA01
ugcgcccuaccugucc

SEQ ID NO: 3409576 - RNA, 19 nt, Pseudomonas aeruginosa PA01
ugcgcggcagcaggcgggc

SEQ ID NO: 3409577 - RNA, 14 nt, Pseudomonas aeruginosa PA01
ugcgcggcaggacc

SEQ ID NO: 3409578 - RNA, 17 nt, Pseudomonas aeruginosa PA01
ugcgcggcaggaucagg

SEQ ID NO: 3409579 - RNA, 22 nt, Pseudomonas aeruginosa PA01
ugcgcggcaggaucaggcucga

SEQ ID NO: 3409580 - RNA, 21 nt, Pseudomonas aeruginosa PA01
ugcgcggcagguggcuggcca

SEQ ID NO: 3409581 - RNA, 17 nt, Pseudomonas aeruginosa PA01
ugcgcggccugcgccgg

SEQ ID NO: 3409582 - RNA, 22 nt, Pseudomonas aeruginosa PA01
ugcgcggcgaguugcgcgaggc

SEQ ID NO: 3409583 - RNA, 21 nt, Pseudomonas aeruginosa PA01
ugcgcggcgccgguugcugcu

SEQ ID NO: 3409584 - RNA, 23 nt, Pseudomonas aeruginosa PA01
ugcgcggcgccgguugcugcugg

SEQ ID NO: 3409585 - RNA, 19 nt, Pseudomonas aeruginosa PA01
ugcgcggcguucgcccugc

SEQ ID NO: 3409586 - RNA, 20 nt, Pseudomonas aeruginosa PA01
ugcgcggcguucgcccugcg

SEQ ID NO: 3409587 - RNA, 22 nt, Pseudomonas aeruginosa PA01
ugcgcggcguucgcccugcgga

SEQ ID NO: 3409588 - RNA, 20 nt, Pseudomonas aeruginosa PA01
ugcgcgggauagacggcgga

SEQ ID NO: 3409589 - RNA, 19 nt, Pseudomonas aeruginosa PA01
ugcgcgggcaugcaccuac

SEQ ID NO: 3409590 - RNA, 22 nt, Pseudomonas aeruginosa PA01
ugcgcgggcaugcaccuaccag

SEQ ID NO: 3409591 - RNA, 24 nt, Pseudomonas aeruginosa PA01
ugcgcgggguagggguggccaggc

SEQ ID NO: 3409592 - RNA, 14 nt, Pseudomonas aeruginosa PA01
ugcgcggucaccag

SEQ ID NO: 3409593 - RNA, 19 nt, Pseudomonas aeruginosa PA01
ugcgcggucaccaggguca

SEQ ID NO: 3409594 - RNA, 22 nt, Pseudomonas aeruginosa PA01
ugcgcggucaccagggucacgc

SEQ ID NO: 3409595 - RNA, 16 nt, Pseudomonas aeruginosa PA01
ugcgcguacaucccgc

SEQ ID NO: 3409596 - RNA, 18 nt, Pseudomonas aeruginosa PA01
ugcgcguccaucccugcu

SEQ ID NO: 3409597 - RNA, 16 nt, Pseudomonas aeruginosa PA01
ugcgcgugcuggugcc

SEQ ID NO: 3409598 - RNA, 17 nt, Pseudomonas aeruginosa PA01
ugcgcguggcgucggcg

SEQ ID NO: 3409599 - RNA, 23 nt, Pseudomonas aeruginosa PA01
ugcgcguugcagcgccuguucca

SEQ ID NO: 3409600 - RNA, 15 nt, Pseudomonas aeruginosa PA01
ugcgcuacggcauca

SEQ ID NO: 3409601 - RNA, 16 nt, Pseudomonas aeruginosa PA01
ugcgcuaucggcccgg

SEQ ID NO: 3409602 - RNA, 14 nt, Pseudomonas aeruginosa PA01
ugcgcuccauccag

SEQ ID NO: 3409603 - RNA, 18 nt, Pseudomonas aeruginosa PA01
ugcgcuccgacuccugca

SEQ ID NO: 3409604 - RNA, 13 nt, Pseudomonas aeruginosa PA01
ugcgcuccgccag

SEQ ID NO: 3409605 - RNA, 14 nt, Pseudomonas aeruginosa PA01
ugcgcuccgccagg

SEQ ID NO: 3409606 - RNA, 15 nt, Pseudomonas aeruginosa PA01
ugcgcuccgccaggc

SEQ ID NO: 3409607 - RNA, 16 nt, Pseudomonas aeruginosa PA01
ugcgcuccgccaggcc

SEQ ID NO: 3409608 - RNA, 18 nt, Pseudomonas aeruginosa PA01
ugcgcuccgccaggccgc

SEQ ID NO: 3409609 - RNA, 20 nt, Pseudomonas aeruginosa PA01
ugcgcuccgccaggccgcgc

SEQ ID NO: 3409610 - RNA, 14 nt, Pseudomonas aeruginosa PA01
ugcgcuccuguugc

SEQ ID NO: 3409611 - RNA, 20 nt, Pseudomonas aeruginosa PA01
ugcgcuccuguugcuggccg

SEQ ID NO: 3409612 - RNA, 21 nt, Pseudomonas aeruginosa PA01
ugcgcuccuuggcuggccagc

SEQ ID NO: 3409613 - RNA, 15 nt, Pseudomonas aeruginosa PA01
ugcgcucgagccggc

SEQ ID NO: 3409614 - RNA, 23 nt, Pseudomonas aeruginosa PA01
ugcgcucgagccggcugaugccc

SEQ ID NO: 3409615 - RNA, 12 nt, Pseudomonas aeruginosa PA01
ugcgcucgcgga

SEQ ID NO: 3409616 - RNA, 20 nt, Pseudomonas aeruginosa PA01
ugcgcucgcggaccucugcg

SEQ ID NO: 3409617 - RNA, 13 nt, Pseudomonas aeruginosa PA01
ugcgcucggcgcu

SEQ ID NO: 3409618 - RNA, 21 nt, Pseudomonas aeruginosa PA01
ugcgcucguagaacucgcccu

SEQ ID NO: 3409619 - RNA, 14 nt, Pseudomonas aeruginosa PA01
ugcgcugagcagga

SEQ ID NO: 3409620 - RNA, 14 nt, Pseudomonas aeruginosa PA01
ugcgcugcaucggc

SEQ ID NO: 3409621 - RNA, 20 nt, Pseudomonas aeruginosa PA01
ugcgcugcaucggcgcgccg

SEQ ID NO: 3409622 - RNA, 14 nt, Pseudomonas aeruginosa PA01
ugcgcugccagcgc

SEQ ID NO: 3409623 - RNA, 15 nt, Pseudomonas aeruginosa PA01
ugcgcugccagcgcc

SEQ ID NO: 3409624 - RNA, 18 nt, Pseudomonas aeruginosa PA01
ugcgcugccagcgccgcc

SEQ ID NO: 3409625 - RNA, 22 nt, Pseudomonas aeruginosa PA01
ugcgcugcgcguacaucccgcc

SEQ ID NO: 3409626 - RNA, 23 nt, Pseudomonas aeruginosa PA01
ugcgcugcgcguacaucccgccg

SEQ ID NO: 3409627 - RNA, 19 nt, Pseudomonas aeruginosa PA01
ugcgcuggaacggccaggu

SEQ ID NO: 3409628 - RNA, 15 nt, Pseudomonas aeruginosa PA01
ugcgcuggccggcaa

SEQ ID NO: 3409629 - RNA, 15 nt, Pseudomonas aeruginosa PA01
ugcgcuggcgcagca

SEQ ID NO: 3409630 - RNA, 16 nt, Pseudomonas aeruginosa PA01
ugcgcuggcgcagcag

SEQ ID NO: 3409631 - RNA, 18 nt, Pseudomonas aeruginosa PA01
ugcgcuggcgcagcagca

SEQ ID NO: 3409632 - RNA, 12 nt, Pseudomonas aeruginosa PA01
ugcgcuggcgcc

SEQ ID NO: 3409633 - RNA, 17 nt, Pseudomonas aeruginosa PA01
ugcgcugggcgccgauu

SEQ ID NO: 3409634 - RNA, 20 nt, Pseudomonas aeruginosa PA01
ugcgcugguaccugccggca

SEQ ID NO: 3409635 - RNA, 15 nt, Pseudomonas aeruginosa PA01
ugcgcuguuccgccg

SEQ ID NO: 3409636 - RNA, 17 nt, Pseudomonas aeruginosa PA01
ugcgcuguuccgccgug

SEQ ID NO: 3409637 - RNA, 20 nt, Pseudomonas aeruginosa PA01
ugcgcuuaaagcaacgcgga

SEQ ID NO: 3409638 - RNA, 13 nt, Pseudomonas aeruginosa PA01
ugcgcuugccggc

SEQ ID NO: 3409639 - RNA, 15 nt, Pseudomonas aeruginosa PA01
ugcgcuugccggccg

SEQ ID NO: 3409640 - RNA, 16 nt, Pseudomonas aeruginosa PA01
ugcgcuugccggccgc

SEQ ID NO: 3409641 - RNA, 18 nt, Pseudomonas aeruginosa PA01
ugcgcuugccggccgcca

SEQ ID NO: 3409642 - RNA, 14 nt, Pseudomonas aeruginosa PA01
ugcgcuugcugcca

SEQ ID NO: 3409643 - RNA, 19 nt, Pseudomonas aeruginosa PA01
ugcggaaaccgcggccggc

SEQ ID NO: 3409644 - RNA, 21 nt, Pseudomonas aeruginosa PA01
ugcggaaaccgcggccggcuu

SEQ ID NO: 3409645 - RNA, 21 nt, Pseudomonas aeruginosa PA01
ugcggaacccgcgcaguuccu

SEQ ID NO: 3409646 - RNA, 15 nt, Pseudomonas aeruginosa PA01
ugcggagagguggcc

SEQ ID NO: 3409647 - RNA, 15 nt, Pseudomonas aeruginosa PA01
ugcggagggucaggc

SEQ ID NO: 3409648 - RNA, 19 nt, Pseudomonas aeruginosa PA01
ugcggagggucaggccgag

SEQ ID NO: 3409649 - RNA, 22 nt, Pseudomonas aeruginosa PA01
ugcggagggucaggccgagggc

SEQ ID NO: 3409650 - RNA, 21 nt, Pseudomonas aeruginosa PA01
ugcggauagccaaccagaucc

SEQ ID NO: 3409651 - RNA, 16 nt, Pseudomonas aeruginosa PA01
ugcggaucgaggaauu

SEQ ID NO: 3409652 - RNA, 12 nt, Pseudomonas aeruginosa PA01
ugcggaucgccu

SEQ ID NO: 3409653 - RNA, 19 nt, Pseudomonas aeruginosa PA01
ugcggauggcaauggcggu

SEQ ID NO: 3409654 - RNA, 15 nt, Pseudomonas aeruginosa PA01
ugcggauggcgcggg

SEQ ID NO: 3409655 - RNA, 15 nt, Pseudomonas aeruginosa PA01
ugcggauucaucggc

SEQ ID NO: 3409656 - RNA, 14 nt, Pseudomonas aeruginosa PA01
ugcggcaacgacgg

SEQ ID NO: 3409657 - RNA, 20 nt, Pseudomonas aeruginosa PA01
ugcggcaaggcgaucccggc

SEQ ID NO: 3409658 - RNA, 21 nt, Pseudomonas aeruginosa PA01
ugcggcaaggcgaucccggcg

SEQ ID NO: 3409659 - RNA, 22 nt, Pseudomonas aeruginosa PA01
ugcggcaaggcgaucccggcgu

SEQ ID NO: 3409660 - RNA, 12 nt, Pseudomonas aeruginosa PA01
ugcggcaccagc

SEQ ID NO: 3409661 - RNA, 13 nt, Pseudomonas aeruginosa PA01
ugcggcaccagcc

SEQ ID NO: 3409662 - RNA, 13 nt, Pseudomonas aeruginosa PA01
ugcggcacgcugc

SEQ ID NO: 3409663 - RNA, 15 nt, Pseudomonas aeruginosa PA01
ugcggcagacgugcu

SEQ ID NO: 3409664 - RNA, 12 nt, Pseudomonas aeruginosa PA01
ugcggcagcagg

SEQ ID NO: 3409665 - RNA, 21 nt, Pseudomonas aeruginosa PA01
ugcggcaggccuuccacgccu

SEQ ID NO: 3409666 - RNA, 23 nt, Pseudomonas aeruginosa PA01
ugcggcaggccuuccacgccuuc

SEQ ID NO: 3409667 - RNA, 15 nt, Pseudomonas aeruginosa PA01
ugcggcaguccucgc

SEQ ID NO: 3409668 - RNA, 23 nt, Pseudomonas aeruginosa PA01
ugcggcaguccucgccguuggcg

SEQ ID NO: 3409669 - RNA, 15 nt, Pseudomonas aeruginosa PA01
ugcggcaugaugcgc

SEQ ID NO: 3409670 - RNA, 16 nt, Pseudomonas aeruginosa PA01
ugcggcauuccgggcg

SEQ ID NO: 3409671 - RNA, 13 nt, Pseudomonas aeruginosa PA01
ugcggccagcgcc

SEQ ID NO: 3409672 - RNA, 16 nt, Pseudomonas aeruginosa PA01
ugcggccagcgccagg

SEQ ID NO: 3409673 - RNA, 13 nt, Pseudomonas aeruginosa PA01
ugcggcccaccac

SEQ ID NO: 3409674 - RNA, 17 nt, Pseudomonas aeruginosa PA01
ugcggcccagcggcagg

SEQ ID NO: 3409675 - RNA, 21 nt, Pseudomonas aeruginosa PA01
ugcggcccagcggcaggucgu

SEQ ID NO: 3409676 - RNA, 19 nt, Pseudomonas aeruginosa PA01
ugcggccccaaggggccgc

SEQ ID NO: 3409677 - RNA, 21 nt, Pseudomonas aeruginosa PA01
ugcggccccaaggggccgcgc

SEQ ID NO: 3409678 - RNA, 23 nt, Pseudomonas aeruginosa PA01
ugcguacgcccagcagcggcagg

SEQ ID NO: 3409679 - RNA, 17 nt, Pseudomonas aeruginosa PA01
ugcguacuuggcccggc

SEQ ID NO: 3409680 - RNA, 19 nt, Pseudomonas aeruginosa PA01
ugcguacuuggcccggcgu

SEQ ID NO: 3409681 - RNA, 19 nt, Pseudomonas aeruginosa PA01
ugcguagggcggauaacgc

SEQ ID NO: 3409682 - RNA, 21 nt, Pseudomonas aeruginosa PA01
ugcguagggcggauaacgcca

SEQ ID NO: 3409683 - RNA, 18 nt, Pseudomonas aeruginosa PA01
ugcguaguugagccccag

SEQ ID NO: 3409684 - RNA, 14 nt, Pseudomonas aeruginosa PA01
ugcgucagcgaggc

SEQ ID NO: 3409685 - RNA, 23 nt, Pseudomonas aeruginosa PA01
ugcgucagcgaggcgggcgcgga

SEQ ID NO: 3409686 - RNA, 16 nt, Pseudomonas aeruginosa PA01
ugcgucauccgccuuu

SEQ ID NO: 3409687 - RNA, 18 nt, Pseudomonas aeruginosa PA01
ugcguccauccaggcuuu

SEQ ID NO: 3409688 - RNA, 18 nt, Pseudomonas aeruginosa PA01
ugcguccgcgcaggcggu

SEQ ID NO: 3409689 - RNA, 13 nt, Pseudomonas aeruginosa PA01
ugcguccugccuc

SEQ ID NO: 3409690 - RNA, 14 nt, Pseudomonas aeruginosa PA01
ugcgucgcaccagg

SEQ ID NO: 3409691 - RNA, 17 nt, Pseudomonas aeruginosa PA01
ugcgugagcugggcagg

SEQ ID NO: 3409692 - RNA, 14 nt, Pseudomonas aeruginosa PA01
ugcgugccagcacc

SEQ ID NO: 3409693 - RNA, 23 nt, Pseudomonas aeruginosa PA01
ugcgugcgagggcggcggcucag

SEQ ID NO: 3409694 - RNA, 23 nt, Pseudomonas aeruginosa PA01
ugcgugcgauucagaugcgguag

SEQ ID NO: 3409695 - RNA, 12 nt, Pseudomonas aeruginosa PA01
ugcgugcgccgc

SEQ ID NO: 3409696 - RNA, 20 nt, Pseudomonas aeruginosa PA01
ugcgugcguugcgcggcagg

SEQ ID NO: 3409697 - RNA, 16 nt, Pseudomonas aeruginosa PA01
ugcguggaaccgcggc

SEQ ID NO: 3409698 - RNA, 20 nt, Pseudomonas aeruginosa PA01
ugcguggaaccgcggcgccc

SEQ ID NO: 3409699 - RNA, 19 nt, Pseudomonas aeruginosa PA01
ugcguggcgaacgcccggc

SEQ ID NO: 3409700 - RNA, 18 nt, Pseudomonas aeruginosa PA01
ugcguggguagccauggc

SEQ ID NO: 3409701 - RNA, 19 nt, Pseudomonas aeruginosa PA01
ugcguggugcauccgccgc

SEQ ID NO: 3409702 - RNA, 20 nt, Pseudomonas aeruginosa PA01
ugcguggugcauccgccgca

SEQ ID NO: 3409703 - RNA, 16 nt, Pseudomonas aeruginosa PA01
ugcguuccagggcgaa

SEQ ID NO: 3409704 - RNA, 20 nt, Pseudomonas aeruginosa PA01
ugcguuccuguccauuucca

SEQ ID NO: 3409705 - RNA, 14 nt, Pseudomonas aeruginosa PA01
ugcguucgcgggcg

SEQ ID NO: 3409706 - RNA, 15 nt, Pseudomonas aeruginosa PA01
ugcguucugcugcuu

SEQ ID NO: 3409707 - RNA, 13 nt, Pseudomonas aeruginosa PA01
ugcguugcgcggc

SEQ ID NO: 3409708 - RNA, 16 nt, Pseudomonas aeruginosa PA01
ugcguugcucgcacca

SEQ ID NO: 3409709 - RNA, 22 nt, Pseudomonas aeruginosa PA01
ugcguuuccggucacgcaggcg

SEQ ID NO: 3409710 - RNA, 14 nt, Pseudomonas aeruginosa PA01
ugcguuucgccggg

SEQ ID NO: 3409711 - RNA, 21 nt, Pseudomonas aeruginosa PA01
ugcguuucguugcggaacgcg

SEQ ID NO: 3409712 - RNA, 20 nt, Pseudomonas aeruginosa PA01
ugcguuugucgaccugcccc

SEQ ID NO: 3409713 - RNA, 23 nt, Pseudomonas aeruginosa PA01
ugcuagcggguggcaacugccgc

SEQ ID NO: 3409714 - RNA, 14 nt, Pseudomonas aeruginosa PA01
ugcuaggcuggaag

SEQ ID NO: 3409715 - RNA, 15 nt, Pseudomonas aeruginosa PA01
ugcuaggcuggaagc

SEQ ID NO: 3409716 - RNA, 21 nt, Pseudomonas aeruginosa PA01
ugcuaggcuggaagccgcgcu

SEQ ID NO: 3409717 - RNA, 12 nt, Pseudomonas aeruginosa PA01
ugcuaugcgccg

SEQ ID NO: 3409718 - RNA, 13 nt, Pseudomonas aeruginosa PA01
ugcuaugcgccgg

SEQ ID NO: 3409719 - RNA, 19 nt, Pseudomonas aeruginosa PA01
ugcucacugcgagcaccau

SEQ ID NO: 3409720 - RNA, 20 nt, Pseudomonas aeruginosa PA01
ugcucagcacggcgacggug

SEQ ID NO: 3409721 - RNA, 18 nt, Pseudomonas aeruginosa PA01
ugcucagccgcgccgggg

SEQ ID NO: 3409722 - RNA, 23 nt, Pseudomonas aeruginosa PA01
ugcucagccgcgccggggcagca

SEQ ID NO: 3409723 - RNA, 13 nt, Pseudomonas aeruginosa PA01
ugcucagcgccgg

SEQ ID NO: 3409724 - RNA, 14 nt, Pseudomonas aeruginosa PA01
ugcucagcggccca

SEQ ID NO: 3409725 - RNA, 18 nt, Pseudomonas aeruginosa PA01
ugcucagcguccucagcc

SEQ ID NO: 3409726 - RNA, 14 nt, Pseudomonas aeruginosa PA01
ugcucaggcgcugc

SEQ ID NO: 3409727 - RNA, 18 nt, Pseudomonas aeruginosa PA01
ugcucaggcgcugcuggu

SEQ ID NO: 3409728 - RNA, 19 nt, Pseudomonas aeruginosa PA01
ugcucaggcgcugcuggug

SEQ ID NO: 3409729 - RNA, 13 nt, Pseudomonas aeruginosa PA01
ugcucaggcggcc

SEQ ID NO: 3409730 - RNA, 15 nt, Pseudomonas aeruginosa PA01
ugcucaggcggccga

SEQ ID NO: 3409731 - RNA, 14 nt, Pseudomonas aeruginosa PA01
ugcucagggccgcg

SEQ ID NO: 3409732 - RNA, 15 nt, Pseudomonas aeruginosa PA01
ugcucagggccgcgc

SEQ ID NO: 3409733 - RNA, 22 nt, Pseudomonas aeruginosa PA01
ugcucagggccgcgccgagccg

SEQ ID NO: 3409734 - RNA, 14 nt, Pseudomonas aeruginosa PA01
ugcucagggcucca

SEQ ID NO: 3409735 - RNA, 15 nt, Pseudomonas aeruginosa PA01
ugcucaguugcaccu

SEQ ID NO: 3409736 - RNA, 16 nt, Pseudomonas aeruginosa PA01
ugcucaguugcaccug

SEQ ID NO: 3409737 - RNA, 14 nt, Pseudomonas aeruginosa PA01
ugcucaugccguug

SEQ ID NO: 3409738 - RNA, 16 nt, Pseudomonas aeruginosa PA01
ugcucauguugcgggc

SEQ ID NO: 3409739 - RNA, 14 nt, Pseudomonas aeruginosa PA01
ugcuccacccgcag

SEQ ID NO: 3409740 - RNA, 17 nt, Pseudomonas aeruginosa PA01
ugcuccacccgcagccg

SEQ ID NO: 3409741 - RNA, 16 nt, Pseudomonas aeruginosa PA01
ugcuccagcaaugcca

SEQ ID NO: 3409742 - RNA, 21 nt, Pseudomonas aeruginosa PA01
ugcuccagcaaugccagcgcc

SEQ ID NO: 3409743 - RNA, 18 nt, Pseudomonas aeruginosa PA01
ugcuccagcaccguggcg

SEQ ID NO: 3409744 - RNA, 23 nt, Pseudomonas aeruginosa PA01
ugcuccagcaccguggcgccauc

SEQ ID NO: 3409745 - RNA, 20 nt, Pseudomonas aeruginosa PA01
ugcuccagcagggccagcgc

SEQ ID NO: 3409746 - RNA, 15 nt, Pseudomonas aeruginosa PA01
ugcuccagcccggcu

SEQ ID NO: 3409747 - RNA, 19 nt, Pseudomonas aeruginosa PA01
ugcuccagguucggcgcca

SEQ ID NO: 3409748 - RNA, 21 nt, Pseudomonas aeruginosa PA01
ugcuccaucaguugcgcgcgg

SEQ ID NO: 3409749 - RNA, 16 nt, Pseudomonas aeruginosa PA01
ugcuccggggcgcugu

SEQ ID NO: 3409750 - RNA, 14 nt, Pseudomonas aeruginosa PA01
ugcuccuccaggcu

SEQ ID NO: 3409751 - RNA, 16 nt, Pseudomonas aeruginosa PA01
ugcuccuccaggcucu

SEQ ID NO: 3409752 - RNA, 18 nt, Pseudomonas aeruginosa PA01
ugcuccuccaggcucuuc

SEQ ID NO: 3409753 - RNA, 18 nt, Pseudomonas aeruginosa PA01
ugcuccucgccguacagc

SEQ ID NO: 3409754 - RNA, 21 nt, Pseudomonas aeruginosa PA01
ugcuccucgccguacagcagg

SEQ ID NO: 3409755 - RNA, 20 nt, Pseudomonas aeruginosa PA01
ugcuccucgucguacuggcg

SEQ ID NO: 3409756 - RNA, 20 nt, Pseudomonas aeruginosa PA01
ugcucgaacgggcacuucuc

SEQ ID NO: 3409757 - RNA, 15 nt, Pseudomonas aeruginosa PA01
ugcucgaacugcucc

SEQ ID NO: 3409758 - RNA, 22 nt, Pseudomonas aeruginosa PA01
ugcucgaauaaaaaaccggcca

SEQ ID NO: 3409759 - RNA, 19 nt, Pseudomonas aeruginosa PA01
ugcucgaccaccucggcgu

SEQ ID NO: 3409760 - RNA, 12 nt, Pseudomonas aeruginosa PA01
ugcucgacccgg

SEQ ID NO: 3409761 - RNA, 23 nt, Pseudomonas aeruginosa PA01
ugcucgaccgccugcucgcggcu

SEQ ID NO: 3409762 - RNA, 16 nt, Pseudomonas aeruginosa PA01
ugcucgagccguucca

SEQ ID NO: 3409763 - RNA, 17 nt, Pseudomonas aeruginosa PA01
ugcucgaucaccaccac

SEQ ID NO: 3409764 - RNA, 16 nt, Pseudomonas aeruginosa PA01
ugcucgaucaggcugu

SEQ ID NO: 3409765 - RNA, 15 nt, Pseudomonas aeruginosa PA01
ugcucgaugccaucg

SEQ ID NO: 3409766 - RNA, 12 nt, Pseudomonas aeruginosa PA01
ugcucgauggcg

SEQ ID NO: 3409767 - RNA, 13 nt, Pseudomonas aeruginosa PA01
ugcucgauggcga

SEQ ID NO: 3409768 - RNA, 21 nt, Pseudomonas aeruginosa PA01
ugcucgauggcgaagcgcuug

SEQ ID NO: 3409769 - RNA, 13 nt, Pseudomonas aeruginosa PA01
ugcucgcaccagg

SEQ ID NO: 3409770 - RNA, 19 nt, Pseudomonas aeruginosa PA01
ugcucgcaccaggccaggu

SEQ ID NO: 3409771 - RNA, 15 nt, Pseudomonas aeruginosa PA01
ugcucgccgccggcg

SEQ ID NO: 3409772 - RNA, 12 nt, Pseudomonas aeruginosa PA01
ugcucgccggcg

SEQ ID NO: 3409773 - RNA, 16 nt, Pseudomonas aeruginosa PA01
ugcucgccggcgcggg

SEQ ID NO: 3409774 - RNA, 23 nt, Pseudomonas aeruginosa PA01
ugcucgccggcgcgggcggccuc

SEQ ID NO: 3409775 - RNA, 15 nt, Pseudomonas aeruginosa PA01
ugcucgccguccgcg

SEQ ID NO: 3409776 - RNA, 21 nt, Pseudomonas aeruginosa PA01
ugcucgccuuggauaccaggg

SEQ ID NO: 3409777 - RNA, 21 nt, Pseudomonas aeruginosa PA01
ugcucgcgcaccgcggccagu

SEQ ID NO: 3409778 - RNA, 16 nt, Pseudomonas aeruginosa PA01
ugcucgcgcagccagg

SEQ ID NO: 3409779 - RNA, 17 nt, Pseudomonas aeruginosa PA01
ugcucgcgcagccaggc

SEQ ID NO: 3409780 - RNA, 18 nt, Pseudomonas aeruginosa PA01
ugcucgcgcagccaggcg

SEQ ID NO: 3409781 - RNA, 15 nt, Pseudomonas aeruginosa PA01
ugcuggccggugccg

SEQ ID NO: 3409782 - RNA, 18 nt, Pseudomonas aeruginosa PA01
ugcuggccggugccgccc

SEQ ID NO: 3409783 - RNA, 20 nt, Pseudomonas aeruginosa PA01
ugcuggccggugccgcccug

SEQ ID NO: 3409784 - RNA, 13 nt, Pseudomonas aeruginosa PA01
ugcuggccuggga

SEQ ID NO: 3409785 - RNA, 23 nt, Pseudomonas aeruginosa PA01
ugcuggcgaauuuccugcuggcg

SEQ ID NO: 3409786 - RNA, 14 nt, Pseudomonas aeruginosa PA01
ugcuggcgaucauc

SEQ ID NO: 3409787 - RNA, 15 nt, Pseudomonas aeruginosa PA01
ugcuggcgaucaucg

SEQ ID NO: 3409788 - RNA, 17 nt, Pseudomonas aeruginosa PA01
ugcuggcgaucaucgcg

SEQ ID NO: 3409789 - RNA, 12 nt, Pseudomonas aeruginosa PA01
ugcuggcgcagc

SEQ ID NO: 3409790 - RNA, 16 nt, Pseudomonas aeruginosa PA01
ugcuggcgcagccagg

SEQ ID NO: 3409791 - RNA, 17 nt, Pseudomonas aeruginosa PA01
ugcuggcgcagccaggc

SEQ ID NO: 3409792 - RNA, 14 nt, Pseudomonas aeruginosa PA01
ugcuggcgccgcug

SEQ ID NO: 3409793 - RNA, 14 nt, Pseudomonas aeruginosa PA01
ugcuggcgcgaucc

SEQ ID NO: 3409794 - RNA, 21 nt, Pseudomonas aeruginosa PA01
ugcuggcgcgauccgcgcggc

SEQ ID NO: 3409795 - RNA, 23 nt, Pseudomonas aeruginosa PA01
ugcuggcgcucucgaacaccagg

SEQ ID NO: 3409796 - RNA, 18 nt, Pseudomonas aeruginosa PA01
ugcuggcgucgccuucca

SEQ ID NO: 3409797 - RNA, 22 nt, Pseudomonas aeruginosa PA01
ugcuggcguucucggccaggua

SEQ ID NO: 3409798 - RNA, 14 nt, Pseudomonas aeruginosa PA01
ugcuggcugcccag

SEQ ID NO: 3409799 - RNA, 15 nt, Pseudomonas aeruginosa PA01
ugcuggcugcccagu

SEQ ID NO: 3409800 - RNA, 18 nt, Pseudomonas aeruginosa PA01
ugcugggacgccuuguuc

SEQ ID NO: 3409801 - RNA, 20 nt, Pseudomonas aeruginosa PA01
ugcugggacgccuuguucac

SEQ ID NO: 3409802 - RNA, 14 nt, Pseudomonas aeruginosa PA01
ugcugggccagcgc

SEQ ID NO: 3409803 - RNA, 20 nt, Pseudomonas aeruginosa PA01
ugcugggcggcgaggccgac

SEQ ID NO: 3409804 - RNA, 14 nt, Pseudomonas aeruginosa PA01
ugcugggcgggauc

SEQ ID NO: 3409805 - RNA, 20 nt, Pseudomonas aeruginosa PA01
ugcugggcgucgaacaccgg

SEQ ID NO: 3409806 - RNA, 19 nt, Pseudomonas aeruginosa PA01
ugcugggucacguggccgc

SEQ ID NO: 3409807 - RNA, 21 nt, Pseudomonas aeruginosa PA01
ugcugggucuccgcucggggu

SEQ ID NO: 3409808 - RNA, 15 nt, Pseudomonas aeruginosa PA01
ugcuggguggaggcc

SEQ ID NO: 3409809 - RNA, 15 nt, Pseudomonas aeruginosa PA01
ugcugguagagccgg

SEQ ID NO: 3409810 - RNA, 17 nt, Pseudomonas aeruginosa PA01
ugcugguagagccgggu

SEQ ID NO: 3409811 - RNA, 15 nt, Pseudomonas aeruginosa PA01
ugcugguagggcuuc

SEQ ID NO: 3409812 - RNA, 13 nt, Pseudomonas aeruginosa PA01
ugcugguccuggc

SEQ ID NO: 3409813 - RNA, 18 nt, Pseudomonas aeruginosa PA01
ugcuggugccgaucagcc

SEQ ID NO: 3409814 - RNA, 15 nt, Pseudomonas aeruginosa PA01
ugcuggugcggccga

SEQ ID NO: 3409815 - RNA, 16 nt, Pseudomonas aeruginosa PA01
ugcuggugcggccgau

SEQ ID NO: 3409816 - RNA, 18 nt, Pseudomonas aeruginosa PA01
ugcugguggacgucgucg

SEQ ID NO: 3409817 - RNA, 22 nt, Pseudomonas aeruginosa PA01
ugcugguggcccugggcggcga

SEQ ID NO: 3409818 - RNA, 19 nt, Pseudomonas aeruginosa PA01
ugcuggugggugaucucgc

SEQ ID NO: 3409819 - RNA, 21 nt, Pseudomonas aeruginosa PA01
ugcuggugggugaucucgcug

SEQ ID NO: 3409820 - RNA, 19 nt, Pseudomonas aeruginosa PA01
ugcugguugaagccgaucg

SEQ ID NO: 3409821 - RNA, 15 nt, Pseudomonas aeruginosa PA01
ugcugguugaccagg

SEQ ID NO: 3409822 - RNA, 18 nt, Pseudomonas aeruginosa PA01
ugcugguugaggccgucc

SEQ ID NO: 3409823 - RNA, 14 nt, Pseudomonas aeruginosa PA01
ugcugguuggacac

SEQ ID NO: 3409824 - RNA, 23 nt, Pseudomonas aeruginosa PA01
ugcuguaguaggcgguggccacg

SEQ ID NO: 3409825 - RNA, 17 nt, Pseudomonas aeruginosa PA01
ugcugucagcgcccggc

SEQ ID NO: 3409826 - RNA, 23 nt, Pseudomonas aeruginosa PA01
ugcuguccagcgcuccuugcgcc

SEQ ID NO: 3409827 - RNA, 20 nt, Pseudomonas aeruginosa PA01
ugcugugcguuucguugcgg

SEQ ID NO: 3409828 - RNA, 16 nt, Pseudomonas aeruginosa PA01
ugcugugcugcaccag

SEQ ID NO: 3409829 - RNA, 18 nt, Pseudomonas aeruginosa PA01
ugcugugcugcaccagca

SEQ ID NO: 3409830 - RNA, 22 nt, Pseudomonas aeruginosa PA01
ugcuguggagccggugccggcg

SEQ ID NO: 3409831 - RNA, 14 nt, Pseudomonas aeruginosa PA01
ugcuguguccggcg

SEQ ID NO: 3409832 - RNA, 13 nt, Pseudomonas aeruginosa PA01
ugcuguguucgau

SEQ ID NO: 3409833 - RNA, 15 nt, Pseudomonas aeruginosa PA01
ugcuguuccucgucg

SEQ ID NO: 3409834 - RNA, 17 nt, Pseudomonas aeruginosa PA01
ugcuguugccagggaua

SEQ ID NO: 3409835 - RNA, 15 nt, Pseudomonas aeruginosa PA01
ugcuguugccgcugc

SEQ ID NO: 3409836 - RNA, 12 nt, Pseudomonas aeruginosa PA01
ugcuguuguugc

SEQ ID NO: 3409837 - RNA, 22 nt, Pseudomonas aeruginosa PA01
ugcuuaauacggcgcaggcuug

SEQ ID NO: 3409838 - RNA, 15 nt, Pseudomonas aeruginosa PA01
ugcuuagcccgggau

SEQ ID NO: 3409839 - RNA, 13 nt, Pseudomonas aeruginosa PA01
ugcuucaggcgcg

SEQ ID NO: 3409840 - RNA, 12 nt, Pseudomonas aeruginosa PA01
ugcuuccagacc

SEQ ID NO: 3409841 - RNA, 13 nt, Pseudomonas aeruginosa PA01
ugcuuccaggcac

SEQ ID NO: 3409842 - RNA, 21 nt, Pseudomonas aeruginosa PA01
ugcuucgaacgugcgcgcaac

SEQ ID NO: 3409843 - RNA, 15 nt, Pseudomonas aeruginosa PA01
ugcuucggcagccuu

SEQ ID NO: 3409844 - RNA, 12 nt, Pseudomonas aeruginosa PA01
ugcuugaacacc

SEQ ID NO: 3409845 - RNA, 14 nt, Pseudomonas aeruginosa PA01
ugcuugaccuugcu

SEQ ID NO: 3409846 - RNA, 15 nt, Pseudomonas aeruginosa PA01
ugcuugacgaaggcg

SEQ ID NO: 3409847 - RNA, 16 nt, Pseudomonas aeruginosa PA01
ugcuugacgaaggcgg

SEQ ID NO: 3409848 - RNA, 15 nt, Pseudomonas aeruginosa PA01
ugcuugcacaccugg

SEQ ID NO: 3409849 - RNA, 17 nt, Pseudomonas aeruginosa PA01
ugcuugcgcuggccggc

SEQ ID NO: 3409850 - RNA, 14 nt, Pseudomonas aeruginosa PA01
ugcuuggccaggcg

SEQ ID NO: 3409851 - RNA, 16 nt, Pseudomonas aeruginosa PA01
ugcuuggcgcgcuggc

SEQ ID NO: 3409852 - RNA, 13 nt, Pseudomonas aeruginosa PA01
ugcuuggcggcgg

SEQ ID NO: 3409853 - RNA, 14 nt, Pseudomonas aeruginosa PA01
ugcuuggcggcggu

SEQ ID NO: 3409854 - RNA, 21 nt, Pseudomonas aeruginosa PA01
ugcuuggcggcgguguagucg

SEQ ID NO: 3409855 - RNA, 19 nt, Pseudomonas aeruginosa PA01
ugcuugucacgcucggcau

SEQ ID NO: 3409856 - RNA, 17 nt, Pseudomonas aeruginosa PA01
ugcuuucccugcugcgg

SEQ ID NO: 3409857 - RNA, 19 nt, Pseudomonas aeruginosa PA01
ugcuuuccggcccacgcuc

SEQ ID NO: 3409858 - RNA, 19 nt, Pseudomonas aeruginosa PA01
ugcuuuccugcuccagcag

SEQ ID NO: 3409859 - RNA, 16 nt, Pseudomonas aeruginosa PA01
ugcuuugcgccucgcg

SEQ ID NO: 3409860 - RNA, 16 nt, Pseudomonas aeruginosa PA01
ugcuuugggagcagga

SEQ ID NO: 3409861 - RNA, 14 nt, Pseudomonas aeruginosa PA01
ugcuuuugaacacc

SEQ ID NO: 3409862 - RNA, 15 nt, Pseudomonas aeruginosa PA01
ugcuuuugaacacca

SEQ ID NO: 3409863 - RNA, 24 nt, Pseudomonas aeruginosa PA01
uggaaaccccggccuggcgccggg

SEQ ID NO: 3409864 - RNA, 18 nt, Pseudomonas aeruginosa PA01
uggaaacgccagcccucg

SEQ ID NO: 3409865 - RNA, 19 nt, Pseudomonas aeruginosa PA01
uggaaaggccucggcgaug

SEQ ID NO: 3409866 - RNA, 16 nt, Pseudomonas aeruginosa PA01
uggaacaccaggccgc

SEQ ID NO: 3409867 - RNA, 16 nt, Pseudomonas aeruginosa PA01
uggaacagcagccagg

SEQ ID NO: 3409868 - RNA, 18 nt, Pseudomonas aeruginosa PA01
uggaacagcagccaggcg

SEQ ID NO: 3409869 - RNA, 17 nt, Pseudomonas aeruginosa PA01
uggaacagcaucagagg

SEQ ID NO: 3409870 - RNA, 18 nt, Pseudomonas aeruginosa PA01
uggaacagccgcagcggc

SEQ ID NO: 3409871 - RNA, 21 nt, Pseudomonas aeruginosa PA01
uggaacagccgcagcggcaug

SEQ ID NO: 3409872 - RNA, 22 nt, Pseudomonas aeruginosa PA01
uggaacagccgcagcggcaugc

SEQ ID NO: 3409873 - RNA, 20 nt, Pseudomonas aeruginosa PA01
uggaacccauggcgcgaugc

SEQ ID NO: 3409874 - RNA, 17 nt, Pseudomonas aeruginosa PA01
uggaaccgauggccagg

SEQ ID NO: 3409875 - RNA, 19 nt, Pseudomonas aeruginosa PA01
uggaaccgauggccagggg

SEQ ID NO: 3409876 - RNA, 17 nt, Pseudomonas aeruginosa PA01
uggaaccgcggcgcccu

SEQ ID NO: 3409877 - RNA, 14 nt, Pseudomonas aeruginosa PA01
uggaaccggccggc

SEQ ID NO: 3409878 - RNA, 20 nt, Pseudomonas aeruginosa PA01
uggaacgcaggggcaccggc

SEQ ID NO: 3409879 - RNA, 19 nt, Pseudomonas aeruginosa PA01
uggaacgcggguugcccgg

SEQ ID NO: 3409880 - RNA, 13 nt, Pseudomonas aeruginosa PA01
uggaacggccagg

SEQ ID NO: 3409881 - RNA, 19 nt, Pseudomonas aeruginosa PA01
uggaacuagcccucgaccu

SEQ ID NO: 3409882 - RNA, 15 nt, Pseudomonas aeruginosa PA01
uggaagaauggcgug

SEQ ID NO: 3409883 - RNA, 22 nt, Pseudomonas aeruginosa PA01
uggaagaggaucuccuggcgcg

SEQ ID NO: 3409884 - RNA, 17 nt, Pseudomonas aeruginosa PA01
uggaucggccccaccug

SEQ ID NO: 3409885 - RNA, 21 nt, Pseudomonas aeruginosa PA01
uggaucggccccaccuggcga

SEQ ID NO: 3409886 - RNA, 13 nt, Pseudomonas aeruginosa PA01
uggaucggcccuu

SEQ ID NO: 3409887 - RNA, 16 nt, Pseudomonas aeruginosa PA01
uggaucggcccuucga

SEQ ID NO: 3409888 - RNA, 12 nt, Pseudomonas aeruginosa PA01
uggaucucugcg

SEQ ID NO: 3409889 - RNA, 16 nt, Pseudomonas aeruginosa PA01
uggaugaaacgggcga

SEQ ID NO: 3409890 - RNA, 17 nt, Pseudomonas aeruginosa PA01
uggaugaacagcggaau

SEQ ID NO: 3409891 - RNA, 17 nt, Pseudomonas aeruginosa PA01
uggaugaccacgucgcg

SEQ ID NO: 3409892 - RNA, 19 nt, Pseudomonas aeruginosa PA01
uggaugcagccgauggcga

SEQ ID NO: 3409893 - RNA, 19 nt, Pseudomonas aeruginosa PA01
uggaugcagccggggcuca

SEQ ID NO: 3409894 - RNA, 19 nt, Pseudomonas aeruginosa PA01
uggaugccgguggcgccca

SEQ ID NO: 3409895 - RNA, 15 nt, Pseudomonas aeruginosa PA01
uggaugcgcggcagg

SEQ ID NO: 3409896 - RNA, 16 nt, Pseudomonas aeruginosa PA01
uggaugcgcggcaggu

SEQ ID NO: 3409897 - RNA, 14 nt, Pseudomonas aeruginosa PA01
uggauggugcccgg

SEQ ID NO: 3409898 - RNA, 18 nt, Pseudomonas aeruginosa PA01
uggaugucgcuggccagc

SEQ ID NO: 3409899 - RNA, 23 nt, Pseudomonas aeruginosa PA01
uggaugucguagacgcccggacc

SEQ ID NO: 3409900 - RNA, 13 nt, Pseudomonas aeruginosa PA01
uggaugugcuggu

SEQ ID NO: 3409901 - RNA, 16 nt, Pseudomonas aeruginosa PA01
uggauguucgccgcca

SEQ ID NO: 3409902 - RNA, 15 nt, Pseudomonas aeruginosa PA01
uggauguugccgccg

SEQ ID NO: 3409903 - RNA, 14 nt, Pseudomonas aeruginosa PA01
uggauucggccugc

SEQ ID NO: 3409904 - RNA, 18 nt, Pseudomonas aeruginosa PA01
uggauugcagcgucgacg

SEQ ID NO: 3409905 - RNA, 18 nt, Pseudomonas aeruginosa PA01
uggauuucagcaggccga

SEQ ID NO: 3409906 - RNA, 20 nt, Pseudomonas aeruginosa PA01
uggcaacccagggcgcugcc

SEQ ID NO: 3409907 - RNA, 18 nt, Pseudomonas aeruginosa PA01
uggcaaccgucgaacagg

SEQ ID NO: 3409908 - RNA, 23 nt, Pseudomonas aeruginosa PA01
uggcaaccgucgaacagguggcu

SEQ ID NO: 3409909 - RNA, 13 nt, Pseudomonas aeruginosa PA01
uggcaacggcggg

SEQ ID NO: 3409910 - RNA, 16 nt, Pseudomonas aeruginosa PA01
uggcaacugccgcccg

SEQ ID NO: 3409911 - RNA, 20 nt, Pseudomonas aeruginosa PA01
uggcaacugcguccgauguc

SEQ ID NO: 3409912 - RNA, 15 nt, Pseudomonas aeruginosa PA01
uggcacccaggccac

SEQ ID NO: 3409913 - RNA, 19 nt, Pseudomonas aeruginosa PA01
uggcacccuggacccgggc

SEQ ID NO: 3409914 - RNA, 21 nt, Pseudomonas aeruginosa PA01
uggcacccuggacccgggccu

SEQ ID NO: 3409915 - RNA, 13 nt, Pseudomonas aeruginosa PA01
uggcaccgcgcag

SEQ ID NO: 3409916 - RNA, 14 nt, Pseudomonas aeruginosa PA01
uggcaccgcuucug

SEQ ID NO: 3409917 - RNA, 16 nt, Pseudomonas aeruginosa PA01
uggcacgaacccaggc

SEQ ID NO: 3409918 - RNA, 17 nt, Pseudomonas aeruginosa PA01
uggcacgaacccaggcg

SEQ ID NO: 3409919 - RNA, 19 nt, Pseudomonas aeruginosa PA01
uggcacgaacccaggcgcu

SEQ ID NO: 3409920 - RNA, 21 nt, Pseudomonas aeruginosa PA01
uggcacgaacccaggcgcugc

SEQ ID NO: 3409921 - RNA, 13 nt, Pseudomonas aeruginosa PA01
uggcacgcagggc

SEQ ID NO: 3409922 - RNA, 23 nt, Pseudomonas aeruginosa PA01
uggcagagcuggaagucguccag

SEQ ID NO: 3409923 - RNA, 15 nt, Pseudomonas aeruginosa PA01
uggcagccuuggcca

SEQ ID NO: 3409924 - RNA, 12 nt, Pseudomonas aeruginosa PA01
uggcagcgccgu

SEQ ID NO: 3409925 - RNA, 16 nt, Pseudomonas aeruginosa PA01
uggcagcgccguugcc

SEQ ID NO: 3409926 - RNA, 23 nt, Pseudomonas aeruginosa PA01
uggcagcgccguugccgaugccg

SEQ ID NO: 3409927 - RNA, 17 nt, Pseudomonas aeruginosa PA01
uggcagcucugcgacug

SEQ ID NO: 3409928 - RNA, 23 nt, Pseudomonas aeruginosa PA01
uggcaggaaaugccuggcuacgc

SEQ ID NO: 3409929 - RNA, 13 nt, Pseudomonas aeruginosa PA01
uggcaggcgcccg

SEQ ID NO: 3409930 - RNA, 13 nt, Pseudomonas aeruginosa PA01
uggcaggcgcugc

SEQ ID NO: 3409931 - RNA, 19 nt, Pseudomonas aeruginosa PA01
uggcaggcgcugcagccac

SEQ ID NO: 3409932 - RNA, 17 nt, Pseudomonas aeruginosa PA01
uggcaggcucaccgcgu

SEQ ID NO: 3409933 - RNA, 21 nt, Pseudomonas aeruginosa PA01
uggcagggcgcguccagcucc

SEQ ID NO: 3409934 - RNA, 23 nt, Pseudomonas aeruginosa PA01
uggcagggcgcguccagcuccac

SEQ ID NO: 3409935 - RNA, 22 nt, Pseudomonas aeruginosa PA01
uggcagguaucgcugggcgccu

SEQ ID NO: 3409936 - RNA, 20 nt, Pseudomonas aeruginosa PA01
uggcaggugacgcagggcgg

SEQ ID NO: 3409937 - RNA, 21 nt, Pseudomonas aeruginosa PA01
uggcagguugauccugggcgc

SEQ ID NO: 3409938 - RNA, 16 nt, Pseudomonas aeruginosa PA01
uggcagguugcacggc

SEQ ID NO: 3409939 - RNA, 20 nt, Pseudomonas aeruginosa PA01
uggcagguugcacggccggu

SEQ ID NO: 3409940 - RNA, 17 nt, Pseudomonas aeruginosa PA01
uggcauaaccggaagcg

SEQ ID NO: 3409941 - RNA, 14 nt, Pseudomonas aeruginosa PA01
uggcaucgccgccc

SEQ ID NO: 3409942 - RNA, 19 nt, Pseudomonas aeruginosa PA01
uggcauggcuuuccaggcg

SEQ ID NO: 3409943 - RNA, 18 nt, Pseudomonas aeruginosa PA01
uggcaugguguccggcgg

SEQ ID NO: 3409944 - RNA, 17 nt, Pseudomonas aeruginosa PA01
uggcauucgucgccgcu

SEQ ID NO: 3409945 - RNA, 14 nt, Pseudomonas aeruginosa PA01
uggccaccagcacc

SEQ ID NO: 3409946 - RNA, 14 nt, Pseudomonas aeruginosa PA01
uggccacccuugcg

SEQ ID NO: 3409947 - RNA, 20 nt, Pseudomonas aeruginosa PA01
uggccacccuugcgcccggc

SEQ ID NO: 3409948 - RNA, 21 nt, Pseudomonas aeruginosa PA01
uggccacccuuggagccgccc

SEQ ID NO: 3409949 - RNA, 22 nt, Pseudomonas aeruginosa PA01
uggccacccuuggagccgcccu

SEQ ID NO: 3409950 - RNA, 20 nt, Pseudomonas aeruginosa PA01
uggccaccgaaucggacagg

SEQ ID NO: 3409951 - RNA, 15 nt, Pseudomonas aeruginosa PA01
uggccaccgccagga

SEQ ID NO: 3409952 - RNA, 21 nt, Pseudomonas aeruginosa PA01
uggccaccgccaggaccucga

SEQ ID NO: 3409953 - RNA, 14 nt, Pseudomonas aeruginosa PA01
uggccaccgucgga

SEQ ID NO: 3409954 - RNA, 22 nt, Pseudomonas aeruginosa PA01
uggccacgacccugcuggccgg

SEQ ID NO: 3409955 - RNA, 18 nt, Pseudomonas aeruginosa PA01
uggccacguccagcggca

SEQ ID NO: 3409956 - RNA, 17 nt, Pseudomonas aeruginosa PA01
uggccacgucgccccag

SEQ ID NO: 3409957 - RNA, 18 nt, Pseudomonas aeruginosa PA01
uggccacgucgccccagg

SEQ ID NO: 3409958 - RNA, 16 nt, Pseudomonas aeruginosa PA01
uggccagaaggucggg

SEQ ID NO: 3409959 - RNA, 18 nt, Pseudomonas aeruginosa PA01
uggccagaauuccagcag

SEQ ID NO: 3409960 - RNA, 19 nt, Pseudomonas aeruginosa PA01
uggccagaauuccagcagg

SEQ ID NO: 3409961 - RNA, 22 nt, Pseudomonas aeruginosa PA01
uggccagaauuccagcaggucg

SEQ ID NO: 3409962 - RNA, 22 nt, Pseudomonas aeruginosa PA01
uggccagcaauacccgccgcug

SEQ ID NO: 3409963 - RNA, 21 nt, Pseudomonas aeruginosa PA01
uggccagcaccagucccuggc

SEQ ID NO: 3409964 - RNA, 15 nt, Pseudomonas aeruginosa PA01
uggccagcaccaugc

SEQ ID NO: 3409965 - RNA, 23 nt, Pseudomonas aeruginosa PA01
uggccagcaccaugcgcggcagg

SEQ ID NO: 3409966 - RNA, 14 nt, Pseudomonas aeruginosa PA01
uggccagcagcauc

SEQ ID NO: 3409967 - RNA, 21 nt, Pseudomonas aeruginosa PA01
uggccagcagcaucggaccgg

SEQ ID NO: 3409968 - RNA, 18 nt, Pseudomonas aeruginosa PA01
uggccagcagccaggccu

SEQ ID NO: 3409969 - RNA, 15 nt, Pseudomonas aeruginosa PA01
uggccagcccggagc

SEQ ID NO: 3409970 - RNA, 19 nt, Pseudomonas aeruginosa PA01
uggccagccgcgcggcaua

SEQ ID NO: 3409971 - RNA, 13 nt, Pseudomonas aeruginosa PA01
uggccagcgccac

SEQ ID NO: 3409972 - RNA, 14 nt, Pseudomonas aeruginosa PA01
uggccagcgccacc

SEQ ID NO: 3409973 - RNA, 17 nt, Pseudomonas aeruginosa PA01
uggccagcgccaccagc

SEQ ID NO: 3409974 - RNA, 13 nt, Pseudomonas aeruginosa PA01
uggccagcgccca

SEQ ID NO: 3409975 - RNA, 16 nt, Pseudomonas aeruginosa PA01
uggccagcgcccaggc

SEQ ID NO: 3409976 - RNA, 19 nt, Pseudomonas aeruginosa PA01
uggccagcgcccaggccgg

SEQ ID NO: 3409977 - RNA, 12 nt, Pseudomonas aeruginosa PA01
uggccagcgcgg

SEQ ID NO: 3409978 - RNA, 14 nt, Pseudomonas aeruginosa PA01
uggccagcgcggcg

SEQ ID NO: 3409979 - RNA, 17 nt, Pseudomonas aeruginosa PA01
uggccagcgcggugcgc

SEQ ID NO: 3409980 - RNA, 18 nt, Pseudomonas aeruginosa PA01
uggccagcgcggugcgcg

SEQ ID NO: 3409981 - RNA, 19 nt, Pseudomonas aeruginosa PA01
uggccagcgcggugcgcgc

SEQ ID NO: 3409982 - RNA, 15 nt, Pseudomonas aeruginosa PA01
uggccagcgcuucca

SEQ ID NO: 3409983 - RNA, 18 nt, Pseudomonas aeruginosa PA01
uggccagcgcuuccaccg

SEQ ID NO: 3409984 - RNA, 15 nt, Pseudomonas aeruginosa PA01
uggccagcucgaccu

SEQ ID NO: 3409985 - RNA, 17 nt, Pseudomonas aeruginosa PA01
uggccagcucgaccuug

SEQ ID NO: 3409986 - RNA, 16 nt, Pseudomonas aeruginosa PA01
uggccgcccaguucgc

SEQ ID NO: 3409987 - RNA, 14 nt, Pseudomonas aeruginosa PA01
uggccgcccaucga

SEQ ID NO: 3409988 - RNA, 13 nt, Pseudomonas aeruginosa PA01
uggccgcccuugc

SEQ ID NO: 3409989 - RNA, 21 nt, Pseudomonas aeruginosa PA01
uggccgcccuugcggcccgcc

SEQ ID NO: 3409990 - RNA, 22 nt, Pseudomonas aeruginosa PA01
uggccgccgccgccgucgacuu

SEQ ID NO: 3409991 - RNA, 20 nt, Pseudomonas aeruginosa PA01
uggccgccucgcgccgcgcc

SEQ ID NO: 3409992 - RNA, 23 nt, Pseudomonas aeruginosa PA01
uggccgccucgcgccgcgccagc

SEQ ID NO: 3409993 - RNA, 20 nt, Pseudomonas aeruginosa PA01
uggccgccugcucggccugc

SEQ ID NO: 3409994 - RNA, 18 nt, Pseudomonas aeruginosa PA01
uggccgcgaaccgggucg

SEQ ID NO: 3409995 - RNA, 18 nt, Pseudomonas aeruginosa PA01
uggccgcgcaggaagaag

SEQ ID NO: 3409996 - RNA, 13 nt, Pseudomonas aeruginosa PA01
uggccgcgcccca

SEQ ID NO: 3409997 - RNA, 18 nt, Pseudomonas aeruginosa PA01
uggccgcgccccacggcg

SEQ ID NO: 3409998 - RNA, 19 nt, Pseudomonas aeruginosa PA01
uggccgcgccccacggcgc

SEQ ID NO: 3409999 - RNA, 12 nt, Pseudomonas aeruginosa PA01
uggccgcgccgc

SEQ ID NO: 3410000 - RNA, 13 nt, Pseudomonas aeruginosa PA01
uggccgcgccgcc

SEQ ID NO: 3410001 - RNA, 14 nt, Pseudomonas aeruginosa PA01
uggccgcgccgccc

SEQ ID NO: 3410002 - RNA, 17 nt, Pseudomonas aeruginosa PA01
uggccgcgccgcccugg

SEQ ID NO: 3410003 - RNA, 18 nt, Pseudomonas aeruginosa PA01
uggccgcgccgcccuggc

SEQ ID NO: 3410004 - RNA, 21 nt, Pseudomonas aeruginosa PA01
uggccgcgccgcccuggccgc

SEQ ID NO: 3410005 - RNA, 19 nt, Pseudomonas aeruginosa PA01
uggccgcgcgaccgcggcg

SEQ ID NO: 3410006 - RNA, 18 nt, Pseudomonas aeruginosa PA01
uggccgcgcggcuugccg

SEQ ID NO: 3410007 - RNA, 22 nt, Pseudomonas aeruginosa PA01
uggccgcgggaggccgccucga

SEQ ID NO: 3410008 - RNA, 22 nt, Pseudomonas aeruginosa PA01
uggccgcggugggcuccagcgg

SEQ ID NO: 3410009 - RNA, 23 nt, Pseudomonas aeruginosa PA01
uggccgcguaccaguagcgacag

SEQ ID NO: 3410010 - RNA, 16 nt, Pseudomonas aeruginosa PA01
uggccgcguucgccga

SEQ ID NO: 3410011 - RNA, 16 nt, Pseudomonas aeruginosa PA01
uggccgcuacgcggcg

SEQ ID NO: 3410012 - RNA, 13 nt, Pseudomonas aeruginosa PA01
uggccgcugaaau

SEQ ID NO: 3410013 - RNA, 16 nt, Pseudomonas aeruginosa PA01
uggccgcugagcagca

SEQ ID NO: 3410014 - RNA, 18 nt, Pseudomonas aeruginosa PA01
uggccgcuucaagcggcc

SEQ ID NO: 3410015 - RNA, 13 nt, Pseudomonas aeruginosa PA01
uggccggaaaaag

SEQ ID NO: 3410016 - RNA, 24 nt, Pseudomonas aeruginosa PA01
uggccggaaaaagcaccgacacgc

SEQ ID NO: 3410017 - RNA, 15 nt, Pseudomonas aeruginosa PA01
uggccggcaccagca

SEQ ID NO: 3410018 - RNA, 23 nt, Pseudomonas aeruginosa PA01
uggccggcacccugaccgcgagc

SEQ ID NO: 3410019 - RNA, 24 nt, Pseudomonas aeruginosa PA01
uggccggcacccugaccgcgagcg

SEQ ID NO: 3410020 - RNA, 13 nt, Pseudomonas aeruginosa PA01
uggccggcagcag

SEQ ID NO: 3410021 - RNA, 18 nt, Pseudomonas aeruginosa PA01
uggccggcagcagcgcca

SEQ ID NO: 3410022 - RNA, 12 nt, Pseudomonas aeruginosa PA01
uggccggccagc

SEQ ID NO: 3410023 - RNA, 17 nt, Pseudomonas aeruginosa PA01
uggccggccucggcggc

SEQ ID NO: 3410024 - RNA, 20 nt, Pseudomonas aeruginosa PA01
uggccggccucggcggcgcg

SEQ ID NO: 3410025 - RNA, 15 nt, Pseudomonas aeruginosa PA01
uggccggcgaccagc

SEQ ID NO: 3410026 - RNA, 15 nt, Pseudomonas aeruginosa PA01
uggccggcgauggcc

SEQ ID NO: 3410027 - RNA, 20 nt, Pseudomonas aeruginosa PA01
uggccggcgauggccgccug

SEQ ID NO: 3410028 - RNA, 21 nt, Pseudomonas aeruginosa PA01
uggccggcgauggccgccugc

SEQ ID NO: 3410029 - RNA, 15 nt, Pseudomonas aeruginosa PA01
uggccggcgcggacg

SEQ ID NO: 3410030 - RNA, 22 nt, Pseudomonas aeruginosa PA01
uggccggcgcggacgauggucg

SEQ ID NO: 3410031 - RNA, 14 nt, Pseudomonas aeruginosa PA01
uggccggcgcggcg

SEQ ID NO: 3410032 - RNA, 18 nt, Pseudomonas aeruginosa PA01
uggccggcgcggcguuca

SEQ ID NO: 3410033 - RNA, 18 nt, Pseudomonas aeruginosa PA01
uggccggcgggcgcgagg

SEQ ID NO: 3410034 - RNA, 19 nt, Pseudomonas aeruginosa PA01
uggccggcgggcgcgaggc

SEQ ID NO: 3410035 - RNA, 13 nt, Pseudomonas aeruginosa PA01
uggccggcugcuc

SEQ ID NO: 3410036 - RNA, 16 nt, Pseudomonas aeruginosa PA01
uggccgggaaccagca

SEQ ID NO: 3410037 - RNA, 22 nt, Pseudomonas aeruginosa PA01
uggccgggaaccagcauguccu

SEQ ID NO: 3410038 - RNA, 16 nt, Pseudomonas aeruginosa PA01
uggccgggccgaugcg

SEQ ID NO: 3410039 - RNA, 20 nt, Pseudomonas aeruginosa PA01
uggccggucguucgcccuuc

SEQ ID NO: 3410040 - RNA, 17 nt, Pseudomonas aeruginosa PA01
uggccggugccauacag

SEQ ID NO: 3410041 - RNA, 22 nt, Pseudomonas aeruginosa PA01
uggccggugugcgacuggggca

SEQ ID NO: 3410042 - RNA, 18 nt, Pseudomonas aeruginosa PA01
uggccguagccggugccg

SEQ ID NO: 3410043 - RNA, 16 nt, Pseudomonas aeruginosa PA01
uggccguccaggcugc

SEQ ID NO: 3410044 - RNA, 14 nt, Pseudomonas aeruginosa PA01
uggccgucccugac

SEQ ID NO: 3410045 - RNA, 16 nt, Pseudomonas aeruginosa PA01
uggccgucccugacca

SEQ ID NO: 3410046 - RNA, 18 nt, Pseudomonas aeruginosa PA01
uggccgucccugaccagc

SEQ ID NO: 3410047 - RNA, 14 nt, Pseudomonas aeruginosa PA01
uggccguccucguc

SEQ ID NO: 3410048 - RNA, 13 nt, Pseudomonas aeruginosa PA01
uggccgucgaagg

SEQ ID NO: 3410049 - RNA, 16 nt, Pseudomonas aeruginosa PA01
uggccgucgacccgcc

SEQ ID NO: 3410050 - RNA, 14 nt, Pseudomonas aeruginosa PA01
uggccgucgcgccg

SEQ ID NO: 3410051 - RNA, 16 nt, Pseudomonas aeruginosa PA01
uggccgucuccaggcg

SEQ ID NO: 3410052 - RNA, 18 nt, Pseudomonas aeruginosa PA01
uggccgucuccaggcgcg

SEQ ID NO: 3410053 - RNA, 19 nt, Pseudomonas aeruginosa PA01
uggccgucuccaggcgcgc

SEQ ID NO: 3410054 - RNA, 22 nt, Pseudomonas aeruginosa PA01
uggccgucuccaggcgcgccgu

SEQ ID NO: 3410055 - RNA, 17 nt, Pseudomonas aeruginosa PA01
uggccgucuuccagggc

SEQ ID NO: 3410056 - RNA, 18 nt, Pseudomonas aeruginosa PA01
uggccgucuuccagggcg

SEQ ID NO: 3410057 - RNA, 20 nt, Pseudomonas aeruginosa PA01
uggccgucuuccagggcggc

SEQ ID NO: 3410058 - RNA, 16 nt, Pseudomonas aeruginosa PA01
uggccgugcagcccuc

SEQ ID NO: 3410059 - RNA, 22 nt, Pseudomonas aeruginosa PA01
uggccgugcucgaugaucgacu

SEQ ID NO: 3410060 - RNA, 20 nt, Pseudomonas aeruginosa PA01
uggccguggcgccccaggcg

SEQ ID NO: 3410061 - RNA, 22 nt, Pseudomonas aeruginosa PA01
uggccguggcgccccaggcggg

SEQ ID NO: 3410062 - RNA, 17 nt, Pseudomonas aeruginosa PA01
uggccguucuccagguc

SEQ ID NO: 3410063 - RNA, 18 nt, Pseudomonas aeruginosa PA01
uggccguucuccaggucg

SEQ ID NO: 3410064 - RNA, 19 nt, Pseudomonas aeruginosa PA01
uggccguugagcaccucga

SEQ ID NO: 3410065 - RNA, 21 nt, Pseudomonas aeruginosa PA01
uggccguugagcaccucgacc

SEQ ID NO: 3410066 - RNA, 16 nt, Pseudomonas aeruginosa PA01
uggccguuggcgaacu

SEQ ID NO: 3410067 - RNA, 18 nt, Pseudomonas aeruginosa PA01
uggccuccacccgcgaag

SEQ ID NO: 3410068 - RNA, 13 nt, Pseudomonas aeruginosa PA01
uggccucggcguc

SEQ ID NO: 3410069 - RNA, 23 nt, Pseudomonas aeruginosa PA01
uggccugcagcaggucgagcagu

SEQ ID NO: 3410070 - RNA, 23 nt, Pseudomonas aeruginosa PA01
uggccugccgaugggccuucagg

SEQ ID NO: 3410071 - RNA, 17 nt, Pseudomonas aeruginosa PA01
uggccuggcccggcgca

SEQ ID NO: 3410072 - RNA, 12 nt, Pseudomonas aeruginosa PA01
uggccuggcgcu

SEQ ID NO: 3410073 - RNA, 14 nt, Pseudomonas aeruginosa PA01
uggccuggcgcuca

SEQ ID NO: 3410074 - RNA, 20 nt, Pseudomonas aeruginosa PA01
uggccuggcgcucagcgccg

SEQ ID NO: 3410075 - RNA, 17 nt, Pseudomonas aeruginosa PA01
uggccuggucggcgcgg

SEQ ID NO: 3410076 - RNA, 18 nt, Pseudomonas aeruginosa PA01
uggccuggucggcgcggc

SEQ ID NO: 3410077 - RNA, 20 nt, Pseudomonas aeruginosa PA01
uggccuugauggugaccggc

SEQ ID NO: 3410078 - RNA, 14 nt, Pseudomonas aeruginosa PA01
uggccuuggccacg

SEQ ID NO: 3410079 - RNA, 15 nt, Pseudomonas aeruginosa PA01
uggccuuggccacga

SEQ ID NO: 3410080 - RNA, 17 nt, Pseudomonas aeruginosa PA01
uggccuuggccacgacc

SEQ ID NO: 3410081 - RNA, 18 nt, Pseudomonas aeruginosa PA01
uggcgaaacuccagcagg

SEQ ID NO: 3410082 - RNA, 22 nt, Pseudomonas aeruginosa PA01
uggcgaaauugccuccgcucug

SEQ ID NO: 3410083 - RNA, 19 nt, Pseudomonas aeruginosa PA01
uggcgaacaaucggucgcc

SEQ ID NO: 3410084 - RNA, 22 nt, Pseudomonas aeruginosa PA01
uggcgaacaugaagccgcgcgc

SEQ ID NO: 3410085 - RNA, 17 nt, Pseudomonas aeruginosa PA01
uggcgaaccaguccagc

SEQ ID NO: 3410086 - RNA, 19 nt, Pseudomonas aeruginosa PA01
uggcgaaccaguccagcac

SEQ ID NO: 3410087 - RNA, 18 nt, Pseudomonas aeruginosa PA01
uggcgaacggcuggucgg

SEQ ID NO: 3410088 - RNA, 21 nt, Pseudomonas aeruginosa PA01
uggcgccucgcaaaggucggc

SEQ ID NO: 3410089 - RNA, 17 nt, Pseudomonas aeruginosa PA01
uggcgccuucggcgaca

SEQ ID NO: 3410090 - RNA, 13 nt, Pseudomonas aeruginosa PA01
uggcgcgaccgcc

SEQ ID NO: 3410091 - RNA, 18 nt, Pseudomonas aeruginosa PA01
uggcgcgacgaggcgcgg

SEQ ID NO: 3410092 - RNA, 20 nt, Pseudomonas aeruginosa PA01
uggcgcgacgaggcgcggcg

SEQ ID NO: 3410093 - RNA, 17 nt, Pseudomonas aeruginosa PA01
uggcgcgagaagccagc

SEQ ID NO: 3410094 - RNA, 21 nt, Pseudomonas aeruginosa PA01
uggcgcgagaagccagccagg

SEQ ID NO: 3410095 - RNA, 18 nt, Pseudomonas aeruginosa PA01
uggcgcgauccgcgcggc

SEQ ID NO: 3410096 - RNA, 21 nt, Pseudomonas aeruginosa PA01
uggcgcgauccgcgcggcaac

SEQ ID NO: 3410097 - RNA, 14 nt, Pseudomonas aeruginosa PA01
uggcgcgaugcucc

SEQ ID NO: 3410098 - RNA, 19 nt, Pseudomonas aeruginosa PA01
uggcgcgaugcucccgagc

SEQ ID NO: 3410099 - RNA, 19 nt, Pseudomonas aeruginosa PA01
uggcgcgcaaaaaaagggg

SEQ ID NO: 3410100 - RNA, 14 nt, Pseudomonas aeruginosa PA01
uggcgcgcaccacc

SEQ ID NO: 3410101 - RNA, 21 nt, Pseudomonas aeruginosa PA01
uggcgcgcaucggugccggca

SEQ ID NO: 3410102 - RNA, 11 nt, Pseudomonas aeruginosa PA01
uggcgcgccuc

SEQ ID NO: 3410103 - RNA, 13 nt, Pseudomonas aeruginosa PA01
uggcgcgcgacag

SEQ ID NO: 3410104 - RNA, 14 nt, Pseudomonas aeruginosa PA01
uggcgcgcgcccuu

SEQ ID NO: 3410105 - RNA, 17 nt, Pseudomonas aeruginosa PA01
uggcgcgcgcgccaggu

SEQ ID NO: 3410106 - RNA, 18 nt, Pseudomonas aeruginosa PA01
uggcgcgcgcgccagguc

SEQ ID NO: 3410107 - RNA, 17 nt, Pseudomonas aeruginosa PA01
uggcgcgcgcgcugcca

SEQ ID NO: 3410108 - RNA, 16 nt, Pseudomonas aeruginosa PA01
uggcgcgcggccgcgu

SEQ ID NO: 3410109 - RNA, 15 nt, Pseudomonas aeruginosa PA01
uggcgcgcgggccuu

SEQ ID NO: 3410110 - RNA, 12 nt, Pseudomonas aeruginosa PA01
uggcgcgcugcg

SEQ ID NO: 3410111 - RNA, 14 nt, Pseudomonas aeruginosa PA01
uggcgcgcugcggc

SEQ ID NO: 3410112 - RNA, 13 nt, Pseudomonas aeruginosa PA01
uggcgcgcuggca

SEQ ID NO: 3410113 - RNA, 16 nt, Pseudomonas aeruginosa PA01
uggcgcgcuuuccggc

SEQ ID NO: 3410114 - RNA, 17 nt, Pseudomonas aeruginosa PA01
uggcgcgcuuuccggcg

SEQ ID NO: 3410115 - RNA, 19 nt, Pseudomonas aeruginosa PA01
uggcgcggacgggccgcgc

SEQ ID NO: 3410116 - RNA, 22 nt, Pseudomonas aeruginosa PA01
uggcgcggaugucgggcucgac

SEQ ID NO: 3410117 - RNA, 15 nt, Pseudomonas aeruginosa PA01
uggcgcggcugaucg

SEQ ID NO: 3410118 - RNA, 22 nt, Pseudomonas aeruginosa PA01
uggcgcggcugaucggccgcca

SEQ ID NO: 3410119 - RNA, 19 nt, Pseudomonas aeruginosa PA01
uggcgcgggcgaaggccuc

SEQ ID NO: 3410120 - RNA, 17 nt, Pseudomonas aeruginosa PA01
uggcgcggggccccggc

SEQ ID NO: 3410121 - RNA, 22 nt, Pseudomonas aeruginosa PA01
uggcgcguacgcccgcagccac

SEQ ID NO: 3410122 - RNA, 16 nt, Pseudomonas aeruginosa PA01
uggcgcgucaugccgc

SEQ ID NO: 3410123 - RNA, 16 nt, Pseudomonas aeruginosa PA01
uggcgcgucgcugccg

SEQ ID NO: 3410124 - RNA, 18 nt, Pseudomonas aeruginosa PA01
uggcgcguugugccgcca

SEQ ID NO: 3410125 - RNA, 18 nt, Pseudomonas aeruginosa PA01
uggcgcuaccgcgcaugg

SEQ ID NO: 3410126 - RNA, 17 nt, Pseudomonas aeruginosa PA01
uggcgcucacgcucgac

SEQ ID NO: 3410127 - RNA, 13 nt, Pseudomonas aeruginosa PA01
uggcgcuccaggg

SEQ ID NO: 3410128 - RNA, 14 nt, Pseudomonas aeruginosa PA01
uggcgcucgccgug

SEQ ID NO: 3410129 - RNA, 17 nt, Pseudomonas aeruginosa PA01
uggcgcucgccguggga

SEQ ID NO: 3410130 - RNA, 14 nt, Pseudomonas aeruginosa PA01
uggcgcucggccac

SEQ ID NO: 3410131 - RNA, 21 nt, Pseudomonas aeruginosa PA01
uggcgcucucgaacaccaggc

SEQ ID NO: 3410132 - RNA, 17 nt, Pseudomonas aeruginosa PA01
uggcgcucugcagugug

SEQ ID NO: 3410133 - RNA, 20 nt, Pseudomonas aeruginosa PA01
uggcgcugaacaagcccugg

SEQ ID NO: 3410134 - RNA, 16 nt, Pseudomonas aeruginosa PA01
uggcgcugaccgcucc

SEQ ID NO: 3410135 - RNA, 18 nt, Pseudomonas aeruginosa PA01
uggcgcugaccgcuccca

SEQ ID NO: 3410136 - RNA, 20 nt, Pseudomonas aeruginosa PA01
uggcgcugaggaagagcagc

SEQ ID NO: 3410137 - RNA, 23 nt, Pseudomonas aeruginosa PA01
uggcgcugaggaagagcagcgcg

SEQ ID NO: 3410138 - RNA, 16 nt, Pseudomonas aeruginosa PA01
uggcgcugccaaacgc

SEQ ID NO: 3410139 - RNA, 12 nt, Pseudomonas aeruginosa PA01
uggcgcuggcca

SEQ ID NO: 3410140 - RNA, 16 nt, Pseudomonas aeruginosa PA01
uggcgcuguaggcgag

SEQ ID NO: 3410141 - RNA, 22 nt, Pseudomonas aeruginosa PA01
uggcgcuguaggcgagcagcgg

SEQ ID NO: 3410142 - RNA, 16 nt, Pseudomonas aeruginosa PA01
uggcgcuucguugcga

SEQ ID NO: 3410143 - RNA, 15 nt, Pseudomonas aeruginosa PA01
uggcgcuugagcagc

SEQ ID NO: 3410144 - RNA, 17 nt, Pseudomonas aeruginosa PA01
uggcgcuugagcagcca

SEQ ID NO: 3410145 - RNA, 20 nt, Pseudomonas aeruginosa PA01
uggcgcuugagcagccaggc

SEQ ID NO: 3410146 - RNA, 18 nt, Pseudomonas aeruginosa PA01
uggcgcuugccgcgcccg

SEQ ID NO: 3410147 - RNA, 19 nt, Pseudomonas aeruginosa PA01
uggcgcuugccgcgcccgg

SEQ ID NO: 3410148 - RNA, 20 nt, Pseudomonas aeruginosa PA01
uggcgcuugccgcgcccggc

SEQ ID NO: 3410149 - RNA, 15 nt, Pseudomonas aeruginosa PA01
uggcgcuugcgcagc

SEQ ID NO: 3410150 - RNA, 15 nt, Pseudomonas aeruginosa PA01
uggcgcuugggcgcg

SEQ ID NO: 3410151 - RNA, 17 nt, Pseudomonas aeruginosa PA01
uggcggaaaagcccgcu

SEQ ID NO: 3410152 - RNA, 19 nt, Pseudomonas aeruginosa PA01
uggcggaagaaucgcagcc

SEQ ID NO: 3410153 - RNA, 19 nt, Pseudomonas aeruginosa PA01
uggcggaaggucagguagg

SEQ ID NO: 3410154 - RNA, 16 nt, Pseudomonas aeruginosa PA01
uggcggaaggugccuu

SEQ ID NO: 3410155 - RNA, 22 nt, Pseudomonas aeruginosa PA01
uggcggacaacccggcgcuggc

SEQ ID NO: 3410156 - RNA, 22 nt, Pseudomonas aeruginosa PA01
uggcggacugguaggacagggc

SEQ ID NO: 3410157 - RNA, 20 nt, Pseudomonas aeruginosa PA01
uggcggauaaccgcaagcgg

SEQ ID NO: 3410158 - RNA, 18 nt, Pseudomonas aeruginosa PA01
uggcggauagccgcaagc

SEQ ID NO: 3410159 - RNA, 14 nt, Pseudomonas aeruginosa PA01
uggcggaucugcuc

SEQ ID NO: 3410160 - RNA, 23 nt, Pseudomonas aeruginosa PA01
uggcggaucuggaauucgccgcg

SEQ ID NO: 3410161 - RNA, 18 nt, Pseudomonas aeruginosa PA01
uggcggauguaguccagc

SEQ ID NO: 3410162 - RNA, 21 nt, Pseudomonas aeruginosa PA01
uggcggauguaguccagcgcc

SEQ ID NO: 3410163 - RNA, 23 nt, Pseudomonas aeruginosa PA01
uggcggauguaguccagcgccgc

SEQ ID NO: 3410164 - RNA, 16 nt, Pseudomonas aeruginosa PA01
uggcggcaucggcgcc

SEQ ID NO: 3410165 - RNA, 13 nt, Pseudomonas aeruginosa PA01
uggcggcaugccg

SEQ ID NO: 3410166 - RNA, 22 nt, Pseudomonas aeruginosa PA01
uggcggcaugccguugggccag

SEQ ID NO: 3410167 - RNA, 13 nt, Pseudomonas aeruginosa PA01
uggcggcauugag

SEQ ID NO: 3410168 - RNA, 19 nt, Pseudomonas aeruginosa PA01
uggcggcauugagcgccag

SEQ ID NO: 3410169 - RNA, 23 nt, Pseudomonas aeruginosa PA01
uggcggcauugagcgccagcagg

SEQ ID NO: 3410170 - RNA, 14 nt, Pseudomonas aeruginosa PA01
uggcggccagggca

SEQ ID NO: 3410171 - RNA, 17 nt, Pseudomonas aeruginosa PA01
uggcggccagggcaugg

SEQ ID NO: 3410172 - RNA, 15 nt, Pseudomonas aeruginosa PA01
uggcggccaucaggc

SEQ ID NO: 3410173 - RNA, 16 nt, Pseudomonas aeruginosa PA01
uggcggccaucaggcg

SEQ ID NO: 3410174 - RNA, 13 nt, Pseudomonas aeruginosa PA01
uggcggccgccgc

SEQ ID NO: 3410175 - RNA, 23 nt, Pseudomonas aeruginosa PA01
uggcggcgacgaaggucggcggc

SEQ ID NO: 3410176 - RNA, 17 nt, Pseudomonas aeruginosa PA01
uggcggcgaucgccccg

SEQ ID NO: 3410177 - RNA, 13 nt, Pseudomonas aeruginosa PA01
uggcggcgcgcgu

SEQ ID NO: 3410178 - RNA, 16 nt, Pseudomonas aeruginosa PA01
uggcggcguggcaccg

SEQ ID NO: 3410179 - RNA, 13 nt, Pseudomonas aeruginosa PA01
uggcggcucggcu

SEQ ID NO: 3410180 - RNA, 12 nt, Pseudomonas aeruginosa PA01
uggcggcugaag

SEQ ID NO: 3410181 - RNA, 12 nt, Pseudomonas aeruginosa PA01
uggcgggccagc

SEQ ID NO: 3410182 - RNA, 16 nt, Pseudomonas aeruginosa PA01
uggcgggccagcaggc

SEQ ID NO: 3410183 - RNA, 19 nt, Pseudomonas aeruginosa PA01
uggcgggccagcaggcgcu

SEQ ID NO: 3410184 - RNA, 14 nt, Pseudomonas aeruginosa PA01
uggcgggcggcccc

SEQ ID NO: 3410185 - RNA, 20 nt, Pseudomonas aeruginosa PA01
uggcgggcucuaugcgcggg

SEQ ID NO: 3410186 - RNA, 15 nt, Pseudomonas aeruginosa PA01
uggcggggucgcgcc

SEQ ID NO: 3410187 - RNA, 17 nt, Pseudomonas aeruginosa PA01
uggcggggucgcgccgg

SEQ ID NO: 3410188 - RNA, 14 nt, Pseudomonas aeruginosa PA01
uggcgggucggcgg

SEQ ID NO: 3410189 - RNA, 17 nt, Pseudomonas aeruginosa PA01
uggcgguacgcugcaug

SEQ ID NO: 3410190 - RNA, 15 nt, Pseudomonas aeruginosa PA01
uggcgguagcccggc

SEQ ID NO: 3410191 - RNA, 18 nt, Pseudomonas aeruginosa PA01
ugggaugccgggccgagg

SEQ ID NO: 3410192 - RNA, 13 nt, Pseudomonas aeruginosa PA01
ugggauggccagc

SEQ ID NO: 3410193 - RNA, 18 nt, Pseudomonas aeruginosa PA01
ugggauggccagccagga

SEQ ID NO: 3410194 - RNA, 14 nt, Pseudomonas aeruginosa PA01
ugggcaacaggccg

SEQ ID NO: 3410195 - RNA, 15 nt, Pseudomonas aeruginosa PA01
ugggcaacaggccga

SEQ ID NO: 3410196 - RNA, 17 nt, Pseudomonas aeruginosa PA01
ugggcaagcugcacggc

SEQ ID NO: 3410197 - RNA, 23 nt, Pseudomonas aeruginosa PA01
ugggcaagcugcacggcgacccg

SEQ ID NO: 3410198 - RNA, 21 nt, Pseudomonas aeruginosa PA01
ugggcaccaguggcgccgcca

SEQ ID NO: 3410199 - RNA, 16 nt, Pseudomonas aeruginosa PA01
ugggcacgagucgagg

SEQ ID NO: 3410200 - RNA, 19 nt, Pseudomonas aeruginosa PA01
ugggcacgaucugcgccgc

SEQ ID NO: 3410201 - RNA, 21 nt, Pseudomonas aeruginosa PA01
ugggcacgaucugcgccgcaa

SEQ ID NO: 3410202 - RNA, 23 nt, Pseudomonas aeruginosa PA01
ugggcacgaucugcgccgcaagc

SEQ ID NO: 3410203 - RNA, 14 nt, Pseudomonas aeruginosa PA01
ugggcacgaugcug

SEQ ID NO: 3410204 - RNA, 19 nt, Pseudomonas aeruginosa PA01
ugggcacgccgguggccag

SEQ ID NO: 3410205 - RNA, 18 nt, Pseudomonas aeruginosa PA01
ugggcagcagcgaacgcc

SEQ ID NO: 3410206 - RNA, 21 nt, Pseudomonas aeruginosa PA01
ugggcagcagcgaacgccgca

SEQ ID NO: 3410207 - RNA, 19 nt, Pseudomonas aeruginosa PA01
ugggcagcgccgccgggcg

SEQ ID NO: 3410208 - RNA, 18 nt, Pseudomonas aeruginosa PA01
ugggcagcgugcaccagc

SEQ ID NO: 3410209 - RNA, 19 nt, Pseudomonas aeruginosa PA01
ugggcaggauaucgcccag

SEQ ID NO: 3410210 - RNA, 20 nt, Pseudomonas aeruginosa PA01
ugggcaggauaucgcccagg

SEQ ID NO: 3410211 - RNA, 21 nt, Pseudomonas aeruginosa PA01
ugggcaggcgcauguccagcc

SEQ ID NO: 3410212 - RNA, 19 nt, Pseudomonas aeruginosa PA01
ugggcauaggaauacggcg

SEQ ID NO: 3410213 - RNA, 22 nt, Pseudomonas aeruginosa PA01
ugggcauaggaauacggcgcga

SEQ ID NO: 3410214 - RNA, 15 nt, Pseudomonas aeruginosa PA01
ugggcaucgagaagg

SEQ ID NO: 3410215 - RNA, 16 nt, Pseudomonas aeruginosa PA01
ugggcaucuuucagcu

SEQ ID NO: 3410216 - RNA, 17 nt, Pseudomonas aeruginosa PA01
ugggcaugcucggccag

SEQ ID NO: 3410217 - RNA, 17 nt, Pseudomonas aeruginosa PA01
ugggcauggcuggcgcu

SEQ ID NO: 3410218 - RNA, 15 nt, Pseudomonas aeruginosa PA01
ugggccaccaucagg

SEQ ID NO: 3410219 - RNA, 19 nt, Pseudomonas aeruginosa PA01
ugggccaccaucagguaga

SEQ ID NO: 3410220 - RNA, 15 nt, Pseudomonas aeruginosa PA01
ugggccagcaggccg

SEQ ID NO: 3410221 - RNA, 16 nt, Pseudomonas aeruginosa PA01
ugggccagcaggccga

SEQ ID NO: 3410222 - RNA, 14 nt, Pseudomonas aeruginosa PA01
ugggccagcccaga

SEQ ID NO: 3410223 - RNA, 21 nt, Pseudomonas aeruginosa PA01
ugggccagcccagaacagcaa

SEQ ID NO: 3410224 - RNA, 14 nt, Pseudomonas aeruginosa PA01
ugggccaggaucag

SEQ ID NO: 3410225 - RNA, 16 nt, Pseudomonas aeruginosa PA01
ugggccaggcauccag

SEQ ID NO: 3410226 - RNA, 19 nt, Pseudomonas aeruginosa PA01
ugggccaggcauccagcac

SEQ ID NO: 3410227 - RNA, 21 nt, Pseudomonas aeruginosa PA01
ugggccaggcauccagcaccg

SEQ ID NO: 3410228 - RNA, 19 nt, Pseudomonas aeruginosa PA01
ugggccagggauuccuugg

SEQ ID NO: 3410229 - RNA, 13 nt, Pseudomonas aeruginosa PA01
ugggccagggccu

SEQ ID NO: 3410230 - RNA, 14 nt, Pseudomonas aeruginosa PA01
ugggccaucgccgg

SEQ ID NO: 3410231 - RNA, 14 nt, Pseudomonas aeruginosa PA01
ugggccccggccag

SEQ ID NO: 3410232 - RNA, 14 nt, Pseudomonas aeruginosa PA01
ugggccccggccgg

SEQ ID NO: 3410233 - RNA, 15 nt, Pseudomonas aeruginosa PA01
ugggccccggccggc

SEQ ID NO: 3410234 - RNA, 19 nt, Pseudomonas aeruginosa PA01
ugggccccggccggcagga

SEQ ID NO: 3410235 - RNA, 21 nt, Pseudomonas aeruginosa PA01
ugggccccggccggcaggagg

SEQ ID NO: 3410236 - RNA, 22 nt, Pseudomonas aeruginosa PA01
ugggccgaaggccaggccggcg

SEQ ID NO: 3410237 - RNA, 11 nt, Pseudomonas aeruginosa PA01
ugggccgccga

SEQ ID NO: 3410238 - RNA, 24 nt, Pseudomonas aeruginosa PA01
ugggccgcgcagaucgcguccagg

SEQ ID NO: 3410239 - RNA, 18 nt, Pseudomonas aeruginosa PA01
ugggccggcaugcucagc

SEQ ID NO: 3410240 - RNA, 22 nt, Pseudomonas aeruginosa PA01
ugggccggcaugcucagccgcg

SEQ ID NO: 3410241 - RNA, 23 nt, Pseudomonas aeruginosa PA01
ugggccggcaugcucagccgcgc

SEQ ID NO: 3410242 - RNA, 20 nt, Pseudomonas aeruginosa PA01
ugggccgguugcggcgccgg

SEQ ID NO: 3410243 - RNA, 14 nt, Pseudomonas aeruginosa PA01
ugggccucgcugcg

SEQ ID NO: 3410244 - RNA, 13 nt, Pseudomonas aeruginosa PA01
ugggccugcaggu

SEQ ID NO: 3410245 - RNA, 18 nt, Pseudomonas aeruginosa PA01
ugggccugcuccucggca

SEQ ID NO: 3410246 - RNA, 16 nt, Pseudomonas aeruginosa PA01
ugggccugucgggggc

SEQ ID NO: 3410247 - RNA, 20 nt, Pseudomonas aeruginosa PA01
ugggccuucagguaaggcac

SEQ ID NO: 3410248 - RNA, 20 nt, Pseudomonas aeruginosa PA01
ugggccuuguucaggguggc

SEQ ID NO: 3410249 - RNA, 18 nt, Pseudomonas aeruginosa PA01
ugggcgaacagcacccag

SEQ ID NO: 3410250 - RNA, 14 nt, Pseudomonas aeruginosa PA01
ugggcgaagccggc

SEQ ID NO: 3410251 - RNA, 16 nt, Pseudomonas aeruginosa PA01
ugggcgaagucgacga

SEQ ID NO: 3410252 - RNA, 14 nt, Pseudomonas aeruginosa PA01
ugggcgaagucggc

SEQ ID NO: 3410253 - RNA, 22 nt, Pseudomonas aeruginosa PA01
ugggcgaaguugaaacggcgga

SEQ ID NO: 3410254 - RNA, 13 nt, Pseudomonas aeruginosa PA01
ugggcgaccugcu

SEQ ID NO: 3410255 - RNA, 18 nt, Pseudomonas aeruginosa PA01
ugggcgacgacgaacgcc

SEQ ID NO: 3410256 - RNA, 16 nt, Pseudomonas aeruginosa PA01
ugggcgacgcggacag

SEQ ID NO: 3410257 - RNA, 16 nt, Pseudomonas aeruginosa PA01
ugggcgagcugccccu

SEQ ID NO: 3410258 - RNA, 12 nt, Pseudomonas aeruginosa PA01
ugggcgaggcgc

SEQ ID NO: 3410259 - RNA, 16 nt, Pseudomonas aeruginosa PA01
ugggcgagggcgcgca

SEQ ID NO: 3410260 - RNA, 13 nt, Pseudomonas aeruginosa PA01
ugggcgaucacgc

SEQ ID NO: 3410261 - RNA, 18 nt, Pseudomonas aeruginosa PA01
ugggcgaucacgccgcgc

SEQ ID NO: 3410262 - RNA, 21 nt, Pseudomonas aeruginosa PA01
ugggcgaucacgccgcgcacc

SEQ ID NO: 3410263 - RNA, 12 nt, Pseudomonas aeruginosa PA01
ugggcgaugcgc

SEQ ID NO: 3410264 - RNA, 16 nt, Pseudomonas aeruginosa PA01
ugggcgcaggggcgcg

SEQ ID NO: 3410265 - RNA, 19 nt, Pseudomonas aeruginosa PA01
ugggcgcaggggcgcgccg

SEQ ID NO: 3410266 - RNA, 22 nt, Pseudomonas aeruginosa PA01
ugggcgcaggggcgcgccggcu

SEQ ID NO: 3410267 - RNA, 16 nt, Pseudomonas aeruginosa PA01
ugggcgccagccgcca

SEQ ID NO: 3410268 - RNA, 19 nt, Pseudomonas aeruginosa PA01
ugggcgcccuucagcgccu

SEQ ID NO: 3410269 - RNA, 22 nt, Pseudomonas aeruginosa PA01
ugggcgcccuucagcgccucga

SEQ ID NO: 3410270 - RNA, 15 nt, Pseudomonas aeruginosa PA01
ugggcgccgccagcc

SEQ ID NO: 3410271 - RNA, 23 nt, Pseudomonas aeruginosa PA01
ugggcgccgccagccagagcagc

SEQ ID NO: 3410272 - RNA, 17 nt, Pseudomonas aeruginosa PA01
ugggcgccggcaggccu

SEQ ID NO: 3410273 - RNA, 21 nt, Pseudomonas aeruginosa PA01
ugggcgccucgucgacgcuca

SEQ ID NO: 3410274 - RNA, 14 nt, Pseudomonas aeruginosa PA01
ugggcgcgcgccgg

SEQ ID NO: 3410275 - RNA, 13 nt, Pseudomonas aeruginosa PA01
ugggcgcucagca

SEQ ID NO: 3410276 - RNA, 16 nt, Pseudomonas aeruginosa PA01
ugggcgcucagcauca

SEQ ID NO: 3410277 - RNA, 12 nt, Pseudomonas aeruginosa PA01
ugggcggccagg

SEQ ID NO: 3410278 - RNA, 14 nt, Pseudomonas aeruginosa PA01
ugggcggccggcca

SEQ ID NO: 3410279 - RNA, 17 nt, Pseudomonas aeruginosa PA01
ugggcggcgaggccgac

SEQ ID NO: 3410280 - RNA, 16 nt, Pseudomonas aeruginosa PA01
ugggcggcuuccugcu

SEQ ID NO: 3410281 - RNA, 17 nt, Pseudomonas aeruginosa PA01
ugggcggcuuccugcug

SEQ ID NO: 3410282 - RNA, 18 nt, Pseudomonas aeruginosa PA01
ugggcggucggcucagcc

SEQ ID NO: 3410283 - RNA, 21 nt, Pseudomonas aeruginosa PA01
ugggcguacaggccccaggcg

SEQ ID NO: 3410284 - RNA, 20 nt, Pseudomonas aeruginosa PA01
ugggcguagaguucgcugcg

SEQ ID NO: 3410285 - RNA, 20 nt, Pseudomonas aeruginosa PA01
ugggcguggcggccgccggc

SEQ ID NO: 3410286 - RNA, 13 nt, Pseudomonas aeruginosa PA01
ugggcguuggcca

SEQ ID NO: 3410287 - RNA, 23 nt, Pseudomonas aeruginosa PA01
ugggcuacaucgucugcgcggcg

SEQ ID NO: 3410288 - RNA, 22 nt, Pseudomonas aeruginosa PA01
ugggcuaccgcaucgccaccgc

SEQ ID NO: 3410289 - RNA, 23 nt, Pseudomonas aeruginosa PA01
ugggcuaccgcaucgccaccgcg

SEQ ID NO: 3410290 - RNA, 21 nt, Pseudomonas aeruginosa PA01
ugggcuccagcgggaaggucg

SEQ ID NO: 3410291 - RNA, 22 nt, Pseudomonas aeruginosa PA01
ugggcuccagcgggaaggucgg

SEQ ID NO: 3410292 - RNA, 23 nt, Pseudomonas aeruginosa PA01
ugggcuccagcgggaaggucggc

SEQ ID NO: 3410293 - RNA, 16 nt, Pseudomonas aeruginosa PA01
uggucgaaccagcuca

SEQ ID NO: 3410294 - RNA, 18 nt, Pseudomonas aeruginosa PA01
uggucgacauagcgcagc

SEQ ID NO: 3410295 - RNA, 19 nt, Pseudomonas aeruginosa PA01
uggucgacauagcgcagca

SEQ ID NO: 3410296 - RNA, 21 nt, Pseudomonas aeruginosa PA01
uggucgacauagcgcagcacc

SEQ ID NO: 3410297 - RNA, 24 nt, Pseudomonas aeruginosa PA01
uggucgacauagcgcagcaccggc

SEQ ID NO: 3410298 - RNA, 15 nt, Pseudomonas aeruginosa PA01
uggucgaccaggcgu

SEQ ID NO: 3410299 - RNA, 18 nt, Pseudomonas aeruginosa PA01
uggucgagaaggcugccg

SEQ ID NO: 3410300 - RNA, 17 nt, Pseudomonas aeruginosa PA01
uggucgaucuccuccuc

SEQ ID NO: 3410301 - RNA, 23 nt, Pseudomonas aeruginosa PA01
uggucgaucuccuccucggcggc

SEQ ID NO: 3410302 - RNA, 14 nt, Pseudomonas aeruginosa PA01
uggucgaugggcga

SEQ ID NO: 3410303 - RNA, 16 nt, Pseudomonas aeruginosa PA01
uggucgcagccgcgca

SEQ ID NO: 3410304 - RNA, 13 nt, Pseudomonas aeruginosa PA01
uggucgccgaagu

SEQ ID NO: 3410305 - RNA, 19 nt, Pseudomonas aeruginosa PA01
uggucgccgggauuguugc

SEQ ID NO: 3410306 - RNA, 23 nt, Pseudomonas aeruginosa PA01
uggucgcgcaggcgguggagcac

SEQ ID NO: 3410307 - RNA, 17 nt, Pseudomonas aeruginosa PA01
uggucgcgcgcggccag

SEQ ID NO: 3410308 - RNA, 15 nt, Pseudomonas aeruginosa PA01
uggucgcuccagccc

SEQ ID NO: 3410309 - RNA, 15 nt, Pseudomonas aeruginosa PA01
uggucggcaccaggg

SEQ ID NO: 3410310 - RNA, 17 nt, Pseudomonas aeruginosa PA01
uggucggcacgaugucg

SEQ ID NO: 3410311 - RNA, 18 nt, Pseudomonas aeruginosa PA01
uggucggcacgaugucga

SEQ ID NO: 3410312 - RNA, 19 nt, Pseudomonas aeruginosa PA01
uggucggcauccggcaggc

SEQ ID NO: 3410313 - RNA, 15 nt, Pseudomonas aeruginosa PA01
uggucggcggccucg

SEQ ID NO: 3410314 - RNA, 21 nt, Pseudomonas aeruginosa PA01
uggucggcuuccgccgccagg

SEQ ID NO: 3410315 - RNA, 15 nt, Pseudomonas aeruginosa PA01
uggucggggccggcg

SEQ ID NO: 3410316 - RNA, 13 nt, Pseudomonas aeruginosa PA01
uggucggugaccc

SEQ ID NO: 3410317 - RNA, 17 nt, Pseudomonas aeruginosa PA01
uggucggugacccgcac

SEQ ID NO: 3410318 - RNA, 14 nt, Pseudomonas aeruginosa PA01
uggucgguucgucg

SEQ ID NO: 3410319 - RNA, 17 nt, Pseudomonas aeruginosa PA01
uggucgguucgucgagg

SEQ ID NO: 3410320 - RNA, 17 nt, Pseudomonas aeruginosa PA01
uggucguagcagguccg

SEQ ID NO: 3410321 - RNA, 23 nt, Pseudomonas aeruginosa PA01
uggucguaggcgcgggcggcggc

SEQ ID NO: 3410322 - RNA, 20 nt, Pseudomonas aeruginosa PA01
uggucgucguaguggccguc

SEQ ID NO: 3410323 - RNA, 16 nt, Pseudomonas aeruginosa PA01
uggucguggcggaagg

SEQ ID NO: 3410324 - RNA, 20 nt, Pseudomonas aeruginosa PA01
uggucguucucgcgcaucgc

SEQ ID NO: 3410325 - RNA, 18 nt, Pseudomonas aeruginosa PA01
uggucguugcgcgccagc

SEQ ID NO: 3410326 - RNA, 14 nt, Pseudomonas aeruginosa PA01
uggucuaauggcac

SEQ ID NO: 3410327 - RNA, 20 nt, Pseudomonas aeruginosa PA01
uggucuccgugcuggccggc

SEQ ID NO: 3410328 - RNA, 18 nt, Pseudomonas aeruginosa PA01
uggucucgcgggcgacga

SEQ ID NO: 3410329 - RNA, 18 nt, Pseudomonas aeruginosa PA01
uggucucgcugacccagg

SEQ ID NO: 3410330 - RNA, 13 nt, Pseudomonas aeruginosa PA01
uggucugcacggc

SEQ ID NO: 3410331 - RNA, 16 nt, Pseudomonas aeruginosa PA01
uggucuugccgauggc

SEQ ID NO: 3410332 - RNA, 15 nt, Pseudomonas aeruginosa PA01
uggucuuuccuuuca

SEQ ID NO: 3410333 - RNA, 14 nt, Pseudomonas aeruginosa PA01
uggugaacgccagg

SEQ ID NO: 3410334 - RNA, 15 nt, Pseudomonas aeruginosa PA01
uggugaacgccaggc

SEQ ID NO: 3410335 - RNA, 19 nt, Pseudomonas aeruginosa PA01
uggugaagcccaccaccac

SEQ ID NO: 3410336 - RNA, 17 nt, Pseudomonas aeruginosa PA01
uggugacgguccgcgcc

SEQ ID NO: 3410337 - RNA, 14 nt, Pseudomonas aeruginosa PA01
uggugaucaccgcc

SEQ ID NO: 3410338 - RNA, 19 nt, Pseudomonas aeruginosa PA01
uggugaucaucguccugcc

SEQ ID NO: 3410339 - RNA, 19 nt, Pseudomonas aeruginosa PA01
uggugauccgcacccgcga

SEQ ID NO: 3410340 - RNA, 14 nt, Pseudomonas aeruginosa PA01
uggugaugccgcgg

SEQ ID NO: 3410341 - RNA, 15 nt, Pseudomonas aeruginosa PA01
uggugcccgaugccg

SEQ ID NO: 3410342 - RNA, 18 nt, Pseudomonas aeruginosa PA01
uggugcccgaugccgcgc

SEQ ID NO: 3410343 - RNA, 14 nt, Pseudomonas aeruginosa PA01
uggugcccugggcg

SEQ ID NO: 3410344 - RNA, 21 nt, Pseudomonas aeruginosa PA01
uggugccgacgcugaucaucg

SEQ ID NO: 3410345 - RNA, 14 nt, Pseudomonas aeruginosa PA01
uggugccgagcagg

SEQ ID NO: 3410346 - RNA, 22 nt, Pseudomonas aeruginosa PA01
uggugccgaucagcccgucggc

SEQ ID NO: 3410347 - RNA, 18 nt, Pseudomonas aeruginosa PA01
uggugcgauagaccgcuu

SEQ ID NO: 3410348 - RNA, 22 nt, Pseudomonas aeruginosa PA01
uggugcggccgaugaucuccgc

SEQ ID NO: 3410349 - RNA, 17 nt, Pseudomonas aeruginosa PA01
uggugcugccgaugcug

SEQ ID NO: 3410350 - RNA, 18 nt, Pseudomonas aeruginosa PA01
uggugcugccgaugcuga

SEQ ID NO: 3410351 - RNA, 22 nt, Pseudomonas aeruginosa PA01
uggugcugccgaugcugaucac

SEQ ID NO: 3410352 - RNA, 19 nt, Pseudomonas aeruginosa PA01
uggugcugcgcgcggccca

SEQ ID NO: 3410353 - RNA, 14 nt, Pseudomonas aeruginosa PA01
ugguggaacagcau

SEQ ID NO: 3410354 - RNA, 15 nt, Pseudomonas aeruginosa PA01
ugguggaacagcauc

SEQ ID NO: 3410355 - RNA, 15 nt, Pseudomonas aeruginosa PA01
ugguggacacccugc

SEQ ID NO: 3410356 - RNA, 13 nt, Pseudomonas aeruginosa PA01
ugguggacggucu

SEQ ID NO: 3410357 - RNA, 22 nt, Pseudomonas aeruginosa PA01
ugguggacggucucgccgccga

SEQ ID NO: 3410358 - RNA, 21 nt, Pseudomonas aeruginosa PA01
ugguggcccugggcggcgacc

SEQ ID NO: 3410359 - RNA, 20 nt, Pseudomonas aeruginosa PA01
ugguggccgcgccgcccugg

SEQ ID NO: 3410360 - RNA, 13 nt, Pseudomonas aeruginosa PA01
ugguggccguggc

SEQ ID NO: 3410361 - RNA, 21 nt, Pseudomonas aeruginosa PA01
ugguggccguggcgccccagg

SEQ ID NO: 3410362 - RNA, 23 nt, Pseudomonas aeruginosa PA01
ugguggccguugagcaccucgac

SEQ ID NO: 3410363 - RNA, 15 nt, Pseudomonas aeruginosa PA01
ugguggcgaacagca

SEQ ID NO: 3410364 - RNA, 16 nt, Pseudomonas aeruginosa PA01
ugguggcgaacagcac

SEQ ID NO: 3410365 - RNA, 14 nt, Pseudomonas aeruginosa PA01
ugguggcgccggcu

SEQ ID NO: 3410366 - RNA, 21 nt, Pseudomonas aeruginosa PA01
uggugggcacgagucgaggcg

SEQ ID NO: 3410367 - RNA, 22 nt, Pseudomonas aeruginosa PA01
uggugggcucuaugcaaugggg

SEQ ID NO: 3410368 - RNA, 12 nt, Pseudomonas aeruginosa PA01
ugguggggcgcc

SEQ ID NO: 3410369 - RNA, 16 nt, Pseudomonas aeruginosa PA01
ugguggggcgccggcu

SEQ ID NO: 3410370 - RNA, 17 nt, Pseudomonas aeruginosa PA01
uggugguagagcggcac

SEQ ID NO: 3410371 - RNA, 23 nt, Pseudomonas aeruginosa PA01
ugguguagccgagcacgcacugg

SEQ ID NO: 3410372 - RNA, 18 nt, Pseudomonas aeruginosa PA01
ugguguagcgauccugac

SEQ ID NO: 3410373 - RNA, 18 nt, Pseudomonas aeruginosa PA01
ugguguagcugcagcgcc

SEQ ID NO: 3410374 - RNA, 12 nt, Pseudomonas aeruginosa PA01
uggugucggccg

SEQ ID NO: 3410375 - RNA, 16 nt, Pseudomonas aeruginosa PA01
uggugugauccugcug

SEQ ID NO: 3410376 - RNA, 23 nt, Pseudomonas aeruginosa PA01
uggugugauccugcugguugaag

SEQ ID NO: 3410377 - RNA, 14 nt, Pseudomonas aeruginosa PA01
uggugugcagcagc

SEQ ID NO: 3410378 - RNA, 21 nt, Pseudomonas aeruginosa PA01
ugguuccaggagggcugcugu

SEQ ID NO: 3410379 - RNA, 13 nt, Pseudomonas aeruginosa PA01
ugguuccuggugu

SEQ ID NO: 3410380 - RNA, 13 nt, Pseudomonas aeruginosa PA01
ugguugaacucgc

SEQ ID NO: 3410381 - RNA, 22 nt, Pseudomonas aeruginosa PA01
ugguugacgauauggaagagga

SEQ ID NO: 3410382 - RNA, 13 nt, Pseudomonas aeruginosa PA01
ugguugaggcgcu

SEQ ID NO: 3410383 - RNA, 15 nt, Pseudomonas aeruginosa PA01
ugguugaggcgcucg

SEQ ID NO: 3410384 - RNA, 14 nt, Pseudomonas aeruginosa PA01
ugguugccagcagc

SEQ ID NO: 3410385 - RNA, 17 nt, Pseudomonas aeruginosa PA01
ugguugccagcagcgcu

SEQ ID NO: 3410386 - RNA, 13 nt, Pseudomonas aeruginosa PA01
ugguugcccaggg

SEQ ID NO: 3410387 - RNA, 23 nt, Pseudomonas aeruginosa PA01
ugguugcucaccaaugccagugc

SEQ ID NO: 3410388 - RNA, 18 nt, Pseudomonas aeruginosa PA01
ugguuggaaaagccccgc

SEQ ID NO: 3410389 - RNA, 17 nt, Pseudomonas aeruginosa PA01
ugguugggcaggcgcau

SEQ ID NO: 3410390 - RNA, 15 nt, Pseudomonas aeruginosa PA01
ugguuguaggcgccg

SEQ ID NO: 3410391 - RNA, 15 nt, Pseudomonas aeruginosa PA01
ugguuuagcucggcg

SEQ ID NO: 3410392 - RNA, 17 nt, Pseudomonas aeruginosa PA01
ugguuuccaggcucacc

SEQ ID NO: 3410393 - RNA, 22 nt, Pseudomonas aeruginosa PA01
ugguuucuucccacuccagcgc

SEQ ID NO: 3410394 - RNA, 18 nt, Pseudomonas aeruginosa PA01
ugguuuugcggauuccua

SEQ ID NO: 3410395 - RNA, 19 nt, Pseudomonas aeruginosa PA01
uguacagaaacaaagagcc

SEQ ID NO: 3410396 - RNA, 19 nt, Pseudomonas aeruginosa PA01
uguccuuguucggcuggac

SEQ ID NO: 3410397 - RNA, 20 nt, Pseudomonas aeruginosa PA01
ugucgaacaacccgccagca

SEQ ID NO: 3410398 - RNA, 15 nt, Pseudomonas aeruginosa PA01
ugucgaagcgcaggu

SEQ ID NO: 3410399 - RNA, 12 nt, Pseudomonas aeruginosa PA01
ugucgaccagcg

SEQ ID NO: 3410400 - RNA, 23 nt, Pseudomonas aeruginosa PA01
ugucgaccauucccacgacccgc

SEQ ID NO: 3410401 - RNA, 22 nt, Pseudomonas aeruginosa PA01
ugucgacgacgaaaggccgcgc

SEQ ID NO: 3410402 - RNA, 23 nt, Pseudomonas aeruginosa PA01
ugucgacgacgaaaggccgcgcc

SEQ ID NO: 3410403 - RNA, 17 nt, Pseudomonas aeruginosa PA01
ugucgacguugucgcaa

SEQ ID NO: 3410404 - RNA, 18 nt, Pseudomonas aeruginosa PA01
ugucgagcacggcgcugg

SEQ ID NO: 3410405 - RNA, 20 nt, Pseudomonas aeruginosa PA01
ugucgagcagggucgcgagc

SEQ ID NO: 3410406 - RNA, 16 nt, Pseudomonas aeruginosa PA01
ugucgaggaaggccag

SEQ ID NO: 3410407 - RNA, 17 nt, Pseudomonas aeruginosa PA01
ugucgaggaaggccagc

SEQ ID NO: 3410408 - RNA, 18 nt, Pseudomonas aeruginosa PA01
ugucgaggaaggccagca

SEQ ID NO: 3410409 - RNA, 23 nt, Pseudomonas aeruginosa PA01
ugucgagggucugcucgacgauc

SEQ ID NO: 3410410 - RNA, 12 nt, Pseudomonas aeruginosa PA01
ugucgagguagg

SEQ ID NO: 3410411 - RNA, 18 nt, Pseudomonas aeruginosa PA01
ugucgagguagguccagg

SEQ ID NO: 3410412 - RNA, 18 nt, Pseudomonas aeruginosa PA01
ugucgagguugcgcucca

SEQ ID NO: 3410413 - RNA, 20 nt, Pseudomonas aeruginosa PA01
ugucgagguugcgcuccauc

SEQ ID NO: 3410414 - RNA, 22 nt, Pseudomonas aeruginosa PA01
ugucgagguugcgcuccaucca

SEQ ID NO: 3410415 - RNA, 20 nt, Pseudomonas aeruginosa PA01
ugucgauaccagcgccgcuc

SEQ ID NO: 3410416 - RNA, 21 nt, Pseudomonas aeruginosa PA01
ugucgaucaggaacgcgccac

SEQ ID NO: 3410417 - RNA, 22 nt, Pseudomonas aeruginosa PA01
ugucgaucaggaacgcgccacg

SEQ ID NO: 3410418 - RNA, 14 nt, Pseudomonas aeruginosa PA01
ugucgaugggcagg

SEQ ID NO: 3410419 - RNA, 17 nt, Pseudomonas aeruginosa PA01
ugucgaugggcgacagc

SEQ ID NO: 3410420 - RNA, 22 nt, Pseudomonas aeruginosa PA01
ugucgauggucaggaucacauc

SEQ ID NO: 3410421 - RNA, 16 nt, Pseudomonas aeruginosa PA01
ugucgauuucccccgg

SEQ ID NO: 3410422 - RNA, 12 nt, Pseudomonas aeruginosa PA01
ugucgcaccagc

SEQ ID NO: 3410423 - RNA, 14 nt, Pseudomonas aeruginosa PA01
ugucgcagcggccg

SEQ ID NO: 3410424 - RNA, 19 nt, Pseudomonas aeruginosa PA01
ugucgccaucagugacauc

SEQ ID NO: 3410425 - RNA, 18 nt, Pseudomonas aeruginosa PA01
ugucgcccuucuuccagu

SEQ ID NO: 3410426 - RNA, 13 nt, Pseudomonas aeruginosa PA01
ugucgccggcaug

SEQ ID NO: 3410427 - RNA, 22 nt, Pseudomonas aeruginosa PA01
ugucgccggucaggcugcggcg

SEQ ID NO: 3410428 - RNA, 16 nt, Pseudomonas aeruginosa PA01
ugucgccguuggccuu

SEQ ID NO: 3410429 - RNA, 18 nt, Pseudomonas aeruginosa PA01
ugucgcggacccgcgccg

SEQ ID NO: 3410430 - RNA, 17 nt, Pseudomonas aeruginosa PA01
ugucgcggcaggcggcg

SEQ ID NO: 3410431 - RNA, 19 nt, Pseudomonas aeruginosa PA01
ugucgcggcaggcggcggc

SEQ ID NO: 3410432 - RNA, 14 nt, Pseudomonas aeruginosa PA01
ugucgcggcugacg

SEQ ID NO: 3410433 - RNA, 19 nt, Pseudomonas aeruginosa PA01
ugucgcgggucugcgaguu

SEQ ID NO: 3410434 - RNA, 18 nt, Pseudomonas aeruginosa PA01
ugucgcgguugccgaagc

SEQ ID NO: 3410435 - RNA, 14 nt, Pseudomonas aeruginosa PA01
ugucgcguccggcc

SEQ ID NO: 3410436 - RNA, 17 nt, Pseudomonas aeruginosa PA01
ugucgcguccggccagc

SEQ ID NO: 3410437 - RNA, 15 nt, Pseudomonas aeruginosa PA01
ugucgcucagcgggc

SEQ ID NO: 3410438 - RNA, 17 nt, Pseudomonas aeruginosa PA01
ugucgcucagcgggccg

SEQ ID NO: 3410439 - RNA, 23 nt, Pseudomonas aeruginosa PA01
ugucgcucagcgggccgauccgc

SEQ ID NO: 3410440 - RNA, 18 nt, Pseudomonas aeruginosa PA01
ugucgcugaaacgcgcgu

SEQ ID NO: 3410441 - RNA, 14 nt, Pseudomonas aeruginosa PA01
ugucgcugaccggc

SEQ ID NO: 3410442 - RNA, 14 nt, Pseudomonas aeruginosa PA01
ugucgcugagcggc

SEQ ID NO: 3410443 - RNA, 14 nt, Pseudomonas aeruginosa PA01
ugucgcuggccugc

SEQ ID NO: 3410444 - RNA, 22 nt, Pseudomonas aeruginosa PA01
ugucgcuggccugcagguccgg

SEQ ID NO: 3410445 - RNA, 15 nt, Pseudomonas aeruginosa PA01
ugucggcaaccgggc

SEQ ID NO: 3410446 - RNA, 17 nt, Pseudomonas aeruginosa PA01
ugucggcccgcgccaug

SEQ ID NO: 3410447 - RNA, 15 nt, Pseudomonas aeruginosa PA01
ugucggccgccaggg

SEQ ID NO: 3410448 - RNA, 16 nt, Pseudomonas aeruginosa PA01
ugucggccgccagggu

SEQ ID NO: 3410449 - RNA, 12 nt, Pseudomonas aeruginosa PA01
ugucggccuugg

SEQ ID NO: 3410450 - RNA, 19 nt, Pseudomonas aeruginosa PA01
ugucggcgaacuggccacc

SEQ ID NO: 3410451 - RNA, 19 nt, Pseudomonas aeruginosa PA01
ugucggcgcugucgccguu

SEQ ID NO: 3410452 - RNA, 15 nt, Pseudomonas aeruginosa PA01
ugucggcucgcgccg

SEQ ID NO: 3410453 - RNA, 15 nt, Pseudomonas aeruginosa PA01
ugucgguauggaaga

SEQ ID NO: 3410454 - RNA, 14 nt, Pseudomonas aeruginosa PA01
ugucguagccgcgc

SEQ ID NO: 3410455 - RNA, 21 nt, Pseudomonas aeruginosa PA01
ugucguagccgcgcgccagca

SEQ ID NO: 3410456 - RNA, 14 nt, Pseudomonas aeruginosa PA01
ugucguaguccugg

SEQ ID NO: 3410457 - RNA, 19 nt, Pseudomonas aeruginosa PA01
ugucgucgaggguggcgcc

SEQ ID NO: 3410458 - RNA, 14 nt, Pseudomonas aeruginosa PA01
ugucgucggcgcgg

SEQ ID NO: 3410459 - RNA, 15 nt, Pseudomonas aeruginosa PA01
ugucgucggcgcggc

SEQ ID NO: 3410460 - RNA, 17 nt, Pseudomonas aeruginosa PA01
ugucgucggcgcggccg

SEQ ID NO: 3410461 - RNA, 16 nt, Pseudomonas aeruginosa PA01
ugucgugccuccagcc

SEQ ID NO: 3410462 - RNA, 22 nt, Pseudomonas aeruginosa PA01
ugucguggacauacaggcgcgc

SEQ ID NO: 3410463 - RNA, 16 nt, Pseudomonas aeruginosa PA01
ugucguggucgccguc

SEQ ID NO: 3410464 - RNA, 15 nt, Pseudomonas aeruginosa PA01
ugucguugcgccccg

SEQ ID NO: 3410465 - RNA, 21 nt, Pseudomonas aeruginosa PA01
ugucguuguugccgcgcacca

SEQ ID NO: 3410466 - RNA, 13 nt, Pseudomonas aeruginosa PA01
ugucuccugugcc

SEQ ID NO: 3410467 - RNA, 14 nt, Pseudomonas aeruginosa PA01
ugucucgccagccc

SEQ ID NO: 3410468 - RNA, 16 nt, Pseudomonas aeruginosa PA01
ugugacggccggggcg

SEQ ID NO: 3410469 - RNA, 16 nt, Pseudomonas aeruginosa PA01
ugugaggugggcgcgc

SEQ ID NO: 3410470 - RNA, 19 nt, Pseudomonas aeruginosa PA01
ugugaggugggcgcgccgc

SEQ ID NO: 3410471 - RNA, 15 nt, Pseudomonas aeruginosa PA01
ugugaucaccagcca

SEQ ID NO: 3410472 - RNA, 20 nt, Pseudomonas aeruginosa PA01
ugugauuggaauugcugacg

SEQ ID NO: 3410473 - RNA, 16 nt, Pseudomonas aeruginosa PA01
ugugauuggguuccuc

SEQ ID NO: 3410474 - RNA, 21 nt, Pseudomonas aeruginosa PA01
ugugcaacggaaacacagcac

SEQ ID NO: 3410475 - RNA, 12 nt, Pseudomonas aeruginosa PA01
ugugcaccagca

SEQ ID NO: 3410476 - RNA, 13 nt, Pseudomonas aeruginosa PA01
ugugcaccagcaa

SEQ ID NO: 3410477 - RNA, 14 nt, Pseudomonas aeruginosa PA01
ugugcaccagcaac

SEQ ID NO: 3410478 - RNA, 14 nt, Pseudomonas aeruginosa PA01
ugugcacgaacagg

SEQ ID NO: 3410479 - RNA, 22 nt, Pseudomonas aeruginosa PA01
ugugcacgaacaggugcuggug

SEQ ID NO: 3410480 - RNA, 18 nt, Pseudomonas aeruginosa PA01
ugugcacggucugcucgg

SEQ ID NO: 3410481 - RNA, 17 nt, Pseudomonas aeruginosa PA01
ugugcagggccgcggcg

SEQ ID NO: 3410482 - RNA, 15 nt, Pseudomonas aeruginosa PA01
ugugcagggucacgc

SEQ ID NO: 3410483 - RNA, 22 nt, Pseudomonas aeruginosa PA01
ugugcagguacggcgccgcugc

SEQ ID NO: 3410484 - RNA, 13 nt, Pseudomonas aeruginosa PA01
ugugcaguucgac

SEQ ID NO: 3410485 - RNA, 23 nt, Pseudomonas aeruginosa PA01
ugugcaguucgaccuccaggccg

SEQ ID NO: 3410486 - RNA, 13 nt, Pseudomonas aeruginosa PA01
ugugcccggcgug

SEQ ID NO: 3410487 - RNA, 19 nt, Pseudomonas aeruginosa PA01
ugugccgugaucaccugga

SEQ ID NO: 3410488 - RNA, 16 nt, Pseudomonas aeruginosa PA01
ugugcgagacccccgg

SEQ ID NO: 3410489 - RNA, 16 nt, Pseudomonas aeruginosa PA01
ugugcgaggcuggccu

SEQ ID NO: 3410490 - RNA, 12 nt, Pseudomonas aeruginosa PA01
ugugcgccagcu

SEQ ID NO: 3410491 - RNA, 13 nt, Pseudomonas aeruginosa PA01
ugugcgccaggcc

SEQ ID NO: 3410492 - RNA, 17 nt, Pseudomonas aeruginosa PA01
ugugcgcugcaucggcg

SEQ ID NO: 3410493 - RNA, 20 nt, Pseudomonas aeruginosa PA01
ugugcgcugcaucggcgcgc

SEQ ID NO: 3410494 - RNA, 14 nt, Pseudomonas aeruginosa PA01
ugugcggcguggcg

SEQ ID NO: 3410495 - RNA, 16 nt, Pseudomonas aeruginosa PA01
ugugcguguucggcgg

SEQ ID NO: 3410496 - RNA, 18 nt, Pseudomonas aeruginosa PA01
ugugcguguucggcggcu

SEQ ID NO: 3410497 - RNA, 19 nt, Pseudomonas aeruginosa PA01
ugugcguguucggcggcuc

SEQ ID NO: 3410498 - RNA, 22 nt, Pseudomonas aeruginosa PA01
ugugcuccuugacccucugguu

SEQ ID NO: 3410499 - RNA, 22 nt, Pseudomonas aeruginosa PA01
uucaaaggaaucuucggcgccc

SEQ ID NO: 3410500 - RNA, 11 nt, Pseudomonas aeruginosa PA01
uucaaccaggc

SEQ ID NO: 3410501 - RNA, 13 nt, Pseudomonas aeruginosa PA01
uucaaccguggcu

SEQ ID NO: 3410502 - RNA, 14 nt, Pseudomonas aeruginosa PA01
uucaagcuggcgca

SEQ ID NO: 3410503 - RNA, 16 nt, Pseudomonas aeruginosa PA01
uucaagugucgaugaa

SEQ ID NO: 3410504 - RNA, 14 nt, Pseudomonas aeruginosa PA01
uucaauuccgccgc

SEQ ID NO: 3410505 - RNA, 17 nt, Pseudomonas aeruginosa PA01
uucacaaaggcgucgau

SEQ ID NO: 3410506 - RNA, 23 nt, Pseudomonas aeruginosa PA01
uucaccaccccgaacucgccguc

SEQ ID NO: 3410507 - RNA, 13 nt, Pseudomonas aeruginosa PA01
uucaccagcgacg

SEQ ID NO: 3410508 - RNA, 18 nt, Pseudomonas aeruginosa PA01
uucaccagcgcugccucg

SEQ ID NO: 3410509 - RNA, 13 nt, Pseudomonas aeruginosa PA01
uucaccaggccga

SEQ ID NO: 3410510 - RNA, 12 nt, Pseudomonas aeruginosa PA01
uucaccgcgccg

SEQ ID NO: 3410511 - RNA, 16 nt, Pseudomonas aeruginosa PA01
uucaccgcggccuugg

SEQ ID NO: 3410512 - RNA, 20 nt, Pseudomonas aeruginosa PA01
uucaccgcggccuuggucuc

SEQ ID NO: 3410513 - RNA, 19 nt, Pseudomonas aeruginosa PA01
uucaccgugaucccgcgcg

SEQ ID NO: 3410514 - RNA, 19 nt, Pseudomonas aeruginosa PA01
uucaccguggcgcuggccg

SEQ ID NO: 3410515 - RNA, 18 nt, Pseudomonas aeruginosa PA01
uucacgacaggcggcggg

SEQ ID NO: 3410516 - RNA, 18 nt, Pseudomonas aeruginosa PA01
uucacgucgagcacgccg

SEQ ID NO: 3410517 - RNA, 19 nt, Pseudomonas aeruginosa PA01
uucacgucgagcacgccgu

SEQ ID NO: 3410518 - RNA, 22 nt, Pseudomonas aeruginosa PA01
uucacgucgagcacgccguccg

SEQ ID NO: 3410519 - RNA, 18 nt, Pseudomonas aeruginosa PA01
uucagcagcaggcgcucg

SEQ ID NO: 3410520 - RNA, 15 nt, Pseudomonas aeruginosa PA01
uucagccagagcccg

SEQ ID NO: 3410521 - RNA, 17 nt, Pseudomonas aeruginosa PA01
uucagccagagcccguc

SEQ ID NO: 3410522 - RNA, 13 nt, Pseudomonas aeruginosa PA01
uucagcccacccc

SEQ ID NO: 3410523 - RNA, 22 nt, Pseudomonas aeruginosa PA01
uucagcccacgcgccuggccgu

SEQ ID NO: 3410524 - RNA, 13 nt, Pseudomonas aeruginosa PA01
uucagccccagca

SEQ ID NO: 3410525 - RNA, 21 nt, Pseudomonas aeruginosa PA01
uucagccccagcacgccgagc

SEQ ID NO: 3410526 - RNA, 20 nt, Pseudomonas aeruginosa PA01
uucagccgaccguccgccug

SEQ ID NO: 3410527 - RNA, 18 nt, Pseudomonas aeruginosa PA01
uucagcgccagcaggcga

SEQ ID NO: 3410528 - RNA, 19 nt, Pseudomonas aeruginosa PA01
uucagcgccaggccgauca

SEQ ID NO: 3410529 - RNA, 16 nt, Pseudomonas aeruginosa PA01
uucagcgccgccaggc

SEQ ID NO: 3410530 - RNA, 22 nt, Pseudomonas aeruginosa PA01
uucagcgccgccaggcccuggg

SEQ ID NO: 3410531 - RNA, 18 nt, Pseudomonas aeruginosa PA01
uucagcgccgcucggcga

SEQ ID NO: 3410532 - RNA, 12 nt, Pseudomonas aeruginosa PA01
uucagcgccucg

SEQ ID NO: 3410533 - RNA, 11 nt, Pseudomonas aeruginosa PA01
uucagcgcgcc

SEQ ID NO: 3410534 - RNA, 18 nt, Pseudomonas aeruginosa PA01
uucagcgcgccccggcga

SEQ ID NO: 3410535 - RNA, 22 nt, Pseudomonas aeruginosa PA01
uucagcgcuuccuugcccuggg

SEQ ID NO: 3410536 - RNA, 18 nt, Pseudomonas aeruginosa PA01
uucagcggaagcccagca

SEQ ID NO: 3410537 - RNA, 20 nt, Pseudomonas aeruginosa PA01
uucagcggcgcgucgaccac

SEQ ID NO: 3410538 - RNA, 15 nt, Pseudomonas aeruginosa PA01
uucagcggcugcccg

SEQ ID NO: 3410539 - RNA, 22 nt, Pseudomonas aeruginosa PA01
uucagcgguccgcucuggauca

SEQ ID NO: 3410540 - RNA, 21 nt, Pseudomonas aeruginosa PA01
uucagcucggcguagcgcugg

SEQ ID NO: 3410541 - RNA, 15 nt, Pseudomonas aeruginosa PA01
uucaggccggcgccg

SEQ ID NO: 3410542 - RNA, 18 nt, Pseudomonas aeruginosa PA01
uucaggccggcgccgaug

SEQ ID NO: 3410543 - RNA, 17 nt, Pseudomonas aeruginosa PA01
uucaggccggcgccgcc

SEQ ID NO: 3410544 - RNA, 20 nt, Pseudomonas aeruginosa PA01
uucaggccggcgccgccgaa

SEQ ID NO: 3410545 - RNA, 15 nt, Pseudomonas aeruginosa PA01
uucaggcgacgccgc

SEQ ID NO: 3410546 - RNA, 18 nt, Pseudomonas aeruginosa PA01
uucaggcgacgccgcgcu

SEQ ID NO: 3410547 - RNA, 21 nt, Pseudomonas aeruginosa PA01
uucaggcgcacuacgccguuc

SEQ ID NO: 3410548 - RNA, 23 nt, Pseudomonas aeruginosa PA01
uucaggcgcuccuggagguucgg

SEQ ID NO: 3410549 - RNA, 17 nt, Pseudomonas aeruginosa PA01
uucaggcugucggccau

SEQ ID NO: 3410550 - RNA, 21 nt, Pseudomonas aeruginosa PA01
uucagggcgagcagggcacag

SEQ ID NO: 3410551 - RNA, 21 nt, Pseudomonas aeruginosa PA01
uucagggcguagcggaagccg

SEQ ID NO: 3410552 - RNA, 21 nt, Pseudomonas aeruginosa PA01
uucagggcuccgaugaagcag

SEQ ID NO: 3410553 - RNA, 22 nt, Pseudomonas aeruginosa PA01
uucagggcuccgaugaagcagg

SEQ ID NO: 3410554 - RNA, 16 nt, Pseudomonas aeruginosa PA01
uucagguauccgcuua

SEQ ID NO: 3410555 - RNA, 19 nt, Pseudomonas aeruginosa PA01
uucaguagguagagaugca

SEQ ID NO: 3410556 - RNA, 14 nt, Pseudomonas aeruginosa PA01
uucagucccucguc

SEQ ID NO: 3410557 - RNA, 18 nt, Pseudomonas aeruginosa PA01
uucagucggccaggcgcc

SEQ ID NO: 3410558 - RNA, 19 nt, Pseudomonas aeruginosa PA01
uucagugcacguuccagcu

SEQ ID NO: 3410559 - RNA, 20 nt, Pseudomonas aeruginosa PA01
uucagugcacguuccagcuc

SEQ ID NO: 3410560 - RNA, 20 nt, Pseudomonas aeruginosa PA01
uucaguucugggcggccagg

SEQ ID NO: 3410561 - RNA, 15 nt, Pseudomonas aeruginosa PA01
uucauagaaacgcag

SEQ ID NO: 3410562 - RNA, 13 nt, Pseudomonas aeruginosa PA01
uucaucaccagcu

SEQ ID NO: 3410563 - RNA, 11 nt, Pseudomonas aeruginosa PA01
uucaucaccuu

SEQ ID NO: 3410564 - RNA, 17 nt, Pseudomonas aeruginosa PA01
uucauccugcgcgccuc

SEQ ID NO: 3410565 - RNA, 18 nt, Pseudomonas aeruginosa PA01
uucauccugcgcgccucu

SEQ ID NO: 3410566 - RNA, 12 nt, Pseudomonas aeruginosa PA01
uucaucggcggc

SEQ ID NO: 3410567 - RNA, 14 nt, Pseudomonas aeruginosa PA01
uucaucucgccguc

SEQ ID NO: 3410568 - RNA, 16 nt, Pseudomonas aeruginosa PA01
uucaugaagucagcca

SEQ ID NO: 3410569 - RNA, 20 nt, Pseudomonas aeruginosa PA01
uucauggccuggcgcucagc

SEQ ID NO: 3410570 - RNA, 18 nt, Pseudomonas aeruginosa PA01
uucaugggcgcgcgccgg

SEQ ID NO: 3410571 - RNA, 21 nt, Pseudomonas aeruginosa PA01
uucauggugcccagcaggcug

SEQ ID NO: 3410572 - RNA, 14 nt, Pseudomonas aeruginosa PA01
uucauucuccagcc

SEQ ID NO: 3410573 - RNA, 15 nt, Pseudomonas aeruginosa PA01
uucauugggcagcca

SEQ ID NO: 3410574 - RNA, 17 nt, Pseudomonas aeruginosa PA01
uucauuuccgcaggaaa

SEQ ID NO: 3410575 - RNA, 22 nt, Pseudomonas aeruginosa PA01
uuccaaggugcugccgaucagg

SEQ ID NO: 3410576 - RNA, 11 nt, Pseudomonas aeruginosa PA01
uuccaccgccu

SEQ ID NO: 3410577 - RNA, 16 nt, Pseudomonas aeruginosa PA01
uuccaccgccugcccc

SEQ ID NO: 3410578 - RNA, 17 nt, Pseudomonas aeruginosa PA01
uuccaccgccuggacca

SEQ ID NO: 3410579 - RNA, 16 nt, Pseudomonas aeruginosa PA01
uuccaccuguuccgcg

SEQ ID NO: 3410580 - RNA, 15 nt, Pseudomonas aeruginosa PA01
uuccaccuuggcacg

SEQ ID NO: 3410581 - RNA, 23 nt, Pseudomonas aeruginosa PA01
uuccacgagagaaaugaaauagu

SEQ ID NO: 3410582 - RNA, 17 nt, Pseudomonas aeruginosa PA01
uuccacgucgagcgggc

SEQ ID NO: 3410583 - RNA, 17 nt, Pseudomonas aeruginosa PA01
uuccacgucgccgacca

SEQ ID NO: 3410584 - RNA, 18 nt, Pseudomonas aeruginosa PA01
uuccagaacgccgcgcac

SEQ ID NO: 3410585 - RNA, 22 nt, Pseudomonas aeruginosa PA01
uuccagaacgccgcgcaccucg

SEQ ID NO: 3410586 - RNA, 22 nt, Pseudomonas aeruginosa PA01
uuccagaucgucuuucucgauc

SEQ ID NO: 3410587 - RNA, 15 nt, Pseudomonas aeruginosa PA01
uuccagcaccucgcg

SEQ ID NO: 3410588 - RNA, 15 nt, Pseudomonas aeruginosa PA01
uuccagcaggcgcuc

SEQ ID NO: 3410589 - RNA, 14 nt, Pseudomonas aeruginosa PA01
uuccagcauuaccc

SEQ ID NO: 3410590 - RNA, 12 nt, Pseudomonas aeruginosa PA01
uuccagcggcac

SEQ ID NO: 3410591 - RNA, 20 nt, Pseudomonas aeruginosa PA01
uuccagcggcacuucccgcc

SEQ ID NO: 3410592 - RNA, 15 nt, Pseudomonas aeruginosa PA01
uuccagcggccacgg

SEQ ID NO: 3410593 - RNA, 18 nt, Pseudomonas aeruginosa PA01
uuccagcggccgcgagcg

SEQ ID NO: 3410594 - RNA, 20 nt, Pseudomonas aeruginosa PA01
uuccagcggcuccuggaugc

SEQ ID NO: 3410595 - RNA, 13 nt, Pseudomonas aeruginosa PA01
uuccagcugccag

SEQ ID NO: 3410596 - RNA, 21 nt, Pseudomonas aeruginosa PA01
uuccaggcaccgaagcugagg

SEQ ID NO: 3410597 - RNA, 13 nt, Pseudomonas aeruginosa PA01
uuccaggcgccgc

SEQ ID NO: 3410598 - RNA, 12 nt, Pseudomonas aeruginosa PA01
uuccaggcgcgc

SEQ ID NO: 3410599 - RNA, 20 nt, Pseudomonas aeruginosa PA01
uuccaggcguccgcuggccu

SEQ ID NO: 3410600 - RNA, 12 nt, Pseudomonas aeruginosa PA01
uuccaggcgugc

SEQ ID NO: 3410601 - RNA, 13 nt, Pseudomonas aeruginosa PA01
uuccaggcguugc

SEQ ID NO: 3410602 - RNA, 13 nt, Pseudomonas aeruginosa PA01
uucgacagcgcgg

SEQ ID NO: 3410603 - RNA, 16 nt, Pseudomonas aeruginosa PA01
uucgaccacgacccgg

SEQ ID NO: 3410604 - RNA, 16 nt, Pseudomonas aeruginosa PA01
uucgacccgccgacca

SEQ ID NO: 3410605 - RNA, 17 nt, Pseudomonas aeruginosa PA01
uucgaccuccaggccga

SEQ ID NO: 3410606 - RNA, 22 nt, Pseudomonas aeruginosa PA01
uucgacgacaccugcaacgccc

SEQ ID NO: 3410607 - RNA, 21 nt, Pseudomonas aeruginosa PA01
uucgacgcgccacgcaggaac

SEQ ID NO: 3410608 - RNA, 14 nt, Pseudomonas aeruginosa PA01
uucgacgcgcggcu

SEQ ID NO: 3410609 - RNA, 13 nt, Pseudomonas aeruginosa PA01
uucgacgucgauc

SEQ ID NO: 3410610 - RNA, 15 nt, Pseudomonas aeruginosa PA01
uucgagaguuuuauc

SEQ ID NO: 3410611 - RNA, 21 nt, Pseudomonas aeruginosa PA01
uucgagcaccccgagcccggc

SEQ ID NO: 3410612 - RNA, 19 nt, Pseudomonas aeruginosa PA01
uucgagcaggaggauacgg

SEQ ID NO: 3410613 - RNA, 14 nt, Pseudomonas aeruginosa PA01
uucgaguccccuag

SEQ ID NO: 3410614 - RNA, 14 nt, Pseudomonas aeruginosa PA01
uucgagucccgucc

SEQ ID NO: 3410615 - RNA, 19 nt, Pseudomonas aeruginosa PA01
uucgaucuccucgcgcagc

SEQ ID NO: 3410616 - RNA, 17 nt, Pseudomonas aeruginosa PA01
uucgaucuggcugccca

SEQ ID NO: 3410617 - RNA, 17 nt, Pseudomonas aeruginosa PA01
uucgaugacgccauccu

SEQ ID NO: 3410618 - RNA, 22 nt, Pseudomonas aeruginosa PA01
uucgaugccgcgcgccuggcug

SEQ ID NO: 3410619 - RNA, 16 nt, Pseudomonas aeruginosa PA01
uucgaugcgccgcagg

SEQ ID NO: 3410620 - RNA, 23 nt, Pseudomonas aeruginosa PA01
uucgcaacggccguugaagcaga

SEQ ID NO: 3410621 - RNA, 16 nt, Pseudomonas aeruginosa PA01
uucgcagagaucggcg

SEQ ID NO: 3410622 - RNA, 15 nt, Pseudomonas aeruginosa PA01
uucgcaggagucgac

SEQ ID NO: 3410623 - RNA, 17 nt, Pseudomonas aeruginosa PA01
uucgcaggagucgacga

SEQ ID NO: 3410624 - RNA, 14 nt, Pseudomonas aeruginosa PA01
uucgcaggccaggc

SEQ ID NO: 3410625 - RNA, 16 nt, Pseudomonas aeruginosa PA01
uucgcaggccaggcgc

SEQ ID NO: 3410626 - RNA, 23 nt, Pseudomonas aeruginosa PA01
uucgcauaggcggccagccuucc

SEQ ID NO: 3410627 - RNA, 16 nt, Pseudomonas aeruginosa PA01
uucgcauuccaccuug

SEQ ID NO: 3410628 - RNA, 14 nt, Pseudomonas aeruginosa PA01
uucgccagcaccuc

SEQ ID NO: 3410629 - RNA, 15 nt, Pseudomonas aeruginosa PA01
uucgccagcaccucg

SEQ ID NO: 3410630 - RNA, 23 nt, Pseudomonas aeruginosa PA01
uucgccagcaccucguaggccga

SEQ ID NO: 3410631 - RNA, 23 nt, Pseudomonas aeruginosa PA01
uucgccaucgauggucacuggcg

SEQ ID NO: 3410632 - RNA, 20 nt, Pseudomonas aeruginosa PA01
uucgcccaguaccacgcagc

SEQ ID NO: 3410633 - RNA, 21 nt, Pseudomonas aeruginosa PA01
uucgcccagugguuccaggag

SEQ ID NO: 3410634 - RNA, 16 nt, Pseudomonas aeruginosa PA01
uucgcccauggcacgc

SEQ ID NO: 3410635 - RNA, 15 nt, Pseudomonas aeruginosa PA01
uucgccccgccgcca

SEQ ID NO: 3410636 - RNA, 15 nt, Pseudomonas aeruginosa PA01
uucgcccgcggcggc

SEQ ID NO: 3410637 - RNA, 17 nt, Pseudomonas aeruginosa PA01
uucgcccuaccccccaa

SEQ ID NO: 3410638 - RNA, 20 nt, Pseudomonas aeruginosa PA01
uucgcccuaccgcccacccu

SEQ ID NO: 3410639 - RNA, 14 nt, Pseudomonas aeruginosa PA01
uucgccgaccaggu

SEQ ID NO: 3410640 - RNA, 15 nt, Pseudomonas aeruginosa PA01
uucgccgaccagguc

SEQ ID NO: 3410641 - RNA, 17 nt, Pseudomonas aeruginosa PA01
uucgccgagcgccgcca

SEQ ID NO: 3410642 - RNA, 18 nt, Pseudomonas aeruginosa PA01
uucgccgaggggcgggau

SEQ ID NO: 3410643 - RNA, 17 nt, Pseudomonas aeruginosa PA01
uucgccgaugcgccgac

SEQ ID NO: 3410644 - RNA, 11 nt, Pseudomonas aeruginosa PA01
uucgccgccac

SEQ ID NO: 3410645 - RNA, 18 nt, Pseudomonas aeruginosa PA01
uucgccgcccgcgccucc

SEQ ID NO: 3410646 - RNA, 19 nt, Pseudomonas aeruginosa PA01
uucgccgcccgcgccucca

SEQ ID NO: 3410647 - RNA, 17 nt, Pseudomonas aeruginosa PA01
uucgccgcccucgcagu

SEQ ID NO: 3410648 - RNA, 14 nt, Pseudomonas aeruginosa PA01
uucgccgccgagcg

SEQ ID NO: 3410649 - RNA, 16 nt, Pseudomonas aeruginosa PA01
uucgccgccgcgcgcg

SEQ ID NO: 3410650 - RNA, 17 nt, Pseudomonas aeruginosa PA01
uucgccgcgacgcucca

SEQ ID NO: 3410651 - RNA, 13 nt, Pseudomonas aeruginosa PA01
uucgccgcgagca

SEQ ID NO: 3410652 - RNA, 20 nt, Pseudomonas aeruginosa PA01
uucgccgcgcaagcucguca

SEQ ID NO: 3410653 - RNA, 17 nt, Pseudomonas aeruginosa PA01
uucgccgcgggcguugc

SEQ ID NO: 3410654 - RNA, 13 nt, Pseudomonas aeruginosa PA01
uucgccggccagg

SEQ ID NO: 3410655 - RNA, 15 nt, Pseudomonas aeruginosa PA01
uucgccggccaggug

SEQ ID NO: 3410656 - RNA, 23 nt, Pseudomonas aeruginosa PA01
uucgccggccagguggucguagc

SEQ ID NO: 3410657 - RNA, 13 nt, Pseudomonas aeruginosa PA01
uucgccggccucc

SEQ ID NO: 3410658 - RNA, 20 nt, Pseudomonas aeruginosa PA01
uucgccggguggaacgaggc

SEQ ID NO: 3410659 - RNA, 20 nt, Pseudomonas aeruginosa PA01
uucgccggguguuuuuccuc

SEQ ID NO: 3410660 - RNA, 12 nt, Pseudomonas aeruginosa PA01
uucgccggugac

SEQ ID NO: 3410661 - RNA, 17 nt, Pseudomonas aeruginosa PA01
uucgccgucgagccagc

SEQ ID NO: 3410662 - RNA, 16 nt, Pseudomonas aeruginosa PA01
uucgccuggcgcgacg

SEQ ID NO: 3410663 - RNA, 17 nt, Pseudomonas aeruginosa PA01
uucgccuugcccuggcc

SEQ ID NO: 3410664 - RNA, 14 nt, Pseudomonas aeruginosa PA01
uucgcgacacaccg

SEQ ID NO: 3410665 - RNA, 22 nt, Pseudomonas aeruginosa PA01
uucgcgacccucagucgccccc

SEQ ID NO: 3410666 - RNA, 22 nt, Pseudomonas aeruginosa PA01
uucgcgcacgauagcgaaagaa

SEQ ID NO: 3410667 - RNA, 13 nt, Pseudomonas aeruginosa PA01
uucgcgcaggacc

SEQ ID NO: 3410668 - RNA, 15 nt, Pseudomonas aeruginosa PA01
uucgcgccauggccg

SEQ ID NO: 3410669 - RNA, 18 nt, Pseudomonas aeruginosa PA01
uucgcggaucucaggacc

SEQ ID NO: 3410670 - RNA, 17 nt, Pseudomonas aeruginosa PA01
uucgcggcggcgcgucg

SEQ ID NO: 3410671 - RNA, 23 nt, Pseudomonas aeruginosa PA01
uucgcggcucuggcgcagggaga

SEQ ID NO: 3410672 - RNA, 14 nt, Pseudomonas aeruginosa PA01
uucgcgggccaggc

SEQ ID NO: 3410673 - RNA, 15 nt, Pseudomonas aeruginosa PA01
uucgcgggccaggcc

SEQ ID NO: 3410674 - RNA, 16 nt, Pseudomonas aeruginosa PA01
uucgcgguagacgcag

SEQ ID NO: 3410675 - RNA, 22 nt, Pseudomonas aeruginosa PA01
uucgcggucggugagcacgccg

SEQ ID NO: 3410676 - RNA, 18 nt, Pseudomonas aeruginosa PA01
uucgcgguggaugccggu

SEQ ID NO: 3410677 - RNA, 21 nt, Pseudomonas aeruginosa PA01
uucgcgugccagacgcucggc

SEQ ID NO: 3410678 - RNA, 21 nt, Pseudomonas aeruginosa PA01
uucgcuaaccggucgcaaugg

SEQ ID NO: 3410679 - RNA, 22 nt, Pseudomonas aeruginosa PA01
uucgcugagaccgauccagcag

SEQ ID NO: 3410680 - RNA, 17 nt, Pseudomonas aeruginosa PA01
uucgcugccccguagcc

SEQ ID NO: 3410681 - RNA, 22 nt, Pseudomonas aeruginosa PA01
uucgcugccgccgcgcugcagg

SEQ ID NO: 3410682 - RNA, 14 nt, Pseudomonas aeruginosa PA01
uucgcugcgcgcca

SEQ ID NO: 3410683 - RNA, 23 nt, Pseudomonas aeruginosa PA01
uucgcugcugccgcguuccuugu

SEQ ID NO: 3410684 - RNA, 20 nt, Pseudomonas aeruginosa PA01
uucgcuggaccaggcggccg

SEQ ID NO: 3410685 - RNA, 15 nt, Pseudomonas aeruginosa PA01
uucgcugucgagcag

SEQ ID NO: 3410686 - RNA, 20 nt, Pseudomonas aeruginosa PA01
uucgcugucgagcagggaga

SEQ ID NO: 3410687 - RNA, 13 nt, Pseudomonas aeruginosa PA01
uucgcugucgucg

SEQ ID NO: 3410688 - RNA, 14 nt, Pseudomonas aeruginosa PA01
uucgcuuugcgcgc

SEQ ID NO: 3410689 - RNA, 16 nt, Pseudomonas aeruginosa PA01
uucgcuuugcgcgcag

SEQ ID NO: 3410690 - RNA, 19 nt, Pseudomonas aeruginosa PA01
uucggagaacagcgagacc

SEQ ID NO: 3410691 - RNA, 22 nt, Pseudomonas aeruginosa PA01
uucggagaacagcgagaccucg

SEQ ID NO: 3410692 - RNA, 23 nt, Pseudomonas aeruginosa PA01
uucggagaacagcgagaccucgc

SEQ ID NO: 3410693 - RNA, 17 nt, Pseudomonas aeruginosa PA01
uucggaucggcccggcg

SEQ ID NO: 3410694 - RNA, 19 nt, Pseudomonas aeruginosa PA01
uucggcaccccuucgagca

SEQ ID NO: 3410695 - RNA, 13 nt, Pseudomonas aeruginosa PA01
uucggcagcgccu

SEQ ID NO: 3410696 - RNA, 15 nt, Pseudomonas aeruginosa PA01
uucggcagcgccucg

SEQ ID NO: 3410697 - RNA, 18 nt, Pseudomonas aeruginosa PA01
uucggcagguugcucgcc

SEQ ID NO: 3410698 - RNA, 21 nt, Pseudomonas aeruginosa PA01
uucggcauuacuugcccacgc

SEQ ID NO: 3410699 - RNA, 12 nt, Pseudomonas aeruginosa PA01
uucggccagcgc

SEQ ID NO: 3410700 - RNA, 15 nt, Pseudomonas aeruginosa PA01
uucggccagcggcag

SEQ ID NO: 3410701 - RNA, 14 nt, Pseudomonas aeruginosa PA01
uucggccagggagu

SEQ ID NO: 3410702 - RNA, 16 nt, Pseudomonas aeruginosa PA01
uucggccaguccuuga

SEQ ID NO: 3410703 - RNA, 23 nt, Pseudomonas aeruginosa PA01
uucggccgcggcuggcaggugcc

SEQ ID NO: 3410704 - RNA, 17 nt, Pseudomonas aeruginosa PA01
uucggcgacagccgggc

SEQ ID NO: 3410705 - RNA, 15 nt, Pseudomonas aeruginosa PA01
uugagauccuggccg

SEQ ID NO: 3410706 - RNA, 16 nt, Pseudomonas aeruginosa PA01
uugagauccuggccgg

SEQ ID NO: 3410707 - RNA, 15 nt, Pseudomonas aeruginosa PA01
uugagcacccgggcg

SEQ ID NO: 3410708 - RNA, 23 nt, Pseudomonas aeruginosa PA01
uugagcacgucgccuucgcugag

SEQ ID NO: 3410709 - RNA, 16 nt, Pseudomonas aeruginosa PA01
uugagcagccaggcga

SEQ ID NO: 3410710 - RNA, 19 nt, Pseudomonas aeruginosa PA01
uugagcagccaggcgaagc

SEQ ID NO: 3410711 - RNA, 17 nt, Pseudomonas aeruginosa PA01
uugagcaggcggccguc

SEQ ID NO: 3410712 - RNA, 20 nt, Pseudomonas aeruginosa PA01
uugagcagggcgucgcccuc

SEQ ID NO: 3410713 - RNA, 13 nt, Pseudomonas aeruginosa PA01
uugagcggcgccc

SEQ ID NO: 3410714 - RNA, 13 nt, Pseudomonas aeruginosa PA01
uugagcuggccga

SEQ ID NO: 3410715 - RNA, 14 nt, Pseudomonas aeruginosa PA01
uugaggaagugcag

SEQ ID NO: 3410716 - RNA, 13 nt, Pseudomonas aeruginosa PA01
uugaggaagugga

SEQ ID NO: 3410717 - RNA, 14 nt, Pseudomonas aeruginosa PA01
uugaggccgucgaa

SEQ ID NO: 3410718 - RNA, 14 nt, Pseudomonas aeruginosa PA01
uugagggcacggcc

SEQ ID NO: 3410719 - RNA, 15 nt, Pseudomonas aeruginosa PA01
uugagggccuugagc

SEQ ID NO: 3410720 - RNA, 19 nt, Pseudomonas aeruginosa PA01
uugagggccuuggccucca

SEQ ID NO: 3410721 - RNA, 18 nt, Pseudomonas aeruginosa PA01
uugagggucagaccagcc

SEQ ID NO: 3410722 - RNA, 18 nt, Pseudomonas aeruginosa PA01
uugaggucgugcagcaca

SEQ ID NO: 3410723 - RNA, 23 nt, Pseudomonas aeruginosa PA01
uugaggucguuggccaggcgcga

SEQ ID NO: 3410724 - RNA, 15 nt, Pseudomonas aeruginosa PA01
uugaguagaaaagaa

SEQ ID NO: 3410725 - RNA, 19 nt, Pseudomonas aeruginosa PA01
uugauagcgcggccuucag

SEQ ID NO: 3410726 - RNA, 16 nt, Pseudomonas aeruginosa PA01
uugaucaccaccggcu

SEQ ID NO: 3410727 - RNA, 15 nt, Pseudomonas aeruginosa PA01
uugaucaccgcggug

SEQ ID NO: 3410728 - RNA, 17 nt, Pseudomonas aeruginosa PA01
uugaucaccuugccauc

SEQ ID NO: 3410729 - RNA, 15 nt, Pseudomonas aeruginosa PA01
uugaucgacgccagc

SEQ ID NO: 3410730 - RNA, 20 nt, Pseudomonas aeruginosa PA01
uugaucggcaacgagcagga

SEQ ID NO: 3410731 - RNA, 13 nt, Pseudomonas aeruginosa PA01
uugaucuuguccg

SEQ ID NO: 3410732 - RNA, 14 nt, Pseudomonas aeruginosa PA01
uugaugaagcgcug

SEQ ID NO: 3410733 - RNA, 18 nt, Pseudomonas aeruginosa PA01
uugauggugaccggcuug

SEQ ID NO: 3410734 - RNA, 19 nt, Pseudomonas aeruginosa PA01
uugcaaacgggguaaagau

SEQ ID NO: 3410735 - RNA, 13 nt, Pseudomonas aeruginosa PA01
uugcacagcgccc

SEQ ID NO: 3410736 - RNA, 19 nt, Pseudomonas aeruginosa PA01
uugcacgcaggccgcugcc

SEQ ID NO: 3410737 - RNA, 19 nt, Pseudomonas aeruginosa PA01
uugcacuuccacuccaggc

SEQ ID NO: 3410738 - RNA, 18 nt, Pseudomonas aeruginosa PA01
uugcacuugaaguguccg

SEQ ID NO: 3410739 - RNA, 19 nt, Pseudomonas aeruginosa PA01
uugcacuugcggcaguccu

SEQ ID NO: 3410740 - RNA, 20 nt, Pseudomonas aeruginosa PA01
uugcagagcggccaggucga

SEQ ID NO: 3410741 - RNA, 23 nt, Pseudomonas aeruginosa PA01
uugcagauaaccgauaucuccca

SEQ ID NO: 3410742 - RNA, 13 nt, Pseudomonas aeruginosa PA01
uugcagcaccccc

SEQ ID NO: 3410743 - RNA, 13 nt, Pseudomonas aeruginosa PA01
uugcagcaccgcc

SEQ ID NO: 3410744 - RNA, 15 nt, Pseudomonas aeruginosa PA01
uugcagcaccgccug

SEQ ID NO: 3410745 - RNA, 15 nt, Pseudomonas aeruginosa PA01
uugcagccagccguc

SEQ ID NO: 3410746 - RNA, 21 nt, Pseudomonas aeruginosa PA01
uugcagcucguuggccaccug

SEQ ID NO: 3410747 - RNA, 22 nt, Pseudomonas aeruginosa PA01
uugcaggcagucccagaaggcc

SEQ ID NO: 3410748 - RNA, 14 nt, Pseudomonas aeruginosa PA01
uugcaggccagcgc

SEQ ID NO: 3410749 - RNA, 16 nt, Pseudomonas aeruginosa PA01
uugcaggccagcgcca

SEQ ID NO: 3410750 - RNA, 15 nt, Pseudomonas aeruginosa PA01
uugcaggccggcgag

SEQ ID NO: 3410751 - RNA, 14 nt, Pseudomonas aeruginosa PA01
uugcagggccgcca

SEQ ID NO: 3410752 - RNA, 15 nt, Pseudomonas aeruginosa PA01
uugcagggccgccag

SEQ ID NO: 3410753 - RNA, 17 nt, Pseudomonas aeruginosa PA01
uugcagggggcuuugcg

SEQ ID NO: 3410754 - RNA, 17 nt, Pseudomonas aeruginosa PA01
uugcaguccaggccgua

SEQ ID NO: 3410755 - RNA, 20 nt, Pseudomonas aeruginosa PA01
uugcagugcgccgcagcgca

SEQ ID NO: 3410756 - RNA, 16 nt, Pseudomonas aeruginosa PA01
uugcaugaccuucagg

SEQ ID NO: 3410757 - RNA, 22 nt, Pseudomonas aeruginosa PA01
uugccagaggcugcgcuccagg

SEQ ID NO: 3410758 - RNA, 23 nt, Pseudomonas aeruginosa PA01
uugccagccggccuugcuuugcg

SEQ ID NO: 3410759 - RNA, 22 nt, Pseudomonas aeruginosa PA01
uugccaggaggauucgccagcc

SEQ ID NO: 3410760 - RNA, 14 nt, Pseudomonas aeruginosa PA01
uugcccaacuccag

SEQ ID NO: 3410761 - RNA, 16 nt, Pseudomonas aeruginosa PA01
uugcccacggccaggc

SEQ ID NO: 3410762 - RNA, 16 nt, Pseudomonas aeruginosa PA01
uugcccagcaggcuca

SEQ ID NO: 3410763 - RNA, 21 nt, Pseudomonas aeruginosa PA01
uugcccagccgacgcgcagcg

SEQ ID NO: 3410764 - RNA, 19 nt, Pseudomonas aeruginosa PA01
uugcccagcgccgccugcu

SEQ ID NO: 3410765 - RNA, 22 nt, Pseudomonas aeruginosa PA01
uugcccagguagucgcccagcg

SEQ ID NO: 3410766 - RNA, 23 nt, Pseudomonas aeruginosa PA01
uugcccaugugcagcuucuccag

SEQ ID NO: 3410767 - RNA, 19 nt, Pseudomonas aeruginosa PA01
uugcccucgcgcuggaccc

SEQ ID NO: 3410768 - RNA, 17 nt, Pseudomonas aeruginosa PA01
uugcccucggcgcccgc

SEQ ID NO: 3410769 - RNA, 18 nt, Pseudomonas aeruginosa PA01
uugcccucggcgcccgcc

SEQ ID NO: 3410770 - RNA, 16 nt, Pseudomonas aeruginosa PA01
uugccgaccgagcagc

SEQ ID NO: 3410771 - RNA, 21 nt, Pseudomonas aeruginosa PA01
uugccgagcgcgaucagccgc

SEQ ID NO: 3410772 - RNA, 21 nt, Pseudomonas aeruginosa PA01
uugccgaucaucuucuggaca

SEQ ID NO: 3410773 - RNA, 11 nt, Pseudomonas aeruginosa PA01
uugccgccaga

SEQ ID NO: 3410774 - RNA, 19 nt, Pseudomonas aeruginosa PA01
uugccgccgaucagcgcgc

SEQ ID NO: 3410775 - RNA, 20 nt, Pseudomonas aeruginosa PA01
uugccgccgcuggccuggcc

SEQ ID NO: 3410776 - RNA, 21 nt, Pseudomonas aeruginosa PA01
uugccgccgcuggccuggcca

SEQ ID NO: 3410777 - RNA, 18 nt, Pseudomonas aeruginosa PA01
uugccgcgccaaaaagca

SEQ ID NO: 3410778 - RNA, 14 nt, Pseudomonas aeruginosa PA01
uugccgcgcccggc

SEQ ID NO: 3410779 - RNA, 19 nt, Pseudomonas aeruginosa PA01
uugccgcgcccggccaggc

SEQ ID NO: 3410780 - RNA, 22 nt, Pseudomonas aeruginosa PA01
uugccggaaagcaguucgcccg

SEQ ID NO: 3410781 - RNA, 16 nt, Pseudomonas aeruginosa PA01
uugccggcgccaucga

SEQ ID NO: 3410782 - RNA, 22 nt, Pseudomonas aeruginosa PA01
uugccgggugcuaugcgccggg

SEQ ID NO: 3410783 - RNA, 17 nt, Pseudomonas aeruginosa PA01
uugccggguuucgucgg

SEQ ID NO: 3410784 - RNA, 19 nt, Pseudomonas aeruginosa PA01
uugccgguagccggcgauc

SEQ ID NO: 3410785 - RNA, 14 nt, Pseudomonas aeruginosa PA01
uugccggucugcug

SEQ ID NO: 3410786 - RNA, 15 nt, Pseudomonas aeruginosa PA01
uugccguccuucagg

SEQ ID NO: 3410787 - RNA, 16 nt, Pseudomonas aeruginosa PA01
uugccgucgagcacca

SEQ ID NO: 3410788 - RNA, 18 nt, Pseudomonas aeruginosa PA01
uugccgucgagcaccagc

SEQ ID NO: 3410789 - RNA, 11 nt, Pseudomonas aeruginosa PA01
uugccguggcu

SEQ ID NO: 3410790 - RNA, 19 nt, Pseudomonas aeruginosa PA01
uugccguggcuccuggagg

SEQ ID NO: 3410791 - RNA, 16 nt, Pseudomonas aeruginosa PA01
uugccuuccaggcugu

SEQ ID NO: 3410792 - RNA, 16 nt, Pseudomonas aeruginosa PA01
uugcgaccgagaugcu

SEQ ID NO: 3410793 - RNA, 15 nt, Pseudomonas aeruginosa PA01
uugcgaccggccuuu

SEQ ID NO: 3410794 - RNA, 14 nt, Pseudomonas aeruginosa PA01
uugcgacugacgcu

SEQ ID NO: 3410795 - RNA, 22 nt, Pseudomonas aeruginosa PA01
uugcgaucgaggaugaucggcu

SEQ ID NO: 3410796 - RNA, 13 nt, Pseudomonas aeruginosa PA01
uugcgcaccgccu

SEQ ID NO: 3410797 - RNA, 19 nt, Pseudomonas aeruginosa PA01
uugcgcaccgccugcagca

SEQ ID NO: 3410798 - RNA, 21 nt, Pseudomonas aeruginosa PA01
uugcgcagcuucugcagggcg

SEQ ID NO: 3410799 - RNA, 22 nt, Pseudomonas aeruginosa PA01
uugcgcagggcgucgaaggcgg

SEQ ID NO: 3410800 - RNA, 14 nt, Pseudomonas aeruginosa PA01
uugcgcaggggcgc

SEQ ID NO: 3410801 - RNA, 18 nt, Pseudomonas aeruginosa PA01
uugcgcaggggcgcggcg

SEQ ID NO: 3410802 - RNA, 19 nt, Pseudomonas aeruginosa PA01
uugcgccagagcaggcgga

SEQ ID NO: 3410803 - RNA, 17 nt, Pseudomonas aeruginosa PA01
uugcgccaggcccggcg

SEQ ID NO: 3410804 - RNA, 20 nt, Pseudomonas aeruginosa PA01
uugcgccaggcccggcgcug

SEQ ID NO: 3410805 - RNA, 22 nt, Pseudomonas aeruginosa PA01
uugcgccccgggucgcugcuca

SEQ ID NO: 3410806 - RNA, 24 nt, Pseudomonas aeruginosa PA01
uugcgcccggcgcgaccgucggcc

SEQ ID NO: 3410807 - RNA, 14 nt, Pseudomonas aeruginosa PA01
uuggugcugcgcgc

SEQ ID NO: 3410808 - RNA, 21 nt, Pseudomonas aeruginosa PA01
uuggugcugcgcgcggcccac

SEQ ID NO: 3410809 - RNA, 16 nt, Pseudomonas aeruginosa PA01
uugguggggcgccggc

SEQ ID NO: 3410810 - RNA, 20 nt, Pseudomonas aeruginosa PA01
uugguguagcugcagcgccc

SEQ ID NO: 3410811 - RNA, 16 nt, Pseudomonas aeruginosa PA01
uuggugucgaugccgc

SEQ ID NO: 3410812 - RNA, 15 nt, Pseudomonas aeruginosa PA01
uuguaagcauuaacu

SEQ ID NO: 3410813 - RNA, 13 nt, Pseudomonas aeruginosa PA01
uuguacuggccga

SEQ ID NO: 3410814 - RNA, 21 nt, Pseudomonas aeruginosa PA01
uuguagaaacgguccagggcc

SEQ ID NO: 3410815 - RNA, 14 nt, Pseudomonas aeruginosa PA01
uuguagcccagggg

SEQ ID NO: 3410816 - RNA, 16 nt, Pseudomonas aeruginosa PA01
uuguaggcgccgccgu

SEQ ID NO: 3410817 - RNA, 20 nt, Pseudomonas aeruginosa PA01
uuguccacgucguaggccga

SEQ ID NO: 3410818 - RNA, 19 nt, Pseudomonas aeruginosa PA01
uuguccaggcgcugcucga

SEQ ID NO: 3410819 - RNA, 12 nt, Pseudomonas aeruginosa PA01
uuguccagggca

SEQ ID NO: 3410820 - RNA, 11 nt, Pseudomonas aeruginosa PA01
uugucccugcg

SEQ ID NO: 3410821 - RNA, 12 nt, Pseudomonas aeruginosa PA01
uugucccugcgg

SEQ ID NO: 3410822 - RNA, 21 nt, Pseudomonas aeruginosa PA01
uugucccugucccgccgcgcc

SEQ ID NO: 3410823 - RNA, 13 nt, Pseudomonas aeruginosa PA01
uuguccggcacca

SEQ ID NO: 3410824 - RNA, 12 nt, Pseudomonas aeruginosa PA01
uuguccuggcgc

SEQ ID NO: 3410825 - RNA, 17 nt, Pseudomonas aeruginosa PA01
uuguccuucggccaguc

SEQ ID NO: 3410826 - RNA, 17 nt, Pseudomonas aeruginosa PA01
uugucgaacagguaguu

SEQ ID NO: 3410827 - RNA, 13 nt, Pseudomonas aeruginosa PA01
uugucgaccagcg

SEQ ID NO: 3410828 - RNA, 22 nt, Pseudomonas aeruginosa PA01
uugucgaugagccagccugcag

SEQ ID NO: 3410829 - RNA, 17 nt, Pseudomonas aeruginosa PA01
uugucgaugcgcccgcc

SEQ ID NO: 3410830 - RNA, 14 nt, Pseudomonas aeruginosa PA01
uugucggucaggua

SEQ ID NO: 3410831 - RNA, 19 nt, Pseudomonas aeruginosa PA01
uugucggugaugaagaagc

SEQ ID NO: 3410832 - RNA, 22 nt, Pseudomonas aeruginosa PA01
uugucguaugccugugcaccga

SEQ ID NO: 3410833 - RNA, 19 nt, Pseudomonas aeruginosa PA01
uugucuuucugcgacgagc

SEQ ID NO: 3410834 - RNA, 16 nt, Pseudomonas aeruginosa PA01
uugugaucgaccucgc

SEQ ID NO: 3410835 - RNA, 14 nt, Pseudomonas aeruginosa PA01
uugugcgccagcuc

SEQ ID NO: 3410836 - RNA, 16 nt, Pseudomonas aeruginosa PA01
uuguggagucaggcgc

SEQ ID NO: 3410837 - RNA, 19 nt, Pseudomonas aeruginosa PA01
uuguggccgaucuccuggu

SEQ ID NO: 3410838 - RNA, 17 nt, Pseudomonas aeruginosa PA01
uugugguugggcaggcg

SEQ ID NO: 3410839 - RNA, 18 nt, Pseudomonas aeruginosa PA01
uuguguagucauggccag

SEQ ID NO: 3410840 - RNA, 19 nt, Pseudomonas aeruginosa PA01
uuguucggcugggccagga

SEQ ID NO: 3410841 - RNA, 16 nt, Pseudomonas aeruginosa PA01
uuguugacguucugcc

SEQ ID NO: 3410842 - RNA, 17 nt, Pseudomonas aeruginosa PA01
uuguugacguucugccc

SEQ ID NO: 3410843 - RNA, 23 nt, Pseudomonas aeruginosa PA01
uuguugacguucugcccgccggc

SEQ ID NO: 3410844 - RNA, 15 nt, Pseudomonas aeruginosa PA01
uuguugaugcccacc

SEQ ID NO: 3410845 - RNA, 21 nt, Pseudomonas aeruginosa PA01
uuguuggccagcagccaggcc

SEQ ID NO: 3410846 - RNA, 17 nt, Pseudomonas aeruginosa PA01
uuuaaaguucgacgauu

SEQ ID NO: 3410847 - RNA, 20 nt, Pseudomonas aeruginosa PA01
uuuaaguaacuuauugaaau

SEQ ID NO: 3410848 - RNA, 21 nt, Pseudomonas aeruginosa PA01
uuuaccguggaaccgauggcc

SEQ ID NO: 3410849 - RNA, 18 nt, Pseudomonas aeruginosa PA01
uuuacggauucucuccca

SEQ ID NO: 3410850 - RNA, 15 nt, Pseudomonas aeruginosa PA01
uuuagcucggcgaug

SEQ ID NO: 3410851 - RNA, 14 nt, Pseudomonas aeruginosa PA01
uuuauuccucccau

SEQ ID NO: 3410852 - RNA, 23 nt, Pseudomonas aeruginosa PA01
uuucaauuccgccgcggcaaugc

SEQ ID NO: 3410853 - RNA, 11 nt, Pseudomonas aeruginosa PA01
uuucacgccga

SEQ ID NO: 3410854 - RNA, 21 nt, Pseudomonas aeruginosa PA01
uuucagcccacgcgccuggcc

SEQ ID NO: 3410855 - RNA, 17 nt, Pseudomonas aeruginosa PA01
uuucagcgcuugcuggc

SEQ ID NO: 3410856 - RNA, 23 nt, Pseudomonas aeruginosa PA01
uuucagcuucaggguggcgcugc

SEQ ID NO: 3410857 - RNA, 14 nt, Pseudomonas aeruginosa PA01
uuucagcuucaucg

SEQ ID NO: 3410858 - RNA, 21 nt, Pseudomonas aeruginosa PA01
uuuccagaaggcuucuuccug

SEQ ID NO: 3410859 - RNA, 16 nt, Pseudomonas aeruginosa PA01
uuuccagcccggcgug

SEQ ID NO: 3410860 - RNA, 16 nt, Pseudomonas aeruginosa PA01
uuuccaggcucaccuc

SEQ ID NO: 3410861 - RNA, 21 nt, Pseudomonas aeruginosa PA01
uuuccagggcaaacagcuccg

SEQ ID NO: 3410862 - RNA, 20 nt, Pseudomonas aeruginosa PA01
uuuccaguucaucgagcagg

SEQ ID NO: 3410863 - RNA, 15 nt, Pseudomonas aeruginosa PA01
uuuccgauccuccug

SEQ ID NO: 3410864 - RNA, 20 nt, Pseudomonas aeruginosa PA01
uuuccgcaggaaaccccucg

SEQ ID NO: 3410865 - RNA, 19 nt, Pseudomonas aeruginosa PA01
uuuccgccggacccugccg

SEQ ID NO: 3410866 - RNA, 18 nt, Pseudomonas aeruginosa PA01
uuuccgcgcccggcuggc

SEQ ID NO: 3410867 - RNA, 14 nt, Pseudomonas aeruginosa PA01
uuuccgcggcguug

SEQ ID NO: 3410868 - RNA, 20 nt, Pseudomonas aeruginosa PA01
uuuccggauacaugcugcuc

SEQ ID NO: 3410869 - RNA, 21 nt, Pseudomonas aeruginosa PA01
uuuccggauacaugcugcuca

SEQ ID NO: 3410870 - RNA, 19 nt, Pseudomonas aeruginosa PA01
uuuccggcgcggccugcag

SEQ ID NO: 3410871 - RNA, 18 nt, Pseudomonas aeruginosa PA01
uuuccgucucaggcgcca

SEQ ID NO: 3410872 - RNA, 22 nt, Pseudomonas aeruginosa PA01
uuuccgugcggaaaccgcggcc

SEQ ID NO: 3410873 - RNA, 13 nt, Pseudomonas aeruginosa PA01
uuuccucaucucc

SEQ ID NO: 3410874 - RNA, 17 nt, Pseudomonas aeruginosa PA01
uuuccucgaucaggccu

SEQ ID NO: 3410875 - RNA, 13 nt, Pseudomonas aeruginosa PA01
uuuccucgucgcc

SEQ ID NO: 3410876 - RNA, 11 nt, Pseudomonas aeruginosa PA01
uuuccugcccc

SEQ ID NO: 3410877 - RNA, 16 nt, Pseudomonas aeruginosa PA01
uuuccugcuccagcag

SEQ ID NO: 3410878 - RNA, 17 nt, Pseudomonas aeruginosa PA01
uuuccugcuccagcagg

SEQ ID NO: 3410879 - RNA, 10 nt, Pseudomonas aeruginosa PA01
uuuccugcug

SEQ ID NO: 3410880 - RNA, 13 nt, Pseudomonas aeruginosa PA01
uuuccuggcccug

SEQ ID NO: 3410881 - RNA, 22 nt, Pseudomonas aeruginosa PA01
uuuccugguacucguccuccca

SEQ ID NO: 3410882 - RNA, 21 nt, Pseudomonas aeruginosa PA01
uuuccuuagaggcucagccga

SEQ ID NO: 3410883 - RNA, 16 nt, Pseudomonas aeruginosa PA01
uuuccuugaccaucuu

SEQ ID NO: 3410884 - RNA, 13 nt, Pseudomonas aeruginosa PA01
uuuccuuguggcg

SEQ ID NO: 3410885 - RNA, 15 nt, Pseudomonas aeruginosa PA01
uuucgaagccgccgc

SEQ ID NO: 3410886 - RNA, 15 nt, Pseudomonas aeruginosa PA01
uuucgaucuggcugc

SEQ ID NO: 3410887 - RNA, 22 nt, Pseudomonas aeruginosa PA01
uuucgaugguggaauccagggc

SEQ ID NO: 3410888 - RNA, 17 nt, Pseudomonas aeruginosa PA01
uuucgcggaaguaggcg

SEQ ID NO: 3410889 - RNA, 14 nt, Pseudomonas aeruginosa PA01
uuucgcucaggccu

SEQ ID NO: 3410890 - RNA, 18 nt, Pseudomonas aeruginosa PA01
uuucgcucaggccucgag

SEQ ID NO: 3410891 - RNA, 18 nt, Pseudomonas aeruginosa PA01
uuucgcucuggucgaaca

SEQ ID NO: 3410892 - RNA, 14 nt, Pseudomonas aeruginosa PA01
uuucgcugcugccg

SEQ ID NO: 3410893 - RNA, 23 nt, Pseudomonas aeruginosa PA01
uuucgcuuugcgcgcaguaggcg

SEQ ID NO: 3410894 - RNA, 23 nt, Pseudomonas aeruginosa PA01
uuucggcgagauugcgcugagcg

SEQ ID NO: 3410895 - RNA, 12 nt, Pseudomonas aeruginosa PA01
uuucguccccuu

SEQ ID NO: 3410896 - RNA, 15 nt, Pseudomonas aeruginosa PA01
uuucgugaaaugaaa

SEQ ID NO: 3410897 - RNA, 18 nt, Pseudomonas aeruginosa PA01
uuucguuggcgcgaccgc

SEQ ID NO: 3410898 - RNA, 18 nt, Pseudomonas aeruginosa PA01
uuucuacuucccugccgg

SEQ ID NO: 3410899 - RNA, 16 nt, Pseudomonas aeruginosa PA01
uuucuauuccggggac

SEQ ID NO: 3410900 - RNA, 13 nt, Pseudomonas aeruginosa PA01
uuucucggcgaug

SEQ ID NO: 3410901 - RNA, 18 nt, Pseudomonas aeruginosa PA01
uuucucggucgccgccag

SEQ ID NO: 3410902 - RNA, 20 nt, Pseudomonas aeruginosa PA01
uuucugccacccggcgcccg

SEQ ID NO: 3410903 - RNA, 17 nt, Pseudomonas aeruginosa PA01
uuucugcuggccaccgc

SEQ ID NO: 3410904 - RNA, 22 nt, Pseudomonas aeruginosa PA01
uuucuucaccaccccacaaaaa

SEQ ID NO: 3410905 - RNA, 12 nt, Pseudomonas aeruginosa PA01
uuucuucagccu

SEQ ID NO: 3410906 - RNA, 16 nt, Pseudomonas aeruginosa PA01
uuugagggucagacca

SEQ ID NO: 3410907 - RNA, 15 nt, Pseudomonas aeruginosa PA01
uuugcaaucggcgag

SEQ ID NO: 3410908 - RNA, 22 nt, Pseudomonas aeruginosa PA01
uuugcccagcgccgccugcugg

SEQ ID NO: 3410909 - RNA, 18 nt, Pseudomonas aeruginosa PA01
uuugcccgucuagcgcag

SEQ ID NO: 3410910 - RNA, 18 nt, Pseudomonas aeruginosa PA01
gaaacgcuggcggccgag

SEQ ID NO: 3410911 - RNA, 23 nt, Pseudomonas aeruginosa PA01
gaaacgcuugagcuggcgcuggu

SEQ ID NO: 3410912 - RNA, 16 nt, Pseudomonas aeruginosa PA01
gaaacgcuuggcgauc

SEQ ID NO: 3410913 - RNA, 13 nt, Pseudomonas aeruginosa PA01
gaaacggacccca

SEQ ID NO: 3410914 - RNA, 16 nt, Pseudomonas aeruginosa PA01
gaaacggaucacgauc

SEQ ID NO: 3410915 - RNA, 14 nt, Pseudomonas aeruginosa PA01
gaaacggcaggcca

SEQ ID NO: 3410916 - RNA, 16 nt, Pseudomonas aeruginosa PA01
gaaacggcaggccagc

SEQ ID NO: 3410917 - RNA, 22 nt, Pseudomonas aeruginosa PA01
gaaacgggcgcucuggccgcgc

SEQ ID NO: 3410918 - RNA, 17 nt, Pseudomonas aeruginosa PA01
gaaacgguggaggcguc

SEQ ID NO: 3410919 - RNA, 13 nt, Pseudomonas aeruginosa PA01
gaaacguccggcg

SEQ ID NO: 3410920 - RNA, 22 nt, Pseudomonas aeruginosa PA01
gaaacucaucaggcugccgagc

SEQ ID NO: 3410921 - RNA, 23 nt, Pseudomonas aeruginosa PA01
gaaacucaucaggcugccgagca

SEQ ID NO: 3410922 - RNA, 16 nt, Pseudomonas aeruginosa PA01
gaaacucgcgggcgcg

SEQ ID NO: 3410923 - RNA, 20 nt, Pseudomonas aeruginosa PA01
gaaagaaacgguggaggcgu

SEQ ID NO: 3410924 - RNA, 13 nt, Pseudomonas aeruginosa PA01
gaaagaacaacuc

SEQ ID NO: 3410925 - RNA, 19 nt, Pseudomonas aeruginosa PA01
gaaagaagccgcacuucca

SEQ ID NO: 3410926 - RNA, 14 nt, Pseudomonas aeruginosa PA01
uucagcuccagcag

SEQ ID NO: 3410927 - RNA, 20 nt, Pseudomonas aeruginosa PA01
uucagcucgaggccaggauc

SEQ ID NO: 3410928 - RNA, 16 nt, Pseudomonas aeruginosa PA01
uucaggccggcgccgc

SEQ ID NO: 3410929 - RNA, 19 nt, Pseudomonas aeruginosa PA01
uucaggccggcgccgccga

SEQ ID NO: 3410930 - RNA, 15 nt, Pseudomonas aeruginosa PA01
uucaggccguucagg

SEQ ID NO: 3410931 - RNA, 20 nt, Pseudomonas aeruginosa PA01
uucaggcgacgccgcgcugc

SEQ ID NO: 3410932 - RNA, 11 nt, Pseudomonas aeruginosa PA01
uucaggcgcgc

SEQ ID NO: 3410933 - RNA, 14 nt, Pseudomonas aeruginosa PA01
uucaggcgcucguc

SEQ ID NO: 3410934 - RNA, 13 nt, Pseudomonas aeruginosa PA01
uucagggagagga

SEQ ID NO: 3410935 - RNA, 16 nt, Pseudomonas aeruginosa PA01
uucaggguggcgcugc

SEQ ID NO: 3410936 - RNA, 20 nt, Pseudomonas aeruginosa PA01
uucagguaaggcaccaccgc

SEQ ID NO: 3410937 - RNA, 23 nt, Pseudomonas aeruginosa PA01
uucagguagugcaacaccuggcg

SEQ ID NO: 3410938 - RNA, 15 nt, Pseudomonas aeruginosa PA01
uucaggucgugcugg

SEQ ID NO: 3410939 - RNA, 14 nt, Pseudomonas aeruginosa PA01
uucagucggccagg

SEQ ID NO: 3410940 - RNA, 15 nt, Pseudomonas aeruginosa PA01
uucauccugcgcgcc

SEQ ID NO: 3410941 - RNA, 20 nt, Pseudomonas aeruginosa PA01
uucauccugcgcgccucuuc

SEQ ID NO: 3410942 - RNA, 23 nt, Pseudomonas aeruginosa PA01
uucauccugcgcgccucuuccug

SEQ ID NO: 3410943 - RNA, 14 nt, Pseudomonas aeruginosa PA01
uucauccugcggaa

SEQ ID NO: 3410944 - RNA, 20 nt, Pseudomonas aeruginosa PA01
uucaucgagcggcggccguc

SEQ ID NO: 3410945 - RNA, 18 nt, Pseudomonas aeruginosa PA01
uucaucgccgccaggcag

SEQ ID NO: 3410946 - RNA, 19 nt, Pseudomonas aeruginosa PA01
uucaucuccugcuggacga

SEQ ID NO: 3410947 - RNA, 12 nt, Pseudomonas aeruginosa PA01
uucaucuuggcc

SEQ ID NO: 3410948 - RNA, 14 nt, Pseudomonas aeruginosa PA01
uucaugagcgcccg

SEQ ID NO: 3410949 - RNA, 21 nt, Pseudomonas aeruginosa PA01
uucauggcggucagaucagcg

SEQ ID NO: 3410950 - RNA, 20 nt, Pseudomonas aeruginosa PA01
uucaugggacaaacgauugc

SEQ ID NO: 3410951 - RNA, 22 nt, Pseudomonas aeruginosa PA01
uucauggugcccagcaggcugc

SEQ ID NO: 3410952 - RNA, 22 nt, Pseudomonas aeruginosa PA01
uucaugucuucucaaagggcag

SEQ ID NO: 3410953 - RNA, 20 nt, Pseudomonas aeruginosa PA01
uucauuggcgcgucgguggc

SEQ ID NO: 3410954 - RNA, 22 nt, Pseudomonas aeruginosa PA01
uucauuuguggagucaggcgcc

SEQ ID NO: 3410955 - RNA, 12 nt, Pseudomonas aeruginosa PA01
uuccaaggguau

SEQ ID NO: 3410956 - RNA, 23 nt, Pseudomonas aeruginosa PA01
uuccaaucgggguauagcgcagu

SEQ ID NO: 3410957 - RNA, 19 nt, Pseudomonas aeruginosa PA01
uuccacccgcuccgcggcc

SEQ ID NO: 3410958 - RNA, 16 nt, Pseudomonas aeruginosa PA01
uuccaccggccgcgcc

SEQ ID NO: 3410959 - RNA, 16 nt, Pseudomonas aeruginosa PA01
uuccaccggcuggccg

SEQ ID NO: 3410960 - RNA, 16 nt, Pseudomonas aeruginosa PA01
uuccaccggcuugccg

SEQ ID NO: 3410961 - RNA, 15 nt, Pseudomonas aeruginosa PA01
uuccaccuggcgcag

SEQ ID NO: 3410962 - RNA, 19 nt, Pseudomonas aeruginosa PA01
uuccacgaaaaagcccggc

SEQ ID NO: 3410963 - RNA, 22 nt, Pseudomonas aeruginosa PA01
uuccacgcugaggcucagcgcg

SEQ ID NO: 3410964 - RNA, 23 nt, Pseudomonas aeruginosa PA01
uuccacgggucgcagccgagccc

SEQ ID NO: 3410965 - RNA, 15 nt, Pseudomonas aeruginosa PA01
uuccacgugcucgcg

SEQ ID NO: 3410966 - RNA, 23 nt, Pseudomonas aeruginosa PA01
uuccacgugcucgcggaccagcu

SEQ ID NO: 3410967 - RNA, 15 nt, Pseudomonas aeruginosa PA01
uuccacucccaugcc

SEQ ID NO: 3410968 - RNA, 20 nt, Pseudomonas aeruginosa PA01
uuccagaaacggcugccggu

SEQ ID NO: 3410969 - RNA, 23 nt, Pseudomonas aeruginosa PA01
uuccagaacgccgcgcaccucga

SEQ ID NO: 3410970 - RNA, 20 nt, Pseudomonas aeruginosa PA01
uuccagcaccucccccagcg

SEQ ID NO: 3410971 - RNA, 19 nt, Pseudomonas aeruginosa PA01
uuccagcaccucgcgggaa

SEQ ID NO: 3410972 - RNA, 12 nt, Pseudomonas aeruginosa PA01
uuccagcaggca

SEQ ID NO: 3410973 - RNA, 13 nt, Pseudomonas aeruginosa PA01
uuccagcaggcag

SEQ ID NO: 3410974 - RNA, 19 nt, Pseudomonas aeruginosa PA01
uuccagcaggcaggcgcgg

SEQ ID NO: 3410975 - RNA, 20 nt, Pseudomonas aeruginosa PA01
uuccagcaugcucgggcugc

SEQ ID NO: 3410976 - RNA, 12 nt, Pseudomonas aeruginosa PA01
uuccagcccggc

SEQ ID NO: 3410977 - RNA, 13 nt, Pseudomonas aeruginosa PA01
uuccagcccuucg

SEQ ID NO: 3410978 - RNA, 21 nt, Pseudomonas aeruginosa PA01
uuccagcccuucgacgucgau

SEQ ID NO: 3410979 - RNA, 13 nt, Pseudomonas aeruginosa PA01
uuccagcgccucg

SEQ ID NO: 3410980 - RNA, 22 nt, Pseudomonas aeruginosa PA01
uuccagcggggaugaccguccg

SEQ ID NO: 3410981 - RNA, 19 nt, Pseudomonas aeruginosa PA01
uuccagcucggugccguca

SEQ ID NO: 3410982 - RNA, 21 nt, Pseudomonas aeruginosa PA01
uuccagcuugcgccagagcag

SEQ ID NO: 3410983 - RNA, 15 nt, Pseudomonas aeruginosa PA01
uuccaggagggcugc

SEQ ID NO: 3410984 - RNA, 19 nt, Pseudomonas aeruginosa PA01
uuccaggaugcaaccgccc

SEQ ID NO: 3410985 - RNA, 22 nt, Pseudomonas aeruginosa PA01
uuccaggcgaaagucggcgcga

SEQ ID NO: 3410986 - RNA, 21 nt, Pseudomonas aeruginosa PA01
uuccaggcgcaggcgaggaug

SEQ ID NO: 3410987 - RNA, 19 nt, Pseudomonas aeruginosa PA01
uuccaggcguccgcuggcc

SEQ ID NO: 3410988 - RNA, 17 nt, Pseudomonas aeruginosa PA01
uuccaggcuguagccgg

SEQ ID NO: 3410989 - RNA, 23 nt, Pseudomonas aeruginosa PA01
uuccaggcuguagccggcgaugu

SEQ ID NO: 3410990 - RNA, 15 nt, Pseudomonas aeruginosa PA01
uuccagggccuggua

SEQ ID NO: 3410991 - RNA, 16 nt, Pseudomonas aeruginosa PA01
uuccagggcggcgcgg

SEQ ID NO: 3410992 - RNA, 23 nt, Pseudomonas aeruginosa PA01
uuccaggggcauguccaccgccg

SEQ ID NO: 3410993 - RNA, 21 nt, Pseudomonas aeruginosa PA01
uuccaggguuuccagcagcac

SEQ ID NO: 3410994 - RNA, 15 nt, Pseudomonas aeruginosa PA01
uuccagguacggccc

SEQ ID NO: 3410995 - RNA, 18 nt, Pseudomonas aeruginosa PA01
uuccagguagcccaccuc

SEQ ID NO: 3410996 - RNA, 14 nt, Pseudomonas aeruginosa PA01
uuccaggucgcugc

SEQ ID NO: 3410997 - RNA, 20 nt, Pseudomonas aeruginosa PA01
uuccaguuccuucuugaccc

SEQ ID NO: 3410998 - RNA, 16 nt, Pseudomonas aeruginosa PA01
uuccaguucggccgcg

SEQ ID NO: 3410999 - RNA, 14 nt, Pseudomonas aeruginosa PA01
uuccaugggcagac

SEQ ID NO: 3411000 - RNA, 18 nt, Pseudomonas aeruginosa PA01
uucccagaccuggccgcu

SEQ ID NO: 3411001 - RNA, 22 nt, Pseudomonas aeruginosa PA01
uucccagcagcaacagcgccgc

SEQ ID NO: 3411002 - RNA, 12 nt, Pseudomonas aeruginosa PA01
uucccagcagcg

SEQ ID NO: 3411003 - RNA, 17 nt, Pseudomonas aeruginosa PA01
uucccagcagcgccucg

SEQ ID NO: 3411004 - RNA, 20 nt, Pseudomonas aeruginosa PA01
uucccagcagcgccucggca

SEQ ID NO: 3411005 - RNA, 20 nt, Pseudomonas aeruginosa PA01
uucccccagcaccuggacga

SEQ ID NO: 3411006 - RNA, 12 nt, Pseudomonas aeruginosa PA01
uuccccguggcg

SEQ ID NO: 3411007 - RNA, 21 nt, Pseudomonas aeruginosa PA01
uucccgcaccggcgcgccgga

SEQ ID NO: 3411008 - RNA, 18 nt, Pseudomonas aeruginosa PA01
uucccgcagcgaucagca

SEQ ID NO: 3411009 - RNA, 16 nt, Pseudomonas aeruginosa PA01
uucccgcccgcucaug

SEQ ID NO: 3411010 - RNA, 18 nt, Pseudomonas aeruginosa PA01
uucccgccgcucugcugg

SEQ ID NO: 3411011 - RNA, 20 nt, Pseudomonas aeruginosa PA01
uucccgcgagcagccgacga

SEQ ID NO: 3411012 - RNA, 13 nt, Pseudomonas aeruginosa PA01
uucccgcuccagg

SEQ ID NO: 3411013 - RNA, 17 nt, Pseudomonas aeruginosa PA01
uucccgcuucggcccgc

SEQ ID NO: 3411014 - RNA, 23 nt, Pseudomonas aeruginosa PA01
uucccggcgcggcuacccucucc

SEQ ID NO: 3411015 - RNA, 19 nt, Pseudomonas aeruginosa PA01
uucccggucgacggcgugc

SEQ ID NO: 3411016 - RNA, 17 nt, Pseudomonas aeruginosa PA01
uucccguaaggccaggc

SEQ ID NO: 3411017 - RNA, 17 nt, Pseudomonas aeruginosa PA01
uucccguccgggcacgc

SEQ ID NO: 3411018 - RNA, 14 nt, Pseudomonas aeruginosa PA01
uucccugccggcgg

SEQ ID NO: 3411019 - RNA, 20 nt, Pseudomonas aeruginosa PA01
uuccgaaucgccuaccagac

SEQ ID NO: 3411020 - RNA, 21 nt, Pseudomonas aeruginosa PA01
uuccgacccggccgaccaggu

SEQ ID NO: 3411021 - RNA, 16 nt, Pseudomonas aeruginosa PA01
uuccgccaggcgcagc

SEQ ID NO: 3411022 - RNA, 23 nt, Pseudomonas aeruginosa PA01
uuccgccgagcguugggccucgc

SEQ ID NO: 3411023 - RNA, 16 nt, Pseudomonas aeruginosa PA01
uuccgccggcgccgcc

SEQ ID NO: 3411024 - RNA, 13 nt, Pseudomonas aeruginosa PA01
uuccgcgcaggac

SEQ ID NO: 3411025 - RNA, 17 nt, Pseudomonas aeruginosa PA01
uuccgcgcccaggcugc

SEQ ID NO: 3411026 - RNA, 17 nt, Pseudomonas aeruginosa PA01
uuccgcgcccggcuggc

SEQ ID NO: 3411027 - RNA, 19 nt, Pseudomonas aeruginosa PA01
uuccgcgcccggcuggcca

SEQ ID NO: 3411028 - RNA, 15 nt, Pseudomonas aeruginosa PA01
uucgccagcaggcuc

SEQ ID NO: 3411029 - RNA, 17 nt, Pseudomonas aeruginosa PA01
uucgccagcggccaggg

SEQ ID NO: 3411030 - RNA, 20 nt, Pseudomonas aeruginosa PA01
uucgccaguucucgcagcag

SEQ ID NO: 3411031 - RNA, 14 nt, Pseudomonas aeruginosa PA01
uucgcccagcucgc

SEQ ID NO: 3411032 - RNA, 16 nt, Pseudomonas aeruginosa PA01
uucgcccagcucgccg

SEQ ID NO: 3411033 - RNA, 21 nt, Pseudomonas aeruginosa PA01
uucgcccagcucgccgcucca

SEQ ID NO: 3411034 - RNA, 18 nt, Pseudomonas aeruginosa PA01
uucgccccagcggucgau

SEQ ID NO: 3411035 - RNA, 14 nt, Pseudomonas aeruginosa PA01
uucgccccgccgcc

SEQ ID NO: 3411036 - RNA, 20 nt, Pseudomonas aeruginosa PA01
uucgcccgcggcggcgacgc

SEQ ID NO: 3411037 - RNA, 19 nt, Pseudomonas aeruginosa PA01
uucgcccgcugcgcugcca

SEQ ID NO: 3411038 - RNA, 23 nt, Pseudomonas aeruginosa PA01
uucgcccgcugcgcugccagcgc

SEQ ID NO: 3411039 - RNA, 16 nt, Pseudomonas aeruginosa PA01
uucgcccuaccgccca

SEQ ID NO: 3411040 - RNA, 19 nt, Pseudomonas aeruginosa PA01
uucgcccucagcagcgccg

SEQ ID NO: 3411041 - RNA, 15 nt, Pseudomonas aeruginosa PA01
uucgccgagcgccgc

SEQ ID NO: 3411042 - RNA, 17 nt, Pseudomonas aeruginosa PA01
uucgccgaggcccagcg

SEQ ID NO: 3411043 - RNA, 14 nt, Pseudomonas aeruginosa PA01
uucgccgaucacca

SEQ ID NO: 3411044 - RNA, 18 nt, Pseudomonas aeruginosa PA01
uucgccgccgagcgccug

SEQ ID NO: 3411045 - RNA, 20 nt, Pseudomonas aeruginosa PA01
uucgccgccgccaguugcuu

SEQ ID NO: 3411046 - RNA, 14 nt, Pseudomonas aeruginosa PA01
uucgccgccgcgcg

SEQ ID NO: 3411047 - RNA, 23 nt, Pseudomonas aeruginosa PA01
uucgccgcgggcguugcgcgccu

SEQ ID NO: 3411048 - RNA, 13 nt, Pseudomonas aeruginosa PA01
uucgccggccagc

SEQ ID NO: 3411049 - RNA, 14 nt, Pseudomonas aeruginosa PA01
uucgccggccaggu

SEQ ID NO: 3411050 - RNA, 16 nt, Pseudomonas aeruginosa PA01
uucgccggccugcgcg

SEQ ID NO: 3411051 - RNA, 23 nt, Pseudomonas aeruginosa PA01
uucgccggccugcgcgcaccagg

SEQ ID NO: 3411052 - RNA, 18 nt, Pseudomonas aeruginosa PA01
uucgccgggcuccagcau

SEQ ID NO: 3411053 - RNA, 13 nt, Pseudomonas aeruginosa PA01
uucgccgggcuuu

SEQ ID NO: 3411054 - RNA, 17 nt, Pseudomonas aeruginosa PA01
uucgccggugacgcugc

SEQ ID NO: 3411055 - RNA, 20 nt, Pseudomonas aeruginosa PA01
uucgccuugcccuggccggc

SEQ ID NO: 3411056 - RNA, 22 nt, Pseudomonas aeruginosa PA01
uucgcgcggauauagcugguca

SEQ ID NO: 3411057 - RNA, 15 nt, Pseudomonas aeruginosa PA01
uucgcgcuccaggcc

SEQ ID NO: 3411058 - RNA, 23 nt, Pseudomonas aeruginosa PA01
uucgcggaaguaggcggcggagu

SEQ ID NO: 3411059 - RNA, 13 nt, Pseudomonas aeruginosa PA01
uucgcggaccacg

SEQ ID NO: 3411060 - RNA, 21 nt, Pseudomonas aeruginosa PA01
uucgcggacgccgaagcgggc

SEQ ID NO: 3411061 - RNA, 20 nt, Pseudomonas aeruginosa PA01
uucgcgggccaggccgagcg

SEQ ID NO: 3411062 - RNA, 18 nt, Pseudomonas aeruginosa PA01
uucgcguagccccucgcg

SEQ ID NO: 3411063 - RNA, 15 nt, Pseudomonas aeruginosa PA01
uucgcguggcccggc

SEQ ID NO: 3411064 - RNA, 20 nt, Pseudomonas aeruginosa PA01
uucgcguggcccggcgcggc

SEQ ID NO: 3411065 - RNA, 13 nt, Pseudomonas aeruginosa PA01
uucgcucugcgcc

SEQ ID NO: 3411066 - RNA, 22 nt, Pseudomonas aeruginosa PA01
uucgcugacccagcgcacgccg

SEQ ID NO: 3411067 - RNA, 21 nt, Pseudomonas aeruginosa PA01
uucgcugacgaggacgccgcc

SEQ ID NO: 3411068 - RNA, 22 nt, Pseudomonas aeruginosa PA01
uucgcugacgaggacgccgccg

SEQ ID NO: 3411069 - RNA, 20 nt, Pseudomonas aeruginosa PA01
uucgcugaggacugccaggg

SEQ ID NO: 3411070 - RNA, 13 nt, Pseudomonas aeruginosa PA01
uucgcugcgcagu

SEQ ID NO: 3411071 - RNA, 22 nt, Pseudomonas aeruginosa PA01
uucgcuggcgaacggcuggucg

SEQ ID NO: 3411072 - RNA, 14 nt, Pseudomonas aeruginosa PA01
uucgcugucgagca

SEQ ID NO: 3411073 - RNA, 19 nt, Pseudomonas aeruginosa PA01
uucgcugucgagcagggag

SEQ ID NO: 3411074 - RNA, 16 nt, Pseudomonas aeruginosa PA01
uucgcuucggccacca

SEQ ID NO: 3411075 - RNA, 14 nt, Pseudomonas aeruginosa PA01
uucggaguugcauu

SEQ ID NO: 3411076 - RNA, 15 nt, Pseudomonas aeruginosa PA01
uucggaucggcccgg

SEQ ID NO: 3411077 - RNA, 16 nt, Pseudomonas aeruginosa PA01
uucggaucggcccggc

SEQ ID NO: 3411078 - RNA, 16 nt, Pseudomonas aeruginosa PA01
uucggcaaggcgcagc

SEQ ID NO: 3411079 - RNA, 14 nt, Pseudomonas aeruginosa PA01
uucggcagccauuu

SEQ ID NO: 3411080 - RNA, 19 nt, Pseudomonas aeruginosa PA01
uucggcagguugcucgccu

SEQ ID NO: 3411081 - RNA, 19 nt, Pseudomonas aeruginosa PA01
uucggcauuacuugcccac

SEQ ID NO: 3411082 - RNA, 14 nt, Pseudomonas aeruginosa PA01
uucggccagccggc

SEQ ID NO: 3411083 - RNA, 15 nt, Pseudomonas aeruginosa PA01
uucggccagccggcg

SEQ ID NO: 3411084 - RNA, 12 nt, Pseudomonas aeruginosa PA01
uucggccagcgg

SEQ ID NO: 3411085 - RNA, 11 nt, Pseudomonas aeruginosa PA01
uucggccaggg

SEQ ID NO: 3411086 - RNA, 23 nt, Pseudomonas aeruginosa PA01
uucggccagggagucgcuggcca

SEQ ID NO: 3411087 - RNA, 17 nt, Pseudomonas aeruginosa PA01
uucggccaguucgagca

SEQ ID NO: 3411088 - RNA, 16 nt, Pseudomonas aeruginosa PA01
uucggcgagaggucgg

SEQ ID NO: 3411089 - RNA, 16 nt, Pseudomonas aeruginosa PA01
uucggcgagcagguag

SEQ ID NO: 3411090 - RNA, 19 nt, Pseudomonas aeruginosa PA01
uucggcgaggaucgccagc

SEQ ID NO: 3411091 - RNA, 16 nt, Pseudomonas aeruginosa PA01
uucggcgaugccgcgc

SEQ ID NO: 3411092 - RNA, 23 nt, Pseudomonas aeruginosa PA01
uucggcgaugccgcgccaggcgc

SEQ ID NO: 3411093 - RNA, 23 nt, Pseudomonas aeruginosa PA01
uucggcgcauagccaccgccgac

SEQ ID NO: 3411094 - RNA, 12 nt, Pseudomonas aeruginosa PA01
uucggcgccagc

SEQ ID NO: 3411095 - RNA, 13 nt, Pseudomonas aeruginosa PA01
uucggcgcccagg

SEQ ID NO: 3411096 - RNA, 17 nt, Pseudomonas aeruginosa PA01
uucggcgcccagguagg

SEQ ID NO: 3411097 - RNA, 12 nt, Pseudomonas aeruginosa PA01
uucggcgccgga

SEQ ID NO: 3411098 - RNA, 20 nt, Pseudomonas aeruginosa PA01
uucggcgccggagcugguca

SEQ ID NO: 3411099 - RNA, 15 nt, Pseudomonas aeruginosa PA01
uucggcgcgcggcag

SEQ ID NO: 3411100 - RNA, 13 nt, Pseudomonas aeruginosa PA01
uucggcgcuggcg

SEQ ID NO: 3411101 - RNA, 17 nt, Pseudomonas aeruginosa PA01
uucggcggcgccuugcg

SEQ ID NO: 3411102 - RNA, 13 nt, Pseudomonas aeruginosa PA01
uucggcggcgugc

SEQ ID NO: 3411103 - RNA, 22 nt, Pseudomonas aeruginosa PA01
uucggcguccugcucccuggcg

SEQ ID NO: 3411104 - RNA, 14 nt, Pseudomonas aeruginosa PA01
uucggcgucgaagu

SEQ ID NO: 3411105 - RNA, 18 nt, Pseudomonas aeruginosa PA01
uucggcgugauccgcagg

SEQ ID NO: 3411106 - RNA, 21 nt, Pseudomonas aeruginosa PA01
uucggcgugauccgcagguag

SEQ ID NO: 3411107 - RNA, 13 nt, Pseudomonas aeruginosa PA01
uucggcuggaccu

SEQ ID NO: 3411108 - RNA, 20 nt, Pseudomonas aeruginosa PA01
uucggcuguuucaggccggc

SEQ ID NO: 3411109 - RNA, 18 nt, Pseudomonas aeruginosa PA01
uucgggagagcccgggcg

SEQ ID NO: 3411110 - RNA, 19 nt, Pseudomonas aeruginosa PA01
uucggggaacagcgccagc

SEQ ID NO: 3411111 - RNA, 23 nt, Pseudomonas aeruginosa PA01
uucggggaacagcgccagcggca

SEQ ID NO: 3411112 - RNA, 18 nt, Pseudomonas aeruginosa PA01
uucggggcccuccaggcg

SEQ ID NO: 3411113 - RNA, 18 nt, Pseudomonas aeruginosa PA01
uucggggucggccugcgg

SEQ ID NO: 3411114 - RNA, 18 nt, Pseudomonas aeruginosa PA01
uucggggugcaggggcgc

SEQ ID NO: 3411115 - RNA, 15 nt, Pseudomonas aeruginosa PA01
uucggguccaggcgc

SEQ ID NO: 3411116 - RNA, 21 nt, Pseudomonas aeruginosa PA01
uucggguccaggcgccagagc

SEQ ID NO: 3411117 - RNA, 22 nt, Pseudomonas aeruginosa PA01
uucggucgaucguugccagccg

SEQ ID NO: 3411118 - RNA, 15 nt, Pseudomonas aeruginosa PA01
uucggucgcgccccg

SEQ ID NO: 3411119 - RNA, 15 nt, Pseudomonas aeruginosa PA01
uucggugccgccggc

SEQ ID NO: 3411120 - RNA, 16 nt, Pseudomonas aeruginosa PA01
uucguaggucaugcgu

SEQ ID NO: 3411121 - RNA, 19 nt, Pseudomonas aeruginosa PA01
uucgucaccggcgccaccc

SEQ ID NO: 3411122 - RNA, 14 nt, Pseudomonas aeruginosa PA01
uucguccaggccgc

SEQ ID NO: 3411123 - RNA, 18 nt, Pseudomonas aeruginosa PA01
uucguccaugcucgccac

SEQ ID NO: 3411124 - RNA, 14 nt, Pseudomonas aeruginosa PA01
uucguccgccacca

SEQ ID NO: 3411125 - RNA, 22 nt, Pseudomonas aeruginosa PA01
uucguccugcugcuggccuucg

SEQ ID NO: 3411126 - RNA, 21 nt, Pseudomonas aeruginosa PA01
uucgucgagggucugcuggua

SEQ ID NO: 3411127 - RNA, 13 nt, Pseudomonas aeruginosa PA01
uucgucgccagcc

SEQ ID NO: 3411128 - RNA, 12 nt, Pseudomonas aeruginosa PA01
uucgucgcgcag

SEQ ID NO: 3411129 - RNA, 19 nt, Pseudomonas aeruginosa PA01
uucgucuggcgccuggccu

SEQ ID NO: 3411130 - RNA, 23 nt, Pseudomonas aeruginosa PA01
uucgugaaacgccagaagcgacu

SEQ ID NO: 3411131 - RNA, 21 nt, Pseudomonas aeruginosa PA01
uugaucgagcccuugcgcggc

SEQ ID NO: 3411132 - RNA, 19 nt, Pseudomonas aeruginosa PA01
uugaucgagucgccggcga

SEQ ID NO: 3411133 - RNA, 16 nt, Pseudomonas aeruginosa PA01
uugaucgccgcgccgc

SEQ ID NO: 3411134 - RNA, 23 nt, Pseudomonas aeruginosa PA01
uugaucuuguccgggaaguccgg

SEQ ID NO: 3411135 - RNA, 13 nt, Pseudomonas aeruginosa PA01
uugaucuuguccu

SEQ ID NO: 3411136 - RNA, 13 nt, Pseudomonas aeruginosa PA01
uugaugaagcccg

SEQ ID NO: 3411137 - RNA, 13 nt, Pseudomonas aeruginosa PA01
uugauuccgccgg

SEQ ID NO: 3411138 - RNA, 19 nt, Pseudomonas aeruginosa PA01
uugcaccgcuugccagccg

SEQ ID NO: 3411139 - RNA, 20 nt, Pseudomonas aeruginosa PA01
uugcacgucgguucagcgcg

SEQ ID NO: 3411140 - RNA, 17 nt, Pseudomonas aeruginosa PA01
uugcagagcggccaggu

SEQ ID NO: 3411141 - RNA, 20 nt, Pseudomonas aeruginosa PA01
uugcagcaacucgccgccga

SEQ ID NO: 3411142 - RNA, 23 nt, Pseudomonas aeruginosa PA01
uugcagcacccccagcaggccag

SEQ ID NO: 3411143 - RNA, 22 nt, Pseudomonas aeruginosa PA01
uugcagcagaaguuguucgaug

SEQ ID NO: 3411144 - RNA, 13 nt, Pseudomonas aeruginosa PA01
uugcagccaccag

SEQ ID NO: 3411145 - RNA, 14 nt, Pseudomonas aeruginosa PA01
uugcagccaccagc

SEQ ID NO: 3411146 - RNA, 19 nt, Pseudomonas aeruginosa PA01
uugcaggcccggccgccug

SEQ ID NO: 3411147 - RNA, 16 nt, Pseudomonas aeruginosa PA01
uugcaggccggcgagc

SEQ ID NO: 3411148 - RNA, 22 nt, Pseudomonas aeruginosa PA01
uugcagggggcuuugcggcccu

SEQ ID NO: 3411149 - RNA, 15 nt, Pseudomonas aeruginosa PA01
uugcagggucgccgg

SEQ ID NO: 3411150 - RNA, 24 nt, Pseudomonas aeruginosa PA01
uugcagguaguucuccaggcccau

SEQ ID NO: 3411151 - RNA, 14 nt, Pseudomonas aeruginosa PA01
uugcaguaccugcu

SEQ ID NO: 3411152 - RNA, 18 nt, Pseudomonas aeruginosa PA01
uugcagugcgccgcagcg

SEQ ID NO: 3411153 - RNA, 18 nt, Pseudomonas aeruginosa PA01
uugcaugaccuucaggua

SEQ ID NO: 3411154 - RNA, 18 nt, Pseudomonas aeruginosa PA01
uugcauggcaugcaagag

SEQ ID NO: 3411155 - RNA, 21 nt, Pseudomonas aeruginosa PA01
uugccaagguguggccgagcc

SEQ ID NO: 3411156 - RNA, 15 nt, Pseudomonas aeruginosa PA01
uugccagaguugccu

SEQ ID NO: 3411157 - RNA, 18 nt, Pseudomonas aeruginosa PA01
uugccagccggccuugcu

SEQ ID NO: 3411158 - RNA, 12 nt, Pseudomonas aeruginosa PA01
uugccaggagga

SEQ ID NO: 3411159 - RNA, 17 nt, Pseudomonas aeruginosa PA01
uugccagguauuccgcc

SEQ ID NO: 3411160 - RNA, 16 nt, Pseudomonas aeruginosa PA01
uugccauccuccagca

SEQ ID NO: 3411161 - RNA, 13 nt, Pseudomonas aeruginosa PA01
uugcccaccagcg

SEQ ID NO: 3411162 - RNA, 12 nt, Pseudomonas aeruginosa PA01
uugcccaccggg

SEQ ID NO: 3411163 - RNA, 15 nt, Pseudomonas aeruginosa PA01
uugcccacggccagg

SEQ ID NO: 3411164 - RNA, 17 nt, Pseudomonas aeruginosa PA01
uugcccacggccaggcc

SEQ ID NO: 3411165 - RNA, 21 nt, Pseudomonas aeruginosa PA01
uugcccacggccaggcccacg

SEQ ID NO: 3411166 - RNA, 19 nt, Pseudomonas aeruginosa PA01
uugcccagguagucgccca

SEQ ID NO: 3411167 - RNA, 15 nt, Pseudomonas aeruginosa PA01
uugcccaugugcagc

SEQ ID NO: 3411168 - RNA, 12 nt, Pseudomonas aeruginosa PA01
uugcccggcgag

SEQ ID NO: 3411169 - RNA, 15 nt, Pseudomonas aeruginosa PA01
uugcccggcuugccg

SEQ ID NO: 3411170 - RNA, 18 nt, Pseudomonas aeruginosa PA01
uugcccgguggccuccug

SEQ ID NO: 3411171 - RNA, 22 nt, Pseudomonas aeruginosa PA01
uugcccgucuagcgcaggcgga

SEQ ID NO: 3411172 - RNA, 13 nt, Pseudomonas aeruginosa PA01
uugcccucgcgcu

SEQ ID NO: 3411173 - RNA, 17 nt, Pseudomonas aeruginosa PA01
uugcccugccagcgggc

SEQ ID NO: 3411174 - RNA, 13 nt, Pseudomonas aeruginosa PA01
uugcccuggccgg

SEQ ID NO: 3411175 - RNA, 13 nt, Pseudomonas aeruginosa PA01
uugccgaacugca

SEQ ID NO: 3411176 - RNA, 22 nt, Pseudomonas aeruginosa PA01
uugccgaagauacccagcgggc

SEQ ID NO: 3411177 - RNA, 20 nt, Pseudomonas aeruginosa PA01
uugccgaagcgcucggucag

SEQ ID NO: 3411178 - RNA, 13 nt, Pseudomonas aeruginosa PA01
uugccgacgccgc

SEQ ID NO: 3411179 - RNA, 19 nt, Pseudomonas aeruginosa PA01
uugccgaucaggcugaagc

SEQ ID NO: 3411180 - RNA, 23 nt, Pseudomonas aeruginosa PA01
uugccgaugccggaaagccuggc

SEQ ID NO: 3411181 - RNA, 22 nt, Pseudomonas aeruginosa PA01
uugccgaugguuucgugccauu

SEQ ID NO: 3411182 - RNA, 17 nt, Pseudomonas aeruginosa PA01
uugccgcagcagcggcg

SEQ ID NO: 3411183 - RNA, 18 nt, Pseudomonas aeruginosa PA01
uugccgcaggucuugucg

SEQ ID NO: 3411184 - RNA, 11 nt, Pseudomonas aeruginosa PA01
uugccgccgau

SEQ ID NO: 3411185 - RNA, 21 nt, Pseudomonas aeruginosa PA01
uugccgccgguucgcaggcca

SEQ ID NO: 3411186 - RNA, 20 nt, Pseudomonas aeruginosa PA01
uugccgcgagcuuggcccug

SEQ ID NO: 3411187 - RNA, 23 nt, Pseudomonas aeruginosa PA01
uugccgcgagcuuggcccuggcc

SEQ ID NO: 3411188 - RNA, 16 nt, Pseudomonas aeruginosa PA01
uugccgcucaggcugu

SEQ ID NO: 3411189 - RNA, 16 nt, Pseudomonas aeruginosa PA01
uugccgcuggccucga

SEQ ID NO: 3411190 - RNA, 20 nt, Pseudomonas aeruginosa PA01
uugccgcuggugaucgacca

SEQ ID NO: 3411191 - RNA, 22 nt, Pseudomonas aeruginosa PA01
uugccggacaacaggccgggcg

SEQ ID NO: 3411192 - RNA, 12 nt, Pseudomonas aeruginosa PA01
uugccggcgcca

SEQ ID NO: 3411193 - RNA, 19 nt, Pseudomonas aeruginosa PA01
uugccggcggcgcugagga

SEQ ID NO: 3411194 - RNA, 19 nt, Pseudomonas aeruginosa PA01
uugccgggcuuccuggccg

SEQ ID NO: 3411195 - RNA, 17 nt, Pseudomonas aeruginosa PA01
uugccgguagccggcga

SEQ ID NO: 3411196 - RNA, 12 nt, Pseudomonas aeruginosa PA01
uugccggugcgg

SEQ ID NO: 3411197 - RNA, 15 nt, Pseudomonas aeruginosa PA01
uugccguagcgaugc

SEQ ID NO: 3411198 - RNA, 17 nt, Pseudomonas aeruginosa PA01
uugccguccagccggcg

SEQ ID NO: 3411199 - RNA, 18 nt, Pseudomonas aeruginosa PA01
uugccguccagccggcgc

SEQ ID NO: 3411200 - RNA, 14 nt, Pseudomonas aeruginosa PA01
uugccguccgucgg

SEQ ID NO: 3411201 - RNA, 19 nt, Pseudomonas aeruginosa PA01
uugccguccuucaggacga

SEQ ID NO: 3411202 - RNA, 23 nt, Pseudomonas aeruginosa PA01
uugccguccuucaggacgaaacc

SEQ ID NO: 3411203 - RNA, 17 nt, Pseudomonas aeruginosa PA01
uugccguggcggcgcgc

SEQ ID NO: 3411204 - RNA, 14 nt, Pseudomonas aeruginosa PA01
uugccuccgcucug

SEQ ID NO: 3411205 - RNA, 18 nt, Pseudomonas aeruginosa PA01
uugccuccgcucugcugg

SEQ ID NO: 3411206 - RNA, 21 nt, Pseudomonas aeruginosa PA01
uugccuccgcucugcuggcca

SEQ ID NO: 3411207 - RNA, 12 nt, Pseudomonas aeruginosa PA01
uugccuguccag

SEQ ID NO: 3411208 - RNA, 16 nt, Pseudomonas aeruginosa PA01
uugccuucguuggccu

SEQ ID NO: 3411209 - RNA, 15 nt, Pseudomonas aeruginosa PA01
uugcgaaaagcccgc

SEQ ID NO: 3411210 - RNA, 16 nt, Pseudomonas aeruginosa PA01
uugcgacugacgcuca

SEQ ID NO: 3411211 - RNA, 18 nt, Pseudomonas aeruginosa PA01
uugcgagcgagcuugcaa

SEQ ID NO: 3411212 - RNA, 23 nt, Pseudomonas aeruginosa PA01
uugcgauagaccaggaaggccgg

SEQ ID NO: 3411213 - RNA, 15 nt, Pseudomonas aeruginosa PA01
uugcgaugggugccg

SEQ ID NO: 3411214 - RNA, 14 nt, Pseudomonas aeruginosa PA01
uugcgcaccagggc

SEQ ID NO: 3411215 - RNA, 16 nt, Pseudomonas aeruginosa PA01
uugcgcaccagggcca

SEQ ID NO: 3411216 - RNA, 18 nt, Pseudomonas aeruginosa PA01
uugcgcaccgccugcagc

SEQ ID NO: 3411217 - RNA, 20 nt, Pseudomonas aeruginosa PA01
uugcgcacgcaauagugcag

SEQ ID NO: 3411218 - RNA, 22 nt, Pseudomonas aeruginosa PA01
uugcgcaggcgguaggugagcg

SEQ ID NO: 3411219 - RNA, 18 nt, Pseudomonas aeruginosa PA01
uugcgccauugccgccag

SEQ ID NO: 3411220 - RNA, 22 nt, Pseudomonas aeruginosa PA01
uugcgccauuucaaggcgacgc

SEQ ID NO: 3411221 - RNA, 16 nt, Pseudomonas aeruginosa PA01
uugcgcccgucgaaga

SEQ ID NO: 3411222 - RNA, 10 nt, Pseudomonas aeruginosa PA01
uugcgccgcc

SEQ ID NO: 3411223 - RNA, 18 nt, Pseudomonas aeruginosa PA01
uugcgccgccucgcgcaa

SEQ ID NO: 3411224 - RNA, 17 nt, Pseudomonas aeruginosa PA01
uugcgccgccugcggcu

SEQ ID NO: 3411225 - RNA, 20 nt, Pseudomonas aeruginosa PA01
uugcgccguggcaccagguc

SEQ ID NO: 3411226 - RNA, 12 nt, Pseudomonas aeruginosa PA01
uugcgccucguc

SEQ ID NO: 3411227 - RNA, 14 nt, Pseudomonas aeruginosa PA01
uugcgcgcauagca

SEQ ID NO: 3411228 - RNA, 15 nt, Pseudomonas aeruginosa PA01
uugcgcgccagcgcc

SEQ ID NO: 3411229 - RNA, 14 nt, Pseudomonas aeruginosa PA01
uugcgcgccgccgc

SEQ ID NO: 3411230 - RNA, 23 nt, Pseudomonas aeruginosa PA01
uugcgcgcggcgucgaccacggc

SEQ ID NO: 3411231 - RNA, 18 nt, Pseudomonas aeruginosa PA01
uugcgcguggcgucggcg

SEQ ID NO: 3411232 - RNA, 18 nt, Pseudomonas aeruginosa PA01
uugcgcuccacccaggcg

SEQ ID NO: 3411233 - RNA, 20 nt, Pseudomonas aeruginosa PA01
uugcgcuccacccaggcgcc

SEQ ID NO: 3411234 - RNA, 20 nt, Pseudomonas aeruginosa PA01
uuggucugcucggcgauggc

SEQ ID NO: 3411235 - RNA, 18 nt, Pseudomonas aeruginosa PA01
uuggugcugccgaugcug

SEQ ID NO: 3411236 - RNA, 18 nt, Pseudomonas aeruginosa PA01
uuggugcugcgcgcggcc

SEQ ID NO: 3411237 - RNA, 23 nt, Pseudomonas aeruginosa PA01
uuguacagcgaggcccgcgccgc

SEQ ID NO: 3411238 - RNA, 16 nt, Pseudomonas aeruginosa PA01
uuguagaucggcagca

SEQ ID NO: 3411239 - RNA, 19 nt, Pseudomonas aeruginosa PA01
uuguagaucugcaccgccc

SEQ ID NO: 3411240 - RNA, 16 nt, Pseudomonas aeruginosa PA01
uuguauaccagcggcu

SEQ ID NO: 3411241 - RNA, 11 nt, Pseudomonas aeruginosa PA01
uuguccaggcu

SEQ ID NO: 3411242 - RNA, 22 nt, Pseudomonas aeruginosa PA01
uuguccaggcuguggcgcggcu

SEQ ID NO: 3411243 - RNA, 12 nt, Pseudomonas aeruginosa PA01
uuguccagggcc

SEQ ID NO: 3411244 - RNA, 15 nt, Pseudomonas aeruginosa PA01
uuguccaggguuucc

SEQ ID NO: 3411245 - RNA, 22 nt, Pseudomonas aeruginosa PA01
uuguccgcgcgcuuccaggcac

SEQ ID NO: 3411246 - RNA, 10 nt, Pseudomonas aeruginosa PA01
uuguccggcc

SEQ ID NO: 3411247 - RNA, 14 nt, Pseudomonas aeruginosa PA01
uuguccggcccgga

SEQ ID NO: 3411248 - RNA, 17 nt, Pseudomonas aeruginosa PA01
uuguccggcccggagcg

SEQ ID NO: 3411249 - RNA, 14 nt, Pseudomonas aeruginosa PA01
uuguccuccagcug

SEQ ID NO: 3411250 - RNA, 15 nt, Pseudomonas aeruginosa PA01
uuguccucggcggcu

SEQ ID NO: 3411251 - RNA, 16 nt, Pseudomonas aeruginosa PA01
uuguccugcggccggg

SEQ ID NO: 3411252 - RNA, 13 nt, Pseudomonas aeruginosa PA01
uuguccuuggccu

SEQ ID NO: 3411253 - RNA, 22 nt, Pseudomonas aeruginosa PA01
uugucgauggucuugaucccag

SEQ ID NO: 3411254 - RNA, 17 nt, Pseudomonas aeruginosa PA01
uugucgccgcuggacga

SEQ ID NO: 3411255 - RNA, 22 nt, Pseudomonas aeruginosa PA01
uugucgccgcuggacgaaccga

SEQ ID NO: 3411256 - RNA, 23 nt, Pseudomonas aeruginosa PA01
uugucgccuucccggucgacggc

SEQ ID NO: 3411257 - RNA, 16 nt, Pseudomonas aeruginosa PA01
uugucgcggcugacga

SEQ ID NO: 3411258 - RNA, 13 nt, Pseudomonas aeruginosa PA01
uugucgcguccgg

SEQ ID NO: 3411259 - RNA, 19 nt, Pseudomonas aeruginosa PA01
uugucgcguccggccagcc

SEQ ID NO: 3411260 - RNA, 16 nt, Pseudomonas aeruginosa PA01
uugucggccagcagca

SEQ ID NO: 3411261 - RNA, 19 nt, Pseudomonas aeruginosa PA01
uugugauguaagacuggug

SEQ ID NO: 3411262 - RNA, 17 nt, Pseudomonas aeruginosa PA01
uuguggguaagcucgau

SEQ ID NO: 3411263 - RNA, 15 nt, Pseudomonas aeruginosa PA01
uuguuauggccgacc

SEQ ID NO: 3411264 - RNA, 21 nt, Pseudomonas aeruginosa PA01
uuguucggcugggccaggauc

SEQ ID NO: 3411265 - RNA, 20 nt, Pseudomonas aeruginosa PA01
uuguucgggguggcgaaggc

SEQ ID NO: 3411266 - RNA, 17 nt, Pseudomonas aeruginosa PA01
uuguucuucauccaguc

SEQ ID NO: 3411267 - RNA, 14 nt, Pseudomonas aeruginosa PA01
uuuaagagaaugcg

SEQ ID NO: 3411268 - RNA, 22 nt, Pseudomonas aeruginosa PA01
uuuaccaggaccagcgccugcu

SEQ ID NO: 3411269 - RNA, 20 nt, Pseudomonas aeruginosa PA01
uuuagaaaaauauauuccuu

SEQ ID NO: 3411270 - RNA, 14 nt, Pseudomonas aeruginosa PA01
uuuagggauggaua

SEQ ID NO: 3411271 - RNA, 22 nt, Pseudomonas aeruginosa PA01
uuuauccacgcgguuccacucc

SEQ ID NO: 3411272 - RNA, 12 nt, Pseudomonas aeruginosa PA01
uuucaaccaggc

SEQ ID NO: 3411273 - RNA, 20 nt, Pseudomonas aeruginosa PA01
uuucaccgguaccacgggca

SEQ ID NO: 3411274 - RNA, 17 nt, Pseudomonas aeruginosa PA01
uuucagaacgucggcgg

SEQ ID NO: 3411275 - RNA, 18 nt, Pseudomonas aeruginosa PA01
uuucagcgcuugcuggcg

SEQ ID NO: 3411276 - RNA, 17 nt, Pseudomonas aeruginosa PA01
uuucaugcggccgaugc

SEQ ID NO: 3411277 - RNA, 16 nt, Pseudomonas aeruginosa PA01
uuucauggccuggcgc

SEQ ID NO: 3411278 - RNA, 22 nt, Pseudomonas aeruginosa PA01
uuucauggccuggcgcucagcg

SEQ ID NO: 3411279 - RNA, 14 nt, Pseudomonas aeruginosa PA01
uuucaugggcgggg

SEQ ID NO: 3411280 - RNA, 13 nt, Pseudomonas aeruginosa PA01
uuucauugcgcac

SEQ ID NO: 3411281 - RNA, 16 nt, Pseudomonas aeruginosa PA01
uuucauuuuccauuga

SEQ ID NO: 3411282 - RNA, 22 nt, Pseudomonas aeruginosa PA01
uuuccagcagcacccggaccuu

SEQ ID NO: 3411283 - RNA, 22 nt, Pseudomonas aeruginosa PA01
uuuccagcggcuccuggaugcu

SEQ ID NO: 3411284 - RNA, 16 nt, Pseudomonas aeruginosa PA01
uuuccagggccuggcg

SEQ ID NO: 3411285 - RNA, 14 nt, Pseudomonas aeruginosa PA01
uuucccauauggaa

SEQ ID NO: 3411286 - RNA, 11 nt, Pseudomonas aeruginosa PA01
uuucccauugu

SEQ ID NO: 3411287 - RNA, 16 nt, Pseudomonas aeruginosa PA01
uuucccauuguuggcg

SEQ ID NO: 3411288 - RNA, 16 nt, Pseudomonas aeruginosa PA01
uuuccccguggcgccg

SEQ ID NO: 3411289 - RNA, 14 nt, Pseudomonas aeruginosa PA01
uuucccgcaccggc

SEQ ID NO: 3411290 - RNA, 18 nt, Pseudomonas aeruginosa PA01
uuuccgauccuccugggg

SEQ ID NO: 3411291 - RNA, 17 nt, Pseudomonas aeruginosa PA01
uuuccgcuguccgccgc

SEQ ID NO: 3411292 - RNA, 20 nt, Pseudomonas aeruginosa PA01
uuuccgcuguccgccgccgc

SEQ ID NO: 3411293 - RNA, 13 nt, Pseudomonas aeruginosa PA01
uuuccggccaggc

SEQ ID NO: 3411294 - RNA, 18 nt, Pseudomonas aeruginosa PA01
uuuccggcuugccgaugu

SEQ ID NO: 3411295 - RNA, 20 nt, Pseudomonas aeruginosa PA01
uuuccggugcaccugggugc

SEQ ID NO: 3411296 - RNA, 18 nt, Pseudomonas aeruginosa PA01
uuuccguuguggcggcgc

SEQ ID NO: 3411297 - RNA, 15 nt, Pseudomonas aeruginosa PA01
uuuccucagcucugu

SEQ ID NO: 3411298 - RNA, 14 nt, Pseudomonas aeruginosa PA01
uuuccucggccaug

SEQ ID NO: 3411299 - RNA, 23 nt, Pseudomonas aeruginosa PA01
uuuccucuaugggacgaccucag

SEQ ID NO: 3411300 - RNA, 12 nt, Pseudomonas aeruginosa PA01
uuuccugcgccu

SEQ ID NO: 3411301 - RNA, 19 nt, Pseudomonas aeruginosa PA01
uuuccugcuccagcagggc

SEQ ID NO: 3411302 - RNA, 14 nt, Pseudomonas aeruginosa PA01
uuuccugcugagca

SEQ ID NO: 3411303 - RNA, 13 nt, Pseudomonas aeruginosa PA01
uuuccugcuggcg

SEQ ID NO: 3411304 - RNA, 13 nt, Pseudomonas aeruginosa PA01
uuuccuucggcac

SEQ ID NO: 3411305 - RNA, 22 nt, Pseudomonas aeruginosa PA01
uuucgaacaaucccagcucgcc

SEQ ID NO: 3411306 - RNA, 16 nt, Pseudomonas aeruginosa PA01
uuucgaagccgccgcc

SEQ ID NO: 3411307 - RNA, 14 nt, Pseudomonas aeruginosa PA01
uuucgcagucgggc

SEQ ID NO: 3411308 - RNA, 23 nt, Pseudomonas aeruginosa PA01
uuucguagggcgaauaucgcggc

SEQ ID NO: 3411309 - RNA, 14 nt, Pseudomonas aeruginosa PA01
uuucguuggccagg

SEQ ID NO: 3411310 - RNA, 22 nt, Pseudomonas aeruginosa PA01
uuucguuggccaggaagcgggc

SEQ ID NO: 3411311 - RNA, 14 nt, Pseudomonas aeruginosa PA01
uuucguuggcccag

SEQ ID NO: 3411312 - RNA, 16 nt, Pseudomonas aeruginosa PA01
uuucguuuccggcagg

SEQ ID NO: 3411313 - RNA, 14 nt, Pseudomonas aeruginosa PA01
uuucuaucucccua

SEQ ID NO: 3411314 - RNA, 14 nt, Pseudomonas aeruginosa PA01
uuucuccggcgccg

SEQ ID NO: 3411315 - RNA, 21 nt, Pseudomonas aeruginosa PA01
uuucucgccucccggcucgcc

SEQ ID NO: 3411316 - RNA, 16 nt, Pseudomonas aeruginosa PA01
uuucucggucgccgcc

SEQ ID NO: 3411317 - RNA, 12 nt, Pseudomonas aeruginosa PA01
uuucugcuggcc

SEQ ID NO: 3411318 - RNA, 14 nt, Pseudomonas aeruginosa PA01
uuucugcuggccac

SEQ ID NO: 3411319 - RNA, 15 nt, Pseudomonas aeruginosa PA01
uuucugcuggccacc

SEQ ID NO: 3411320 - RNA, 17 nt, Pseudomonas aeruginosa PA01
uuugaacgcuguagaau

SEQ ID NO: 3411321 - RNA, 18 nt, Pseudomonas aeruginosa PA01
uuugaacgggcucaccca

SEQ ID NO: 3411322 - RNA, 14 nt, Pseudomonas aeruginosa PA01
uuugcagggcgauc

SEQ ID NO: 3411323 - RNA, 13 nt, Pseudomonas aeruginosa PA01
uuugcccggcgag

SEQ ID NO: 3411324 - RNA, 23 nt, Pseudomonas aeruginosa PA01
uuugccgucccggaguuccagcg

SEQ ID NO: 3411325 - RNA, 13 nt, Pseudomonas aeruginosa PA01
uuugccgucggcg

SEQ ID NO: 3411326 - RNA, 12 nt, Pseudomonas aeruginosa PA01
uuugcugcacgc

SEQ ID NO: 3411327 - RNA, 12 nt, Pseudomonas aeruginosa PA01
uuugggcucaga

SEQ ID NO: 3411328 - RNA, 20 nt, Pseudomonas aeruginosa PA01
uuuuacucgucgccaaagaa

SEQ ID NO: 3411329 - RNA, 21 nt, Pseudomonas aeruginosa PA01
uuuuaucucuuuuuaagagaa

SEQ ID NO: 3411330 - RNA, 16 nt, Pseudomonas aeruginosa PA01
uuuucaauuccgccgc

SEQ ID NO: 3411331 - RNA, 17 nt, Pseudomonas aeruginosa PA01
uuuucaggcgacgccgc

SEQ ID NO: 3411332 - RNA, 14 nt, Pseudomonas aeruginosa PA01
uuuuccaacuccac

SEQ ID NO: 3411333 - RNA, 12 nt, Pseudomonas aeruginosa PA01
uuuuccugcugg

SEQ ID NO: 3411334 - RNA, 14 nt, Pseudomonas aeruginosa PA01
uuuucgcuccucag

SEQ ID NO: 3411335 - RNA, 15 nt, Pseudomonas aeruginosa PA01
uuuucgcuuugcgcg

SEQ ID NO: 3411336 - RNA, 16 nt, Pseudomonas aeruginosa PA01
uuuucggcggccaggc

SEQ ID NO: 3411337 - RNA, 14 nt, Pseudomonas aeruginosa PA01
uuuucguuggccag

SEQ ID NO: 3411338 - RNA, 13 nt, Pseudomonas aeruginosa PA01
agcaggacggcga

SEQ ID NO: 3411339 - RNA, 14 nt, Pseudomonas aeruginosa PA01
agcaggacgucgag

SEQ ID NO: 3411340 - RNA, 20 nt, Pseudomonas aeruginosa PA01
agcaggagaagcgccucgcc

SEQ ID NO: 3411341 - RNA, 15 nt, Pseudomonas aeruginosa PA01
agcaggagcagcuug

SEQ ID NO: 3411342 - RNA, 13 nt, Pseudomonas aeruginosa PA01
agcaggagcgcca

SEQ ID NO: 3411343 - RNA, 20 nt, Pseudomonas aeruginosa PA01
agcaggagcgccaucagcga

SEQ ID NO: 3411344 - RNA, 17 nt, Pseudomonas aeruginosa PA01
agcaggaggauacggcg

SEQ ID NO: 3411345 - RNA, 20 nt, Pseudomonas aeruginosa PA01
agcaggaggauacggcgcag

SEQ ID NO: 3411346 - RNA, 20 nt, Pseudomonas aeruginosa PA01
agcaggaucgacagcagcgc

SEQ ID NO: 3411347 - RNA, 22 nt, Pseudomonas aeruginosa PA01
agcaggaucggagagacccgcc

SEQ ID NO: 3411348 - RNA, 21 nt, Pseudomonas aeruginosa PA01
agcaggaugaucacguugaac

SEQ ID NO: 3411349 - RNA, 15 nt, Pseudomonas aeruginosa PA01
agcaggaugcagucg

SEQ ID NO: 3411350 - RNA, 13 nt, Pseudomonas aeruginosa PA01
agcaggaugcugc

SEQ ID NO: 3411351 - RNA, 18 nt, Pseudomonas aeruginosa PA01
agcaggaugcugcacagc

SEQ ID NO: 3411352 - RNA, 14 nt, Pseudomonas aeruginosa PA01
agcaggcaggcgcg

SEQ ID NO: 3411353 - RNA, 14 nt, Pseudomonas aeruginosa PA01
agcaggccaugggu

SEQ ID NO: 3411354 - RNA, 22 nt, Pseudomonas aeruginosa PA01
agcaggccaugggugucggcga

SEQ ID NO: 3411355 - RNA, 23 nt, Pseudomonas aeruginosa PA01
agcaggccaugggugucggcgau

SEQ ID NO: 3411356 - RNA, 14 nt, Pseudomonas aeruginosa PA01
agcaggcccagcca

SEQ ID NO: 3411357 - RNA, 18 nt, Pseudomonas aeruginosa PA01
agcaggcccaugaugguc

SEQ ID NO: 3411358 - RNA, 16 nt, Pseudomonas aeruginosa PA01
agcaggcccgagccgg

SEQ ID NO: 3411359 - RNA, 13 nt, Pseudomonas aeruginosa PA01
agcaggccgaagg

SEQ ID NO: 3411360 - RNA, 14 nt, Pseudomonas aeruginosa PA01
agcaggccgaaggc

SEQ ID NO: 3411361 - RNA, 19 nt, Pseudomonas aeruginosa PA01
agcaggccgaaggccagga

SEQ ID NO: 3411362 - RNA, 20 nt, Pseudomonas aeruginosa PA01
agcaggccgaaggccaggac

SEQ ID NO: 3411363 - RNA, 15 nt, Pseudomonas aeruginosa PA01
agcaggccgacggcg

SEQ ID NO: 3411364 - RNA, 20 nt, Pseudomonas aeruginosa PA01
agcaggccgacggcgcgcug

SEQ ID NO: 3411365 - RNA, 13 nt, Pseudomonas aeruginosa PA01
agcaggccgagcc

SEQ ID NO: 3411366 - RNA, 23 nt, Pseudomonas aeruginosa PA01
agcaggccgagcccgagugcgcc

SEQ ID NO: 3411367 - RNA, 17 nt, Pseudomonas aeruginosa PA01
agcaggccgagcguggu

SEQ ID NO: 3411368 - RNA, 22 nt, Pseudomonas aeruginosa PA01
agcaggccgaggaggacgucgc

SEQ ID NO: 3411369 - RNA, 21 nt, Pseudomonas aeruginosa PA01
agcaggccgaggucggcggcg

SEQ ID NO: 3411370 - RNA, 20 nt, Pseudomonas aeruginosa PA01
agcaggccgaucaccagcgc

SEQ ID NO: 3411371 - RNA, 22 nt, Pseudomonas aeruginosa PA01
agcaggccgaucaccagcgcca

SEQ ID NO: 3411372 - RNA, 15 nt, Pseudomonas aeruginosa PA01
agcaggccgaucagc

SEQ ID NO: 3411373 - RNA, 18 nt, Pseudomonas aeruginosa PA01
agcaggccgaucagcggc

SEQ ID NO: 3411374 - RNA, 14 nt, Pseudomonas aeruginosa PA01
agcaggccgccgcg

SEQ ID NO: 3411375 - RNA, 15 nt, Pseudomonas aeruginosa PA01
agcaggccgccgcgu

SEQ ID NO: 3411376 - RNA, 16 nt, Pseudomonas aeruginosa PA01
agcaggccgccgcgug

SEQ ID NO: 3411377 - RNA, 12 nt, Pseudomonas aeruginosa PA01
agcaggccgcgg

SEQ ID NO: 3411378 - RNA, 16 nt, Pseudomonas aeruginosa PA01
agcaggccgcuggcga

SEQ ID NO: 3411379 - RNA, 13 nt, Pseudomonas aeruginosa PA01
agcaggccggcca

SEQ ID NO: 3411380 - RNA, 15 nt, Pseudomonas aeruginosa PA01
agcaggccggcgacc

SEQ ID NO: 3411381 - RNA, 19 nt, Pseudomonas aeruginosa PA01
agcaggccggcgaccagcg

SEQ ID NO: 3411382 - RNA, 20 nt, Pseudomonas aeruginosa PA01
agcaggccggcgaccagcgu

SEQ ID NO: 3411383 - RNA, 22 nt, Pseudomonas aeruginosa PA01
agcaggccgugggccggcgcgc

SEQ ID NO: 3411384 - RNA, 14 nt, Pseudomonas aeruginosa PA01
agcaggccuggagc

SEQ ID NO: 3411385 - RNA, 21 nt, Pseudomonas aeruginosa PA01
agcaggccuggagcgccucga

SEQ ID NO: 3411386 - RNA, 18 nt, Pseudomonas aeruginosa PA01
agcaggccuugcagggcc

SEQ ID NO: 3411387 - RNA, 19 nt, Pseudomonas aeruginosa PA01
agcaggccuugcagggccg

SEQ ID NO: 3411388 - RNA, 21 nt, Pseudomonas aeruginosa PA01
agcaggcgacaaaucggcauc

SEQ ID NO: 3411389 - RNA, 16 nt, Pseudomonas aeruginosa PA01
agcaggcgacggucag

SEQ ID NO: 3411390 - RNA, 18 nt, Pseudomonas aeruginosa PA01
agcaggcgacggucaggc

SEQ ID NO: 3411391 - RNA, 15 nt, Pseudomonas aeruginosa PA01
agcaggcgauacacc

SEQ ID NO: 3411392 - RNA, 16 nt, Pseudomonas aeruginosa PA01
agcaggcgcagcagcg

SEQ ID NO: 3411393 - RNA, 17 nt, Pseudomonas aeruginosa PA01
agcaggcgcaggucggc

SEQ ID NO: 3411394 - RNA, 13 nt, Pseudomonas aeruginosa PA01
agcaggcgccgcg

SEQ ID NO: 3411395 - RNA, 14 nt, Pseudomonas aeruginosa PA01
agcaggcgccgcgc

SEQ ID NO: 3411396 - RNA, 13 nt, Pseudomonas aeruginosa PA01
agcaggcgcgcca

SEQ ID NO: 3411397 - RNA, 16 nt, Pseudomonas aeruginosa PA01
agcaggcgcgccaggc

SEQ ID NO: 3411398 - RNA, 15 nt, Pseudomonas aeruginosa PA01
agcaggcgcgcccug

SEQ ID NO: 3411399 - RNA, 17 nt, Pseudomonas aeruginosa PA01
agcaggcgcgggcuggc

SEQ ID NO: 3411400 - RNA, 13 nt, Pseudomonas aeruginosa PA01
agcaggcgcucgg

SEQ ID NO: 3411401 - RNA, 15 nt, Pseudomonas aeruginosa PA01
agcaggcgcucggcg

SEQ ID NO: 3411402 - RNA, 16 nt, Pseudomonas aeruginosa PA01
agcaggcgcucggcga

SEQ ID NO: 3411403 - RNA, 21 nt, Pseudomonas aeruginosa PA01
agcaggcgcucggggaugucc

SEQ ID NO: 3411404 - RNA, 22 nt, Pseudomonas aeruginosa PA01
agcaggcggaaaaagcgcggag

SEQ ID NO: 3411405 - RNA, 22 nt, Pseudomonas aeruginosa PA01
agcaggcggagauugcggcgaa

SEQ ID NO: 3411406 - RNA, 15 nt, Pseudomonas aeruginosa PA01
agcaggcggaguagc

SEQ ID NO: 3411407 - RNA, 18 nt, Pseudomonas aeruginosa PA01
agcaggcggaguagccgg

SEQ ID NO: 3411408 - RNA, 18 nt, Pseudomonas aeruginosa PA01
agcaggcggaucgccgcc

SEQ ID NO: 3411409 - RNA, 23 nt, Pseudomonas aeruginosa PA01
agcaggcggaucgccgccuugcg

SEQ ID NO: 3411410 - RNA, 22 nt, Pseudomonas aeruginosa PA01
agcaggcgggaguccaggcggg

SEQ ID NO: 3411411 - RNA, 17 nt, Pseudomonas aeruginosa PA01
agcaggcgggcgaagua

SEQ ID NO: 3411412 - RNA, 17 nt, Pseudomonas aeruginosa PA01
agcaggcguucggcgau

SEQ ID NO: 3411413 - RNA, 13 nt, Pseudomonas aeruginosa PA01
agcaggcguugca

SEQ ID NO: 3411414 - RNA, 20 nt, Pseudomonas aeruginosa PA01
agcaggcguugcagugcgcc

SEQ ID NO: 3411415 - RNA, 21 nt, Pseudomonas aeruginosa PA01
agcaggcguugcagugcgccg

SEQ ID NO: 3411416 - RNA, 24 nt, Pseudomonas aeruginosa PA01
agcaggcguugcagugcgccgcag

SEQ ID NO: 3411417 - RNA, 17 nt, Pseudomonas aeruginosa PA01
agcaggcugccgagaau

SEQ ID NO: 3411418 - RNA, 21 nt, Pseudomonas aeruginosa PA01
agcaggcuggcggcaucggcg

SEQ ID NO: 3411419 - RNA, 17 nt, Pseudomonas aeruginosa PA01
agcaggcuguacagcag

SEQ ID NO: 3411420 - RNA, 16 nt, Pseudomonas aeruginosa PA01
agcagggagaaccagg

SEQ ID NO: 3411421 - RNA, 21 nt, Pseudomonas aeruginosa PA01
agcagggaggcgcacaucacc

SEQ ID NO: 3411422 - RNA, 13 nt, Pseudomonas aeruginosa PA01
agcagggccagca

SEQ ID NO: 3411423 - RNA, 16 nt, Pseudomonas aeruginosa PA01
agcagggccagcagcg

SEQ ID NO: 3411424 - RNA, 19 nt, Pseudomonas aeruginosa PA01
agcagggccagcagcgcug

SEQ ID NO: 3411425 - RNA, 21 nt, Pseudomonas aeruginosa PA01
agcagggccagccagagccag

SEQ ID NO: 3411426 - RNA, 14 nt, Pseudomonas aeruginosa PA01
agcagggccagcgc

SEQ ID NO: 3411427 - RNA, 13 nt, Pseudomonas aeruginosa PA01
agcagggccgagc

SEQ ID NO: 3411428 - RNA, 14 nt, Pseudomonas aeruginosa PA01
agcagggccgagcg

SEQ ID NO: 3411429 - RNA, 16 nt, Pseudomonas aeruginosa PA01
agcagggccgccgagg

SEQ ID NO: 3411430 - RNA, 17 nt, Pseudomonas aeruginosa PA01
agcagggccgccgaggu

SEQ ID NO: 3411431 - RNA, 18 nt, Pseudomonas aeruginosa PA01
agcagggccgccgagguc

SEQ ID NO: 3411432 - RNA, 17 nt, Pseudomonas aeruginosa PA01
cgguagagacggcggcg

SEQ ID NO: 3411433 - RNA, 17 nt, Pseudomonas aeruginosa PA01
cgguagaucuccacccg

SEQ ID NO: 3411434 - RNA, 12 nt, Pseudomonas aeruginosa PA01
cgguagcccgcg

SEQ ID NO: 3411435 - RNA, 16 nt, Pseudomonas aeruginosa PA01
cgguagcccgcggcga

SEQ ID NO: 3411436 - RNA, 14 nt, Pseudomonas aeruginosa PA01
cgguagcccggcag

SEQ ID NO: 3411437 - RNA, 20 nt, Pseudomonas aeruginosa PA01
cgguagcccggcagcucccu

SEQ ID NO: 3411438 - RNA, 14 nt, Pseudomonas aeruginosa PA01
cgguagccgaggcg

SEQ ID NO: 3411439 - RNA, 20 nt, Pseudomonas aeruginosa PA01
cgguagccgaggcggccgag

SEQ ID NO: 3411440 - RNA, 18 nt, Pseudomonas aeruginosa PA01
cgguagccgaucaacgcg

SEQ ID NO: 3411441 - RNA, 22 nt, Pseudomonas aeruginosa PA01
cgguagccgaucaacgcggcca

SEQ ID NO: 3411442 - RNA, 23 nt, Pseudomonas aeruginosa PA01
cgguagccgaucaacgcggccag

SEQ ID NO: 3411443 - RNA, 14 nt, Pseudomonas aeruginosa PA01
cgguagccggcgau

SEQ ID NO: 3411444 - RNA, 15 nt, Pseudomonas aeruginosa PA01
cgguagccggcgauc

SEQ ID NO: 3411445 - RNA, 18 nt, Pseudomonas aeruginosa PA01
cgguagccggcgaucagc

SEQ ID NO: 3411446 - RNA, 13 nt, Pseudomonas aeruginosa PA01
cgguagcgccgcg

SEQ ID NO: 3411447 - RNA, 15 nt, Pseudomonas aeruginosa PA01
cgguagcgccgcgcc

SEQ ID NO: 3411448 - RNA, 14 nt, Pseudomonas aeruginosa PA01
cgguagcgcgccug

SEQ ID NO: 3411449 - RNA, 15 nt, Pseudomonas aeruginosa PA01
cgguagcgcgccugc

SEQ ID NO: 3411450 - RNA, 18 nt, Pseudomonas aeruginosa PA01
cgguagcgggccagcagc

SEQ ID NO: 3411451 - RNA, 19 nt, Pseudomonas aeruginosa PA01
cgguagcgggccagcagcu

SEQ ID NO: 3411452 - RNA, 17 nt, Pseudomonas aeruginosa PA01
cgguagcuccaggccga

SEQ ID NO: 3411453 - RNA, 16 nt, Pseudomonas aeruginosa PA01
cgguagcugcgcaggg

SEQ ID NO: 3411454 - RNA, 17 nt, Pseudomonas aeruginosa PA01
cgguagcugcgcagggc

SEQ ID NO: 3411455 - RNA, 19 nt, Pseudomonas aeruginosa PA01
cgguaggcguugauccggu

SEQ ID NO: 3411456 - RNA, 20 nt, Pseudomonas aeruginosa PA01
cgguagggaucgucgccaag

SEQ ID NO: 3411457 - RNA, 13 nt, Pseudomonas aeruginosa PA01
cgguagggccgag

SEQ ID NO: 3411458 - RNA, 15 nt, Pseudomonas aeruginosa PA01
cgguagggccgaggu

SEQ ID NO: 3411459 - RNA, 20 nt, Pseudomonas aeruginosa PA01
cgguagggccgaggucgagg

SEQ ID NO: 3411460 - RNA, 19 nt, Pseudomonas aeruginosa PA01
cgguagggcgaauagcgcc

SEQ ID NO: 3411461 - RNA, 21 nt, Pseudomonas aeruginosa PA01
cgguagggcgaauagcgccgc

SEQ ID NO: 3411462 - RNA, 15 nt, Pseudomonas aeruginosa PA01
cgguaggggccgacg

SEQ ID NO: 3411463 - RNA, 15 nt, Pseudomonas aeruginosa PA01
cgguaggugagcgac

SEQ ID NO: 3411464 - RNA, 13 nt, Pseudomonas aeruginosa PA01
cgguaggugaugc

SEQ ID NO: 3411465 - RNA, 17 nt, Pseudomonas aeruginosa PA01
cgguaggugaugcggcc

SEQ ID NO: 3411466 - RNA, 13 nt, Pseudomonas aeruginosa PA01
cgguaggugaugu

SEQ ID NO: 3411467 - RNA, 20 nt, Pseudomonas aeruginosa PA01
cgguagguguacccagggug

SEQ ID NO: 3411468 - RNA, 21 nt, Pseudomonas aeruginosa PA01
cgguagguguacccagggugc

SEQ ID NO: 3411469 - RNA, 23 nt, Pseudomonas aeruginosa PA01
cgguagguguacccagggugcgc

SEQ ID NO: 3411470 - RNA, 21 nt, Pseudomonas aeruginosa PA01
cgguaguaggguucgccgacg

SEQ ID NO: 3411471 - RNA, 20 nt, Pseudomonas aeruginosa PA01
cgguagucgcugcuggcgcc

SEQ ID NO: 3411472 - RNA, 14 nt, Pseudomonas aeruginosa PA01
cgguagucggggca

SEQ ID NO: 3411473 - RNA, 15 nt, Pseudomonas aeruginosa PA01
cgguagugggcgagg

SEQ ID NO: 3411474 - RNA, 22 nt, Pseudomonas aeruginosa PA01
cgguaguguugaagccgccauc

SEQ ID NO: 3411475 - RNA, 24 nt, Pseudomonas aeruginosa PA01
cgguaucccggcugagcgccaggc

SEQ ID NO: 3411476 - RNA, 17 nt, Pseudomonas aeruginosa PA01
cgguaucggcuugccgg

SEQ ID NO: 3411477 - RNA, 20 nt, Pseudomonas aeruginosa PA01
cgguaucggcuugccggcgg

SEQ ID NO: 3411478 - RNA, 17 nt, Pseudomonas aeruginosa PA01
cgguaugccgcaggcag

SEQ ID NO: 3411479 - RNA, 22 nt, Pseudomonas aeruginosa PA01
cgguauggaagaacaucgccug

SEQ ID NO: 3411480 - RNA, 14 nt, Pseudomonas aeruginosa PA01
cgguauguuucugg

SEQ ID NO: 3411481 - RNA, 23 nt, Pseudomonas aeruginosa PA01
cgguauucagccagagcccgucg

SEQ ID NO: 3411482 - RNA, 15 nt, Pseudomonas aeruginosa PA01
cgguauucuccagca

SEQ ID NO: 3411483 - RNA, 16 nt, Pseudomonas aeruginosa PA01
cgguauucuccagcag

SEQ ID NO: 3411484 - RNA, 21 nt, Pseudomonas aeruginosa PA01
cgguauugaagucgucgucca

SEQ ID NO: 3411485 - RNA, 20 nt, Pseudomonas aeruginosa PA01
cgguauuguggccccagcgc

SEQ ID NO: 3411486 - RNA, 20 nt, Pseudomonas aeruginosa PA01
cggucaaccgcgggcgaggu

SEQ ID NO: 3411487 - RNA, 21 nt, Pseudomonas aeruginosa PA01
cggucaaccgcgggcgagguc

SEQ ID NO: 3411488 - RNA, 21 nt, Pseudomonas aeruginosa PA01
cggucaccacccagccgcggc

SEQ ID NO: 3411489 - RNA, 22 nt, Pseudomonas aeruginosa PA01
cggucaccacccagccgcggcc

SEQ ID NO: 3411490 - RNA, 23 nt, Pseudomonas aeruginosa PA01
cggucaccacccagccgcggccg

SEQ ID NO: 3411491 - RNA, 21 nt, Pseudomonas aeruginosa PA01
cggucacccauucgaugccgc

SEQ ID NO: 3411492 - RNA, 20 nt, Pseudomonas aeruginosa PA01
cggucaccguggucauggcg

SEQ ID NO: 3411493 - RNA, 14 nt, Pseudomonas aeruginosa PA01
cggucacgaaggcg

SEQ ID NO: 3411494 - RNA, 21 nt, Pseudomonas aeruginosa PA01
cggucacgaaggcgaucacgg

SEQ ID NO: 3411495 - RNA, 15 nt, Pseudomonas aeruginosa PA01
cggucacgcaggcgc

SEQ ID NO: 3411496 - RNA, 18 nt, Pseudomonas aeruginosa PA01
cggucacgcaggcgcugg

SEQ ID NO: 3411497 - RNA, 13 nt, Pseudomonas aeruginosa PA01
cggucacgccggg

SEQ ID NO: 3411498 - RNA, 22 nt, Pseudomonas aeruginosa PA01
cggucacgccgggaauccccag

SEQ ID NO: 3411499 - RNA, 14 nt, Pseudomonas aeruginosa PA01
cggucacucggccu

SEQ ID NO: 3411500 - RNA, 18 nt, Pseudomonas aeruginosa PA01
cggucacucggccucggc

SEQ ID NO: 3411501 - RNA, 19 nt, Pseudomonas aeruginosa PA01
cggucacucggccucggcg

SEQ ID NO: 3411502 - RNA, 18 nt, Pseudomonas aeruginosa PA01
cggucagagacagguacu

SEQ ID NO: 3411503 - RNA, 14 nt, Pseudomonas aeruginosa PA01
cggucagcagcagg

SEQ ID NO: 3411504 - RNA, 12 nt, Pseudomonas aeruginosa PA01
cggucagcgacu

SEQ ID NO: 3411505 - RNA, 19 nt, Pseudomonas aeruginosa PA01
cggucagcgcguucacccc

SEQ ID NO: 3411506 - RNA, 14 nt, Pseudomonas aeruginosa PA01
cggucagcggcgca

SEQ ID NO: 3411507 - RNA, 19 nt, Pseudomonas aeruginosa PA01
cggucagcggcgcagccuc

SEQ ID NO: 3411508 - RNA, 13 nt, Pseudomonas aeruginosa PA01
cggucagcucccu

SEQ ID NO: 3411509 - RNA, 20 nt, Pseudomonas aeruginosa PA01
cggucagcucccugauccgc

SEQ ID NO: 3411510 - RNA, 17 nt, Pseudomonas aeruginosa PA01
cggucagcuucgccgcc

SEQ ID NO: 3411511 - RNA, 22 nt, Pseudomonas aeruginosa PA01
cggucaggacagcgugcggccc

SEQ ID NO: 3411512 - RNA, 16 nt, Pseudomonas aeruginosa PA01
cggucaggccaagcuu

SEQ ID NO: 3411513 - RNA, 15 nt, Pseudomonas aeruginosa PA01
cggucaggccgagca

SEQ ID NO: 3411514 - RNA, 19 nt, Pseudomonas aeruginosa PA01
cggucaggccgagcagcgc

SEQ ID NO: 3411515 - RNA, 23 nt, Pseudomonas aeruginosa PA01
cggucaggccgagcagcgccagc

SEQ ID NO: 3411516 - RNA, 20 nt, Pseudomonas aeruginosa PA01
cggucaggccgaucaccacc

SEQ ID NO: 3411517 - RNA, 14 nt, Pseudomonas aeruginosa PA01
cggucaggcgcugg

SEQ ID NO: 3411518 - RNA, 16 nt, Pseudomonas aeruginosa PA01
cggucaggcucagcuc

SEQ ID NO: 3411519 - RNA, 20 nt, Pseudomonas aeruginosa PA01
cggucaggcucagcucggcg

SEQ ID NO: 3411520 - RNA, 23 nt, Pseudomonas aeruginosa PA01
cggucaggcucagcucggcgaug

SEQ ID NO: 3411521 - RNA, 19 nt, Pseudomonas aeruginosa PA01
cggucaggcugaucggcgc

SEQ ID NO: 3411522 - RNA, 20 nt, Pseudomonas aeruginosa PA01
cggucaggcugaucggcgcg

SEQ ID NO: 3411523 - RNA, 13 nt, Pseudomonas aeruginosa PA01
cggucaggcugcg

SEQ ID NO: 3411524 - RNA, 23 nt, Pseudomonas aeruginosa PA01
cggucaggcugcggcggaaggcg

SEQ ID NO: 3411525 - RNA, 21 nt, Pseudomonas aeruginosa PA01
cggucaggcuggugccgcugu

SEQ ID NO: 3411526 - RNA, 23 nt, Pseudomonas aeruginosa PA01
cggucaggcuggugccgcuguag

SEQ ID NO: 3411527 - RNA, 19 nt, Pseudomonas aeruginosa PA01
cggucaggguauagguggu

SEQ ID NO: 3411528 - RNA, 22 nt, Pseudomonas aeruginosa PA01
cggucagguacguuuccaguuc

SEQ ID NO: 3411529 - RNA, 22 nt, Pseudomonas aeruginosa PA01
cggucagguaggcaucgacgcc

SEQ ID NO: 3411530 - RNA, 20 nt, Pseudomonas aeruginosa PA01
cggucagguauucgccggcc

SEQ ID NO: 3411531 - RNA, 23 nt, Pseudomonas aeruginosa PA01
cggucagguauucgccggccagg

SEQ ID NO: 3411532 - RNA, 18 nt, Pseudomonas aeruginosa PA01
cggucagguugaccuucu

SEQ ID NO: 3411533 - RNA, 18 nt, Pseudomonas aeruginosa PA01
cggucagguuggacaggu

SEQ ID NO: 3411534 - RNA, 21 nt, Pseudomonas aeruginosa PA01
cggucaucacgcuuuccggcu

SEQ ID NO: 3411535 - RNA, 14 nt, Pseudomonas aeruginosa PA01
accccaggguuggc

SEQ ID NO: 3411536 - RNA, 17 nt, Pseudomonas aeruginosa PA01
accccaggguuggcggc

SEQ ID NO: 3411537 - RNA, 13 nt, Pseudomonas aeruginosa PA01
accccauccucgc

SEQ ID NO: 3411538 - RNA, 14 nt, Pseudomonas aeruginosa PA01
accccauccucgcc

SEQ ID NO: 3411539 - RNA, 15 nt, Pseudomonas aeruginosa PA01
accccauccucgccg

SEQ ID NO: 3411540 - RNA, 17 nt, Pseudomonas aeruginosa PA01
accccaugaaaaaggcc

SEQ ID NO: 3411541 - RNA, 16 nt, Pseudomonas aeruginosa PA01
acccccaccgggccau

SEQ ID NO: 3411542 - RNA, 22 nt, Pseudomonas aeruginosa PA01
acccccagcaggccagccaacu

SEQ ID NO: 3411543 - RNA, 17 nt, Pseudomonas aeruginosa PA01
acccccagcccggccau

SEQ ID NO: 3411544 - RNA, 20 nt, Pseudomonas aeruginosa PA01
acccccagcccggccauccu

SEQ ID NO: 3411545 - RNA, 15 nt, Pseudomonas aeruginosa PA01
acccccaucgcccgc

SEQ ID NO: 3411546 - RNA, 18 nt, Pseudomonas aeruginosa PA01
acccccaucgcccgcagc

SEQ ID NO: 3411547 - RNA, 15 nt, Pseudomonas aeruginosa PA01
accccccaauugccc

SEQ ID NO: 3411548 - RNA, 12 nt, Pseudomonas aeruginosa PA01
acccccgcaacc

SEQ ID NO: 3411549 - RNA, 20 nt, Pseudomonas aeruginosa PA01
acccccgcaaccgcugccgc

SEQ ID NO: 3411550 - RNA, 20 nt, Pseudomonas aeruginosa PA01
acccccggcccggccauccu

SEQ ID NO: 3411551 - RNA, 16 nt, Pseudomonas aeruginosa PA01
acccccugcgcggacg

SEQ ID NO: 3411552 - RNA, 20 nt, Pseudomonas aeruginosa PA01
acccccuugcccgucgggca

SEQ ID NO: 3411553 - RNA, 15 nt, Pseudomonas aeruginosa PA01
accccgaacucgccg

SEQ ID NO: 3411554 - RNA, 14 nt, Pseudomonas aeruginosa PA01
accccgaaguagcg

SEQ ID NO: 3411555 - RNA, 13 nt, Pseudomonas aeruginosa PA01
acccggguauaga

SEQ ID NO: 3411556 - RNA, 15 nt, Pseudomonas aeruginosa PA01
acccgggucaggccg

SEQ ID NO: 3411557 - RNA, 17 nt, Pseudomonas aeruginosa PA01
acccgggucaggccgag

SEQ ID NO: 3411558 - RNA, 22 nt, Pseudomonas aeruginosa PA01
acccgggugccuuccgcgccca

SEQ ID NO: 3411559 - RNA, 21 nt, Pseudomonas aeruginosa PA01
acccggguuuccgugugcagc

SEQ ID NO: 3411560 - RNA, 17 nt, Pseudomonas aeruginosa PA01
acccggguuuccugccc

SEQ ID NO: 3411561 - RNA, 22 nt, Pseudomonas aeruginosa PA01
acccgguacagccaacccucgg

SEQ ID NO: 3411562 - RNA, 17 nt, Pseudomonas aeruginosa PA01
acccgguacagcgccug

SEQ ID NO: 3411563 - RNA, 18 nt, Pseudomonas aeruginosa PA01
acccgguacagcgccugg

SEQ ID NO: 3411564 - RNA, 19 nt, Pseudomonas aeruginosa PA01
acccgguacagcgccuggu

SEQ ID NO: 3411565 - RNA, 21 nt, Pseudomonas aeruginosa PA01
acccgguacagcgccuggucg

SEQ ID NO: 3411566 - RNA, 19 nt, Pseudomonas aeruginosa PA01
acccgguacuccuccagca

SEQ ID NO: 3411567 - RNA, 21 nt, Pseudomonas aeruginosa PA01
acccgguacuccuccagcauc

SEQ ID NO: 3411568 - RNA, 17 nt, Pseudomonas aeruginosa PA01
acccgguagccgaucaa

SEQ ID NO: 3411569 - RNA, 22 nt, Pseudomonas aeruginosa PA01
acccgguccugcaacuggaagg

SEQ ID NO: 3411570 - RNA, 13 nt, Pseudomonas aeruginosa PA01
acccggucgcgcu

SEQ ID NO: 3411571 - RNA, 14 nt, Pseudomonas aeruginosa PA01
acccggucgcgcug

SEQ ID NO: 3411572 - RNA, 17 nt, Pseudomonas aeruginosa PA01
acccggucggccuguuc

SEQ ID NO: 3411573 - RNA, 13 nt, Pseudomonas aeruginosa PA01
acccgguugccga

SEQ ID NO: 3411574 - RNA, 14 nt, Pseudomonas aeruginosa PA01
acccguacgcugcc

SEQ ID NO: 3411575 - RNA, 15 nt, Pseudomonas aeruginosa PA01
acccgucccgcgcgc

SEQ ID NO: 3411576 - RNA, 17 nt, Pseudomonas aeruginosa PA01
acccgucccgcgcgccg

SEQ ID NO: 3411577 - RNA, 12 nt, Pseudomonas aeruginosa PA01
acccgugcgccc

SEQ ID NO: 3411578 - RNA, 17 nt, Pseudomonas aeruginosa PA01
acccgugcgccccagcu

SEQ ID NO: 3411579 - RNA, 18 nt, Pseudomonas aeruginosa PA01
acccgugcgccccagcuc

SEQ ID NO: 3411580 - RNA, 18 nt, Pseudomonas aeruginosa PA01
acccguuccuugcgcggc

SEQ ID NO: 3411581 - RNA, 13 nt, Pseudomonas aeruginosa PA01
acccguucgccgg

SEQ ID NO: 3411582 - RNA, 14 nt, Pseudomonas aeruginosa PA01
acccguugcgccuc

SEQ ID NO: 3411583 - RNA, 22 nt, Pseudomonas aeruginosa PA01
acccguugcgccucgccgcccg

SEQ ID NO: 3411584 - RNA, 23 nt, Pseudomonas aeruginosa PA01
acccucaggucggcgccugcgga

SEQ ID NO: 3411585 - RNA, 20 nt, Pseudomonas aeruginosa PA01
acccucagucgcccccaccg

SEQ ID NO: 3411586 - RNA, 15 nt, Pseudomonas aeruginosa PA01
acccucauggaaacc

SEQ ID NO: 3411587 - RNA, 22 nt, Pseudomonas aeruginosa PA01
acccucauggaaaccccggccu

SEQ ID NO: 3411588 - RNA, 19 nt, Pseudomonas aeruginosa PA01
acccucccuaucuccgccg

SEQ ID NO: 3411589 - RNA, 12 nt, Pseudomonas aeruginosa PA01
acccucggcgag

SEQ ID NO: 3411590 - RNA, 22 nt, Pseudomonas aeruginosa PA01
acccucggcuucguccugcugc

SEQ ID NO: 3411591 - RNA, 23 nt, Pseudomonas aeruginosa PA01
acccucggcuucguccugcugcu

SEQ ID NO: 3411592 - RNA, 12 nt, Pseudomonas aeruginosa PA01
acccucucccca

SEQ ID NO: 3411593 - RNA, 13 nt, Pseudomonas aeruginosa PA01
acccucuccccaa

SEQ ID NO: 3411594 - RNA, 20 nt, Pseudomonas aeruginosa PA01
acccucuccccaaccuucuc

SEQ ID NO: 3411595 - RNA, 13 nt, Pseudomonas aeruginosa PA01
acccucugguugg

SEQ ID NO: 3411596 - RNA, 22 nt, Pseudomonas aeruginosa PA01
acccugcacccuuggcgcaggu

SEQ ID NO: 3411597 - RNA, 14 nt, Pseudomonas aeruginosa PA01
acccugccccagca

SEQ ID NO: 3411598 - RNA, 15 nt, Pseudomonas aeruginosa PA01
acccugccccagcau

SEQ ID NO: 3411599 - RNA, 24 nt, Pseudomonas aeruginosa PA01
acccugccccagcaucgccggcag

SEQ ID NO: 3411600 - RNA, 22 nt, Pseudomonas aeruginosa PA01
acccugcgcaaggaacuggaag

SEQ ID NO: 3411601 - RNA, 20 nt, Pseudomonas aeruginosa PA01
acccugcugcugcucagcgc

SEQ ID NO: 3411602 - RNA, 21 nt, Pseudomonas aeruginosa PA01
acccugcuggccggugccgcc

SEQ ID NO: 3411603 - RNA, 18 nt, Pseudomonas aeruginosa PA01
acccuggccggccucggc

SEQ ID NO: 3411604 - RNA, 23 nt, Pseudomonas aeruginosa PA01
acccuggccggccucggcggcgc

SEQ ID NO: 3411605 - RNA, 18 nt, Pseudomonas aeruginosa PA01
acccugggaauggcggau

SEQ ID NO: 3411606 - RNA, 12 nt, Pseudomonas aeruginosa PA01
acccugggccaa

SEQ ID NO: 3411607 - RNA, 19 nt, Pseudomonas aeruginosa PA01
acccugguaguccagcagg

SEQ ID NO: 3411608 - RNA, 21 nt, Pseudomonas aeruginosa PA01
acccugguaguccagcaggug

SEQ ID NO: 3411609 - RNA, 13 nt, Pseudomonas aeruginosa PA01
acccugucccauc

SEQ ID NO: 3411610 - RNA, 18 nt, Pseudomonas aeruginosa PA01
acccugucccaucacggc

SEQ ID NO: 3411611 - RNA, 15 nt, Pseudomonas aeruginosa PA01
acccuuccagccgcc

SEQ ID NO: 3411612 - RNA, 16 nt, Pseudomonas aeruginosa PA01
acccuuccagccgccc

SEQ ID NO: 3411613 - RNA, 16 nt, Pseudomonas aeruginosa PA01
acccuugcgcccggcu

SEQ ID NO: 3411614 - RNA, 13 nt, Pseudomonas aeruginosa PA01
acccuugcguccu

SEQ ID NO: 3411615 - RNA, 18 nt, Pseudomonas aeruginosa PA01
acccuugcucccgccgcu

SEQ ID NO: 3411616 - RNA, 17 nt, Pseudomonas aeruginosa PA01
acccuuguggccgaucu

SEQ ID NO: 3411617 - RNA, 13 nt, Pseudomonas aeruginosa PA01
accgaaacagggc

SEQ ID NO: 3411618 - RNA, 16 nt, Pseudomonas aeruginosa PA01
accgaacaccagcaaa

SEQ ID NO: 3411619 - RNA, 14 nt, Pseudomonas aeruginosa PA01
accgaacagcgcgc

SEQ ID NO: 3411620 - RNA, 16 nt, Pseudomonas aeruginosa PA01
accgaacagcgcgcca

SEQ ID NO: 3411621 - RNA, 17 nt, Pseudomonas aeruginosa PA01
accgaacaucagcagca

SEQ ID NO: 3411622 - RNA, 16 nt, Pseudomonas aeruginosa PA01
accgaacuuccgccga

SEQ ID NO: 3411623 - RNA, 14 nt, Pseudomonas aeruginosa PA01
accgaagccgcgca

SEQ ID NO: 3411624 - RNA, 16 nt, Pseudomonas aeruginosa PA01
accgaagccgcgcagc

SEQ ID NO: 3411625 - RNA, 20 nt, Pseudomonas aeruginosa PA01
accgaaggcaacagcccgcg

SEQ ID NO: 3411626 - RNA, 19 nt, Pseudomonas aeruginosa PA01
accgaaguagucgccccgg

SEQ ID NO: 3411627 - RNA, 14 nt, Pseudomonas aeruginosa PA01
accgaagucgcccg

SEQ ID NO: 3411628 - RNA, 17 nt, Pseudomonas aeruginosa PA01
accgaagucgcccgccg

SEQ ID NO: 3411629 - RNA, 19 nt, Pseudomonas aeruginosa PA01
accgaagucgcccgccggc

SEQ ID NO: 3411630 - RNA, 21 nt, Pseudomonas aeruginosa PA01
accgaagucgcccgccggcgu

SEQ ID NO: 3411631 - RNA, 20 nt, Pseudomonas aeruginosa PA01
accgaauccuugaucaccuu

SEQ ID NO: 3411632 - RNA, 24 nt, Pseudomonas aeruginosa PA01
accgaauccuugaucaccuugcca

SEQ ID NO: 3411633 - RNA, 16 nt, Pseudomonas aeruginosa PA01
accgacaaucgccgag

SEQ ID NO: 3411634 - RNA, 18 nt, Pseudomonas aeruginosa PA01
accgacaaucgccgagaa

SEQ ID NO: 3411635 - RNA, 20 nt, Pseudomonas aeruginosa PA01
accgacaggccgaccagcag

SEQ ID NO: 3411636 - RNA, 15 nt, Pseudomonas aeruginosa PA01
accgacagucccagg

SEQ ID NO: 3411637 - RNA, 21 nt, Pseudomonas aeruginosa PA01
accgaccaccaucaccgccau

SEQ ID NO: 3411638 - RNA, 14 nt, Pseudomonas aeruginosa PA01
accgaccaguacca

SEQ ID NO: 3411639 - RNA, 16 nt, Pseudomonas aeruginosa PA01
accgaccaguaccagc

SEQ ID NO: 3411640 - RNA, 13 nt, Pseudomonas aeruginosa PA01
accgacccucggc

SEQ ID NO: 3411641 - RNA, 17 nt, Pseudomonas aeruginosa PA01
accgacccucggcgagg

SEQ ID NO: 3411642 - RNA, 20 nt, Pseudomonas aeruginosa PA01
accgaccgcgaguucgccgg

SEQ ID NO: 3411643 - RNA, 21 nt, Pseudomonas aeruginosa PA01
accgaccgcgaguucgccggc

SEQ ID NO: 3411644 - RNA, 13 nt, Pseudomonas aeruginosa PA01
accgacgaugggc

SEQ ID NO: 3411645 - RNA, 13 nt, Pseudomonas aeruginosa PA01
accgacgccgccu

SEQ ID NO: 3411646 - RNA, 15 nt, Pseudomonas aeruginosa PA01
accgacgccgccugc

SEQ ID NO: 3411647 - RNA, 19 nt, Pseudomonas aeruginosa PA01
accgacgccgccugcgccu

SEQ ID NO: 3411648 - RNA, 12 nt, Pseudomonas aeruginosa PA01
accgacgccgga

SEQ ID NO: 3411649 - RNA, 23 nt, Pseudomonas aeruginosa PA01
accgacgcgcaggagugugggac

SEQ ID NO: 3411650 - RNA, 12 nt, Pseudomonas aeruginosa PA01
accgacgcucgc

SEQ ID NO: 3411651 - RNA, 15 nt, Pseudomonas aeruginosa PA01
accgacgcucgcggc

SEQ ID NO: 3411652 - RNA, 19 nt, Pseudomonas aeruginosa PA01
accgacggcuccggauggc

SEQ ID NO: 3411653 - RNA, 20 nt, Pseudomonas aeruginosa PA01
accgacgggucgccaugguc

SEQ ID NO: 3411654 - RNA, 21 nt, Pseudomonas aeruginosa PA01
accgacgggucgccauggucg

SEQ ID NO: 3411655 - RNA, 12 nt, Pseudomonas aeruginosa PA01
accgacuggccg

SEQ ID NO: 3411656 - RNA, 21 nt, Pseudomonas aeruginosa PA01
accgacuuggcagucgccgcc

SEQ ID NO: 3411657 - RNA, 13 nt, Pseudomonas aeruginosa PA01
accgagaaccagu

SEQ ID NO: 3411658 - RNA, 20 nt, Pseudomonas aeruginosa PA01
accgagaaccaguacuugaa

SEQ ID NO: 3411659 - RNA, 13 nt, Pseudomonas aeruginosa PA01
accgagaccgacg

SEQ ID NO: 3411660 - RNA, 13 nt, Pseudomonas aeruginosa PA01
accgagaucaccu

SEQ ID NO: 3411661 - RNA, 19 nt, Pseudomonas aeruginosa PA01
accgagauucugcaggcgc

SEQ ID NO: 3411662 - RNA, 22 nt, Pseudomonas aeruginosa PA01
accgagauucugcaggcgcucc

SEQ ID NO: 3411663 - RNA, 19 nt, Pseudomonas aeruginosa PA01
accgagcagcggacgcagc

SEQ ID NO: 3411664 - RNA, 22 nt, Pseudomonas aeruginosa PA01
accgaggaggacgauggaacgc

SEQ ID NO: 3411665 - RNA, 16 nt, Pseudomonas aeruginosa PA01
accgaggcgcgccgac

SEQ ID NO: 3411666 - RNA, 17 nt, Pseudomonas aeruginosa PA01
accgaggcgcgccgaca

SEQ ID NO: 3411667 - RNA, 17 nt, Pseudomonas aeruginosa PA01
accgagguagucccaga

SEQ ID NO: 3411668 - RNA, 20 nt, Pseudomonas aeruginosa PA01
accgaguggcgcagcgcccg

SEQ ID NO: 3411669 - RNA, 17 nt, Pseudomonas aeruginosa PA01
accgaguugaccagcau

SEQ ID NO: 3411670 - RNA, 16 nt, Pseudomonas aeruginosa PA01
accgaguuucccggcg

SEQ ID NO: 3411671 - RNA, 19 nt, Pseudomonas aeruginosa PA01
accgaguuucccggcgcgg

SEQ ID NO: 3411672 - RNA, 22 nt, Pseudomonas aeruginosa PA01
accgaguuucccggcgcggccg

SEQ ID NO: 3411673 - RNA, 18 nt, Pseudomonas aeruginosa PA01
accgauauggcuggcgca

SEQ ID NO: 3411674 - RNA, 16 nt, Pseudomonas aeruginosa PA01
accgaucaccuggccg

SEQ ID NO: 3411675 - RNA, 18 nt, Pseudomonas aeruginosa PA01
accgaucagcaccgccac

SEQ ID NO: 3411676 - RNA, 14 nt, Pseudomonas aeruginosa PA01
accgauccagcagu

SEQ ID NO: 3411677 - RNA, 15 nt, Pseudomonas aeruginosa PA01
accgauccagcaguc

SEQ ID NO: 3411678 - RNA, 13 nt, Pseudomonas aeruginosa PA01
accgaucggcugc

SEQ ID NO: 3411679 - RNA, 14 nt, Pseudomonas aeruginosa PA01
accgauggccaggg

SEQ ID NO: 3411680 - RNA, 17 nt, Pseudomonas aeruginosa PA01
accgauggccagggggc

SEQ ID NO: 3411681 - RNA, 20 nt, Pseudomonas aeruginosa PA01
accgauggccagggggccug

SEQ ID NO: 3411682 - RNA, 23 nt, Pseudomonas aeruginosa PA01
accgauggccagggggccuggcu

SEQ ID NO: 3411683 - RNA, 20 nt, Pseudomonas aeruginosa PA01
accgauggcgccgcgauggu

SEQ ID NO: 3411684 - RNA, 14 nt, Pseudomonas aeruginosa PA01
accgauucgccggc

SEQ ID NO: 3411685 - RNA, 19 nt, Pseudomonas aeruginosa PA01
accgcaaccgguccucgcc

SEQ ID NO: 3411686 - RNA, 19 nt, Pseudomonas aeruginosa PA01
accgcagaagacgauggug

SEQ ID NO: 3411687 - RNA, 17 nt, Pseudomonas aeruginosa PA01
accgcagcccaguucgc

SEQ ID NO: 3411688 - RNA, 14 nt, Pseudomonas aeruginosa PA01
accgcagccggcga

SEQ ID NO: 3411689 - RNA, 19 nt, Pseudomonas aeruginosa PA01
accgcaggauagaugcguc

SEQ ID NO: 3411690 - RNA, 20 nt, Pseudomonas aeruginosa PA01
accgcauaggucaugcccag

SEQ ID NO: 3411691 - RNA, 15 nt, Pseudomonas aeruginosa PA01
accgcauagucgcga

SEQ ID NO: 3411692 - RNA, 13 nt, Pseudomonas aeruginosa PA01
accgcaucgaagc

SEQ ID NO: 3411693 - RNA, 15 nt, Pseudomonas aeruginosa PA01
accgcaucgccaccg

SEQ ID NO: 3411694 - RNA, 14 nt, Pseudomonas aeruginosa PA01
accgcaucgcgguu

SEQ ID NO: 3411695 - RNA, 17 nt, Pseudomonas aeruginosa PA01
accgccaaggccucggc

SEQ ID NO: 3411696 - RNA, 20 nt, Pseudomonas aeruginosa PA01
accgccaaggccucggcauc

SEQ ID NO: 3411697 - RNA, 22 nt, Pseudomonas aeruginosa PA01
accgccaaggucggucucgcca

SEQ ID NO: 3411698 - RNA, 16 nt, Pseudomonas aeruginosa PA01
accgccaccagcgagu

SEQ ID NO: 3411699 - RNA, 21 nt, Pseudomonas aeruginosa PA01
accgccaccagcgagucgacc

SEQ ID NO: 3411700 - RNA, 15 nt, Pseudomonas aeruginosa PA01
accgccaccgccgga

SEQ ID NO: 3411701 - RNA, 16 nt, Pseudomonas aeruginosa PA01
accgccaccugccccg

SEQ ID NO: 3411702 - RNA, 23 nt, Pseudomonas aeruginosa PA01
accgccaccuugcgucccugggc

SEQ ID NO: 3411703 - RNA, 19 nt, Pseudomonas aeruginosa PA01
accgccacguacagcgcga

SEQ ID NO: 3411704 - RNA, 22 nt, Pseudomonas aeruginosa PA01
accgccacguacagcgcgacau

SEQ ID NO: 3411705 - RNA, 12 nt, Pseudomonas aeruginosa PA01
accgccagcacc

SEQ ID NO: 3411706 - RNA, 21 nt, Pseudomonas aeruginosa PA01
accgccagcaguugcaacagc

SEQ ID NO: 3411707 - RNA, 14 nt, Pseudomonas aeruginosa PA01
accgccagcccgcc

SEQ ID NO: 3411708 - RNA, 12 nt, Pseudomonas aeruginosa PA01
accgccagcgca

SEQ ID NO: 3411709 - RNA, 13 nt, Pseudomonas aeruginosa PA01
accgccagcgcac

SEQ ID NO: 3411710 - RNA, 22 nt, Pseudomonas aeruginosa PA01
accgccagcgggacgaugccga

SEQ ID NO: 3411711 - RNA, 23 nt, Pseudomonas aeruginosa PA01
accgccagcgggacgaugccgau

SEQ ID NO: 3411712 - RNA, 15 nt, Pseudomonas aeruginosa PA01
accgccagcgucgcc

SEQ ID NO: 3411713 - RNA, 17 nt, Pseudomonas aeruginosa PA01
accgccagcgucgccgc

SEQ ID NO: 3411714 - RNA, 22 nt, Pseudomonas aeruginosa PA01
accgccagcgucgccgccgcgg

SEQ ID NO: 3411715 - RNA, 18 nt, Pseudomonas aeruginosa PA01
accgccaggccgacccgc

SEQ ID NO: 3411716 - RNA, 12 nt, Pseudomonas aeruginosa PA01
accgccaggcgg

SEQ ID NO: 3411717 - RNA, 16 nt, Pseudomonas aeruginosa PA01
accgccaucgaugguc

SEQ ID NO: 3411718 - RNA, 20 nt, Pseudomonas aeruginosa PA01
accgccaucgauggucaggc

SEQ ID NO: 3411719 - RNA, 12 nt, Pseudomonas aeruginosa PA01
accgccaugcug

SEQ ID NO: 3411720 - RNA, 14 nt, Pseudomonas aeruginosa PA01
accgccauggcgcu

SEQ ID NO: 3411721 - RNA, 14 nt, Pseudomonas aeruginosa PA01
accgcccacccugc

SEQ ID NO: 3411722 - RNA, 16 nt, Pseudomonas aeruginosa PA01
accgcccacccugcgc

SEQ ID NO: 3411723 - RNA, 17 nt, Pseudomonas aeruginosa PA01
accgcccacccugcgcg

SEQ ID NO: 3411724 - RNA, 19 nt, Pseudomonas aeruginosa PA01
accgcccagccgagguggu

SEQ ID NO: 3411725 - RNA, 19 nt, Pseudomonas aeruginosa PA01
accgcccaggcugccgccg

SEQ ID NO: 3411726 - RNA, 14 nt, Pseudomonas aeruginosa PA01
accgccccggcagc

SEQ ID NO: 3411727 - RNA, 18 nt, Pseudomonas aeruginosa PA01
accgccccggcagccacc

SEQ ID NO: 3411728 - RNA, 12 nt, Pseudomonas aeruginosa PA01
accgcccgccuc

SEQ ID NO: 3411729 - RNA, 15 nt, Pseudomonas aeruginosa PA01
accgcccuuucgaac

SEQ ID NO: 3411730 - RNA, 15 nt, Pseudomonas aeruginosa PA01
accgccgagggcgcc

SEQ ID NO: 3411731 - RNA, 19 nt, Pseudomonas aeruginosa PA01
accgccgagggcgccaggu

SEQ ID NO: 3411732 - RNA, 12 nt, Pseudomonas aeruginosa PA01
accgccgccagc

SEQ ID NO: 3411733 - RNA, 17 nt, Pseudomonas aeruginosa PA01
accgccgccagcaacag

SEQ ID NO: 3411734 - RNA, 16 nt, Pseudomonas aeruginosa PA01
accgccgccggccugc

SEQ ID NO: 3411735 - RNA, 22 nt, Pseudomonas aeruginosa PA01
accgccgccuggguggcgacga

SEQ ID NO: 3411736 - RNA, 17 nt, Pseudomonas aeruginosa PA01
accgccgcucaucugca

SEQ ID NO: 3411737 - RNA, 12 nt, Pseudomonas aeruginosa PA01
accgccggcggc

SEQ ID NO: 3411738 - RNA, 19 nt, Pseudomonas aeruginosa PA01
accgccggguacagcgcca

SEQ ID NO: 3411739 - RNA, 20 nt, Pseudomonas aeruginosa PA01
accgccggguacagcgccac

SEQ ID NO: 3411740 - RNA, 22 nt, Pseudomonas aeruginosa PA01
accgccggguacagcgccacgg

SEQ ID NO: 3411741 - RNA, 21 nt, Pseudomonas aeruginosa PA01
accgccguacggguuucgcug

SEQ ID NO: 3411742 - RNA, 16 nt, Pseudomonas aeruginosa PA01
accgccucgaccccgg

SEQ ID NO: 3411743 - RNA, 20 nt, Pseudomonas aeruginosa PA01
accgccucggagaacagcag

SEQ ID NO: 3411744 - RNA, 16 nt, Pseudomonas aeruginosa PA01
accgccugcagcacca

SEQ ID NO: 3411745 - RNA, 13 nt, Pseudomonas aeruginosa PA01
accgccugcucgc

SEQ ID NO: 3411746 - RNA, 16 nt, Pseudomonas aeruginosa PA01
accgccugcucgcggc

SEQ ID NO: 3411747 - RNA, 22 nt, Pseudomonas aeruginosa PA01
accgccugcucgcggcuggccg

SEQ ID NO: 3411748 - RNA, 16 nt, Pseudomonas aeruginosa PA01
accgccuggaccaggu

SEQ ID NO: 3411749 - RNA, 22 nt, Pseudomonas aeruginosa PA01
accgccuggucgaucucgucga

SEQ ID NO: 3411750 - RNA, 23 nt, Pseudomonas aeruginosa PA01
accgccuggucgaucucgucgaa

SEQ ID NO: 3411751 - RNA, 17 nt, Pseudomonas aeruginosa PA01
accgccuggucgccggg

SEQ ID NO: 3411752 - RNA, 22 nt, Pseudomonas aeruginosa PA01
accgccuuggcaucgccgccca

SEQ ID NO: 3411753 - RNA, 22 nt, Pseudomonas aeruginosa PA01
accgcgaagcgguuagccggcg

SEQ ID NO: 3411754 - RNA, 23 nt, Pseudomonas aeruginosa PA01
accgcgaagcgguuagccggcga

SEQ ID NO: 3411755 - RNA, 13 nt, Pseudomonas aeruginosa PA01
accgcgacaaccc

SEQ ID NO: 3411756 - RNA, 24 nt, Pseudomonas aeruginosa PA01
accgcgacaacccuguccccucac

SEQ ID NO: 3411757 - RNA, 15 nt, Pseudomonas aeruginosa PA01
accgcgagcgccgcc

SEQ ID NO: 3411758 - RNA, 21 nt, Pseudomonas aeruginosa PA01
accgcgagcgccgccuugagc

SEQ ID NO: 3411759 - RNA, 17 nt, Pseudomonas aeruginosa PA01
accgcgaguucgccggc

SEQ ID NO: 3411760 - RNA, 18 nt, Pseudomonas aeruginosa PA01
accgcgaguucgccggcc

SEQ ID NO: 3411761 - RNA, 19 nt, Pseudomonas aeruginosa PA01
accgcgaguucgccggcca

SEQ ID NO: 3411762 - RNA, 19 nt, Pseudomonas aeruginosa PA01
accgcgcaaaccggcagca

SEQ ID NO: 3411763 - RNA, 14 nt, Pseudomonas aeruginosa PA01
accgcgcagaugau

SEQ ID NO: 3411764 - RNA, 20 nt, Pseudomonas aeruginosa PA01
accgcgcagaugaucgccac

SEQ ID NO: 3411765 - RNA, 14 nt, Pseudomonas aeruginosa PA01
accgcgcagcguca

SEQ ID NO: 3411766 - RNA, 17 nt, Pseudomonas aeruginosa PA01
accgcgcagcgucaccg

SEQ ID NO: 3411767 - RNA, 19 nt, Pseudomonas aeruginosa PA01
accgcgcagcgucaccgcg

SEQ ID NO: 3411768 - RNA, 21 nt, Pseudomonas aeruginosa PA01
accgcgcagcgucaccgcguc

SEQ ID NO: 3411769 - RNA, 15 nt, Pseudomonas aeruginosa PA01
accgcgcauggcggc

SEQ ID NO: 3411770 - RNA, 16 nt, Pseudomonas aeruginosa PA01
accgcgcauggcggcg

SEQ ID NO: 3411771 - RNA, 21 nt, Pseudomonas aeruginosa PA01
accgcgcauggcggcgaccgc

SEQ ID NO: 3411772 - RNA, 22 nt, Pseudomonas aeruginosa PA01
accgcgccgauguacggcacca

SEQ ID NO: 3411773 - RNA, 14 nt, Pseudomonas aeruginosa PA01
accgcgccggcggu

SEQ ID NO: 3411774 - RNA, 12 nt, Pseudomonas aeruginosa PA01
accgcgccggua

SEQ ID NO: 3411775 - RNA, 17 nt, Pseudomonas aeruginosa PA01
accgcgccuuccagccc

SEQ ID NO: 3411776 - RNA, 18 nt, Pseudomonas aeruginosa PA01
accgcgccuuccagcccu

SEQ ID NO: 3411777 - RNA, 19 nt, Pseudomonas aeruginosa PA01
accgcgccuuccagcccuu

SEQ ID NO: 3411778 - RNA, 11 nt, Pseudomonas aeruginosa PA01
accgcgcgcca

SEQ ID NO: 3411779 - RNA, 23 nt, Pseudomonas aeruginosa PA01
accgcgcgccugcaacgccagca

SEQ ID NO: 3411780 - RNA, 13 nt, Pseudomonas aeruginosa PA01
accgcgcgcgcaa

SEQ ID NO: 3411781 - RNA, 14 nt, Pseudomonas aeruginosa PA01
accgcgcgcgcaag

SEQ ID NO: 3411782 - RNA, 19 nt, Pseudomonas aeruginosa PA01
accgcgcgcgcaaggccga

SEQ ID NO: 3411783 - RNA, 23 nt, Pseudomonas aeruginosa PA01
accgcgcgcgccugcaacguccu

SEQ ID NO: 3411784 - RNA, 20 nt, Pseudomonas aeruginosa PA01
accgcgcggauccccucccg

SEQ ID NO: 3411785 - RNA, 20 nt, Pseudomonas aeruginosa PA01
accgcgcucggcggucaggc

SEQ ID NO: 3411786 - RNA, 17 nt, Pseudomonas aeruginosa PA01
accgcggaauccgcuuc

SEQ ID NO: 3411787 - RNA, 16 nt, Pseudomonas aeruginosa PA01
accgcggauccacgcc

SEQ ID NO: 3411788 - RNA, 17 nt, Pseudomonas aeruginosa PA01
accgcggauccacgccu

SEQ ID NO: 3411789 - RNA, 22 nt, Pseudomonas aeruginosa PA01
accgcggccggcuucuacgccu

SEQ ID NO: 3411790 - RNA, 11 nt, Pseudomonas aeruginosa PA01
accgcggcgcc

SEQ ID NO: 3411791 - RNA, 21 nt, Pseudomonas aeruginosa PA01
accgcggcgcccucugccggu

SEQ ID NO: 3411792 - RNA, 14 nt, Pseudomonas aeruginosa PA01
accgcggcgcugaa

SEQ ID NO: 3411793 - RNA, 16 nt, Pseudomonas aeruginosa PA01
accgcgggcgaggucg

SEQ ID NO: 3411794 - RNA, 22 nt, Pseudomonas aeruginosa PA01
accgcgggcgaggucgccacgc

SEQ ID NO: 3411795 - RNA, 22 nt, Pseudomonas aeruginosa PA01
accgcgggggucggaugcagcg

SEQ ID NO: 3411796 - RNA, 17 nt, Pseudomonas aeruginosa PA01
accgcgguggaggcggc

SEQ ID NO: 3411797 - RNA, 19 nt, Pseudomonas aeruginosa PA01
accgcggugucggugcccu

SEQ ID NO: 3411798 - RNA, 19 nt, Pseudomonas aeruginosa PA01
accgcguccauccccgccu

SEQ ID NO: 3411799 - RNA, 15 nt, Pseudomonas aeruginosa PA01
accgcguccuugagu

SEQ ID NO: 3411800 - RNA, 22 nt, Pseudomonas aeruginosa PA01
accgcgucgggaaaggccgcca

SEQ ID NO: 3411801 - RNA, 14 nt, Pseudomonas aeruginosa PA01
accgcgugggccgg

SEQ ID NO: 3411802 - RNA, 14 nt, Pseudomonas aeruginosa PA01
accgcguucaccgu

SEQ ID NO: 3411803 - RNA, 20 nt, Pseudomonas aeruginosa PA01
accgcucaagacggcccgca

SEQ ID NO: 3411804 - RNA, 19 nt, Pseudomonas aeruginosa PA01
accgcuccccacucggcca

SEQ ID NO: 3411805 - RNA, 18 nt, Pseudomonas aeruginosa PA01
accgcuccggcgccgagg

SEQ ID NO: 3411806 - RNA, 16 nt, Pseudomonas aeruginosa PA01
accgcucgaguucgcg

SEQ ID NO: 3411807 - RNA, 13 nt, Pseudomonas aeruginosa PA01
accgcucgccaga

SEQ ID NO: 3411808 - RNA, 14 nt, Pseudomonas aeruginosa PA01
accgcucgccagau

SEQ ID NO: 3411809 - RNA, 22 nt, Pseudomonas aeruginosa PA01
accgcucgcgguuauccgccgg

SEQ ID NO: 3411810 - RNA, 19 nt, Pseudomonas aeruginosa PA01
accgcucgucaggcgcuca

SEQ ID NO: 3411811 - RNA, 15 nt, Pseudomonas aeruginosa PA01
accgcugccgccguc

SEQ ID NO: 3411812 - RNA, 19 nt, Pseudomonas aeruginosa PA01
accgcugcgcaggugcuug

SEQ ID NO: 3411813 - RNA, 16 nt, Pseudomonas aeruginosa PA01
accgcugcgccgccgu

SEQ ID NO: 3411814 - RNA, 14 nt, Pseudomonas aeruginosa PA01
accgcugcggccgg

SEQ ID NO: 3411815 - RNA, 16 nt, Pseudomonas aeruginosa PA01
accgcugcgugccagg

SEQ ID NO: 3411816 - RNA, 12 nt, Pseudomonas aeruginosa PA01
accgcuggcgcu

SEQ ID NO: 3411817 - RNA, 17 nt, Pseudomonas aeruginosa PA01
accgcugggacggcggc

SEQ ID NO: 3411818 - RNA, 20 nt, Pseudomonas aeruginosa PA01
accgcugggacggcggcugg

SEQ ID NO: 3411819 - RNA, 14 nt, Pseudomonas aeruginosa PA01
accgcuuccugggc

SEQ ID NO: 3411820 - RNA, 20 nt, Pseudomonas aeruginosa PA01
accgcuucugugggcagcgg

SEQ ID NO: 3411821 - RNA, 18 nt, Pseudomonas aeruginosa PA01
accgcuugccagccgcuu

SEQ ID NO: 3411822 - RNA, 22 nt, Pseudomonas aeruginosa PA01
accgcuugcgguuauccgccgc

SEQ ID NO: 3411823 - RNA, 22 nt, Pseudomonas aeruginosa PA01
accgcuuucaccagggucgcca

SEQ ID NO: 3411824 - RNA, 23 nt, Pseudomonas aeruginosa PA01
accgcuuucaccagggucgccag

SEQ ID NO: 3411825 - RNA, 16 nt, Pseudomonas aeruginosa PA01
accgcuuucagcgccg

SEQ ID NO: 3411826 - RNA, 19 nt, Pseudomonas aeruginosa PA01
accgcuuucagcgccgcuc

SEQ ID NO: 3411827 - RNA, 17 nt, Pseudomonas aeruginosa PA01
accggaaaagaagccgc

SEQ ID NO: 3411828 - RNA, 19 nt, Pseudomonas aeruginosa PA01
accggaaaagaagccgcgc

SEQ ID NO: 3411829 - RNA, 20 nt, Pseudomonas aeruginosa PA01
accggaaaagaagccgcgca

SEQ ID NO: 3411830 - RNA, 21 nt, Pseudomonas aeruginosa PA01
accggaaaagaagccgcgcaa

SEQ ID NO: 3411831 - RNA, 17 nt, Pseudomonas aeruginosa PA01
accggaagcgaucuccu

SEQ ID NO: 3411832 - RNA, 17 nt, Pseudomonas aeruginosa PA01
accggaagcguccaggg

SEQ ID NO: 3411833 - RNA, 17 nt, Pseudomonas aeruginosa PA01
accggaaucacgucgau

SEQ ID NO: 3411834 - RNA, 15 nt, Pseudomonas aeruginosa PA01
accggacggcugagg

SEQ ID NO: 3411835 - RNA, 18 nt, Pseudomonas aeruginosa PA01
accggacggcugaggcug

SEQ ID NO: 3411836 - RNA, 18 nt, Pseudomonas aeruginosa PA01
accggaucgcccuggcgc

SEQ ID NO: 3411837 - RNA, 16 nt, Pseudomonas aeruginosa PA01
accggcaagcuccgcg

SEQ ID NO: 3411838 - RNA, 17 nt, Pseudomonas aeruginosa PA01
accggcaagcuccgcga

SEQ ID NO: 3411839 - RNA, 18 nt, Pseudomonas aeruginosa PA01
accggcaaggcggccuca

SEQ ID NO: 3411840 - RNA, 14 nt, Pseudomonas aeruginosa PA01
accggcagcagcgg

SEQ ID NO: 3411841 - RNA, 23 nt, Pseudomonas aeruginosa PA01
accggcagcagcggaucggcggu

SEQ ID NO: 3411842 - RNA, 13 nt, Pseudomonas aeruginosa PA01
accggcagcgccg

SEQ ID NO: 3411843 - RNA, 14 nt, Pseudomonas aeruginosa PA01
accggcagcgccga

SEQ ID NO: 3411844 - RNA, 18 nt, Pseudomonas aeruginosa PA01
accggcagcgccgagguc

SEQ ID NO: 3411845 - RNA, 18 nt, Pseudomonas aeruginosa PA01
accggcagcgccgccagc

SEQ ID NO: 3411846 - RNA, 16 nt, Pseudomonas aeruginosa PA01
accggcaggacgauga

SEQ ID NO: 3411847 - RNA, 14 nt, Pseudomonas aeruginosa PA01
cggucgugcagcag

SEQ ID NO: 3411848 - RNA, 16 nt, Pseudomonas aeruginosa PA01
cggucgugcagcagcg

SEQ ID NO: 3411849 - RNA, 17 nt, Pseudomonas aeruginosa PA01
cggucgugcagcagcgc

SEQ ID NO: 3411850 - RNA, 20 nt, Pseudomonas aeruginosa PA01
cggucgugcagcagcgccuu

SEQ ID NO: 3411851 - RNA, 14 nt, Pseudomonas aeruginosa PA01
cggucguucgcccu

SEQ ID NO: 3411852 - RNA, 17 nt, Pseudomonas aeruginosa PA01
cggucuagcgccccggc

SEQ ID NO: 3411853 - RNA, 19 nt, Pseudomonas aeruginosa PA01
cggucuagcgccccggccg

SEQ ID NO: 3411854 - RNA, 16 nt, Pseudomonas aeruginosa PA01
cggucucagccggcgc

SEQ ID NO: 3411855 - RNA, 14 nt, Pseudomonas aeruginosa PA01
cggucucgaacgcc

SEQ ID NO: 3411856 - RNA, 18 nt, Pseudomonas aeruginosa PA01
cggucucgaacgccaggc

SEQ ID NO: 3411857 - RNA, 15 nt, Pseudomonas aeruginosa PA01
cggucucgaucggcc

SEQ ID NO: 3411858 - RNA, 17 nt, Pseudomonas aeruginosa PA01
cggucucgaucggcccg

SEQ ID NO: 3411859 - RNA, 19 nt, Pseudomonas aeruginosa PA01
cggucucgaucggcccggg

SEQ ID NO: 3411860 - RNA, 22 nt, Pseudomonas aeruginosa PA01
cggucucgaucggcccgggcgc

SEQ ID NO: 3411861 - RNA, 23 nt, Pseudomonas aeruginosa PA01
cggucucgauggcagccuuggcc

SEQ ID NO: 3411862 - RNA, 13 nt, Pseudomonas aeruginosa PA01
cggucucgccgcc

SEQ ID NO: 3411863 - RNA, 19 nt, Pseudomonas aeruginosa PA01
cggucucgccgccgagcag

SEQ ID NO: 3411864 - RNA, 20 nt, Pseudomonas aeruginosa PA01
cggucucgccgccgagcagg

SEQ ID NO: 3411865 - RNA, 17 nt, Pseudomonas aeruginosa PA01
cggucucgcgcagcggc

SEQ ID NO: 3411866 - RNA, 12 nt, Pseudomonas aeruginosa PA01
cggucucggcgg

SEQ ID NO: 3411867 - RNA, 23 nt, Pseudomonas aeruginosa PA01
cggucucuucgucggucaugucc

SEQ ID NO: 3411868 - RNA, 12 nt, Pseudomonas aeruginosa PA01
cggucugccagc

SEQ ID NO: 3411869 - RNA, 23 nt, Pseudomonas aeruginosa PA01
cggucugcucggaaaccucgccg

SEQ ID NO: 3411870 - RNA, 19 nt, Pseudomonas aeruginosa PA01
cggucugcugcgcgcacca

SEQ ID NO: 3411871 - RNA, 16 nt, Pseudomonas aeruginosa PA01
cggucuucaucaccuu

SEQ ID NO: 3411872 - RNA, 15 nt, Pseudomonas aeruginosa PA01
cggucuuccgccgac

SEQ ID NO: 3411873 - RNA, 19 nt, Pseudomonas aeruginosa PA01
cggucuuccgccgacugca

SEQ ID NO: 3411874 - RNA, 18 nt, Pseudomonas aeruginosa PA01
cggucuugccggcugcgc

SEQ ID NO: 3411875 - RNA, 16 nt, Pseudomonas aeruginosa PA01
cggucuugcgcuugcc

SEQ ID NO: 3411876 - RNA, 18 nt, Pseudomonas aeruginosa PA01
cggucuugcgcuugccgg

SEQ ID NO: 3411877 - RNA, 17 nt, Pseudomonas aeruginosa PA01
cggucuuggcgcgcgac

SEQ ID NO: 3411878 - RNA, 17 nt, Pseudomonas aeruginosa PA01
cggucuuggcggcgauc

SEQ ID NO: 3411879 - RNA, 18 nt, Pseudomonas aeruginosa PA01
cggucuuggcggcgaucg

SEQ ID NO: 3411880 - RNA, 19 nt, Pseudomonas aeruginosa PA01
cggucuuggcggcgaucgc

SEQ ID NO: 3411881 - RNA, 21 nt, Pseudomonas aeruginosa PA01
cggucuuggcguugccgugcc

SEQ ID NO: 3411882 - RNA, 17 nt, Pseudomonas aeruginosa PA01
cggugaaacggaucacg

SEQ ID NO: 3411883 - RNA, 23 nt, Pseudomonas aeruginosa PA01
cggugaaacggaucacgaucgcg

SEQ ID NO: 3411884 - RNA, 15 nt, Pseudomonas aeruginosa PA01
cggugaacagguagc

SEQ ID NO: 3411885 - RNA, 17 nt, Pseudomonas aeruginosa PA01
cggugaaccaggcgccg

SEQ ID NO: 3411886 - RNA, 18 nt, Pseudomonas aeruginosa PA01
cggugaacgagcccaggc

SEQ ID NO: 3411887 - RNA, 19 nt, Pseudomonas aeruginosa PA01
cggugaacgagcccaggca

SEQ ID NO: 3411888 - RNA, 18 nt, Pseudomonas aeruginosa PA01
cggugaagcgcggcggcg

SEQ ID NO: 3411889 - RNA, 15 nt, Pseudomonas aeruginosa PA01
cggugaaggcgaagu

SEQ ID NO: 3411890 - RNA, 16 nt, Pseudomonas aeruginosa PA01
cggugaagguccgcgc

SEQ ID NO: 3411891 - RNA, 17 nt, Pseudomonas aeruginosa PA01
cggugaagguccgcgcc

SEQ ID NO: 3411892 - RNA, 18 nt, Pseudomonas aeruginosa PA01
cggugaagguccgcgcca

SEQ ID NO: 3411893 - RNA, 21 nt, Pseudomonas aeruginosa PA01
cggugaagguccgcgccaugc

SEQ ID NO: 3411894 - RNA, 16 nt, Pseudomonas aeruginosa PA01
cggugaaguagaucgc

SEQ ID NO: 3411895 - RNA, 19 nt, Pseudomonas aeruginosa PA01
cggugaaguagaucgcccg

SEQ ID NO: 3411896 - RNA, 21 nt, Pseudomonas aeruginosa PA01
cggugaaguagaucgcccgca

SEQ ID NO: 3411897 - RNA, 16 nt, Pseudomonas aeruginosa PA01
cggugacacccugccg

SEQ ID NO: 3411898 - RNA, 18 nt, Pseudomonas aeruginosa PA01
cggugacacccugccgcg

SEQ ID NO: 3411899 - RNA, 20 nt, Pseudomonas aeruginosa PA01
cggugacacccugccgcgcc

SEQ ID NO: 3411900 - RNA, 21 nt, Pseudomonas aeruginosa PA01
cggugacacccugccgcgccg

SEQ ID NO: 3411901 - RNA, 22 nt, Pseudomonas aeruginosa PA01
cggugacacccugccgcgccgg

SEQ ID NO: 3411902 - RNA, 15 nt, Pseudomonas aeruginosa PA01
cggugacauucgaca

SEQ ID NO: 3411903 - RNA, 18 nt, Pseudomonas aeruginosa PA01
cggugacauucgacagca

SEQ ID NO: 3411904 - RNA, 19 nt, Pseudomonas aeruginosa PA01
cggugacauucgacagcag

SEQ ID NO: 3411905 - RNA, 12 nt, Pseudomonas aeruginosa PA01
cggugaccacca

SEQ ID NO: 3411906 - RNA, 23 nt, Pseudomonas aeruginosa PA01
cggugaccaccuugauccgcgac

SEQ ID NO: 3411907 - RNA, 14 nt, Pseudomonas aeruginosa PA01
cggugaccagcggc

SEQ ID NO: 3411908 - RNA, 15 nt, Pseudomonas aeruginosa PA01
cggugaccagcggca

SEQ ID NO: 3411909 - RNA, 23 nt, Pseudomonas aeruginosa PA01
cggugacccacuccggcaggcgc

SEQ ID NO: 3411910 - RNA, 13 nt, Pseudomonas aeruginosa PA01
cggugacccgcac

SEQ ID NO: 3411911 - RNA, 19 nt, Pseudomonas aeruginosa PA01
cggugaccguuucgccgcc

SEQ ID NO: 3411912 - RNA, 22 nt, Pseudomonas aeruginosa PA01
cggugaccguuucgccgccggc

SEQ ID NO: 3411913 - RNA, 17 nt, Pseudomonas aeruginosa PA01
cggugaccugguagucg

SEQ ID NO: 3411914 - RNA, 22 nt, Pseudomonas aeruginosa PA01
cggugaccugguagucgcgguu

SEQ ID NO: 3411915 - RNA, 14 nt, Pseudomonas aeruginosa PA01
cggugacgaacgaa

SEQ ID NO: 3411916 - RNA, 18 nt, Pseudomonas aeruginosa PA01
cggugacgaacgaagcgc

SEQ ID NO: 3411917 - RNA, 12 nt, Pseudomonas aeruginosa PA01
cggugacgcugc

SEQ ID NO: 3411918 - RNA, 15 nt, Pseudomonas aeruginosa PA01
cggugacggugcagc

SEQ ID NO: 3411919 - RNA, 16 nt, Pseudomonas aeruginosa PA01
cggugacggugcagcc

SEQ ID NO: 3411920 - RNA, 16 nt, Pseudomonas aeruginosa PA01
cggugacguuggccgg

SEQ ID NO: 3411921 - RNA, 19 nt, Pseudomonas aeruginosa PA01
cggugacguuggccggggu

SEQ ID NO: 3411922 - RNA, 16 nt, Pseudomonas aeruginosa PA01
cggugagcacgccgcg

SEQ ID NO: 3411923 - RNA, 15 nt, Pseudomonas aeruginosa PA01
cggugagcaggcgcc

SEQ ID NO: 3411924 - RNA, 19 nt, Pseudomonas aeruginosa PA01
cggugaggaccuggccgcg

SEQ ID NO: 3411925 - RNA, 19 nt, Pseudomonas aeruginosa PA01
cggugaggcgcagcagcgc

SEQ ID NO: 3411926 - RNA, 22 nt, Pseudomonas aeruginosa PA01
cggugagguagcagaucucguc

SEQ ID NO: 3411927 - RNA, 17 nt, Pseudomonas aeruginosa PA01
cggugagguugccgccg

SEQ ID NO: 3411928 - RNA, 22 nt, Pseudomonas aeruginosa PA01
cggugagguugccgccgaucag

SEQ ID NO: 3411929 - RNA, 17 nt, Pseudomonas aeruginosa PA01
cggugauaccgccggcg

SEQ ID NO: 3411930 - RNA, 18 nt, Pseudomonas aeruginosa PA01
cggugauagagcacgccc

SEQ ID NO: 3411931 - RNA, 19 nt, Pseudomonas aeruginosa PA01
cggugauagagcacgccca

SEQ ID NO: 3411932 - RNA, 13 nt, Pseudomonas aeruginosa PA01
cggugaucaggcg

SEQ ID NO: 3411933 - RNA, 20 nt, Pseudomonas aeruginosa PA01
cggugaucgagacgccguag

SEQ ID NO: 3411934 - RNA, 13 nt, Pseudomonas aeruginosa PA01
cggugaucgagcc

SEQ ID NO: 3411935 - RNA, 14 nt, Pseudomonas aeruginosa PA01
cggugaucgccgcg

SEQ ID NO: 3411936 - RNA, 15 nt, Pseudomonas aeruginosa PA01
cggugaucucgcggc

SEQ ID NO: 3411937 - RNA, 17 nt, Pseudomonas aeruginosa PA01
cggugaucucgcggcgc

SEQ ID NO: 3411938 - RNA, 18 nt, Pseudomonas aeruginosa PA01
cggugaucucgcggcgcg

SEQ ID NO: 3411939 - RNA, 15 nt, Pseudomonas aeruginosa PA01
cggugaugaagaagc

SEQ ID NO: 3411940 - RNA, 15 nt, Pseudomonas aeruginosa PA01
cggugaugcgucgca

SEQ ID NO: 3411941 - RNA, 18 nt, Pseudomonas aeruginosa PA01
cggugaugcgucgcacca

SEQ ID NO: 3411942 - RNA, 18 nt, Pseudomonas aeruginosa PA01
cggugaugguaucgccgu

SEQ ID NO: 3411943 - RNA, 18 nt, Pseudomonas aeruginosa PA01
cggugauguaggacgccu

SEQ ID NO: 3411944 - RNA, 21 nt, Pseudomonas aeruginosa PA01
cggugauguaggacgccucgu

SEQ ID NO: 3411945 - RNA, 22 nt, Pseudomonas aeruginosa PA01
cggugauucguccggagccggg

SEQ ID NO: 3411946 - RNA, 15 nt, Pseudomonas aeruginosa PA01
cggugcaccaggcga

SEQ ID NO: 3411947 - RNA, 13 nt, Pseudomonas aeruginosa PA01
cggugcaccuggg

SEQ ID NO: 3411948 - RNA, 16 nt, Pseudomonas aeruginosa PA01
cggugcaccugggugc

SEQ ID NO: 3411949 - RNA, 20 nt, Pseudomonas aeruginosa PA01
cggugcagaagacgcccagc

SEQ ID NO: 3411950 - RNA, 18 nt, Pseudomonas aeruginosa PA01
cggugcagaugaccagcg

SEQ ID NO: 3411951 - RNA, 17 nt, Pseudomonas aeruginosa PA01
cggugcagccacccagc

SEQ ID NO: 3411952 - RNA, 19 nt, Pseudomonas aeruginosa PA01
cggugcagccacccagcag

SEQ ID NO: 3411953 - RNA, 20 nt, Pseudomonas aeruginosa PA01
cggugcagccacccagcagc

SEQ ID NO: 3411954 - RNA, 21 nt, Pseudomonas aeruginosa PA01
cggugcagccacccagcagca

SEQ ID NO: 3411955 - RNA, 16 nt, Pseudomonas aeruginosa PA01
cggugcagcggaagcc

SEQ ID NO: 3411956 - RNA, 13 nt, Pseudomonas aeruginosa PA01
cggugcaggccga

SEQ ID NO: 3411957 - RNA, 15 nt, Pseudomonas aeruginosa PA01
cggugcaggccgacg

SEQ ID NO: 3411958 - RNA, 16 nt, Pseudomonas aeruginosa PA01
cggugcaggccgacgu

SEQ ID NO: 3411959 - RNA, 14 nt, Pseudomonas aeruginosa PA01
cggugcaggccgag

SEQ ID NO: 3411960 - RNA, 16 nt, Pseudomonas aeruginosa PA01
cggugcaugcgcacgg

SEQ ID NO: 3411961 - RNA, 17 nt, Pseudomonas aeruginosa PA01
cggugcaugcgcacggu

SEQ ID NO: 3411962 - RNA, 21 nt, Pseudomonas aeruginosa PA01
cggugccagggcggucggcca

SEQ ID NO: 3411963 - RNA, 22 nt, Pseudomonas aeruginosa PA01
cggugccagggcggucggccag

SEQ ID NO: 3411964 - RNA, 18 nt, Pseudomonas aeruginosa PA01
cggugccauacucggacg

SEQ ID NO: 3411965 - RNA, 19 nt, Pseudomonas aeruginosa PA01
cggugccauacucggacgg

SEQ ID NO: 3411966 - RNA, 20 nt, Pseudomonas aeruginosa PA01
cggugccauacucggacggc

SEQ ID NO: 3411967 - RNA, 21 nt, Pseudomonas aeruginosa PA01
cggugccauggaucaccaggg

SEQ ID NO: 3411968 - RNA, 18 nt, Pseudomonas aeruginosa PA01
cggugccccgcuggccca

SEQ ID NO: 3411969 - RNA, 16 nt, Pseudomonas aeruginosa PA01
cggugcccucgcggac

SEQ ID NO: 3411970 - RNA, 17 nt, Pseudomonas aeruginosa PA01
cggugcccucgcggacg

SEQ ID NO: 3411971 - RNA, 12 nt, Pseudomonas aeruginosa PA01
cggugccgaucu

SEQ ID NO: 3411972 - RNA, 13 nt, Pseudomonas aeruginosa PA01
cggugccgcagac

SEQ ID NO: 3411973 - RNA, 17 nt, Pseudomonas aeruginosa PA01
cggugccgcccggcgcc

SEQ ID NO: 3411974 - RNA, 22 nt, Pseudomonas aeruginosa PA01
cggugccgcccggcgccaccgc

SEQ ID NO: 3411975 - RNA, 17 nt, Pseudomonas aeruginosa PA01
cggugccgccggccacc

SEQ ID NO: 3411976 - RNA, 18 nt, Pseudomonas aeruginosa PA01
cggugccgccggccacca

SEQ ID NO: 3411977 - RNA, 14 nt, Pseudomonas aeruginosa PA01
cggugccgccggcg

SEQ ID NO: 3411978 - RNA, 15 nt, Pseudomonas aeruginosa PA01
cggugccgccggcgc

SEQ ID NO: 3411979 - RNA, 16 nt, Pseudomonas aeruginosa PA01
cggugccgccggcgcc

SEQ ID NO: 3411980 - RNA, 17 nt, Pseudomonas aeruginosa PA01
cggugccgccggcgccg

SEQ ID NO: 3411981 - RNA, 14 nt, Pseudomonas aeruginosa PA01
cggugccgcgcagc

SEQ ID NO: 3411982 - RNA, 14 nt, Pseudomonas aeruginosa PA01
cggugccggcaggc

SEQ ID NO: 3411983 - RNA, 21 nt, Pseudomonas aeruginosa PA01
cggugccggcaggccuucgac

SEQ ID NO: 3411984 - RNA, 14 nt, Pseudomonas aeruginosa PA01
cggugccggcggcg

SEQ ID NO: 3411985 - RNA, 20 nt, Pseudomonas aeruginosa PA01
cggugccgggaagcgcaggc

SEQ ID NO: 3411986 - RNA, 19 nt, Pseudomonas aeruginosa PA01
cggugccggucugguagcg

SEQ ID NO: 3411987 - RNA, 19 nt, Pseudomonas aeruginosa PA01
cggugccgugggucgccuc

SEQ ID NO: 3411988 - RNA, 14 nt, Pseudomonas aeruginosa PA01
cggugccuucggcg

SEQ ID NO: 3411989 - RNA, 13 nt, Pseudomonas aeruginosa PA01
cggugcgaaccgg

SEQ ID NO: 3411990 - RNA, 16 nt, Pseudomonas aeruginosa PA01
cggugcgcaugucguc

SEQ ID NO: 3411991 - RNA, 17 nt, Pseudomonas aeruginosa PA01
cggugcgccccaggugc

SEQ ID NO: 3411992 - RNA, 15 nt, Pseudomonas aeruginosa PA01
cggugcgccggcggg

SEQ ID NO: 3411993 - RNA, 16 nt, Pseudomonas aeruginosa PA01
cggugcgccggcggga

SEQ ID NO: 3411994 - RNA, 19 nt, Pseudomonas aeruginosa PA01
cggugcgccuccaggaccu

SEQ ID NO: 3411995 - RNA, 12 nt, Pseudomonas aeruginosa PA01
cggugcgcgcca

SEQ ID NO: 3411996 - RNA, 16 nt, Pseudomonas aeruginosa PA01
cggugcgcgccaucaa

SEQ ID NO: 3411997 - RNA, 22 nt, Pseudomonas aeruginosa PA01
cggugcgcuccuguugcuggcc

SEQ ID NO: 3411998 - RNA, 13 nt, Pseudomonas aeruginosa PA01
cggugcggcauuc

SEQ ID NO: 3411999 - RNA, 18 nt, Pseudomonas aeruginosa PA01
cggugcggcauuccgggc

SEQ ID NO: 3412000 - RNA, 20 nt, Pseudomonas aeruginosa PA01
cggugcggcauuccgggcga

SEQ ID NO: 3412001 - RNA, 23 nt, Pseudomonas aeruginosa PA01
cggugcgggcagacaccaccagg

SEQ ID NO: 3412002 - RNA, 17 nt, Pseudomonas aeruginosa PA01
cggugcgggccuugacc

SEQ ID NO: 3412003 - RNA, 23 nt, Pseudomonas aeruginosa PA01
cggugcgggccuugaccaccgcc

SEQ ID NO: 3412004 - RNA, 14 nt, Pseudomonas aeruginosa PA01
cggugcggguaucg

SEQ ID NO: 3412005 - RNA, 21 nt, Pseudomonas aeruginosa PA01
cggugcggguaucgaucucga

SEQ ID NO: 3412006 - RNA, 20 nt, Pseudomonas aeruginosa PA01
cggugcggguggucgccgcc

SEQ ID NO: 3412007 - RNA, 14 nt, Pseudomonas aeruginosa PA01
cggugcggucggcg

SEQ ID NO: 3412008 - RNA, 19 nt, Pseudomonas aeruginosa PA01
cggugcggucguugaucac

SEQ ID NO: 3412009 - RNA, 14 nt, Pseudomonas aeruginosa PA01
cggugcguagcgac

SEQ ID NO: 3412010 - RNA, 15 nt, Pseudomonas aeruginosa PA01
cggugcguucgcggg

SEQ ID NO: 3412011 - RNA, 17 nt, Pseudomonas aeruginosa PA01
cggugcucaggcggccg

SEQ ID NO: 3412012 - RNA, 14 nt, Pseudomonas aeruginosa PA01
cggugcucggccug

SEQ ID NO: 3412013 - RNA, 23 nt, Pseudomonas aeruginosa PA01
cggugcuggcgucgccuuccacc

SEQ ID NO: 3412014 - RNA, 16 nt, Pseudomonas aeruginosa PA01
cggugcuggugcggcc

SEQ ID NO: 3412015 - RNA, 18 nt, Pseudomonas aeruginosa PA01
cggugcuguaguaggcgg

SEQ ID NO: 3412016 - RNA, 17 nt, Pseudomonas aeruginosa PA01
cggugcuuugcauggcc

SEQ ID NO: 3412017 - RNA, 22 nt, Pseudomonas aeruginosa PA01
cgguggacugguugaccugcag

SEQ ID NO: 3412018 - RNA, 19 nt, Pseudomonas aeruginosa PA01
cgguggagcacgucgagca

SEQ ID NO: 3412019 - RNA, 18 nt, Pseudomonas aeruginosa PA01
cgguggaggcggcgguca

SEQ ID NO: 3412020 - RNA, 17 nt, Pseudomonas aeruginosa PA01
cgguggaggcgggcuca

SEQ ID NO: 3412021 - RNA, 20 nt, Pseudomonas aeruginosa PA01
cgguggaggcgggcucacau

SEQ ID NO: 3412022 - RNA, 19 nt, Pseudomonas aeruginosa PA01
cgguggaggucugccacca

SEQ ID NO: 3412023 - RNA, 22 nt, Pseudomonas aeruginosa PA01
cgguggcaggaaaugccuggcu

SEQ ID NO: 3412024 - RNA, 22 nt, Pseudomonas aeruginosa PA01
cgguggcaugguguccggcggc

SEQ ID NO: 3412025 - RNA, 19 nt, Pseudomonas aeruginosa PA01
cgguggccacgucgcccca

SEQ ID NO: 3412026 - RNA, 20 nt, Pseudomonas aeruginosa PA01
cgguggccacgucgccccag

SEQ ID NO: 3412027 - RNA, 12 nt, Pseudomonas aeruginosa PA01
cgguggccagga

SEQ ID NO: 3412028 - RNA, 21 nt, Pseudomonas aeruginosa PA01
cgguggccaggacgcuggcga

SEQ ID NO: 3412029 - RNA, 12 nt, Pseudomonas aeruginosa PA01
cgguggccaggc

SEQ ID NO: 3412030 - RNA, 17 nt, Pseudomonas aeruginosa PA01
cgguggccaggcucuuc

SEQ ID NO: 3412031 - RNA, 16 nt, Pseudomonas aeruginosa PA01
cgguggcccacuccag

SEQ ID NO: 3412032 - RNA, 17 nt, Pseudomonas aeruginosa PA01
cgguggcccacuccaga

SEQ ID NO: 3412033 - RNA, 21 nt, Pseudomonas aeruginosa PA01
cgguggcccacuccagauagu

SEQ ID NO: 3412034 - RNA, 14 nt, Pseudomonas aeruginosa PA01
cgguggccgugggc

SEQ ID NO: 3412035 - RNA, 13 nt, Pseudomonas aeruginosa PA01
cgguggccuccug

SEQ ID NO: 3412036 - RNA, 22 nt, Pseudomonas aeruginosa PA01
cgguggccuccugcaacgccug

SEQ ID NO: 3412037 - RNA, 16 nt, Pseudomonas aeruginosa PA01
cgguggcgacgcgcag

SEQ ID NO: 3412038 - RNA, 17 nt, Pseudomonas aeruginosa PA01
cgguggcgacgcgcagg

SEQ ID NO: 3412039 - RNA, 18 nt, Pseudomonas aeruginosa PA01
cgguggcgacgcgcaggc

SEQ ID NO: 3412040 - RNA, 13 nt, Pseudomonas aeruginosa PA01
cgguggcgcccag

SEQ ID NO: 3412041 - RNA, 16 nt, Pseudomonas aeruginosa PA01
cgguggcgcccagcca

SEQ ID NO: 3412042 - RNA, 11 nt, Pseudomonas aeruginosa PA01
cgguggcggcg

SEQ ID NO: 3412043 - RNA, 14 nt, Pseudomonas aeruginosa PA01
cgguggcggcgacg

SEQ ID NO: 3412044 - RNA, 17 nt, Pseudomonas aeruginosa PA01
cgguggcggcgacgaag

SEQ ID NO: 3412045 - RNA, 22 nt, Pseudomonas aeruginosa PA01
cgguggcggcgacgaagcccag

SEQ ID NO: 3412046 - RNA, 15 nt, Pseudomonas aeruginosa PA01
cgguggcgguugcgg

SEQ ID NO: 3412047 - RNA, 18 nt, Pseudomonas aeruginosa PA01
cgguggcguuauccgccc

SEQ ID NO: 3412048 - RNA, 19 nt, Pseudomonas aeruginosa PA01
cggugggacugagccgcug

SEQ ID NO: 3412049 - RNA, 17 nt, Pseudomonas aeruginosa PA01
cggugggccuugagcau

SEQ ID NO: 3412050 - RNA, 16 nt, Pseudomonas aeruginosa PA01
cggugggcuccagcgg

SEQ ID NO: 3412051 - RNA, 14 nt, Pseudomonas aeruginosa PA01
cggugggcuugccg

SEQ ID NO: 3412052 - RNA, 16 nt, Pseudomonas aeruginosa PA01
cggugggcuugccggg

SEQ ID NO: 3412053 - RNA, 15 nt, Pseudomonas aeruginosa PA01
cgguggggccgccga

SEQ ID NO: 3412054 - RNA, 21 nt, Pseudomonas aeruginosa PA01
cgguggggccgccgaugccga

SEQ ID NO: 3412055 - RNA, 15 nt, Pseudomonas aeruginosa PA01
cggugguaccgugcu

SEQ ID NO: 3412056 - RNA, 19 nt, Pseudomonas aeruginosa PA01
cgguggucgguucgucgag

SEQ ID NO: 3412057 - RNA, 21 nt, Pseudomonas aeruginosa PA01
cgguggucgguucgucgagga

SEQ ID NO: 3412058 - RNA, 22 nt, Pseudomonas aeruginosa PA01
cgguggucgguucgucgaggau

SEQ ID NO: 3412059 - RNA, 15 nt, Pseudomonas aeruginosa PA01
cgguggucuucagca

SEQ ID NO: 3412060 - RNA, 21 nt, Pseudomonas aeruginosa PA01
cgguggugucugguuccuggu

SEQ ID NO: 3412061 - RNA, 17 nt, Pseudomonas aeruginosa PA01
cgguguagaccaccagc

SEQ ID NO: 3412062 - RNA, 18 nt, Pseudomonas aeruginosa PA01
cgguguagaccaccagca

SEQ ID NO: 3412063 - RNA, 22 nt, Pseudomonas aeruginosa PA01
cgguguaguucaccguccacug

SEQ ID NO: 3412064 - RNA, 15 nt, Pseudomonas aeruginosa PA01
cggugucaggccgag

SEQ ID NO: 3412065 - RNA, 16 nt, Pseudomonas aeruginosa PA01
cggugucaggccgagg

SEQ ID NO: 3412066 - RNA, 15 nt, Pseudomonas aeruginosa PA01
cgguguccaccacca

SEQ ID NO: 3412067 - RNA, 16 nt, Pseudomonas aeruginosa PA01
cgguguccaccaccag

SEQ ID NO: 3412068 - RNA, 18 nt, Pseudomonas aeruginosa PA01
cgguguccaccaccagca

SEQ ID NO: 3412069 - RNA, 20 nt, Pseudomonas aeruginosa PA01
cgguguccaccaccagcagg

SEQ ID NO: 3412070 - RNA, 16 nt, Pseudomonas aeruginosa PA01
cggugucccuucuuuu

SEQ ID NO: 3412071 - RNA, 12 nt, Pseudomonas aeruginosa PA01
cggugucggcca

SEQ ID NO: 3412072 - RNA, 13 nt, Pseudomonas aeruginosa PA01
cggugucggccaa

SEQ ID NO: 3412073 - RNA, 22 nt, Pseudomonas aeruginosa PA01
cggugucggcgauucguucgag

SEQ ID NO: 3412074 - RNA, 19 nt, Pseudomonas aeruginosa PA01
cggugucggugcccucgcg

SEQ ID NO: 3412075 - RNA, 16 nt, Pseudomonas aeruginosa PA01
cggugugaccuucaac

SEQ ID NO: 3412076 - RNA, 19 nt, Pseudomonas aeruginosa PA01
cggugugaccuucaacggu

SEQ ID NO: 3412077 - RNA, 17 nt, Pseudomonas aeruginosa PA01
cggugugaucaccagcc

SEQ ID NO: 3412078 - RNA, 12 nt, Pseudomonas aeruginosa PA01
cggugugcgcug

SEQ ID NO: 3412079 - RNA, 13 nt, Pseudomonas aeruginosa PA01
cggugugcgcugc

SEQ ID NO: 3412080 - RNA, 21 nt, Pseudomonas aeruginosa PA01
cggugugcgcugcaucggcgc

SEQ ID NO: 3412081 - RNA, 15 nt, Pseudomonas aeruginosa PA01
cggugugcucaggcg

SEQ ID NO: 3412082 - RNA, 17 nt, Pseudomonas aeruginosa PA01
cgguguuguggcuggcc

SEQ ID NO: 3412083 - RNA, 23 nt, Pseudomonas aeruginosa PA01
cgguguuguggcuggccucggcg

SEQ ID NO: 3412084 - RNA, 20 nt, Pseudomonas aeruginosa PA01
cgguguuuccucagcucugu

SEQ ID NO: 3412085 - RNA, 17 nt, Pseudomonas aeruginosa PA01
cgguuacucgccggcau

SEQ ID NO: 3412086 - RNA, 18 nt, Pseudomonas aeruginosa PA01
cgguuagaauaccggccu

SEQ ID NO: 3412087 - RNA, 23 nt, Pseudomonas aeruginosa PA01
cgguuagaauaccggccugucac

SEQ ID NO: 3412088 - RNA, 16 nt, Pseudomonas aeruginosa PA01
cgguuagccggcgauc

SEQ ID NO: 3412089 - RNA, 16 nt, Pseudomonas aeruginosa PA01
cgguuauccgccgccg

SEQ ID NO: 3412090 - RNA, 17 nt, Pseudomonas aeruginosa PA01
cgguuauccgccgccgg

SEQ ID NO: 3412091 - RNA, 19 nt, Pseudomonas aeruginosa PA01
cgguuauccgccgccgggc

SEQ ID NO: 3412092 - RNA, 15 nt, Pseudomonas aeruginosa PA01
cgguuauccgccgug

SEQ ID NO: 3412093 - RNA, 16 nt, Pseudomonas aeruginosa PA01
cgguuauucgccccag

SEQ ID NO: 3412094 - RNA, 17 nt, Pseudomonas aeruginosa PA01
cgguuauucgcccuacc

SEQ ID NO: 3412095 - RNA, 12 nt, Pseudomonas aeruginosa PA01
cgguucagcagc

SEQ ID NO: 3412096 - RNA, 16 nt, Pseudomonas aeruginosa PA01
cgguucagcagcggca

SEQ ID NO: 3412097 - RNA, 17 nt, Pseudomonas aeruginosa PA01
cgguucagcagcggcac

SEQ ID NO: 3412098 - RNA, 17 nt, Pseudomonas aeruginosa PA01
cgguucaggucgaggcc

SEQ ID NO: 3412099 - RNA, 19 nt, Pseudomonas aeruginosa PA01
cgguucaggucgaggccgc

SEQ ID NO: 3412100 - RNA, 21 nt, Pseudomonas aeruginosa PA01
cgguuccagacauccgggucc

SEQ ID NO: 3412101 - RNA, 15 nt, Pseudomonas aeruginosa PA01
cgguuccagcucguc

SEQ ID NO: 3412102 - RNA, 18 nt, Pseudomonas aeruginosa PA01
cgguucccgcagcgauca

SEQ ID NO: 3412103 - RNA, 19 nt, Pseudomonas aeruginosa PA01
cgguucccgcagcgaucag

SEQ ID NO: 3412104 - RNA, 22 nt, Pseudomonas aeruginosa PA01
cgguucccgcagcgaucagcac

SEQ ID NO: 3412105 - RNA, 21 nt, Pseudomonas aeruginosa PA01
cgguuccuccauuagcgucgc

SEQ ID NO: 3412106 - RNA, 22 nt, Pseudomonas aeruginosa PA01
cgguucgacacgcucagccccg

SEQ ID NO: 3412107 - RNA, 19 nt, Pseudomonas aeruginosa PA01
cgguucgaugaggaugcug

SEQ ID NO: 3412108 - RNA, 14 nt, Pseudomonas aeruginosa PA01
cgguucgcaggcca

SEQ ID NO: 3412109 - RNA, 17 nt, Pseudomonas aeruginosa PA01
cgguucgcaggccaggc

SEQ ID NO: 3412110 - RNA, 23 nt, Pseudomonas aeruginosa PA01
cgguucgcccgcgggcagcucga

SEQ ID NO: 3412111 - RNA, 16 nt, Pseudomonas aeruginosa PA01
cgguucgccgagcgcc

SEQ ID NO: 3412112 - RNA, 19 nt, Pseudomonas aeruginosa PA01
cgguucgccgagcgccgcc

SEQ ID NO: 3412113 - RNA, 20 nt, Pseudomonas aeruginosa PA01
cgguucgccgagcgccgcca

SEQ ID NO: 3412114 - RNA, 23 nt, Pseudomonas aeruginosa PA01
cgguucgccgagcgccgccaggc

SEQ ID NO: 3412115 - RNA, 17 nt, Pseudomonas aeruginosa PA01
cgguucgcggcgcagcu

SEQ ID NO: 3412116 - RNA, 20 nt, Pseudomonas aeruginosa PA01
cgguucggcaaggcgcagcu

SEQ ID NO: 3412117 - RNA, 13 nt, Pseudomonas aeruginosa PA01
cgguucgucgagg

SEQ ID NO: 3412118 - RNA, 18 nt, Pseudomonas aeruginosa PA01
cgguucucgucgaugucg

SEQ ID NO: 3412119 - RNA, 15 nt, Pseudomonas aeruginosa PA01
cgguucugcgcacca

SEQ ID NO: 3412120 - RNA, 19 nt, Pseudomonas aeruginosa PA01
cgguugagacgaaagccuu

SEQ ID NO: 3412121 - RNA, 17 nt, Pseudomonas aeruginosa PA01
cgguugagauccuggcc

SEQ ID NO: 3412122 - RNA, 19 nt, Pseudomonas aeruginosa PA01
cgguugagauccuggccgg

SEQ ID NO: 3412123 - RNA, 20 nt, Pseudomonas aeruginosa PA01
cgguugagauccuggccggc

SEQ ID NO: 3412124 - RNA, 14 nt, Pseudomonas aeruginosa PA01
cgguugaguagaaa

SEQ ID NO: 3412125 - RNA, 17 nt, Pseudomonas aeruginosa PA01
cgguugauagcgcggcc

SEQ ID NO: 3412126 - RNA, 20 nt, Pseudomonas aeruginosa PA01
cgguugauagcgcggccuuc

SEQ ID NO: 3412127 - RNA, 23 nt, Pseudomonas aeruginosa PA01
cgguugauagcgcggccuucagc

SEQ ID NO: 3412128 - RNA, 15 nt, Pseudomonas aeruginosa PA01
cgguugaugccgacg

SEQ ID NO: 3412129 - RNA, 16 nt, Pseudomonas aeruginosa PA01
cgguugaugccgacgu

SEQ ID NO: 3412130 - RNA, 22 nt, Pseudomonas aeruginosa PA01
cgguugauuuccgcaccgaggu

SEQ ID NO: 3412131 - RNA, 14 nt, Pseudomonas aeruginosa PA01
cgguugcagccacc

SEQ ID NO: 3412132 - RNA, 16 nt, Pseudomonas aeruginosa PA01
cgguugccaggccggc

SEQ ID NO: 3412133 - RNA, 17 nt, Pseudomonas aeruginosa PA01
cgguugccaggccggcg

SEQ ID NO: 3412134 - RNA, 19 nt, Pseudomonas aeruginosa PA01
cgguugccaggccggcgca

SEQ ID NO: 3412135 - RNA, 19 nt, Pseudomonas aeruginosa PA01
cgguugccgcgccaaaaag

SEQ ID NO: 3412136 - RNA, 14 nt, Pseudomonas aeruginosa PA01
cgguugccgcugcg

SEQ ID NO: 3412137 - RNA, 17 nt, Pseudomonas aeruginosa PA01
cgguugccgcugcggcg

SEQ ID NO: 3412138 - RNA, 14 nt, Pseudomonas aeruginosa PA01
cgguugcggcgccg

SEQ ID NO: 3412139 - RNA, 22 nt, Pseudomonas aeruginosa PA01
cgguugcugcuugcgcgcggcg

SEQ ID NO: 3412140 - RNA, 19 nt, Pseudomonas aeruginosa PA01
cgguuggaguuggaacugu

SEQ ID NO: 3412141 - RNA, 13 nt, Pseudomonas aeruginosa PA01
cgguuggcccgcg

SEQ ID NO: 3412142 - RNA, 18 nt, Pseudomonas aeruginosa PA01
cgguuggccucggcccgg

SEQ ID NO: 3412143 - RNA, 19 nt, Pseudomonas aeruginosa PA01
cgguuggccucggcccggu

SEQ ID NO: 3412144 - RNA, 18 nt, Pseudomonas aeruginosa PA01
cgguuggcuacccgcagg

SEQ ID NO: 3412145 - RNA, 16 nt, Pseudomonas aeruginosa PA01
cgguugucgaugcgcc

SEQ ID NO: 3412146 - RNA, 20 nt, Pseudomonas aeruginosa PA01
cgguugucgaugcgcccgcc

SEQ ID NO: 3412147 - RNA, 22 nt, Pseudomonas aeruginosa PA01
cgguugucgaugcgcccgccgc

SEQ ID NO: 3412148 - RNA, 22 nt, Pseudomonas aeruginosa PA01
cgguuuccaggaugcaaccgcc

SEQ ID NO: 3412149 - RNA, 17 nt, Pseudomonas aeruginosa PA01
cgguuucccucgagcac

SEQ ID NO: 3412150 - RNA, 16 nt, Pseudomonas aeruginosa PA01
cgguuuccgcagcgcu

SEQ ID NO: 3412151 - RNA, 15 nt, Pseudomonas aeruginosa PA01
cgguuuccggccagg

SEQ ID NO: 3412152 - RNA, 16 nt, Pseudomonas aeruginosa PA01
cgguuuccggccaggc

SEQ ID NO: 3412153 - RNA, 17 nt, Pseudomonas aeruginosa PA01
cgguuuccggccaggcg

SEQ ID NO: 3412154 - RNA, 19 nt, Pseudomonas aeruginosa PA01
cgguuucgaccggcgcgcc

SEQ ID NO: 3412155 - RNA, 20 nt, Pseudomonas aeruginosa PA01
cgguuucgaccggcgcgccu

SEQ ID NO: 3412156 - RNA, 14 nt, Pseudomonas aeruginosa PA01
cgguuucgccaccu

SEQ ID NO: 3412157 - RNA, 13 nt, Pseudomonas aeruginosa PA01
cgguuucgccgag

SEQ ID NO: 3412158 - RNA, 17 nt, Pseudomonas aeruginosa PA01
cgguuucgccgaggccc

SEQ ID NO: 3412159 - RNA, 19 nt, Pseudomonas aeruginosa PA01
cgguuucguggaugcugau

SEQ ID NO: 3412160 - RNA, 21 nt, Pseudomonas aeruginosa PA01
cgguuuuuuauugccagcgac

SEQ ID NO: 3412161 - RNA, 18 nt, Pseudomonas aeruginosa PA01
cguaaaauggcgcgccuc

SEQ ID NO: 3412162 - RNA, 19 nt, Pseudomonas aeruginosa PA01
cguaaaauggcgcgccucu

SEQ ID NO: 3412163 - RNA, 11 nt, Pseudomonas aeruginosa PA01
cguaacggcuu

SEQ ID NO: 3412164 - RNA, 17 nt, Pseudomonas aeruginosa PA01
cguaagcggccuuuucu

SEQ ID NO: 3412165 - RNA, 13 nt, Pseudomonas aeruginosa PA01
cguaaggccaggc

SEQ ID NO: 3412166 - RNA, 14 nt, Pseudomonas aeruginosa PA01
cguaaggccaggcu

SEQ ID NO: 3412167 - RNA, 21 nt, Pseudomonas aeruginosa PA01
cguaaucgccauuggccaggg

SEQ ID NO: 3412168 - RNA, 19 nt, Pseudomonas aeruginosa PA01
cguaaugcaacccgccgcu

SEQ ID NO: 3412169 - RNA, 20 nt, Pseudomonas aeruginosa PA01
cguaauucgcugacgaggac

SEQ ID NO: 3412170 - RNA, 16 nt, Pseudomonas aeruginosa PA01
cguacaccgcgcggca

SEQ ID NO: 3412171 - RNA, 17 nt, Pseudomonas aeruginosa PA01
cguacaccgcgcggcac

SEQ ID NO: 3412172 - RNA, 18 nt, Pseudomonas aeruginosa PA01
cguacacguuggccgucu

SEQ ID NO: 3412173 - RNA, 17 nt, Pseudomonas aeruginosa PA01
cguacagcaggcaggca

SEQ ID NO: 3412174 - RNA, 21 nt, Pseudomonas aeruginosa PA01
cguacagcaggcaggcauggu

SEQ ID NO: 3412175 - RNA, 13 nt, Pseudomonas aeruginosa PA01
cguacagcgcgac

SEQ ID NO: 3412176 - RNA, 14 nt, Pseudomonas aeruginosa PA01
cguacagcgcgaca

SEQ ID NO: 3412177 - RNA, 20 nt, Pseudomonas aeruginosa PA01
cguacagcgcgacaucggcg

SEQ ID NO: 3412178 - RNA, 23 nt, Pseudomonas aeruginosa PA01
cguacagcgcgacaucggcgaug

SEQ ID NO: 3412179 - RNA, 18 nt, Pseudomonas aeruginosa PA01
cguacagcgggccgggga

SEQ ID NO: 3412180 - RNA, 17 nt, Pseudomonas aeruginosa PA01
cguacagcgggucggcg

SEQ ID NO: 3412181 - RNA, 20 nt, Pseudomonas aeruginosa PA01
cguacagcgggucggcgaag

SEQ ID NO: 3412182 - RNA, 19 nt, Pseudomonas aeruginosa PA01
cguacaggccaccgcgcag

SEQ ID NO: 3412183 - RNA, 15 nt, Pseudomonas aeruginosa PA01
cguacaggucggcgc

SEQ ID NO: 3412184 - RNA, 19 nt, Pseudomonas aeruginosa PA01
cguacaggucggcgccggu

SEQ ID NO: 3412185 - RNA, 22 nt, Pseudomonas aeruginosa PA01
cguacaugggaaccucggcagg

SEQ ID NO: 3412186 - RNA, 13 nt, Pseudomonas aeruginosa PA01
cguaccagccgcg

SEQ ID NO: 3412187 - RNA, 17 nt, Pseudomonas aeruginosa PA01
cguaccagccgcggucc

SEQ ID NO: 3412188 - RNA, 14 nt, Pseudomonas aeruginosa PA01
cguaccagcgcgau

SEQ ID NO: 3412189 - RNA, 13 nt, Pseudomonas aeruginosa PA01
cguaccagcgcgc

SEQ ID NO: 3412190 - RNA, 13 nt, Pseudomonas aeruginosa PA01
cguaccaguagcg

SEQ ID NO: 3412191 - RNA, 12 nt, Pseudomonas aeruginosa PA01
cguaccccgacg

SEQ ID NO: 3412192 - RNA, 15 nt, Pseudomonas aeruginosa PA01
cguaccuucgagcag

SEQ ID NO: 3412193 - RNA, 23 nt, Pseudomonas aeruginosa PA01
cguacgaaccccgggccgcgcac

SEQ ID NO: 3412194 - RNA, 14 nt, Pseudomonas aeruginosa PA01
cguacgcaccgcgu

SEQ ID NO: 3412195 - RNA, 21 nt, Pseudomonas aeruginosa PA01
cguacgcccagcagcggcagg

SEQ ID NO: 3412196 - RNA, 18 nt, Pseudomonas aeruginosa PA01
cguacgcugccagguugg

SEQ ID NO: 3412197 - RNA, 15 nt, Pseudomonas aeruginosa PA01
cguacggucaugccg

SEQ ID NO: 3412198 - RNA, 16 nt, Pseudomonas aeruginosa PA01
cguacucaggccgggc

SEQ ID NO: 3412199 - RNA, 17 nt, Pseudomonas aeruginosa PA01
cguacucaggccgggcg

SEQ ID NO: 3412200 - RNA, 18 nt, Pseudomonas aeruginosa PA01
cguacucauggccgcagc

SEQ ID NO: 3412201 - RNA, 19 nt, Pseudomonas aeruginosa PA01
cguacucauggccgcagcg

SEQ ID NO: 3412202 - RNA, 21 nt, Pseudomonas aeruginosa PA01
cguacucauggccgcagcggc

SEQ ID NO: 3412203 - RNA, 12 nt, Pseudomonas aeruginosa PA01
cguacuccagca

SEQ ID NO: 3412204 - RNA, 21 nt, Pseudomonas aeruginosa PA01
cguacuccagcaacggcaucg

SEQ ID NO: 3412205 - RNA, 15 nt, Pseudomonas aeruginosa PA01
cguacuggcgccagg

SEQ ID NO: 3412206 - RNA, 16 nt, Pseudomonas aeruginosa PA01
cguacuggcgccaggc

SEQ ID NO: 3412207 - RNA, 20 nt, Pseudomonas aeruginosa PA01
cguacuggcggaucaccggc

SEQ ID NO: 3412208 - RNA, 23 nt, Pseudomonas aeruginosa PA01
cguacuucagcgucaccgcgccg

SEQ ID NO: 3412209 - RNA, 14 nt, Pseudomonas aeruginosa PA01
cguacuucggcgcg

SEQ ID NO: 3412210 - RNA, 16 nt, Pseudomonas aeruginosa PA01
cguacuuggcccggcg

SEQ ID NO: 3412211 - RNA, 15 nt, Pseudomonas aeruginosa PA01
cguagaacaccaccc

SEQ ID NO: 3412212 - RNA, 12 nt, Pseudomonas aeruginosa PA01
cguagaccacca

SEQ ID NO: 3412213 - RNA, 19 nt, Pseudomonas aeruginosa PA01
cguagaccaccagcagcag

SEQ ID NO: 3412214 - RNA, 20 nt, Pseudomonas aeruginosa PA01
cguagaccaccagcagcagc

SEQ ID NO: 3412215 - RNA, 14 nt, Pseudomonas aeruginosa PA01
cguagaccggcucc

SEQ ID NO: 3412216 - RNA, 17 nt, Pseudomonas aeruginosa PA01
cguagaccggcuccagg

SEQ ID NO: 3412217 - RNA, 19 nt, Pseudomonas aeruginosa PA01
cguagaccggcuccagggc

SEQ ID NO: 3412218 - RNA, 19 nt, Pseudomonas aeruginosa PA01
cguagacugugguguagcg

SEQ ID NO: 3412219 - RNA, 21 nt, Pseudomonas aeruginosa PA01
cguagagauauucccgcgaca

SEQ ID NO: 3412220 - RNA, 12 nt, Pseudomonas aeruginosa PA01
cguagagccugg

SEQ ID NO: 3412221 - RNA, 21 nt, Pseudomonas aeruginosa PA01
cguagagcuugcugaagcccc

SEQ ID NO: 3412222 - RNA, 17 nt, Pseudomonas aeruginosa PA01
cguagaggcucggcggc

SEQ ID NO: 3412223 - RNA, 18 nt, Pseudomonas aeruginosa PA01
cguagaggcucggcggcc

SEQ ID NO: 3412224 - RNA, 16 nt, Pseudomonas aeruginosa PA01
cguagaguucgcugag

SEQ ID NO: 3412225 - RNA, 21 nt, Pseudomonas aeruginosa PA01
cguagaguucgcugcgcgcca

SEQ ID NO: 3412226 - RNA, 14 nt, Pseudomonas aeruginosa PA01
cguagaugccggug

SEQ ID NO: 3412227 - RNA, 17 nt, Pseudomonas aeruginosa PA01
cguagaugccggugcug

SEQ ID NO: 3412228 - RNA, 17 nt, Pseudomonas aeruginosa PA01
cguagauggucagcaac

SEQ ID NO: 3412229 - RNA, 17 nt, Pseudomonas aeruginosa PA01
cguagcagguccgcgcc

SEQ ID NO: 3412230 - RNA, 19 nt, Pseudomonas aeruginosa PA01
cguagcagguccgcgccuc

SEQ ID NO: 3412231 - RNA, 17 nt, Pseudomonas aeruginosa PA01
cguagccaugcccggcu

SEQ ID NO: 3412232 - RNA, 18 nt, Pseudomonas aeruginosa PA01
cguagcccauggucagcg

SEQ ID NO: 3412233 - RNA, 23 nt, Pseudomonas aeruginosa PA01
cguagcccccgccgcugaggcuc

SEQ ID NO: 3412234 - RNA, 16 nt, Pseudomonas aeruginosa PA01
cguagccccucgcgca

SEQ ID NO: 3412235 - RNA, 20 nt, Pseudomonas aeruginosa PA01
cguagcccuucuccgccagc

SEQ ID NO: 3412236 - RNA, 14 nt, Pseudomonas aeruginosa PA01
cguagccgcgcgcc

SEQ ID NO: 3412237 - RNA, 15 nt, Pseudomonas aeruginosa PA01
cguagccgcgcgcca

SEQ ID NO: 3412238 - RNA, 17 nt, Pseudomonas aeruginosa PA01
cguagccgcgcgccagc

SEQ ID NO: 3412239 - RNA, 18 nt, Pseudomonas aeruginosa PA01
cguagccgcgcgccagca

SEQ ID NO: 3412240 - RNA, 14 nt, Pseudomonas aeruginosa PA01
cguagccggccagg

SEQ ID NO: 3412241 - RNA, 15 nt, Pseudomonas aeruginosa PA01
cguagccggccaggg

SEQ ID NO: 3412242 - RNA, 17 nt, Pseudomonas aeruginosa PA01
cguagccggcgauccgc

SEQ ID NO: 3412243 - RNA, 20 nt, Pseudomonas aeruginosa PA01
cguagccggcgauccgcugc

SEQ ID NO: 3412244 - RNA, 16 nt, Pseudomonas aeruginosa PA01
cguagccggcgcggcg

SEQ ID NO: 3412245 - RNA, 20 nt, Pseudomonas aeruginosa PA01
cguagccggcgcggcgcagc

SEQ ID NO: 3412246 - RNA, 23 nt, Pseudomonas aeruginosa PA01
cguagccggcgcggcgcagcggc

SEQ ID NO: 3412247 - RNA, 19 nt, Pseudomonas aeruginosa PA01
cguagccguagauggucag

SEQ ID NO: 3412248 - RNA, 21 nt, Pseudomonas aeruginosa PA01
cguagccguagauggucagca

SEQ ID NO: 3412249 - RNA, 23 nt, Pseudomonas aeruginosa PA01
cguagccguauucgaagcucggc

SEQ ID NO: 3412250 - RNA, 21 nt, Pseudomonas aeruginosa PA01
cguagccgucgaacagcagcu

SEQ ID NO: 3412251 - RNA, 22 nt, Pseudomonas aeruginosa PA01
cguagccgucgaacagcagcuc

SEQ ID NO: 3412252 - RNA, 20 nt, Pseudomonas aeruginosa PA01
cguagccgucguagcgcagc

SEQ ID NO: 3412253 - RNA, 21 nt, Pseudomonas aeruginosa PA01
cguagccgucguagcgcagcg

SEQ ID NO: 3412254 - RNA, 14 nt, Pseudomonas aeruginosa PA01
cguagcgcagcggc

SEQ ID NO: 3412255 - RNA, 15 nt, Pseudomonas aeruginosa PA01
cguagcgcagcggca

SEQ ID NO: 3412256 - RNA, 13 nt, Pseudomonas aeruginosa PA01
cguagcgcagguc

SEQ ID NO: 3412257 - RNA, 21 nt, Pseudomonas aeruginosa PA01
cguagcgcaguucgccgccga

SEQ ID NO: 3412258 - RNA, 23 nt, Pseudomonas aeruginosa PA01
cguagcgcaguucgccgccgagc

SEQ ID NO: 3412259 - RNA, 22 nt, Pseudomonas aeruginosa PA01
cguagcgccccuuggccagcac

SEQ ID NO: 3412260 - RNA, 17 nt, Pseudomonas aeruginosa PA01
cguagcgcgcggcgagc

SEQ ID NO: 3412261 - RNA, 17 nt, Pseudomonas aeruginosa PA01
cguagcgcggcagcgcc

SEQ ID NO: 3412262 - RNA, 18 nt, Pseudomonas aeruginosa PA01
cguagcgcggcagcgcca

SEQ ID NO: 3412263 - RNA, 21 nt, Pseudomonas aeruginosa PA01
cguagcggaagccgucggcga

SEQ ID NO: 3412264 - RNA, 16 nt, Pseudomonas aeruginosa PA01
cguagcggccucguuc

SEQ ID NO: 3412265 - RNA, 18 nt, Pseudomonas aeruginosa PA01
cguagcggucgugcagca

SEQ ID NO: 3412266 - RNA, 21 nt, Pseudomonas aeruginosa PA01
cguagcggucgugcagcagcg

SEQ ID NO: 3412267 - RNA, 22 nt, Pseudomonas aeruginosa PA01
cguagcggucgugcagcagcgc

SEQ ID NO: 3412268 - RNA, 16 nt, Pseudomonas aeruginosa PA01
cguagcguagggcgaa

SEQ ID NO: 3412269 - RNA, 15 nt, Pseudomonas aeruginosa PA01
cguagcgugccgcca

SEQ ID NO: 3412270 - RNA, 22 nt, Pseudomonas aeruginosa PA01
cguagcuguucucuuugaccuu

SEQ ID NO: 3412271 - RNA, 23 nt, Pseudomonas aeruginosa PA01
cguagcuguucucuuugaccuug

SEQ ID NO: 3412272 - RNA, 22 nt, Pseudomonas aeruginosa PA01
cguaggacgcauaaccgcuugc

SEQ ID NO: 3412273 - RNA, 15 nt, Pseudomonas aeruginosa PA01
cguaggagccggcca

SEQ ID NO: 3412274 - RNA, 17 nt, Pseudomonas aeruginosa PA01
cguaggagccggccagg

SEQ ID NO: 3412275 - RNA, 18 nt, Pseudomonas aeruginosa PA01
cguaggagccggccaggc

SEQ ID NO: 3412276 - RNA, 21 nt, Pseudomonas aeruginosa PA01
cguaggccacuucccggcgca

SEQ ID NO: 3412277 - RNA, 13 nt, Pseudomonas aeruginosa PA01
cguaggccaggca

SEQ ID NO: 3412278 - RNA, 20 nt, Pseudomonas aeruginosa PA01
cguaggccaguucgcugacc

SEQ ID NO: 3412279 - RNA, 18 nt, Pseudomonas aeruginosa PA01
cguaggccgucgcugccg

SEQ ID NO: 3412280 - RNA, 23 nt, Pseudomonas aeruginosa PA01
cguaggcgaacacgucggcgcgc

SEQ ID NO: 3412281 - RNA, 24 nt, Pseudomonas aeruginosa PA01
cguaggcgaacacgucggcgcgca

SEQ ID NO: 3412282 - RNA, 14 nt, Pseudomonas aeruginosa PA01
cguaggcgcgcacc

SEQ ID NO: 3412283 - RNA, 20 nt, Pseudomonas aeruginosa PA01
cguaggcgcgccaaggccgc

SEQ ID NO: 3412284 - RNA, 16 nt, Pseudomonas aeruginosa PA01
cguaggcgcgggcggc

SEQ ID NO: 3412285 - RNA, 16 nt, Pseudomonas aeruginosa PA01
cguaggcggcgaaggc

SEQ ID NO: 3412286 - RNA, 20 nt, Pseudomonas aeruginosa PA01
cguaggcuuggucgggcgcc

SEQ ID NO: 3412287 - RNA, 21 nt, Pseudomonas aeruginosa PA01
cguaggcuuggucgggcgccg

SEQ ID NO: 3412288 - RNA, 18 nt, Pseudomonas aeruginosa PA01
cguagggcaucgccgaca

SEQ ID NO: 3412289 - RNA, 20 nt, Pseudomonas aeruginosa PA01
cguagggcgaacaacgccgc

SEQ ID NO: 3412290 - RNA, 22 nt, Pseudomonas aeruginosa PA01
cguagggcgaacaacgccgccg

SEQ ID NO: 3412291 - RNA, 16 nt, Pseudomonas aeruginosa PA01
cguagggcgaagccaa

SEQ ID NO: 3412292 - RNA, 20 nt, Pseudomonas aeruginosa PA01
cguagggcgcauaaccgcuc

SEQ ID NO: 3412293 - RNA, 22 nt, Pseudomonas aeruginosa PA01
cguagggcgcauaaccgcucgc

SEQ ID NO: 3412294 - RNA, 19 nt, Pseudomonas aeruginosa PA01
cguagggcggauaacgcca

SEQ ID NO: 3412295 - RNA, 20 nt, Pseudomonas aeruginosa PA01
cguagggcguauaaccgcuc

SEQ ID NO: 3412296 - RNA, 14 nt, Pseudomonas aeruginosa PA01
cguaggggaccacc

SEQ ID NO: 3412297 - RNA, 16 nt, Pseudomonas aeruginosa PA01
cguaggugaagcccag

SEQ ID NO: 3412298 - RNA, 23 nt, Pseudomonas aeruginosa PA01
cguagguggauugcagcgucgac

SEQ ID NO: 3412299 - RNA, 15 nt, Pseudomonas aeruginosa PA01
cguagguggcgccgc

SEQ ID NO: 3412300 - RNA, 16 nt, Pseudomonas aeruginosa PA01
cguagguggcgccgcc

SEQ ID NO: 3412301 - RNA, 18 nt, Pseudomonas aeruginosa PA01
cguagguggcgccgccgg

SEQ ID NO: 3412302 - RNA, 19 nt, Pseudomonas aeruginosa PA01
cguagguggcgccgccggc

SEQ ID NO: 3412303 - RNA, 21 nt, Pseudomonas aeruginosa PA01
cguagguggcgccgccggcga

SEQ ID NO: 3412304 - RNA, 23 nt, Pseudomonas aeruginosa PA01
cguagguggcgccgccggcgaac

SEQ ID NO: 3412305 - RNA, 14 nt, Pseudomonas aeruginosa PA01
cguaguagugcccc

SEQ ID NO: 3412306 - RNA, 14 nt, Pseudomonas aeruginosa PA01
cguagucgaucagg

SEQ ID NO: 3412307 - RNA, 17 nt, Pseudomonas aeruginosa PA01
cguagucggcagucgcc

SEQ ID NO: 3412308 - RNA, 16 nt, Pseudomonas aeruginosa PA01
cguagugcaucagccu

SEQ ID NO: 3412309 - RNA, 21 nt, Pseudomonas aeruginosa PA01
cguagugcugguagggcuucg

SEQ ID NO: 3412310 - RNA, 15 nt, Pseudomonas aeruginosa PA01
cguaguggcgcaaca

SEQ ID NO: 3412311 - RNA, 22 nt, Pseudomonas aeruginosa PA01
cguaguugacccgccccugcuc

SEQ ID NO: 3412312 - RNA, 14 nt, Pseudomonas aeruginosa PA01
cguaguugagcccc

SEQ ID NO: 3412313 - RNA, 21 nt, Pseudomonas aeruginosa PA01
cguaguugagccccagguagg

SEQ ID NO: 3412314 - RNA, 19 nt, Pseudomonas aeruginosa PA01
cguaguugaugaagccgcg

SEQ ID NO: 3412315 - RNA, 20 nt, Pseudomonas aeruginosa PA01
cguaguugaugaagccgcga

SEQ ID NO: 3412316 - RNA, 21 nt, Pseudomonas aeruginosa PA01
cguauccaagagagcgccagc

SEQ ID NO: 3412317 - RNA, 13 nt, Pseudomonas aeruginosa PA01
cguaucccagcgc

SEQ ID NO: 3412318 - RNA, 24 nt, Pseudomonas aeruginosa PA01
cguaucccagcgcgugcaggcgcc

SEQ ID NO: 3412319 - RNA, 14 nt, Pseudomonas aeruginosa PA01
cguauccucggcca

SEQ ID NO: 3412320 - RNA, 17 nt, Pseudomonas aeruginosa PA01
cguauggcgggccuugc

SEQ ID NO: 3412321 - RNA, 16 nt, Pseudomonas aeruginosa PA01
cguauuccacgucgcc

SEQ ID NO: 3412322 - RNA, 19 nt, Pseudomonas aeruginosa PA01
cguauuccacgucgccgac

SEQ ID NO: 3412323 - RNA, 20 nt, Pseudomonas aeruginosa PA01
cguauuccacgucgccgacc

SEQ ID NO: 3412324 - RNA, 12 nt, Pseudomonas aeruginosa PA01
cguauuccaggg

SEQ ID NO: 3412325 - RNA, 13 nt, Pseudomonas aeruginosa PA01
cguauucgccgaa

SEQ ID NO: 3412326 - RNA, 22 nt, Pseudomonas aeruginosa PA01
cguauucggcgaccagcccgcg

SEQ ID NO: 3412327 - RNA, 15 nt, Pseudomonas aeruginosa PA01
cgucaaccagcaccg

SEQ ID NO: 3412328 - RNA, 22 nt, Pseudomonas aeruginosa PA01
cgucaacccuugcucccgccgc

SEQ ID NO: 3412329 - RNA, 16 nt, Pseudomonas aeruginosa PA01
cgucaaugcggccugc

SEQ ID NO: 3412330 - RNA, 22 nt, Pseudomonas aeruginosa PA01
cgucaaugcggccugcaacgcc

SEQ ID NO: 3412331 - RNA, 13 nt, Pseudomonas aeruginosa PA01
cgucacccgcgcc

SEQ ID NO: 3412332 - RNA, 18 nt, Pseudomonas aeruginosa PA01
cgucacccgcgccugcag

SEQ ID NO: 3412333 - RNA, 14 nt, Pseudomonas aeruginosa PA01
cgucaccgcgccga

SEQ ID NO: 3412334 - RNA, 14 nt, Pseudomonas aeruginosa PA01
cgucaccgcgucgg

SEQ ID NO: 3412335 - RNA, 13 nt, Pseudomonas aeruginosa PA01
cgucaccggcgcc

SEQ ID NO: 3412336 - RNA, 17 nt, Pseudomonas aeruginosa PA01
cgucaccggcgccaccc

SEQ ID NO: 3412337 - RNA, 14 nt, Pseudomonas aeruginosa PA01
cgucaccucggcgc

SEQ ID NO: 3412338 - RNA, 15 nt, Pseudomonas aeruginosa PA01
cgucaccucggcgcc

SEQ ID NO: 3412339 - RNA, 17 nt, Pseudomonas aeruginosa PA01
cgucaccuguucggcgc

SEQ ID NO: 3412340 - RNA, 11 nt, Pseudomonas aeruginosa PA01
cgucacgccga

SEQ ID NO: 3412341 - RNA, 21 nt, Pseudomonas aeruginosa PA01
cgucacgcggacccaguuggg

SEQ ID NO: 3412342 - RNA, 18 nt, Pseudomonas aeruginosa PA01
cgucacggauaggcggcg

SEQ ID NO: 3412343 - RNA, 19 nt, Pseudomonas aeruginosa PA01
cgucacggauaggcggcgg

SEQ ID NO: 3412344 - RNA, 20 nt, Pseudomonas aeruginosa PA01
cgucacggauaggcggcgga

SEQ ID NO: 3412345 - RNA, 13 nt, Pseudomonas aeruginosa PA01
cgucacggcgugc

SEQ ID NO: 3412346 - RNA, 14 nt, Pseudomonas aeruginosa PA01
cgucacggcgugcc

SEQ ID NO: 3412347 - RNA, 19 nt, Pseudomonas aeruginosa PA01
cgucacggcgugccgcagg

SEQ ID NO: 3412348 - RNA, 16 nt, Pseudomonas aeruginosa PA01
cgucacucgacaggcc

SEQ ID NO: 3412349 - RNA, 17 nt, Pseudomonas aeruginosa PA01
cgucacucgacaggcca

SEQ ID NO: 3412350 - RNA, 18 nt, Pseudomonas aeruginosa PA01
cgucacuguuuuccaugg

SEQ ID NO: 3412351 - RNA, 13 nt, Pseudomonas aeruginosa PA01
cgucagcaggucu

SEQ ID NO: 3412352 - RNA, 13 nt, Pseudomonas aeruginosa PA01
cgucagccaggcu

SEQ ID NO: 3412353 - RNA, 14 nt, Pseudomonas aeruginosa PA01
cgucagccgcggcc

SEQ ID NO: 3412354 - RNA, 15 nt, Pseudomonas aeruginosa PA01
cgucagccgcggccg

SEQ ID NO: 3412355 - RNA, 16 nt, Pseudomonas aeruginosa PA01
cgucagccgcggccgg

SEQ ID NO: 3412356 - RNA, 13 nt, Pseudomonas aeruginosa PA01
cgucagcgaggcg

SEQ ID NO: 3412357 - RNA, 15 nt, Pseudomonas aeruginosa PA01
cgucagcgaggcggg

SEQ ID NO: 3412358 - RNA, 22 nt, Pseudomonas aeruginosa PA01
cgucagcgaggcgggcgcggau

SEQ ID NO: 3412359 - RNA, 15 nt, Pseudomonas aeruginosa PA01
cgucagcgcgccagc

SEQ ID NO: 3412360 - RNA, 17 nt, Pseudomonas aeruginosa PA01
cgucaggcaccucgucc

SEQ ID NO: 3412361 - RNA, 13 nt, Pseudomonas aeruginosa PA01
cgucaggccuugc

SEQ ID NO: 3412362 - RNA, 19 nt, Pseudomonas aeruginosa PA01
cgucaggccuugcgcggcg

SEQ ID NO: 3412363 - RNA, 16 nt, Pseudomonas aeruginosa PA01
cgugcagcagcgccuu

SEQ ID NO: 3412364 - RNA, 13 nt, Pseudomonas aeruginosa PA01
cgugcagcggcag

SEQ ID NO: 3412365 - RNA, 14 nt, Pseudomonas aeruginosa PA01
cgugcagcggcagc

SEQ ID NO: 3412366 - RNA, 15 nt, Pseudomonas aeruginosa PA01
cgugcagcggcagcg

SEQ ID NO: 3412367 - RNA, 13 nt, Pseudomonas aeruginosa PA01
cgugcagcucggc

SEQ ID NO: 3412368 - RNA, 23 nt, Pseudomonas aeruginosa PA01
cgugcagcucggcacgcagcagc

SEQ ID NO: 3412369 - RNA, 12 nt, Pseudomonas aeruginosa PA01
cgugcaggccga

SEQ ID NO: 3412370 - RNA, 16 nt, Pseudomonas aeruginosa PA01
cgugcaggccgccgag

SEQ ID NO: 3412371 - RNA, 15 nt, Pseudomonas aeruginosa PA01
cgugcaggcgcccug

SEQ ID NO: 3412372 - RNA, 18 nt, Pseudomonas aeruginosa PA01
cgugcagguagccgcgcc

SEQ ID NO: 3412373 - RNA, 22 nt, Pseudomonas aeruginosa PA01
cgugcagguagccgcgccggcc

SEQ ID NO: 3412374 - RNA, 19 nt, Pseudomonas aeruginosa PA01
cgugcagguguucggcggc

SEQ ID NO: 3412375 - RNA, 20 nt, Pseudomonas aeruginosa PA01
cgugcaguacuuggccagca

SEQ ID NO: 3412376 - RNA, 15 nt, Pseudomonas aeruginosa PA01
cgugcaucaccggca

SEQ ID NO: 3412377 - RNA, 17 nt, Pseudomonas aeruginosa PA01
cgugcaucaccggcagc

SEQ ID NO: 3412378 - RNA, 22 nt, Pseudomonas aeruginosa PA01
cgugcaucaccggcagcagcgg

SEQ ID NO: 3412379 - RNA, 15 nt, Pseudomonas aeruginosa PA01
cgugcaugccgacga

SEQ ID NO: 3412380 - RNA, 17 nt, Pseudomonas aeruginosa PA01
cgugcaugccgacgagc

SEQ ID NO: 3412381 - RNA, 19 nt, Pseudomonas aeruginosa PA01
cgugcauggccgggccgau

SEQ ID NO: 3412382 - RNA, 13 nt, Pseudomonas aeruginosa PA01
cgugccagcaccu

SEQ ID NO: 3412383 - RNA, 17 nt, Pseudomonas aeruginosa PA01
cgugccaggagcuugcc

SEQ ID NO: 3412384 - RNA, 12 nt, Pseudomonas aeruginosa PA01
cgugccaggcga

SEQ ID NO: 3412385 - RNA, 13 nt, Pseudomonas aeruginosa PA01
cgugccaggcgcu

SEQ ID NO: 3412386 - RNA, 15 nt, Pseudomonas aeruginosa PA01
cgugccaggcgcucg

SEQ ID NO: 3412387 - RNA, 18 nt, Pseudomonas aeruginosa PA01
cgugccaggcgcucgcgc

SEQ ID NO: 3412388 - RNA, 12 nt, Pseudomonas aeruginosa PA01
cgugccaggcgg

SEQ ID NO: 3412389 - RNA, 20 nt, Pseudomonas aeruginosa PA01
cgugccaggcggcagccgcg

SEQ ID NO: 3412390 - RNA, 20 nt, Pseudomonas aeruginosa PA01
cgugccagggcuucccaggc

SEQ ID NO: 3412391 - RNA, 20 nt, Pseudomonas aeruginosa PA01
cgugccaucaggccgcggcc

SEQ ID NO: 3412392 - RNA, 20 nt, Pseudomonas aeruginosa PA01
cgugcccauccgcucggcga

SEQ ID NO: 3412393 - RNA, 15 nt, Pseudomonas aeruginosa PA01
cgugccccaggccga

SEQ ID NO: 3412394 - RNA, 16 nt, Pseudomonas aeruginosa PA01
cgugccccgacugucg

SEQ ID NO: 3412395 - RNA, 24 nt, Pseudomonas aeruginosa PA01
cgugccccgacugucgugccucca

SEQ ID NO: 3412396 - RNA, 15 nt, Pseudomonas aeruginosa PA01
cgugccccguggcgg

SEQ ID NO: 3412397 - RNA, 18 nt, Pseudomonas aeruginosa PA01
cgugccccguggcgggcc

SEQ ID NO: 3412398 - RNA, 23 nt, Pseudomonas aeruginosa PA01
cgugcccgccggcgcgcccaggc

SEQ ID NO: 3412399 - RNA, 22 nt, Pseudomonas aeruginosa PA01
cgugcccgcugcaugugccagg

SEQ ID NO: 3412400 - RNA, 19 nt, Pseudomonas aeruginosa PA01
cgugccgcaacgaucucgc

SEQ ID NO: 3412401 - RNA, 16 nt, Pseudomonas aeruginosa PA01
cgugccgcaggccgcg

SEQ ID NO: 3412402 - RNA, 17 nt, Pseudomonas aeruginosa PA01
cgugccgcaggccgcgg

SEQ ID NO: 3412403 - RNA, 19 nt, Pseudomonas aeruginosa PA01
cgugccgcaggccgcggcc

SEQ ID NO: 3412404 - RNA, 21 nt, Pseudomonas aeruginosa PA01
cgugccgcaggccgcggccga

SEQ ID NO: 3412405 - RNA, 13 nt, Pseudomonas aeruginosa PA01
cgugccgccaggc

SEQ ID NO: 3412406 - RNA, 12 nt, Pseudomonas aeruginosa PA01
cgugccgccggg

SEQ ID NO: 3412407 - RNA, 21 nt, Pseudomonas aeruginosa PA01
cgugccgcggaugacgggcga

SEQ ID NO: 3412408 - RNA, 20 nt, Pseudomonas aeruginosa PA01
cgugccgcuggccgaccagu

SEQ ID NO: 3412409 - RNA, 18 nt, Pseudomonas aeruginosa PA01
cgugccgggcagugcgcc

SEQ ID NO: 3412410 - RNA, 15 nt, Pseudomonas aeruginosa PA01
cgugccgggccggcc

SEQ ID NO: 3412411 - RNA, 18 nt, Pseudomonas aeruginosa PA01
cgugccgggccggccagg

SEQ ID NO: 3412412 - RNA, 19 nt, Pseudomonas aeruginosa PA01
cgugccgggccggccaggg

SEQ ID NO: 3412413 - RNA, 14 nt, Pseudomonas aeruginosa PA01
cgugccggucgcgc

SEQ ID NO: 3412414 - RNA, 24 nt, Pseudomonas aeruginosa PA01
cgugccguggaccaacagccggcg

SEQ ID NO: 3412415 - RNA, 17 nt, Pseudomonas aeruginosa PA01
cgugccguggcucggcg

SEQ ID NO: 3412416 - RNA, 12 nt, Pseudomonas aeruginosa PA01
cgugccuccagc

SEQ ID NO: 3412417 - RNA, 15 nt, Pseudomonas aeruginosa PA01
cgugccuccagccuc

SEQ ID NO: 3412418 - RNA, 13 nt, Pseudomonas aeruginosa PA01
cgugccucggcgg

SEQ ID NO: 3412419 - RNA, 21 nt, Pseudomonas aeruginosa PA01
cgugccucggcggacagcccg

SEQ ID NO: 3412420 - RNA, 21 nt, Pseudomonas aeruginosa PA01
cgugccuguuccuccgccagg

SEQ ID NO: 3412421 - RNA, 20 nt, Pseudomonas aeruginosa PA01
cgugcgaacacaccgaccgc

SEQ ID NO: 3412422 - RNA, 21 nt, Pseudomonas aeruginosa PA01
cgugcgaacacaccgaccgcg

SEQ ID NO: 3412423 - RNA, 18 nt, Pseudomonas aeruginosa PA01
cgugcgagggcggcggcu

SEQ ID NO: 3412424 - RNA, 19 nt, Pseudomonas aeruginosa PA01
cgugcgcaugcccgcgucg

SEQ ID NO: 3412425 - RNA, 20 nt, Pseudomonas aeruginosa PA01
cgugcgccccagcucagcag

SEQ ID NO: 3412426 - RNA, 15 nt, Pseudomonas aeruginosa PA01
cgugcgccgcggguc

SEQ ID NO: 3412427 - RNA, 19 nt, Pseudomonas aeruginosa PA01
cgugcgccgcgggucacca

SEQ ID NO: 3412428 - RNA, 14 nt, Pseudomonas aeruginosa PA01
cgugcgccgcucgc

SEQ ID NO: 3412429 - RNA, 21 nt, Pseudomonas aeruginosa PA01
cgugcgccgcucgcgcacggc

SEQ ID NO: 3412430 - RNA, 18 nt, Pseudomonas aeruginosa PA01
cgugcgccggccucuccg

SEQ ID NO: 3412431 - RNA, 13 nt, Pseudomonas aeruginosa PA01
cgugcgccgggcu

SEQ ID NO: 3412432 - RNA, 17 nt, Pseudomonas aeruginosa PA01
cgugcgccgggcuugca

SEQ ID NO: 3412433 - RNA, 22 nt, Pseudomonas aeruginosa PA01
cgugcgcgcaacuggucgcggc

SEQ ID NO: 3412434 - RNA, 15 nt, Pseudomonas aeruginosa PA01
cgugcgcgcccucgg

SEQ ID NO: 3412435 - RNA, 14 nt, Pseudomonas aeruginosa PA01
cgugcgcgcggccu

SEQ ID NO: 3412436 - RNA, 16 nt, Pseudomonas aeruginosa PA01
cgugcgcgcggccugu

SEQ ID NO: 3412437 - RNA, 13 nt, Pseudomonas aeruginosa PA01
cgugcgcuccgcc

SEQ ID NO: 3412438 - RNA, 14 nt, Pseudomonas aeruginosa PA01
cgugcgcuccgcca

SEQ ID NO: 3412439 - RNA, 17 nt, Pseudomonas aeruginosa PA01
cgugcgcuccgccaggc

SEQ ID NO: 3412440 - RNA, 21 nt, Pseudomonas aeruginosa PA01
cgugcgcuccgccaggccgcg

SEQ ID NO: 3412441 - RNA, 23 nt, Pseudomonas aeruginosa PA01
cgugcgcuccgccaggccgcgca

SEQ ID NO: 3412442 - RNA, 14 nt, Pseudomonas aeruginosa PA01
cgugcgcugcgcgu

SEQ ID NO: 3412443 - RNA, 21 nt, Pseudomonas aeruginosa PA01
cgugcggaaaccgcggccggc

SEQ ID NO: 3412444 - RNA, 15 nt, Pseudomonas aeruginosa PA01
cgugcggagggucag

SEQ ID NO: 3412445 - RNA, 21 nt, Pseudomonas aeruginosa PA01
cgugcggagggucaggccgag

SEQ ID NO: 3412446 - RNA, 22 nt, Pseudomonas aeruginosa PA01
cgugcggagggucaggccgagg

SEQ ID NO: 3412447 - RNA, 14 nt, Pseudomonas aeruginosa PA01
cgugcggcccuugu

SEQ ID NO: 3412448 - RNA, 21 nt, Pseudomonas aeruginosa PA01
cgugcggcccuuguucgcggc

SEQ ID NO: 3412449 - RNA, 23 nt, Pseudomonas aeruginosa PA01
cgugcggcccuuguucgcggcga

SEQ ID NO: 3412450 - RNA, 14 nt, Pseudomonas aeruginosa PA01
cgugcggccgauca

SEQ ID NO: 3412451 - RNA, 12 nt, Pseudomonas aeruginosa PA01
cgugcggccugc

SEQ ID NO: 3412452 - RNA, 18 nt, Pseudomonas aeruginosa PA01
cgugcggccugcaacaga

SEQ ID NO: 3412453 - RNA, 19 nt, Pseudomonas aeruginosa PA01
cgugcgggaacgaugccgc

SEQ ID NO: 3412454 - RNA, 18 nt, Pseudomonas aeruginosa PA01
cgugcguugcgcggcagg

SEQ ID NO: 3412455 - RNA, 14 nt, Pseudomonas aeruginosa PA01
cgugcuccgugucg

SEQ ID NO: 3412456 - RNA, 23 nt, Pseudomonas aeruginosa PA01
cgugcucggggaacacgcgcugg

SEQ ID NO: 3412457 - RNA, 17 nt, Pseudomonas aeruginosa PA01
cgugcuggccggcagca

SEQ ID NO: 3412458 - RNA, 15 nt, Pseudomonas aeruginosa PA01
cgugcugggucuccu

SEQ ID NO: 3412459 - RNA, 21 nt, Pseudomonas aeruginosa PA01
cgugcugggucuccuccucca

SEQ ID NO: 3412460 - RNA, 21 nt, Pseudomonas aeruginosa PA01
cgugcuuacggagaagggcgc

SEQ ID NO: 3412461 - RNA, 23 nt, Pseudomonas aeruginosa PA01
cgugcuuacggagaagggcgcgc

SEQ ID NO: 3412462 - RNA, 19 nt, Pseudomonas aeruginosa PA01
cgugcuuggcgaggcgcgc

SEQ ID NO: 3412463 - RNA, 20 nt, Pseudomonas aeruginosa PA01
cgugcuuggcgaggcgcgcc

SEQ ID NO: 3412464 - RNA, 17 nt, Pseudomonas aeruginosa PA01
cgugcuuggugucggcc

SEQ ID NO: 3412465 - RNA, 19 nt, Pseudomonas aeruginosa PA01
cguggaaaaagaagaaaaa

SEQ ID NO: 3412466 - RNA, 16 nt, Pseudomonas aeruginosa PA01
cgucguccagcggcuc

SEQ ID NO: 3412467 - RNA, 18 nt, Pseudomonas aeruginosa PA01
cgucguccagcggcucgc

SEQ ID NO: 3412468 - RNA, 17 nt, Pseudomonas aeruginosa PA01
cgucguccagcgggccc

SEQ ID NO: 3412469 - RNA, 22 nt, Pseudomonas aeruginosa PA01
cgucguccagcgggcccauggc

SEQ ID NO: 3412470 - RNA, 23 nt, Pseudomonas aeruginosa PA01
cgucguccagcgggcccauggcg

SEQ ID NO: 3412471 - RNA, 21 nt, Pseudomonas aeruginosa PA01
cgucguccaucgccgcggcga

SEQ ID NO: 3412472 - RNA, 17 nt, Pseudomonas aeruginosa PA01
cgucguccgaggcggau

SEQ ID NO: 3412473 - RNA, 15 nt, Pseudomonas aeruginosa PA01
cgucguccggcgcca

SEQ ID NO: 3412474 - RNA, 21 nt, Pseudomonas aeruginosa PA01
cgucguccucgaaagccgccg

SEQ ID NO: 3412475 - RNA, 20 nt, Pseudomonas aeruginosa PA01
cgucguccugcgcggcgacg

SEQ ID NO: 3412476 - RNA, 17 nt, Pseudomonas aeruginosa PA01
cgucgucgaagcugucg

SEQ ID NO: 3412477 - RNA, 14 nt, Pseudomonas aeruginosa PA01
cgucgucgcggcgc

SEQ ID NO: 3412478 - RNA, 15 nt, Pseudomonas aeruginosa PA01
cgucgucgcggcgcc

SEQ ID NO: 3412479 - RNA, 17 nt, Pseudomonas aeruginosa PA01
cgucgucgcugcgcggg

SEQ ID NO: 3412480 - RNA, 19 nt, Pseudomonas aeruginosa PA01
cgucgucgcugcgcggguc

SEQ ID NO: 3412481 - RNA, 22 nt, Pseudomonas aeruginosa PA01
cgucgucggagauagccuccuc

SEQ ID NO: 3412482 - RNA, 13 nt, Pseudomonas aeruginosa PA01
cgucgucggcgac

SEQ ID NO: 3412483 - RNA, 14 nt, Pseudomonas aeruginosa PA01
cgucgucggcgacg

SEQ ID NO: 3412484 - RNA, 14 nt, Pseudomonas aeruginosa PA01
cgucgugcgccggc

SEQ ID NO: 3412485 - RNA, 16 nt, Pseudomonas aeruginosa PA01
cgucgugcgccggccu

SEQ ID NO: 3412486 - RNA, 12 nt, Pseudomonas aeruginosa PA01
cgucguggccau

SEQ ID NO: 3412487 - RNA, 14 nt, Pseudomonas aeruginosa PA01
cgucguuggccggc

SEQ ID NO: 3412488 - RNA, 18 nt, Pseudomonas aeruginosa PA01
cgucguuucauucgucgc

SEQ ID NO: 3412489 - RNA, 21 nt, Pseudomonas aeruginosa PA01
cgucguuucucggcgauggcg

SEQ ID NO: 3412490 - RNA, 17 nt, Pseudomonas aeruginosa PA01
cgucucagaccuuccug

SEQ ID NO: 3412491 - RNA, 17 nt, Pseudomonas aeruginosa PA01
cgucucagcccucggcc

SEQ ID NO: 3412492 - RNA, 17 nt, Pseudomonas aeruginosa PA01
cgucucauggaacagca

SEQ ID NO: 3412493 - RNA, 22 nt, Pseudomonas aeruginosa PA01
cgucucauggaacagcagccag

SEQ ID NO: 3412494 - RNA, 17 nt, Pseudomonas aeruginosa PA01
cgucuccagcucggcga

SEQ ID NO: 3412495 - RNA, 15 nt, Pseudomonas aeruginosa PA01
cgucuccaggcgcgc

SEQ ID NO: 3412496 - RNA, 16 nt, Pseudomonas aeruginosa PA01
cgucuccaggcgcgcc

SEQ ID NO: 3412497 - RNA, 20 nt, Pseudomonas aeruginosa PA01
cgucuccgccgcuaucgccg

SEQ ID NO: 3412498 - RNA, 12 nt, Pseudomonas aeruginosa PA01
cgucucggcgaa

SEQ ID NO: 3412499 - RNA, 23 nt, Pseudomonas aeruginosa PA01
cgucucggcgaacgacagcacca

SEQ ID NO: 3412500 - RNA, 20 nt, Pseudomonas aeruginosa PA01
cgucucggugcucaggcggc

SEQ ID NO: 3412501 - RNA, 21 nt, Pseudomonas aeruginosa PA01
cgucucggugcucaggcggcc

SEQ ID NO: 3412502 - RNA, 15 nt, Pseudomonas aeruginosa PA01
cgucugcagcuugcg

SEQ ID NO: 3412503 - RNA, 17 nt, Pseudomonas aeruginosa PA01
cgucugcagcuugcgcg

SEQ ID NO: 3412504 - RNA, 13 nt, Pseudomonas aeruginosa PA01
cgucugccgcucg

SEQ ID NO: 3412505 - RNA, 14 nt, Pseudomonas aeruginosa PA01
cgucugccgcucgu

SEQ ID NO: 3412506 - RNA, 18 nt, Pseudomonas aeruginosa PA01
cgucugccgcucguuggc

SEQ ID NO: 3412507 - RNA, 14 nt, Pseudomonas aeruginosa PA01
cgucugccgcuggc

SEQ ID NO: 3412508 - RNA, 16 nt, Pseudomonas aeruginosa PA01
cgucugccgcuggcgg

SEQ ID NO: 3412509 - RNA, 22 nt, Pseudomonas aeruginosa PA01
cgucugcucauucggccagcgc

SEQ ID NO: 3412510 - RNA, 23 nt, Pseudomonas aeruginosa PA01
cgucugcucauucggccagcgcg

SEQ ID NO: 3412511 - RNA, 18 nt, Pseudomonas aeruginosa PA01
cgucuggcgcauccgccc

SEQ ID NO: 3412512 - RNA, 14 nt, Pseudomonas aeruginosa PA01
cgucuggcgccugg

SEQ ID NO: 3412513 - RNA, 17 nt, Pseudomonas aeruginosa PA01
cgucuggcgccuggccu

SEQ ID NO: 3412514 - RNA, 19 nt, Pseudomonas aeruginosa PA01
cgucuggcgccuggccugg

SEQ ID NO: 3412515 - RNA, 16 nt, Pseudomonas aeruginosa PA01
cgucugggacggcagc

SEQ ID NO: 3412516 - RNA, 18 nt, Pseudomonas aeruginosa PA01
cgucugggugaccagcag

SEQ ID NO: 3412517 - RNA, 17 nt, Pseudomonas aeruginosa PA01
cgucugugccgaggccg

SEQ ID NO: 3412518 - RNA, 18 nt, Pseudomonas aeruginosa PA01
cgucugugccgaggccgc

SEQ ID NO: 3412519 - RNA, 18 nt, Pseudomonas aeruginosa PA01
cgucuucaguaggccagc

SEQ ID NO: 3412520 - RNA, 21 nt, Pseudomonas aeruginosa PA01
cgucuuccggcucgccgcgcu

SEQ ID NO: 3412521 - RNA, 20 nt, Pseudomonas aeruginosa PA01
cgucuucgauggcggccgcc

SEQ ID NO: 3412522 - RNA, 22 nt, Pseudomonas aeruginosa PA01
cgucuucgauggcggccgccau

SEQ ID NO: 3412523 - RNA, 21 nt, Pseudomonas aeruginosa PA01
cgucuucgccgaugcgccgac

SEQ ID NO: 3412524 - RNA, 16 nt, Pseudomonas aeruginosa PA01
cgucuucggcggcgcc

SEQ ID NO: 3412525 - RNA, 17 nt, Pseudomonas aeruginosa PA01
cgugaaaagcggcgugc

SEQ ID NO: 3412526 - RNA, 13 nt, Pseudomonas aeruginosa PA01
cgugaaacgccag

SEQ ID NO: 3412527 - RNA, 22 nt, Pseudomonas aeruginosa PA01
cgugaaaggaagaagcccgccu

SEQ ID NO: 3412528 - RNA, 16 nt, Pseudomonas aeruginosa PA01
cgugaacgcggcgaga

SEQ ID NO: 3412529 - RNA, 18 nt, Pseudomonas aeruginosa PA01
cgugaagccccuggcgcu

SEQ ID NO: 3412530 - RNA, 19 nt, Pseudomonas aeruginosa PA01
cgugaagccccuggcgcug

SEQ ID NO: 3412531 - RNA, 15 nt, Pseudomonas aeruginosa PA01
cgugaagccgccgcc

SEQ ID NO: 3412532 - RNA, 16 nt, Pseudomonas aeruginosa PA01
cgugaagccgccgccc

SEQ ID NO: 3412533 - RNA, 22 nt, Pseudomonas aeruginosa PA01
cgugaagccgccgcccagcagc

SEQ ID NO: 3412534 - RNA, 23 nt, Pseudomonas aeruginosa PA01
cgugaagccgccgcccagcagca

SEQ ID NO: 3412535 - RNA, 16 nt, Pseudomonas aeruginosa PA01
cgugaagcuggagcag

SEQ ID NO: 3412536 - RNA, 18 nt, Pseudomonas aeruginosa PA01
cgugaagcuggagcagca

SEQ ID NO: 3412537 - RNA, 19 nt, Pseudomonas aeruginosa PA01
cgugaagcuggagcagcag

SEQ ID NO: 3412538 - RNA, 21 nt, Pseudomonas aeruginosa PA01
cgugaagcuggagcagcagcg

SEQ ID NO: 3412539 - RNA, 17 nt, Pseudomonas aeruginosa PA01
cgugaaguagccgccgg

SEQ ID NO: 3412540 - RNA, 11 nt, Pseudomonas aeruginosa PA01
cgugaccagca

SEQ ID NO: 3412541 - RNA, 14 nt, Pseudomonas aeruginosa PA01
cgugaccagcaugg

SEQ ID NO: 3412542 - RNA, 16 nt, Pseudomonas aeruginosa PA01
cgugaccagcauggcg

SEQ ID NO: 3412543 - RNA, 14 nt, Pseudomonas aeruginosa PA01
cgugacccgcgcuu

SEQ ID NO: 3412544 - RNA, 24 nt, Pseudomonas aeruginosa PA01
cgugaccguccagcgcgccgcgca

SEQ ID NO: 3412545 - RNA, 16 nt, Pseudomonas aeruginosa PA01
cgugacgucggcggcg

SEQ ID NO: 3412546 - RNA, 17 nt, Pseudomonas aeruginosa PA01
cgugacgucggcggcgg

SEQ ID NO: 3412547 - RNA, 14 nt, Pseudomonas aeruginosa PA01
cgugacugcaaucg

SEQ ID NO: 3412548 - RNA, 17 nt, Pseudomonas aeruginosa PA01
cgugagcugggcaggcu

SEQ ID NO: 3412549 - RNA, 14 nt, Pseudomonas aeruginosa PA01
cgugagcuugucca

SEQ ID NO: 3412550 - RNA, 14 nt, Pseudomonas aeruginosa PA01
cgugaggcgcaggg

SEQ ID NO: 3412551 - RNA, 16 nt, Pseudomonas aeruginosa PA01
cgugaggcgcgcgccg

SEQ ID NO: 3412552 - RNA, 19 nt, Pseudomonas aeruginosa PA01
cgugagggucgcgccgacg

SEQ ID NO: 3412553 - RNA, 21 nt, Pseudomonas aeruginosa PA01
cgugauccguggcgagcgcga

SEQ ID NO: 3412554 - RNA, 13 nt, Pseudomonas aeruginosa PA01
cgugcaccagcag

SEQ ID NO: 3412555 - RNA, 14 nt, Pseudomonas aeruginosa PA01
cgugcaccagcagg

SEQ ID NO: 3412556 - RNA, 17 nt, Pseudomonas aeruginosa PA01
cgugcaccagcaggcga

SEQ ID NO: 3412557 - RNA, 13 nt, Pseudomonas aeruginosa PA01
cgugcaccgaggc

SEQ ID NO: 3412558 - RNA, 18 nt, Pseudomonas aeruginosa PA01
cgugcaccgaggcgcgcc

SEQ ID NO: 3412559 - RNA, 21 nt, Pseudomonas aeruginosa PA01
cgugcaccgaggcgcgccgac

SEQ ID NO: 3412560 - RNA, 24 nt, Pseudomonas aeruginosa PA01
cgugcaccgaggcgcgccgacagc

SEQ ID NO: 3412561 - RNA, 14 nt, Pseudomonas aeruginosa PA01
cgugcacgccgugc

SEQ ID NO: 3412562 - RNA, 20 nt, Pseudomonas aeruginosa PA01
cgugcacgccgugcaucacc

SEQ ID NO: 3412563 - RNA, 14 nt, Pseudomonas aeruginosa PA01
cgugcagaccaggg

SEQ ID NO: 3412564 - RNA, 18 nt, Pseudomonas aeruginosa PA01
cgugcagcaagccgcagc

SEQ ID NO: 3412565 - RNA, 20 nt, Pseudomonas aeruginosa PA01
cgugcagcacauagaggguc

SEQ ID NO: 3412566 - RNA, 12 nt, Pseudomonas aeruginosa PA01
cgugcagcagcg

SEQ ID NO: 3412567 - RNA, 21 nt, Pseudomonas aeruginosa PA01
cgugcagcagcgaccugaccc

SEQ ID NO: 3412568 - RNA, 14 nt, Pseudomonas aeruginosa PA01
cgugcagcagcgcc

SEQ ID NO: 3412569 - RNA, 15 nt, Pseudomonas aeruginosa PA01
cgugcagcagcgccu

SEQ ID NO: 3412570 - RNA, 20 nt, Pseudomonas aeruginosa PA01
cgucaggccuugcgcggcgc

SEQ ID NO: 3412571 - RNA, 21 nt, Pseudomonas aeruginosa PA01
cgucaggccuugcgcggcgcc

SEQ ID NO: 3412572 - RNA, 21 nt, Pseudomonas aeruginosa PA01
cgucaguuccgcaucggccac

SEQ ID NO: 3412573 - RNA, 22 nt, Pseudomonas aeruginosa PA01
cgucauacaacuguugcucggg

SEQ ID NO: 3412574 - RNA, 15 nt, Pseudomonas aeruginosa PA01
cgucauaggccuugg

SEQ ID NO: 3412575 - RNA, 18 nt, Pseudomonas aeruginosa PA01
cgucauaggccuuggcga

SEQ ID NO: 3412576 - RNA, 14 nt, Pseudomonas aeruginosa PA01
cgucaucaggcuca

SEQ ID NO: 3412577 - RNA, 15 nt, Pseudomonas aeruginosa PA01
cgucaucaggcucag

SEQ ID NO: 3412578 - RNA, 18 nt, Pseudomonas aeruginosa PA01
cgucaucaggcucaggcc

SEQ ID NO: 3412579 - RNA, 14 nt, Pseudomonas aeruginosa PA01
cgucauccgccaac

SEQ ID NO: 3412580 - RNA, 15 nt, Pseudomonas aeruginosa PA01
cgucauccgccaacc

SEQ ID NO: 3412581 - RNA, 22 nt, Pseudomonas aeruginosa PA01
cgucaucgagcaguuccaggcg

SEQ ID NO: 3412582 - RNA, 14 nt, Pseudomonas aeruginosa PA01
cgucaucgcugacc

SEQ ID NO: 3412583 - RNA, 18 nt, Pseudomonas aeruginosa PA01
cgucaucgcugaccugga

SEQ ID NO: 3412584 - RNA, 16 nt, Pseudomonas aeruginosa PA01
cgucaugaccagagcc

SEQ ID NO: 3412585 - RNA, 23 nt, Pseudomonas aeruginosa PA01
cgucaugaccagagccgccgaac

SEQ ID NO: 3412586 - RNA, 15 nt, Pseudomonas aeruginosa PA01
cgucaugccgccguc

SEQ ID NO: 3412587 - RNA, 14 nt, Pseudomonas aeruginosa PA01
cgucauggcgcacg

SEQ ID NO: 3412588 - RNA, 15 nt, Pseudomonas aeruginosa PA01
cgucauggcgggcgu

SEQ ID NO: 3412589 - RNA, 13 nt, Pseudomonas aeruginosa PA01
cguccaccauaaa

SEQ ID NO: 3412590 - RNA, 23 nt, Pseudomonas aeruginosa PA01
cguccaccauaaagcccacacgc

SEQ ID NO: 3412591 - RNA, 18 nt, Pseudomonas aeruginosa PA01
cguccaccgaguggcgca

SEQ ID NO: 3412592 - RNA, 12 nt, Pseudomonas aeruginosa PA01
cguccaccgcuu

SEQ ID NO: 3412593 - RNA, 17 nt, Pseudomonas aeruginosa PA01
cguccaccgcuucgcgg

SEQ ID NO: 3412594 - RNA, 14 nt, Pseudomonas aeruginosa PA01
cguccaccggcgcc

SEQ ID NO: 3412595 - RNA, 15 nt, Pseudomonas aeruginosa PA01
cguccaccuggcggc

SEQ ID NO: 3412596 - RNA, 17 nt, Pseudomonas aeruginosa PA01
cguccaccuggcggcug

SEQ ID NO: 3412597 - RNA, 18 nt, Pseudomonas aeruginosa PA01
cguccaccuggcggcuga

SEQ ID NO: 3412598 - RNA, 21 nt, Pseudomonas aeruginosa PA01
cguccacggcgcgucggcggu

SEQ ID NO: 3412599 - RNA, 16 nt, Pseudomonas aeruginosa PA01
cguccacuccggcagc

SEQ ID NO: 3412600 - RNA, 17 nt, Pseudomonas aeruginosa PA01
cguccacuccggcagca

SEQ ID NO: 3412601 - RNA, 20 nt, Pseudomonas aeruginosa PA01
cguccacuccggcagcaccc

SEQ ID NO: 3412602 - RNA, 22 nt, Pseudomonas aeruginosa PA01
cguccacuccggcagcacccgc

SEQ ID NO: 3412603 - RNA, 20 nt, Pseudomonas aeruginosa PA01
cguccacugcguccuggucg

SEQ ID NO: 3412604 - RNA, 22 nt, Pseudomonas aeruginosa PA01
cguccagaugaaacugcccggc

SEQ ID NO: 3412605 - RNA, 16 nt, Pseudomonas aeruginosa PA01
cguccagcaggcccag

SEQ ID NO: 3412606 - RNA, 19 nt, Pseudomonas aeruginosa PA01
cguccagcagguucggcgg

SEQ ID NO: 3412607 - RNA, 12 nt, Pseudomonas aeruginosa PA01
cguccagccgcc

SEQ ID NO: 3412608 - RNA, 17 nt, Pseudomonas aeruginosa PA01
cguccagccgccgcugc

SEQ ID NO: 3412609 - RNA, 14 nt, Pseudomonas aeruginosa PA01
cguccagccggcgc

SEQ ID NO: 3412610 - RNA, 15 nt, Pseudomonas aeruginosa PA01
cguccagccggcgcu

SEQ ID NO: 3412611 - RNA, 20 nt, Pseudomonas aeruginosa PA01
cguccagcgaggcguggaag

SEQ ID NO: 3412612 - RNA, 12 nt, Pseudomonas aeruginosa PA01
cguccagcgcca

SEQ ID NO: 3412613 - RNA, 21 nt, Pseudomonas aeruginosa PA01
cguccagcgcgcccggcgcca

SEQ ID NO: 3412614 - RNA, 14 nt, Pseudomonas aeruginosa PA01
cguccagcgcgccg

SEQ ID NO: 3412615 - RNA, 15 nt, Pseudomonas aeruginosa PA01
cguccagcgcgccgc

SEQ ID NO: 3412616 - RNA, 17 nt, Pseudomonas aeruginosa PA01
cguccagcgcgccgcgc

SEQ ID NO: 3412617 - RNA, 20 nt, Pseudomonas aeruginosa PA01
cguccagcgcuugaacgcgc

SEQ ID NO: 3412618 - RNA, 17 nt, Pseudomonas aeruginosa PA01
cguccagcggcaugccg

SEQ ID NO: 3412619 - RNA, 12 nt, Pseudomonas aeruginosa PA01
cguccagcucca

SEQ ID NO: 3412620 - RNA, 15 nt, Pseudomonas aeruginosa PA01
cguccagcucggcca

SEQ ID NO: 3412621 - RNA, 17 nt, Pseudomonas aeruginosa PA01
cguccagcucggccauc

SEQ ID NO: 3412622 - RNA, 18 nt, Pseudomonas aeruginosa PA01
cguccagcucggccauca

SEQ ID NO: 3412623 - RNA, 23 nt, Pseudomonas aeruginosa PA01
cguccagcucggccaucagcgcc

SEQ ID NO: 3412624 - RNA, 20 nt, Pseudomonas aeruginosa PA01
cguccagcucgucguggaag

SEQ ID NO: 3412625 - RNA, 15 nt, Pseudomonas aeruginosa PA01
cguccaggcaagcgc

SEQ ID NO: 3412626 - RNA, 15 nt, Pseudomonas aeruginosa PA01
cguccaggccgcagg

SEQ ID NO: 3412627 - RNA, 12 nt, Pseudomonas aeruginosa PA01
cguccagggcac

SEQ ID NO: 3412628 - RNA, 13 nt, Pseudomonas aeruginosa PA01
cguccagggcgcu

SEQ ID NO: 3412629 - RNA, 19 nt, Pseudomonas aeruginosa PA01
cguccaggguuggaagaaa

SEQ ID NO: 3412630 - RNA, 20 nt, Pseudomonas aeruginosa PA01
cguccaggguuggaagaaag

SEQ ID NO: 3412631 - RNA, 16 nt, Pseudomonas aeruginosa PA01
cguccagguagaaaug

SEQ ID NO: 3412632 - RNA, 14 nt, Pseudomonas aeruginosa PA01
cguccaguagcgcc

SEQ ID NO: 3412633 - RNA, 13 nt, Pseudomonas aeruginosa PA01
cguccagugcggc

SEQ ID NO: 3412634 - RNA, 21 nt, Pseudomonas aeruginosa PA01
cguccagugcggcagucggua

SEQ ID NO: 3412635 - RNA, 16 nt, Pseudomonas aeruginosa PA01
cguccaguucagggcc

SEQ ID NO: 3412636 - RNA, 20 nt, Pseudomonas aeruginosa PA01
cguccaguuccagggucagc

SEQ ID NO: 3412637 - RNA, 17 nt, Pseudomonas aeruginosa PA01
cguccaucgccaggcca

SEQ ID NO: 3412638 - RNA, 14 nt, Pseudomonas aeruginosa PA01
cguccaucgccgcg

SEQ ID NO: 3412639 - RNA, 16 nt, Pseudomonas aeruginosa PA01
cguccaucgccgcggc

SEQ ID NO: 3412640 - RNA, 18 nt, Pseudomonas aeruginosa PA01
cguccaucgccgcggcga

SEQ ID NO: 3412641 - RNA, 13 nt, Pseudomonas aeruginosa PA01
cguccauggcggc

SEQ ID NO: 3412642 - RNA, 14 nt, Pseudomonas aeruginosa PA01
cguccauggcggcg

SEQ ID NO: 3412643 - RNA, 17 nt, Pseudomonas aeruginosa PA01
cguccauggcggcgaug

SEQ ID NO: 3412644 - RNA, 13 nt, Pseudomonas aeruginosa PA01
cgucccagucggc

SEQ ID NO: 3412645 - RNA, 22 nt, Pseudomonas aeruginosa PA01
cgucccagucggcguccgccuc

SEQ ID NO: 3412646 - RNA, 23 nt, Pseudomonas aeruginosa PA01
cgucccaugaccgucagccaggc

SEQ ID NO: 3412647 - RNA, 12 nt, Pseudomonas aeruginosa PA01
cgucccauggcg

SEQ ID NO: 3412648 - RNA, 22 nt, Pseudomonas aeruginosa PA01
cguccccacucaucucagcaac

SEQ ID NO: 3412649 - RNA, 13 nt, Pseudomonas aeruginosa PA01
cguccccaugccc

SEQ ID NO: 3412650 - RNA, 17 nt, Pseudomonas aeruginosa PA01
cguccccuuccuccucg

SEQ ID NO: 3412651 - RNA, 24 nt, Pseudomonas aeruginosa PA01
cguccccuuccuccucgccgcucc

SEQ ID NO: 3412652 - RNA, 16 nt, Pseudomonas aeruginosa PA01
cgucccgcaguagcuc

SEQ ID NO: 3412653 - RNA, 20 nt, Pseudomonas aeruginosa PA01
cgucccgcaguagcucgccg

SEQ ID NO: 3412654 - RNA, 13 nt, Pseudomonas aeruginosa PA01
cgucccgcgcgcc

SEQ ID NO: 3412655 - RNA, 19 nt, Pseudomonas aeruginosa PA01
cgucccgcgcgccgagccc

SEQ ID NO: 3412656 - RNA, 13 nt, Pseudomonas aeruginosa PA01
cgucccgcuccag

SEQ ID NO: 3412657 - RNA, 15 nt, Pseudomonas aeruginosa PA01
cgucccgcuccagcc

SEQ ID NO: 3412658 - RNA, 17 nt, Pseudomonas aeruginosa PA01
cgucccgcuccagccgg

SEQ ID NO: 3412659 - RNA, 12 nt, Pseudomonas aeruginosa PA01
cgucccgcugcg

SEQ ID NO: 3412660 - RNA, 22 nt, Pseudomonas aeruginosa PA01
cgucccgcugcguagggcgagu

SEQ ID NO: 3412661 - RNA, 15 nt, Pseudomonas aeruginosa PA01
cgucccggcgccgcc

SEQ ID NO: 3412662 - RNA, 16 nt, Pseudomonas aeruginosa PA01
cgucccggcgccgccc

SEQ ID NO: 3412663 - RNA, 17 nt, Pseudomonas aeruginosa PA01
cgucccggcgccgcccu

SEQ ID NO: 3412664 - RNA, 18 nt, Pseudomonas aeruginosa PA01
cgucccggcgccgcccuu

SEQ ID NO: 3412665 - RNA, 19 nt, Pseudomonas aeruginosa PA01
cgucccggguucugcucga

SEQ ID NO: 3412666 - RNA, 19 nt, Pseudomonas aeruginosa PA01
cgucccguuccgcucacca

SEQ ID NO: 3412667 - RNA, 14 nt, Pseudomonas aeruginosa PA01
cgucccguuccggc

SEQ ID NO: 3412668 - RNA, 17 nt, Pseudomonas aeruginosa PA01
cgucccguuccggcgca

SEQ ID NO: 3412669 - RNA, 22 nt, Pseudomonas aeruginosa PA01
cgucccguuccggcgcagcgga

SEQ ID NO: 3412670 - RNA, 13 nt, Pseudomonas aeruginosa PA01
cgucccguugcgc

SEQ ID NO: 3412671 - RNA, 14 nt, Pseudomonas aeruginosa PA01
cgucccucagguag

SEQ ID NO: 3412672 - RNA, 17 nt, Pseudomonas aeruginosa PA01
cgucccugaccagcagg

SEQ ID NO: 3412673 - RNA, 20 nt, Pseudomonas aeruginosa PA01
cgucccugcccgcgccucgc

SEQ ID NO: 3412674 - RNA, 14 nt, Pseudomonas aeruginosa PA01
cgucccugggcgca

SEQ ID NO: 3412675 - RNA, 16 nt, Pseudomonas aeruginosa PA01
cgucccuuccccgauc

SEQ ID NO: 3412676 - RNA, 12 nt, Pseudomonas aeruginosa PA01
cgucccuuggcg

SEQ ID NO: 3412677 - RNA, 19 nt, Pseudomonas aeruginosa PA01
cgucccuuggcgucgcggc

SEQ ID NO: 3412678 - RNA, 20 nt, Pseudomonas aeruginosa PA01
cgucccuuguuuuccuggcc

SEQ ID NO: 3412679 - RNA, 13 nt, Pseudomonas aeruginosa PA01
cguccgaacgcgc

SEQ ID NO: 3412680 - RNA, 13 nt, Pseudomonas aeruginosa PA01
cguccgacagcag

SEQ ID NO: 3412681 - RNA, 15 nt, Pseudomonas aeruginosa PA01
cguccgacagcaggu

SEQ ID NO: 3412682 - RNA, 16 nt, Pseudomonas aeruginosa PA01
cguccgacagcagguc

SEQ ID NO: 3412683 - RNA, 22 nt, Pseudomonas aeruginosa PA01
cguccgagagcagggccuggcc

SEQ ID NO: 3412684 - RNA, 16 nt, Pseudomonas aeruginosa PA01
cguccgagguggcuga

SEQ ID NO: 3412685 - RNA, 18 nt, Pseudomonas aeruginosa PA01
cguccgagguggcugaag

SEQ ID NO: 3412686 - RNA, 12 nt, Pseudomonas aeruginosa PA01
cguccgcagcac

SEQ ID NO: 3412687 - RNA, 16 nt, Pseudomonas aeruginosa PA01
cguccgcaguucgccc

SEQ ID NO: 3412688 - RNA, 19 nt, Pseudomonas aeruginosa PA01
cguccgcaguucgccccgc

SEQ ID NO: 3412689 - RNA, 20 nt, Pseudomonas aeruginosa PA01
cguccgcaguucgccccgcc

SEQ ID NO: 3412690 - RNA, 14 nt, Pseudomonas aeruginosa PA01
cguccgccaccacg

SEQ ID NO: 3412691 - RNA, 22 nt, Pseudomonas aeruginosa PA01
cguccgcccaguucgccggcca

SEQ ID NO: 3412692 - RNA, 13 nt, Pseudomonas aeruginosa PA01
cguccgccgccgu

SEQ ID NO: 3412693 - RNA, 22 nt, Pseudomonas aeruginosa PA01
cguccgccggguccaccgcggc

SEQ ID NO: 3412694 - RNA, 12 nt, Pseudomonas aeruginosa PA01
cguccgccuggg

SEQ ID NO: 3412695 - RNA, 13 nt, Pseudomonas aeruginosa PA01
cguccgcgaugcg

SEQ ID NO: 3412696 - RNA, 19 nt, Pseudomonas aeruginosa PA01
cguccgcgaugcguuccag

SEQ ID NO: 3412697 - RNA, 22 nt, Pseudomonas aeruginosa PA01
cguccgcgaugcguuccagggc

SEQ ID NO: 3412698 - RNA, 13 nt, Pseudomonas aeruginosa PA01
cguccgcgcaggc

SEQ ID NO: 3412699 - RNA, 14 nt, Pseudomonas aeruginosa PA01
cguccgcgcaggcg

SEQ ID NO: 3412700 - RNA, 22 nt, Pseudomonas aeruginosa PA01
cguccgcgcaggcggucgccga

SEQ ID NO: 3412701 - RNA, 14 nt, Pseudomonas aeruginosa PA01
cguccgcgccgcgc

SEQ ID NO: 3412702 - RNA, 14 nt, Pseudomonas aeruginosa PA01
cguccgcggccugc

SEQ ID NO: 3412703 - RNA, 14 nt, Pseudomonas aeruginosa PA01
cguccgcgggcgau

SEQ ID NO: 3412704 - RNA, 21 nt, Pseudomonas aeruginosa PA01
cguccgcuggccugcagcagg

SEQ ID NO: 3412705 - RNA, 19 nt, Pseudomonas aeruginosa PA01
cguccggaccgggcggcag

SEQ ID NO: 3412706 - RNA, 14 nt, Pseudomonas aeruginosa PA01
cguccggagccggg

SEQ ID NO: 3412707 - RNA, 20 nt, Pseudomonas aeruginosa PA01
cguccggagugaugccgaug

SEQ ID NO: 3412708 - RNA, 15 nt, Pseudomonas aeruginosa PA01
cguccggcagggccu

SEQ ID NO: 3412709 - RNA, 23 nt, Pseudomonas aeruginosa PA01
cguccggcagggccucgggcggg

SEQ ID NO: 3412710 - RNA, 22 nt, Pseudomonas aeruginosa PA01
cguccggcaggucuucgagaag

SEQ ID NO: 3412711 - RNA, 15 nt, Pseudomonas aeruginosa PA01
cguccggccagccug

SEQ ID NO: 3412712 - RNA, 18 nt, Pseudomonas aeruginosa PA01
cguccggccagccuggcc

SEQ ID NO: 3412713 - RNA, 20 nt, Pseudomonas aeruginosa PA01
cguccggccgcccgagccgc

SEQ ID NO: 3412714 - RNA, 23 nt, Pseudomonas aeruginosa PA01
cguccggcgagaaaggcugcuuc

SEQ ID NO: 3412715 - RNA, 18 nt, Pseudomonas aeruginosa PA01
cguccggcgagcacggcg

SEQ ID NO: 3412716 - RNA, 15 nt, Pseudomonas aeruginosa PA01
cguccggcgccaacu

SEQ ID NO: 3412717 - RNA, 21 nt, Pseudomonas aeruginosa PA01
cguccggcgugguggcgggga

SEQ ID NO: 3412718 - RNA, 14 nt, Pseudomonas aeruginosa PA01
cguccgggcacgca

SEQ ID NO: 3412719 - RNA, 15 nt, Pseudomonas aeruginosa PA01
cguccgggcacgcau

SEQ ID NO: 3412720 - RNA, 16 nt, Pseudomonas aeruginosa PA01
cguccgggcgguacag

SEQ ID NO: 3412721 - RNA, 20 nt, Pseudomonas aeruginosa PA01
cguccgggcgguacaggcgc

SEQ ID NO: 3412722 - RNA, 18 nt, Pseudomonas aeruginosa PA01
cguccgggugccccaggc

SEQ ID NO: 3412723 - RNA, 19 nt, Pseudomonas aeruginosa PA01
cguccgggugccccaggcg

SEQ ID NO: 3412724 - RNA, 15 nt, Pseudomonas aeruginosa PA01
cguccggucgcuuuu

SEQ ID NO: 3412725 - RNA, 15 nt, Pseudomonas aeruginosa PA01
cguccgguugcuggc

SEQ ID NO: 3412726 - RNA, 18 nt, Pseudomonas aeruginosa PA01
cguccguaaugcaacccg

SEQ ID NO: 3412727 - RNA, 20 nt, Pseudomonas aeruginosa PA01
cguccguaaugcaacccgcc

SEQ ID NO: 3412728 - RNA, 22 nt, Pseudomonas aeruginosa PA01
cguccguaaugcaacccgccgc

SEQ ID NO: 3412729 - RNA, 23 nt, Pseudomonas aeruginosa PA01
cguccguaaugcaacccgccgcu

SEQ ID NO: 3412730 - RNA, 19 nt, Pseudomonas aeruginosa PA01
cguccgucccacaggccgg

SEQ ID NO: 3412731 - RNA, 20 nt, Pseudomonas aeruginosa PA01
cguccuacgcgaccggucag

SEQ ID NO: 3412732 - RNA, 19 nt, Pseudomonas aeruginosa PA01
cguccucagccucacccug

SEQ ID NO: 3412733 - RNA, 12 nt, Pseudomonas aeruginosa PA01
cguccuccaccg

SEQ ID NO: 3412734 - RNA, 15 nt, Pseudomonas aeruginosa PA01
cguccuccaccgcuc

SEQ ID NO: 3412735 - RNA, 12 nt, Pseudomonas aeruginosa PA01
cguccuccagca

SEQ ID NO: 3412736 - RNA, 17 nt, Pseudomonas aeruginosa PA01
cguccuccaggaccagg

SEQ ID NO: 3412737 - RNA, 17 nt, Pseudomonas aeruginosa PA01
cguccuccaggcucagg

SEQ ID NO: 3412738 - RNA, 12 nt, Pseudomonas aeruginosa PA01
cguccucccagu

SEQ ID NO: 3412739 - RNA, 19 nt, Pseudomonas aeruginosa PA01
cguccucgaaagccgccgc

SEQ ID NO: 3412740 - RNA, 14 nt, Pseudomonas aeruginosa PA01
cguccucgaugccc

SEQ ID NO: 3412741 - RNA, 21 nt, Pseudomonas aeruginosa PA01
cguccucgaugcccgccucgc

SEQ ID NO: 3412742 - RNA, 23 nt, Pseudomonas aeruginosa PA01
cguccucgaugcccgccucgcgc

SEQ ID NO: 3412743 - RNA, 13 nt, Pseudomonas aeruginosa PA01
cguccucgcccug

SEQ ID NO: 3412744 - RNA, 16 nt, Pseudomonas aeruginosa PA01
cguccucgcccugcuu

SEQ ID NO: 3412745 - RNA, 19 nt, Pseudomonas aeruginosa PA01
cguccucgcccugcuuggc

SEQ ID NO: 3412746 - RNA, 20 nt, Pseudomonas aeruginosa PA01
cguccucgcgacaccgggcc

SEQ ID NO: 3412747 - RNA, 21 nt, Pseudomonas aeruginosa PA01
cguccucgcgacaccgggccu

SEQ ID NO: 3412748 - RNA, 14 nt, Pseudomonas aeruginosa PA01
cguccucgcgccgc

SEQ ID NO: 3412749 - RNA, 16 nt, Pseudomonas aeruginosa PA01
cguccucgcgccgcuu

SEQ ID NO: 3412750 - RNA, 17 nt, Pseudomonas aeruginosa PA01
cguccucggagagcagc

SEQ ID NO: 3412751 - RNA, 20 nt, Pseudomonas aeruginosa PA01
cguccucggcguagccggcc

SEQ ID NO: 3412752 - RNA, 21 nt, Pseudomonas aeruginosa PA01
cguccucggcguagccggcca

SEQ ID NO: 3412753 - RNA, 14 nt, Pseudomonas aeruginosa PA01
cguccucggggaag

SEQ ID NO: 3412754 - RNA, 22 nt, Pseudomonas aeruginosa PA01
cguccucggggaagcgcggcuc

SEQ ID NO: 3412755 - RNA, 14 nt, Pseudomonas aeruginosa PA01
cguccucguggcgc

SEQ ID NO: 3412756 - RNA, 15 nt, Pseudomonas aeruginosa PA01
cguccucguggcgcg

SEQ ID NO: 3412757 - RNA, 18 nt, Pseudomonas aeruginosa PA01
cguccucguggcgcgccg

SEQ ID NO: 3412758 - RNA, 19 nt, Pseudomonas aeruginosa PA01
cguccucguggcgcgccgc

SEQ ID NO: 3412759 - RNA, 16 nt, Pseudomonas aeruginosa PA01
cguccugcaacugcuc

SEQ ID NO: 3412760 - RNA, 15 nt, Pseudomonas aeruginosa PA01
cguccugcccuccug

SEQ ID NO: 3412761 - RNA, 19 nt, Pseudomonas aeruginosa PA01
cguccugcccuccugcucg

SEQ ID NO: 3412762 - RNA, 22 nt, Pseudomonas aeruginosa PA01
cguccugcccuccugcucgauc

SEQ ID NO: 3412763 - RNA, 13 nt, Pseudomonas aeruginosa PA01
cguccugcgcggc

SEQ ID NO: 3412764 - RNA, 17 nt, Pseudomonas aeruginosa PA01
cguccugcgcggcgacg

SEQ ID NO: 3412765 - RNA, 23 nt, Pseudomonas aeruginosa PA01
cguccugcggauucaucggcggc

SEQ ID NO: 3412766 - RNA, 14 nt, Pseudomonas aeruginosa PA01
cguccugcggccgc

SEQ ID NO: 3412767 - RNA, 18 nt, Pseudomonas aeruginosa PA01
cguccugcggccgcaacc

SEQ ID NO: 3412768 - RNA, 18 nt, Pseudomonas aeruginosa PA01
cguccugcggccguucgc

SEQ ID NO: 3412769 - RNA, 16 nt, Pseudomonas aeruginosa PA01
cguccugcugcuggcc

SEQ ID NO: 3412770 - RNA, 20 nt, Pseudomonas aeruginosa PA01
cguccugcuuccagaccucg

SEQ ID NO: 3412771 - RNA, 17 nt, Pseudomonas aeruginosa PA01
cguccuggcgaguggcg

SEQ ID NO: 3412772 - RNA, 11 nt, Pseudomonas aeruginosa PA01
cguccuggcgg

SEQ ID NO: 3412773 - RNA, 20 nt, Pseudomonas aeruginosa PA01
cguccuggguaugcgcgguc

SEQ ID NO: 3412774 - RNA, 13 nt, Pseudomonas aeruginosa PA01
cguccuucggccg

SEQ ID NO: 3412775 - RNA, 14 nt, Pseudomonas aeruginosa PA01
cguccuucggccgc

SEQ ID NO: 3412776 - RNA, 22 nt, Pseudomonas aeruginosa PA01
cguccuugaguagcuggcgcag

SEQ ID NO: 3412777 - RNA, 14 nt, Pseudomonas aeruginosa PA01
cguccuugcccggc

SEQ ID NO: 3412778 - RNA, 16 nt, Pseudomonas aeruginosa PA01
cgucgaaacgcuggcg

SEQ ID NO: 3412779 - RNA, 18 nt, Pseudomonas aeruginosa PA01
cgucgaaacgcuggcggc

SEQ ID NO: 3412780 - RNA, 22 nt, Pseudomonas aeruginosa PA01
cgucgaaacgcuggcggccgag

SEQ ID NO: 3412781 - RNA, 16 nt, Pseudomonas aeruginosa PA01
cgucgaaacgggcgcu

SEQ ID NO: 3412782 - RNA, 17 nt, Pseudomonas aeruginosa PA01
cgucgaaacgggcgcuc

SEQ ID NO: 3412783 - RNA, 23 nt, Pseudomonas aeruginosa PA01
cgucgaaacgggcgcucuggccg

SEQ ID NO: 3412784 - RNA, 15 nt, Pseudomonas aeruginosa PA01
cgucgaaagccucga

SEQ ID NO: 3412785 - RNA, 19 nt, Pseudomonas aeruginosa PA01
cgucgaaagccucgacgac

SEQ ID NO: 3412786 - RNA, 20 nt, Pseudomonas aeruginosa PA01
cgucgaaagccucgacgaca

SEQ ID NO: 3412787 - RNA, 19 nt, Pseudomonas aeruginosa PA01
cgucgaacaccggcgccgc

SEQ ID NO: 3412788 - RNA, 22 nt, Pseudomonas aeruginosa PA01
cgucgaacaccggcgccgccug

SEQ ID NO: 3412789 - RNA, 13 nt, Pseudomonas aeruginosa PA01
cgucgaacagcag

SEQ ID NO: 3412790 - RNA, 20 nt, Pseudomonas aeruginosa PA01
cgucgaacagcagcucgccg

SEQ ID NO: 3412791 - RNA, 21 nt, Pseudomonas aeruginosa PA01
cgucgaacagcagcucgccgc

SEQ ID NO: 3412792 - RNA, 16 nt, Pseudomonas aeruginosa PA01
cgucgaacgacucuuc

SEQ ID NO: 3412793 - RNA, 22 nt, Pseudomonas aeruginosa PA01
cgucgaacgacucuucgaaguu

SEQ ID NO: 3412794 - RNA, 17 nt, Pseudomonas aeruginosa PA01
cgucgaagccaggcacc

SEQ ID NO: 3412795 - RNA, 18 nt, Pseudomonas aeruginosa PA01
cgucgaagcgcagcaggu

SEQ ID NO: 3412796 - RNA, 16 nt, Pseudomonas aeruginosa PA01
cgucgaagcucggcgc

SEQ ID NO: 3412797 - RNA, 19 nt, Pseudomonas aeruginosa PA01
cgucgaaggccucgucgcc

SEQ ID NO: 3412798 - RNA, 21 nt, Pseudomonas aeruginosa PA01
cgucgaaggccucgucgcccg

SEQ ID NO: 3412799 - RNA, 14 nt, Pseudomonas aeruginosa PA01
cgucgaaggcggcg

SEQ ID NO: 3412800 - RNA, 17 nt, Pseudomonas aeruginosa PA01
cgucgaaggcggcgcgg

SEQ ID NO: 3412801 - RNA, 20 nt, Pseudomonas aeruginosa PA01
cgucgaaggcggcgcggcgg

SEQ ID NO: 3412802 - RNA, 18 nt, Pseudomonas aeruginosa PA01
cgucgaagggcacgccgc

SEQ ID NO: 3412803 - RNA, 23 nt, Pseudomonas aeruginosa PA01
cgucgaagggcacgccgcucugc

SEQ ID NO: 3412804 - RNA, 17 nt, Pseudomonas aeruginosa PA01
cgucgaagucgaucacc

SEQ ID NO: 3412805 - RNA, 22 nt, Pseudomonas aeruginosa PA01
cgucgaagucguugaagcggcc

SEQ ID NO: 3412806 - RNA, 23 nt, Pseudomonas aeruginosa PA01
cgucgaaguuggaaggaucgagc

SEQ ID NO: 3412807 - RNA, 19 nt, Pseudomonas aeruginosa PA01
cgucgacaccgaucaccug

SEQ ID NO: 3412808 - RNA, 23 nt, Pseudomonas aeruginosa PA01
cgucgacaccgaucaccuggccg

SEQ ID NO: 3412809 - RNA, 14 nt, Pseudomonas aeruginosa PA01
cgucgaccaccgcg

SEQ ID NO: 3412810 - RNA, 18 nt, Pseudomonas aeruginosa PA01
cgucgaccacgaagcugu

SEQ ID NO: 3412811 - RNA, 16 nt, Pseudomonas aeruginosa PA01
cgucgaccaucaccag

SEQ ID NO: 3412812 - RNA, 17 nt, Pseudomonas aeruginosa PA01
cgucgaccaucaccagc

SEQ ID NO: 3412813 - RNA, 19 nt, Pseudomonas aeruginosa PA01
cgucgaccaucaccagcgc

SEQ ID NO: 3412814 - RNA, 20 nt, Pseudomonas aeruginosa PA01
cgucgaccaucaccagcgcc

SEQ ID NO: 3412815 - RNA, 22 nt, Pseudomonas aeruginosa PA01
cgucgaccaucaccagcgccgu

SEQ ID NO: 3412816 - RNA, 12 nt, Pseudomonas aeruginosa PA01
cgucgaccucga

SEQ ID NO: 3412817 - RNA, 17 nt, Pseudomonas aeruginosa PA01
cgucgaccucgauggcg

SEQ ID NO: 3412818 - RNA, 18 nt, Pseudomonas aeruginosa PA01
cgucgaccucgauggcga

SEQ ID NO: 3412819 - RNA, 19 nt, Pseudomonas aeruginosa PA01
cgucgaccucgauggcgau

SEQ ID NO: 3412820 - RNA, 12 nt, Pseudomonas aeruginosa PA01
cgucgaccugcg

SEQ ID NO: 3412821 - RNA, 14 nt, Pseudomonas aeruginosa PA01
cgucgaccugcggg

SEQ ID NO: 3412822 - RNA, 16 nt, Pseudomonas aeruginosa PA01
cgucgacgcagcgcgc

SEQ ID NO: 3412823 - RNA, 22 nt, Pseudomonas aeruginosa PA01
cgucgacgcagcgcgcgucggc

SEQ ID NO: 3412824 - RNA, 16 nt, Pseudomonas aeruginosa PA01
cgucgacgcccuggcg

SEQ ID NO: 3412825 - RNA, 17 nt, Pseudomonas aeruginosa PA01
cgucgacgcccugggcg

SEQ ID NO: 3412826 - RNA, 20 nt, Pseudomonas aeruginosa PA01
cgucgacgcccugggcgacg

SEQ ID NO: 3412827 - RNA, 16 nt, Pseudomonas aeruginosa PA01
cgucgacgccgagcug

SEQ ID NO: 3412828 - RNA, 18 nt, Pseudomonas aeruginosa PA01
cgucgacgcucagcaccc

SEQ ID NO: 3412829 - RNA, 13 nt, Pseudomonas aeruginosa PA01
cgucgacggccuu

SEQ ID NO: 3412830 - RNA, 19 nt, Pseudomonas aeruginosa PA01
cgucgacuugccgaucaug

SEQ ID NO: 3412831 - RNA, 15 nt, Pseudomonas aeruginosa PA01
cgucgagaccgaccg

SEQ ID NO: 3412832 - RNA, 12 nt, Pseudomonas aeruginosa PA01
cgucgagcacca

SEQ ID NO: 3412833 - RNA, 13 nt, Pseudomonas aeruginosa PA01
cgucgagcaccag

SEQ ID NO: 3412834 - RNA, 17 nt, Pseudomonas aeruginosa PA01
cgucgagcaccagcagg

SEQ ID NO: 3412835 - RNA, 18 nt, Pseudomonas aeruginosa PA01
cgucgagcaccagcaggu

SEQ ID NO: 3412836 - RNA, 17 nt, Pseudomonas aeruginosa PA01
cgucgagcacgccgucc

SEQ ID NO: 3412837 - RNA, 15 nt, Pseudomonas aeruginosa PA01
cgucgagcagcgcgc

SEQ ID NO: 3412838 - RNA, 17 nt, Pseudomonas aeruginosa PA01
cgucgagcagcgcgcgg

SEQ ID NO: 3412839 - RNA, 18 nt, Pseudomonas aeruginosa PA01
cgucgagcagcgcgcggc

SEQ ID NO: 3412840 - RNA, 19 nt, Pseudomonas aeruginosa PA01
cgucgagcagcgcgcggcu

SEQ ID NO: 3412841 - RNA, 15 nt, Pseudomonas aeruginosa PA01
cgucgagcaucugcc

SEQ ID NO: 3412842 - RNA, 17 nt, Pseudomonas aeruginosa PA01
cgucgagcaucugccgg

SEQ ID NO: 3412843 - RNA, 18 nt, Pseudomonas aeruginosa PA01
cgucgagcaucugccggg

SEQ ID NO: 3412844 - RNA, 18 nt, Pseudomonas aeruginosa PA01
cgucgagcaugccgagga

SEQ ID NO: 3412845 - RNA, 15 nt, Pseudomonas aeruginosa PA01
cgucgagccagccca

SEQ ID NO: 3412846 - RNA, 14 nt, Pseudomonas aeruginosa PA01
cgucgagcgcagcg

SEQ ID NO: 3412847 - RNA, 15 nt, Pseudomonas aeruginosa PA01
cgucgagcgcagcga

SEQ ID NO: 3412848 - RNA, 15 nt, Pseudomonas aeruginosa PA01
cgucgagcgggcggu

SEQ ID NO: 3412849 - RNA, 17 nt, Pseudomonas aeruginosa PA01
cgucgagcugcucggcg

SEQ ID NO: 3412850 - RNA, 21 nt, Pseudomonas aeruginosa PA01
cgucgagcugcucggcggugg

SEQ ID NO: 3412851 - RNA, 16 nt, Pseudomonas aeruginosa PA01
cgucgagcuggcgcag

SEQ ID NO: 3412852 - RNA, 18 nt, Pseudomonas aeruginosa PA01
cgucgagcuggcgcaggc

SEQ ID NO: 3412853 - RNA, 20 nt, Pseudomonas aeruginosa PA01
cgucgaggcugucgcggacc

SEQ ID NO: 3412854 - RNA, 22 nt, Pseudomonas aeruginosa PA01
cgucgagggcaaaggcgcgcag

SEQ ID NO: 3412855 - RNA, 19 nt, Pseudomonas aeruginosa PA01
cgucgaggguggcgccgag

SEQ ID NO: 3412856 - RNA, 21 nt, Pseudomonas aeruginosa PA01
cgucgaggguugucaccggca

SEQ ID NO: 3412857 - RNA, 22 nt, Pseudomonas aeruginosa PA01
cgucgagguagucggugaagcg

SEQ ID NO: 3412858 - RNA, 17 nt, Pseudomonas aeruginosa PA01
cgucgaggucgacggcg

SEQ ID NO: 3412859 - RNA, 20 nt, Pseudomonas aeruginosa PA01
cgucgaggucgacggcggcc

SEQ ID NO: 3412860 - RNA, 15 nt, Pseudomonas aeruginosa PA01
cgucgaggucggcga

SEQ ID NO: 3412861 - RNA, 17 nt, Pseudomonas aeruginosa PA01
cgucgaggucggcgauc

SEQ ID NO: 3412862 - RNA, 23 nt, Pseudomonas aeruginosa PA01
cgucgaguaccgcugcggccggc

SEQ ID NO: 3412863 - RNA, 16 nt, Pseudomonas aeruginosa PA01
cgucgagucgcgcagc

SEQ ID NO: 3412864 - RNA, 18 nt, Pseudomonas aeruginosa PA01
cgucgagucgcgcagcca

SEQ ID NO: 3412865 - RNA, 23 nt, Pseudomonas aeruginosa PA01
cgucgauacgcaucugcucgagg

SEQ ID NO: 3412866 - RNA, 17 nt, Pseudomonas aeruginosa PA01
cgucgauauugccgcgg

SEQ ID NO: 3412867 - RNA, 17 nt, Pseudomonas aeruginosa PA01
cgucgaucaggcgggcg

SEQ ID NO: 3412868 - RNA, 18 nt, Pseudomonas aeruginosa PA01
cgucgaucaggcgggcgu

SEQ ID NO: 3412869 - RNA, 19 nt, Pseudomonas aeruginosa PA01
cgucgaucagguaggccgg

SEQ ID NO: 3412870 - RNA, 21 nt, Pseudomonas aeruginosa PA01
cgucgaucagguaggccggcg

SEQ ID NO: 3412871 - RNA, 21 nt, Pseudomonas aeruginosa PA01
cgucgaucagguccuggccga

SEQ ID NO: 3412872 - RNA, 21 nt, Pseudomonas aeruginosa PA01
cgucgaucaucugcugcagca

SEQ ID NO: 3412873 - RNA, 23 nt, Pseudomonas aeruginosa PA01
cgucgaucaucugcugcagcauc

SEQ ID NO: 3412874 - RNA, 18 nt, Pseudomonas aeruginosa PA01
cgucgaucccgaucgcca

SEQ ID NO: 3412875 - RNA, 23 nt, Pseudomonas aeruginosa PA01
cgucgaucccggauucgccgagg

SEQ ID NO: 3412876 - RNA, 16 nt, Pseudomonas aeruginosa PA01
cgucgaucucgagcau

SEQ ID NO: 3412877 - RNA, 13 nt, Pseudomonas aeruginosa PA01
cgucgaucucgcc

SEQ ID NO: 3412878 - RNA, 15 nt, Pseudomonas aeruginosa PA01
cgucgaucucgccga

SEQ ID NO: 3412879 - RNA, 21 nt, Pseudomonas aeruginosa PA01
cgucgaucugcucguccaggc

SEQ ID NO: 3412880 - RNA, 17 nt, Pseudomonas aeruginosa PA01
cgucgaugacgauggcg

SEQ ID NO: 3412881 - RNA, 20 nt, Pseudomonas aeruginosa PA01
cgucgaugaucugcauggcg

SEQ ID NO: 3412882 - RNA, 17 nt, Pseudomonas aeruginosa PA01
cgucgaugccuucggcg

SEQ ID NO: 3412883 - RNA, 18 nt, Pseudomonas aeruginosa PA01
cgucgaugccuucggcgg

SEQ ID NO: 3412884 - RNA, 23 nt, Pseudomonas aeruginosa PA01
cgucgaugccuucggcggccggg

SEQ ID NO: 3412885 - RNA, 14 nt, Pseudomonas aeruginosa PA01
cgucgaugcgccuc

SEQ ID NO: 3412886 - RNA, 16 nt, Pseudomonas aeruginosa PA01
cgucgaugcgccucag

SEQ ID NO: 3412887 - RNA, 20 nt, Pseudomonas aeruginosa PA01
cgucgaugcgccucagcggc

SEQ ID NO: 3412888 - RNA, 16 nt, Pseudomonas aeruginosa PA01
cgucgaugcguccgcg

SEQ ID NO: 3412889 - RNA, 18 nt, Pseudomonas aeruginosa PA01
cgucgaugcguccgcgca

SEQ ID NO: 3412890 - RNA, 20 nt, Pseudomonas aeruginosa PA01
cgucgaugcguccgcgcagg

SEQ ID NO: 3412891 - RNA, 15 nt, Pseudomonas aeruginosa PA01
cgucgaugcugccgu

SEQ ID NO: 3412892 - RNA, 17 nt, Pseudomonas aeruginosa PA01
cgucgaugcugccguag

SEQ ID NO: 3412893 - RNA, 19 nt, Pseudomonas aeruginosa PA01
cgucgaugcuuucgagcaa

SEQ ID NO: 3412894 - RNA, 17 nt, Pseudomonas aeruginosa PA01
cgucgaugucgcggcug

SEQ ID NO: 3412895 - RNA, 23 nt, Pseudomonas aeruginosa PA01
cgucgaugucgcggcugaaggcc

SEQ ID NO: 3412896 - RNA, 13 nt, Pseudomonas aeruginosa PA01
cgucgcaccaggu

SEQ ID NO: 3412897 - RNA, 15 nt, Pseudomonas aeruginosa PA01
cgucgcaccaggugc

SEQ ID NO: 3412898 - RNA, 17 nt, Pseudomonas aeruginosa PA01
cgucgcacccggcccau

SEQ ID NO: 3412899 - RNA, 20 nt, Pseudomonas aeruginosa PA01
cgucgcacccggcccauggc

SEQ ID NO: 3412900 - RNA, 22 nt, Pseudomonas aeruginosa PA01
cgucgcaccuguuccagcaacg

SEQ ID NO: 3412901 - RNA, 15 nt, Pseudomonas aeruginosa PA01
cgucgcacugcugcu

SEQ ID NO: 3412902 - RNA, 17 nt, Pseudomonas aeruginosa PA01
cgucgcagagacgcagc

SEQ ID NO: 3412903 - RNA, 15 nt, Pseudomonas aeruginosa PA01
cgucgcaggccuggu

SEQ ID NO: 3412904 - RNA, 19 nt, Pseudomonas aeruginosa PA01
cgucgcagguaacccgcgg

SEQ ID NO: 3412905 - RNA, 20 nt, Pseudomonas aeruginosa PA01
cgucgcagguaacccgcggc

SEQ ID NO: 3412906 - RNA, 21 nt, Pseudomonas aeruginosa PA01
cgucgcagguaacccgcggcg

SEQ ID NO: 3412907 - RNA, 14 nt, Pseudomonas aeruginosa PA01
cgucgcauccacca

SEQ ID NO: 3412908 - RNA, 16 nt, Pseudomonas aeruginosa PA01
cgucgcauccaccagc

SEQ ID NO: 3412909 - RNA, 17 nt, Pseudomonas aeruginosa PA01
cgucgccaacgcgccgu

SEQ ID NO: 3412910 - RNA, 17 nt, Pseudomonas aeruginosa PA01
cgucgccaagcccggcg

SEQ ID NO: 3412911 - RNA, 18 nt, Pseudomonas aeruginosa PA01
cgucgccaagcccggcga

SEQ ID NO: 3412912 - RNA, 16 nt, Pseudomonas aeruginosa PA01
cgucgccacgcccgcc

SEQ ID NO: 3412913 - RNA, 22 nt, Pseudomonas aeruginosa PA01
cgucgccacgcccgccguggcg

SEQ ID NO: 3412914 - RNA, 16 nt, Pseudomonas aeruginosa PA01
cgucgccacgcucucc

SEQ ID NO: 3412915 - RNA, 12 nt, Pseudomonas aeruginosa PA01
cgucgccaggcc

SEQ ID NO: 3412916 - RNA, 14 nt, Pseudomonas aeruginosa PA01
cgucgccaggccgu

SEQ ID NO: 3412917 - RNA, 16 nt, Pseudomonas aeruginosa PA01
cgucgccaugcggcag

SEQ ID NO: 3412918 - RNA, 17 nt, Pseudomonas aeruginosa PA01
cgucgccaugcggcagg

SEQ ID NO: 3412919 - RNA, 20 nt, Pseudomonas aeruginosa PA01
cgucgccaugcggcaggccu

SEQ ID NO: 3412920 - RNA, 18 nt, Pseudomonas aeruginosa PA01
cgucgccauucggcgacg

SEQ ID NO: 3412921 - RNA, 21 nt, Pseudomonas aeruginosa PA01
cgucgccauucggcgacgggc

SEQ ID NO: 3412922 - RNA, 15 nt, Pseudomonas aeruginosa PA01
cgucgcccaggccgc

SEQ ID NO: 3412923 - RNA, 16 nt, Pseudomonas aeruginosa PA01
cgucgcccaggccgcu

SEQ ID NO: 3412924 - RNA, 17 nt, Pseudomonas aeruginosa PA01
cgucgcccaggccgcug

SEQ ID NO: 3412925 - RNA, 23 nt, Pseudomonas aeruginosa PA01
cgucgcccaggccgcuggcggcg

SEQ ID NO: 3412926 - RNA, 15 nt, Pseudomonas aeruginosa PA01
cgucgccccacagcg

SEQ ID NO: 3412927 - RNA, 19 nt, Pseudomonas aeruginosa PA01
cgucgccccacagcggugg

SEQ ID NO: 3412928 - RNA, 14 nt, Pseudomonas aeruginosa PA01
cgucgccccaggga

SEQ ID NO: 3412929 - RNA, 14 nt, Pseudomonas aeruginosa PA01
cgucgcccucggcg

SEQ ID NO: 3412930 - RNA, 16 nt, Pseudomonas aeruginosa PA01
cgucgcccucggcgcu

SEQ ID NO: 3412931 - RNA, 15 nt, Pseudomonas aeruginosa PA01
cgucgcccuggccga

SEQ ID NO: 3412932 - RNA, 19 nt, Pseudomonas aeruginosa PA01
cgucgcccuggugcacggc

SEQ ID NO: 3412933 - RNA, 20 nt, Pseudomonas aeruginosa PA01
cgucgcccuggugcacggcg

SEQ ID NO: 3412934 - RNA, 17 nt, Pseudomonas aeruginosa PA01
cgucgccgaacggcagc

SEQ ID NO: 3412935 - RNA, 20 nt, Pseudomonas aeruginosa PA01
cgucgccgaacuccgagcag

SEQ ID NO: 3412936 - RNA, 23 nt, Pseudomonas aeruginosa PA01
cgucgccgaccaggcggccgucg

SEQ ID NO: 3412937 - RNA, 15 nt, Pseudomonas aeruginosa PA01
cgucgccgacccugc

SEQ ID NO: 3412938 - RNA, 14 nt, Pseudomonas aeruginosa PA01
cgucgccgacugcg

SEQ ID NO: 3412939 - RNA, 16 nt, Pseudomonas aeruginosa PA01
cgucgccgacuucggc

SEQ ID NO: 3412940 - RNA, 13 nt, Pseudomonas aeruginosa PA01
cgucgccgccagc

SEQ ID NO: 3412941 - RNA, 16 nt, Pseudomonas aeruginosa PA01
cgucgccgccagcgcc

SEQ ID NO: 3412942 - RNA, 20 nt, Pseudomonas aeruginosa PA01
cgucgccgcccggcagcggc

SEQ ID NO: 3412943 - RNA, 15 nt, Pseudomonas aeruginosa PA01
cgucgccgccgaggc

SEQ ID NO: 3412944 - RNA, 21 nt, Pseudomonas aeruginosa PA01
cgucgccgccgaggcgcgcca

SEQ ID NO: 3412945 - RNA, 12 nt, Pseudomonas aeruginosa PA01
cgucgccgcugg

SEQ ID NO: 3412946 - RNA, 14 nt, Pseudomonas aeruginosa PA01
cgucgccggagggg

SEQ ID NO: 3412947 - RNA, 21 nt, Pseudomonas aeruginosa PA01
cgucgccggaggggcggccgc

SEQ ID NO: 3412948 - RNA, 14 nt, Pseudomonas aeruginosa PA01
cgucgccggcgacg

SEQ ID NO: 3412949 - RNA, 22 nt, Pseudomonas aeruginosa PA01
cgucgccgggaaacagggcgac

SEQ ID NO: 3412950 - RNA, 18 nt, Pseudomonas aeruginosa PA01
cgucgccugccaggcggg

SEQ ID NO: 3412951 - RNA, 22 nt, Pseudomonas aeruginosa PA01
cgucgccugccaggcggggaug

SEQ ID NO: 3412952 - RNA, 20 nt, Pseudomonas aeruginosa PA01
cgucgccuuccaccaccagg

SEQ ID NO: 3412953 - RNA, 21 nt, Pseudomonas aeruginosa PA01
cgucgccuucgcugagaccga

SEQ ID NO: 3412954 - RNA, 17 nt, Pseudomonas aeruginosa PA01
cgucgccuucggagaac

SEQ ID NO: 3412955 - RNA, 23 nt, Pseudomonas aeruginosa PA01
cgucgcgaaccacauccuugccg

SEQ ID NO: 3412956 - RNA, 21 nt, Pseudomonas aeruginosa PA01
cgucgcgaagaccggccggcu

SEQ ID NO: 3412957 - RNA, 15 nt, Pseudomonas aeruginosa PA01
cgucgcgcaccaccc

SEQ ID NO: 3412958 - RNA, 22 nt, Pseudomonas aeruginosa PA01
cgucgcgcaccacccaucugcc

SEQ ID NO: 3412959 - RNA, 16 nt, Pseudomonas aeruginosa PA01
cgucgcgcaccuggcg

SEQ ID NO: 3412960 - RNA, 14 nt, Pseudomonas aeruginosa PA01
cgucgcgcagcucc

SEQ ID NO: 3412961 - RNA, 15 nt, Pseudomonas aeruginosa PA01
cgucgcgccagcacc

SEQ ID NO: 3412962 - RNA, 16 nt, Pseudomonas aeruginosa PA01
cgucgcgccagcaccg

SEQ ID NO: 3412963 - RNA, 13 nt, Pseudomonas aeruginosa PA01
cgucgcgccaggc

SEQ ID NO: 3412964 - RNA, 14 nt, Pseudomonas aeruginosa PA01
cgucgcgccaggcg

SEQ ID NO: 3412965 - RNA, 18 nt, Pseudomonas aeruginosa PA01
cgucgcgccaggcgaaga

SEQ ID NO: 3412966 - RNA, 23 nt, Pseudomonas aeruginosa PA01
cgucgcgccgcccggcucgccgc

SEQ ID NO: 3412967 - RNA, 13 nt, Pseudomonas aeruginosa PA01
cgucgcgcgcggc

SEQ ID NO: 3412968 - RNA, 13 nt, Pseudomonas aeruginosa PA01
cgucgcgcggcca

SEQ ID NO: 3412969 - RNA, 14 nt, Pseudomonas aeruginosa PA01
cgucgcgcggccag

SEQ ID NO: 3412970 - RNA, 15 nt, Pseudomonas aeruginosa PA01
cgucgcgcggccagc

SEQ ID NO: 3412971 - RNA, 17 nt, Pseudomonas aeruginosa PA01
cgucgcgcggccagcgu

SEQ ID NO: 3412972 - RNA, 15 nt, Pseudomonas aeruginosa PA01
cgucgcgcguccagc

SEQ ID NO: 3412973 - RNA, 17 nt, Pseudomonas aeruginosa PA01
cgucgcgcuugagcagg

SEQ ID NO: 3412974 - RNA, 21 nt, Pseudomonas aeruginosa PA01
cgucgcggagaauccgcucgg

SEQ ID NO: 3412975 - RNA, 22 nt, Pseudomonas aeruginosa PA01
cgucgcggaucaacgggcccug

SEQ ID NO: 3412976 - RNA, 20 nt, Pseudomonas aeruginosa PA01
cgucgcggccaucggcgaag

SEQ ID NO: 3412977 - RNA, 15 nt, Pseudomonas aeruginosa PA01
cgucgcggccucuuc

SEQ ID NO: 3412978 - RNA, 14 nt, Pseudomonas aeruginosa PA01
cgucgcggcgccug

SEQ ID NO: 3412979 - RNA, 15 nt, Pseudomonas aeruginosa PA01
cgucgcggcgccugg

SEQ ID NO: 3412980 - RNA, 17 nt, Pseudomonas aeruginosa PA01
cgucgcggcgccuggcg

SEQ ID NO: 3412981 - RNA, 14 nt, Pseudomonas aeruginosa PA01
cgucgcggcgcgag

SEQ ID NO: 3412982 - RNA, 22 nt, Pseudomonas aeruginosa PA01
cgucgcgguacagcucguccuu

SEQ ID NO: 3412983 - RNA, 20 nt, Pseudomonas aeruginosa PA01
cgucgcggucuuccgccgac

SEQ ID NO: 3412984 - RNA, 15 nt, Pseudomonas aeruginosa PA01
cgucgcgucggccug

SEQ ID NO: 3412985 - RNA, 22 nt, Pseudomonas aeruginosa PA01
cgucgcgucggccuggcgcagc

SEQ ID NO: 3412986 - RNA, 16 nt, Pseudomonas aeruginosa PA01
cgucgcuauagcggau

SEQ ID NO: 3412987 - RNA, 14 nt, Pseudomonas aeruginosa PA01
cgucgcugcacgca

SEQ ID NO: 3412988 - RNA, 16 nt, Pseudomonas aeruginosa PA01
cgucgcugcacgcacg

SEQ ID NO: 3412989 - RNA, 22 nt, Pseudomonas aeruginosa PA01
cgucgcugcacgcacgcgccug

SEQ ID NO: 3412990 - RNA, 18 nt, Pseudomonas aeruginosa PA01
cgucgcugccgccgcgcc

SEQ ID NO: 3412991 - RNA, 20 nt, Pseudomonas aeruginosa PA01
cgucgcugccgccgcgcccg

SEQ ID NO: 3412992 - RNA, 14 nt, Pseudomonas aeruginosa PA01
cgucgcugcgcggg

SEQ ID NO: 3412993 - RNA, 16 nt, Pseudomonas aeruginosa PA01
cgucgcugcgcggguc

SEQ ID NO: 3412994 - RNA, 18 nt, Pseudomonas aeruginosa PA01
cgucgcugcgcgggucgu

SEQ ID NO: 3412995 - RNA, 21 nt, Pseudomonas aeruginosa PA01
cgucgcuguagcggcucgccg

SEQ ID NO: 3412996 - RNA, 16 nt, Pseudomonas aeruginosa PA01
cgucgcuuccggcgcc

SEQ ID NO: 3412997 - RNA, 17 nt, Pseudomonas aeruginosa PA01
cgucgcuucgcccgccg

SEQ ID NO: 3412998 - RNA, 15 nt, Pseudomonas aeruginosa PA01
cgucggaagcgucag

SEQ ID NO: 3412999 - RNA, 18 nt, Pseudomonas aeruginosa PA01
cgucggacucgacgucau

SEQ ID NO: 3413000 - RNA, 13 nt, Pseudomonas aeruginosa PA01
cgucggacuugcg

SEQ ID NO: 3413001 - RNA, 17 nt, Pseudomonas aeruginosa PA01
cgucggacuugcggccc

SEQ ID NO: 3413002 - RNA, 22 nt, Pseudomonas aeruginosa PA01
cgucggacuugcggcccaccac

SEQ ID NO: 3413003 - RNA, 20 nt, Pseudomonas aeruginosa PA01
cgucggagagauagucgccg

SEQ ID NO: 3413004 - RNA, 21 nt, Pseudomonas aeruginosa PA01
cgucggagagauagucgccgu

SEQ ID NO: 3413005 - RNA, 17 nt, Pseudomonas aeruginosa PA01
cgucggagauagccucc

SEQ ID NO: 3413006 - RNA, 22 nt, Pseudomonas aeruginosa PA01
cgucggauggccguccaggcug

SEQ ID NO: 3413007 - RNA, 22 nt, Pseudomonas aeruginosa PA01
cgucggcaagcaggccgcggua

SEQ ID NO: 3413008 - RNA, 20 nt, Pseudomonas aeruginosa PA01
cgucggcaauucuucaaggu

SEQ ID NO: 3413009 - RNA, 12 nt, Pseudomonas aeruginosa PA01
cgucggcacgcc

SEQ ID NO: 3413010 - RNA, 13 nt, Pseudomonas aeruginosa PA01
cgucggcagccau

SEQ ID NO: 3413011 - RNA, 17 nt, Pseudomonas aeruginosa PA01
cgucggcagccaucgca

SEQ ID NO: 3413012 - RNA, 14 nt, Pseudomonas aeruginosa PA01
cgucggccaccagg

SEQ ID NO: 3413013 - RNA, 14 nt, Pseudomonas aeruginosa PA01
cgucggcccucccc

SEQ ID NO: 3413014 - RNA, 18 nt, Pseudomonas aeruginosa PA01
cgucggcccuccccuggc

SEQ ID NO: 3413015 - RNA, 23 nt, Pseudomonas aeruginosa PA01
cgucggcccuccccuggcccugc

SEQ ID NO: 3413016 - RNA, 14 nt, Pseudomonas aeruginosa PA01
cgucggccgcucgg

SEQ ID NO: 3413017 - RNA, 16 nt, Pseudomonas aeruginosa PA01
cgucggccgcucggcc

SEQ ID NO: 3413018 - RNA, 21 nt, Pseudomonas aeruginosa PA01
cgucggccggggucaggccga

SEQ ID NO: 3413019 - RNA, 15 nt, Pseudomonas aeruginosa PA01
cgucggccucgccga

SEQ ID NO: 3413020 - RNA, 15 nt, Pseudomonas aeruginosa PA01
cgucggccugcaaca

SEQ ID NO: 3413021 - RNA, 22 nt, Pseudomonas aeruginosa PA01
cgucggccugcaacacccaggc

SEQ ID NO: 3413022 - RNA, 19 nt, Pseudomonas aeruginosa PA01
cgucggccugcuugcagga

SEQ ID NO: 3413023 - RNA, 18 nt, Pseudomonas aeruginosa PA01
cgucggccuggcgcagcg

SEQ ID NO: 3413024 - RNA, 20 nt, Pseudomonas aeruginosa PA01
cgucggccuggcgcagcggc

SEQ ID NO: 3413025 - RNA, 21 nt, Pseudomonas aeruginosa PA01
cgucggccuggcgcagcggca

SEQ ID NO: 3413026 - RNA, 16 nt, Pseudomonas aeruginosa PA01
cgucggcgaacgaggc

SEQ ID NO: 3413027 - RNA, 14 nt, Pseudomonas aeruginosa PA01
cgucggcgaccuug

SEQ ID NO: 3413028 - RNA, 13 nt, Pseudomonas aeruginosa PA01
cgucggcgaucac

SEQ ID NO: 3413029 - RNA, 14 nt, Pseudomonas aeruginosa PA01
cgucggcgcccuuc

SEQ ID NO: 3413030 - RNA, 18 nt, Pseudomonas aeruginosa PA01
cgucggcgccuuccugcu

SEQ ID NO: 3413031 - RNA, 13 nt, Pseudomonas aeruginosa PA01
cgucggcgcgcau

SEQ ID NO: 3413032 - RNA, 16 nt, Pseudomonas aeruginosa PA01
cgucggcgcggccggc

SEQ ID NO: 3413033 - RNA, 17 nt, Pseudomonas aeruginosa PA01
cgucggcgcggccggcg

SEQ ID NO: 3413034 - RNA, 21 nt, Pseudomonas aeruginosa PA01
cgucggcgcggccggcgccgc

SEQ ID NO: 3413035 - RNA, 18 nt, Pseudomonas aeruginosa PA01
cgucggcgcuuugcugca

SEQ ID NO: 3413036 - RNA, 21 nt, Pseudomonas aeruginosa PA01
cgucggcggcacccucuuccg

SEQ ID NO: 3413037 - RNA, 14 nt, Pseudomonas aeruginosa PA01
cgucggcggcggau

SEQ ID NO: 3413038 - RNA, 14 nt, Pseudomonas aeruginosa PA01
cgucggcgggaagg

SEQ ID NO: 3413039 - RNA, 15 nt, Pseudomonas aeruginosa PA01
cgucggcggggcgca

SEQ ID NO: 3413040 - RNA, 20 nt, Pseudomonas aeruginosa PA01
cgucggcggggcgcaccgcc

SEQ ID NO: 3413041 - RNA, 22 nt, Pseudomonas aeruginosa PA01
cgucggcggggcgcaccgccuc

SEQ ID NO: 3413042 - RNA, 14 nt, Pseudomonas aeruginosa PA01
cgucggcgggguga

SEQ ID NO: 3413043 - RNA, 19 nt, Pseudomonas aeruginosa PA01
cgucggcucgguuccagcu

SEQ ID NO: 3413044 - RNA, 14 nt, Pseudomonas aeruginosa PA01
cgucggcugcgcug

SEQ ID NO: 3413045 - RNA, 16 nt, Pseudomonas aeruginosa PA01
cgucggcuucgcccau

SEQ ID NO: 3413046 - RNA, 20 nt, Pseudomonas aeruginosa PA01
cgucggcuucgcccauggca

SEQ ID NO: 3413047 - RNA, 22 nt, Pseudomonas aeruginosa PA01
cgucggcuucugguucguccgc

SEQ ID NO: 3413048 - RNA, 19 nt, Pseudomonas aeruginosa PA01
cgucgggaaaggccgccac

SEQ ID NO: 3413049 - RNA, 22 nt, Pseudomonas aeruginosa PA01
cgucgggaaaggccgccacggc

SEQ ID NO: 3413050 - RNA, 23 nt, Pseudomonas aeruginosa PA01
cgucgggaaaggccgccacggcg

SEQ ID NO: 3413051 - RNA, 20 nt, Pseudomonas aeruginosa PA01
cgucgggacgcaugcgcggc

SEQ ID NO: 3413052 - RNA, 22 nt, Pseudomonas aeruginosa PA01
cgucgggaucgagcaacagcag

SEQ ID NO: 3413053 - RNA, 21 nt, Pseudomonas aeruginosa PA01
cgucgggcagaguggcgcggc

SEQ ID NO: 3413054 - RNA, 22 nt, Pseudomonas aeruginosa PA01
cgucgggcagaguggcgcggcu

SEQ ID NO: 3413055 - RNA, 23 nt, Pseudomonas aeruginosa PA01
cgucgggcagaguggcgcggcug

SEQ ID NO: 3413056 - RNA, 15 nt, Pseudomonas aeruginosa PA01
cgucgggcauggcga

SEQ ID NO: 3413057 - RNA, 16 nt, Pseudomonas aeruginosa PA01
cgucgggcauggcgau

SEQ ID NO: 3413058 - RNA, 21 nt, Pseudomonas aeruginosa PA01
cgucgggcgggaucaggucgc

SEQ ID NO: 3413059 - RNA, 15 nt, Pseudomonas aeruginosa PA01
cgucgggucgacccg

SEQ ID NO: 3413060 - RNA, 16 nt, Pseudomonas aeruginosa PA01
cgucggucaggacagc

SEQ ID NO: 3413061 - RNA, 21 nt, Pseudomonas aeruginosa PA01
cgucggucaggacagcgugcg

SEQ ID NO: 3413062 - RNA, 15 nt, Pseudomonas aeruginosa PA01
cgucggucggccagg

SEQ ID NO: 3413063 - RNA, 22 nt, Pseudomonas aeruginosa PA01
cgucggucggccaggacgccac

SEQ ID NO: 3413064 - RNA, 13 nt, Pseudomonas aeruginosa PA01
cgucggucggcgu

SEQ ID NO: 3413065 - RNA, 14 nt, Pseudomonas aeruginosa PA01
cgucggucggcguc

SEQ ID NO: 3413066 - RNA, 15 nt, Pseudomonas aeruginosa PA01
cgucggugccgacgg

SEQ ID NO: 3413067 - RNA, 13 nt, Pseudomonas aeruginosa PA01
cgucggugccgcc

SEQ ID NO: 3413068 - RNA, 17 nt, Pseudomonas aeruginosa PA01
cgucggugccgcccggc

SEQ ID NO: 3413069 - RNA, 20 nt, Pseudomonas aeruginosa PA01
cgucggugccgcccggcgcc

SEQ ID NO: 3413070 - RNA, 21 nt, Pseudomonas aeruginosa PA01
cgucggugccgcccggcgcca

SEQ ID NO: 3413071 - RNA, 17 nt, Pseudomonas aeruginosa PA01
cgucgguguccgcggug

SEQ ID NO: 3413072 - RNA, 17 nt, Pseudomonas aeruginosa PA01
cgucgguucagcgcgga

SEQ ID NO: 3413073 - RNA, 18 nt, Pseudomonas aeruginosa PA01
cgucguacucggcggggc

SEQ ID NO: 3413074 - RNA, 15 nt, Pseudomonas aeruginosa PA01
cgucguacuggcgga

SEQ ID NO: 3413075 - RNA, 22 nt, Pseudomonas aeruginosa PA01
cgucguagagcgugcggccgau

SEQ ID NO: 3413076 - RNA, 22 nt, Pseudomonas aeruginosa PA01
cgucguagcccuucuccgccag

SEQ ID NO: 3413077 - RNA, 13 nt, Pseudomonas aeruginosa PA01
cgucguagcgcag

SEQ ID NO: 3413078 - RNA, 17 nt, Pseudomonas aeruginosa PA01
cgucguagcgcagcggc

SEQ ID NO: 3413079 - RNA, 18 nt, Pseudomonas aeruginosa PA01
cgucguaggccgagccca

SEQ ID NO: 3413080 - RNA, 20 nt, Pseudomonas aeruginosa PA01
cgucguaguggccgucgaag

SEQ ID NO: 3413081 - RNA, 16 nt, Pseudomonas aeruginosa PA01
cgucgucaccucggcg

SEQ ID NO: 3413082 - RNA, 14 nt, Pseudomonas aeruginosa PA01
cgucgucacgcagg

SEQ ID NO: 3413083 - RNA, 22 nt, Pseudomonas aeruginosa PA01
cgucguccaccgaguggcgcag

SEQ ID NO: 3413084 - RNA, 23 nt, Pseudomonas aeruginosa PA01
cgucguccaccgaguggcgcagc

SEQ ID NO: 3413085 - RNA, 14 nt, Pseudomonas aeruginosa PA01
cgucguccagcgcc

SEQ ID NO: 3413086 - RNA, 15 nt, Pseudomonas aeruginosa PA01
cgucguccagcgccg

SEQ ID NO: 3413087 - RNA, 13 nt, Pseudomonas aeruginosa PA01
cgucguccagcgg

SEQ ID NO: 3413088 - RNA, 15 nt, Pseudomonas aeruginosa PA01
cggucauccgccggc

SEQ ID NO: 3413089 - RNA, 17 nt, Pseudomonas aeruginosa PA01
cggucauccgccggcgc

SEQ ID NO: 3413090 - RNA, 18 nt, Pseudomonas aeruginosa PA01
cggucauccgccggcgcg

SEQ ID NO: 3413091 - RNA, 13 nt, Pseudomonas aeruginosa PA01
cggucaucgcgcc

SEQ ID NO: 3413092 - RNA, 21 nt, Pseudomonas aeruginosa PA01
cggucaucgcgccgccgaagc

SEQ ID NO: 3413093 - RNA, 15 nt, Pseudomonas aeruginosa PA01
cggucaugcccuugu

SEQ ID NO: 3413094 - RNA, 17 nt, Pseudomonas aeruginosa PA01
cggucaugcccuugucg

SEQ ID NO: 3413095 - RNA, 19 nt, Pseudomonas aeruginosa PA01
cggucauguccggggcgau

SEQ ID NO: 3413096 - RNA, 23 nt, Pseudomonas aeruginosa PA01
cgguccaacccauguggcgcagc

SEQ ID NO: 3413097 - RNA, 12 nt, Pseudomonas aeruginosa PA01
cgguccaccagg

SEQ ID NO: 3413098 - RNA, 21 nt, Pseudomonas aeruginosa PA01
cgguccagaucgccaccccgc

SEQ ID NO: 3413099 - RNA, 17 nt, Pseudomonas aeruginosa PA01
cgguccagcgagcgggc

SEQ ID NO: 3413100 - RNA, 19 nt, Pseudomonas aeruginosa PA01
cgguccagcgagcgggcga

SEQ ID NO: 3413101 - RNA, 15 nt, Pseudomonas aeruginosa PA01
cgguccagcuccuug

SEQ ID NO: 3413102 - RNA, 14 nt, Pseudomonas aeruginosa PA01
cgguccagggccgc

SEQ ID NO: 3413103 - RNA, 19 nt, Pseudomonas aeruginosa PA01
cgguccaggggccgaugcc

SEQ ID NO: 3413104 - RNA, 23 nt, Pseudomonas aeruginosa PA01
cgguccaggggccgaugccgggc

SEQ ID NO: 3413105 - RNA, 21 nt, Pseudomonas aeruginosa PA01
cgguccaggucaugcccuggc

SEQ ID NO: 3413106 - RNA, 23 nt, Pseudomonas aeruginosa PA01
cgguccaggucaugcccuggccg

SEQ ID NO: 3413107 - RNA, 17 nt, Pseudomonas aeruginosa PA01
cggucccagaccagcag

SEQ ID NO: 3413108 - RNA, 18 nt, Pseudomonas aeruginosa PA01
cggucccagaccagcagc

SEQ ID NO: 3413109 - RNA, 19 nt, Pseudomonas aeruginosa PA01
cggucccagaccagcagcg

SEQ ID NO: 3413110 - RNA, 23 nt, Pseudomonas aeruginosa PA01
cggucccagaccagcagcggcag

SEQ ID NO: 3413111 - RNA, 23 nt, Pseudomonas aeruginosa PA01
cggucccagguagcgcugcgcca

SEQ ID NO: 3413112 - RNA, 13 nt, Pseudomonas aeruginosa PA01
cggucccaucagc

SEQ ID NO: 3413113 - RNA, 15 nt, Pseudomonas aeruginosa PA01
cgguccccuccaggu

SEQ ID NO: 3413114 - RNA, 15 nt, Pseudomonas aeruginosa PA01
cggucccgggaaacc

SEQ ID NO: 3413115 - RNA, 20 nt, Pseudomonas aeruginosa PA01
cggucccgggaaaccaccag

SEQ ID NO: 3413116 - RNA, 16 nt, Pseudomonas aeruginosa PA01
cggucccgggcuccgg

SEQ ID NO: 3413117 - RNA, 14 nt, Pseudomonas aeruginosa PA01
cggucccucggggc

SEQ ID NO: 3413118 - RNA, 20 nt, Pseudomonas aeruginosa PA01
cggucccuucgugggccugc

SEQ ID NO: 3413119 - RNA, 19 nt, Pseudomonas aeruginosa PA01
cgguccgacaaucagcggc

SEQ ID NO: 3413120 - RNA, 14 nt, Pseudomonas aeruginosa PA01
cgguccgccgaugc

SEQ ID NO: 3413121 - RNA, 23 nt, Pseudomonas aeruginosa PA01
cgguccgccgaugcgcuacggca

SEQ ID NO: 3413122 - RNA, 15 nt, Pseudomonas aeruginosa PA01
cgguccgccgcggga

SEQ ID NO: 3413123 - RNA, 20 nt, Pseudomonas aeruginosa PA01
cgguccgccgcgggacgccg

SEQ ID NO: 3413124 - RNA, 21 nt, Pseudomonas aeruginosa PA01
cgguccgccgcgggacgccgc

SEQ ID NO: 3413125 - RNA, 15 nt, Pseudomonas aeruginosa PA01
cgguccgcgaaccgc

SEQ ID NO: 3413126 - RNA, 14 nt, Pseudomonas aeruginosa PA01
cgguccgcgccacg

SEQ ID NO: 3413127 - RNA, 19 nt, Pseudomonas aeruginosa PA01
cgguccgcgguagcugcgc

SEQ ID NO: 3413128 - RNA, 16 nt, Pseudomonas aeruginosa PA01
cgguccguccagcgcg

SEQ ID NO: 3413129 - RNA, 22 nt, Pseudomonas aeruginosa PA01
cgguccguccagcgcgcccggc

SEQ ID NO: 3413130 - RNA, 13 nt, Pseudomonas aeruginosa PA01
cgguccucgcccg

SEQ ID NO: 3413131 - RNA, 18 nt, Pseudomonas aeruginosa PA01
cgguccucgggcaccagc

SEQ ID NO: 3413132 - RNA, 15 nt, Pseudomonas aeruginosa PA01
cgguccuuguccggg

SEQ ID NO: 3413133 - RNA, 21 nt, Pseudomonas aeruginosa PA01
cgguccuuguccggguagucc

SEQ ID NO: 3413134 - RNA, 20 nt, Pseudomonas aeruginosa PA01
cggucgaaccccuucccccc

SEQ ID NO: 3413135 - RNA, 18 nt, Pseudomonas aeruginosa PA01
cggucgaacugaccacca

SEQ ID NO: 3413136 - RNA, 21 nt, Pseudomonas aeruginosa PA01
cggucgaacugaccaccagga

SEQ ID NO: 3413137 - RNA, 16 nt, Pseudomonas aeruginosa PA01
cggucgacggcgugca

SEQ ID NO: 3413138 - RNA, 17 nt, Pseudomonas aeruginosa PA01
cggucgagacgccauca

SEQ ID NO: 3413139 - RNA, 13 nt, Pseudomonas aeruginosa PA01
cggucgagcccca

SEQ ID NO: 3413140 - RNA, 20 nt, Pseudomonas aeruginosa PA01
cggucgagcucggccaggca

SEQ ID NO: 3413141 - RNA, 16 nt, Pseudomonas aeruginosa PA01
cggucgaggcccucgg

SEQ ID NO: 3413142 - RNA, 14 nt, Pseudomonas aeruginosa PA01
cggucgaggcggag

SEQ ID NO: 3413143 - RNA, 19 nt, Pseudomonas aeruginosa PA01
cggucgagguugcgcggca

SEQ ID NO: 3413144 - RNA, 20 nt, Pseudomonas aeruginosa PA01
cggucgagguugcgcggcag

SEQ ID NO: 3413145 - RNA, 16 nt, Pseudomonas aeruginosa PA01
cggucgauguccuggg

SEQ ID NO: 3413146 - RNA, 18 nt, Pseudomonas aeruginosa PA01
cggucgauguccugggcc

SEQ ID NO: 3413147 - RNA, 16 nt, Pseudomonas aeruginosa PA01
cggucgaugucgcggc

SEQ ID NO: 3413148 - RNA, 13 nt, Pseudomonas aeruginosa PA01
cggucgcaccgcc

SEQ ID NO: 3413149 - RNA, 14 nt, Pseudomonas aeruginosa PA01
cggucgcaccgcca

SEQ ID NO: 3413150 - RNA, 16 nt, Pseudomonas aeruginosa PA01
cggucgcaccgccagc

SEQ ID NO: 3413151 - RNA, 18 nt, Pseudomonas aeruginosa PA01
cggucgcaccgccagcag

SEQ ID NO: 3413152 - RNA, 16 nt, Pseudomonas aeruginosa PA01
cggucgcccucggcca

SEQ ID NO: 3413153 - RNA, 18 nt, Pseudomonas aeruginosa PA01
cggucgcccucggccagg

SEQ ID NO: 3413154 - RNA, 20 nt, Pseudomonas aeruginosa PA01
cggucgcccucggccaggca

SEQ ID NO: 3413155 - RNA, 18 nt, Pseudomonas aeruginosa PA01
cggucgccgaacagccgc

SEQ ID NO: 3413156 - RNA, 13 nt, Pseudomonas aeruginosa PA01
cggucgccgccag

SEQ ID NO: 3413157 - RNA, 15 nt, Pseudomonas aeruginosa PA01
cggucgccgccagca

SEQ ID NO: 3413158 - RNA, 14 nt, Pseudomonas aeruginosa PA01
cggucgccgccggc

SEQ ID NO: 3413159 - RNA, 15 nt, Pseudomonas aeruginosa PA01
cggucgccgccggcg

SEQ ID NO: 3413160 - RNA, 16 nt, Pseudomonas aeruginosa PA01
cggucgccgccggcga

SEQ ID NO: 3413161 - RNA, 12 nt, Pseudomonas aeruginosa PA01
cggucgccggcg

SEQ ID NO: 3413162 - RNA, 16 nt, Pseudomonas aeruginosa PA01
cggucgccggcgcgca

SEQ ID NO: 3413163 - RNA, 18 nt, Pseudomonas aeruginosa PA01
cggucgcgaucugcuggu

SEQ ID NO: 3413164 - RNA, 14 nt, Pseudomonas aeruginosa PA01
cggucgcgccccgc

SEQ ID NO: 3413165 - RNA, 15 nt, Pseudomonas aeruginosa PA01
cggucgcgccccgcc

SEQ ID NO: 3413166 - RNA, 20 nt, Pseudomonas aeruginosa PA01
cggucgcgcgggugcggcug

SEQ ID NO: 3413167 - RNA, 15 nt, Pseudomonas aeruginosa PA01
cggucgcggaccucc

SEQ ID NO: 3413168 - RNA, 22 nt, Pseudomonas aeruginosa PA01
cggucgcggaccuccagccggc

SEQ ID NO: 3413169 - RNA, 16 nt, Pseudomonas aeruginosa PA01
cggucgcugaccagcc

SEQ ID NO: 3413170 - RNA, 21 nt, Pseudomonas aeruginosa PA01
cggucgcugaccagcccggcg

SEQ ID NO: 3413171 - RNA, 23 nt, Pseudomonas aeruginosa PA01
cggucgcugaccagcccggcggc

SEQ ID NO: 3413172 - RNA, 18 nt, Pseudomonas aeruginosa PA01
cggucgcuuuuuccgcug

SEQ ID NO: 3413173 - RNA, 19 nt, Pseudomonas aeruginosa PA01
cggucggaaagcagggcga

SEQ ID NO: 3413174 - RNA, 20 nt, Pseudomonas aeruginosa PA01
cggucggaaagcagggcgau

SEQ ID NO: 3413175 - RNA, 23 nt, Pseudomonas aeruginosa PA01
cggucggaucggauagccgugca

SEQ ID NO: 3413176 - RNA, 12 nt, Pseudomonas aeruginosa PA01
cggucggccagg

SEQ ID NO: 3413177 - RNA, 13 nt, Pseudomonas aeruginosa PA01
cggucggccaggc

SEQ ID NO: 3413178 - RNA, 18 nt, Pseudomonas aeruginosa PA01
cggucggccaggcggccg

SEQ ID NO: 3413179 - RNA, 19 nt, Pseudomonas aeruginosa PA01
cggucggccaggcggccga

SEQ ID NO: 3413180 - RNA, 17 nt, Pseudomonas aeruginosa PA01
cggucggccaucuggcu

SEQ ID NO: 3413181 - RNA, 14 nt, Pseudomonas aeruginosa PA01
cggucggccauggc

SEQ ID NO: 3413182 - RNA, 16 nt, Pseudomonas aeruginosa PA01
cggucggccuugaggc

SEQ ID NO: 3413183 - RNA, 12 nt, Pseudomonas aeruginosa PA01
cggucggcggcg

SEQ ID NO: 3413184 - RNA, 14 nt, Pseudomonas aeruginosa PA01
cggucggcucagcc

SEQ ID NO: 3413185 - RNA, 21 nt, Pseudomonas aeruginosa PA01
cggucggcucagccgaccacc

SEQ ID NO: 3413186 - RNA, 12 nt, Pseudomonas aeruginosa PA01
cggucgggcaga

SEQ ID NO: 3413187 - RNA, 14 nt, Pseudomonas aeruginosa PA01
cggucgggugaagg

SEQ ID NO: 3413188 - RNA, 16 nt, Pseudomonas aeruginosa PA01
cggucggugagcacgc

SEQ ID NO: 3413189 - RNA, 21 nt, Pseudomonas aeruginosa PA01
cggucggugagcacgccgcga

SEQ ID NO: 3413190 - RNA, 18 nt, Pseudomonas aeruginosa PA01
cggucgguugcggccuga

SEQ ID NO: 3413191 - RNA, 14 nt, Pseudomonas aeruginosa PA01
cggucguccugcgg

SEQ ID NO: 3413192 - RNA, 12 nt, Pseudomonas aeruginosa PA01
cgggacccuggu

SEQ ID NO: 3413193 - RNA, 22 nt, Pseudomonas aeruginosa PA01
cgggacccugguaguccagcag

SEQ ID NO: 3413194 - RNA, 23 nt, Pseudomonas aeruginosa PA01
cgggacccugguaguccagcagg

SEQ ID NO: 3413195 - RNA, 13 nt, Pseudomonas aeruginosa PA01
cgggacgaugccg

SEQ ID NO: 3413196 - RNA, 16 nt, Pseudomonas aeruginosa PA01
cgggacgcaugcgcgg

SEQ ID NO: 3413197 - RNA, 12 nt, Pseudomonas aeruginosa PA01
cgggacgccagg

SEQ ID NO: 3413198 - RNA, 14 nt, Pseudomonas aeruginosa PA01
cgggacgccaggcg

SEQ ID NO: 3413199 - RNA, 15 nt, Pseudomonas aeruginosa PA01
cgggacgccaggcgu

SEQ ID NO: 3413200 - RNA, 17 nt, Pseudomonas aeruginosa PA01
cgggacgccaggcgucc

SEQ ID NO: 3413201 - RNA, 16 nt, Pseudomonas aeruginosa PA01
cgggacgccuggcguc

SEQ ID NO: 3413202 - RNA, 13 nt, Pseudomonas aeruginosa PA01
cgggacgcggcgu

SEQ ID NO: 3413203 - RNA, 23 nt, Pseudomonas aeruginosa PA01
cgggacggcgcauauccaccaug

SEQ ID NO: 3413204 - RNA, 23 nt, Pseudomonas aeruginosa PA01
cgggacuggggcaugggcgcggg

SEQ ID NO: 3413205 - RNA, 15 nt, Pseudomonas aeruginosa PA01
cgggacuuguacucg

SEQ ID NO: 3413206 - RNA, 19 nt, Pseudomonas aeruginosa PA01
cgggacuuguacucgccgg

SEQ ID NO: 3413207 - RNA, 22 nt, Pseudomonas aeruginosa PA01
cgggacuuuccgaagccccgga

SEQ ID NO: 3413208 - RNA, 15 nt, Pseudomonas aeruginosa PA01
cgggagagggcggcg

SEQ ID NO: 3413209 - RNA, 18 nt, Pseudomonas aeruginosa PA01
cgggagagggcggcgacc

SEQ ID NO: 3413210 - RNA, 21 nt, Pseudomonas aeruginosa PA01
cgggagcgcgaggcgcaggca

SEQ ID NO: 3413211 - RNA, 14 nt, Pseudomonas aeruginosa PA01
cgggagcggccgug

SEQ ID NO: 3413212 - RNA, 13 nt, Pseudomonas aeruginosa PA01
cgggaggcgccgc

SEQ ID NO: 3413213 - RNA, 14 nt, Pseudomonas aeruginosa PA01
cgggaggcgccgcg

SEQ ID NO: 3413214 - RNA, 15 nt, Pseudomonas aeruginosa PA01
cgggaggcgccgcgc

SEQ ID NO: 3413215 - RNA, 17 nt, Pseudomonas aeruginosa PA01
cgggaggcgccgcgcca

SEQ ID NO: 3413216 - RNA, 22 nt, Pseudomonas aeruginosa PA01
cgggagucaacgccuggccacg

SEQ ID NO: 3413217 - RNA, 20 nt, Pseudomonas aeruginosa PA01
cgggauaaacggcggauaac

SEQ ID NO: 3413218 - RNA, 21 nt, Pseudomonas aeruginosa PA01
cgggauaccggccaucagcac

SEQ ID NO: 3413219 - RNA, 22 nt, Pseudomonas aeruginosa PA01
cgggauaccggccaucagcacc

SEQ ID NO: 3413220 - RNA, 20 nt, Pseudomonas aeruginosa PA01
cgggauagacggcggauaac

SEQ ID NO: 3413221 - RNA, 22 nt, Pseudomonas aeruginosa PA01
cgggauagucguucuuccugag

SEQ ID NO: 3413222 - RNA, 12 nt, Pseudomonas aeruginosa PA01
cgggaucagcgg

SEQ ID NO: 3413223 - RNA, 16 nt, Pseudomonas aeruginosa PA01
cgggaucagcggcggg

SEQ ID NO: 3413224 - RNA, 18 nt, Pseudomonas aeruginosa PA01
cgggaucagcggcggggc

SEQ ID NO: 3413225 - RNA, 13 nt, Pseudomonas aeruginosa PA01
cgggaucaggucg

SEQ ID NO: 3413226 - RNA, 19 nt, Pseudomonas aeruginosa PA01
cgggaucaggucgccagcg

SEQ ID NO: 3413227 - RNA, 14 nt, Pseudomonas aeruginosa PA01
cgggaucgacgccg

SEQ ID NO: 3413228 - RNA, 15 nt, Pseudomonas aeruginosa PA01
cgggaucgacgccgc

SEQ ID NO: 3413229 - RNA, 20 nt, Pseudomonas aeruginosa PA01
cgggaucgacgccgcuggcg

SEQ ID NO: 3413230 - RNA, 22 nt, Pseudomonas aeruginosa PA01
cgggaucgaguaagugccgacc

SEQ ID NO: 3413231 - RNA, 20 nt, Pseudomonas aeruginosa PA01
cgggaucgaugcgcgcccug

SEQ ID NO: 3413232 - RNA, 23 nt, Pseudomonas aeruginosa PA01
cgggaucgcuaccgacaggacca

SEQ ID NO: 3413233 - RNA, 23 nt, Pseudomonas aeruginosa PA01
cgggaucguaggcgcgcaccugc

SEQ ID NO: 3413234 - RNA, 20 nt, Pseudomonas aeruginosa PA01
cgggaucuucuaccuggcgc

SEQ ID NO: 3413235 - RNA, 21 nt, Pseudomonas aeruginosa PA01
cgggaucuucuaccuggcgcu

SEQ ID NO: 3413236 - RNA, 23 nt, Pseudomonas aeruginosa PA01
cgggaucuucuaccuggcgcuga

SEQ ID NO: 3413237 - RNA, 23 nt, Pseudomonas aeruginosa PA01
cgggaucuuguagaacaggcugu

SEQ ID NO: 3413238 - RNA, 20 nt, Pseudomonas aeruginosa PA01
cgggaugaagaucaucuggg

SEQ ID NO: 3413239 - RNA, 22 nt, Pseudomonas aeruginosa PA01
cgggaugaagaucaucuggguc

SEQ ID NO: 3413240 - RNA, 14 nt, Pseudomonas aeruginosa PA01
cgggaugcccggcc

SEQ ID NO: 3413241 - RNA, 16 nt, Pseudomonas aeruginosa PA01
cgggaugcccggccgc

SEQ ID NO: 3413242 - RNA, 16 nt, Pseudomonas aeruginosa PA01
cgggaugcucaccgcg

SEQ ID NO: 3413243 - RNA, 17 nt, Pseudomonas aeruginosa PA01
cgggaugcucaccgcgc

SEQ ID NO: 3413244 - RNA, 19 nt, Pseudomonas aeruginosa PA01
cgggaugcucaccgcgcuu

SEQ ID NO: 3413245 - RNA, 15 nt, Pseudomonas aeruginosa PA01
cgggauggcgaagcc

SEQ ID NO: 3413246 - RNA, 16 nt, Pseudomonas aeruginosa PA01
cgggauggcgaagccg

SEQ ID NO: 3413247 - RNA, 14 nt, Pseudomonas aeruginosa PA01
cgggauggucgagg

SEQ ID NO: 3413248 - RNA, 19 nt, Pseudomonas aeruginosa PA01
cgggauggucgagggcgcg

SEQ ID NO: 3413249 - RNA, 16 nt, Pseudomonas aeruginosa PA01
cgggaugugcaccagc

SEQ ID NO: 3413250 - RNA, 16 nt, Pseudomonas aeruginosa PA01
cgggauugucgccgcc

SEQ ID NO: 3413251 - RNA, 17 nt, Pseudomonas aeruginosa PA01
cgggauugucgccgccg

SEQ ID NO: 3413252 - RNA, 20 nt, Pseudomonas aeruginosa PA01
cgggauuuccgauccuccug

SEQ ID NO: 3413253 - RNA, 17 nt, Pseudomonas aeruginosa PA01
cgggcaaccgcggcggc

SEQ ID NO: 3413254 - RNA, 21 nt, Pseudomonas aeruginosa PA01
cgggcaacgauucgacgcagc

SEQ ID NO: 3413255 - RNA, 14 nt, Pseudomonas aeruginosa PA01
cgggcaacgccagg

SEQ ID NO: 3413256 - RNA, 16 nt, Pseudomonas aeruginosa PA01
cgggcaacgccaggcc

SEQ ID NO: 3413257 - RNA, 14 nt, Pseudomonas aeruginosa PA01
cgggcaacgcgcag

SEQ ID NO: 3413258 - RNA, 16 nt, Pseudomonas aeruginosa PA01
cgggcaacgcgcagag

SEQ ID NO: 3413259 - RNA, 16 nt, Pseudomonas aeruginosa PA01
cgggcaacggcugggu

SEQ ID NO: 3413260 - RNA, 19 nt, Pseudomonas aeruginosa PA01
cgggcaacugaucagccgg

SEQ ID NO: 3413261 - RNA, 14 nt, Pseudomonas aeruginosa PA01
cgggcaacugccga

SEQ ID NO: 3413262 - RNA, 15 nt, Pseudomonas aeruginosa PA01
cgggcaagcucgacg

SEQ ID NO: 3413263 - RNA, 16 nt, Pseudomonas aeruginosa PA01
cgggcaagcucgacga

SEQ ID NO: 3413264 - RNA, 23 nt, Pseudomonas aeruginosa PA01
cgggcacaaaaaaggcggaugac

SEQ ID NO: 3413265 - RNA, 15 nt, Pseudomonas aeruginosa PA01
cgggcaccagcacgg

SEQ ID NO: 3413266 - RNA, 20 nt, Pseudomonas aeruginosa PA01
cgggcaccgagucggcaacg

SEQ ID NO: 3413267 - RNA, 20 nt, Pseudomonas aeruginosa PA01
cgggcaccgucaccuguucg

SEQ ID NO: 3413268 - RNA, 20 nt, Pseudomonas aeruginosa PA01
cgggcacgcauagcgcgcug

SEQ ID NO: 3413269 - RNA, 23 nt, Pseudomonas aeruginosa PA01
cgggcacgcauagcgcgcuguag

SEQ ID NO: 3413270 - RNA, 14 nt, Pseudomonas aeruginosa PA01
cgggcacgucgcgg

SEQ ID NO: 3413271 - RNA, 19 nt, Pseudomonas aeruginosa PA01
cgggcacuucucgaacagc

SEQ ID NO: 3413272 - RNA, 19 nt, Pseudomonas aeruginosa PA01
cgggcagacaccaccaggu

SEQ ID NO: 3413273 - RNA, 15 nt, Pseudomonas aeruginosa PA01
cgggcagaccagcag

SEQ ID NO: 3413274 - RNA, 16 nt, Pseudomonas aeruginosa PA01
cgggcagaccagcagc

SEQ ID NO: 3413275 - RNA, 18 nt, Pseudomonas aeruginosa PA01
cgggcagacuucgccgug

SEQ ID NO: 3413276 - RNA, 20 nt, Pseudomonas aeruginosa PA01
cgggcagacuucgccgugcu

SEQ ID NO: 3413277 - RNA, 17 nt, Pseudomonas aeruginosa PA01
cgggcagaguggcgcgg

SEQ ID NO: 3413278 - RNA, 19 nt, Pseudomonas aeruginosa PA01
cgggcagauguccaggcag

SEQ ID NO: 3413279 - RNA, 20 nt, Pseudomonas aeruginosa PA01
cgggcagccccuugagcgcg

SEQ ID NO: 3413280 - RNA, 16 nt, Pseudomonas aeruginosa PA01
cgggcagccguuggcg

SEQ ID NO: 3413281 - RNA, 22 nt, Pseudomonas aeruginosa PA01
cgggcagcucguugcacagcgc

SEQ ID NO: 3413282 - RNA, 19 nt, Pseudomonas aeruginosa PA01
cgggcaggccgaggccggc

SEQ ID NO: 3413283 - RNA, 15 nt, Pseudomonas aeruginosa PA01
cgggcagggcagccg

SEQ ID NO: 3413284 - RNA, 16 nt, Pseudomonas aeruginosa PA01
cgggcagggcagccgc

SEQ ID NO: 3413285 - RNA, 18 nt, Pseudomonas aeruginosa PA01
cgggcagggcagccgccg

SEQ ID NO: 3413286 - RNA, 17 nt, Pseudomonas aeruginosa PA01
cgggcagguggacggca

SEQ ID NO: 3413287 - RNA, 16 nt, Pseudomonas aeruginosa PA01
cgggcaguacucauga

SEQ ID NO: 3413288 - RNA, 21 nt, Pseudomonas aeruginosa PA01
cgggcaguacucaugaccgcc

SEQ ID NO: 3413289 - RNA, 24 nt, Pseudomonas aeruginosa PA01
cgggcagugcgcccucgaacggcg

SEQ ID NO: 3413290 - RNA, 15 nt, Pseudomonas aeruginosa PA01
cgggcaguuccaggc

SEQ ID NO: 3413291 - RNA, 21 nt, Pseudomonas aeruginosa PA01
cgggcauauggaucggccucg

SEQ ID NO: 3413292 - RNA, 14 nt, Pseudomonas aeruginosa PA01
cgggcauccagcgg

SEQ ID NO: 3413293 - RNA, 19 nt, Pseudomonas aeruginosa PA01
cgggcauccagcggacgcu

SEQ ID NO: 3413294 - RNA, 15 nt, Pseudomonas aeruginosa PA01
cgggcaucgccgacc

SEQ ID NO: 3413295 - RNA, 16 nt, Pseudomonas aeruginosa PA01
cgggcaucgccgacca

SEQ ID NO: 3413296 - RNA, 18 nt, Pseudomonas aeruginosa PA01
cgggcaucgucgaagggc

SEQ ID NO: 3413297 - RNA, 20 nt, Pseudomonas aeruginosa PA01
cgggcaucgucgaagggcca

SEQ ID NO: 3413298 - RNA, 16 nt, Pseudomonas aeruginosa PA01
cgggcaugcaccuacc

SEQ ID NO: 3413299 - RNA, 17 nt, Pseudomonas aeruginosa PA01
cgggcaugccgugggcg

SEQ ID NO: 3413300 - RNA, 22 nt, Pseudomonas aeruginosa PA01
cgggcaugccgugggcgccgcc

SEQ ID NO: 3413301 - RNA, 16 nt, Pseudomonas aeruginosa PA01
cgggcauggaucuccc

SEQ ID NO: 3413302 - RNA, 17 nt, Pseudomonas aeruginosa PA01
cgggcauggaucucccg

SEQ ID NO: 3413303 - RNA, 13 nt, Pseudomonas aeruginosa PA01
cgggcauggcgau

SEQ ID NO: 3413304 - RNA, 20 nt, Pseudomonas aeruginosa PA01
cgggcauggcgaucuccggg

SEQ ID NO: 3413305 - RNA, 16 nt, Pseudomonas aeruginosa PA01
cgggcauucgcagcgg

SEQ ID NO: 3413306 - RNA, 18 nt, Pseudomonas aeruginosa PA01
cgggcauugucccugcgg

SEQ ID NO: 3413307 - RNA, 17 nt, Pseudomonas aeruginosa PA01
cgggcauuuccucgaug

SEQ ID NO: 3413308 - RNA, 21 nt, Pseudomonas aeruginosa PA01
cgggcauuuccucgaugagca

SEQ ID NO: 3413309 - RNA, 16 nt, Pseudomonas aeruginosa PA01
cgggccagcagcuccg

SEQ ID NO: 3413310 - RNA, 17 nt, Pseudomonas aeruginosa PA01
cgggccagcagcuccgg

SEQ ID NO: 3413311 - RNA, 12 nt, Pseudomonas aeruginosa PA01
cgggccagcagg

SEQ ID NO: 3413312 - RNA, 16 nt, Pseudomonas aeruginosa PA01
cgggccagcaggcgcu

SEQ ID NO: 3413313 - RNA, 17 nt, Pseudomonas aeruginosa PA01
cgggccagcaggcgcuc

SEQ ID NO: 3413314 - RNA, 20 nt, Pseudomonas aeruginosa PA01
cgggccagcaggguggccag

SEQ ID NO: 3413315 - RNA, 21 nt, Pseudomonas aeruginosa PA01
cgggccagcaggguggccagg

SEQ ID NO: 3413316 - RNA, 15 nt, Pseudomonas aeruginosa PA01
cgggccagcuccagc

SEQ ID NO: 3413317 - RNA, 22 nt, Pseudomonas aeruginosa PA01
cgggccagcuccagcaccggcg

SEQ ID NO: 3413318 - RNA, 16 nt, Pseudomonas aeruginosa PA01
cgggccagcuccgccu

SEQ ID NO: 3413319 - RNA, 17 nt, Pseudomonas aeruginosa PA01
cgggccagcuccgccug

SEQ ID NO: 3413320 - RNA, 14 nt, Pseudomonas aeruginosa PA01
cgggccagcuggcg

SEQ ID NO: 3413321 - RNA, 13 nt, Pseudomonas aeruginosa PA01
cgggccaggcccu

SEQ ID NO: 3413322 - RNA, 14 nt, Pseudomonas aeruginosa PA01
cgggccaggcccuu

SEQ ID NO: 3413323 - RNA, 13 nt, Pseudomonas aeruginosa PA01
cgggccaggccga

SEQ ID NO: 3413324 - RNA, 15 nt, Pseudomonas aeruginosa PA01
cgggccauugcaggu

SEQ ID NO: 3413325 - RNA, 17 nt, Pseudomonas aeruginosa PA01
cgggcccaggcuggcgg

SEQ ID NO: 3413326 - RNA, 18 nt, Pseudomonas aeruginosa PA01
cgggcccaggcuggcggc

SEQ ID NO: 3413327 - RNA, 19 nt, Pseudomonas aeruginosa PA01
cgggcccaggcuggcggcc

SEQ ID NO: 3413328 - RNA, 19 nt, Pseudomonas aeruginosa PA01
cgggcccaguucgcguagc

SEQ ID NO: 3413329 - RNA, 19 nt, Pseudomonas aeruginosa PA01
cgggcccauggcgguagug

SEQ ID NO: 3413330 - RNA, 21 nt, Pseudomonas aeruginosa PA01
cgggcccugcuucgaacgugc

SEQ ID NO: 3413331 - RNA, 13 nt, Pseudomonas aeruginosa PA01
cgggcccugggcc

SEQ ID NO: 3413332 - RNA, 18 nt, Pseudomonas aeruginosa PA01
cgggcccugggccccggc

SEQ ID NO: 3413333 - RNA, 19 nt, Pseudomonas aeruginosa PA01
cgggcccugggccccggcc

SEQ ID NO: 3413334 - RNA, 22 nt, Pseudomonas aeruginosa PA01
cgggcccugggccccggccggc

SEQ ID NO: 3413335 - RNA, 15 nt, Pseudomonas aeruginosa PA01
cgggccgaccugccc

SEQ ID NO: 3413336 - RNA, 17 nt, Pseudomonas aeruginosa PA01
cgggccgaccugcccgc

SEQ ID NO: 3413337 - RNA, 16 nt, Pseudomonas aeruginosa PA01
cgggccgacggcccuc

SEQ ID NO: 3413338 - RNA, 23 nt, Pseudomonas aeruginosa PA01
cgggccgacggcccuccggcgcg

SEQ ID NO: 3413339 - RNA, 16 nt, Pseudomonas aeruginosa PA01
cgggccgagggcugag

SEQ ID NO: 3413340 - RNA, 17 nt, Pseudomonas aeruginosa PA01
cgggccgagggcugaga

SEQ ID NO: 3413341 - RNA, 20 nt, Pseudomonas aeruginosa PA01
cgggccgaggucgcgggcca

SEQ ID NO: 3413342 - RNA, 23 nt, Pseudomonas aeruginosa PA01
cgggccgaggucgcgggccaggc

SEQ ID NO: 3413343 - RNA, 23 nt, Pseudomonas aeruginosa PA01
cgggccgaucaccaccuggaugg

SEQ ID NO: 3413344 - RNA, 14 nt, Pseudomonas aeruginosa PA01
cgggccgcagcgca

SEQ ID NO: 3413345 - RNA, 17 nt, Pseudomonas aeruginosa PA01
cgggccgcagcgcagcc

SEQ ID NO: 3413346 - RNA, 14 nt, Pseudomonas aeruginosa PA01
cgggccgccggcga

SEQ ID NO: 3413347 - RNA, 15 nt, Pseudomonas aeruginosa PA01
cgggccgccggcgac

SEQ ID NO: 3413348 - RNA, 17 nt, Pseudomonas aeruginosa PA01
cgggccgccggcgacga

SEQ ID NO: 3413349 - RNA, 18 nt, Pseudomonas aeruginosa PA01
cgggccgccggcgacgag

SEQ ID NO: 3413350 - RNA, 19 nt, Pseudomonas aeruginosa PA01
cgggccgccuugcgcagca

SEQ ID NO: 3413351 - RNA, 20 nt, Pseudomonas aeruginosa PA01
cgggccgccuugcgcagcaa

SEQ ID NO: 3413352 - RNA, 14 nt, Pseudomonas aeruginosa PA01
cgggccgcgccgca

SEQ ID NO: 3413353 - RNA, 16 nt, Pseudomonas aeruginosa PA01
cgggccgcgccgcaag

SEQ ID NO: 3413354 - RNA, 23 nt, Pseudomonas aeruginosa PA01
cgggccgcgccuuucgcucaggc

SEQ ID NO: 3413355 - RNA, 15 nt, Pseudomonas aeruginosa PA01
cgggccgcucgcgcg

SEQ ID NO: 3413356 - RNA, 16 nt, Pseudomonas aeruginosa PA01
cgggccgcucgcgcgg

SEQ ID NO: 3413357 - RNA, 16 nt, Pseudomonas aeruginosa PA01
cgggccggagcaggcc

SEQ ID NO: 3413358 - RNA, 19 nt, Pseudomonas aeruginosa PA01
cgggccggagcaggccaug

SEQ ID NO: 3413359 - RNA, 22 nt, Pseudomonas aeruginosa PA01
cgggccggagcaggccaugggu

SEQ ID NO: 3413360 - RNA, 14 nt, Pseudomonas aeruginosa PA01
cgggccggccaggg

SEQ ID NO: 3413361 - RNA, 16 nt, Pseudomonas aeruginosa PA01
cgggccggccagggcg

SEQ ID NO: 3413362 - RNA, 17 nt, Pseudomonas aeruginosa PA01
cgggccggccagggcga

SEQ ID NO: 3413363 - RNA, 13 nt, Pseudomonas aeruginosa PA01
cgggccggcgaug

SEQ ID NO: 3413364 - RNA, 15 nt, Pseudomonas aeruginosa PA01
cgggccggcgauggc

SEQ ID NO: 3413365 - RNA, 16 nt, Pseudomonas aeruginosa PA01
cgggccggcgauggcc

SEQ ID NO: 3413366 - RNA, 17 nt, Pseudomonas aeruginosa PA01
cgggccggcgauggccc

SEQ ID NO: 3413367 - RNA, 18 nt, Pseudomonas aeruginosa PA01
cgggccggcgauggccca

SEQ ID NO: 3413368 - RNA, 21 nt, Pseudomonas aeruginosa PA01
cgggccggcgauggcccagau

SEQ ID NO: 3413369 - RNA, 12 nt, Pseudomonas aeruginosa PA01
cgggccgggggc

SEQ ID NO: 3413370 - RNA, 21 nt, Pseudomonas aeruginosa PA01
cgggccgucguuuuguccggc

SEQ ID NO: 3413371 - RNA, 23 nt, Pseudomonas aeruginosa PA01
cgggccguuuuuuaugccgaggc

SEQ ID NO: 3413372 - RNA, 16 nt, Pseudomonas aeruginosa PA01
cgggccuccuggcggc

SEQ ID NO: 3413373 - RNA, 12 nt, Pseudomonas aeruginosa PA01
cgggccucggcg

SEQ ID NO: 3413374 - RNA, 22 nt, Pseudomonas aeruginosa PA01
cgggccucguuuuugggggagg

SEQ ID NO: 3413375 - RNA, 17 nt, Pseudomonas aeruginosa PA01
cgggccuggugagcgga

SEQ ID NO: 3413376 - RNA, 18 nt, Pseudomonas aeruginosa PA01
cgggccuggugcacgccg

SEQ ID NO: 3413377 - RNA, 13 nt, Pseudomonas aeruginosa PA01
cgggccuucaggc

SEQ ID NO: 3413378 - RNA, 15 nt, Pseudomonas aeruginosa PA01
cgggccuucaggcug

SEQ ID NO: 3413379 - RNA, 19 nt, Pseudomonas aeruginosa PA01
cgggccuucaggcugcgcg

SEQ ID NO: 3413380 - RNA, 23 nt, Pseudomonas aeruginosa PA01
cgggccuucaggcugcgcgcauc

SEQ ID NO: 3413381 - RNA, 14 nt, Pseudomonas aeruginosa PA01
cgggccuucgccag

SEQ ID NO: 3413382 - RNA, 20 nt, Pseudomonas aeruginosa PA01
cgggccuucgccagcggcca

SEQ ID NO: 3413383 - RNA, 19 nt, Pseudomonas aeruginosa PA01
cgggccuucgccuucggcg

SEQ ID NO: 3413384 - RNA, 22 nt, Pseudomonas aeruginosa PA01
cgggccuucgccuucggcgugc

SEQ ID NO: 3413385 - RNA, 19 nt, Pseudomonas aeruginosa PA01
cgggccuugaccaccgcca

SEQ ID NO: 3413386 - RNA, 22 nt, Pseudomonas aeruginosa PA01
cgggccuugaccaccgccaggc

SEQ ID NO: 3413387 - RNA, 20 nt, Pseudomonas aeruginosa PA01
cgggccuugcgaccaggucc

SEQ ID NO: 3413388 - RNA, 16 nt, Pseudomonas aeruginosa PA01
cgggcgaaacggcagg

SEQ ID NO: 3413389 - RNA, 17 nt, Pseudomonas aeruginosa PA01
cgggcgaaacggcaggc

SEQ ID NO: 3413390 - RNA, 19 nt, Pseudomonas aeruginosa PA01
cgggcgaaacggcaggcca

SEQ ID NO: 3413391 - RNA, 22 nt, Pseudomonas aeruginosa PA01
cgggcgaaacggcaggccagca

SEQ ID NO: 3413392 - RNA, 18 nt, Pseudomonas aeruginosa PA01
cgggcgaacccgaauccc

SEQ ID NO: 3413393 - RNA, 15 nt, Pseudomonas aeruginosa PA01
cgggcgaacggcagc

SEQ ID NO: 3413394 - RNA, 19 nt, Pseudomonas aeruginosa PA01
cgggcgaaggccucgucga

SEQ ID NO: 3413395 - RNA, 21 nt, Pseudomonas aeruginosa PA01
cgggcgaaggccucgucgauc

SEQ ID NO: 3413396 - RNA, 17 nt, Pseudomonas aeruginosa PA01
cgggcgacaaggcugag

SEQ ID NO: 3413397 - RNA, 14 nt, Pseudomonas aeruginosa PA01
cgggcgacccaggc

SEQ ID NO: 3413398 - RNA, 15 nt, Pseudomonas aeruginosa PA01
cgggcgacccaggcc

SEQ ID NO: 3413399 - RNA, 17 nt, Pseudomonas aeruginosa PA01
cgggcgacccaggccga

SEQ ID NO: 3413400 - RNA, 19 nt, Pseudomonas aeruginosa PA01
cgggcgacccaggccgaca

SEQ ID NO: 3413401 - RNA, 13 nt, Pseudomonas aeruginosa PA01
cgggcgaccugcu

SEQ ID NO: 3413402 - RNA, 22 nt, Pseudomonas aeruginosa PA01
cgggcgaccugcucgcgcaccg

SEQ ID NO: 3413403 - RNA, 23 nt, Pseudomonas aeruginosa PA01
cgggcgaccugcucgcgcaccgc

SEQ ID NO: 3413404 - RNA, 20 nt, Pseudomonas aeruginosa PA01
cgggcgacgaagcccucgcg

SEQ ID NO: 3413405 - RNA, 16 nt, Pseudomonas aeruginosa PA01
cgggcgacgcguccgg

SEQ ID NO: 3413406 - RNA, 17 nt, Pseudomonas aeruginosa PA01
cgggcgacgugggccug

SEQ ID NO: 3413407 - RNA, 20 nt, Pseudomonas aeruginosa PA01
cgggcgacgugggccugcuc

SEQ ID NO: 3413408 - RNA, 18 nt, Pseudomonas aeruginosa PA01
cgggcgagaaucgccgag

SEQ ID NO: 3413409 - RNA, 18 nt, Pseudomonas aeruginosa PA01
cgggcgagcagggaggag

SEQ ID NO: 3413410 - RNA, 23 nt, Pseudomonas aeruginosa PA01
cgggcgagcgcagacgggugcug

SEQ ID NO: 3413411 - RNA, 20 nt, Pseudomonas aeruginosa PA01
cgggcgaggcuaacgccgag

SEQ ID NO: 3413412 - RNA, 22 nt, Pseudomonas aeruginosa PA01
cgggcgaggcuaacgccgagga

SEQ ID NO: 3413413 - RNA, 23 nt, Pseudomonas aeruginosa PA01
cgggcgaggcuaacgccgaggau

SEQ ID NO: 3413414 - RNA, 13 nt, Pseudomonas aeruginosa PA01
cgggcgagggcgg

SEQ ID NO: 3413415 - RNA, 20 nt, Pseudomonas aeruginosa PA01
cgggcgagggcggcgcgggc

SEQ ID NO: 3413416 - RNA, 15 nt, Pseudomonas aeruginosa PA01
cgggcgaggucgcca

SEQ ID NO: 3413417 - RNA, 20 nt, Pseudomonas aeruginosa PA01
cgggcgaggucgccacgcag

SEQ ID NO: 3413418 - RNA, 21 nt, Pseudomonas aeruginosa PA01
cgggcgaggucgccacgcagu

SEQ ID NO: 3413419 - RNA, 14 nt, Pseudomonas aeruginosa PA01
cgggcgagucgauc

SEQ ID NO: 3413420 - RNA, 18 nt, Pseudomonas aeruginosa PA01
cgggcgaucuccucgauc

SEQ ID NO: 3413421 - RNA, 21 nt, Pseudomonas aeruginosa PA01
cgggcgaucuccucgauccgc

SEQ ID NO: 3413422 - RNA, 22 nt, Pseudomonas aeruginosa PA01
cgggcgaugaggcuguccagca

SEQ ID NO: 3413423 - RNA, 15 nt, Pseudomonas aeruginosa PA01
cgggcgcaacccugc

SEQ ID NO: 3413424 - RNA, 20 nt, Pseudomonas aeruginosa PA01
cgggcgcaacccugcccagu

SEQ ID NO: 3413425 - RNA, 17 nt, Pseudomonas aeruginosa PA01
cgggcgcaagcccaagg

SEQ ID NO: 3413426 - RNA, 12 nt, Pseudomonas aeruginosa PA01
cgggcgccaccg

SEQ ID NO: 3413427 - RNA, 13 nt, Pseudomonas aeruginosa PA01
cgggcgccaccga

SEQ ID NO: 3413428 - RNA, 17 nt, Pseudomonas aeruginosa PA01
cgggcgccaccgauagc

SEQ ID NO: 3413429 - RNA, 12 nt, Pseudomonas aeruginosa PA01
cgggcgccaggg

SEQ ID NO: 3413430 - RNA, 15 nt, Pseudomonas aeruginosa PA01
cgggcgccaucgcuu

SEQ ID NO: 3413431 - RNA, 14 nt, Pseudomonas aeruginosa PA01
cgggcgccgcgccu

SEQ ID NO: 3413432 - RNA, 15 nt, Pseudomonas aeruginosa PA01
cgggcgccgcgccuu

SEQ ID NO: 3413433 - RNA, 15 nt, Pseudomonas aeruginosa PA01
cgggcgccguggauc

SEQ ID NO: 3413434 - RNA, 19 nt, Pseudomonas aeruginosa PA01
cgggcgccguggaucgccc

SEQ ID NO: 3413435 - RNA, 21 nt, Pseudomonas aeruginosa PA01
cgggcgccguggaucgcccgg

SEQ ID NO: 3413436 - RNA, 20 nt, Pseudomonas aeruginosa PA01
cgggcgccuuuuucauggcc

SEQ ID NO: 3413437 - RNA, 21 nt, Pseudomonas aeruginosa PA01
cgggcgccuuuuucauggccu

SEQ ID NO: 3413438 - RNA, 22 nt, Pseudomonas aeruginosa PA01
cgggcgccuuuuuucauccugc

SEQ ID NO: 3413439 - RNA, 19 nt, Pseudomonas aeruginosa PA01
cgggcgcgaggcgcccgcc

SEQ ID NO: 3413440 - RNA, 21 nt, Pseudomonas aeruginosa PA01
cgggcgcgaggcgcccgccgg

SEQ ID NO: 3413441 - RNA, 23 nt, Pseudomonas aeruginosa PA01
cgggcgcgaggcgcccgccggcc

SEQ ID NO: 3413442 - RNA, 13 nt, Pseudomonas aeruginosa PA01
cgggcgcgcgcca

SEQ ID NO: 3413443 - RNA, 18 nt, Pseudomonas aeruginosa PA01
cgggcgcgcgccaccgcc

SEQ ID NO: 3413444 - RNA, 20 nt, Pseudomonas aeruginosa PA01
cgggcgcgcgccaccgccug

SEQ ID NO: 3413445 - RNA, 13 nt, Pseudomonas aeruginosa PA01
cgggcgcgcgccu

SEQ ID NO: 3413446 - RNA, 14 nt, Pseudomonas aeruginosa PA01
cgggcgcgcgccuc

SEQ ID NO: 3413447 - RNA, 16 nt, Pseudomonas aeruginosa PA01
cgggcgcggcuggugc

SEQ ID NO: 3413448 - RNA, 22 nt, Pseudomonas aeruginosa PA01
cgggcgcucaugaaaaagcccc

SEQ ID NO: 3413449 - RNA, 16 nt, Pseudomonas aeruginosa PA01
cgggcgcucuggccgc

SEQ ID NO: 3413450 - RNA, 19 nt, Pseudomonas aeruginosa PA01
cgggcgcucuggccgcgcu

SEQ ID NO: 3413451 - RNA, 20 nt, Pseudomonas aeruginosa PA01
cgggcgcucuggccgcgcuc

SEQ ID NO: 3413452 - RNA, 11 nt, Pseudomonas aeruginosa PA01
cgggcgcugca

SEQ ID NO: 3413453 - RNA, 16 nt, Pseudomonas aeruginosa PA01
cgggcgcugcaugggc

SEQ ID NO: 3413454 - RNA, 20 nt, Pseudomonas aeruginosa PA01
cgggcgcugcaugggcucgc

SEQ ID NO: 3413455 - RNA, 22 nt, Pseudomonas aeruginosa PA01
cgggcgcugcaugggcucgcgc

SEQ ID NO: 3413456 - RNA, 14 nt, Pseudomonas aeruginosa PA01
cgggcgcuuccggc

SEQ ID NO: 3413457 - RNA, 16 nt, Pseudomonas aeruginosa PA01
cgggcggacgcugggc

SEQ ID NO: 3413458 - RNA, 13 nt, Pseudomonas aeruginosa PA01
cgggcggaggcga

SEQ ID NO: 3413459 - RNA, 15 nt, Pseudomonas aeruginosa PA01
cgggcggaggcgagg

SEQ ID NO: 3413460 - RNA, 19 nt, Pseudomonas aeruginosa PA01
cgggcggaucagcucgauc

SEQ ID NO: 3413461 - RNA, 17 nt, Pseudomonas aeruginosa PA01
cgggcggaucgagcagc

SEQ ID NO: 3413462 - RNA, 19 nt, Pseudomonas aeruginosa PA01
cgggcggaucgagcagcgg

SEQ ID NO: 3413463 - RNA, 23 nt, Pseudomonas aeruginosa PA01
cgggcggaucgccaaccaguagg

SEQ ID NO: 3413464 - RNA, 14 nt, Pseudomonas aeruginosa PA01
cgggcggcaagggc

SEQ ID NO: 3413465 - RNA, 20 nt, Pseudomonas aeruginosa PA01
cgggcggcaagggcacgugc

SEQ ID NO: 3413466 - RNA, 14 nt, Pseudomonas aeruginosa PA01
cgggcggcaggcgc

SEQ ID NO: 3413467 - RNA, 16 nt, Pseudomonas aeruginosa PA01
cgggcggcaggcgccg

SEQ ID NO: 3413468 - RNA, 19 nt, Pseudomonas aeruginosa PA01
cgggcggcaggcgccggcc

SEQ ID NO: 3413469 - RNA, 12 nt, Pseudomonas aeruginosa PA01
cgggcggccgac

SEQ ID NO: 3413470 - RNA, 13 nt, Pseudomonas aeruginosa PA01
cgggcggccgacg

SEQ ID NO: 3413471 - RNA, 18 nt, Pseudomonas aeruginosa PA01
cgggcggccucgauggcg

SEQ ID NO: 3413472 - RNA, 15 nt, Pseudomonas aeruginosa PA01
cgggcggcgcggcgc

SEQ ID NO: 3413473 - RNA, 14 nt, Pseudomonas aeruginosa PA01
cgggcggcggcgcu

SEQ ID NO: 3413474 - RNA, 14 nt, Pseudomonas aeruginosa PA01
cgggcggcuguagc

SEQ ID NO: 3413475 - RNA, 21 nt, Pseudomonas aeruginosa PA01
cgggcggcuuuuuucauggcg

SEQ ID NO: 3413476 - RNA, 16 nt, Pseudomonas aeruginosa PA01
cgggcgggacucgccg

SEQ ID NO: 3413477 - RNA, 18 nt, Pseudomonas aeruginosa PA01
cgggcgggaucaggucgc

SEQ ID NO: 3413478 - RNA, 17 nt, Pseudomonas aeruginosa PA01
cgggcgggucuggcgga

SEQ ID NO: 3413479 - RNA, 20 nt, Pseudomonas aeruginosa PA01
cgggcgggucuggcggaaca

SEQ ID NO: 3413480 - RNA, 17 nt, Pseudomonas aeruginosa PA01
cgggcgguacaggcgca

SEQ ID NO: 3413481 - RNA, 18 nt, Pseudomonas aeruginosa PA01
cgggcgguagcgggccag

SEQ ID NO: 3413482 - RNA, 21 nt, Pseudomonas aeruginosa PA01
cgggcgguagcgggccagcag

SEQ ID NO: 3413483 - RNA, 14 nt, Pseudomonas aeruginosa PA01
cgggcggucgaggc

SEQ ID NO: 3413484 - RNA, 18 nt, Pseudomonas aeruginosa PA01
cgggcggucgaggcccuc

SEQ ID NO: 3413485 - RNA, 21 nt, Pseudomonas aeruginosa PA01
cgggcguaacggcucgccggg

SEQ ID NO: 3413486 - RNA, 13 nt, Pseudomonas aeruginosa PA01
cgggcguagcgcg

SEQ ID NO: 3413487 - RNA, 19 nt, Pseudomonas aeruginosa PA01
cgggcguagcgcggcagcg

SEQ ID NO: 3413488 - RNA, 15 nt, Pseudomonas aeruginosa PA01
cgggcguagggcgaa

SEQ ID NO: 3413489 - RNA, 13 nt, Pseudomonas aeruginosa PA01
cgggcguccggcg

SEQ ID NO: 3413490 - RNA, 14 nt, Pseudomonas aeruginosa PA01
cgggcguccggcga

SEQ ID NO: 3413491 - RNA, 16 nt, Pseudomonas aeruginosa PA01
cgggcguccggcgagc

SEQ ID NO: 3413492 - RNA, 21 nt, Pseudomonas aeruginosa PA01
cgggcgucggcgucggcugcg

SEQ ID NO: 3413493 - RNA, 14 nt, Pseudomonas aeruginosa PA01
cgggcgucgucggg

SEQ ID NO: 3413494 - RNA, 22 nt, Pseudomonas aeruginosa PA01
cgggcgucgucggggugccgcc

SEQ ID NO: 3413495 - RNA, 18 nt, Pseudomonas aeruginosa PA01
cgggcgucuccugccgcc

SEQ ID NO: 3413496 - RNA, 20 nt, Pseudomonas aeruginosa PA01
cgggcgucuccugccgccga

SEQ ID NO: 3413497 - RNA, 23 nt, Pseudomonas aeruginosa PA01
cgggcgucugcucauucggccag

SEQ ID NO: 3413498 - RNA, 16 nt, Pseudomonas aeruginosa PA01
cgggcgugcuccagca

SEQ ID NO: 3413499 - RNA, 17 nt, Pseudomonas aeruginosa PA01
cgggcgugcuccagcac

SEQ ID NO: 3413500 - RNA, 13 nt, Pseudomonas aeruginosa PA01
cgggcguggggcg

SEQ ID NO: 3413501 - RNA, 15 nt, Pseudomonas aeruginosa PA01
cgggcguggggcgaa

SEQ ID NO: 3413502 - RNA, 15 nt, Pseudomonas aeruginosa PA01
cgggcgugucgagga

SEQ ID NO: 3413503 - RNA, 19 nt, Pseudomonas aeruginosa PA01
cgggcgugucgaggaaggc

SEQ ID NO: 3413504 - RNA, 22 nt, Pseudomonas aeruginosa PA01
cgggcgugucgaggaaggccag

SEQ ID NO: 3413505 - RNA, 15 nt, Pseudomonas aeruginosa PA01
cgggcguugccggca

SEQ ID NO: 3413506 - RNA, 16 nt, Pseudomonas aeruginosa PA01
cgggcguugccggcau

SEQ ID NO: 3413507 - RNA, 14 nt, Pseudomonas aeruginosa PA01
cgggcguugcgcgc

SEQ ID NO: 3413508 - RNA, 16 nt, Pseudomonas aeruginosa PA01
cgggcguugcgcgccu

SEQ ID NO: 3413509 - RNA, 23 nt, Pseudomonas aeruginosa PA01
cgggcguugcgcgccucgcccca

SEQ ID NO: 3413510 - RNA, 16 nt, Pseudomonas aeruginosa PA01
cgggcguuggcuccgg

SEQ ID NO: 3413511 - RNA, 22 nt, Pseudomonas aeruginosa PA01
cgggcguuggcuccgggccgag

SEQ ID NO: 3413512 - RNA, 16 nt, Pseudomonas aeruginosa PA01
cgggcguugguacagc

SEQ ID NO: 3413513 - RNA, 20 nt, Pseudomonas aeruginosa PA01
cgggcguugguacagcucgc

SEQ ID NO: 3413514 - RNA, 22 nt, Pseudomonas aeruginosa PA01
cgggcguugguacagcucgcgc

SEQ ID NO: 3413515 - RNA, 21 nt, Pseudomonas aeruginosa PA01
cgggcguuuucguugccgcgc

SEQ ID NO: 3413516 - RNA, 22 nt, Pseudomonas aeruginosa PA01
cgggcguuuucguugccgcgcu

SEQ ID NO: 3413517 - RNA, 23 nt, Pseudomonas aeruginosa PA01
cgggcguuuucguugccgcgcuc

SEQ ID NO: 3413518 - RNA, 19 nt, Pseudomonas aeruginosa PA01
cgggcguuuucguuggcgc

SEQ ID NO: 3413519 - RNA, 22 nt, Pseudomonas aeruginosa PA01
cgggcguuuucguuggcgcgac

SEQ ID NO: 3413520 - RNA, 22 nt, Pseudomonas aeruginosa PA01
cgggcguuuucguuggcggcca

SEQ ID NO: 3413521 - RNA, 22 nt, Pseudomonas aeruginosa PA01
cgggcucacauuaauugcgagc

SEQ ID NO: 3413522 - RNA, 13 nt, Pseudomonas aeruginosa PA01
cgggcucacuccc

SEQ ID NO: 3413523 - RNA, 13 nt, Pseudomonas aeruginosa PA01
cgggcuccgccgc

SEQ ID NO: 3413524 - RNA, 15 nt, Pseudomonas aeruginosa PA01
cgggcuccgccgccg

SEQ ID NO: 3413525 - RNA, 17 nt, Pseudomonas aeruginosa PA01
cgggcuccgccgcgagc

SEQ ID NO: 3413526 - RNA, 20 nt, Pseudomonas aeruginosa PA01
cgggcucgcaaucagcgcga

SEQ ID NO: 3413527 - RNA, 12 nt, Pseudomonas aeruginosa PA01
cgggcucgccca

SEQ ID NO: 3413528 - RNA, 15 nt, Pseudomonas aeruginosa PA01
cgggcucgcccaucu

SEQ ID NO: 3413529 - RNA, 17 nt, Pseudomonas aeruginosa PA01
cgggcucuaugcgcggg

SEQ ID NO: 3413530 - RNA, 21 nt, Pseudomonas aeruginosa PA01
cgggcucugugcuuugcccgu

SEQ ID NO: 3413531 - RNA, 14 nt, Pseudomonas aeruginosa PA01
cgggcugccagcau

SEQ ID NO: 3413532 - RNA, 13 nt, Pseudomonas aeruginosa PA01
cgggcugccccuc

SEQ ID NO: 3413533 - RNA, 21 nt, Pseudomonas aeruginosa PA01
cgggcugccccucacaccacc

SEQ ID NO: 3413534 - RNA, 22 nt, Pseudomonas aeruginosa PA01
cgggcugccccucacaccacca

SEQ ID NO: 3413535 - RNA, 22 nt, Pseudomonas aeruginosa PA01
cgggcugccgcggaagugcgcc

SEQ ID NO: 3413536 - RNA, 18 nt, Pseudomonas aeruginosa PA01
cgggcugcgcucggcgcu

SEQ ID NO: 3413537 - RNA, 16 nt, Pseudomonas aeruginosa PA01
cgggcugcgugccagc

SEQ ID NO: 3413538 - RNA, 17 nt, Pseudomonas aeruginosa PA01
cgggcugcgugccagca

SEQ ID NO: 3413539 - RNA, 19 nt, Pseudomonas aeruginosa PA01
cgggcugcgugccagcacc

SEQ ID NO: 3413540 - RNA, 20 nt, Pseudomonas aeruginosa PA01
cgggcugcgugccagcaccu

SEQ ID NO: 3413541 - RNA, 19 nt, Pseudomonas aeruginosa PA01
cgggcuggaaaacgccaca

SEQ ID NO: 3413542 - RNA, 16 nt, Pseudomonas aeruginosa PA01
cgggcuggccaccgcc

SEQ ID NO: 3413543 - RNA, 22 nt, Pseudomonas aeruginosa PA01
cgggcuggccaccgggaucagc

SEQ ID NO: 3413544 - RNA, 20 nt, Pseudomonas aeruginosa PA01
cgggcuggucguagcagcgg

SEQ ID NO: 3413545 - RNA, 19 nt, Pseudomonas aeruginosa PA01
cgggcugguucagcggguu

SEQ ID NO: 3413546 - RNA, 23 nt, Pseudomonas aeruginosa PA01
cgggcuguagugcuccggggcgc

SEQ ID NO: 3413547 - RNA, 15 nt, Pseudomonas aeruginosa PA01
cgggcuucagcgccg

SEQ ID NO: 3413548 - RNA, 17 nt, Pseudomonas aeruginosa PA01
cgggcuucagcgccggg

SEQ ID NO: 3413549 - RNA, 21 nt, Pseudomonas aeruginosa PA01
cgggcuucagcgccgggucga

SEQ ID NO: 3413550 - RNA, 13 nt, Pseudomonas aeruginosa PA01
cgggcuucgcgac

SEQ ID NO: 3413551 - RNA, 14 nt, Pseudomonas aeruginosa PA01
cgggcuucggcagc

SEQ ID NO: 3413552 - RNA, 19 nt, Pseudomonas aeruginosa PA01
cgggcuucgguguaucggc

SEQ ID NO: 3413553 - RNA, 22 nt, Pseudomonas aeruginosa PA01
cgggcuucgguguaucggcgga

SEQ ID NO: 3413554 - RNA, 24 nt, Pseudomonas aeruginosa PA01
cgggcuucuucaccaggccgaacg

SEQ ID NO: 3413555 - RNA, 23 nt, Pseudomonas aeruginosa PA01
cgggcuuuuucauggcuggcccu

SEQ ID NO: 3413556 - RNA, 23 nt, Pseudomonas aeruginosa PA01
cgggcuuuuucaugggcgcgcgc

SEQ ID NO: 3413557 - RNA, 20 nt, Pseudomonas aeruginosa PA01
cgggcuuuuucauuuccgca

SEQ ID NO: 3413558 - RNA, 22 nt, Pseudomonas aeruginosa PA01
cgggcuuuuucauuuccgcagg

SEQ ID NO: 3413559 - RNA, 23 nt, Pseudomonas aeruginosa PA01
cgggcuuuuucauuuccuccgag

SEQ ID NO: 3413560 - RNA, 20 nt, Pseudomonas aeruginosa PA01
cgggcuuuuucguuggccag

SEQ ID NO: 3413561 - RNA, 20 nt, Pseudomonas aeruginosa PA01
cgggcuuuuucucgucgcgc

SEQ ID NO: 3413562 - RNA, 23 nt, Pseudomonas aeruginosa PA01
cggggaaacccucaggucggcgc

SEQ ID NO: 3413563 - RNA, 19 nt, Pseudomonas aeruginosa PA01
cggggaaagcuccucggcc

SEQ ID NO: 3413564 - RNA, 13 nt, Pseudomonas aeruginosa PA01
cggggaacacgcg

SEQ ID NO: 3413565 - RNA, 16 nt, Pseudomonas aeruginosa PA01
cggggaacacgcgcug

SEQ ID NO: 3413566 - RNA, 13 nt, Pseudomonas aeruginosa PA01
cggggaacagcau

SEQ ID NO: 3413567 - RNA, 14 nt, Pseudomonas aeruginosa PA01
cggggaacagcgcc

SEQ ID NO: 3413568 - RNA, 17 nt, Pseudomonas aeruginosa PA01
cggggaacagcgccagc

SEQ ID NO: 3413569 - RNA, 21 nt, Pseudomonas aeruginosa PA01
cggggaacagcgccagcggca

SEQ ID NO: 3413570 - RNA, 17 nt, Pseudomonas aeruginosa PA01
cggggaaccacaccugc

SEQ ID NO: 3413571 - RNA, 22 nt, Pseudomonas aeruginosa PA01
cggggaagcgcggcucggggau

SEQ ID NO: 3413572 - RNA, 19 nt, Pseudomonas aeruginosa PA01
cggggaagcugccuuccag

SEQ ID NO: 3413573 - RNA, 21 nt, Pseudomonas aeruginosa PA01
cggggaagcugccuuccagca

SEQ ID NO: 3413574 - RNA, 16 nt, Pseudomonas aeruginosa PA01
cggggaauuuccggca

SEQ ID NO: 3413575 - RNA, 21 nt, Pseudomonas aeruginosa PA01
cggggaauuuccggcaacagg

SEQ ID NO: 3413576 - RNA, 14 nt, Pseudomonas aeruginosa PA01
cggggacgcugucc

SEQ ID NO: 3413577 - RNA, 18 nt, Pseudomonas aeruginosa PA01
cggggacgcugucccggc

SEQ ID NO: 3413578 - RNA, 14 nt, Pseudomonas aeruginosa PA01
cggggagaggggcu

SEQ ID NO: 3413579 - RNA, 21 nt, Pseudomonas aeruginosa PA01
cggggaguucgacccaugccg

SEQ ID NO: 3413580 - RNA, 11 nt, Pseudomonas aeruginosa PA01
cggggaucacu

SEQ ID NO: 3413581 - RNA, 15 nt, Pseudomonas aeruginosa PA01
cggggaucagcgaga

SEQ ID NO: 3413582 - RNA, 18 nt, Pseudomonas aeruginosa PA01
cggggaucaggucgccgc

SEQ ID NO: 3413583 - RNA, 19 nt, Pseudomonas aeruginosa PA01
cggggaugaccguccgguc

SEQ ID NO: 3413584 - RNA, 22 nt, Pseudomonas aeruginosa PA01
cggggaugaccguccggucgcu

SEQ ID NO: 3413585 - RNA, 13 nt, Pseudomonas aeruginosa PA01
cggggauggcggg

SEQ ID NO: 3413586 - RNA, 14 nt, Pseudomonas aeruginosa PA01
cggggauguccgcc

SEQ ID NO: 3413587 - RNA, 18 nt, Pseudomonas aeruginosa PA01
cggggauguccgccgccc

SEQ ID NO: 3413588 - RNA, 16 nt, Pseudomonas aeruginosa PA01
cggggcagaacacccg

SEQ ID NO: 3413589 - RNA, 16 nt, Pseudomonas aeruginosa PA01
cggggcagcagggcgu

SEQ ID NO: 3413590 - RNA, 18 nt, Pseudomonas aeruginosa PA01
cggggcaggcaugcggcc

SEQ ID NO: 3413591 - RNA, 14 nt, Pseudomonas aeruginosa PA01
cggggcaggcgcag

SEQ ID NO: 3413592 - RNA, 23 nt, Pseudomonas aeruginosa PA01
cggggcaggcgcaggcgaacugc

SEQ ID NO: 3413593 - RNA, 17 nt, Pseudomonas aeruginosa PA01
cggggcauucguccagc

SEQ ID NO: 3413594 - RNA, 18 nt, Pseudomonas aeruginosa PA01
cggggcauucguccagcc

SEQ ID NO: 3413595 - RNA, 21 nt, Pseudomonas aeruginosa PA01
cggggcauucguccagccgcc

SEQ ID NO: 3413596 - RNA, 22 nt, Pseudomonas aeruginosa PA01
cggggcauucguccagccgccg

SEQ ID NO: 3413597 - RNA, 16 nt, Pseudomonas aeruginosa PA01
cggggccccggcaagg

SEQ ID NO: 3413598 - RNA, 15 nt, Pseudomonas aeruginosa PA01
cggggccccucgccg

SEQ ID NO: 3413599 - RNA, 14 nt, Pseudomonas aeruginosa PA01
cggggcccggcagg

SEQ ID NO: 3413600 - RNA, 17 nt, Pseudomonas aeruginosa PA01
cggggcccggcaggcag

SEQ ID NO: 3413601 - RNA, 18 nt, Pseudomonas aeruginosa PA01
cggggcccggcaggcagu

SEQ ID NO: 3413602 - RNA, 18 nt, Pseudomonas aeruginosa PA01
cggggcccggcuccagcc

SEQ ID NO: 3413603 - RNA, 20 nt, Pseudomonas aeruginosa PA01
cggggcccggcuccagccgg

SEQ ID NO: 3413604 - RNA, 21 nt, Pseudomonas aeruginosa PA01
cggggccgaggucgaccagcc

SEQ ID NO: 3413605 - RNA, 17 nt, Pseudomonas aeruginosa PA01
cggggccggacgcgacu

SEQ ID NO: 3413606 - RNA, 15 nt, Pseudomonas aeruginosa PA01
cggggccggcgaugc

SEQ ID NO: 3413607 - RNA, 15 nt, Pseudomonas aeruginosa PA01
cggggccuacugcug

SEQ ID NO: 3413608 - RNA, 22 nt, Pseudomonas aeruginosa PA01
cggggccuacugcuggacggcg

SEQ ID NO: 3413609 - RNA, 17 nt, Pseudomonas aeruginosa PA01
cggggccucgcugccug

SEQ ID NO: 3413610 - RNA, 13 nt, Pseudomonas aeruginosa PA01
cggggcgaccagc

SEQ ID NO: 3413611 - RNA, 14 nt, Pseudomonas aeruginosa PA01
cggggcgaggucgg

SEQ ID NO: 3413612 - RNA, 19 nt, Pseudomonas aeruginosa PA01
cggggcgaucuugaucgcc

SEQ ID NO: 3413613 - RNA, 12 nt, Pseudomonas aeruginosa PA01
cggggcgcaagg

SEQ ID NO: 3413614 - RNA, 17 nt, Pseudomonas aeruginosa PA01
cggggcgcaaggccagc

SEQ ID NO: 3413615 - RNA, 19 nt, Pseudomonas aeruginosa PA01
cggggcgcaaggccagcgg

SEQ ID NO: 3413616 - RNA, 21 nt, Pseudomonas aeruginosa PA01
cggggcgcaaggccagcggca

SEQ ID NO: 3413617 - RNA, 21 nt, Pseudomonas aeruginosa PA01
cggggcgcaccgccucgaccc

SEQ ID NO: 3413618 - RNA, 14 nt, Pseudomonas aeruginosa PA01
cggggcgcagcagg

SEQ ID NO: 3413619 - RNA, 15 nt, Pseudomonas aeruginosa PA01
cggggcgcagcagga

SEQ ID NO: 3413620 - RNA, 18 nt, Pseudomonas aeruginosa PA01
cggggcgcaggucgcugg

SEQ ID NO: 3413621 - RNA, 19 nt, Pseudomonas aeruginosa PA01
cggggcgccgcgcggcgcc

SEQ ID NO: 3413622 - RNA, 22 nt, Pseudomonas aeruginosa PA01
cggggcgccgcgcggcgccccg

SEQ ID NO: 3413623 - RNA, 17 nt, Pseudomonas aeruginosa PA01
cggggcgccuccagcgg

SEQ ID NO: 3413624 - RNA, 22 nt, Pseudomonas aeruginosa PA01
cggggcgccuccagcgggccuu

SEQ ID NO: 3413625 - RNA, 12 nt, Pseudomonas aeruginosa PA01
cggggcgcgcug

SEQ ID NO: 3413626 - RNA, 24 nt, Pseudomonas aeruginosa PA01
cggggcgcgcugcgaaucgucgcc

SEQ ID NO: 3413627 - RNA, 19 nt, Pseudomonas aeruginosa PA01
cggggcgcgggcgaagcgc

SEQ ID NO: 3413628 - RNA, 22 nt, Pseudomonas aeruginosa PA01
cggggcgcuguuggccugggcg

SEQ ID NO: 3413629 - RNA, 12 nt, Pseudomonas aeruginosa PA01
cggggcggcgca

SEQ ID NO: 3413630 - RNA, 18 nt, Pseudomonas aeruginosa PA01
cggggcggcgcaucggcg

SEQ ID NO: 3413631 - RNA, 17 nt, Pseudomonas aeruginosa PA01
cggggcggcgucccggc

SEQ ID NO: 3413632 - RNA, 12 nt, Pseudomonas aeruginosa PA01
cggggcgggccg

SEQ ID NO: 3413633 - RNA, 18 nt, Pseudomonas aeruginosa PA01
cggggcguauagcccggg

SEQ ID NO: 3413634 - RNA, 14 nt, Pseudomonas aeruginosa PA01
cggggcgugcaggc

SEQ ID NO: 3413635 - RNA, 16 nt, Pseudomonas aeruginosa PA01
cggggcgugcaggccg

SEQ ID NO: 3413636 - RNA, 22 nt, Pseudomonas aeruginosa PA01
cggggcguuuuucauggcggca

SEQ ID NO: 3413637 - RNA, 13 nt, Pseudomonas aeruginosa PA01
cggggcuccccug

SEQ ID NO: 3413638 - RNA, 14 nt, Pseudomonas aeruginosa PA01
cggggcucugccgg

SEQ ID NO: 3413639 - RNA, 17 nt, Pseudomonas aeruginosa PA01
cggggcuuuuucauucu

SEQ ID NO: 3413640 - RNA, 21 nt, Pseudomonas aeruginosa PA01
cggggcuuuuucguuuccggc

SEQ ID NO: 3413641 - RNA, 14 nt, Pseudomonas aeruginosa PA01
cgggggcuccaggg

SEQ ID NO: 3413642 - RNA, 14 nt, Pseudomonas aeruginosa PA01
cgggggucgcggcg

SEQ ID NO: 3413643 - RNA, 19 nt, Pseudomonas aeruginosa PA01
cgggguagggguggccagg

SEQ ID NO: 3413644 - RNA, 21 nt, Pseudomonas aeruginosa PA01
cggggucagagggugaucagc

SEQ ID NO: 3413645 - RNA, 13 nt, Pseudomonas aeruginosa PA01
cggggucagcgcc

SEQ ID NO: 3413646 - RNA, 13 nt, Pseudomonas aeruginosa PA01
cggggucaggccg

SEQ ID NO: 3413647 - RNA, 15 nt, Pseudomonas aeruginosa PA01
cggggucaggccgag

SEQ ID NO: 3413648 - RNA, 18 nt, Pseudomonas aeruginosa PA01
cggggucaguuccagguc

SEQ ID NO: 3413649 - RNA, 13 nt, Pseudomonas aeruginosa PA01
cggggucgcgccg

SEQ ID NO: 3413650 - RNA, 16 nt, Pseudomonas aeruginosa PA01
cggggucgcgccggug

SEQ ID NO: 3413651 - RNA, 17 nt, Pseudomonas aeruginosa PA01
cggggucgcgccggugg

SEQ ID NO: 3413652 - RNA, 15 nt, Pseudomonas aeruginosa PA01
cggggucggccugcg

SEQ ID NO: 3413653 - RNA, 19 nt, Pseudomonas aeruginosa PA01
cggggucuggccggcgauc

SEQ ID NO: 3413654 - RNA, 21 nt, Pseudomonas aeruginosa PA01
cggggucuggccggcgaucag

SEQ ID NO: 3413655 - RNA, 19 nt, Pseudomonas aeruginosa PA01
cggggucuuuaccguggaa

SEQ ID NO: 3413656 - RNA, 22 nt, Pseudomonas aeruginosa PA01
cggggugaucacccagagcacc

SEQ ID NO: 3413657 - RNA, 15 nt, Pseudomonas aeruginosa PA01
cggggugauccagcu

SEQ ID NO: 3413658 - RNA, 19 nt, Pseudomonas aeruginosa PA01
cggggugauuuacaggacu

SEQ ID NO: 3413659 - RNA, 11 nt, Pseudomonas aeruginosa PA01
cggggugcagg

SEQ ID NO: 3413660 - RNA, 13 nt, Pseudomonas aeruginosa PA01
cggggugcagggg

SEQ ID NO: 3413661 - RNA, 18 nt, Pseudomonas aeruginosa PA01
cggggugcauagggucca

SEQ ID NO: 3413662 - RNA, 13 nt, Pseudomonas aeruginosa PA01
cggggugccgcca

SEQ ID NO: 3413663 - RNA, 15 nt, Pseudomonas aeruginosa PA01
cggggugccgccagu

SEQ ID NO: 3413664 - RNA, 20 nt, Pseudomonas aeruginosa PA01
cggggugccgccagucggcc

SEQ ID NO: 3413665 - RNA, 18 nt, Pseudomonas aeruginosa PA01
cggggugcgcggcgaagg

SEQ ID NO: 3413666 - RNA, 13 nt, Pseudomonas aeruginosa PA01
cggggugcgcugg

SEQ ID NO: 3413667 - RNA, 18 nt, Pseudomonas aeruginosa PA01
cgggguggaguaccaggc

SEQ ID NO: 3413668 - RNA, 17 nt, Pseudomonas aeruginosa PA01
cgggguggccgugcagc

SEQ ID NO: 3413669 - RNA, 19 nt, Pseudomonas aeruginosa PA01
cgggguggccgugcagccc

SEQ ID NO: 3413670 - RNA, 22 nt, Pseudomonas aeruginosa PA01
cgggguggccgugcagcccucg

SEQ ID NO: 3413671 - RNA, 14 nt, Pseudomonas aeruginosa PA01
cgggguggcgaagg

SEQ ID NO: 3413672 - RNA, 13 nt, Pseudomonas aeruginosa PA01
cgggguggcgcgg

SEQ ID NO: 3413673 - RNA, 15 nt, Pseudomonas aeruginosa PA01
cgggguucgacccgc

SEQ ID NO: 3413674 - RNA, 19 nt, Pseudomonas aeruginosa PA01
cgggguucgacccgcacuu

SEQ ID NO: 3413675 - RNA, 16 nt, Pseudomonas aeruginosa PA01
cgggguucgacgcgcc

SEQ ID NO: 3413676 - RNA, 20 nt, Pseudomonas aeruginosa PA01
cgggguugaguugcaggccg

SEQ ID NO: 3413677 - RNA, 21 nt, Pseudomonas aeruginosa PA01
cgggguugaguugcaggccgg

SEQ ID NO: 3413678 - RNA, 17 nt, Pseudomonas aeruginosa PA01
cgggguugcccagcagg

SEQ ID NO: 3413679 - RNA, 17 nt, Pseudomonas aeruginosa PA01
cgggguuggcgcugacc

SEQ ID NO: 3413680 - RNA, 21 nt, Pseudomonas aeruginosa PA01
cgggguuuuuuuugccuggaa

SEQ ID NO: 3413681 - RNA, 15 nt, Pseudomonas aeruginosa PA01
cggguaaagcgcccg

SEQ ID NO: 3413682 - RNA, 21 nt, Pseudomonas aeruginosa PA01
cggguaaagcgcccgcgcaug

SEQ ID NO: 3413683 - RNA, 14 nt, Pseudomonas aeruginosa PA01
cggguacagcgcca

SEQ ID NO: 3413684 - RNA, 15 nt, Pseudomonas aeruginosa PA01
cggguacagcgccac

SEQ ID NO: 3413685 - RNA, 20 nt, Pseudomonas aeruginosa PA01
cggguacagcgccacggcca

SEQ ID NO: 3413686 - RNA, 23 nt, Pseudomonas aeruginosa PA01
cggguacagcgccacggccagca

SEQ ID NO: 3413687 - RNA, 14 nt, Pseudomonas aeruginosa PA01
cggguaccugcucg

SEQ ID NO: 3413688 - RNA, 15 nt, Pseudomonas aeruginosa PA01
cggguacgcgggccu

SEQ ID NO: 3413689 - RNA, 14 nt, Pseudomonas aeruginosa PA01
cggguacuggcgcu

SEQ ID NO: 3413690 - RNA, 17 nt, Pseudomonas aeruginosa PA01
cggguacuggcgcugcg

SEQ ID NO: 3413691 - RNA, 22 nt, Pseudomonas aeruginosa PA01
cggguacuggcgcugcgcggcg

SEQ ID NO: 3413692 - RNA, 21 nt, Pseudomonas aeruginosa PA01
cggguagagcgcggcgcaggc

SEQ ID NO: 3413693 - RNA, 16 nt, Pseudomonas aeruginosa PA01
cggguagagcgggccg

SEQ ID NO: 3413694 - RNA, 17 nt, Pseudomonas aeruginosa PA01
cggguagagcgggccgu

SEQ ID NO: 3413695 - RNA, 14 nt, Pseudomonas aeruginosa PA01
cggguagagucgcu

SEQ ID NO: 3413696 - RNA, 19 nt, Pseudomonas aeruginosa PA01
cggguagagucgcucgcgc

SEQ ID NO: 3413697 - RNA, 22 nt, Pseudomonas aeruginosa PA01
cggguagaugccacugacgcgc

SEQ ID NO: 3413698 - RNA, 17 nt, Pseudomonas aeruginosa PA01
cggguagccaugcacac

SEQ ID NO: 3413699 - RNA, 19 nt, Pseudomonas aeruginosa PA01
cggguagccaugcacacgc

SEQ ID NO: 3413700 - RNA, 20 nt, Pseudomonas aeruginosa PA01
cggguagcguuaucgccggu

SEQ ID NO: 3413701 - RNA, 13 nt, Pseudomonas aeruginosa PA01
cggguagcugcug

SEQ ID NO: 3413702 - RNA, 15 nt, Pseudomonas aeruginosa PA01
cggguagcugcuggg

SEQ ID NO: 3413703 - RNA, 16 nt, Pseudomonas aeruginosa PA01
cggguaguagaucagc

SEQ ID NO: 3413704 - RNA, 13 nt, Pseudomonas aeruginosa PA01
cggguaguccagc

SEQ ID NO: 3413705 - RNA, 23 nt, Pseudomonas aeruginosa PA01
cggguagucuucgaugcgccgca

SEQ ID NO: 3413706 - RNA, 14 nt, Pseudomonas aeruginosa PA01
cggguauccagcac

SEQ ID NO: 3413707 - RNA, 17 nt, Pseudomonas aeruginosa PA01
cggguauccagcacccg

SEQ ID NO: 3413708 - RNA, 15 nt, Pseudomonas aeruginosa PA01
cggguauccgccggg

SEQ ID NO: 3413709 - RNA, 16 nt, Pseudomonas aeruginosa PA01
cggguauccgccgggc

SEQ ID NO: 3413710 - RNA, 20 nt, Pseudomonas aeruginosa PA01
cggguauccgccgggccgcc

SEQ ID NO: 3413711 - RNA, 21 nt, Pseudomonas aeruginosa PA01
cggguaucgaucucgaucgag

SEQ ID NO: 3413712 - RNA, 22 nt, Pseudomonas aeruginosa PA01
cggguaucgaucucgaucgagu

SEQ ID NO: 3413713 - RNA, 19 nt, Pseudomonas aeruginosa PA01
cggguauucagugaaaggg

SEQ ID NO: 3413714 - RNA, 13 nt, Pseudomonas aeruginosa PA01
cgggucaccaccg

SEQ ID NO: 3413715 - RNA, 16 nt, Pseudomonas aeruginosa PA01
cgggucaccaccggga

SEQ ID NO: 3413716 - RNA, 14 nt, Pseudomonas aeruginosa PA01
cgggucaccagcgg

SEQ ID NO: 3413717 - RNA, 21 nt, Pseudomonas aeruginosa PA01
cgggucaccagcggguaguag

SEQ ID NO: 3413718 - RNA, 14 nt, Pseudomonas aeruginosa PA01
cgggucacgccgag

SEQ ID NO: 3413719 - RNA, 13 nt, Pseudomonas aeruginosa PA01
cgggucagcagca

SEQ ID NO: 3413720 - RNA, 15 nt, Pseudomonas aeruginosa PA01
cgggucagcagcacc

SEQ ID NO: 3413721 - RNA, 21 nt, Pseudomonas aeruginosa PA01
cgggucagcagcaccgcgagc

SEQ ID NO: 3413722 - RNA, 16 nt, Pseudomonas aeruginosa PA01
cgggucagcagugcgg

SEQ ID NO: 3413723 - RNA, 22 nt, Pseudomonas aeruginosa PA01
cgggucagcagugcggggcgcu

SEQ ID NO: 3413724 - RNA, 14 nt, Pseudomonas aeruginosa PA01
cgggucaguccuug

SEQ ID NO: 3413725 - RNA, 16 nt, Pseudomonas aeruginosa PA01
cgggucaucaccggca

SEQ ID NO: 3413726 - RNA, 18 nt, Pseudomonas aeruginosa PA01
cgggucaucaccggcagg

SEQ ID NO: 3413727 - RNA, 15 nt, Pseudomonas aeruginosa PA01
cgggucaucggcccg

SEQ ID NO: 3413728 - RNA, 18 nt, Pseudomonas aeruginosa PA01
cgggucaucggcccgacg

SEQ ID NO: 3413729 - RNA, 20 nt, Pseudomonas aeruginosa PA01
cgggucaucggcccgacgcc

SEQ ID NO: 3413730 - RNA, 16 nt, Pseudomonas aeruginosa PA01
cgggucaugccgccau

SEQ ID NO: 3413731 - RNA, 17 nt, Pseudomonas aeruginosa PA01
cgggucaugccgccauc

SEQ ID NO: 3413732 - RNA, 23 nt, Pseudomonas aeruginosa PA01
cgggucaugccgccaucgaccag

SEQ ID NO: 3413733 - RNA, 13 nt, Pseudomonas aeruginosa PA01
cgggucauuggcg

SEQ ID NO: 3413734 - RNA, 14 nt, Pseudomonas aeruginosa PA01
cgggucauuggcga

SEQ ID NO: 3413735 - RNA, 15 nt, Pseudomonas aeruginosa PA01
cgggucauuggcgaa

SEQ ID NO: 3413736 - RNA, 14 nt, Pseudomonas aeruginosa PA01
cggguccaccgcgg

SEQ ID NO: 3413737 - RNA, 24 nt, Pseudomonas aeruginosa PA01
cggguccaccgcggccucgcuggc

SEQ ID NO: 3413738 - RNA, 13 nt, Pseudomonas aeruginosa PA01
cggguccaggcgc

SEQ ID NO: 3413739 - RNA, 23 nt, Pseudomonas aeruginosa PA01
cggguccaggcgccagagcgcgc

SEQ ID NO: 3413740 - RNA, 20 nt, Pseudomonas aeruginosa PA01
cggguccaucugcaacgcgg

SEQ ID NO: 3413741 - RNA, 19 nt, Pseudomonas aeruginosa PA01
cggguccuggguggcgacg

SEQ ID NO: 3413742 - RNA, 13 nt, Pseudomonas aeruginosa PA01
cgggucgacaugc

SEQ ID NO: 3413743 - RNA, 18 nt, Pseudomonas aeruginosa PA01
cgggucgacaugcaggcc

SEQ ID NO: 3413744 - RNA, 19 nt, Pseudomonas aeruginosa PA01
cgggucgacaugcaggccg

SEQ ID NO: 3413745 - RNA, 24 nt, Pseudomonas aeruginosa PA01
cgggucgacaugcaggccggccuc

SEQ ID NO: 3413746 - RNA, 12 nt, Pseudomonas aeruginosa PA01
cgggucgaccuu

SEQ ID NO: 3413747 - RNA, 13 nt, Pseudomonas aeruginosa PA01
cgggucgaccuug

SEQ ID NO: 3413748 - RNA, 18 nt, Pseudomonas aeruginosa PA01
cgggucgacuucgcacca

SEQ ID NO: 3413749 - RNA, 19 nt, Pseudomonas aeruginosa PA01
cgggucgacuucgcaccag

SEQ ID NO: 3413750 - RNA, 23 nt, Pseudomonas aeruginosa PA01
cgggucgacuucgcaccagccgg

SEQ ID NO: 3413751 - RNA, 17 nt, Pseudomonas aeruginosa PA01
cgggucgagccaggcgu

SEQ ID NO: 3413752 - RNA, 18 nt, Pseudomonas aeruginosa PA01
cgggucgagcuugccgag

SEQ ID NO: 3413753 - RNA, 15 nt, Pseudomonas aeruginosa PA01
cgggucgaggccgaa

SEQ ID NO: 3413754 - RNA, 16 nt, Pseudomonas aeruginosa PA01
cgggucgaggcugccg

SEQ ID NO: 3413755 - RNA, 15 nt, Pseudomonas aeruginosa PA01
cgggucgaggucgag

SEQ ID NO: 3413756 - RNA, 21 nt, Pseudomonas aeruginosa PA01
cgggucgaucaggcgcaugcc

SEQ ID NO: 3413757 - RNA, 15 nt, Pseudomonas aeruginosa PA01
cgggucgauggcugg

SEQ ID NO: 3413758 - RNA, 16 nt, Pseudomonas aeruginosa PA01
cgggucgcagccgagc

SEQ ID NO: 3413759 - RNA, 14 nt, Pseudomonas aeruginosa PA01
cgggucgcagccgg

SEQ ID NO: 3413760 - RNA, 23 nt, Pseudomonas aeruginosa PA01
cgggucgccgcagcccuaggcga

SEQ ID NO: 3413761 - RNA, 14 nt, Pseudomonas aeruginosa PA01
cgggucgcggcugg

SEQ ID NO: 3413762 - RNA, 17 nt, Pseudomonas aeruginosa PA01
cgggucgcggcuggccg

SEQ ID NO: 3413763 - RNA, 21 nt, Pseudomonas aeruginosa PA01
cgggucgcggcuggccgccug

SEQ ID NO: 3413764 - RNA, 19 nt, Pseudomonas aeruginosa PA01
cgggucgcugcucagggcc

SEQ ID NO: 3413765 - RNA, 22 nt, Pseudomonas aeruginosa PA01
cgggucgcugcucagggccgcg

SEQ ID NO: 3413766 - RNA, 13 nt, Pseudomonas aeruginosa PA01
cgggucggcgaag

SEQ ID NO: 3413767 - RNA, 20 nt, Pseudomonas aeruginosa PA01
cgggucggcgaaguccacca

SEQ ID NO: 3413768 - RNA, 23 nt, Pseudomonas aeruginosa PA01
cgggucggcgaaguccaccaggc

SEQ ID NO: 3413769 - RNA, 13 nt, Pseudomonas aeruginosa PA01
cgggucggcggau

SEQ ID NO: 3413770 - RNA, 20 nt, Pseudomonas aeruginosa PA01
cgggucgggcucaugggcga

SEQ ID NO: 3413771 - RNA, 20 nt, Pseudomonas aeruginosa PA01
cgggucgggcuucagcgccg

SEQ ID NO: 3413772 - RNA, 18 nt, Pseudomonas aeruginosa PA01
cgggucggucacgaaggc

SEQ ID NO: 3413773 - RNA, 18 nt, Pseudomonas aeruginosa PA01
cgggucguacaccagaug

SEQ ID NO: 3413774 - RNA, 20 nt, Pseudomonas aeruginosa PA01
cgggucguacaccgcgcggc

SEQ ID NO: 3413775 - RNA, 16 nt, Pseudomonas aeruginosa PA01
cgggucguccuccacc

SEQ ID NO: 3413776 - RNA, 16 nt, Pseudomonas aeruginosa PA01
cgggucgucgaagcgc

SEQ ID NO: 3413777 - RNA, 19 nt, Pseudomonas aeruginosa PA01
cgggucgucgaagcgcagc

SEQ ID NO: 3413778 - RNA, 20 nt, Pseudomonas aeruginosa PA01
cgggucgucgaagcgcagca

SEQ ID NO: 3413779 - RNA, 13 nt, Pseudomonas aeruginosa PA01
cgggucgucgaug

SEQ ID NO: 3413780 - RNA, 13 nt, Pseudomonas aeruginosa PA01
cgggucgucgguc

SEQ ID NO: 3413781 - RNA, 17 nt, Pseudomonas aeruginosa PA01
cgggucgucggucggcc

SEQ ID NO: 3413782 - RNA, 21 nt, Pseudomonas aeruginosa PA01
cgggucgucggucggccagga

SEQ ID NO: 3413783 - RNA, 22 nt, Pseudomonas aeruginosa PA01
cgggucgugcccgagcgacugg

SEQ ID NO: 3413784 - RNA, 18 nt, Pseudomonas aeruginosa PA01
cgggucucgaucagcgcc

SEQ ID NO: 3413785 - RNA, 19 nt, Pseudomonas aeruginosa PA01
cgggucucgaucagcgccg

SEQ ID NO: 3413786 - RNA, 20 nt, Pseudomonas aeruginosa PA01
cgggucucgaucagcgccgg

SEQ ID NO: 3413787 - RNA, 15 nt, Pseudomonas aeruginosa PA01
cgggucugcucggcg

SEQ ID NO: 3413788 - RNA, 16 nt, Pseudomonas aeruginosa PA01
cgggucugcucggcgc

SEQ ID NO: 3413789 - RNA, 16 nt, Pseudomonas aeruginosa PA01
cgggucuucaggccgc

SEQ ID NO: 3413790 - RNA, 17 nt, Pseudomonas aeruginosa PA01
cgggucuucaggccgca

SEQ ID NO: 3413791 - RNA, 14 nt, Pseudomonas aeruginosa PA01
cgggucuugccggu

SEQ ID NO: 3413792 - RNA, 15 nt, Pseudomonas aeruginosa PA01
cgggucuugccgguc

SEQ ID NO: 3413793 - RNA, 21 nt, Pseudomonas aeruginosa PA01
cgggucuugccggucugcugc

SEQ ID NO: 3413794 - RNA, 22 nt, Pseudomonas aeruginosa PA01
cgggucuugccggucugcugcg

SEQ ID NO: 3413795 - RNA, 15 nt, Pseudomonas aeruginosa PA01
cgggucuugcgcagg

SEQ ID NO: 3413796 - RNA, 20 nt, Pseudomonas aeruginosa PA01
cgggucuugcgcagggcggc

SEQ ID NO: 3413797 - RNA, 20 nt, Pseudomonas aeruginosa PA01
cgggugaacucaugcaggcc

SEQ ID NO: 3413798 - RNA, 23 nt, Pseudomonas aeruginosa PA01
cgggugaacucaugcaggccgaa

SEQ ID NO: 3413799 - RNA, 14 nt, Pseudomonas aeruginosa PA01
cgggugaaggucug

SEQ ID NO: 3413800 - RNA, 21 nt, Pseudomonas aeruginosa PA01
cgggugaaggucugguaggcc

SEQ ID NO: 3413801 - RNA, 16 nt, Pseudomonas aeruginosa PA01
cgggugaccgugcggg

SEQ ID NO: 3413802 - RNA, 14 nt, Pseudomonas aeruginosa PA01
cgggugccccaggc

SEQ ID NO: 3413803 - RNA, 16 nt, Pseudomonas aeruginosa PA01
cgggugccggugcggg

SEQ ID NO: 3413804 - RNA, 19 nt, Pseudomonas aeruginosa PA01
cgggugccggugcgggugg

SEQ ID NO: 3413805 - RNA, 18 nt, Pseudomonas aeruginosa PA01
cgggugccuuccgcgccc

SEQ ID NO: 3413806 - RNA, 16 nt, Pseudomonas aeruginosa PA01
cgggugcgcaggcugc

SEQ ID NO: 3413807 - RNA, 13 nt, Pseudomonas aeruginosa PA01
cgggugcggcugg

SEQ ID NO: 3413808 - RNA, 19 nt, Pseudomonas aeruginosa PA01
cgggugcggcuggcgcgcg

SEQ ID NO: 3413809 - RNA, 23 nt, Pseudomonas aeruginosa PA01
cgggugcggcuggcgcgcgcgcu

SEQ ID NO: 3413810 - RNA, 19 nt, Pseudomonas aeruginosa PA01
cgggugcguggugcauccg

SEQ ID NO: 3413811 - RNA, 21 nt, Pseudomonas aeruginosa PA01
cgggugcguggugcauccgcc

SEQ ID NO: 3413812 - RNA, 23 nt, Pseudomonas aeruginosa PA01
cgggugcguggugcauccgccgc

SEQ ID NO: 3413813 - RNA, 15 nt, Pseudomonas aeruginosa PA01
cgggugcuaugcgcc

SEQ ID NO: 3413814 - RNA, 16 nt, Pseudomonas aeruginosa PA01
cgggugcugcggaugg

SEQ ID NO: 3413815 - RNA, 22 nt, Pseudomonas aeruginosa PA01
cgggugcugcggaugggcgacg

SEQ ID NO: 3413816 - RNA, 23 nt, Pseudomonas aeruginosa PA01
cgggugcugcggaugggcgacga

SEQ ID NO: 3413817 - RNA, 18 nt, Pseudomonas aeruginosa PA01
cggguggaacgaggcgac

SEQ ID NO: 3413818 - RNA, 19 nt, Pseudomonas aeruginosa PA01
cggguggauaucgucggga

SEQ ID NO: 3413819 - RNA, 20 nt, Pseudomonas aeruginosa PA01
cggguggcgcugucgccggu

SEQ ID NO: 3413820 - RNA, 17 nt, Pseudomonas aeruginosa PA01
cgggugggacauggaga

SEQ ID NO: 3413821 - RNA, 16 nt, Pseudomonas aeruginosa PA01
cggguggucgccgccc

SEQ ID NO: 3413822 - RNA, 17 nt, Pseudomonas aeruginosa PA01
cggguggucgccgccca

SEQ ID NO: 3413823 - RNA, 18 nt, Pseudomonas aeruginosa PA01
cggguggucgccgcccac

SEQ ID NO: 3413824 - RNA, 12 nt, Pseudomonas aeruginosa PA01
cggguggucuug

SEQ ID NO: 3413825 - RNA, 15 nt, Pseudomonas aeruginosa PA01
cggguguccucgauc

SEQ ID NO: 3413826 - RNA, 16 nt, Pseudomonas aeruginosa PA01
cggguguuucggccgc

SEQ ID NO: 3413827 - RNA, 20 nt, Pseudomonas aeruginosa PA01
cggguguuucggccgcugcc

SEQ ID NO: 3413828 - RNA, 21 nt, Pseudomonas aeruginosa PA01
cggguguuucggccgcugccg

SEQ ID NO: 3413829 - RNA, 17 nt, Pseudomonas aeruginosa PA01
cggguuacuucgccgau

SEQ ID NO: 3413830 - RNA, 18 nt, Pseudomonas aeruginosa PA01
cggguuacuucgccgauc

SEQ ID NO: 3413831 - RNA, 22 nt, Pseudomonas aeruginosa PA01
cggguuacuucgccgaucacca

SEQ ID NO: 3413832 - RNA, 22 nt, Pseudomonas aeruginosa PA01
cggguucagucggccaggcgcc

SEQ ID NO: 3413833 - RNA, 17 nt, Pseudomonas aeruginosa PA01
cggguucccaguugcug

SEQ ID NO: 3413834 - RNA, 15 nt, Pseudomonas aeruginosa PA01
cggguucccugcgcc

SEQ ID NO: 3413835 - RNA, 19 nt, Pseudomonas aeruginosa PA01
cggguucccugcgccucga

SEQ ID NO: 3413836 - RNA, 18 nt, Pseudomonas aeruginosa PA01
cggguuccucacggcgca

SEQ ID NO: 3413837 - RNA, 14 nt, Pseudomonas aeruginosa PA01
cggguucggcgaga

SEQ ID NO: 3413838 - RNA, 12 nt, Pseudomonas aeruginosa PA01
cggguucugcuc

SEQ ID NO: 3413839 - RNA, 22 nt, Pseudomonas aeruginosa PA01
cggguucugcucgaacaucagc

SEQ ID NO: 3413840 - RNA, 17 nt, Pseudomonas aeruginosa PA01
cggguucuucucgucga

SEQ ID NO: 3413841 - RNA, 17 nt, Pseudomonas aeruginosa PA01
cggguucuugccgcugu

SEQ ID NO: 3413842 - RNA, 19 nt, Pseudomonas aeruginosa PA01
cggguugacccagagccgc

SEQ ID NO: 3413843 - RNA, 13 nt, Pseudomonas aeruginosa PA01
cggguugagcacc

SEQ ID NO: 3413844 - RNA, 20 nt, Pseudomonas aeruginosa PA01
cggguugagcaccccggaga

SEQ ID NO: 3413845 - RNA, 15 nt, Pseudomonas aeruginosa PA01
cggguugagguagag

SEQ ID NO: 3413846 - RNA, 13 nt, Pseudomonas aeruginosa PA01
cggguugaucagg

SEQ ID NO: 3413847 - RNA, 15 nt, Pseudomonas aeruginosa PA01
cggguugaucagguu

SEQ ID NO: 3413848 - RNA, 22 nt, Pseudomonas aeruginosa PA01
cggguugaucagguucggcagc

SEQ ID NO: 3413849 - RNA, 23 nt, Pseudomonas aeruginosa PA01
cggguugaucagguucggcagcg

SEQ ID NO: 3413850 - RNA, 17 nt, Pseudomonas aeruginosa PA01
cggguugaugccgaggc

SEQ ID NO: 3413851 - RNA, 22 nt, Pseudomonas aeruginosa PA01
cggguugaugucgucgaacgac

SEQ ID NO: 3413852 - RNA, 13 nt, Pseudomonas aeruginosa PA01
cggguugcccggc

SEQ ID NO: 3413853 - RNA, 20 nt, Pseudomonas aeruginosa PA01
cggguugcccucgcagccgg

SEQ ID NO: 3413854 - RNA, 15 nt, Pseudomonas aeruginosa PA01
cggguugcgccuccg

SEQ ID NO: 3413855 - RNA, 20 nt, Pseudomonas aeruginosa PA01
cggguugcgccuccgggcgu

SEQ ID NO: 3413856 - RNA, 22 nt, Pseudomonas aeruginosa PA01
cggguuggcgcaggccgggcgg

SEQ ID NO: 3413857 - RNA, 17 nt, Pseudomonas aeruginosa PA01
cggguuggcuuccagcc

SEQ ID NO: 3413858 - RNA, 20 nt, Pseudomonas aeruginosa PA01
cggguuggcuuccagccagc

SEQ ID NO: 3413859 - RNA, 15 nt, Pseudomonas aeruginosa PA01
cggguuggucggcac

SEQ ID NO: 3413860 - RNA, 17 nt, Pseudomonas aeruginosa PA01
cggguuggucggcacca

SEQ ID NO: 3413861 - RNA, 18 nt, Pseudomonas aeruginosa PA01
cggguugguggccgcgcc

SEQ ID NO: 3413862 - RNA, 19 nt, Pseudomonas aeruginosa PA01
cggguugguggccgcgccg

SEQ ID NO: 3413863 - RNA, 22 nt, Pseudomonas aeruginosa PA01
cggguugguggccgcgccgccc

SEQ ID NO: 3413864 - RNA, 19 nt, Pseudomonas aeruginosa PA01
cggguugucguugcgcagc

SEQ ID NO: 3413865 - RNA, 17 nt, Pseudomonas aeruginosa PA01
cggguuuccgugcgcug

SEQ ID NO: 3413866 - RNA, 21 nt, Pseudomonas aeruginosa PA01
cggguuuccgugcgcugcgcg

SEQ ID NO: 3413867 - RNA, 21 nt, Pseudomonas aeruginosa PA01
cggguuuccgugugcagcagg

SEQ ID NO: 3413868 - RNA, 19 nt, Pseudomonas aeruginosa PA01
cggguuucgcugcugccgc

SEQ ID NO: 3413869 - RNA, 16 nt, Pseudomonas aeruginosa PA01
cggguuuggcgcccgc

SEQ ID NO: 3413870 - RNA, 22 nt, Pseudomonas aeruginosa PA01
cggguuugugccguuccagcgg

SEQ ID NO: 3413871 - RNA, 22 nt, Pseudomonas aeruginosa PA01
cggguuuuuuuaugccucggcg

SEQ ID NO: 3413872 - RNA, 23 nt, Pseudomonas aeruginosa PA01
cggguuuuuuuaugccucggcgg

SEQ ID NO: 3413873 - RNA, 15 nt, Pseudomonas aeruginosa PA01
cgguaaagcccaggu

SEQ ID NO: 3413874 - RNA, 16 nt, Pseudomonas aeruginosa PA01
cgguaacuggccaggg

SEQ ID NO: 3413875 - RNA, 17 nt, Pseudomonas aeruginosa PA01
cgguaauccggcacuuu

SEQ ID NO: 3413876 - RNA, 15 nt, Pseudomonas aeruginosa PA01
cgguaauuggccagg

SEQ ID NO: 3413877 - RNA, 17 nt, Pseudomonas aeruginosa PA01
cgguaauuggccaggcu

SEQ ID NO: 3413878 - RNA, 15 nt, Pseudomonas aeruginosa PA01
cgguacaccgccagg

SEQ ID NO: 3413879 - RNA, 13 nt, Pseudomonas aeruginosa PA01
cgguacagccaac

SEQ ID NO: 3413880 - RNA, 17 nt, Pseudomonas aeruginosa PA01
cgguacagcccccaggc

SEQ ID NO: 3413881 - RNA, 18 nt, Pseudomonas aeruginosa PA01
cgguacagccgguugcgu

SEQ ID NO: 3413882 - RNA, 13 nt, Pseudomonas aeruginosa PA01
cgguacagcgccu

SEQ ID NO: 3413883 - RNA, 16 nt, Pseudomonas aeruginosa PA01
cgguacagcgccuggu

SEQ ID NO: 3413884 - RNA, 23 nt, Pseudomonas aeruginosa PA01
cgguacagcgccuggucggcggc

SEQ ID NO: 3413885 - RNA, 20 nt, Pseudomonas aeruginosa PA01
cgguacaggcgcaccuggcg

SEQ ID NO: 3413886 - RNA, 22 nt, Pseudomonas aeruginosa PA01
cgguacaggcggauuuccugcg

SEQ ID NO: 3413887 - RNA, 16 nt, Pseudomonas aeruginosa PA01
cgguacauggccuucu

SEQ ID NO: 3413888 - RNA, 18 nt, Pseudomonas aeruginosa PA01
cgguacauggccuucucg

SEQ ID NO: 3413889 - RNA, 17 nt, Pseudomonas aeruginosa PA01
cgguaccagcagcgccg

SEQ ID NO: 3413890 - RNA, 18 nt, Pseudomonas aeruginosa PA01
cgguaccagcagcgccga

SEQ ID NO: 3413891 - RNA, 23 nt, Pseudomonas aeruginosa PA01
cgguaccagcagcgccgaacagg

SEQ ID NO: 3413892 - RNA, 13 nt, Pseudomonas aeruginosa PA01
cgguaccagcgca

SEQ ID NO: 3413893 - RNA, 19 nt, Pseudomonas aeruginosa PA01
cgguaccagggaagcgcgc

SEQ ID NO: 3413894 - RNA, 21 nt, Pseudomonas aeruginosa PA01
cgguaccagggaagcgcgcgc

SEQ ID NO: 3413895 - RNA, 13 nt, Pseudomonas aeruginosa PA01
cgguacccagcuu

SEQ ID NO: 3413896 - RNA, 18 nt, Pseudomonas aeruginosa PA01
cgguacccggcagggcca

SEQ ID NO: 3413897 - RNA, 19 nt, Pseudomonas aeruginosa PA01
cgguaccgggccaggcaau

SEQ ID NO: 3413898 - RNA, 14 nt, Pseudomonas aeruginosa PA01
cgguacgcaccagc

SEQ ID NO: 3413899 - RNA, 17 nt, Pseudomonas aeruginosa PA01
cgguacgcccuccagca

SEQ ID NO: 3413900 - RNA, 19 nt, Pseudomonas aeruginosa PA01
cgguacgcccuccagcacc

SEQ ID NO: 3413901 - RNA, 16 nt, Pseudomonas aeruginosa PA01
cgguacgccgcgcugc

SEQ ID NO: 3413902 - RNA, 16 nt, Pseudomonas aeruginosa PA01
cgguacgcucaccacc

SEQ ID NO: 3413903 - RNA, 17 nt, Pseudomonas aeruginosa PA01
cgguacgcucaccacca

SEQ ID NO: 3413904 - RNA, 18 nt, Pseudomonas aeruginosa PA01
cgguacgcucaccaccac

SEQ ID NO: 3413905 - RNA, 21 nt, Pseudomonas aeruginosa PA01
cgguacuccggguugaccgcc

SEQ ID NO: 3413906 - RNA, 16 nt, Pseudomonas aeruginosa PA01
cgguacuccuccagca

SEQ ID NO: 3413907 - RNA, 17 nt, Pseudomonas aeruginosa PA01
cgguacuccuccagcau

SEQ ID NO: 3413908 - RNA, 12 nt, Pseudomonas aeruginosa PA01
cgguacucgccg

SEQ ID NO: 3413909 - RNA, 15 nt, Pseudomonas aeruginosa PA01
cgguacucgccgggc

SEQ ID NO: 3413910 - RNA, 17 nt, Pseudomonas aeruginosa PA01
cgguacucgccgggcgu

SEQ ID NO: 3413911 - RNA, 23 nt, Pseudomonas aeruginosa PA01
cgguacucgccgggcgucugccc

SEQ ID NO: 3413912 - RNA, 14 nt, Pseudomonas aeruginosa PA01
cgguacugcgccag

SEQ ID NO: 3413913 - RNA, 19 nt, Pseudomonas aeruginosa PA01
cgguacugcugggccuuga

SEQ ID NO: 3413914 - RNA, 17 nt, Pseudomonas aeruginosa PA01
cgguagaacaggcgaua

SEQ ID NO: 3413915 - RNA, 17 nt, Pseudomonas aeruginosa PA01
cggcgccgggaucaccu

SEQ ID NO: 3413916 - RNA, 19 nt, Pseudomonas aeruginosa PA01
cggcgccggugaggcgcag

SEQ ID NO: 3413917 - RNA, 20 nt, Pseudomonas aeruginosa PA01
cggcgccggugaggcgcagc

SEQ ID NO: 3413918 - RNA, 21 nt, Pseudomonas aeruginosa PA01
cggcgccggugaggcgcagca

SEQ ID NO: 3413919 - RNA, 17 nt, Pseudomonas aeruginosa PA01
cggcgccggugcuggcg

SEQ ID NO: 3413920 - RNA, 22 nt, Pseudomonas aeruginosa PA01
cggcgccggugcuggcgagcag

SEQ ID NO: 3413921 - RNA, 23 nt, Pseudomonas aeruginosa PA01
cggcgccgguugcgucucagcgg

SEQ ID NO: 3413922 - RNA, 19 nt, Pseudomonas aeruginosa PA01
cggcgccgguugcugcugc

SEQ ID NO: 3413923 - RNA, 22 nt, Pseudomonas aeruginosa PA01
cggcgccgguugcugcugcggg

SEQ ID NO: 3413924 - RNA, 19 nt, Pseudomonas aeruginosa PA01
cggcgccgguugcugcugg

SEQ ID NO: 3413925 - RNA, 14 nt, Pseudomonas aeruginosa PA01
cggcgccgucgauc

SEQ ID NO: 3413926 - RNA, 23 nt, Pseudomonas aeruginosa PA01
cggcgccuccaggaauccuccgc

SEQ ID NO: 3413927 - RNA, 21 nt, Pseudomonas aeruginosa PA01
cggcgccucccagggucgccu

SEQ ID NO: 3413928 - RNA, 22 nt, Pseudomonas aeruginosa PA01
cggcgccugcgcuucguuggcg

SEQ ID NO: 3413929 - RNA, 14 nt, Pseudomonas aeruginosa PA01
cggcgccugcggac

SEQ ID NO: 3413930 - RNA, 13 nt, Pseudomonas aeruginosa PA01
cggcgccugcugc

SEQ ID NO: 3413931 - RNA, 14 nt, Pseudomonas aeruginosa PA01
cggcgccugcugcg

SEQ ID NO: 3413932 - RNA, 14 nt, Pseudomonas aeruginosa PA01
cggcgccuggagca

SEQ ID NO: 3413933 - RNA, 17 nt, Pseudomonas aeruginosa PA01
cggcgccugguucccuc

SEQ ID NO: 3413934 - RNA, 20 nt, Pseudomonas aeruginosa PA01
cggcgccugguucccucaac

SEQ ID NO: 3413935 - RNA, 12 nt, Pseudomonas aeruginosa PA01
cggcgccuucag

SEQ ID NO: 3413936 - RNA, 13 nt, Pseudomonas aeruginosa PA01
cggcgccuucaga

SEQ ID NO: 3413937 - RNA, 15 nt, Pseudomonas aeruginosa PA01
cggcgccuucagcgc

SEQ ID NO: 3413938 - RNA, 20 nt, Pseudomonas aeruginosa PA01
cggcgccuucagcgccgcca

SEQ ID NO: 3413939 - RNA, 23 nt, Pseudomonas aeruginosa PA01
cggcgccuucagcgccgccaggc

SEQ ID NO: 3413940 - RNA, 15 nt, Pseudomonas aeruginosa PA01
cggcgccuucaucgc

SEQ ID NO: 3413941 - RNA, 20 nt, Pseudomonas aeruginosa PA01
cggcgccuucaucgccaccu

SEQ ID NO: 3413942 - RNA, 17 nt, Pseudomonas aeruginosa PA01
cggcgccuugcgccagg

SEQ ID NO: 3413943 - RNA, 18 nt, Pseudomonas aeruginosa PA01
cggcgccuugcgccaggc

SEQ ID NO: 3413944 - RNA, 23 nt, Pseudomonas aeruginosa PA01
cggcgccuugcgguccagcgagc

SEQ ID NO: 3413945 - RNA, 16 nt, Pseudomonas aeruginosa PA01
cggcgcgaaccagcag

SEQ ID NO: 3413946 - RNA, 20 nt, Pseudomonas aeruginosa PA01
cggcgcgaaccagcagcagg

SEQ ID NO: 3413947 - RNA, 18 nt, Pseudomonas aeruginosa PA01
cggcgcgaccgucggccg

SEQ ID NO: 3413948 - RNA, 21 nt, Pseudomonas aeruginosa PA01
cggcgcgacggcccacggcga

SEQ ID NO: 3413949 - RNA, 23 nt, Pseudomonas aeruginosa PA01
cggcgcgacggcccacggcgaga

SEQ ID NO: 3413950 - RNA, 21 nt, Pseudomonas aeruginosa PA01
cggcgcgacuguucucuacgc

SEQ ID NO: 3413951 - RNA, 23 nt, Pseudomonas aeruginosa PA01
cggcgcgagaugaagcgccgcag

SEQ ID NO: 3413952 - RNA, 16 nt, Pseudomonas aeruginosa PA01
cggcgcgauauccgcc

SEQ ID NO: 3413953 - RNA, 20 nt, Pseudomonas aeruginosa PA01
cggcgcgauauccgccaggg

SEQ ID NO: 3413954 - RNA, 16 nt, Pseudomonas aeruginosa PA01
cggcgcgauccuccgc

SEQ ID NO: 3413955 - RNA, 17 nt, Pseudomonas aeruginosa PA01
cggcgcgauccuccgcc

SEQ ID NO: 3413956 - RNA, 18 nt, Pseudomonas aeruginosa PA01
cggcgcgauccuccgcca

SEQ ID NO: 3413957 - RNA, 20 nt, Pseudomonas aeruginosa PA01
cggcgcgauccuccgccagc

SEQ ID NO: 3413958 - RNA, 23 nt, Pseudomonas aeruginosa PA01
cggcgcgauccuccgccagcccc

SEQ ID NO: 3413959 - RNA, 19 nt, Pseudomonas aeruginosa PA01
cggcgcgauccuggcggca

SEQ ID NO: 3413960 - RNA, 20 nt, Pseudomonas aeruginosa PA01
cggcgcgauccuggcggcac

SEQ ID NO: 3413961 - RNA, 22 nt, Pseudomonas aeruginosa PA01
cggcgcgauccuggcggcacuc

SEQ ID NO: 3413962 - RNA, 20 nt, Pseudomonas aeruginosa PA01
cggcgcgaugaugccgccgu

SEQ ID NO: 3413963 - RNA, 13 nt, Pseudomonas aeruginosa PA01
cggcgcgauggag

SEQ ID NO: 3413964 - RNA, 22 nt, Pseudomonas aeruginosa PA01
cggcgcgcaccuguuucagcgg

SEQ ID NO: 3413965 - RNA, 17 nt, Pseudomonas aeruginosa PA01
cggcgcgcacggaggcg

SEQ ID NO: 3413966 - RNA, 18 nt, Pseudomonas aeruginosa PA01
cggcgcgcacggaggcgc

SEQ ID NO: 3413967 - RNA, 20 nt, Pseudomonas aeruginosa PA01
cggcgcgcagggccagcaac

SEQ ID NO: 3413968 - RNA, 21 nt, Pseudomonas aeruginosa PA01
cggcgcgcagggccagcaaca

SEQ ID NO: 3413969 - RNA, 24 nt, Pseudomonas aeruginosa PA01
cggcgcgcaucuggugcgcgucca

SEQ ID NO: 3413970 - RNA, 12 nt, Pseudomonas aeruginosa PA01
cggcgcgccaga

SEQ ID NO: 3413971 - RNA, 14 nt, Pseudomonas aeruginosa PA01
cggcgcgccagaag

SEQ ID NO: 3413972 - RNA, 19 nt, Pseudomonas aeruginosa PA01
cggcgcgccagaagcggcc

SEQ ID NO: 3413973 - RNA, 14 nt, Pseudomonas aeruginosa PA01
cggcgcgcccaggc

SEQ ID NO: 3413974 - RNA, 16 nt, Pseudomonas aeruginosa PA01
cggcgcgcccaggccc

SEQ ID NO: 3413975 - RNA, 18 nt, Pseudomonas aeruginosa PA01
cggcgcgcccaggcccag

SEQ ID NO: 3413976 - RNA, 19 nt, Pseudomonas aeruginosa PA01
cggcgcgccccugcgccca

SEQ ID NO: 3413977 - RNA, 15 nt, Pseudomonas aeruginosa PA01
cggcgcgcccggcgc

SEQ ID NO: 3413978 - RNA, 18 nt, Pseudomonas aeruginosa PA01
cggcgcgcccggcgcaga

SEQ ID NO: 3413979 - RNA, 20 nt, Pseudomonas aeruginosa PA01
cggcgcgcccggcgcagaac

SEQ ID NO: 3413980 - RNA, 13 nt, Pseudomonas aeruginosa PA01
cggcgcgccgaag

SEQ ID NO: 3413981 - RNA, 11 nt, Pseudomonas aeruginosa PA01
cggcgcgccgg

SEQ ID NO: 3413982 - RNA, 12 nt, Pseudomonas aeruginosa PA01
cggcgcgccgga

SEQ ID NO: 3413983 - RNA, 14 nt, Pseudomonas aeruginosa PA01
cggcgcgccggccc

SEQ ID NO: 3413984 - RNA, 20 nt, Pseudomonas aeruginosa PA01
cggcgcgccggugaucgagc

SEQ ID NO: 3413985 - RNA, 23 nt, Pseudomonas aeruginosa PA01
cggcgcgccuucagcgccuccag

SEQ ID NO: 3413986 - RNA, 23 nt, Pseudomonas aeruginosa PA01
cggcgcgcgacacauggucggcc

SEQ ID NO: 3413987 - RNA, 12 nt, Pseudomonas aeruginosa PA01
cggcgcgcgccc

SEQ ID NO: 3413988 - RNA, 20 nt, Pseudomonas aeruginosa PA01
cggcgcgcgguuucuucgcc

SEQ ID NO: 3413989 - RNA, 14 nt, Pseudomonas aeruginosa PA01
cggcgcgcuccggc

SEQ ID NO: 3413990 - RNA, 16 nt, Pseudomonas aeruginosa PA01
cggcgcgcuccggcgc

SEQ ID NO: 3413991 - RNA, 19 nt, Pseudomonas aeruginosa PA01
cggcgcgcuccggcgcgcc

SEQ ID NO: 3413992 - RNA, 20 nt, Pseudomonas aeruginosa PA01
cggcgcgcuccggcgcgcca

SEQ ID NO: 3413993 - RNA, 19 nt, Pseudomonas aeruginosa PA01
cggcgcgcugaacuuuccc

SEQ ID NO: 3413994 - RNA, 12 nt, Pseudomonas aeruginosa PA01
cggcgcgcugcg

SEQ ID NO: 3413995 - RNA, 16 nt, Pseudomonas aeruginosa PA01
cggcgcgcugcgugcg

SEQ ID NO: 3413996 - RNA, 19 nt, Pseudomonas aeruginosa PA01
cggcgcggaagcgccugcg

SEQ ID NO: 3413997 - RNA, 20 nt, Pseudomonas aeruginosa PA01
cggcgcggacauggcgcucg

SEQ ID NO: 3413998 - RNA, 21 nt, Pseudomonas aeruginosa PA01
cggcgcggacauggcgcucga

SEQ ID NO: 3413999 - RNA, 22 nt, Pseudomonas aeruginosa PA01
cggcgcggacgauggucgccgc

SEQ ID NO: 3414000 - RNA, 14 nt, Pseudomonas aeruginosa PA01
cggcgcggacggcc

SEQ ID NO: 3414001 - RNA, 15 nt, Pseudomonas aeruginosa PA01
cggcgcggacggccu

SEQ ID NO: 3414002 - RNA, 14 nt, Pseudomonas aeruginosa PA01
cggcgcggagcugc

SEQ ID NO: 3414003 - RNA, 20 nt, Pseudomonas aeruginosa PA01
cggcgcggauguucgccacg

SEQ ID NO: 3414004 - RNA, 21 nt, Pseudomonas aeruginosa PA01
cggcgcggauguucgccacgc

SEQ ID NO: 3414005 - RNA, 15 nt, Pseudomonas aeruginosa PA01
cggcgcggcccgucc

SEQ ID NO: 3414006 - RNA, 21 nt, Pseudomonas aeruginosa PA01
cggcgcggccggcgccgcggu

SEQ ID NO: 3414007 - RNA, 14 nt, Pseudomonas aeruginosa PA01
cggcgcggcgcaau

SEQ ID NO: 3414008 - RNA, 14 nt, Pseudomonas aeruginosa PA01
cggcgcggcgcagc

SEQ ID NO: 3414009 - RNA, 16 nt, Pseudomonas aeruginosa PA01
cggcgcggcgcagcca

SEQ ID NO: 3414010 - RNA, 17 nt, Pseudomonas aeruginosa PA01
cggcgcggcgcagccag

SEQ ID NO: 3414011 - RNA, 18 nt, Pseudomonas aeruginosa PA01
cggcgcggcgcagccaga

SEQ ID NO: 3414012 - RNA, 15 nt, Pseudomonas aeruginosa PA01
cggcgcggcgcagcg

SEQ ID NO: 3414013 - RNA, 18 nt, Pseudomonas aeruginosa PA01
cggcgcggcgcuccaggc

SEQ ID NO: 3414014 - RNA, 16 nt, Pseudomonas aeruginosa PA01
cggcgcggcggccgcc

SEQ ID NO: 3414015 - RNA, 19 nt, Pseudomonas aeruginosa PA01
cggcgcggcggccgccucg

SEQ ID NO: 3414016 - RNA, 12 nt, Pseudomonas aeruginosa PA01
cggcgcggcggg

SEQ ID NO: 3414017 - RNA, 20 nt, Pseudomonas aeruginosa PA01
cggcgcggcguaccagccgc

SEQ ID NO: 3414018 - RNA, 22 nt, Pseudomonas aeruginosa PA01
cggcgcggcguaccagccgcgg

SEQ ID NO: 3414019 - RNA, 15 nt, Pseudomonas aeruginosa PA01
cggcgcggcguggcg

SEQ ID NO: 3414020 - RNA, 17 nt, Pseudomonas aeruginosa PA01
cggcgcggcguggcgga

SEQ ID NO: 3414021 - RNA, 18 nt, Pseudomonas aeruginosa PA01
cggcgcgggccuucaggc

SEQ ID NO: 3414022 - RNA, 15 nt, Pseudomonas aeruginosa PA01
cggcgcgggcgccga

SEQ ID NO: 3414023 - RNA, 22 nt, Pseudomonas aeruginosa PA01
cggcgcgggcgccgaugccggc

SEQ ID NO: 3414024 - RNA, 14 nt, Pseudomonas aeruginosa PA01
cggcgcgggcgcgc

SEQ ID NO: 3414025 - RNA, 15 nt, Pseudomonas aeruginosa PA01
cggcgcgggcgcgcg

SEQ ID NO: 3414026 - RNA, 14 nt, Pseudomonas aeruginosa PA01
cggcgcgggcggcc

SEQ ID NO: 3414027 - RNA, 15 nt, Pseudomonas aeruginosa PA01
cggcgcgggcggccu

SEQ ID NO: 3414028 - RNA, 18 nt, Pseudomonas aeruginosa PA01
cggcgcgggcggccucga

SEQ ID NO: 3414029 - RNA, 22 nt, Pseudomonas aeruginosa PA01
cggcgcggggcccggcuccagc

SEQ ID NO: 3414030 - RNA, 18 nt, Pseudomonas aeruginosa PA01
cggcgcgggucugcucgc

SEQ ID NO: 3414031 - RNA, 21 nt, Pseudomonas aeruginosa PA01
cggcgcgggucugcucgcgcu

SEQ ID NO: 3414032 - RNA, 17 nt, Pseudomonas aeruginosa PA01
cggcgcggguucgugcc

SEQ ID NO: 3414033 - RNA, 22 nt, Pseudomonas aeruginosa PA01
cggcgcggucggguccgggccc

SEQ ID NO: 3414034 - RNA, 22 nt, Pseudomonas aeruginosa PA01
cggcgcggugccgugggucgcc

SEQ ID NO: 3414035 - RNA, 23 nt, Pseudomonas aeruginosa PA01
cggcgcggugccgugggucgccu

SEQ ID NO: 3414036 - RNA, 22 nt, Pseudomonas aeruginosa PA01
cggcgcguagaggaugccggcc

SEQ ID NO: 3414037 - RNA, 23 nt, Pseudomonas aeruginosa PA01
cggcgcguagaggaugccggccu

SEQ ID NO: 3414038 - RNA, 20 nt, Pseudomonas aeruginosa PA01
cggcgcguccaccuggcggc

SEQ ID NO: 3414039 - RNA, 19 nt, Pseudomonas aeruginosa PA01
cggcgcgucccugggcgca

SEQ ID NO: 3414040 - RNA, 22 nt, Pseudomonas aeruginosa PA01
cggcgcgucccugggcgcaggg

SEQ ID NO: 3414041 - RNA, 15 nt, Pseudomonas aeruginosa PA01
cggcgcgucgcugcg

SEQ ID NO: 3414042 - RNA, 14 nt, Pseudomonas aeruginosa PA01
cggcgcgucggcgg

SEQ ID NO: 3414043 - RNA, 19 nt, Pseudomonas aeruginosa PA01
cggcgcgucggcggugucg

SEQ ID NO: 3414044 - RNA, 21 nt, Pseudomonas aeruginosa PA01
cggcgcgucggcggugucggu

SEQ ID NO: 3414045 - RNA, 14 nt, Pseudomonas aeruginosa PA01
cggcgcgucggugc

SEQ ID NO: 3414046 - RNA, 21 nt, Pseudomonas aeruginosa PA01
cggcgcgucggugccgcccgg

SEQ ID NO: 3414047 - RNA, 14 nt, Pseudomonas aeruginosa PA01
cggcgcguuccggg

SEQ ID NO: 3414048 - RNA, 19 nt, Pseudomonas aeruginosa PA01
cggcgcguuccgggucgcu

SEQ ID NO: 3414049 - RNA, 23 nt, Pseudomonas aeruginosa PA01
cggcgcguuuuuccgcgaggaaa

SEQ ID NO: 3414050 - RNA, 16 nt, Pseudomonas aeruginosa PA01
cggcgcuacgaaggcg

SEQ ID NO: 3414051 - RNA, 13 nt, Pseudomonas aeruginosa PA01
cggcgcuauccgc

SEQ ID NO: 3414052 - RNA, 18 nt, Pseudomonas aeruginosa PA01
cggcgcuauccgccgcua

SEQ ID NO: 3414053 - RNA, 15 nt, Pseudomonas aeruginosa PA01
cggcgcucacccaca

SEQ ID NO: 3414054 - RNA, 13 nt, Pseudomonas aeruginosa PA01
cggcgcucaccgc

SEQ ID NO: 3414055 - RNA, 21 nt, Pseudomonas aeruginosa PA01
cggcgcucagucgagcauguc

SEQ ID NO: 3414056 - RNA, 15 nt, Pseudomonas aeruginosa PA01
cggcgcuccaacagc

SEQ ID NO: 3414057 - RNA, 19 nt, Pseudomonas aeruginosa PA01
cggcgcuccacagcugcca

SEQ ID NO: 3414058 - RNA, 21 nt, Pseudomonas aeruginosa PA01
cggcgcuccacagcugccagc

SEQ ID NO: 3414059 - RNA, 23 nt, Pseudomonas aeruginosa PA01
cggcgcuccacagcugccagccc

SEQ ID NO: 3414060 - RNA, 15 nt, Pseudomonas aeruginosa PA01
cggcgcuccaggcgg

SEQ ID NO: 3414061 - RNA, 13 nt, Pseudomonas aeruginosa PA01
cggcgcuccgccg

SEQ ID NO: 3414062 - RNA, 12 nt, Pseudomonas aeruginosa PA01
cggcgcucggca

SEQ ID NO: 3414063 - RNA, 16 nt, Pseudomonas aeruginosa PA01
cggcgcucggcaucga

SEQ ID NO: 3414064 - RNA, 15 nt, Pseudomonas aeruginosa PA01
cggcgcucggccagg

SEQ ID NO: 3414065 - RNA, 20 nt, Pseudomonas aeruginosa PA01
cggcgcucuucagcacgccc

SEQ ID NO: 3414066 - RNA, 21 nt, Pseudomonas aeruginosa PA01
cggcgcugaacagcuggcgcg

SEQ ID NO: 3414067 - RNA, 13 nt, Pseudomonas aeruginosa PA01
cggcgcugaccuc

SEQ ID NO: 3414068 - RNA, 20 nt, Pseudomonas aeruginosa PA01
cggcgcugaccucgauggcg

SEQ ID NO: 3414069 - RNA, 17 nt, Pseudomonas aeruginosa PA01
cggcgcugagcgagacc

SEQ ID NO: 3414070 - RNA, 14 nt, Pseudomonas aeruginosa PA01
cggcgcugcccggg

SEQ ID NO: 3414071 - RNA, 15 nt, Pseudomonas aeruginosa PA01
cggcgcugccgaaca

SEQ ID NO: 3414072 - RNA, 17 nt, Pseudomonas aeruginosa PA01
cggcgcugccgaacagc

SEQ ID NO: 3414073 - RNA, 19 nt, Pseudomonas aeruginosa PA01
cggcgcugccgaacagcag

SEQ ID NO: 3414074 - RNA, 14 nt, Pseudomonas aeruginosa PA01
cggcgcugccggcc

SEQ ID NO: 3414075 - RNA, 16 nt, Pseudomonas aeruginosa PA01
cggcgcugccggccag

SEQ ID NO: 3414076 - RNA, 19 nt, Pseudomonas aeruginosa PA01
cggcgcugccggccagggu

SEQ ID NO: 3414077 - RNA, 13 nt, Pseudomonas aeruginosa PA01
cggcgcugcgagc

SEQ ID NO: 3414078 - RNA, 22 nt, Pseudomonas aeruginosa PA01
cggcgcugcgccguuucgacga

SEQ ID NO: 3414079 - RNA, 13 nt, Pseudomonas aeruginosa PA01
cggcgcugcuucu

SEQ ID NO: 3414080 - RNA, 14 nt, Pseudomonas aeruginosa PA01
cggcgcugcuucuu

SEQ ID NO: 3414081 - RNA, 16 nt, Pseudomonas aeruginosa PA01
cggcgcuggccgcgcg

SEQ ID NO: 3414082 - RNA, 17 nt, Pseudomonas aeruginosa PA01
cggcgcuggccgcgcga

SEQ ID NO: 3414083 - RNA, 19 nt, Pseudomonas aeruginosa PA01
cggcgcuggccgcgcgacc

SEQ ID NO: 3414084 - RNA, 13 nt, Pseudomonas aeruginosa PA01
cggcgcuggcgcg

SEQ ID NO: 3414085 - RNA, 14 nt, Pseudomonas aeruginosa PA01
cggcgcuggcgcgg

SEQ ID NO: 3414086 - RNA, 21 nt, Pseudomonas aeruginosa PA01
cggcgcuggucucuuccagca

SEQ ID NO: 3414087 - RNA, 15 nt, Pseudomonas aeruginosa PA01
cggcgcugucgccgu

SEQ ID NO: 3414088 - RNA, 17 nt, Pseudomonas aeruginosa PA01
cggcgcuguuugcggcg

SEQ ID NO: 3414089 - RNA, 18 nt, Pseudomonas aeruginosa PA01
cggcgcuguuugcggcgc

SEQ ID NO: 3414090 - RNA, 23 nt, Pseudomonas aeruginosa PA01
cggcgcuguuugcggcgcaggcg

SEQ ID NO: 3414091 - RNA, 15 nt, Pseudomonas aeruginosa PA01
cggcgcuucgcgcag

SEQ ID NO: 3414092 - RNA, 17 nt, Pseudomonas aeruginosa PA01
cggcgcuucgcgcagga

SEQ ID NO: 3414093 - RNA, 21 nt, Pseudomonas aeruginosa PA01
cggcgcuucugcgagccgcgc

SEQ ID NO: 3414094 - RNA, 19 nt, Pseudomonas aeruginosa PA01
cggcgcuugcgggcgcgcc

SEQ ID NO: 3414095 - RNA, 22 nt, Pseudomonas aeruginosa PA01
cggcgcuugcgggcgcgccuga

SEQ ID NO: 3414096 - RNA, 19 nt, Pseudomonas aeruginosa PA01
cggcgcuuguagcccaggg

SEQ ID NO: 3414097 - RNA, 22 nt, Pseudomonas aeruginosa PA01
cggcgcuuguagcccaggggca

SEQ ID NO: 3414098 - RNA, 17 nt, Pseudomonas aeruginosa PA01
cggcgcuuucaucaggc

SEQ ID NO: 3414099 - RNA, 18 nt, Pseudomonas aeruginosa PA01
cggcgcuuucaucaggcg

SEQ ID NO: 3414100 - RNA, 20 nt, Pseudomonas aeruginosa PA01
cggcgcuuucaucaggcgcu

SEQ ID NO: 3414101 - RNA, 21 nt, Pseudomonas aeruginosa PA01
cggcgcuuucgcucuggucga

SEQ ID NO: 3414102 - RNA, 18 nt, Pseudomonas aeruginosa PA01
cggcgcuuugcugcacgc

SEQ ID NO: 3414103 - RNA, 17 nt, Pseudomonas aeruginosa PA01
cggcggaacauggucga

SEQ ID NO: 3414104 - RNA, 15 nt, Pseudomonas aeruginosa PA01
cggcggaagaagccc

SEQ ID NO: 3414105 - RNA, 17 nt, Pseudomonas aeruginosa PA01
cggcggaagaagcccuu

SEQ ID NO: 3414106 - RNA, 21 nt, Pseudomonas aeruginosa PA01
cggcggaagaauaccgccagc

SEQ ID NO: 3414107 - RNA, 13 nt, Pseudomonas aeruginosa PA01
cggcggaaggcgg

SEQ ID NO: 3414108 - RNA, 15 nt, Pseudomonas aeruginosa PA01
cggcggaaggcggcg

SEQ ID NO: 3414109 - RNA, 22 nt, Pseudomonas aeruginosa PA01
cggcggaaggcggcgucgucgc

SEQ ID NO: 3414110 - RNA, 20 nt, Pseudomonas aeruginosa PA01
cggcggaagucgaagcagcc

SEQ ID NO: 3414111 - RNA, 18 nt, Pseudomonas aeruginosa PA01
cggcggaauuccugcucg

SEQ ID NO: 3414112 - RNA, 19 nt, Pseudomonas aeruginosa PA01
cggcggacaaccaccaugc

SEQ ID NO: 3414113 - RNA, 23 nt, Pseudomonas aeruginosa PA01
cggcggacagcccgcgcucggcc

SEQ ID NO: 3414114 - RNA, 21 nt, Pseudomonas aeruginosa PA01
cggcggacaggcagccggcca

SEQ ID NO: 3414115 - RNA, 15 nt, Pseudomonas aeruginosa PA01
cggcggaccuccgcc

SEQ ID NO: 3414116 - RNA, 16 nt, Pseudomonas aeruginosa PA01
cggcggaccuccgcca

SEQ ID NO: 3414117 - RNA, 18 nt, Pseudomonas aeruginosa PA01
cggcggaccuccgccagg

SEQ ID NO: 3414118 - RNA, 15 nt, Pseudomonas aeruginosa PA01
cggcggacgacgaag

SEQ ID NO: 3414119 - RNA, 17 nt, Pseudomonas aeruginosa PA01
cggcggacgcaggccga

SEQ ID NO: 3414120 - RNA, 23 nt, Pseudomonas aeruginosa PA01
cggcggacgcaggccgaccucgg

SEQ ID NO: 3414121 - RNA, 13 nt, Pseudomonas aeruginosa PA01
cggcggacugcuc

SEQ ID NO: 3414122 - RNA, 24 nt, Pseudomonas aeruginosa PA01
cggcggagccgucggcuccgcuca

SEQ ID NO: 3414123 - RNA, 20 nt, Pseudomonas aeruginosa PA01
cggcggauaaacggcaugca

SEQ ID NO: 3414124 - RNA, 22 nt, Pseudomonas aeruginosa PA01
cggcggauaaacggcaugcacg

SEQ ID NO: 3414125 - RNA, 21 nt, Pseudomonas aeruginosa PA01
cggcggauaacaccguuggcg

SEQ ID NO: 3414126 - RNA, 18 nt, Pseudomonas aeruginosa PA01
cggcggauaaccgcgagc

SEQ ID NO: 3414127 - RNA, 21 nt, Pseudomonas aeruginosa PA01
cggcggauaaccgcgagcggu

SEQ ID NO: 3414128 - RNA, 21 nt, Pseudomonas aeruginosa PA01
cggcggauaacgccgauggcg

SEQ ID NO: 3414129 - RNA, 21 nt, Pseudomonas aeruginosa PA01
cggcggauaacgccgcuggcg

SEQ ID NO: 3414130 - RNA, 16 nt, Pseudomonas aeruginosa PA01
cggcggauaacgccgg

SEQ ID NO: 3414131 - RNA, 21 nt, Pseudomonas aeruginosa PA01
cggcggauaacgccgguggcg

SEQ ID NO: 3414132 - RNA, 21 nt, Pseudomonas aeruginosa PA01
cggcggauaacgccguuggcg

SEQ ID NO: 3414133 - RNA, 21 nt, Pseudomonas aeruginosa PA01
cggcggauaacgccuauggcg

SEQ ID NO: 3414134 - RNA, 16 nt, Pseudomonas aeruginosa PA01
cggcggauaacgccug

SEQ ID NO: 3414135 - RNA, 21 nt, Pseudomonas aeruginosa PA01
cggcggauaacgccugcggcg

SEQ ID NO: 3414136 - RNA, 17 nt, Pseudomonas aeruginosa PA01
cggcggauaacgccugu

SEQ ID NO: 3414137 - RNA, 21 nt, Pseudomonas aeruginosa PA01
cggcggauaacgccuguggcg

SEQ ID NO: 3414138 - RNA, 20 nt, Pseudomonas aeruginosa PA01
cggcggauaacgcuucgcag

SEQ ID NO: 3414139 - RNA, 20 nt, Pseudomonas aeruginosa PA01
cggcggauacaggcgcagca

SEQ ID NO: 3414140 - RNA, 21 nt, Pseudomonas aeruginosa PA01
cggcggauacaggcgcagcag

SEQ ID NO: 3414141 - RNA, 15 nt, Pseudomonas aeruginosa PA01
cggcggaucagcccg

SEQ ID NO: 3414142 - RNA, 21 nt, Pseudomonas aeruginosa PA01
cggcggaucagcccgcugacc

SEQ ID NO: 3414143 - RNA, 23 nt, Pseudomonas aeruginosa PA01
cggcggaucagcccgcugaccgg

SEQ ID NO: 3414144 - RNA, 18 nt, Pseudomonas aeruginosa PA01
cggcggaucgaucagcag

SEQ ID NO: 3414145 - RNA, 20 nt, Pseudomonas aeruginosa PA01
cggcggaucgaucagcagca

SEQ ID NO: 3414146 - RNA, 21 nt, Pseudomonas aeruginosa PA01
cggcggaucgaucagcagcac

SEQ ID NO: 3414147 - RNA, 17 nt, Pseudomonas aeruginosa PA01
cggcggaucgaucgauc

SEQ ID NO: 3414148 - RNA, 17 nt, Pseudomonas aeruginosa PA01
cggcggaugacguuccc

SEQ ID NO: 3414149 - RNA, 21 nt, Pseudomonas aeruginosa PA01
cggcggauuacuccgccggcg

SEQ ID NO: 3414150 - RNA, 17 nt, Pseudomonas aeruginosa PA01
cggcggauugccagcag

SEQ ID NO: 3414151 - RNA, 21 nt, Pseudomonas aeruginosa PA01
cggcggcaccacgugcagcag

SEQ ID NO: 3414152 - RNA, 21 nt, Pseudomonas aeruginosa PA01
cggcggcacccucuuccgcgc

SEQ ID NO: 3414153 - RNA, 22 nt, Pseudomonas aeruginosa PA01
cggcggcacccucuuccgcgcu

SEQ ID NO: 3414154 - RNA, 22 nt, Pseudomonas aeruginosa PA01
cggcggcacgaccacaucggcc

SEQ ID NO: 3414155 - RNA, 13 nt, Pseudomonas aeruginosa PA01
cggcggcacgcuc

SEQ ID NO: 3414156 - RNA, 14 nt, Pseudomonas aeruginosa PA01
cggcggcagcugcg

SEQ ID NO: 3414157 - RNA, 20 nt, Pseudomonas aeruginosa PA01
cggcggcagcugcggcggca

SEQ ID NO: 3414158 - RNA, 12 nt, Pseudomonas aeruginosa PA01
cggcggcaggcc

SEQ ID NO: 3414159 - RNA, 17 nt, Pseudomonas aeruginosa PA01
cggcggcaggcgcauca

SEQ ID NO: 3414160 - RNA, 12 nt, Pseudomonas aeruginosa PA01
cggcggcaggcu

SEQ ID NO: 3414161 - RNA, 14 nt, Pseudomonas aeruginosa PA01
cggcggcaggcugc

SEQ ID NO: 3414162 - RNA, 16 nt, Pseudomonas aeruginosa PA01
cggcggcaggcugcgc

SEQ ID NO: 3414163 - RNA, 19 nt, Pseudomonas aeruginosa PA01
cggcggcaucccuuuuuca

SEQ ID NO: 3414164 - RNA, 13 nt, Pseudomonas aeruginosa PA01
cggcggccagcag

SEQ ID NO: 3414165 - RNA, 15 nt, Pseudomonas aeruginosa PA01
cggcggccagcagca

SEQ ID NO: 3414166 - RNA, 16 nt, Pseudomonas aeruginosa PA01
cggcggccagcagcac

SEQ ID NO: 3414167 - RNA, 13 nt, Pseudomonas aeruginosa PA01
cggcggccagcgg

SEQ ID NO: 3414168 - RNA, 12 nt, Pseudomonas aeruginosa PA01
cggcggccaggc

SEQ ID NO: 3414169 - RNA, 13 nt, Pseudomonas aeruginosa PA01
cggcggccaggcg

SEQ ID NO: 3414170 - RNA, 21 nt, Pseudomonas aeruginosa PA01
cggcggccauugccgcgggcu

SEQ ID NO: 3414171 - RNA, 13 nt, Pseudomonas aeruginosa PA01
cggcggcccgcac

SEQ ID NO: 3414172 - RNA, 15 nt, Pseudomonas aeruginosa PA01
cggcggcccgcacag

SEQ ID NO: 3414173 - RNA, 12 nt, Pseudomonas aeruginosa PA01
cggcggccgagg

SEQ ID NO: 3414174 - RNA, 12 nt, Pseudomonas aeruginosa PA01
cggcggccgcca

SEQ ID NO: 3414175 - RNA, 20 nt, Pseudomonas aeruginosa PA01
cggcggccgccaucgcccgg

SEQ ID NO: 3414176 - RNA, 14 nt, Pseudomonas aeruginosa PA01
cggcggccgccucg

SEQ ID NO: 3414177 - RNA, 21 nt, Pseudomonas aeruginosa PA01
cggcggccgccuugaccugcu

SEQ ID NO: 3414178 - RNA, 12 nt, Pseudomonas aeruginosa PA01
cggcggccgucg

SEQ ID NO: 3414179 - RNA, 15 nt, Pseudomonas aeruginosa PA01
cggcggccgucgcug

SEQ ID NO: 3414180 - RNA, 21 nt, Pseudomonas aeruginosa PA01
cggcggccucggccucgucga

SEQ ID NO: 3414181 - RNA, 23 nt, Pseudomonas aeruginosa PA01
cggcggccucggccucgucgagc

SEQ ID NO: 3414182 - RNA, 14 nt, Pseudomonas aeruginosa PA01
cggcggccugcccc

SEQ ID NO: 3414183 - RNA, 17 nt, Pseudomonas aeruginosa PA01
cggcggccugccccgcc

SEQ ID NO: 3414184 - RNA, 15 nt, Pseudomonas aeruginosa PA01
cggcggccugcucgc

SEQ ID NO: 3414185 - RNA, 17 nt, Pseudomonas aeruginosa PA01
cggcggccugcucgcgc

SEQ ID NO: 3414186 - RNA, 18 nt, Pseudomonas aeruginosa PA01
cggcggccugcucgcgca

SEQ ID NO: 3414187 - RNA, 22 nt, Pseudomonas aeruginosa PA01
cggcggccugcucgcgcagcca

SEQ ID NO: 3414188 - RNA, 10 nt, Pseudomonas aeruginosa PA01
cggcggccuu

SEQ ID NO: 3414189 - RNA, 21 nt, Pseudomonas aeruginosa PA01
cggcggcgaauacguggggga

SEQ ID NO: 3414190 - RNA, 19 nt, Pseudomonas aeruginosa PA01
cggcggcgacccagaccug

SEQ ID NO: 3414191 - RNA, 21 nt, Pseudomonas aeruginosa PA01
cggcggcgacccagaccugcc

SEQ ID NO: 3414192 - RNA, 22 nt, Pseudomonas aeruginosa PA01
cggcggcgaccccgaucaccgg

SEQ ID NO: 3414193 - RNA, 14 nt, Pseudomonas aeruginosa PA01
cggcggcgacgcug

SEQ ID NO: 3414194 - RNA, 22 nt, Pseudomonas aeruginosa PA01
cggcggcgacgcuggcggugcg

SEQ ID NO: 3414195 - RNA, 21 nt, Pseudomonas aeruginosa PA01
cggcggcgaucuucuccgccg

SEQ ID NO: 3414196 - RNA, 23 nt, Pseudomonas aeruginosa PA01
cggcggcgaugaucggcagccgu

SEQ ID NO: 3414197 - RNA, 12 nt, Pseudomonas aeruginosa PA01
cggcggcgccgg

SEQ ID NO: 3414198 - RNA, 16 nt, Pseudomonas aeruginosa PA01
cggcggcgccggcagg

SEQ ID NO: 3414199 - RNA, 17 nt, Pseudomonas aeruginosa PA01
cggcggcgccggcaggu

SEQ ID NO: 3414200 - RNA, 23 nt, Pseudomonas aeruginosa PA01
cggcggcgccggugaggcgcagc

SEQ ID NO: 3414201 - RNA, 18 nt, Pseudomonas aeruginosa PA01
cggcggcgccuucgccgg

SEQ ID NO: 3414202 - RNA, 20 nt, Pseudomonas aeruginosa PA01
cggcggcgccuugcggucca

SEQ ID NO: 3414203 - RNA, 21 nt, Pseudomonas aeruginosa PA01
cggcggcgcgaaccagcagca

SEQ ID NO: 3414204 - RNA, 14 nt, Pseudomonas aeruginosa PA01
cggcggcgcgcagc

SEQ ID NO: 3414205 - RNA, 15 nt, Pseudomonas aeruginosa PA01
cggcggcgcgcagcg

SEQ ID NO: 3414206 - RNA, 17 nt, Pseudomonas aeruginosa PA01
cggcggcgcgcugcggg

SEQ ID NO: 3414207 - RNA, 21 nt, Pseudomonas aeruginosa PA01
cggcggcgcgcugcgggucau

SEQ ID NO: 3414208 - RNA, 12 nt, Pseudomonas aeruginosa PA01
cggcggcgcggc

SEQ ID NO: 3414209 - RNA, 14 nt, Pseudomonas aeruginosa PA01
cggcggcgcggggg

SEQ ID NO: 3414210 - RNA, 14 nt, Pseudomonas aeruginosa PA01
cggcggcgcggguc

SEQ ID NO: 3414211 - RNA, 17 nt, Pseudomonas aeruginosa PA01
cggcggcgcgucggugc

SEQ ID NO: 3414212 - RNA, 15 nt, Pseudomonas aeruginosa PA01
cggcggcgcuauccg

SEQ ID NO: 3414213 - RNA, 17 nt, Pseudomonas aeruginosa PA01
cggcggcgcuauccgcc

SEQ ID NO: 3414214 - RNA, 20 nt, Pseudomonas aeruginosa PA01
cggcggcggaccuccgccag

SEQ ID NO: 3414215 - RNA, 20 nt, Pseudomonas aeruginosa PA01
cggcggcggacgcaggccga

SEQ ID NO: 3414216 - RNA, 14 nt, Pseudomonas aeruginosa PA01
cggcggcggccagc

SEQ ID NO: 3414217 - RNA, 15 nt, Pseudomonas aeruginosa PA01
cggcggcggccagca

SEQ ID NO: 3414218 - RNA, 15 nt, Pseudomonas aeruginosa PA01
cggcggcggcccgca

SEQ ID NO: 3414219 - RNA, 14 nt, Pseudomonas aeruginosa PA01
cggcggcggccgca

SEQ ID NO: 3414220 - RNA, 14 nt, Pseudomonas aeruginosa PA01
cggcggcggccugc

SEQ ID NO: 3414221 - RNA, 22 nt, Pseudomonas aeruginosa PA01
cggcggcgguucgccgagcgcc

SEQ ID NO: 3414222 - RNA, 21 nt, Pseudomonas aeruginosa PA01
cggcggcguauucgccgaaga

SEQ ID NO: 3414223 - RNA, 15 nt, Pseudomonas aeruginosa PA01
cggcggcgugcaggc

SEQ ID NO: 3414224 - RNA, 17 nt, Pseudomonas aeruginosa PA01
cggcggcgugcaggccg

SEQ ID NO: 3414225 - RNA, 18 nt, Pseudomonas aeruginosa PA01
cggcggcgugcaggccga

SEQ ID NO: 3414226 - RNA, 16 nt, Pseudomonas aeruginosa PA01
cggcggcguuggccga

SEQ ID NO: 3414227 - RNA, 19 nt, Pseudomonas aeruginosa PA01
cggcggcguuggccgagga

SEQ ID NO: 3414228 - RNA, 22 nt, Pseudomonas aeruginosa PA01
cggcggcguuggccgaggaggc

SEQ ID NO: 3414229 - RNA, 21 nt, Pseudomonas aeruginosa PA01
cggcggcuaccagcgcuucgg

SEQ ID NO: 3414230 - RNA, 18 nt, Pseudomonas aeruginosa PA01
cggcggcuacccgcgccu

SEQ ID NO: 3414231 - RNA, 16 nt, Pseudomonas aeruginosa PA01
cggcggcucaacggga

SEQ ID NO: 3414232 - RNA, 16 nt, Pseudomonas aeruginosa PA01
cggcggcucaggccgc

SEQ ID NO: 3414233 - RNA, 17 nt, Pseudomonas aeruginosa PA01
cggcggcuccggcgcca

SEQ ID NO: 3414234 - RNA, 21 nt, Pseudomonas aeruginosa PA01
cggcggcucuuuccgggucau

SEQ ID NO: 3414235 - RNA, 19 nt, Pseudomonas aeruginosa PA01
cggcggcugcugcgccugg

SEQ ID NO: 3414236 - RNA, 16 nt, Pseudomonas aeruginosa PA01
cggcggcuucagccag

SEQ ID NO: 3414237 - RNA, 17 nt, Pseudomonas aeruginosa PA01
cggcggcuucagccaga

SEQ ID NO: 3414238 - RNA, 23 nt, Pseudomonas aeruginosa PA01
cggcggcuucagccagaccggca

SEQ ID NO: 3414239 - RNA, 21 nt, Pseudomonas aeruginosa PA01
cggcgggacaggaacgcccuu

SEQ ID NO: 3414240 - RNA, 13 nt, Pseudomonas aeruginosa PA01
cggcgggacgcgc

SEQ ID NO: 3414241 - RNA, 17 nt, Pseudomonas aeruginosa PA01
cggcgggacgcgcaugc

SEQ ID NO: 3414242 - RNA, 14 nt, Pseudomonas aeruginosa PA01
cggcgggacggcgc

SEQ ID NO: 3414243 - RNA, 15 nt, Pseudomonas aeruginosa PA01
cggcgggacggcgca

SEQ ID NO: 3414244 - RNA, 17 nt, Pseudomonas aeruginosa PA01
cggcgggacggcgcaua

SEQ ID NO: 3414245 - RNA, 16 nt, Pseudomonas aeruginosa PA01
cggcgggagagggcgg

SEQ ID NO: 3414246 - RNA, 15 nt, Pseudomonas aeruginosa PA01
cggcgggaggucaca

SEQ ID NO: 3414247 - RNA, 23 nt, Pseudomonas aeruginosa PA01
cggcgggaucgaguaagugccga

SEQ ID NO: 3414248 - RNA, 13 nt, Pseudomonas aeruginosa PA01
cggcgggcaccgc

SEQ ID NO: 3414249 - RNA, 19 nt, Pseudomonas aeruginosa PA01
cggcgggcaccgccagccc

SEQ ID NO: 3414250 - RNA, 14 nt, Pseudomonas aeruginosa PA01
cggcgggccgcuca

SEQ ID NO: 3414251 - RNA, 17 nt, Pseudomonas aeruginosa PA01
cggcgggccgcucagga

SEQ ID NO: 3414252 - RNA, 14 nt, Pseudomonas aeruginosa PA01
cggcgggccggcgu

SEQ ID NO: 3414253 - RNA, 14 nt, Pseudomonas aeruginosa PA01
cggcgggcgguuuc

SEQ ID NO: 3414254 - RNA, 22 nt, Pseudomonas aeruginosa PA01
cggcgggcucgcaaucagcgcg

SEQ ID NO: 3414255 - RNA, 14 nt, Pseudomonas aeruginosa PA01
cggcgggcugccgc

SEQ ID NO: 3414256 - RNA, 17 nt, Pseudomonas aeruginosa PA01
cggcgggcugccgcgga

SEQ ID NO: 3414257 - RNA, 18 nt, Pseudomonas aeruginosa PA01
cggcgggcugccgcggaa

SEQ ID NO: 3414258 - RNA, 20 nt, Pseudomonas aeruginosa PA01
cggcggggaagccuucgccc

SEQ ID NO: 3414259 - RNA, 23 nt, Pseudomonas aeruginosa PA01
cggcggggaagccuucgcccggc

SEQ ID NO: 3414260 - RNA, 13 nt, Pseudomonas aeruginosa PA01
cggcggggccauc

SEQ ID NO: 3414261 - RNA, 15 nt, Pseudomonas aeruginosa PA01
cggcggggcgcaccg

SEQ ID NO: 3414262 - RNA, 16 nt, Pseudomonas aeruginosa PA01
cggcggggcgcaccgc

SEQ ID NO: 3414263 - RNA, 17 nt, Pseudomonas aeruginosa PA01
cggcggggcgcaccgcc

SEQ ID NO: 3414264 - RNA, 16 nt, Pseudomonas aeruginosa PA01
cggcggggcgcagcag

SEQ ID NO: 3414265 - RNA, 18 nt, Pseudomonas aeruginosa PA01
cggcggggugaucaccca

SEQ ID NO: 3414266 - RNA, 23 nt, Pseudomonas aeruginosa PA01
cggcggguagagucgcucgcgca

SEQ ID NO: 3414267 - RNA, 21 nt, Pseudomonas aeruginosa PA01
cggcggguauccgccgggccg

SEQ ID NO: 3414268 - RNA, 13 nt, Pseudomonas aeruginosa PA01
cggcggguggcgc

SEQ ID NO: 3414269 - RNA, 14 nt, Pseudomonas aeruginosa PA01
cggcggguggcgcu

SEQ ID NO: 3414270 - RNA, 21 nt, Pseudomonas aeruginosa PA01
cggcggguucagcccgccgug

SEQ ID NO: 3414271 - RNA, 22 nt, Pseudomonas aeruginosa PA01
cggcggguucagcccgccgugc

SEQ ID NO: 3414272 - RNA, 19 nt, Pseudomonas aeruginosa PA01
cggcggguugaccccgagg

SEQ ID NO: 3414273 - RNA, 20 nt, Pseudomonas aeruginosa PA01
cggcggguugaccccgaggu

SEQ ID NO: 3414274 - RNA, 20 nt, Pseudomonas aeruginosa PA01
cggcgguacgcccuccagca

SEQ ID NO: 3414275 - RNA, 15 nt, Pseudomonas aeruginosa PA01
cggcgguagccgagg

SEQ ID NO: 3414276 - RNA, 19 nt, Pseudomonas aeruginosa PA01
cggcgguagccgaggcggc

SEQ ID NO: 3414277 - RNA, 18 nt, Pseudomonas aeruginosa PA01
cggcgguagcgcgaaggc

SEQ ID NO: 3414278 - RNA, 17 nt, Pseudomonas aeruginosa PA01
cggcgguagcuccaggc

SEQ ID NO: 3414279 - RNA, 19 nt, Pseudomonas aeruginosa PA01
cggcgguagcuccaggccg

SEQ ID NO: 3414280 - RNA, 21 nt, Pseudomonas aeruginosa PA01
cggcgguagcuccaggccgaa

SEQ ID NO: 3414281 - RNA, 22 nt, Pseudomonas aeruginosa PA01
cggcgguagcuccaggccgaag

SEQ ID NO: 3414282 - RNA, 12 nt, Pseudomonas aeruginosa PA01
cggcggucaggc

SEQ ID NO: 3414283 - RNA, 20 nt, Pseudomonas aeruginosa PA01
cggcggucaggcucagcucg

SEQ ID NO: 3414284 - RNA, 12 nt, Pseudomonas aeruginosa PA01
cggcggucaggu

SEQ ID NO: 3414285 - RNA, 21 nt, Pseudomonas aeruginosa PA01
cggcggucaucgcgccgccga

SEQ ID NO: 3414286 - RNA, 12 nt, Pseudomonas aeruginosa PA01
cggcggucccag

SEQ ID NO: 3414287 - RNA, 20 nt, Pseudomonas aeruginosa PA01
cggcggucccagaccagcag

SEQ ID NO: 3414288 - RNA, 21 nt, Pseudomonas aeruginosa PA01
cggcggucccagaccagcagc

SEQ ID NO: 3414289 - RNA, 16 nt, Pseudomonas aeruginosa PA01
cggcggucccaucagc

SEQ ID NO: 3414290 - RNA, 18 nt, Pseudomonas aeruginosa PA01
cggcggucccaucagcag

SEQ ID NO: 3414291 - RNA, 23 nt, Pseudomonas aeruginosa PA01
cggcggucccuucgugggccugc

SEQ ID NO: 3414292 - RNA, 14 nt, Pseudomonas aeruginosa PA01
cggcgguccgccgc

SEQ ID NO: 3414293 - RNA, 17 nt, Pseudomonas aeruginosa PA01
cggcggucgcgaucugc

SEQ ID NO: 3414294 - RNA, 19 nt, Pseudomonas aeruginosa PA01
cggcggucucgaacgccag

SEQ ID NO: 3414295 - RNA, 20 nt, Pseudomonas aeruginosa PA01
cggcggucucgaacgccagg

SEQ ID NO: 3414296 - RNA, 24 nt, Pseudomonas aeruginosa PA01
cggcggucucgaacgccaggcagg

SEQ ID NO: 3414297 - RNA, 18 nt, Pseudomonas aeruginosa PA01
cggcggucuugaucacgu

SEQ ID NO: 3414298 - RNA, 16 nt, Pseudomonas aeruginosa PA01
cggcggugaaggcgaa

SEQ ID NO: 3414299 - RNA, 14 nt, Pseudomonas aeruginosa PA01
cggcggugaugccg

SEQ ID NO: 3414300 - RNA, 16 nt, Pseudomonas aeruginosa PA01
cggcggugcagaacgc

SEQ ID NO: 3414301 - RNA, 22 nt, Pseudomonas aeruginosa PA01
cggcggugccauggaucaccag

SEQ ID NO: 3414302 - RNA, 14 nt, Pseudomonas aeruginosa PA01
cggcggugcgccgg

SEQ ID NO: 3414303 - RNA, 15 nt, Pseudomonas aeruginosa PA01
cggcgguggagcaga

SEQ ID NO: 3414304 - RNA, 16 nt, Pseudomonas aeruginosa PA01
cggcgguggggaagcg

SEQ ID NO: 3414305 - RNA, 17 nt, Pseudomonas aeruginosa PA01
cggcgguggggccgccg

SEQ ID NO: 3414306 - RNA, 18 nt, Pseudomonas aeruginosa PA01
cggcgguggggccgccga

SEQ ID NO: 3414307 - RNA, 15 nt, Pseudomonas aeruginosa PA01
cggcgguucgauccc

SEQ ID NO: 3414308 - RNA, 21 nt, Pseudomonas aeruginosa PA01
cggcgguucgaucccgucauc

SEQ ID NO: 3414309 - RNA, 13 nt, Pseudomonas aeruginosa PA01
cggcgguucgccg

SEQ ID NO: 3414310 - RNA, 23 nt, Pseudomonas aeruginosa PA01
cggcgguucgccgagcgccgcca

SEQ ID NO: 3414311 - RNA, 17 nt, Pseudomonas aeruginosa PA01
cggcgguuucgccgagg

SEQ ID NO: 3414312 - RNA, 19 nt, Pseudomonas aeruginosa PA01
cggcgguuucgccgaggcc

SEQ ID NO: 3414313 - RNA, 16 nt, Pseudomonas aeruginosa PA01
cggcguaaucgcgcca

SEQ ID NO: 3414314 - RNA, 20 nt, Pseudomonas aeruginosa PA01
cggcguaccaggaugcccug

SEQ ID NO: 3414315 - RNA, 16 nt, Pseudomonas aeruginosa PA01
cggcguaccguuggcg

SEQ ID NO: 3414316 - RNA, 22 nt, Pseudomonas aeruginosa PA01
cggcguacgaaccccgggccgc

SEQ ID NO: 3414317 - RNA, 16 nt, Pseudomonas aeruginosa PA01
cggcguacuucggcgc

SEQ ID NO: 3414318 - RNA, 21 nt, Pseudomonas aeruginosa PA01
cggcguacuucggcgcggugc

SEQ ID NO: 3414319 - RNA, 16 nt, Pseudomonas aeruginosa PA01
cggcguagccggccag

SEQ ID NO: 3414320 - RNA, 14 nt, Pseudomonas aeruginosa PA01
cggcguagccggcg

SEQ ID NO: 3414321 - RNA, 17 nt, Pseudomonas aeruginosa PA01
cggcguagccggcgauc

SEQ ID NO: 3414322 - RNA, 19 nt, Pseudomonas aeruginosa PA01
cggcguagccggcgauccg

SEQ ID NO: 3414323 - RNA, 20 nt, Pseudomonas aeruginosa PA01
cggcguagccggcgauccgc

SEQ ID NO: 3414324 - RNA, 15 nt, Pseudomonas aeruginosa PA01
cggcguagcgcaggg

SEQ ID NO: 3414325 - RNA, 20 nt, Pseudomonas aeruginosa PA01
cggcguagcgcagggucgcg

SEQ ID NO: 3414326 - RNA, 17 nt, Pseudomonas aeruginosa PA01
cggcguaggccucggag

SEQ ID NO: 3414327 - RNA, 16 nt, Pseudomonas aeruginosa PA01
cggcguaggcgcgcca

SEQ ID NO: 3414328 - RNA, 22 nt, Pseudomonas aeruginosa PA01
cggcguagugcuggguggaggc

SEQ ID NO: 3414329 - RNA, 20 nt, Pseudomonas aeruginosa PA01
cggcguauccaagagagcgc

SEQ ID NO: 3414330 - RNA, 15 nt, Pseudomonas aeruginosa PA01
cggcguauccucggc

SEQ ID NO: 3414331 - RNA, 22 nt, Pseudomonas aeruginosa PA01
cggcguaugcgccuccagguag

SEQ ID NO: 3414332 - RNA, 22 nt, Pseudomonas aeruginosa PA01
cggcguaugguggaggaagcgc

SEQ ID NO: 3414333 - RNA, 16 nt, Pseudomonas aeruginosa PA01
cggcguauucgccgaa

SEQ ID NO: 3414334 - RNA, 15 nt, Pseudomonas aeruginosa PA01
cggcgucacgccgau

SEQ ID NO: 3414335 - RNA, 20 nt, Pseudomonas aeruginosa PA01
cggcgucacgccgaucccgg

SEQ ID NO: 3414336 - RNA, 16 nt, Pseudomonas aeruginosa PA01
cggcguccacuccggc

SEQ ID NO: 3414337 - RNA, 19 nt, Pseudomonas aeruginosa PA01
cggcguccacuccggcagc

SEQ ID NO: 3414338 - RNA, 20 nt, Pseudomonas aeruginosa PA01
cggcguccacuccggcagca

SEQ ID NO: 3414339 - RNA, 21 nt, Pseudomonas aeruginosa PA01
cggcguccacuccggcagcac

SEQ ID NO: 3414340 - RNA, 22 nt, Pseudomonas aeruginosa PA01
cggcguccacuccggcagcacc

SEQ ID NO: 3414341 - RNA, 23 nt, Pseudomonas aeruginosa PA01
cggcguccacuccggcagcaccc

SEQ ID NO: 3414342 - RNA, 13 nt, Pseudomonas aeruginosa PA01
cggcguccaggag

SEQ ID NO: 3414343 - RNA, 19 nt, Pseudomonas aeruginosa PA01
cggcguccauggcggcgau

SEQ ID NO: 3414344 - RNA, 12 nt, Pseudomonas aeruginosa PA01
cggcguccccuu

SEQ ID NO: 3414345 - RNA, 13 nt, Pseudomonas aeruginosa PA01
cggcgucccggcg

SEQ ID NO: 3414346 - RNA, 14 nt, Pseudomonas aeruginosa PA01
cggcguccgccggg

SEQ ID NO: 3414347 - RNA, 15 nt, Pseudomonas aeruginosa PA01
cggcguccgccgggu

SEQ ID NO: 3414348 - RNA, 14 nt, Pseudomonas aeruginosa PA01
cggcguccgccucg

SEQ ID NO: 3414349 - RNA, 15 nt, Pseudomonas aeruginosa PA01
cggcguccgccucgc

SEQ ID NO: 3414350 - RNA, 18 nt, Pseudomonas aeruginosa PA01
cggcguccgccucgcuga

SEQ ID NO: 3414351 - RNA, 20 nt, Pseudomonas aeruginosa PA01
cggcguccgcggccugcucg

SEQ ID NO: 3414352 - RNA, 18 nt, Pseudomonas aeruginosa PA01
cggcguccgggugcccca

SEQ ID NO: 3414353 - RNA, 23 nt, Pseudomonas aeruginosa PA01
cggcguccgggugccccaggcga

SEQ ID NO: 3414354 - RNA, 15 nt, Pseudomonas aeruginosa PA01
cggcguccuccucca

SEQ ID NO: 3414355 - RNA, 12 nt, Pseudomonas aeruginosa PA01
cggcguccucgc

SEQ ID NO: 3414356 - RNA, 15 nt, Pseudomonas aeruginosa PA01
cggcguccucggaga

SEQ ID NO: 3414357 - RNA, 17 nt, Pseudomonas aeruginosa PA01
cggcguccucggagagc

SEQ ID NO: 3414358 - RNA, 21 nt, Pseudomonas aeruginosa PA01
cggcguccucggagagcagcc

SEQ ID NO: 3414359 - RNA, 15 nt, Pseudomonas aeruginosa PA01
cggcguccuggucga

SEQ ID NO: 3414360 - RNA, 15 nt, Pseudomonas aeruginosa PA01
cggcguccuugccga

SEQ ID NO: 3414361 - RNA, 16 nt, Pseudomonas aeruginosa PA01
cggcguccuugccgag

SEQ ID NO: 3414362 - RNA, 13 nt, Pseudomonas aeruginosa PA01
cggcgucgaccac

SEQ ID NO: 3414363 - RNA, 21 nt, Pseudomonas aeruginosa PA01
cggcgucgaccacggccuucg

SEQ ID NO: 3414364 - RNA, 22 nt, Pseudomonas aeruginosa PA01
cggcgucgaccacggccuucgg

SEQ ID NO: 3414365 - RNA, 22 nt, Pseudomonas aeruginosa PA01
cggcgucgaggugcggcugccg

SEQ ID NO: 3414366 - RNA, 13 nt, Pseudomonas aeruginosa PA01
cggcgucgcgcag

SEQ ID NO: 3414367 - RNA, 14 nt, Pseudomonas aeruginosa PA01
cggcgucgcgcagg

SEQ ID NO: 3414368 - RNA, 13 nt, Pseudomonas aeruginosa PA01
cggcgucggcgaa

SEQ ID NO: 3414369 - RNA, 17 nt, Pseudomonas aeruginosa PA01
cggcgucggcgagcagg

SEQ ID NO: 3414370 - RNA, 13 nt, Pseudomonas aeruginosa PA01
cggcgucggcgcg

SEQ ID NO: 3414371 - RNA, 19 nt, Pseudomonas aeruginosa PA01
cggcgucggcgcgggcgcc

SEQ ID NO: 3414372 - RNA, 23 nt, Pseudomonas aeruginosa PA01
cggcgucggcgcgggcgccgaug

SEQ ID NO: 3414373 - RNA, 20 nt, Pseudomonas aeruginosa PA01
cggcgucggcugcgcugggc

SEQ ID NO: 3414374 - RNA, 17 nt, Pseudomonas aeruginosa PA01
cggcgucggcuggucga

SEQ ID NO: 3414375 - RNA, 23 nt, Pseudomonas aeruginosa PA01
cggcgucggcuggucgaagcgga

SEQ ID NO: 3414376 - RNA, 22 nt, Pseudomonas aeruginosa PA01
cggcgucgggcgaaacggcagg

SEQ ID NO: 3414377 - RNA, 16 nt, Pseudomonas aeruginosa PA01
cggcgucguccugcgc

SEQ ID NO: 3414378 - RNA, 19 nt, Pseudomonas aeruginosa PA01
cggcgucguccugcgcggc

SEQ ID NO: 3414379 - RNA, 22 nt, Pseudomonas aeruginosa PA01
cggcgucguccugcgcggcgac

SEQ ID NO: 3414380 - RNA, 17 nt, Pseudomonas aeruginosa PA01
cggcgucgucgaucgga

SEQ ID NO: 3414381 - RNA, 18 nt, Pseudomonas aeruginosa PA01
cggcgucgucgcugcgcg

SEQ ID NO: 3414382 - RNA, 24 nt, Pseudomonas aeruginosa PA01
cggcgucucauggaacagcagcca

SEQ ID NO: 3414383 - RNA, 20 nt, Pseudomonas aeruginosa PA01
cggcgucucggagugaggcc

SEQ ID NO: 3414384 - RNA, 22 nt, Pseudomonas aeruginosa PA01
cggcgucuggggugaggccgag

SEQ ID NO: 3414385 - RNA, 14 nt, Pseudomonas aeruginosa PA01
cggcgucuucggcg

SEQ ID NO: 3414386 - RNA, 18 nt, Pseudomonas aeruginosa PA01
cggcgucuugucgaagcc

SEQ ID NO: 3414387 - RNA, 17 nt, Pseudomonas aeruginosa PA01
cggcgugaacgcggcga

SEQ ID NO: 3414388 - RNA, 19 nt, Pseudomonas aeruginosa PA01
cggcgugaacgcggcgaga

SEQ ID NO: 3414389 - RNA, 17 nt, Pseudomonas aeruginosa PA01
cggcgugaagccgccgc

SEQ ID NO: 3414390 - RNA, 21 nt, Pseudomonas aeruginosa PA01
cggcgugaagccgccgcccag

SEQ ID NO: 3414391 - RNA, 22 nt, Pseudomonas aeruginosa PA01
cggcgugaagccgccgcccagc

SEQ ID NO: 3414392 - RNA, 14 nt, Pseudomonas aeruginosa PA01
cggcgugagcaggg

SEQ ID NO: 3414393 - RNA, 22 nt, Pseudomonas aeruginosa PA01
cggcgugagggucgcgccgacg

SEQ ID NO: 3414394 - RNA, 19 nt, Pseudomonas aeruginosa PA01
cggcgugauccgcagguag

SEQ ID NO: 3414395 - RNA, 16 nt, Pseudomonas aeruginosa PA01
cggcgugcaggccgau

SEQ ID NO: 3414396 - RNA, 21 nt, Pseudomonas aeruginosa PA01
cggcgugcaggccgaucagga

SEQ ID NO: 3414397 - RNA, 16 nt, Pseudomonas aeruginosa PA01
cggcgugcauggccgg

SEQ ID NO: 3414398 - RNA, 22 nt, Pseudomonas aeruginosa PA01
cggcgugcccauccgcucggcg

SEQ ID NO: 3414399 - RNA, 23 nt, Pseudomonas aeruginosa PA01
cggcgugcccauccgcucggcga

SEQ ID NO: 3414400 - RNA, 17 nt, Pseudomonas aeruginosa PA01
cggcgugcccuuuuccu

SEQ ID NO: 3414401 - RNA, 13 nt, Pseudomonas aeruginosa PA01
cggcgugccgacc

SEQ ID NO: 3414402 - RNA, 14 nt, Pseudomonas aeruginosa PA01
cggcgugccgaccu

SEQ ID NO: 3414403 - RNA, 15 nt, Pseudomonas aeruginosa PA01
cggcgugccgcaacg

SEQ ID NO: 3414404 - RNA, 17 nt, Pseudomonas aeruginosa PA01
cggcgugccgcaacgau

SEQ ID NO: 3414405 - RNA, 14 nt, Pseudomonas aeruginosa PA01
cggcgugccgcagg

SEQ ID NO: 3414406 - RNA, 20 nt, Pseudomonas aeruginosa PA01
cggcgugccgcaggccgcgg

SEQ ID NO: 3414407 - RNA, 19 nt, Pseudomonas aeruginosa PA01
cggcgugccguggcucggc

SEQ ID NO: 3414408 - RNA, 20 nt, Pseudomonas aeruginosa PA01
cggcgugccguggcucggcg

SEQ ID NO: 3414409 - RNA, 23 nt, Pseudomonas aeruginosa PA01
cggcgugccguggcucggcggca

SEQ ID NO: 3414410 - RNA, 15 nt, Pseudomonas aeruginosa PA01
cggcgugcugggucu

SEQ ID NO: 3414411 - RNA, 22 nt, Pseudomonas aeruginosa PA01
cggcgugcugggucuccuccuc

SEQ ID NO: 3414412 - RNA, 18 nt, Pseudomonas aeruginosa PA01
cggcguggaaggccacua

SEQ ID NO: 3414413 - RNA, 18 nt, Pseudomonas aeruginosa PA01
cggcguggcaccgcuucu

SEQ ID NO: 3414414 - RNA, 18 nt, Pseudomonas aeruginosa PA01
cggcguggccggcgacca

SEQ ID NO: 3414415 - RNA, 21 nt, Pseudomonas aeruginosa PA01
cggcguggccggcgaccagcu

SEQ ID NO: 3414416 - RNA, 15 nt, Pseudomonas aeruginosa PA01
cggcguggcgaucag

SEQ ID NO: 3414417 - RNA, 13 nt, Pseudomonas aeruginosa PA01
cggcguggcuacg

SEQ ID NO: 3414418 - RNA, 15 nt, Pseudomonas aeruginosa PA01
cggcguggcucgauc

SEQ ID NO: 3414419 - RNA, 19 nt, Pseudomonas aeruginosa PA01
cggcguggcucgaucagcc

SEQ ID NO: 3414420 - RNA, 21 nt, Pseudomonas aeruginosa PA01
cggcguggcucgaucagccgg

SEQ ID NO: 3414421 - RNA, 17 nt, Pseudomonas aeruginosa PA01
cggcgugggcggucggc

SEQ ID NO: 3414422 - RNA, 20 nt, Pseudomonas aeruginosa PA01
cggcgugggcggucggcgag

SEQ ID NO: 3414423 - RNA, 22 nt, Pseudomonas aeruginosa PA01
cggcguggucuccgugcuggcc

SEQ ID NO: 3414424 - RNA, 14 nt, Pseudomonas aeruginosa PA01
cggcgugguugccu

SEQ ID NO: 3414425 - RNA, 14 nt, Pseudomonas aeruginosa PA01
cggcguguccaggg

SEQ ID NO: 3414426 - RNA, 21 nt, Pseudomonas aeruginosa PA01
cggcguuagccgccugcggcg

SEQ ID NO: 3414427 - RNA, 15 nt, Pseudomonas aeruginosa PA01
cggcguucaccgcgc

SEQ ID NO: 3414428 - RNA, 12 nt, Pseudomonas aeruginosa PA01
cggcguucgccc

SEQ ID NO: 3414429 - RNA, 13 nt, Pseudomonas aeruginosa PA01
cggcguucgccga

SEQ ID NO: 3414430 - RNA, 16 nt, Pseudomonas aeruginosa PA01
cggcguucgccgagca

SEQ ID NO: 3414431 - RNA, 15 nt, Pseudomonas aeruginosa PA01
cggcguucgccgcgg

SEQ ID NO: 3414432 - RNA, 19 nt, Pseudomonas aeruginosa PA01
cggcguucgccgcgggcgu

SEQ ID NO: 3414433 - RNA, 15 nt, Pseudomonas aeruginosa PA01
cggcguucggaccug

SEQ ID NO: 3414434 - RNA, 20 nt, Pseudomonas aeruginosa PA01
cggcguucggaccugucccg

SEQ ID NO: 3414435 - RNA, 22 nt, Pseudomonas aeruginosa PA01
cggcguucggggcccuccaggc

SEQ ID NO: 3414436 - RNA, 19 nt, Pseudomonas aeruginosa PA01
cggcguugaacugcccgca

SEQ ID NO: 3414437 - RNA, 15 nt, Pseudomonas aeruginosa PA01
cggcguugcgcgccc

SEQ ID NO: 3414438 - RNA, 21 nt, Pseudomonas aeruginosa PA01
cggcguugcugaucgcuccgc

SEQ ID NO: 3414439 - RNA, 14 nt, Pseudomonas aeruginosa PA01
cggcguuggccgag

SEQ ID NO: 3414440 - RNA, 16 nt, Pseudomonas aeruginosa PA01
cggcguuggcgucgcu

SEQ ID NO: 3414441 - RNA, 20 nt, Pseudomonas aeruginosa PA01
cggcguuggcgucgcugccg

SEQ ID NO: 3414442 - RNA, 15 nt, Pseudomonas aeruginosa PA01
cggcguuguccaggc

SEQ ID NO: 3414443 - RNA, 22 nt, Pseudomonas aeruginosa PA01
cggcguuguccaggcuguggcg

SEQ ID NO: 3414444 - RNA, 17 nt, Pseudomonas aeruginosa PA01
cggcguugucggccagc

SEQ ID NO: 3414445 - RNA, 20 nt, Pseudomonas aeruginosa PA01
cggcguugucggccagcagc

SEQ ID NO: 3414446 - RNA, 19 nt, Pseudomonas aeruginosa PA01
cggcguuuagcgcccgacg

SEQ ID NO: 3414447 - RNA, 13 nt, Pseudomonas aeruginosa PA01
cggcguuucgccg

SEQ ID NO: 3414448 - RNA, 14 nt, Pseudomonas aeruginosa PA01
cggcguuucgccgg

SEQ ID NO: 3414449 - RNA, 21 nt, Pseudomonas aeruginosa PA01
cggcguuuuucauugggcagc

SEQ ID NO: 3414450 - RNA, 12 nt, Pseudomonas aeruginosa PA01
cggcuaaccgcc

SEQ ID NO: 3414451 - RNA, 14 nt, Pseudomonas aeruginosa PA01
cggcuaaccgcgaa

SEQ ID NO: 3414452 - RNA, 14 nt, Pseudomonas aeruginosa PA01
cggcuacaggccgu

SEQ ID NO: 3414453 - RNA, 13 nt, Pseudomonas aeruginosa PA01
cggcuacccgcgc

SEQ ID NO: 3414454 - RNA, 14 nt, Pseudomonas aeruginosa PA01
cggcuacccgcgcc

SEQ ID NO: 3414455 - RNA, 16 nt, Pseudomonas aeruginosa PA01
cggcuacccucucccc

SEQ ID NO: 3414456 - RNA, 19 nt, Pseudomonas aeruginosa PA01
cggcuacccucuccccaac

SEQ ID NO: 3414457 - RNA, 17 nt, Pseudomonas aeruginosa PA01
cggcuacgaaccgagcg

SEQ ID NO: 3414458 - RNA, 15 nt, Pseudomonas aeruginosa PA01
cggcuacucgcccga

SEQ ID NO: 3414459 - RNA, 18 nt, Pseudomonas aeruginosa PA01
cggcuacucgcccgaccc

SEQ ID NO: 3414460 - RNA, 20 nt, Pseudomonas aeruginosa PA01
cggcucaacugguuggccgc

SEQ ID NO: 3414461 - RNA, 16 nt, Pseudomonas aeruginosa PA01
cggcucaauccggcug

SEQ ID NO: 3414462 - RNA, 17 nt, Pseudomonas aeruginosa PA01
cggcucaauccggcugg

SEQ ID NO: 3414463 - RNA, 18 nt, Pseudomonas aeruginosa PA01
cggcucaauccggcugga

SEQ ID NO: 3414464 - RNA, 16 nt, Pseudomonas aeruginosa PA01
cggcucacgccccagc

SEQ ID NO: 3414465 - RNA, 19 nt, Pseudomonas aeruginosa PA01
cggcucacgccccagcgca

SEQ ID NO: 3414466 - RNA, 18 nt, Pseudomonas aeruginosa PA01
cggcucagaacagcggca

SEQ ID NO: 3414467 - RNA, 20 nt, Pseudomonas aeruginosa PA01
cggcucagaacagcggcagc

SEQ ID NO: 3414468 - RNA, 18 nt, Pseudomonas aeruginosa PA01
cggcucagccgaccaccu

SEQ ID NO: 3414469 - RNA, 15 nt, Pseudomonas aeruginosa PA01
cggcucagccgcugg

SEQ ID NO: 3414470 - RNA, 13 nt, Pseudomonas aeruginosa PA01
cggcucagcgcuu

SEQ ID NO: 3414471 - RNA, 15 nt, Pseudomonas aeruginosa PA01
cggcucagcgcuucg

SEQ ID NO: 3414472 - RNA, 15 nt, Pseudomonas aeruginosa PA01
cggcucaggccgccg

SEQ ID NO: 3414473 - RNA, 17 nt, Pseudomonas aeruginosa PA01
cggcucaggccgccgcg

SEQ ID NO: 3414474 - RNA, 20 nt, Pseudomonas aeruginosa PA01
cggcucaggccgccgcgucg

SEQ ID NO: 3414475 - RNA, 17 nt, Pseudomonas aeruginosa PA01
cggcucauggccggggu

SEQ ID NO: 3414476 - RNA, 16 nt, Pseudomonas aeruginosa PA01
cggcuccagcaccagc

SEQ ID NO: 3414477 - RNA, 22 nt, Pseudomonas aeruginosa PA01
cggcuccagcaccagcacgccc

SEQ ID NO: 3414478 - RNA, 23 nt, Pseudomonas aeruginosa PA01
cggcuccagcaccagcacgcccu

SEQ ID NO: 3414479 - RNA, 14 nt, Pseudomonas aeruginosa PA01
cggcuccagccagg

SEQ ID NO: 3414480 - RNA, 18 nt, Pseudomonas aeruginosa PA01
cggcuccagccgcugcag

SEQ ID NO: 3414481 - RNA, 16 nt, Pseudomonas aeruginosa PA01
cggcuccagccgggcu

SEQ ID NO: 3414482 - RNA, 22 nt, Pseudomonas aeruginosa PA01
cggcuccagccgggcuccgccg

SEQ ID NO: 3414483 - RNA, 16 nt, Pseudomonas aeruginosa PA01
cggcuccagcuugucg

SEQ ID NO: 3414484 - RNA, 17 nt, Pseudomonas aeruginosa PA01
cggcuccaggaccggca

SEQ ID NO: 3414485 - RNA, 13 nt, Pseudomonas aeruginosa PA01
cggcuccagggcg

SEQ ID NO: 3414486 - RNA, 14 nt, Pseudomonas aeruginosa PA01
cggcuccagggcga

SEQ ID NO: 3414487 - RNA, 15 nt, Pseudomonas aeruginosa PA01
cggcuccagggcgaa

SEQ ID NO: 3414488 - RNA, 20 nt, Pseudomonas aeruginosa PA01
cggcuccaguugcagcaccc

SEQ ID NO: 3414489 - RNA, 22 nt, Pseudomonas aeruginosa PA01
cggcuccaguugcagcaccccc

SEQ ID NO: 3414490 - RNA, 23 nt, Pseudomonas aeruginosa PA01
cggcuccccuggaaugccggccg

SEQ ID NO: 3414491 - RNA, 12 nt, Pseudomonas aeruginosa PA01
cggcuccgcgca

SEQ ID NO: 3414492 - RNA, 21 nt, Pseudomonas aeruginosa PA01
cggcuccggauggcugacccg

SEQ ID NO: 3414493 - RNA, 16 nt, Pseudomonas aeruginosa PA01
cggcuccggcgccagg

SEQ ID NO: 3414494 - RNA, 19 nt, Pseudomonas aeruginosa PA01
cggcuccggcuccgcgcac

SEQ ID NO: 3414495 - RNA, 21 nt, Pseudomonas aeruginosa PA01
cggcuccggguacuggcgcug

SEQ ID NO: 3414496 - RNA, 13 nt, Pseudomonas aeruginosa PA01
cggcuccucggcc

SEQ ID NO: 3414497 - RNA, 19 nt, Pseudomonas aeruginosa PA01
cggcuccucggccugggcg

SEQ ID NO: 3414498 - RNA, 20 nt, Pseudomonas aeruginosa PA01
cggcuccucugccugcgccc

SEQ ID NO: 3414499 - RNA, 17 nt, Pseudomonas aeruginosa PA01
cggcucgcccagcaggc

SEQ ID NO: 3414500 - RNA, 18 nt, Pseudomonas aeruginosa PA01
cggcucgcccaugcgcgg

SEQ ID NO: 3414501 - RNA, 19 nt, Pseudomonas aeruginosa PA01
cggcucgcccaugcgcggc

SEQ ID NO: 3414502 - RNA, 20 nt, Pseudomonas aeruginosa PA01
cggcucgcccaugcgcggcg

SEQ ID NO: 3414503 - RNA, 21 nt, Pseudomonas aeruginosa PA01
cggcucgcccaugcgcggcga

SEQ ID NO: 3414504 - RNA, 22 nt, Pseudomonas aeruginosa PA01
cggcucgccgccgggcgcgcgc

SEQ ID NO: 3414505 - RNA, 14 nt, Pseudomonas aeruginosa PA01
cggcucgccgcgcu

SEQ ID NO: 3414506 - RNA, 13 nt, Pseudomonas aeruginosa PA01
cggcucgccgggu

SEQ ID NO: 3414507 - RNA, 17 nt, Pseudomonas aeruginosa PA01
cggcucgcgcagcggcg

SEQ ID NO: 3414508 - RNA, 18 nt, Pseudomonas aeruginosa PA01
cggcucgcgcagcggcgc

SEQ ID NO: 3414509 - RNA, 14 nt, Pseudomonas aeruginosa PA01
cggcucgcgccggc

SEQ ID NO: 3414510 - RNA, 16 nt, Pseudomonas aeruginosa PA01
cggcucgcgggucacc

SEQ ID NO: 3414511 - RNA, 20 nt, Pseudomonas aeruginosa PA01
cggcucgcgguucgaggacu

SEQ ID NO: 3414512 - RNA, 22 nt, Pseudomonas aeruginosa PA01
cggcucgcgguucgaggacuuc

SEQ ID NO: 3414513 - RNA, 22 nt, Pseudomonas aeruginosa PA01
cggcucgcucucgaacaccggc

SEQ ID NO: 3414514 - RNA, 23 nt, Pseudomonas aeruginosa PA01
cggcucgcugaaauccaccagca

SEQ ID NO: 3414515 - RNA, 13 nt, Pseudomonas aeruginosa PA01
cggcucgcugacg

SEQ ID NO: 3414516 - RNA, 17 nt, Pseudomonas aeruginosa PA01
cggcucgcugacgccau

SEQ ID NO: 3414517 - RNA, 19 nt, Pseudomonas aeruginosa PA01
cggcucggcaagcgaaccg

SEQ ID NO: 3414518 - RNA, 20 nt, Pseudomonas aeruginosa PA01
cggcucggccagggccgcuc

SEQ ID NO: 3414519 - RNA, 22 nt, Pseudomonas aeruginosa PA01
cggcucggccagggccgcucga

SEQ ID NO: 3414520 - RNA, 18 nt, Pseudomonas aeruginosa PA01
cggcucggccgugugccu

SEQ ID NO: 3414521 - RNA, 12 nt, Pseudomonas aeruginosa PA01
cggcucggcggg

SEQ ID NO: 3414522 - RNA, 21 nt, Pseudomonas aeruginosa PA01
cggcucggcgggcugccgcgg

SEQ ID NO: 3414523 - RNA, 14 nt, Pseudomonas aeruginosa PA01
cggcucggcugcuu

SEQ ID NO: 3414524 - RNA, 16 nt, Pseudomonas aeruginosa PA01
cggcucgggcggcaag

SEQ ID NO: 3414525 - RNA, 18 nt, Pseudomonas aeruginosa PA01
cggcucgguuuccaccug

SEQ ID NO: 3414526 - RNA, 23 nt, Pseudomonas aeruginosa PA01
cggcucgucaucguccagcucgg

SEQ ID NO: 3414527 - RNA, 12 nt, Pseudomonas aeruginosa PA01
cggcucgucggc

SEQ ID NO: 3414528 - RNA, 15 nt, Pseudomonas aeruginosa PA01
cggcucgugcgacuc

SEQ ID NO: 3414529 - RNA, 16 nt, Pseudomonas aeruginosa PA01
cggcucgugucgacuc

SEQ ID NO: 3414530 - RNA, 16 nt, Pseudomonas aeruginosa PA01
cggcucucuucggccg

SEQ ID NO: 3414531 - RNA, 20 nt, Pseudomonas aeruginosa PA01
cggcucugcuucugucccug

SEQ ID NO: 3414532 - RNA, 14 nt, Pseudomonas aeruginosa PA01
cggcucuggaugcg

SEQ ID NO: 3414533 - RNA, 13 nt, Pseudomonas aeruginosa PA01
cggcucuggcgca

SEQ ID NO: 3414534 - RNA, 15 nt, Pseudomonas aeruginosa PA01
cggcucuggcgcagg

SEQ ID NO: 3414535 - RNA, 23 nt, Pseudomonas aeruginosa PA01
cggcucuuccccuaccggcaagg

SEQ ID NO: 3414536 - RNA, 19 nt, Pseudomonas aeruginosa PA01
cggcucuuuccgggucauu

SEQ ID NO: 3414537 - RNA, 13 nt, Pseudomonas aeruginosa PA01
cggcugaagaagc

SEQ ID NO: 3414538 - RNA, 20 nt, Pseudomonas aeruginosa PA01
cggcugaagaagcugcccca

SEQ ID NO: 3414539 - RNA, 15 nt, Pseudomonas aeruginosa PA01
cggcugaaggccgaa

SEQ ID NO: 3414540 - RNA, 14 nt, Pseudomonas aeruginosa PA01
cggcugaccggcau

SEQ ID NO: 3414541 - RNA, 15 nt, Pseudomonas aeruginosa PA01
cggcugaccggcauc

SEQ ID NO: 3414542 - RNA, 23 nt, Pseudomonas aeruginosa PA01
cggcugacgaaguccuugugcug

SEQ ID NO: 3414543 - RNA, 15 nt, Pseudomonas aeruginosa PA01
cggcugacgcuggcg

SEQ ID NO: 3414544 - RNA, 20 nt, Pseudomonas aeruginosa PA01
cggcugacgcuggcgaaggc

SEQ ID NO: 3414545 - RNA, 14 nt, Pseudomonas aeruginosa PA01
cggcugagcgccag

SEQ ID NO: 3414546 - RNA, 16 nt, Pseudomonas aeruginosa PA01
cggcugagcgccaggc

SEQ ID NO: 3414547 - RNA, 19 nt, Pseudomonas aeruginosa PA01
cggcugagcgccaggcgca

SEQ ID NO: 3414548 - RNA, 16 nt, Pseudomonas aeruginosa PA01
cggcugaggcuggcga

SEQ ID NO: 3414549 - RNA, 18 nt, Pseudomonas aeruginosa PA01
cggcugaucggccgccag

SEQ ID NO: 3414550 - RNA, 23 nt, Pseudomonas aeruginosa PA01
cggcugaugccgcgguaggucag

SEQ ID NO: 3414551 - RNA, 14 nt, Pseudomonas aeruginosa PA01
cggcugcaacgccg

SEQ ID NO: 3414552 - RNA, 16 nt, Pseudomonas aeruginosa PA01
cggcugcaacgccgcg

SEQ ID NO: 3414553 - RNA, 18 nt, Pseudomonas aeruginosa PA01
cggcugcaacgccgcggg

SEQ ID NO: 3414554 - RNA, 18 nt, Pseudomonas aeruginosa PA01
cggcugcaacgccggccc

SEQ ID NO: 3414555 - RNA, 15 nt, Pseudomonas aeruginosa PA01
cggcugcaacuucca

SEQ ID NO: 3414556 - RNA, 23 nt, Pseudomonas aeruginosa PA01
cggcugcaacuuccacucgccga

SEQ ID NO: 3414557 - RNA, 16 nt, Pseudomonas aeruginosa PA01
cggcugcauguccgcc

SEQ ID NO: 3414558 - RNA, 18 nt, Pseudomonas aeruginosa PA01
cggcugcccaagggccug

SEQ ID NO: 3414559 - RNA, 22 nt, Pseudomonas aeruginosa PA01
cggcugcccaagggccugggcg

SEQ ID NO: 3414560 - RNA, 15 nt, Pseudomonas aeruginosa PA01
cggcugcccgggguu

SEQ ID NO: 3414561 - RNA, 22 nt, Pseudomonas aeruginosa PA01
cggcugcccgggguuggcgcug

SEQ ID NO: 3414562 - RNA, 15 nt, Pseudomonas aeruginosa PA01
cggcugccgccagcu

SEQ ID NO: 3414563 - RNA, 16 nt, Pseudomonas aeruginosa PA01
cggcugccgccagcuc

SEQ ID NO: 3414564 - RNA, 14 nt, Pseudomonas aeruginosa PA01
cggcugccgcgcgu

SEQ ID NO: 3414565 - RNA, 13 nt, Pseudomonas aeruginosa PA01
cggcugcgccgcg

SEQ ID NO: 3414566 - RNA, 13 nt, Pseudomonas aeruginosa PA01
cggcugcgcgccg

SEQ ID NO: 3414567 - RNA, 17 nt, Pseudomonas aeruginosa PA01
cggcugcgcgccggguc

SEQ ID NO: 3414568 - RNA, 23 nt, Pseudomonas aeruginosa PA01
cggcugcgcgccgggucgacaug

SEQ ID NO: 3414569 - RNA, 17 nt, Pseudomonas aeruginosa PA01
cggcugcgcugggcgcc

SEQ ID NO: 3414570 - RNA, 19 nt, Pseudomonas aeruginosa PA01
cggcugcgugaggaucacg

SEQ ID NO: 3414571 - RNA, 21 nt, Pseudomonas aeruginosa PA01
cggcugcgugaggaucacgca

SEQ ID NO: 3414572 - RNA, 19 nt, Pseudomonas aeruginosa PA01
cggcugcuccggaucgcgc

SEQ ID NO: 3414573 - RNA, 13 nt, Pseudomonas aeruginosa PA01
cggcugcuccggg

SEQ ID NO: 3414574 - RNA, 16 nt, Pseudomonas aeruginosa PA01
cggcugcuccgggcgg

SEQ ID NO: 3414575 - RNA, 13 nt, Pseudomonas aeruginosa PA01
cggcugcugcgcc

SEQ ID NO: 3414576 - RNA, 18 nt, Pseudomonas aeruginosa PA01
cggcugcugcgccuggcc

SEQ ID NO: 3414577 - RNA, 23 nt, Pseudomonas aeruginosa PA01
cggcugcugcgccuggccgcgca

SEQ ID NO: 3414578 - RNA, 14 nt, Pseudomonas aeruginosa PA01
cggcugcugcugcg

SEQ ID NO: 3414579 - RNA, 13 nt, Pseudomonas aeruginosa PA01
cggcugcuugccg

SEQ ID NO: 3414580 - RNA, 17 nt, Pseudomonas aeruginosa PA01
cggcugcuugccgcuca

SEQ ID NO: 3414581 - RNA, 18 nt, Pseudomonas aeruginosa PA01
cggcugcuugccgcucag

SEQ ID NO: 3414582 - RNA, 20 nt, Pseudomonas aeruginosa PA01
cggcugcuugccgcucaggc

SEQ ID NO: 3414583 - RNA, 14 nt, Pseudomonas aeruginosa PA01
cggcugcuuggcca

SEQ ID NO: 3414584 - RNA, 15 nt, Pseudomonas aeruginosa PA01
cggcugcuuggccag

SEQ ID NO: 3414585 - RNA, 24 nt, Pseudomonas aeruginosa PA01
cggcuggaccuccuggcgcgucgg

SEQ ID NO: 3414586 - RNA, 23 nt, Pseudomonas aeruginosa PA01
cggcuggacgugcaggaucaccu

SEQ ID NO: 3414587 - RNA, 14 nt, Pseudomonas aeruginosa PA01
cggcuggcagggcg

SEQ ID NO: 3414588 - RNA, 16 nt, Pseudomonas aeruginosa PA01
cggcuggcagggcgcg

SEQ ID NO: 3414589 - RNA, 17 nt, Pseudomonas aeruginosa PA01
cggcuggcagggcgcgu

SEQ ID NO: 3414590 - RNA, 19 nt, Pseudomonas aeruginosa PA01
cggcuggcagggcgcgucc

SEQ ID NO: 3414591 - RNA, 14 nt, Pseudomonas aeruginosa PA01
cggcuggcaggugc

SEQ ID NO: 3414592 - RNA, 12 nt, Pseudomonas aeruginosa PA01
cggcuggccauc

SEQ ID NO: 3414593 - RNA, 17 nt, Pseudomonas aeruginosa PA01
cggcuggccauccgccc

SEQ ID NO: 3414594 - RNA, 19 nt, Pseudomonas aeruginosa PA01
cggcuggccauccgcccug

SEQ ID NO: 3414595 - RNA, 12 nt, Pseudomonas aeruginosa PA01
cggcuggcccuc

SEQ ID NO: 3414596 - RNA, 12 nt, Pseudomonas aeruginosa PA01
cggcuggccgag

SEQ ID NO: 3414597 - RNA, 13 nt, Pseudomonas aeruginosa PA01
cggcuggccgagg

SEQ ID NO: 3414598 - RNA, 16 nt, Pseudomonas aeruginosa PA01
cggcuggccgaggacc

SEQ ID NO: 3414599 - RNA, 21 nt, Pseudomonas aeruginosa PA01
cggcuggccgaggacccggcg

SEQ ID NO: 3414600 - RNA, 16 nt, Pseudomonas aeruginosa PA01
cggcuggccgagggcg

SEQ ID NO: 3414601 - RNA, 17 nt, Pseudomonas aeruginosa PA01
cggcuggccgagggcgc

SEQ ID NO: 3414602 - RNA, 17 nt, Pseudomonas aeruginosa PA01
cggcuggccgccucgcg

SEQ ID NO: 3414603 - RNA, 14 nt, Pseudomonas aeruginosa PA01
cggcuggccgccug

SEQ ID NO: 3414604 - RNA, 12 nt, Pseudomonas aeruginosa PA01
cggcuggccgcg

SEQ ID NO: 3414605 - RNA, 13 nt, Pseudomonas aeruginosa PA01
cggcuggccgcga

SEQ ID NO: 3414606 - RNA, 13 nt, Pseudomonas aeruginosa PA01
cggcuggccgcgg

SEQ ID NO: 3414607 - RNA, 15 nt, Pseudomonas aeruginosa PA01
cggcuggccgucgac

SEQ ID NO: 3414608 - RNA, 20 nt, Pseudomonas aeruginosa PA01
cggcuggccgucgacccgcc

SEQ ID NO: 3414609 - RNA, 22 nt, Pseudomonas aeruginosa PA01
cggcuggcgaaccaguccagca

SEQ ID NO: 3414610 - RNA, 14 nt, Pseudomonas aeruginosa PA01
cggcuggcgcagga

SEQ ID NO: 3414611 - RNA, 14 nt, Pseudomonas aeruginosa PA01
cggcuggcgccggu

SEQ ID NO: 3414612 - RNA, 16 nt, Pseudomonas aeruginosa PA01
cggcuggcgccggugc

SEQ ID NO: 3414613 - RNA, 21 nt, Pseudomonas aeruginosa PA01
cggcuggcgccggugcaugaa

SEQ ID NO: 3414614 - RNA, 20 nt, Pseudomonas aeruginosa PA01
cggcuggcgcgaucggggca

SEQ ID NO: 3414615 - RNA, 17 nt, Pseudomonas aeruginosa PA01
cggcuggcgcgcgcgcu

SEQ ID NO: 3414616 - RNA, 20 nt, Pseudomonas aeruginosa PA01
cggcuggcgcuugccgcgcc

SEQ ID NO: 3414617 - RNA, 13 nt, Pseudomonas aeruginosa PA01
cggcuggcggcuc

SEQ ID NO: 3414618 - RNA, 15 nt, Pseudomonas aeruginosa PA01
cggcuggcggcucgg

SEQ ID NO: 3414619 - RNA, 16 nt, Pseudomonas aeruginosa PA01
cggcuggcggcucggc

SEQ ID NO: 3414620 - RNA, 21 nt, Pseudomonas aeruginosa PA01
cggcuggcggcucggcugcuu

SEQ ID NO: 3414621 - RNA, 14 nt, Pseudomonas aeruginosa PA01
cggcuggcugaagc

SEQ ID NO: 3414622 - RNA, 16 nt, Pseudomonas aeruginosa PA01
cggcuggcugaagccg

SEQ ID NO: 3414623 - RNA, 13 nt, Pseudomonas aeruginosa PA01
cggcuggcugccc

SEQ ID NO: 3414624 - RNA, 20 nt, Pseudomonas aeruginosa PA01
cggcugggugucgaccuccg

SEQ ID NO: 3414625 - RNA, 23 nt, Pseudomonas aeruginosa PA01
cggcugggugucgaccuccgccg

SEQ ID NO: 3414626 - RNA, 16 nt, Pseudomonas aeruginosa PA01
cggcuggguucggcga

SEQ ID NO: 3414627 - RNA, 17 nt, Pseudomonas aeruginosa PA01
cggcuggguucggcgag

SEQ ID NO: 3414628 - RNA, 11 nt, Pseudomonas aeruginosa PA01
cggcuggucag

SEQ ID NO: 3414629 - RNA, 16 nt, Pseudomonas aeruginosa PA01
cggcuggucgaagcgg

SEQ ID NO: 3414630 - RNA, 14 nt, Pseudomonas aeruginosa PA01
cggcuggucgucgc

SEQ ID NO: 3414631 - RNA, 16 nt, Pseudomonas aeruginosa PA01
cggcuggucgucgcgg

SEQ ID NO: 3414632 - RNA, 20 nt, Pseudomonas aeruginosa PA01
cggcugguucugguccacca

SEQ ID NO: 3414633 - RNA, 22 nt, Pseudomonas aeruginosa PA01
cggcugguucugguccaccagc

SEQ ID NO: 3414634 - RNA, 15 nt, Pseudomonas aeruginosa PA01
cggcugguugccagc

SEQ ID NO: 3414635 - RNA, 16 nt, Pseudomonas aeruginosa PA01
cggcugguugccagca

SEQ ID NO: 3414636 - RNA, 17 nt, Pseudomonas aeruginosa PA01
cggcugguugccagcag

SEQ ID NO: 3414637 - RNA, 17 nt, Pseudomonas aeruginosa PA01
cggcuguagccacggcg

SEQ ID NO: 3414638 - RNA, 18 nt, Pseudomonas aeruginosa PA01
cggcugucgacgcagccg

SEQ ID NO: 3414639 - RNA, 13 nt, Pseudomonas aeruginosa PA01
cggcugugaccga

SEQ ID NO: 3414640 - RNA, 15 nt, Pseudomonas aeruginosa PA01
cggcugugcagggca

SEQ ID NO: 3414641 - RNA, 22 nt, Pseudomonas aeruginosa PA01
cggcugugcagggcagcggccc

SEQ ID NO: 3414642 - RNA, 17 nt, Pseudomonas aeruginosa PA01
cggcugugcucgacggg

SEQ ID NO: 3414643 - RNA, 21 nt, Pseudomonas aeruginosa PA01
cggcugugcucgaggaagcgc

SEQ ID NO: 3414644 - RNA, 21 nt, Pseudomonas aeruginosa PA01
cggcuguugccguucugugcg

SEQ ID NO: 3414645 - RNA, 15 nt, Pseudomonas aeruginosa PA01
cggcuguuucaggcc

SEQ ID NO: 3414646 - RNA, 18 nt, Pseudomonas aeruginosa PA01
cggcuguuucaggccggc

SEQ ID NO: 3414647 - RNA, 20 nt, Pseudomonas aeruginosa PA01
cggcuguuucaggccggcgu

SEQ ID NO: 3414648 - RNA, 13 nt, Pseudomonas aeruginosa PA01
cggcuucagccag

SEQ ID NO: 3414649 - RNA, 22 nt, Pseudomonas aeruginosa PA01
cggcuucagccagaccggcagc

SEQ ID NO: 3414650 - RNA, 13 nt, Pseudomonas aeruginosa PA01
cggcuucagcgcc

SEQ ID NO: 3414651 - RNA, 17 nt, Pseudomonas aeruginosa PA01
cggcuucagcgccaggc

SEQ ID NO: 3414652 - RNA, 19 nt, Pseudomonas aeruginosa PA01
cggcuucagcgccaggccg

SEQ ID NO: 3414653 - RNA, 18 nt, Pseudomonas aeruginosa PA01
cggcuuccaccagacgca

SEQ ID NO: 3414654 - RNA, 20 nt, Pseudomonas aeruginosa PA01
cggcuuccagguacggcccg

SEQ ID NO: 3414655 - RNA, 21 nt, Pseudomonas aeruginosa PA01
cggcuuccagguacggcccgc

SEQ ID NO: 3414656 - RNA, 16 nt, Pseudomonas aeruginosa PA01
cggcuuccucgcccuc

SEQ ID NO: 3414657 - RNA, 12 nt, Pseudomonas aeruginosa PA01
cggcuuccuggg

SEQ ID NO: 3414658 - RNA, 15 nt, Pseudomonas aeruginosa PA01
cggcuuccugggcga

SEQ ID NO: 3414659 - RNA, 14 nt, Pseudomonas aeruginosa PA01
cggcuucgaccacg

SEQ ID NO: 3414660 - RNA, 18 nt, Pseudomonas aeruginosa PA01
cggcuucgcgcuccaggc

SEQ ID NO: 3414661 - RNA, 14 nt, Pseudomonas aeruginosa PA01
cggcuucggcggcg

SEQ ID NO: 3414662 - RNA, 18 nt, Pseudomonas aeruginosa PA01
cggcuucggcggcgcgcu

SEQ ID NO: 3414663 - RNA, 13 nt, Pseudomonas aeruginosa PA01
cggcuucggucag

SEQ ID NO: 3414664 - RNA, 16 nt, Pseudomonas aeruginosa PA01
cggcuucguccugcug

SEQ ID NO: 3414665 - RNA, 18 nt, Pseudomonas aeruginosa PA01
cggcuucguccugcugcu

SEQ ID NO: 3414666 - RNA, 21 nt, Pseudomonas aeruginosa PA01
cggcuucuacgccuugcggcg

SEQ ID NO: 3414667 - RNA, 22 nt, Pseudomonas aeruginosa PA01
cggcuucuggaaggcggucagc

SEQ ID NO: 3414668 - RNA, 23 nt, Pseudomonas aeruginosa PA01
cggcuucugguucguccgcgcga

SEQ ID NO: 3414669 - RNA, 17 nt, Pseudomonas aeruginosa PA01
cggcuugaccgccgccg

SEQ ID NO: 3414670 - RNA, 20 nt, Pseudomonas aeruginosa PA01
cggcuugaccgccgccgccu

SEQ ID NO: 3414671 - RNA, 15 nt, Pseudomonas aeruginosa PA01
cggcuugaggaaaaa

SEQ ID NO: 3414672 - RNA, 16 nt, Pseudomonas aeruginosa PA01
cggcuugaggaaguag

SEQ ID NO: 3414673 - RNA, 13 nt, Pseudomonas aeruginosa PA01
cggcuugaucacg

SEQ ID NO: 3414674 - RNA, 19 nt, Pseudomonas aeruginosa PA01
cggcuugaucacgccgaag

SEQ ID NO: 3414675 - RNA, 11 nt, Pseudomonas aeruginosa PA01
cggcuugccgg

SEQ ID NO: 3414676 - RNA, 13 nt, Pseudomonas aeruginosa PA01
cggcuugccggca

SEQ ID NO: 3414677 - RNA, 16 nt, Pseudomonas aeruginosa PA01
cggcuugccggcagcg

SEQ ID NO: 3414678 - RNA, 19 nt, Pseudomonas aeruginosa PA01
cggcuugccggcagcgacc

SEQ ID NO: 3414679 - RNA, 21 nt, Pseudomonas aeruginosa PA01
cggcuugccggcagcgaccac

SEQ ID NO: 3414680 - RNA, 14 nt, Pseudomonas aeruginosa PA01
cggcuugccggcgc

SEQ ID NO: 3414681 - RNA, 17 nt, Pseudomonas aeruginosa PA01
cggcuugccggcggcgc

SEQ ID NO: 3414682 - RNA, 18 nt, Pseudomonas aeruginosa PA01
cggcuugccggcggcgcu

SEQ ID NO: 3414683 - RNA, 16 nt, Pseudomonas aeruginosa PA01
cggcuugcguucgcuc

SEQ ID NO: 3414684 - RNA, 17 nt, Pseudomonas aeruginosa PA01
cggcuuggcgggcucgc

SEQ ID NO: 3414685 - RNA, 14 nt, Pseudomonas aeruginosa PA01
cggcuuggcucagu

SEQ ID NO: 3414686 - RNA, 23 nt, Pseudomonas aeruginosa PA01
cggcuuggcucaguugcugauca

SEQ ID NO: 3414687 - RNA, 16 nt, Pseudomonas aeruginosa PA01
cggcuugggucagcgg

SEQ ID NO: 3414688 - RNA, 18 nt, Pseudomonas aeruginosa PA01
cggcuuggucacgccguu

SEQ ID NO: 3414689 - RNA, 17 nt, Pseudomonas aeruginosa PA01
cggcuuguccuggcgca

SEQ ID NO: 3414690 - RNA, 21 nt, Pseudomonas aeruginosa PA01
cggcuugucggguagggcgaa

SEQ ID NO: 3414691 - RNA, 14 nt, Pseudomonas aeruginosa PA01
cggcuuguucagcu

SEQ ID NO: 3414692 - RNA, 20 nt, Pseudomonas aeruginosa PA01
cggcuuguucagcucggcgu

SEQ ID NO: 3414693 - RNA, 21 nt, Pseudomonas aeruginosa PA01
cggcuuguucagcucggcgua

SEQ ID NO: 3414694 - RNA, 23 nt, Pseudomonas aeruginosa PA01
cggcuuguucagcucggcguagc

SEQ ID NO: 3414695 - RNA, 22 nt, Pseudomonas aeruginosa PA01
cggcuuguugcgcuccacccag

SEQ ID NO: 3414696 - RNA, 23 nt, Pseudomonas aeruginosa PA01
cggcuuguugcgcuccacccagg

SEQ ID NO: 3414697 - RNA, 15 nt, Pseudomonas aeruginosa PA01
cggcuuuccucggcc

SEQ ID NO: 3414698 - RNA, 16 nt, Pseudomonas aeruginosa PA01
cggcuuuccucggcca

SEQ ID NO: 3414699 - RNA, 17 nt, Pseudomonas aeruginosa PA01
cggcuuuccucggccau

SEQ ID NO: 3414700 - RNA, 21 nt, Pseudomonas aeruginosa PA01
cggcuuuccucggccaugccg

SEQ ID NO: 3414701 - RNA, 23 nt, Pseudomonas aeruginosa PA01
cggcuuucucccacagucgauga

SEQ ID NO: 3414702 - RNA, 20 nt, Pseudomonas aeruginosa PA01
cggcuuuuucauucggcuug

SEQ ID NO: 3414703 - RNA, 19 nt, Pseudomonas aeruginosa PA01
cggcuuuuucuugcgugcg

SEQ ID NO: 3414704 - RNA, 22 nt, Pseudomonas aeruginosa PA01
cggcuuuuuucgcccgugccga

SEQ ID NO: 3414705 - RNA, 15 nt, Pseudomonas aeruginosa PA01
cgggaaaccaccagg

SEQ ID NO: 3414706 - RNA, 21 nt, Pseudomonas aeruginosa PA01
cgggaaaccaccaggaaggcg

SEQ ID NO: 3414707 - RNA, 15 nt, Pseudomonas aeruginosa PA01
cgggaaaggccgcca

SEQ ID NO: 3414708 - RNA, 16 nt, Pseudomonas aeruginosa PA01
cgggaaaggccgccac

SEQ ID NO: 3414709 - RNA, 23 nt, Pseudomonas aeruginosa PA01
cgggaaagucugugaucaggcug

SEQ ID NO: 3414710 - RNA, 17 nt, Pseudomonas aeruginosa PA01
cgggaaauuucgcgcac

SEQ ID NO: 3414711 - RNA, 23 nt, Pseudomonas aeruginosa PA01
cgggaaccacgacgaagcgccgg

SEQ ID NO: 3414712 - RNA, 13 nt, Pseudomonas aeruginosa PA01
cgggaaccagcau

SEQ ID NO: 3414713 - RNA, 14 nt, Pseudomonas aeruginosa PA01
cgggaacgaugccg

SEQ ID NO: 3414714 - RNA, 15 nt, Pseudomonas aeruginosa PA01
cgggaacgaugccgc

SEQ ID NO: 3414715 - RNA, 14 nt, Pseudomonas aeruginosa PA01
cgggaacgccgggc

SEQ ID NO: 3414716 - RNA, 19 nt, Pseudomonas aeruginosa PA01
cgggaacuuggcgcgcagg

SEQ ID NO: 3414717 - RNA, 21 nt, Pseudomonas aeruginosa PA01
cgggaacuuggcgcgcagggc

SEQ ID NO: 3414718 - RNA, 19 nt, Pseudomonas aeruginosa PA01
cgggaagcaccgacucgcc

SEQ ID NO: 3414719 - RNA, 22 nt, Pseudomonas aeruginosa PA01
cgggaagcaggucucgacgcgc

SEQ ID NO: 3414720 - RNA, 23 nt, Pseudomonas aeruginosa PA01
cgggaagcaggucucgacgcgca

SEQ ID NO: 3414721 - RNA, 20 nt, Pseudomonas aeruginosa PA01
cgggaagcgaaccaggcaau

SEQ ID NO: 3414722 - RNA, 17 nt, Pseudomonas aeruginosa PA01
cgggaagcgcaggccgc

SEQ ID NO: 3414723 - RNA, 21 nt, Pseudomonas aeruginosa PA01
cgggaaggauuccacccgcuc

SEQ ID NO: 3414724 - RNA, 15 nt, Pseudomonas aeruginosa PA01
cgggaaggccugacg

SEQ ID NO: 3414725 - RNA, 18 nt, Pseudomonas aeruginosa PA01
cgggaaggccugacgcaa

SEQ ID NO: 3414726 - RNA, 15 nt, Pseudomonas aeruginosa PA01
cgggaagggaucgac

SEQ ID NO: 3414727 - RNA, 17 nt, Pseudomonas aeruginosa PA01
cgggaagggaucgaccg

SEQ ID NO: 3414728 - RNA, 20 nt, Pseudomonas aeruginosa PA01
cgggaagggucugcuugcgc

SEQ ID NO: 3414729 - RNA, 14 nt, Pseudomonas aeruginosa PA01
cgggaaggucggca

SEQ ID NO: 3414730 - RNA, 18 nt, Pseudomonas aeruginosa PA01
cgggaaggucggcagcag

SEQ ID NO: 3414731 - RNA, 19 nt, Pseudomonas aeruginosa PA01
cgggaaggucggcagcagc

SEQ ID NO: 3414732 - RNA, 19 nt, Pseudomonas aeruginosa PA01
cgggaaguaggccuggccg

SEQ ID NO: 3414733 - RNA, 16 nt, Pseudomonas aeruginosa PA01
cgggaaguccgggcgc

SEQ ID NO: 3414734 - RNA, 17 nt, Pseudomonas aeruginosa PA01
cgggaaguccgggcgcg

SEQ ID NO: 3414735 - RNA, 23 nt, Pseudomonas aeruginosa PA01
cgggaaguccgggcgcggcuggu

SEQ ID NO: 3414736 - RNA, 19 nt, Pseudomonas aeruginosa PA01
cgggaagucguucccggcc

SEQ ID NO: 3414737 - RNA, 18 nt, Pseudomonas aeruginosa PA01
cgggacagcuugccgucc

SEQ ID NO: 3414738 - RNA, 13 nt, Pseudomonas aeruginosa PA01
cgggacaggaacg

SEQ ID NO: 3414739 - RNA, 15 nt, Pseudomonas aeruginosa PA01
cgggacagguugucg

SEQ ID NO: 3414740 - RNA, 20 nt, Pseudomonas aeruginosa PA01
cgggaccacgcucaggucgg

SEQ ID NO: 3414741 - RNA, 23 nt, Pseudomonas aeruginosa PA01
cugggugucguuguugccgcgca

SEQ ID NO: 3414742 - RNA, 15 nt, Pseudomonas aeruginosa PA01
cuggguugccaggua

SEQ ID NO: 3414743 - RNA, 14 nt, Pseudomonas aeruginosa PA01
cuggguuggcgcga

SEQ ID NO: 3414744 - RNA, 19 nt, Pseudomonas aeruginosa PA01
cugguaacgggcgaacccg

SEQ ID NO: 3414745 - RNA, 23 nt, Pseudomonas aeruginosa PA01
cugguaacugggaauggcgaugc

SEQ ID NO: 3414746 - RNA, 18 nt, Pseudomonas aeruginosa PA01
cugguacagcacccaggc

SEQ ID NO: 3414747 - RNA, 20 nt, Pseudomonas aeruginosa PA01
cugguacagcacccaggcga

SEQ ID NO: 3414748 - RNA, 17 nt, Pseudomonas aeruginosa PA01
cugguaccugccggcac

SEQ ID NO: 3414749 - RNA, 13 nt, Pseudomonas aeruginosa PA01
cugguacgccccc

SEQ ID NO: 3414750 - RNA, 16 nt, Pseudomonas aeruginosa PA01
cugguagaacuccuug

SEQ ID NO: 3414751 - RNA, 13 nt, Pseudomonas aeruginosa PA01
cugguagcagagg

SEQ ID NO: 3414752 - RNA, 20 nt, Pseudomonas aeruginosa PA01
cugguagcagagggucgcca

SEQ ID NO: 3414753 - RNA, 21 nt, Pseudomonas aeruginosa PA01
cugguagccgcaguccagggc

SEQ ID NO: 3414754 - RNA, 19 nt, Pseudomonas aeruginosa PA01
cugguagcgggccaucagg

SEQ ID NO: 3414755 - RNA, 21 nt, Pseudomonas aeruginosa PA01
cugguagcgggccaucagguc

SEQ ID NO: 3414756 - RNA, 17 nt, Pseudomonas aeruginosa PA01
cugguagcuaccgucgg

SEQ ID NO: 3414757 - RNA, 17 nt, Pseudomonas aeruginosa PA01
cugguagcugcugccgg

SEQ ID NO: 3414758 - RNA, 22 nt, Pseudomonas aeruginosa PA01
cugguaggacagggccaggccg

SEQ ID NO: 3414759 - RNA, 23 nt, Pseudomonas aeruginosa PA01
cugguaggagccgucgccggcga

SEQ ID NO: 3414760 - RNA, 14 nt, Pseudomonas aeruginosa PA01
cugguaggccagca

SEQ ID NO: 3414761 - RNA, 16 nt, Pseudomonas aeruginosa PA01
cugguaggccagcagg

SEQ ID NO: 3414762 - RNA, 16 nt, Pseudomonas aeruginosa PA01
cugguaggccaugagg

SEQ ID NO: 3414763 - RNA, 18 nt, Pseudomonas aeruginosa PA01
cugguaggccaugagguu

SEQ ID NO: 3414764 - RNA, 15 nt, Pseudomonas aeruginosa PA01
cugguaggugcgcug

SEQ ID NO: 3414765 - RNA, 16 nt, Pseudomonas aeruginosa PA01
cugguaguaggcgcuc

SEQ ID NO: 3414766 - RNA, 19 nt, Pseudomonas aeruginosa PA01
cugguaguaggcgcucugg

SEQ ID NO: 3414767 - RNA, 21 nt, Pseudomonas aeruginosa PA01
cugguaugcagcaacccggcc

SEQ ID NO: 3414768 - RNA, 22 nt, Pseudomonas aeruginosa PA01
cuggucaccgucugcaccgccc

SEQ ID NO: 3414769 - RNA, 12 nt, Pseudomonas aeruginosa PA01
cuggucaggcug

SEQ ID NO: 3414770 - RNA, 20 nt, Pseudomonas aeruginosa PA01
cuggucaggcugaucuugcc

SEQ ID NO: 3414771 - RNA, 16 nt, Pseudomonas aeruginosa PA01
cugguccaccagcccg

SEQ ID NO: 3414772 - RNA, 17 nt, Pseudomonas aeruginosa PA01
cugguccaccagcccgc

SEQ ID NO: 3414773 - RNA, 18 nt, Pseudomonas aeruginosa PA01
cugguccaccagcccgca

SEQ ID NO: 3414774 - RNA, 19 nt, Pseudomonas aeruginosa PA01
cugguccaccagcccgcag

SEQ ID NO: 3414775 - RNA, 13 nt, Pseudomonas aeruginosa PA01
cugguccagcacg

SEQ ID NO: 3414776 - RNA, 16 nt, Pseudomonas aeruginosa PA01
cugguccagccagccg

SEQ ID NO: 3414777 - RNA, 20 nt, Pseudomonas aeruginosa PA01
cugguccggguuggcgcagg

SEQ ID NO: 3414778 - RNA, 21 nt, Pseudomonas aeruginosa PA01
cugguccggguuggcgcaggc

SEQ ID NO: 3414779 - RNA, 22 nt, Pseudomonas aeruginosa PA01
cugguccggguuggcgcaggcc

SEQ ID NO: 3414780 - RNA, 18 nt, Pseudomonas aeruginosa PA01
cugguccucaauaccgaa

SEQ ID NO: 3414781 - RNA, 17 nt, Pseudomonas aeruginosa PA01
cugguccugcggcggca

SEQ ID NO: 3414782 - RNA, 14 nt, Pseudomonas aeruginosa PA01
cugguccuuauucg

SEQ ID NO: 3414783 - RNA, 22 nt, Pseudomonas aeruginosa PA01
cugguccuuauucggcccaugc

SEQ ID NO: 3414784 - RNA, 21 nt, Pseudomonas aeruginosa PA01
cuggucgaaagccugccgggc

SEQ ID NO: 3414785 - RNA, 23 nt, Pseudomonas aeruginosa PA01
cuggucgaaagccugccgggcaa

SEQ ID NO: 3414786 - RNA, 22 nt, Pseudomonas aeruginosa PA01
cuggucgaacacuugaccgucg

SEQ ID NO: 3414787 - RNA, 16 nt, Pseudomonas aeruginosa PA01
cuggucgacauagcgc

SEQ ID NO: 3414788 - RNA, 21 nt, Pseudomonas aeruginosa PA01
cuggucgacauagcgcagcac

SEQ ID NO: 3414789 - RNA, 17 nt, Pseudomonas aeruginosa PA01
cuggucgcagccgcgca

SEQ ID NO: 3414790 - RNA, 22 nt, Pseudomonas aeruginosa PA01
cuggucgccgaaguacucgugu

SEQ ID NO: 3414791 - RNA, 13 nt, Pseudomonas aeruginosa PA01
cuggucgccgaca

SEQ ID NO: 3414792 - RNA, 14 nt, Pseudomonas aeruginosa PA01
cuggucgcgcgcgg

SEQ ID NO: 3414793 - RNA, 15 nt, Pseudomonas aeruginosa PA01
cuggucgcgcgcggc

SEQ ID NO: 3414794 - RNA, 13 nt, Pseudomonas aeruginosa PA01
cuggucgcggcug

SEQ ID NO: 3414795 - RNA, 17 nt, Pseudomonas aeruginosa PA01
cuggucgcggcugcgcg

SEQ ID NO: 3414796 - RNA, 20 nt, Pseudomonas aeruginosa PA01
cuggucgcguuccagcuccg

SEQ ID NO: 3414797 - RNA, 16 nt, Pseudomonas aeruginosa PA01
cuggucgcuccagccc

SEQ ID NO: 3414798 - RNA, 17 nt, Pseudomonas aeruginosa PA01
cuggucggccaguuccu

SEQ ID NO: 3414799 - RNA, 14 nt, Pseudomonas aeruginosa PA01
cuggucggcgcggc

SEQ ID NO: 3414800 - RNA, 23 nt, Pseudomonas aeruginosa PA01
cuggucggcgcggcgcuccaggc

SEQ ID NO: 3414801 - RNA, 15 nt, Pseudomonas aeruginosa PA01
cuggucggcuuccgc

SEQ ID NO: 3414802 - RNA, 17 nt, Pseudomonas aeruginosa PA01
cuggucggcuuccgccg

SEQ ID NO: 3414803 - RNA, 18 nt, Pseudomonas aeruginosa PA01
cuggucggggccggcgau

SEQ ID NO: 3414804 - RNA, 20 nt, Pseudomonas aeruginosa PA01
cuggucggggccggcgaugc

SEQ ID NO: 3414805 - RNA, 20 nt, Pseudomonas aeruginosa PA01
cuggucggggcgcaaggcca

SEQ ID NO: 3414806 - RNA, 18 nt, Pseudomonas aeruginosa PA01
cuggucguaggcgcgggc

SEQ ID NO: 3414807 - RNA, 23 nt, Pseudomonas aeruginosa PA01
cuggucgucgcgguacagccggu

SEQ ID NO: 3414808 - RNA, 19 nt, Pseudomonas aeruginosa PA01
cuggucgucguaguggccg

SEQ ID NO: 3414809 - RNA, 17 nt, Pseudomonas aeruginosa PA01
cuggucgugguccagcu

SEQ ID NO: 3414810 - RNA, 17 nt, Pseudomonas aeruginosa PA01
cuggucguucagugcca

SEQ ID NO: 3414811 - RNA, 20 nt, Pseudomonas aeruginosa PA01
cuggucguucagugccagca

SEQ ID NO: 3414812 - RNA, 16 nt, Pseudomonas aeruginosa PA01
cuggucguucucgcgc

SEQ ID NO: 3414813 - RNA, 17 nt, Pseudomonas aeruginosa PA01
cuggucguugcgcgcau

SEQ ID NO: 3414814 - RNA, 20 nt, Pseudomonas aeruginosa PA01
cuggucuucgguggcggcga

SEQ ID NO: 3414815 - RNA, 22 nt, Pseudomonas aeruginosa PA01
cuggucuugccgauggcgcacc

SEQ ID NO: 3414816 - RNA, 22 nt, Pseudomonas aeruginosa PA01
cuggugacccggacagccuucg

SEQ ID NO: 3414817 - RNA, 19 nt, Pseudomonas aeruginosa PA01
cuggugacggugaccuugu

SEQ ID NO: 3414818 - RNA, 21 nt, Pseudomonas aeruginosa PA01
cuggugagcggaacgggacgc

SEQ ID NO: 3414819 - RNA, 16 nt, Pseudomonas aeruginosa PA01
cuggugaucgaccaca

SEQ ID NO: 3414820 - RNA, 20 nt, Pseudomonas aeruginosa PA01
cuggugaucgaccacacaug

SEQ ID NO: 3414821 - RNA, 24 nt, Pseudomonas aeruginosa PA01
cuggugaucgaccacacaugcagg

SEQ ID NO: 3414822 - RNA, 16 nt, Pseudomonas aeruginosa PA01
cuggugcaccuggcga

SEQ ID NO: 3414823 - RNA, 19 nt, Pseudomonas aeruginosa PA01
cuggugcaccuggcgaugc

SEQ ID NO: 3414824 - RNA, 21 nt, Pseudomonas aeruginosa PA01
cuggugcaccuggcgaugccc

SEQ ID NO: 3414825 - RNA, 13 nt, Pseudomonas aeruginosa PA01
cuggugcacggcg

SEQ ID NO: 3414826 - RNA, 22 nt, Pseudomonas aeruginosa PA01
cuggugcaggucgcgcggcgcc

SEQ ID NO: 3414827 - RNA, 15 nt, Pseudomonas aeruginosa PA01
cuggugcccugggcg

SEQ ID NO: 3414828 - RNA, 22 nt, Pseudomonas aeruginosa PA01
cuggugccgcuguaggacaggu

SEQ ID NO: 3414829 - RNA, 14 nt, Pseudomonas aeruginosa PA01
cuggugccgggcuu

SEQ ID NO: 3414830 - RNA, 19 nt, Pseudomonas aeruginosa PA01
cuggugcgcguccaucccu

SEQ ID NO: 3414831 - RNA, 14 nt, Pseudomonas aeruginosa PA01
cuggugcggcacca

SEQ ID NO: 3414832 - RNA, 16 nt, Pseudomonas aeruginosa PA01
cuggugcggcaccagc

SEQ ID NO: 3414833 - RNA, 18 nt, Pseudomonas aeruginosa PA01
cuggugcggcaccagcca

SEQ ID NO: 3414834 - RNA, 15 nt, Pseudomonas aeruginosa PA01
cuggugcggccgaug

SEQ ID NO: 3414835 - RNA, 15 nt, Pseudomonas aeruginosa PA01
cuggugcugcuccau

SEQ ID NO: 3414836 - RNA, 13 nt, Pseudomonas aeruginosa PA01
cugguggaacagc

SEQ ID NO: 3414837 - RNA, 17 nt, Pseudomonas aeruginosa PA01
cugguggaacagccgca

SEQ ID NO: 3414838 - RNA, 18 nt, Pseudomonas aeruginosa PA01
cugguggaacagccgcag

SEQ ID NO: 3414839 - RNA, 23 nt, Pseudomonas aeruginosa PA01
cugguggaacagccgcagcggca

SEQ ID NO: 3414840 - RNA, 20 nt, Pseudomonas aeruginosa PA01
cugguggacacccugcugcu

SEQ ID NO: 3414841 - RNA, 13 nt, Pseudomonas aeruginosa PA01
cugguggacgguc

SEQ ID NO: 3414842 - RNA, 18 nt, Pseudomonas aeruginosa PA01
cugguggacgucgucggc

SEQ ID NO: 3414843 - RNA, 19 nt, Pseudomonas aeruginosa PA01
cugguggacgucgucggcg

SEQ ID NO: 3414844 - RNA, 20 nt, Pseudomonas aeruginosa PA01
cugguggauguucgccgcca

SEQ ID NO: 3414845 - RNA, 21 nt, Pseudomonas aeruginosa PA01
cugguggauguucgccgccac

SEQ ID NO: 3414846 - RNA, 22 nt, Pseudomonas aeruginosa PA01
cugguggauguucgccgccacc

SEQ ID NO: 3414847 - RNA, 17 nt, Pseudomonas aeruginosa PA01
cugguggcccugggcgg

SEQ ID NO: 3414848 - RNA, 23 nt, Pseudomonas aeruginosa PA01
cugguggcccugggcggcgaccu

SEQ ID NO: 3414849 - RNA, 16 nt, Pseudomonas aeruginosa PA01
cugguggcgaacagca

SEQ ID NO: 3414850 - RNA, 19 nt, Pseudomonas aeruginosa PA01
cugguggcgaacagcaccu

SEQ ID NO: 3414851 - RNA, 14 nt, Pseudomonas aeruginosa PA01
cugguggcgccggc

SEQ ID NO: 3414852 - RNA, 21 nt, Pseudomonas aeruginosa PA01
cuggugggcacgagucgaggc

SEQ ID NO: 3414853 - RNA, 15 nt, Pseudomonas aeruginosa PA01
cuggugggcggcggc

SEQ ID NO: 3414854 - RNA, 16 nt, Pseudomonas aeruginosa PA01
cugguggucaccgcca

SEQ ID NO: 3414855 - RNA, 18 nt, Pseudomonas aeruginosa PA01
cugguggucaccgccagc

SEQ ID NO: 3414856 - RNA, 20 nt, Pseudomonas aeruginosa PA01
cugguggucaccgccagcgg

SEQ ID NO: 3414857 - RNA, 21 nt, Pseudomonas aeruginosa PA01
cugguggucaccgccagcggg

SEQ ID NO: 3414858 - RNA, 13 nt, Pseudomonas aeruginosa PA01
cuggugucgggug

SEQ ID NO: 3414859 - RNA, 17 nt, Pseudomonas aeruginosa PA01
cugguucgaguccaggu

SEQ ID NO: 3414860 - RNA, 16 nt, Pseudomonas aeruginosa PA01
cugguucguccgcgcg

SEQ ID NO: 3414861 - RNA, 20 nt, Pseudomonas aeruginosa PA01
cugguugaccugcagcgccu

SEQ ID NO: 3414862 - RNA, 21 nt, Pseudomonas aeruginosa PA01
cugguugaccugcagcgccuc

SEQ ID NO: 3414863 - RNA, 17 nt, Pseudomonas aeruginosa PA01
cugguugaggucgacga

SEQ ID NO: 3414864 - RNA, 15 nt, Pseudomonas aeruginosa PA01
cugguugccagcagc

SEQ ID NO: 3414865 - RNA, 21 nt, Pseudomonas aeruginosa PA01
cugguugcgccauugccgcca

SEQ ID NO: 3414866 - RNA, 23 nt, Pseudomonas aeruginosa PA01
cugguugcgccauugccgccagg

SEQ ID NO: 3414867 - RNA, 17 nt, Pseudomonas aeruginosa PA01
cugguuggccgccuggc

SEQ ID NO: 3414868 - RNA, 16 nt, Pseudomonas aeruginosa PA01
cugguuguaggcgccg

SEQ ID NO: 3414869 - RNA, 17 nt, Pseudomonas aeruginosa PA01
cugguuguaggcgccgc

SEQ ID NO: 3414870 - RNA, 14 nt, Pseudomonas aeruginosa PA01
cuguaaucgccgcu

SEQ ID NO: 3414871 - RNA, 23 nt, Pseudomonas aeruginosa PA01
cuguacagaaacaaagagcccgc

SEQ ID NO: 3414872 - RNA, 15 nt, Pseudomonas aeruginosa PA01
cuguacagcaggagc

SEQ ID NO: 3414873 - RNA, 17 nt, Pseudomonas aeruginosa PA01
cuguacagcaggagcgc

SEQ ID NO: 3414874 - RNA, 19 nt, Pseudomonas aeruginosa PA01
cuguacagcucaccccagg

SEQ ID NO: 3414875 - RNA, 15 nt, Pseudomonas aeruginosa PA01
cuguaccaccgccau

SEQ ID NO: 3414876 - RNA, 13 nt, Pseudomonas aeruginosa PA01
cuguaccgcuucc

SEQ ID NO: 3414877 - RNA, 21 nt, Pseudomonas aeruginosa PA01
cuguaccuacuguucggucgg

SEQ ID NO: 3414878 - RNA, 14 nt, Pseudomonas aeruginosa PA01
cuguacgcaggagu

SEQ ID NO: 3414879 - RNA, 14 nt, Pseudomonas aeruginosa PA01
cuguagcacaugug

SEQ ID NO: 3414880 - RNA, 22 nt, Pseudomonas aeruginosa PA01
cuguagcagggugcgggcgcgg

SEQ ID NO: 3414881 - RNA, 23 nt, Pseudomonas aeruginosa PA01
cuguagccacggcgagagcgccg

SEQ ID NO: 3414882 - RNA, 13 nt, Pseudomonas aeruginosa PA01
cuguagccggcga

SEQ ID NO: 3414883 - RNA, 15 nt, Pseudomonas aeruginosa PA01
cuguagccucccgcc

SEQ ID NO: 3414884 - RNA, 18 nt, Pseudomonas aeruginosa PA01
cuguagccucccgccgcg

SEQ ID NO: 3414885 - RNA, 20 nt, Pseudomonas aeruginosa PA01
cuguagccucccgccgcggc

SEQ ID NO: 3414886 - RNA, 15 nt, Pseudomonas aeruginosa PA01
cuguagcggaucagg

SEQ ID NO: 3414887 - RNA, 16 nt, Pseudomonas aeruginosa PA01
cuguagcggcucgccg

SEQ ID NO: 3414888 - RNA, 19 nt, Pseudomonas aeruginosa PA01
cuguagcucugcuggcugu

SEQ ID NO: 3414889 - RNA, 18 nt, Pseudomonas aeruginosa PA01
cuguaggacagguucagg

SEQ ID NO: 3414890 - RNA, 19 nt, Pseudomonas aeruginosa PA01
cuguaggacagguucaggu

SEQ ID NO: 3414891 - RNA, 20 nt, Pseudomonas aeruginosa PA01
cuguaggacagguucagguc

SEQ ID NO: 3414892 - RNA, 17 nt, Pseudomonas aeruginosa PA01
cuguaggcgagcagcgg

SEQ ID NO: 3414893 - RNA, 19 nt, Pseudomonas aeruginosa PA01
cuguaggcgagcagcggca

SEQ ID NO: 3414894 - RNA, 22 nt, Pseudomonas aeruginosa PA01
cuguagggcgaauaacgccaca

SEQ ID NO: 3414895 - RNA, 17 nt, Pseudomonas aeruginosa PA01
cuguagggucgcagcag

SEQ ID NO: 3414896 - RNA, 19 nt, Pseudomonas aeruginosa PA01
cuguagggucgcagcaggc

SEQ ID NO: 3414897 - RNA, 16 nt, Pseudomonas aeruginosa PA01
cuguaggugcccggcg

SEQ ID NO: 3414898 - RNA, 18 nt, Pseudomonas aeruginosa PA01
cuguaggugcccggcggg

SEQ ID NO: 3414899 - RNA, 16 nt, Pseudomonas aeruginosa PA01
cuguaguaggcggugg

SEQ ID NO: 3414900 - RNA, 17 nt, Pseudomonas aeruginosa PA01
cuguagugcuccggggc

SEQ ID NO: 3414901 - RNA, 20 nt, Pseudomonas aeruginosa PA01
cuguaguugauggauggcuu

SEQ ID NO: 3414902 - RNA, 13 nt, Pseudomonas aeruginosa PA01
cugucacgccggg

SEQ ID NO: 3414903 - RNA, 16 nt, Pseudomonas aeruginosa PA01
cugucacucaggcaug

SEQ ID NO: 3414904 - RNA, 23 nt, Pseudomonas aeruginosa PA01
cugucagacacgaaaaagccggc

SEQ ID NO: 3414905 - RNA, 14 nt, Pseudomonas aeruginosa PA01
cugucagcgcccgg

SEQ ID NO: 3414906 - RNA, 15 nt, Pseudomonas aeruginosa PA01
cugucagggcgcaau

SEQ ID NO: 3414907 - RNA, 17 nt, Pseudomonas aeruginosa PA01
cugucagggcuugcgcg

SEQ ID NO: 3414908 - RNA, 18 nt, Pseudomonas aeruginosa PA01
cuguccaccgguggcgac

SEQ ID NO: 3414909 - RNA, 20 nt, Pseudomonas aeruginosa PA01
cuguccaccgguggcgacgc

SEQ ID NO: 3414910 - RNA, 22 nt, Pseudomonas aeruginosa PA01
cuguccaccgguggcgacgcgc

SEQ ID NO: 3414911 - RNA, 22 nt, Pseudomonas aeruginosa PA01
cuguccaucucgccgcgcacgu

SEQ ID NO: 3414912 - RNA, 22 nt, Pseudomonas aeruginosa PA01
cugucccagcgaguagucgcgg

SEQ ID NO: 3414913 - RNA, 18 nt, Pseudomonas aeruginosa PA01
cugucccaucacggcccc

SEQ ID NO: 3414914 - RNA, 19 nt, Pseudomonas aeruginosa PA01
cugucccaucacggccccg

SEQ ID NO: 3414915 - RNA, 22 nt, Pseudomonas aeruginosa PA01
cugucccaucacggccccgaga

SEQ ID NO: 3414916 - RNA, 15 nt, Pseudomonas aeruginosa PA01
cugucccgccgcgcc

SEQ ID NO: 3414917 - RNA, 22 nt, Pseudomonas aeruginosa PA01
cugucccgccgcgccgcucagg

SEQ ID NO: 3414918 - RNA, 23 nt, Pseudomonas aeruginosa PA01
cugucccggacgacgaaagaagc

SEQ ID NO: 3414919 - RNA, 13 nt, Pseudomonas aeruginosa PA01
cugucccugggcc

SEQ ID NO: 3414920 - RNA, 14 nt, Pseudomonas aeruginosa PA01
cugucccugggcca

SEQ ID NO: 3414921 - RNA, 17 nt, Pseudomonas aeruginosa PA01
cuguccgaacagggcga

SEQ ID NO: 3414922 - RNA, 21 nt, Pseudomonas aeruginosa PA01
cuguccgaacagggcgaaggc

SEQ ID NO: 3414923 - RNA, 13 nt, Pseudomonas aeruginosa PA01
cuguccgccgccg

SEQ ID NO: 3414924 - RNA, 15 nt, Pseudomonas aeruginosa PA01
cuguccggcgcugag

SEQ ID NO: 3414925 - RNA, 20 nt, Pseudomonas aeruginosa PA01
cuguccguugcgcagcacca

SEQ ID NO: 3414926 - RNA, 12 nt, Pseudomonas aeruginosa PA01
cuguccuccagc

SEQ ID NO: 3414927 - RNA, 16 nt, Pseudomonas aeruginosa PA01
cuguccuccagcggcg

SEQ ID NO: 3414928 - RNA, 16 nt, Pseudomonas aeruginosa PA01
cugucgacgcagccgg

SEQ ID NO: 3414929 - RNA, 17 nt, Pseudomonas aeruginosa PA01
cugucgacgcagccggg

SEQ ID NO: 3414930 - RNA, 19 nt, Pseudomonas aeruginosa PA01
cugucgagcagggucgcga

SEQ ID NO: 3414931 - RNA, 21 nt, Pseudomonas aeruginosa PA01
cugucgagcgaagcgucgaug

SEQ ID NO: 3414932 - RNA, 17 nt, Pseudomonas aeruginosa PA01
cugucgagggucugcuc

SEQ ID NO: 3414933 - RNA, 18 nt, Pseudomonas aeruginosa PA01
cugucgagggucugcucg

SEQ ID NO: 3414934 - RNA, 16 nt, Pseudomonas aeruginosa PA01
cugucgauaccagcgc

SEQ ID NO: 3414935 - RNA, 17 nt, Pseudomonas aeruginosa PA01
cugucgauaccagcgcc

SEQ ID NO: 3414936 - RNA, 18 nt, Pseudomonas aeruginosa PA01
cugucgauaccagcgccg

SEQ ID NO: 3414937 - RNA, 20 nt, Pseudomonas aeruginosa PA01
cugucgauaccagcgccgcu

SEQ ID NO: 3414938 - RNA, 22 nt, Pseudomonas aeruginosa PA01
cugucgauaccagcgccgcucc

SEQ ID NO: 3414939 - RNA, 16 nt, Pseudomonas aeruginosa PA01
cugucgauuucccccg

SEQ ID NO: 3414940 - RNA, 14 nt, Pseudomonas aeruginosa PA01
cugucgcagcgggc

SEQ ID NO: 3414941 - RNA, 16 nt, Pseudomonas aeruginosa PA01
cugucgcagcgggcug

SEQ ID NO: 3414942 - RNA, 15 nt, Pseudomonas aeruginosa PA01
cugucgcccgggcgc

SEQ ID NO: 3414943 - RNA, 18 nt, Pseudomonas aeruginosa PA01
cugucgcccgggcgccac

SEQ ID NO: 3414944 - RNA, 16 nt, Pseudomonas aeruginosa PA01
cugucgcccucgcgga

SEQ ID NO: 3414945 - RNA, 21 nt, Pseudomonas aeruginosa PA01
cugucgcggacccgcgccggc

SEQ ID NO: 3414946 - RNA, 22 nt, Pseudomonas aeruginosa PA01
cugucgcggggcuugcgccccc

SEQ ID NO: 3414947 - RNA, 21 nt, Pseudomonas aeruginosa PA01
cugucgcguucccacucgcga

SEQ ID NO: 3414948 - RNA, 20 nt, Pseudomonas aeruginosa PA01
cugucgcucagcgggccgau

SEQ ID NO: 3414949 - RNA, 22 nt, Pseudomonas aeruginosa PA01
cugucgcucagcgggccgaucc

SEQ ID NO: 3414950 - RNA, 15 nt, Pseudomonas aeruginosa PA01
cugucgcuccggcag

SEQ ID NO: 3414951 - RNA, 19 nt, Pseudomonas aeruginosa PA01
cugucggagagggagcgcc

SEQ ID NO: 3414952 - RNA, 21 nt, Pseudomonas aeruginosa PA01
cugucggagagggagcgccug

SEQ ID NO: 3414953 - RNA, 22 nt, Pseudomonas aeruginosa PA01
cugucggagagggagcgccugg

SEQ ID NO: 3414954 - RNA, 23 nt, Pseudomonas aeruginosa PA01
cugucggagagggagcgccuggc

SEQ ID NO: 3414955 - RNA, 14 nt, Pseudomonas aeruginosa PA01
cugucggccagccc

SEQ ID NO: 3414956 - RNA, 17 nt, Pseudomonas aeruginosa PA01
cugucggccagccccug

SEQ ID NO: 3414957 - RNA, 17 nt, Pseudomonas aeruginosa PA01
cugucggccaucgccgu

SEQ ID NO: 3414958 - RNA, 12 nt, Pseudomonas aeruginosa PA01
cugucggcggau

SEQ ID NO: 3414959 - RNA, 20 nt, Pseudomonas aeruginosa PA01
cugucggcggauugccagca

SEQ ID NO: 3414960 - RNA, 16 nt, Pseudomonas aeruginosa PA01
cugucgggggcugcgc

SEQ ID NO: 3414961 - RNA, 19 nt, Pseudomonas aeruginosa PA01
cugucgggggcugcgcauc

SEQ ID NO: 3414962 - RNA, 21 nt, Pseudomonas aeruginosa PA01
cugucgggggcugcgcaucgc

SEQ ID NO: 3414963 - RNA, 15 nt, Pseudomonas aeruginosa PA01
cugucguaguccugg

SEQ ID NO: 3414964 - RNA, 21 nt, Pseudomonas aeruginosa PA01
cugucguaguccugggccggu

SEQ ID NO: 3414965 - RNA, 13 nt, Pseudomonas aeruginosa PA01
cugucgucgaggg

SEQ ID NO: 3414966 - RNA, 21 nt, Pseudomonas aeruginosa PA01
cugucgucgaggguggcgccg

SEQ ID NO: 3414967 - RNA, 19 nt, Pseudomonas aeruginosa PA01
cugucgucggcgcggccgg

SEQ ID NO: 3414968 - RNA, 23 nt, Pseudomonas aeruginosa PA01
cugucgucggcgcggccggcgcc

SEQ ID NO: 3414969 - RNA, 16 nt, Pseudomonas aeruginosa PA01
cugucgucuucggcca

SEQ ID NO: 3414970 - RNA, 18 nt, Pseudomonas aeruginosa PA01
cugucgucuucggccagu

SEQ ID NO: 3414971 - RNA, 15 nt, Pseudomonas aeruginosa PA01
cugucgugccuccag

SEQ ID NO: 3414972 - RNA, 20 nt, Pseudomonas aeruginosa PA01
cugucuaucccgugccgggc

SEQ ID NO: 3414973 - RNA, 21 nt, Pseudomonas aeruginosa PA01
cugucuaucccgugccgggcc

SEQ ID NO: 3414974 - RNA, 17 nt, Pseudomonas aeruginosa PA01
cugucuuguccucaucg

SEQ ID NO: 3414975 - RNA, 13 nt, Pseudomonas aeruginosa PA01
cugugaggugggc

SEQ ID NO: 3414976 - RNA, 22 nt, Pseudomonas aeruginosa PA01
cugugaucaggcuguccacgcc

SEQ ID NO: 3414977 - RNA, 19 nt, Pseudomonas aeruginosa PA01
cugugcacccagaccuucc

SEQ ID NO: 3414978 - RNA, 18 nt, Pseudomonas aeruginosa PA01
cugugcaggaaggcgacg

SEQ ID NO: 3414979 - RNA, 20 nt, Pseudomonas aeruginosa PA01
cugugcaggaaggcgacgau

SEQ ID NO: 3414980 - RNA, 16 nt, Pseudomonas aeruginosa PA01
cugugcagggaggcau

SEQ ID NO: 3414981 - RNA, 17 nt, Pseudomonas aeruginosa PA01
cugugccgaggccgccg

SEQ ID NO: 3414982 - RNA, 13 nt, Pseudomonas aeruginosa PA01
cugugccuggaag

SEQ ID NO: 3414983 - RNA, 17 nt, Pseudomonas aeruginosa PA01
cugugcgaggcuggccu

SEQ ID NO: 3414984 - RNA, 19 nt, Pseudomonas aeruginosa PA01
cugugcgccaggccggugc

SEQ ID NO: 3414985 - RNA, 15 nt, Pseudomonas aeruginosa PA01
cugugcggcagcagg

SEQ ID NO: 3414986 - RNA, 23 nt, Pseudomonas aeruginosa PA01
cugugcgguauagcucauggcca

SEQ ID NO: 3414987 - RNA, 18 nt, Pseudomonas aeruginosa PA01
cugugcggugccgcgcag

SEQ ID NO: 3414988 - RNA, 19 nt, Pseudomonas aeruginosa PA01
cugugcggugccgcgcagc

SEQ ID NO: 3414989 - RNA, 20 nt, Pseudomonas aeruginosa PA01
cugugcucgaggaagcgccc

SEQ ID NO: 3414990 - RNA, 17 nt, Pseudomonas aeruginosa PA01
cugugcugcaccagcag

SEQ ID NO: 3414991 - RNA, 16 nt, Pseudomonas aeruginosa PA01
cugugcugcgcgccgc

SEQ ID NO: 3414992 - RNA, 16 nt, Pseudomonas aeruginosa PA01
cugugcuggccacccu

SEQ ID NO: 3414993 - RNA, 20 nt, Pseudomonas aeruginosa PA01
cuguggaaguacggcgcggu

SEQ ID NO: 3414994 - RNA, 17 nt, Pseudomonas aeruginosa PA01
cuguggaauguccugcc

SEQ ID NO: 3414995 - RNA, 14 nt, Pseudomonas aeruginosa PA01
cuguggagccggug

SEQ ID NO: 3414996 - RNA, 21 nt, Pseudomonas aeruginosa PA01
cuguggauaaaaaggcccgga

SEQ ID NO: 3414997 - RNA, 11 nt, Pseudomonas aeruginosa PA01
cuguggauaac

SEQ ID NO: 3414998 - RNA, 19 nt, Pseudomonas aeruginosa PA01
cugugggucgggucggcga

SEQ ID NO: 3414999 - RNA, 16 nt, Pseudomonas aeruginosa PA01
cuguggguggugcgau

SEQ ID NO: 3415000 - RNA, 17 nt, Pseudomonas aeruginosa PA01
cuguggucaggcgccag

SEQ ID NO: 3415001 - RNA, 14 nt, Pseudomonas aeruginosa PA01
cuguguccggcgga

SEQ ID NO: 3415002 - RNA, 23 nt, Pseudomonas aeruginosa PA01
cuguuacugagcgugacccgcgc

SEQ ID NO: 3415003 - RNA, 21 nt, Pseudomonas aeruginosa PA01
cuguucacaaaggcgucgauc

SEQ ID NO: 3415004 - RNA, 13 nt, Pseudomonas aeruginosa PA01
cuguucagcagga

SEQ ID NO: 3415005 - RNA, 21 nt, Pseudomonas aeruginosa PA01
cuguuccgcgaucaacgguag

SEQ ID NO: 3415006 - RNA, 19 nt, Pseudomonas aeruginosa PA01
cuguuccgggcccaguucg

SEQ ID NO: 3415007 - RNA, 16 nt, Pseudomonas aeruginosa PA01
cuguuccucagccccu

SEQ ID NO: 3415008 - RNA, 13 nt, Pseudomonas aeruginosa PA01
cuguuccuccgcc

SEQ ID NO: 3415009 - RNA, 18 nt, Pseudomonas aeruginosa PA01
cuguuccucggcggcggu

SEQ ID NO: 3415010 - RNA, 20 nt, Pseudomonas aeruginosa PA01
cuguucgcgcgccucgcggc

SEQ ID NO: 3415011 - RNA, 13 nt, Pseudomonas aeruginosa PA01
cuguucggccagg

SEQ ID NO: 3415012 - RNA, 16 nt, Pseudomonas aeruginosa PA01
cuguucggccagggag

SEQ ID NO: 3415013 - RNA, 17 nt, Pseudomonas aeruginosa PA01
cuguucggccuugcucu

SEQ ID NO: 3415014 - RNA, 17 nt, Pseudomonas aeruginosa PA01
cuguucgucccgagcac

SEQ ID NO: 3415015 - RNA, 19 nt, Pseudomonas aeruginosa PA01
cuguucgucccgagcaccg

SEQ ID NO: 3415016 - RNA, 21 nt, Pseudomonas aeruginosa PA01
cuguucgucccgagcaccggc

SEQ ID NO: 3415017 - RNA, 23 nt, Pseudomonas aeruginosa PA01
cuguucgucgcgucgcacccggc

SEQ ID NO: 3415018 - RNA, 16 nt, Pseudomonas aeruginosa PA01
cuguucgucuggcgcc

SEQ ID NO: 3415019 - RNA, 18 nt, Pseudomonas aeruginosa PA01
cuguucucuuugaccuug

SEQ ID NO: 3415020 - RNA, 18 nt, Pseudomonas aeruginosa PA01
cuguugcagagcggccag

SEQ ID NO: 3415021 - RNA, 19 nt, Pseudomonas aeruginosa PA01
cuguugccagggauacuca

SEQ ID NO: 3415022 - RNA, 15 nt, Pseudomonas aeruginosa PA01
cuguugcccugggcc

SEQ ID NO: 3415023 - RNA, 17 nt, Pseudomonas aeruginosa PA01
cuguugccgcugcaggc

SEQ ID NO: 3415024 - RNA, 21 nt, Pseudomonas aeruginosa PA01
cuguugccggcaaacgccgcc

SEQ ID NO: 3415025 - RNA, 22 nt, Pseudomonas aeruginosa PA01
cuguugccggcaaacgccgcca

SEQ ID NO: 3415026 - RNA, 17 nt, Pseudomonas aeruginosa PA01
cuguugcuccaaccagu

SEQ ID NO: 3415027 - RNA, 19 nt, Pseudomonas aeruginosa PA01
cuguuggccaaccaggaag

SEQ ID NO: 3415028 - RNA, 15 nt, Pseudomonas aeruginosa PA01
cuguuggccugggcg

SEQ ID NO: 3415029 - RNA, 21 nt, Pseudomonas aeruginosa PA01
cuguugguggggcgccggcuc

SEQ ID NO: 3415030 - RNA, 13 nt, Pseudomonas aeruginosa PA01
cuguuucaggccg

SEQ ID NO: 3415031 - RNA, 16 nt, Pseudomonas aeruginosa PA01
cuguuucggguccagg

SEQ ID NO: 3415032 - RNA, 18 nt, Pseudomonas aeruginosa PA01
cuguuucggguccaggcg

SEQ ID NO: 3415033 - RNA, 14 nt, Pseudomonas aeruginosa PA01
cuguuucugcugug

SEQ ID NO: 3415034 - RNA, 14 nt, Pseudomonas aeruginosa PA01
cuguuuuccauggc

SEQ ID NO: 3415035 - RNA, 17 nt, Pseudomonas aeruginosa PA01
cuguuuuccauggcgag

SEQ ID NO: 3415036 - RNA, 22 nt, Pseudomonas aeruginosa PA01
cuuaaggugacggaucacggug

SEQ ID NO: 3415037 - RNA, 15 nt, Pseudomonas aeruginosa PA01
cuuaccuugccggug

SEQ ID NO: 3415038 - RNA, 14 nt, Pseudomonas aeruginosa PA01
cuuacgcggccuuu

SEQ ID NO: 3415039 - RNA, 23 nt, Pseudomonas aeruginosa PA01
cuucaaaggaaucuucggcgccc

SEQ ID NO: 3415040 - RNA, 14 nt, Pseudomonas aeruginosa PA01
cuucaaccacucca

SEQ ID NO: 3415041 - RNA, 15 nt, Pseudomonas aeruginosa PA01
cuucaaccacuccag

SEQ ID NO: 3415042 - RNA, 17 nt, Pseudomonas aeruginosa PA01
cuucaaccacuccagcg

SEQ ID NO: 3415043 - RNA, 14 nt, Pseudomonas aeruginosa PA01
cuucaagcggccau

SEQ ID NO: 3415044 - RNA, 19 nt, Pseudomonas aeruginosa PA01
cuucaagcggccauuuuuc

SEQ ID NO: 3415045 - RNA, 13 nt, Pseudomonas aeruginosa PA01
cuucaccacccca

SEQ ID NO: 3415046 - RNA, 16 nt, Pseudomonas aeruginosa PA01
cuucacccgcagcggc

SEQ ID NO: 3415047 - RNA, 14 nt, Pseudomonas aeruginosa PA01
cuucaccgcgccgc

SEQ ID NO: 3415048 - RNA, 23 nt, Pseudomonas aeruginosa PA01
cuucaccgcgccgcgcuuggccu

SEQ ID NO: 3415049 - RNA, 16 nt, Pseudomonas aeruginosa PA01
cuucaccggcacgccc

SEQ ID NO: 3415050 - RNA, 11 nt, Pseudomonas aeruginosa PA01
cuucaccggcg

SEQ ID NO: 3415051 - RNA, 15 nt, Pseudomonas aeruginosa PA01
cuucaccggcggaug

SEQ ID NO: 3415052 - RNA, 16 nt, Pseudomonas aeruginosa PA01
cuucaccguucccagc

SEQ ID NO: 3415053 - RNA, 21 nt, Pseudomonas aeruginosa PA01
cuucaccguucccagcagcgc

SEQ ID NO: 3415054 - RNA, 15 nt, Pseudomonas aeruginosa PA01
cuucacgacaggcgg

SEQ ID NO: 3415055 - RNA, 20 nt, Pseudomonas aeruginosa PA01
cuucacgacaggcggcgggc

SEQ ID NO: 3415056 - RNA, 19 nt, Pseudomonas aeruginosa PA01
cuucacgcagcucugcgau

SEQ ID NO: 3415057 - RNA, 18 nt, Pseudomonas aeruginosa PA01
cuucacguccagcuguac

SEQ ID NO: 3415058 - RNA, 23 nt, Pseudomonas aeruginosa PA01
cuucacucauccucgccgcuggc

SEQ ID NO: 3415059 - RNA, 22 nt, Pseudomonas aeruginosa PA01
cuucagagcagggugaagcugc

SEQ ID NO: 3415060 - RNA, 23 nt, Pseudomonas aeruginosa PA01
cuucagagcagggugaagcugcg

SEQ ID NO: 3415061 - RNA, 13 nt, Pseudomonas aeruginosa PA01
cuucagagcugga

SEQ ID NO: 3415062 - RNA, 14 nt, Pseudomonas aeruginosa PA01
cuucagagcuggac

SEQ ID NO: 3415063 - RNA, 16 nt, Pseudomonas aeruginosa PA01
cuucagagcuggacga

SEQ ID NO: 3415064 - RNA, 19 nt, Pseudomonas aeruginosa PA01
cuucagagcuggacgacgc

SEQ ID NO: 3415065 - RNA, 13 nt, Pseudomonas aeruginosa PA01
cuucagauaacgu

SEQ ID NO: 3415066 - RNA, 19 nt, Pseudomonas aeruginosa PA01
cuucagauacuccagcagc

SEQ ID NO: 3415067 - RNA, 16 nt, Pseudomonas aeruginosa PA01
cuucagcaacucuucc

SEQ ID NO: 3415068 - RNA, 20 nt, Pseudomonas aeruginosa PA01
cuucagcaacucuuccaggg

SEQ ID NO: 3415069 - RNA, 22 nt, Pseudomonas aeruginosa PA01
cuucagcacauagcugccgaau

SEQ ID NO: 3415070 - RNA, 18 nt, Pseudomonas aeruginosa PA01
cuucagcaccugcgccga

SEQ ID NO: 3415071 - RNA, 16 nt, Pseudomonas aeruginosa PA01
cuucagcagcaggcgc

SEQ ID NO: 3415072 - RNA, 14 nt, Pseudomonas aeruginosa PA01
cuucagcagcgggc

SEQ ID NO: 3415073 - RNA, 21 nt, Pseudomonas aeruginosa PA01
cuucagcaucaggucggcgcg

SEQ ID NO: 3415074 - RNA, 19 nt, Pseudomonas aeruginosa PA01
cuucagccagaccggcagc

SEQ ID NO: 3415075 - RNA, 22 nt, Pseudomonas aeruginosa PA01
cuucagccagaccggcagcgcc

SEQ ID NO: 3415076 - RNA, 23 nt, Pseudomonas aeruginosa PA01
cuucagccagaccggcagcgccg

SEQ ID NO: 3415077 - RNA, 19 nt, Pseudomonas aeruginosa PA01
cuucagccccagcacgccg

SEQ ID NO: 3415078 - RNA, 23 nt, Pseudomonas aeruginosa PA01
cuucagccccagcacgccgagca

SEQ ID NO: 3415079 - RNA, 19 nt, Pseudomonas aeruginosa PA01
cuucagcccggcaccaggc

SEQ ID NO: 3415080 - RNA, 21 nt, Pseudomonas aeruginosa PA01
cuucagccgaccguccgccug

SEQ ID NO: 3415081 - RNA, 14 nt, Pseudomonas aeruginosa PA01
cuucagcgagcggu

SEQ ID NO: 3415082 - RNA, 20 nt, Pseudomonas aeruginosa PA01
cuucagcgagcggucggcca

SEQ ID NO: 3415083 - RNA, 16 nt, Pseudomonas aeruginosa PA01
cuucagcgccagcagg

SEQ ID NO: 3415084 - RNA, 17 nt, Pseudomonas aeruginosa PA01
cuucagcgccagcaggc

SEQ ID NO: 3415085 - RNA, 19 nt, Pseudomonas aeruginosa PA01
cuucagcgccagcaggcga

SEQ ID NO: 3415086 - RNA, 19 nt, Pseudomonas aeruginosa PA01
cuucagcgccaggccgauc

SEQ ID NO: 3415087 - RNA, 21 nt, Pseudomonas aeruginosa PA01
cuucagcgccaggccgaucag

SEQ ID NO: 3415088 - RNA, 15 nt, Pseudomonas aeruginosa PA01
cuucagcgccgccag

SEQ ID NO: 3415089 - RNA, 15 nt, Pseudomonas aeruginosa PA01
cuucagcgccuccag

SEQ ID NO: 3415090 - RNA, 17 nt, Pseudomonas aeruginosa PA01
cuucagcgccuccagca

SEQ ID NO: 3415091 - RNA, 20 nt, Pseudomonas aeruginosa PA01
cuucagcgccuccagcaccg

SEQ ID NO: 3415092 - RNA, 16 nt, Pseudomonas aeruginosa PA01
cuucagcgcgccgagc

SEQ ID NO: 3415093 - RNA, 16 nt, Pseudomonas aeruginosa PA01
cuucagcuccagcagu

SEQ ID NO: 3415094 - RNA, 21 nt, Pseudomonas aeruginosa PA01
cuucagcuccgagccacggau

SEQ ID NO: 3415095 - RNA, 21 nt, Pseudomonas aeruginosa PA01
cuucaggagggaacgucuggc

SEQ ID NO: 3415096 - RNA, 23 nt, Pseudomonas aeruginosa PA01
cuucaggagggaacgucuggcca

SEQ ID NO: 3415097 - RNA, 12 nt, Pseudomonas aeruginosa PA01
cuucaggccgaa

SEQ ID NO: 3415098 - RNA, 20 nt, Pseudomonas aeruginosa PA01
cuucaggccgaguccgcgcg

SEQ ID NO: 3415099 - RNA, 13 nt, Pseudomonas aeruginosa PA01
cuucaggccggcg

SEQ ID NO: 3415100 - RNA, 14 nt, Pseudomonas aeruginosa PA01
cuucaggccggcgc

SEQ ID NO: 3415101 - RNA, 16 nt, Pseudomonas aeruginosa PA01
cuucaggccggcgccg

SEQ ID NO: 3415102 - RNA, 18 nt, Pseudomonas aeruginosa PA01
cuucaggccggcgccgau

SEQ ID NO: 3415103 - RNA, 16 nt, Pseudomonas aeruginosa PA01
cuucaggcgcgcggcc

SEQ ID NO: 3415104 - RNA, 16 nt, Pseudomonas aeruginosa PA01
cuucaggcgcuccugg

SEQ ID NO: 3415105 - RNA, 19 nt, Pseudomonas aeruginosa PA01
cuucaggcgcuccuugagc

SEQ ID NO: 3415106 - RNA, 12 nt, Pseudomonas aeruginosa PA01
cuucaggcgugg

SEQ ID NO: 3415107 - RNA, 17 nt, Pseudomonas aeruginosa PA01
cuucaggcgugggccag

SEQ ID NO: 3415108 - RNA, 22 nt, Pseudomonas aeruginosa PA01
cuucaggcgugggccagcccag

SEQ ID NO: 3415109 - RNA, 14 nt, Pseudomonas aeruginosa PA01
cuucaggcucggcc

SEQ ID NO: 3415110 - RNA, 17 nt, Pseudomonas aeruginosa PA01
cuucaggcucggccugu

SEQ ID NO: 3415111 - RNA, 17 nt, Pseudomonas aeruginosa PA01
cuucaggcugcgcgcau

SEQ ID NO: 3415112 - RNA, 20 nt, Pseudomonas aeruginosa PA01
cuucaggcugcgcgcaucga

SEQ ID NO: 3415113 - RNA, 23 nt, Pseudomonas aeruginosa PA01
cuucaggcugucggccaucgccg

SEQ ID NO: 3415114 - RNA, 21 nt, Pseudomonas aeruginosa PA01
cuucagggugacgucgaaacc

SEQ ID NO: 3415115 - RNA, 23 nt, Pseudomonas aeruginosa PA01
cuucaggguggcgcugccuucga

SEQ ID NO: 3415116 - RNA, 16 nt, Pseudomonas aeruginosa PA01
cuucagguaaggcacc

SEQ ID NO: 3415117 - RNA, 19 nt, Pseudomonas aeruginosa PA01
cuucagguaaggcaccacc

SEQ ID NO: 3415118 - RNA, 19 nt, Pseudomonas aeruginosa PA01
cuucaguucguugggccgg

SEQ ID NO: 3415119 - RNA, 12 nt, Pseudomonas aeruginosa PA01
cuucaucaccuu

SEQ ID NO: 3415120 - RNA, 14 nt, Pseudomonas aeruginosa PA01
cuucaucaccuugc

SEQ ID NO: 3415121 - RNA, 16 nt, Pseudomonas aeruginosa PA01
cuucaucaccuugccc

SEQ ID NO: 3415122 - RNA, 15 nt, Pseudomonas aeruginosa PA01
cuucaucaggcggca

SEQ ID NO: 3415123 - RNA, 23 nt, Pseudomonas aeruginosa PA01
cuucaucaggcggcacucggcga

SEQ ID NO: 3415124 - RNA, 21 nt, Pseudomonas aeruginosa PA01
cuucaucgaggugcuugacag

SEQ ID NO: 3415125 - RNA, 20 nt, Pseudomonas aeruginosa PA01
cuucaucuccugcuggacga

SEQ ID NO: 3415126 - RNA, 15 nt, Pseudomonas aeruginosa PA01
cuucaucuuggccca

SEQ ID NO: 3415127 - RNA, 22 nt, Pseudomonas aeruginosa PA01
cuucaugaacacauagaccagc

SEQ ID NO: 3415128 - RNA, 22 nt, Pseudomonas aeruginosa PA01
cuuccaaggguauugguaucca

SEQ ID NO: 3415129 - RNA, 15 nt, Pseudomonas aeruginosa PA01
cuuccaccaccaggg

SEQ ID NO: 3415130 - RNA, 14 nt, Pseudomonas aeruginosa PA01
cuuccaccgccugc

SEQ ID NO: 3415131 - RNA, 18 nt, Pseudomonas aeruginosa PA01
cuuccaccgccugcccca

SEQ ID NO: 3415132 - RNA, 15 nt, Pseudomonas aeruginosa PA01
cuuccaccggcuugc

SEQ ID NO: 3415133 - RNA, 16 nt, Pseudomonas aeruginosa PA01
cuuccaccggcuugcc

SEQ ID NO: 3415134 - RNA, 20 nt, Pseudomonas aeruginosa PA01
cuuccaccgggaagcagguc

SEQ ID NO: 3415135 - RNA, 14 nt, Pseudomonas aeruginosa PA01
cuuccaccguggcg

SEQ ID NO: 3415136 - RNA, 13 nt, Pseudomonas aeruginosa PA01
cuuccacgccuuc

SEQ ID NO: 3415137 - RNA, 17 nt, Pseudomonas aeruginosa PA01
cuuccacgccuucgcgg

SEQ ID NO: 3415138 - RNA, 22 nt, Pseudomonas aeruginosa PA01
cuuccacgccuucgcggccgag

SEQ ID NO: 3415139 - RNA, 14 nt, Pseudomonas aeruginosa PA01
cuuccacuccaggc

SEQ ID NO: 3415140 - RNA, 18 nt, Pseudomonas aeruginosa PA01
cuuccacucgccgaccag

SEQ ID NO: 3415141 - RNA, 17 nt, Pseudomonas aeruginosa PA01
cuuccacuugcgccggc

SEQ ID NO: 3415142 - RNA, 22 nt, Pseudomonas aeruginosa PA01
cuuccagaacgccgcgcaccuc

SEQ ID NO: 3415143 - RNA, 20 nt, Pseudomonas aeruginosa PA01
cuuccagaccucgagcaggc

SEQ ID NO: 3415144 - RNA, 15 nt, Pseudomonas aeruginosa PA01
cuuccagcaccuccc

SEQ ID NO: 3415145 - RNA, 21 nt, Pseudomonas aeruginosa PA01
cuuccagcaccucccccagcg

SEQ ID NO: 3415146 - RNA, 14 nt, Pseudomonas aeruginosa PA01
cuuccagcacgccg

SEQ ID NO: 3415147 - RNA, 15 nt, Pseudomonas aeruginosa PA01
cuuccagcacgccga

SEQ ID NO: 3415148 - RNA, 14 nt, Pseudomonas aeruginosa PA01
cuuccagcaugcuc

SEQ ID NO: 3415149 - RNA, 15 nt, Pseudomonas aeruginosa PA01
cuuccagccagcccu

SEQ ID NO: 3415150 - RNA, 16 nt, Pseudomonas aeruginosa PA01
cuuccagccagcccuc

SEQ ID NO: 3415151 - RNA, 11 nt, Pseudomonas aeruginosa PA01
cuuccagccgc

SEQ ID NO: 3415152 - RNA, 15 nt, Pseudomonas aeruginosa PA01
cuuccagccgcgcgc

SEQ ID NO: 3415153 - RNA, 15 nt, Pseudomonas aeruginosa PA01
cuuccagcggccacg

SEQ ID NO: 3415154 - RNA, 18 nt, Pseudomonas aeruginosa PA01
cuuccagcggccacggcg

SEQ ID NO: 3415155 - RNA, 14 nt, Pseudomonas aeruginosa PA01
cuuccagcgggcgg

SEQ ID NO: 3415156 - RNA, 22 nt, Pseudomonas aeruginosa PA01
cuuccagcgggcggaucagcuc

SEQ ID NO: 3415157 - RNA, 16 nt, Pseudomonas aeruginosa PA01
cuuccagcucucgcug

SEQ ID NO: 3415158 - RNA, 18 nt, Pseudomonas aeruginosa PA01
cuuccagcuugcgccaga

SEQ ID NO: 3415159 - RNA, 15 nt, Pseudomonas aeruginosa PA01
cuuccagcuugcgcu

SEQ ID NO: 3415160 - RNA, 15 nt, Pseudomonas aeruginosa PA01
cuuccagcuuggcac

SEQ ID NO: 3415161 - RNA, 18 nt, Pseudomonas aeruginosa PA01
cuuccagcuugguguaga

SEQ ID NO: 3415162 - RNA, 12 nt, Pseudomonas aeruginosa PA01
cuuccaggcacc

SEQ ID NO: 3415163 - RNA, 11 nt, Pseudomonas aeruginosa PA01
cuuccaggcgc

SEQ ID NO: 3415164 - RNA, 16 nt, Pseudomonas aeruginosa PA01
cuuccaggcgcaggcg

SEQ ID NO: 3415165 - RNA, 21 nt, Pseudomonas aeruginosa PA01
cuuccaggcuguagccggcga

SEQ ID NO: 3415166 - RNA, 23 nt, Pseudomonas aeruginosa PA01
cuuccaggcuguagccggcgaug

SEQ ID NO: 3415167 - RNA, 15 nt, Pseudomonas aeruginosa PA01
cuuccagggcggcgc

SEQ ID NO: 3415168 - RNA, 17 nt, Pseudomonas aeruginosa PA01
cuuccagggucggcacc

SEQ ID NO: 3415169 - RNA, 17 nt, Pseudomonas aeruginosa PA01
cuuccaggguuuccagc

SEQ ID NO: 3415170 - RNA, 19 nt, Pseudomonas aeruginosa PA01
cuuccaggguuuccagcag

SEQ ID NO: 3415171 - RNA, 16 nt, Pseudomonas aeruginosa PA01
cuuccagguacggccc

SEQ ID NO: 3415172 - RNA, 22 nt, Pseudomonas aeruginosa PA01
cuuccagguaguccagcuccuc

SEQ ID NO: 3415173 - RNA, 18 nt, Pseudomonas aeruginosa PA01
cuuccaguucguugcucu

SEQ ID NO: 3415174 - RNA, 13 nt, Pseudomonas aeruginosa PA01
cuuccaucaccgc

SEQ ID NO: 3415175 - RNA, 16 nt, Pseudomonas aeruginosa PA01
cuuccaucagcuccac

SEQ ID NO: 3415176 - RNA, 22 nt, Pseudomonas aeruginosa PA01
cuuccaucguggggcggcgcag

SEQ ID NO: 3415177 - RNA, 17 nt, Pseudomonas aeruginosa PA01
cuucccacuccagcgcg

SEQ ID NO: 3415178 - RNA, 20 nt, Pseudomonas aeruginosa PA01
cuucccagacguccagcgcc

SEQ ID NO: 3415179 - RNA, 13 nt, Pseudomonas aeruginosa PA01
cuucccagauacc

SEQ ID NO: 3415180 - RNA, 13 nt, Pseudomonas aeruginosa PA01
cuuccccccgcgu

SEQ ID NO: 3415181 - RNA, 20 nt, Pseudomonas aeruginosa PA01
cuuccccgccacuuccagca

SEQ ID NO: 3415182 - RNA, 18 nt, Pseudomonas aeruginosa PA01
cuuccccugcaugccggc

SEQ ID NO: 3415183 - RNA, 20 nt, Pseudomonas aeruginosa PA01
cuuccccugcaugccggccg

SEQ ID NO: 3415184 - RNA, 23 nt, Pseudomonas aeruginosa PA01
cuucccgcccaucaacgagccga

SEQ ID NO: 3415185 - RNA, 15 nt, Pseudomonas aeruginosa PA01
cuucccgcggcucca

SEQ ID NO: 3415186 - RNA, 16 nt, Pseudomonas aeruginosa PA01
cuucccgcggcuccag

SEQ ID NO: 3415187 - RNA, 21 nt, Pseudomonas aeruginosa PA01
cuucccgcggcuccagccgcu

SEQ ID NO: 3415188 - RNA, 15 nt, Pseudomonas aeruginosa PA01
cuucccugccggcgg

SEQ ID NO: 3415189 - RNA, 16 nt, Pseudomonas aeruginosa PA01
cuucccugccggcggu

SEQ ID NO: 3415190 - RNA, 15 nt, Pseudomonas aeruginosa PA01
cuuccgacgccgcgu

SEQ ID NO: 3415191 - RNA, 19 nt, Pseudomonas aeruginosa PA01
cuuccgacucuccgcgccg

SEQ ID NO: 3415192 - RNA, 16 nt, Pseudomonas aeruginosa PA01
cuuccgcaucggccga

SEQ ID NO: 3415193 - RNA, 23 nt, Pseudomonas aeruginosa PA01
cuuccgccagcaggcgcgggcug

SEQ ID NO: 3415194 - RNA, 20 nt, Pseudomonas aeruginosa PA01
cuuccgccgacugcaacugg

SEQ ID NO: 3415195 - RNA, 15 nt, Pseudomonas aeruginosa PA01
cuuccgccggcgccg

SEQ ID NO: 3415196 - RNA, 19 nt, Pseudomonas aeruginosa PA01
cuuccgccggcgccgccuc

SEQ ID NO: 3415197 - RNA, 16 nt, Pseudomonas aeruginosa PA01
cuuccgccucgcgccg

SEQ ID NO: 3415198 - RNA, 14 nt, Pseudomonas aeruginosa PA01
cuuccgcgcccagg

SEQ ID NO: 3415199 - RNA, 13 nt, Pseudomonas aeruginosa PA01
cuuccgcgcggcg

SEQ ID NO: 3415200 - RNA, 21 nt, Pseudomonas aeruginosa PA01
cuuccgcgcggcgcccugccg

SEQ ID NO: 3415201 - RNA, 16 nt, Pseudomonas aeruginosa PA01
cuuccgcgcugaccug

SEQ ID NO: 3415202 - RNA, 21 nt, Pseudomonas aeruginosa PA01
cuuccggacugcccagcgccg
